United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 83

SEQ ID NO: 2982918 - RNA, 16 nt, Mycobacterium avium subsp. paratuberculosis
cagcgcgucgcacagc

SEQ ID NO: 2982919 - RNA, 20 nt, Mycobacterium avium subsp. paratuberculosis
cagcgcgucgcgcccggcgu

SEQ ID NO: 2982920 - RNA, 21 nt, Mycobacterium avium subsp. paratuberculosis
cagcgcgucgcgcccggcguc

SEQ ID NO: 2982921 - RNA, 22 nt, Mycobacterium avium subsp. paratuberculosis
cagcgcgucgcgcccggcgucg

SEQ ID NO: 2982922 - RNA, 15 nt, Mycobacterium avium subsp. paratuberculosis
cagcgcgucgcgggc

SEQ ID NO: 2982923 - RNA, 17 nt, Mycobacterium avium subsp. paratuberculosis
cagcgcgucgcgggccc

SEQ ID NO: 2982924 - RNA, 22 nt, Mycobacterium avium subsp. paratuberculosis
cagcgcgucgcgggcccgggcc

SEQ ID NO: 2982925 - RNA, 14 nt, Mycobacterium avium subsp. paratuberculosis
cagcgcgucggcca

SEQ ID NO: 2982926 - RNA, 20 nt, Mycobacterium avium subsp. paratuberculosis
cagcgcgucggccagcacca

SEQ ID NO: 2982927 - RNA, 17 nt, Mycobacterium avium subsp. paratuberculosis
cagcgcgucggccagcg

SEQ ID NO: 2982928 - RNA, 19 nt, Mycobacterium avium subsp. paratuberculosis
cagcgcgucggccagcgcg

SEQ ID NO: 2982929 - RNA, 13 nt, Mycobacterium avium subsp. paratuberculosis
cagcgcgucggcg

SEQ ID NO: 2982930 - RNA, 20 nt, Mycobacterium avium subsp. paratuberculosis
cagcgcgucggcgaccgcgc

SEQ ID NO: 2982931 - RNA, 23 nt, Mycobacterium avium subsp. paratuberculosis
cagcgcgucggcgaccgcgcgcg

SEQ ID NO: 2982932 - RNA, 18 nt, Mycobacterium avium subsp. paratuberculosis
cagcgcgucggcgauguc

SEQ ID NO: 2982933 - RNA, 20 nt, Mycobacterium avium subsp. paratuberculosis
cagcgcgucgucgauggcca

SEQ ID NO: 2982934 - RNA, 23 nt, Mycobacterium avium subsp. paratuberculosis
cagcgcgucgucgauggccacca

SEQ ID NO: 2982935 - RNA, 23 nt, Mycobacterium avium subsp. paratuberculosis
cagcgcgucgugcaacucccgcg

SEQ ID NO: 2982936 - RNA, 19 nt, Mycobacterium avium subsp. paratuberculosis
cagcgcgugaccccggcga

SEQ ID NO: 2982937 - RNA, 22 nt, Mycobacterium avium subsp. paratuberculosis
cagcgcgugaccccggcgacca

SEQ ID NO: 2982938 - RNA, 14 nt, Mycobacterium avium subsp. paratuberculosis
cagcgcgugaucgg

SEQ ID NO: 2982939 - RNA, 18 nt, Mycobacterium avium subsp. paratuberculosis
cagcgcgugaucggugcc

SEQ ID NO: 2982940 - RNA, 21 nt, Mycobacterium avium subsp. paratuberculosis
cagcgcgugaugggugggcag

SEQ ID NO: 2982941 - RNA, 22 nt, Mycobacterium avium subsp. paratuberculosis
cagcgcgugaugggugggcagc

SEQ ID NO: 2982942 - RNA, 17 nt, Mycobacterium avium subsp. paratuberculosis
cagcgcguugaugacgg

SEQ ID NO: 2982943 - RNA, 18 nt, Mycobacterium avium subsp. paratuberculosis
cagcgcguugcggccguc

SEQ ID NO: 2982944 - RNA, 20 nt, Mycobacterium avium subsp. paratuberculosis
cagcgcguuggccagguugc

SEQ ID NO: 2982945 - RNA, 17 nt, Mycobacterium avium subsp. paratuberculosis
cagcgcuaaccgcgggc

SEQ ID NO: 2982946 - RNA, 15 nt, Mycobacterium avium subsp. paratuberculosis
cagcgcuacugccgc

SEQ ID NO: 2982947 - RNA, 17 nt, Mycobacterium avium subsp. paratuberculosis
cagcgcuacugccgcug

SEQ ID NO: 2982948 - RNA, 18 nt, Mycobacterium avium subsp. paratuberculosis
cagcgcuacugccgcugc

SEQ ID NO: 2982949 - RNA, 19 nt, Mycobacterium avium subsp. paratuberculosis
cagcgcuacugccgcugcu

SEQ ID NO: 2982950 - RNA, 22 nt, Mycobacterium avium subsp. paratuberculosis
cagcgcuccugcagcgcggcga

SEQ ID NO: 2982951 - RNA, 16 nt, Mycobacterium avium subsp. paratuberculosis
cagcgcuccuggccgg

SEQ ID NO: 2982952 - RNA, 17 nt, Mycobacterium avium subsp. paratuberculosis
cagcgcuccuggccgga

SEQ ID NO: 2982953 - RNA, 18 nt, Mycobacterium avium subsp. paratuberculosis
cagcgcuccuggccggac

SEQ ID NO: 2982954 - RNA, 16 nt, Mycobacterium avium subsp. paratuberculosis
cagcgcucgacgaggc

SEQ ID NO: 2982955 - RNA, 13 nt, Mycobacterium avium subsp. paratuberculosis
cagcgcuggccgg

SEQ ID NO: 2982956 - RNA, 16 nt, Mycobacterium avium subsp. paratuberculosis
cagcgcuggccggcca

SEQ ID NO: 2982957 - RNA, 20 nt, Mycobacterium avium subsp. paratuberculosis
cagcgcuggccggccaccag

SEQ ID NO: 2982958 - RNA, 22 nt, Mycobacterium avium subsp. paratuberculosis
cagcgcuggccggccaccagcg

SEQ ID NO: 2982959 - RNA, 19 nt, Mycobacterium avium subsp. paratuberculosis
cagcgcugucgcgggcccg

SEQ ID NO: 2982960 - RNA, 14 nt, Mycobacterium avium subsp. paratuberculosis
cagcgcuuccagcg

SEQ ID NO: 2982961 - RNA, 16 nt, Mycobacterium avium subsp. paratuberculosis
cagcgcuuccagcgcg

SEQ ID NO: 2982962 - RNA, 19 nt, Mycobacterium avium subsp. paratuberculosis
cagcgcuuucgcgcacgcc

SEQ ID NO: 2982963 - RNA, 21 nt, Mycobacterium avium subsp. paratuberculosis
cagcgcuuucgcgcacgccau

SEQ ID NO: 2982964 - RNA, 20 nt, Mycobacterium avium subsp. paratuberculosis
cagcggaaacgacgucgcca

SEQ ID NO: 2982965 - RNA, 14 nt, Mycobacterium avium subsp. paratuberculosis
cagcggaaccgaca

SEQ ID NO: 2982966 - RNA, 16 nt, Mycobacterium avium subsp. paratuberculosis
cagcggaaccgacacc

SEQ ID NO: 2982967 - RNA, 15 nt, Mycobacterium avium subsp. paratuberculosis
cagcggaaccggggg

SEQ ID NO: 2982968 - RNA, 22 nt, Mycobacterium avium subsp. paratuberculosis
cagcggaaccgggggccgucac

SEQ ID NO: 2982969 - RNA, 23 nt, Mycobacterium avium subsp. paratuberculosis
cagcggaaccgggggccgucaca

SEQ ID NO: 2982970 - RNA, 16 nt, Mycobacterium avium subsp. paratuberculosis
cagcggaaugaacgcg

SEQ ID NO: 2982971 - RNA, 19 nt, Mycobacterium avium subsp. paratuberculosis
cagcggacccggucggccg

SEQ ID NO: 2982972 - RNA, 24 nt, Mycobacterium avium subsp. paratuberculosis
cagcggacccggucggccgcgugc

SEQ ID NO: 2982973 - RNA, 21 nt, Mycobacterium avium subsp. paratuberculosis
cagcggagcguucuccacccg

SEQ ID NO: 2982974 - RNA, 17 nt, Mycobacterium avium subsp. paratuberculosis
cagcggagugaccgcca

SEQ ID NO: 2982975 - RNA, 20 nt, Mycobacterium avium subsp. paratuberculosis
cagcggauagaggcggcgca

SEQ ID NO: 2982976 - RNA, 13 nt, Mycobacterium avium subsp. paratuberculosis
cagcggaucggcc

SEQ ID NO: 2982977 - RNA, 19 nt, Mycobacterium avium subsp. paratuberculosis
cagcggaucggcggucccg

SEQ ID NO: 2982978 - RNA, 22 nt, Mycobacterium avium subsp. paratuberculosis
cagcggaugccggaggcgccgu

SEQ ID NO: 2982979 - RNA, 14 nt, Mycobacterium avium subsp. paratuberculosis
cagcggcaacacgc

SEQ ID NO: 2982980 - RNA, 17 nt, Mycobacterium avium subsp. paratuberculosis
cagcggcaacacgccgg

SEQ ID NO: 2982981 - RNA, 18 nt, Mycobacterium avium subsp. paratuberculosis
cagcggcaacacgccggc

SEQ ID NO: 2982982 - RNA, 19 nt, Mycobacterium avium subsp. paratuberculosis
cagcggcaacacgccggcg

SEQ ID NO: 2982983 - RNA, 20 nt, Mycobacterium avium subsp. paratuberculosis
cagcggcaacacgccggcgg

SEQ ID NO: 2982984 - RNA, 21 nt, Mycobacterium avium subsp. paratuberculosis
cagcggcaacacgccggcggc

SEQ ID NO: 2982985 - RNA, 23 nt, Mycobacterium avium subsp. paratuberculosis
cagcggcaacacgccggcggcca

SEQ ID NO: 2982986 - RNA, 18 nt, Mycobacterium avium subsp. paratuberculosis
cagcggcaacugggcggc

SEQ ID NO: 2982987 - RNA, 23 nt, Mycobacterium avium subsp. paratuberculosis
cagcggcaccagguaccggcggg

SEQ ID NO: 2982988 - RNA, 18 nt, Mycobacterium avium subsp. paratuberculosis
cagcggcacccgguccgg

SEQ ID NO: 2982989 - RNA, 14 nt, Mycobacterium avium subsp. paratuberculosis
cagcggcaccgcca

SEQ ID NO: 2982990 - RNA, 23 nt, Mycobacterium avium subsp. paratuberculosis
cagcggcaccgccaucggcaucg

SEQ ID NO: 2982991 - RNA, 14 nt, Mycobacterium avium subsp. paratuberculosis
cagcggcaccguca

SEQ ID NO: 2982992 - RNA, 20 nt, Mycobacterium avium subsp. paratuberculosis
cagcggcacgaucucgacca

SEQ ID NO: 2982993 - RNA, 13 nt, Mycobacterium avium subsp. paratuberculosis
cagcggcacgucg

SEQ ID NO: 2982994 - RNA, 17 nt, Mycobacterium avium subsp. paratuberculosis
cagcggcacgucgccgu

SEQ ID NO: 2982995 - RNA, 22 nt, Mycobacterium avium subsp. paratuberculosis
cagcggcagcagcaccagcgug

SEQ ID NO: 2982996 - RNA, 15 nt, Mycobacterium avium subsp. paratuberculosis
cagcggcagccacgg

SEQ ID NO: 2982997 - RNA, 17 nt, Mycobacterium avium subsp. paratuberculosis
cagcggcagccacggca

SEQ ID NO: 2982998 - RNA, 17 nt, Mycobacterium avium subsp. paratuberculosis
cagcggcagcgccagcg

SEQ ID NO: 2982999 - RNA, 15 nt, Mycobacterium avium subsp. paratuberculosis
cagcggcagcggcgu

SEQ ID NO: 2983000 - RNA, 16 nt, Mycobacterium avium subsp. paratuberculosis
cagcggcagcgucgcc

SEQ ID NO: 2983001 - RNA, 17 nt, Mycobacterium avium subsp. paratuberculosis
cagcggcaggucgucgu

SEQ ID NO: 2983002 - RNA, 13 nt, Mycobacterium avium subsp. paratuberculosis
cagcggcaggugg

SEQ ID NO: 2983003 - RNA, 19 nt, Mycobacterium avium subsp. paratuberculosis
cagcggcaguagcgcaccg

SEQ ID NO: 2983004 - RNA, 23 nt, Mycobacterium avium subsp. paratuberculosis
cagcggcaguagcgcaccgguca

SEQ ID NO: 2983005 - RNA, 19 nt, Mycobacterium avium subsp. paratuberculosis
cagcggcaucgaggaccgg

SEQ ID NO: 2983006 - RNA, 20 nt, Mycobacterium avium subsp. paratuberculosis
cagcggcaucgaggaccggc

SEQ ID NO: 2983007 - RNA, 22 nt, Mycobacterium avium subsp. paratuberculosis
cagcggcaucgaggaccggcgc

SEQ ID NO: 2983008 - RNA, 16 nt, Mycobacterium avium subsp. paratuberculosis
cagcggcaucgccgcc

SEQ ID NO: 2983009 - RNA, 17 nt, Mycobacterium avium subsp. paratuberculosis
cagcggcaucgccgcca

SEQ ID NO: 2983010 - RNA, 18 nt, Mycobacterium avium subsp. paratuberculosis
cagcggcaucgccgccaa

SEQ ID NO: 2983011 - RNA, 17 nt, Mycobacterium avium subsp. paratuberculosis
cagcggcauggcgauga

SEQ ID NO: 2983012 - RNA, 14 nt, Mycobacterium avium subsp. paratuberculosis
cagcggccacaccg

SEQ ID NO: 2983013 - RNA, 15 nt, Mycobacterium avium subsp. paratuberculosis
cagcggccacaccgg

SEQ ID NO: 2983014 - RNA, 21 nt, Mycobacterium avium subsp. paratuberculosis
cagcggccacaccggggccag

SEQ ID NO: 2983015 - RNA, 15 nt, Mycobacterium avium subsp. paratuberculosis
cagcggccagcccau

SEQ ID NO: 2983016 - RNA, 19 nt, Mycobacterium avium subsp. paratuberculosis
cagcggccagcccaucccg

SEQ ID NO: 2983017 - RNA, 21 nt, Mycobacterium avium subsp. paratuberculosis
cagcggccagcccgcggcagc

SEQ ID NO: 2983018 - RNA, 23 nt, Mycobacterium avium subsp. paratuberculosis
cagcggccagcccgcggcagcca

SEQ ID NO: 2983019 - RNA, 13 nt, Mycobacterium avium subsp. paratuberculosis
cagcggcccaccg

SEQ ID NO: 2983020 - RNA, 14 nt, Mycobacterium avium subsp. paratuberculosis
cagcggcccaccgc

SEQ ID NO: 2983021 - RNA, 16 nt, Mycobacterium avium subsp. paratuberculosis
cagcggcccaccgcga

SEQ ID NO: 2983022 - RNA, 14 nt, Mycobacterium avium subsp. paratuberculosis
cagcggccccacgu

SEQ ID NO: 2983023 - RNA, 19 nt, Mycobacterium avium subsp. paratuberculosis
cagcggccccacguugauc

SEQ ID NO: 2983024 - RNA, 12 nt, Mycobacterium avium subsp. paratuberculosis
cagcggccccgg

SEQ ID NO: 2983025 - RNA, 13 nt, Mycobacterium avium subsp. paratuberculosis
cagcggccccggc

SEQ ID NO: 2983026 - RNA, 18 nt, Mycobacterium avium subsp. paratuberculosis
cagcggccccggcucggg

SEQ ID NO: 2983027 - RNA, 14 nt, Mycobacterium avium subsp. paratuberculosis
cagcggcccgauca

SEQ ID NO: 2983028 - RNA, 16 nt, Mycobacterium avium subsp. paratuberculosis
cagcggcccgaucacc

SEQ ID NO: 2983029 - RNA, 19 nt, Mycobacterium avium subsp. paratuberculosis
cagcggcccgaucaccagg

SEQ ID NO: 2983030 - RNA, 17 nt, Mycobacterium avium subsp. paratuberculosis
cagcggccggaacagcu

SEQ ID NO: 2983031 - RNA, 14 nt, Mycobacterium avium subsp. paratuberculosis
cagcggccggcgca

SEQ ID NO: 2983032 - RNA, 15 nt, Mycobacterium avium subsp. paratuberculosis
cagcggccggcgcag

SEQ ID NO: 2983033 - RNA, 22 nt, Mycobacterium avium subsp. paratuberculosis
cagcggccggcgcagccggcca

SEQ ID NO: 2983034 - RNA, 23 nt, Mycobacterium avium subsp. paratuberculosis
cagcggccggcgcagccggccac

SEQ ID NO: 2983035 - RNA, 12 nt, Mycobacterium avium subsp. paratuberculosis
cagcggccgggc

SEQ ID NO: 2983036 - RNA, 13 nt, Mycobacterium avium subsp. paratuberculosis
cagcggccgggcg

SEQ ID NO: 2983037 - RNA, 17 nt, Mycobacterium avium subsp. paratuberculosis
cagcggccgggcgaucu

SEQ ID NO: 2983038 - RNA, 23 nt, Mycobacterium avium subsp. paratuberculosis
cagcggccgggcgaucucuucga

SEQ ID NO: 2983039 - RNA, 14 nt, Mycobacterium avium subsp. paratuberculosis
cagcggccgucgcc

SEQ ID NO: 2983040 - RNA, 23 nt, Mycobacterium avium subsp. paratuberculosis
cagcggccgucgccgggcggggu

SEQ ID NO: 2983041 - RNA, 15 nt, Mycobacterium avium subsp. paratuberculosis
cagcggccgucgcgc

SEQ ID NO: 2983042 - RNA, 20 nt, Mycobacterium avium subsp. paratuberculosis
cagcggccuaugcgcccggg

SEQ ID NO: 2983043 - RNA, 15 nt, Mycobacterium avium subsp. paratuberculosis
cagcggcgacagcgg

SEQ ID NO: 2983044 - RNA, 14 nt, Mycobacterium avium subsp. paratuberculosis
cagcggcgaugccc

SEQ ID NO: 2983045 - RNA, 14 nt, Mycobacterium avium subsp. paratuberculosis
cagcggcgcaccgu

SEQ ID NO: 2983046 - RNA, 15 nt, Mycobacterium avium subsp. paratuberculosis
cagcggcgcaccgug

SEQ ID NO: 2983047 - RNA, 14 nt, Mycobacterium avium subsp. paratuberculosis
cagcggcgccaccg

SEQ ID NO: 2983048 - RNA, 17 nt, Mycobacterium avium subsp. paratuberculosis
cagcggcgccaccggga

SEQ ID NO: 2983049 - RNA, 18 nt, Mycobacterium avium subsp. paratuberculosis
cagcggcgccaccgggac

SEQ ID NO: 2983050 - RNA, 13 nt, Mycobacterium avium subsp. paratuberculosis
cagcggcgccagg

SEQ ID NO: 2983051 - RNA, 14 nt, Mycobacterium avium subsp. paratuberculosis
cagcggcgccaggu

SEQ ID NO: 2983052 - RNA, 19 nt, Mycobacterium avium subsp. paratuberculosis
cagcggcgccaggucgggg

SEQ ID NO: 2983053 - RNA, 22 nt, Mycobacterium avium subsp. paratuberculosis
cagcggcgcccacggccaccac

SEQ ID NO: 2983054 - RNA, 13 nt, Mycobacterium avium subsp. paratuberculosis
cagcggcgccgaa

SEQ ID NO: 2983055 - RNA, 13 nt, Mycobacterium avium subsp. paratuberculosis
cagcggcgccgca

SEQ ID NO: 2983056 - RNA, 15 nt, Mycobacterium avium subsp. paratuberculosis
cagcggcgccgcagc

SEQ ID NO: 2983057 - RNA, 19 nt, Mycobacterium avium subsp. paratuberculosis
cagcggcgccgcagcucgu

SEQ ID NO: 2983058 - RNA, 16 nt, Mycobacterium avium subsp. paratuberculosis
cagcggcgcgccgggc

SEQ ID NO: 2983059 - RNA, 17 nt, Mycobacterium avium subsp. paratuberculosis
cagcggcgcgccgggca

SEQ ID NO: 2983060 - RNA, 15 nt, Mycobacterium avium subsp. paratuberculosis
cagcggcgcgcgccg

SEQ ID NO: 2983061 - RNA, 20 nt, Mycobacterium avium subsp. paratuberculosis
cagcggcgcgcgccgcagcg

SEQ ID NO: 2983062 - RNA, 14 nt, Mycobacterium avium subsp. paratuberculosis
cagcggcgcggccg

SEQ ID NO: 2983063 - RNA, 15 nt, Mycobacterium avium subsp. paratuberculosis
cagcggcgcgguuuc

SEQ ID NO: 2983064 - RNA, 22 nt, Mycobacterium avium subsp. paratuberculosis
cagcggcgcgguuucggcgucg

SEQ ID NO: 2983065 - RNA, 20 nt, Mycobacterium avium subsp. paratuberculosis
cagcggcggaugggugcggu

SEQ ID NO: 2983066 - RNA, 13 nt, Mycobacterium avium subsp. paratuberculosis
cagcggcggcacg

SEQ ID NO: 2983067 - RNA, 14 nt, Mycobacterium avium subsp. paratuberculosis
cagcggcggcacgg

SEQ ID NO: 2983068 - RNA, 11 nt, Mycobacterium avium subsp. paratuberculosis
cagcggcggcc

SEQ ID NO: 2983069 - RNA, 12 nt, Mycobacterium avium subsp. paratuberculosis
cagcggcggcca

SEQ ID NO: 2983070 - RNA, 15 nt, Mycobacterium avium subsp. paratuberculosis
cagcggcggccauuc

SEQ ID NO: 2983071 - RNA, 12 nt, Mycobacterium avium subsp. paratuberculosis
cagcggcggccc

SEQ ID NO: 2983072 - RNA, 13 nt, Mycobacterium avium subsp. paratuberculosis
cagcggcgggccc

SEQ ID NO: 2983073 - RNA, 15 nt, Mycobacterium avium subsp. paratuberculosis
cagcggcgggcccag

SEQ ID NO: 2983074 - RNA, 17 nt, Mycobacterium avium subsp. paratuberculosis
cagcggcgggcccagca

SEQ ID NO: 2983075 - RNA, 13 nt, Mycobacterium avium subsp. paratuberculosis
cagcggcgucacg

SEQ ID NO: 2983076 - RNA, 20 nt, Mycobacterium avium subsp. paratuberculosis
cagcggcgucgucgucgaga

SEQ ID NO: 2983077 - RNA, 20 nt, Mycobacterium avium subsp. paratuberculosis
cagcggcgugcugcgcagca

SEQ ID NO: 2983078 - RNA, 23 nt, Mycobacterium avium subsp. paratuberculosis
cagcggcgugcugcgcagcagcg

SEQ ID NO: 2983079 - RNA, 15 nt, Mycobacterium avium subsp. paratuberculosis
cagcggcuccgagcg

SEQ ID NO: 2983080 - RNA, 16 nt, Mycobacterium avium subsp. paratuberculosis
cagcggcuccgagcgg

SEQ ID NO: 2983081 - RNA, 22 nt, Mycobacterium avium subsp. paratuberculosis
cagcggcuccgagcggaugccg

SEQ ID NO: 2983082 - RNA, 18 nt, Mycobacterium avium subsp. paratuberculosis
cagcggcucgcgggugcg

SEQ ID NO: 2983083 - RNA, 22 nt, Mycobacterium avium subsp. paratuberculosis
cagcggcucgcgggugcggcgc

SEQ ID NO: 2983084 - RNA, 12 nt, Mycobacterium avium subsp. paratuberculosis
cagcggcucggc

SEQ ID NO: 2983085 - RNA, 13 nt, Mycobacterium avium subsp. paratuberculosis
cagcggcucggcc

SEQ ID NO: 2983086 - RNA, 23 nt, Mycobacterium avium subsp. paratuberculosis
cagcggcucggccuucggggugg

SEQ ID NO: 2983087 - RNA, 14 nt, Mycobacterium avium subsp. paratuberculosis
cagcggcucggugu

SEQ ID NO: 2983088 - RNA, 14 nt, Mycobacterium avium subsp. paratuberculosis
cagcggcugcagca

SEQ ID NO: 2983089 - RNA, 22 nt, Mycobacterium avium subsp. paratuberculosis
cagcggcugcugcagcgcccgg

SEQ ID NO: 2983090 - RNA, 18 nt, Mycobacterium avium subsp. paratuberculosis
cagcggcuugaccggcuc

SEQ ID NO: 2983091 - RNA, 18 nt, Mycobacterium avium subsp. paratuberculosis
cagcggcuugagccggau

SEQ ID NO: 2983092 - RNA, 17 nt, Mycobacterium avium subsp. paratuberculosis
cagcggcuugagcgcca

SEQ ID NO: 2983093 - RNA, 20 nt, Mycobacterium avium subsp. paratuberculosis
cagcggcuugagcgccagcg

SEQ ID NO: 2983094 - RNA, 14 nt, Mycobacterium avium subsp. paratuberculosis
cagcggcuuggccg

SEQ ID NO: 2983095 - RNA, 17 nt, Mycobacterium avium subsp. paratuberculosis
cagcggcuuggccgugc

SEQ ID NO: 2983096 - RNA, 19 nt, Mycobacterium avium subsp. paratuberculosis
cagcggcuuggucaccagc

SEQ ID NO: 2983097 - RNA, 19 nt, Mycobacterium avium subsp. paratuberculosis
cagcgggaacaccacgucg

SEQ ID NO: 2983098 - RNA, 20 nt, Mycobacterium avium subsp. paratuberculosis
cagcgggaacaccacgucgu

SEQ ID NO: 2983099 - RNA, 21 nt, Mycobacterium avium subsp. paratuberculosis
cagcgggaacaccacgucguc

SEQ ID NO: 2983100 - RNA, 12 nt, Mycobacterium avium subsp. paratuberculosis
cagcgggacagc

SEQ ID NO: 2983101 - RNA, 19 nt, Mycobacterium avium subsp. paratuberculosis
cagcgggacagcaccacca

SEQ ID NO: 2983102 - RNA, 20 nt, Mycobacterium avium subsp. paratuberculosis
cagcgggacagcaccaccag

SEQ ID NO: 2983103 - RNA, 17 nt, Mycobacterium avium subsp. paratuberculosis
cagcgggacgaucugcg

SEQ ID NO: 2983104 - RNA, 23 nt, Mycobacterium avium subsp. paratuberculosis
cagcgggauacccaugaucgcca

SEQ ID NO: 2983105 - RNA, 21 nt, Mycobacterium avium subsp. paratuberculosis
cagcgggaucagcuccucgcg

SEQ ID NO: 2983106 - RNA, 19 nt, Mycobacterium avium subsp. paratuberculosis
cagcgggaugaaggcaccc

SEQ ID NO: 2983107 - RNA, 20 nt, Mycobacterium avium subsp. paratuberculosis
cagcgggaugaaggcaccca

SEQ ID NO: 2983108 - RNA, 19 nt, Mycobacterium avium subsp. paratuberculosis
cagcgggauguagccgguc

SEQ ID NO: 2983109 - RNA, 17 nt, Mycobacterium avium subsp. paratuberculosis
cagcgggauuggcgcca

SEQ ID NO: 2983110 - RNA, 18 nt, Mycobacterium avium subsp. paratuberculosis
cagcgggauuggcgccac

SEQ ID NO: 2983111 - RNA, 20 nt, Mycobacterium avium subsp. paratuberculosis
cagcgggauuggcgccacug

SEQ ID NO: 2983112 - RNA, 11 nt, Mycobacterium avium subsp. paratuberculosis
cagcgggcaga

SEQ ID NO: 2983113 - RNA, 19 nt, Mycobacterium avium subsp. paratuberculosis
cagcgggcagagcugcuga

SEQ ID NO: 2983114 - RNA, 17 nt, Mycobacterium avium subsp. paratuberculosis
cagcgggcccgggcugc

SEQ ID NO: 2983115 - RNA, 14 nt, Mycobacterium avium subsp. paratuberculosis
cagcgggccgaaga

SEQ ID NO: 2983116 - RNA, 21 nt, Mycobacterium avium subsp. paratuberculosis
cagcgggccgaagaccgggcc

SEQ ID NO: 2983117 - RNA, 14 nt, Mycobacterium avium subsp. paratuberculosis
cagcgggccgaccc

SEQ ID NO: 2983118 - RNA, 17 nt, Mycobacterium avium subsp. paratuberculosis
cagcgggccgacccggc

SEQ ID NO: 2983119 - RNA, 18 nt, Mycobacterium avium subsp. paratuberculosis
cagcgggccgacccggcc

SEQ ID NO: 2983120 - RNA, 20 nt, Mycobacterium avium subsp. paratuberculosis
cagcgggccgaccuggcggc

SEQ ID NO: 2983121 - RNA, 23 nt, Mycobacterium avium subsp. paratuberculosis
cagcgggccgagcguucggcgcg

SEQ ID NO: 2983122 - RNA, 12 nt, Mycobacterium avium subsp. paratuberculosis
cagcgggccggc

SEQ ID NO: 2983123 - RNA, 14 nt, Mycobacterium avium subsp. paratuberculosis
cagcgggccggcgu

SEQ ID NO: 2983124 - RNA, 16 nt, Mycobacterium avium subsp. paratuberculosis
cagcgggccggcgucg

SEQ ID NO: 2983125 - RNA, 15 nt, Mycobacterium avium subsp. paratuberculosis
cagcgggccgugccg

SEQ ID NO: 2983126 - RNA, 18 nt, Mycobacterium avium subsp. paratuberculosis
cagcgggccgugccgcca

SEQ ID NO: 2983127 - RNA, 13 nt, Mycobacterium avium subsp. paratuberculosis
cagcgggcgcagc

SEQ ID NO: 2983128 - RNA, 20 nt, Mycobacterium avium subsp. paratuberculosis
cagcgggcgcagcucgucgu

SEQ ID NO: 2983129 - RNA, 18 nt, Mycobacterium avium subsp. paratuberculosis
cagcgggcggccagccgc

SEQ ID NO: 2983130 - RNA, 14 nt, Mycobacterium avium subsp. paratuberculosis
cagcgggcggcccc

SEQ ID NO: 2983131 - RNA, 15 nt, Mycobacterium avium subsp. paratuberculosis
cagcgggcggccccg

SEQ ID NO: 2983132 - RNA, 13 nt, Mycobacterium avium subsp. paratuberculosis
cagcgggcggcgg

SEQ ID NO: 2983133 - RNA, 14 nt, Mycobacterium avium subsp. paratuberculosis
cagcgggcuggcgu

SEQ ID NO: 2983134 - RNA, 16 nt, Mycobacterium avium subsp. paratuberculosis
cagcgggcuguccgcg

SEQ ID NO: 2983135 - RNA, 16 nt, Mycobacterium avium subsp. paratuberculosis
cagcgggcugucggcg

SEQ ID NO: 2983136 - RNA, 19 nt, Mycobacterium avium subsp. paratuberculosis
cagcgggcugucggcgccc

SEQ ID NO: 2983137 - RNA, 17 nt, Mycobacterium avium subsp. paratuberculosis
cagcgggcugugccggc

SEQ ID NO: 2983138 - RNA, 13 nt, Mycobacterium avium subsp. paratuberculosis
cagcggggaggcc

SEQ ID NO: 2983139 - RNA, 14 nt, Mycobacterium avium subsp. paratuberculosis
cagcggggcaagca

SEQ ID NO: 2983140 - RNA, 20 nt, Mycobacterium avium subsp. paratuberculosis
cagcggggcaagcagcggca

SEQ ID NO: 2983141 - RNA, 20 nt, Mycobacterium avium subsp. paratuberculosis
cagcggggcgagcuggccgc

SEQ ID NO: 2983142 - RNA, 22 nt, Mycobacterium avium subsp. paratuberculosis
cagcggggcgagcuggccgccc

SEQ ID NO: 2983143 - RNA, 13 nt, Mycobacterium avium subsp. paratuberculosis
cagcggggcgcgc

SEQ ID NO: 2983144 - RNA, 14 nt, Mycobacterium avium subsp. paratuberculosis
cagcggggcgcgca

SEQ ID NO: 2983145 - RNA, 14 nt, Mycobacterium avium subsp. paratuberculosis
cagcggggcgucca

SEQ ID NO: 2983146 - RNA, 22 nt, Mycobacterium avium subsp. paratuberculosis
cagcggggcguccagcgagggg

SEQ ID NO: 2983147 - RNA, 16 nt, Mycobacterium avium subsp. paratuberculosis
cagcggggucgggauc

SEQ ID NO: 2983148 - RNA, 19 nt, Mycobacterium avium subsp. paratuberculosis
cagcggggugagcaccgcg

SEQ ID NO: 2983149 - RNA, 20 nt, Mycobacterium avium subsp. paratuberculosis
cagcggggugagcaccgcga

SEQ ID NO: 2983150 - RNA, 23 nt, Mycobacterium avium subsp. paratuberculosis
cagcggggugcccaccaccugcu

SEQ ID NO: 2983151 - RNA, 23 nt, Mycobacterium avium subsp. paratuberculosis
cagcggggugugcucggcggcgc

SEQ ID NO: 2983152 - RNA, 24 nt, Mycobacterium avium subsp. paratuberculosis
cagcggggugugcucggcggcgca

SEQ ID NO: 2983153 - RNA, 18 nt, Mycobacterium avium subsp. paratuberculosis
cagcggguccagccgccg

SEQ ID NO: 2983154 - RNA, 20 nt, Mycobacterium avium subsp. paratuberculosis
cagcggguccagccgccggc

SEQ ID NO: 2983155 - RNA, 22 nt, Mycobacterium avium subsp. paratuberculosis
cagcgggucgauggcgacgggg

SEQ ID NO: 2983156 - RNA, 19 nt, Mycobacterium avium subsp. paratuberculosis
cagcgggucgucgggccgg

SEQ ID NO: 2983157 - RNA, 21 nt, Mycobacterium avium subsp. paratuberculosis
cagcgggucguuggcggcggu

SEQ ID NO: 2983158 - RNA, 23 nt, Mycobacterium avium subsp. paratuberculosis
cagcgggucguuggcggcggugg

SEQ ID NO: 2983159 - RNA, 18 nt, Mycobacterium avium subsp. paratuberculosis
cagcggguugccgcuggc

SEQ ID NO: 2983160 - RNA, 13 nt, Mycobacterium avium subsp. paratuberculosis
cagcggguugcgg

SEQ ID NO: 2983161 - RNA, 19 nt, Mycobacterium avium subsp. paratuberculosis
cagcggguugucgucgucg

SEQ ID NO: 2983162 - RNA, 21 nt, Mycobacterium avium subsp. paratuberculosis
cagcggguuguucuccagcgg

SEQ ID NO: 2983163 - RNA, 22 nt, Mycobacterium avium subsp. paratuberculosis
cagcggguuguucuccagcggc

SEQ ID NO: 2983164 - RNA, 17 nt, Mycobacterium avium subsp. paratuberculosis
cagcggguuuggccgcg

SEQ ID NO: 2983165 - RNA, 18 nt, Mycobacterium avium subsp. paratuberculosis
cagcggguuuggccgcgg

SEQ ID NO: 2983166 - RNA, 16 nt, Mycobacterium avium subsp. paratuberculosis
cagcgguaaccacccg

SEQ ID NO: 2983167 - RNA, 19 nt, Mycobacterium avium subsp. paratuberculosis
cagcgguaaccacccgugg

SEQ ID NO: 2983168 - RNA, 17 nt, Mycobacterium avium subsp. paratuberculosis
cagcgguaucccguugg

SEQ ID NO: 2983169 - RNA, 17 nt, Mycobacterium avium subsp. paratuberculosis
cagcggucacggacagg

SEQ ID NO: 2983170 - RNA, 19 nt, Mycobacterium avium subsp. paratuberculosis
cagcggucauugaugcccc

SEQ ID NO: 2983171 - RNA, 22 nt, Mycobacterium avium subsp. paratuberculosis
cagcggucauugaugccccggg

SEQ ID NO: 2983172 - RNA, 16 nt, Mycobacterium avium subsp. paratuberculosis
cagcgguccagcguga

SEQ ID NO: 2983173 - RNA, 12 nt, Mycobacterium avium subsp. paratuberculosis
cagcggucggcg

SEQ ID NO: 2983174 - RNA, 16 nt, Mycobacterium avium subsp. paratuberculosis
cagcggucggcgguuc

SEQ ID NO: 2983175 - RNA, 14 nt, Mycobacterium avium subsp. paratuberculosis
cagcggucgggugc

SEQ ID NO: 2983176 - RNA, 14 nt, Mycobacterium avium subsp. paratuberculosis
cagcggugaucgcg

SEQ ID NO: 2983177 - RNA, 15 nt, Mycobacterium avium subsp. paratuberculosis
cagcggugcagcccc

SEQ ID NO: 2983178 - RNA, 17 nt, Mycobacterium avium subsp. paratuberculosis
cagcggugccgcccgga

SEQ ID NO: 2983179 - RNA, 13 nt, Mycobacterium avium subsp. paratuberculosis
cagcggugucacc

SEQ ID NO: 2983180 - RNA, 15 nt, Mycobacterium avium subsp. paratuberculosis
cagcggugucaccga

SEQ ID NO: 2983181 - RNA, 20 nt, Mycobacterium avium subsp. paratuberculosis
cagcggugucaccgacgcca

SEQ ID NO: 2983182 - RNA, 16 nt, Mycobacterium avium subsp. paratuberculosis
cagcgguucggcgacg

SEQ ID NO: 2983183 - RNA, 20 nt, Mycobacterium avium subsp. paratuberculosis
cagcguagaacauccacggc

SEQ ID NO: 2983184 - RNA, 16 nt, Mycobacterium avium subsp. paratuberculosis
cagcgucaacucgucg

SEQ ID NO: 2983185 - RNA, 14 nt, Mycobacterium avium subsp. paratuberculosis
cagcgucaccaaug

SEQ ID NO: 2983186 - RNA, 21 nt, Mycobacterium avium subsp. paratuberculosis
cagcgucaccaaugcgccggc

SEQ ID NO: 2983187 - RNA, 23 nt, Mycobacterium avium subsp. paratuberculosis
cagcgucaccaaugcgccggcgg

SEQ ID NO: 2983188 - RNA, 16 nt, Mycobacterium avium subsp. paratuberculosis
cagcgucacgucgacg

SEQ ID NO: 2983189 - RNA, 22 nt, Mycobacterium avium subsp. paratuberculosis
cagcgucacgucgacggccgcc

SEQ ID NO: 2983190 - RNA, 23 nt, Mycobacterium avium subsp. paratuberculosis
cagcgucacgucgacggccgccg

SEQ ID NO: 2983191 - RNA, 14 nt, Mycobacterium avium subsp. paratuberculosis
cagcgucagcaucg

SEQ ID NO: 2983192 - RNA, 19 nt, Mycobacterium avium subsp. paratuberculosis
cagcgucagccccgagucc

SEQ ID NO: 2983193 - RNA, 14 nt, Mycobacterium avium subsp. paratuberculosis
cagcgucaggucac

SEQ ID NO: 2983194 - RNA, 19 nt, Mycobacterium avium subsp. paratuberculosis
cagcgucaggucaccgagc

SEQ ID NO: 2983195 - RNA, 21 nt, Mycobacterium avium subsp. paratuberculosis
cagcgucaggucaccgagcgg

SEQ ID NO: 2983196 - RNA, 18 nt, Mycobacterium avium subsp. paratuberculosis
cagcgucaucacgugcug

SEQ ID NO: 2983197 - RNA, 19 nt, Mycobacterium avium subsp. paratuberculosis
cagcgucaucacgugcugg

SEQ ID NO: 2983198 - RNA, 18 nt, Mycobacterium avium subsp. paratuberculosis
cagcguccaguccggcgu

SEQ ID NO: 2983199 - RNA, 12 nt, Mycobacterium avium subsp. paratuberculosis
cagcgucccguc

SEQ ID NO: 2983200 - RNA, 18 nt, Mycobacterium avium subsp. paratuberculosis
cagcgucccguccugggc

SEQ ID NO: 2983201 - RNA, 23 nt, Mycobacterium avium subsp. paratuberculosis
cagcgucccguccugggccuggc

SEQ ID NO: 2983202 - RNA, 18 nt, Mycobacterium avium subsp. paratuberculosis
cagcgucccgucggccag

SEQ ID NO: 2983203 - RNA, 14 nt, Mycobacterium avium subsp. paratuberculosis
cagcguccgggcgu

SEQ ID NO: 2983204 - RNA, 13 nt, Mycobacterium avium subsp. paratuberculosis
cagcgucgacgcg

SEQ ID NO: 2983205 - RNA, 17 nt, Mycobacterium avium subsp. paratuberculosis
cagcgucgacugcaccg

SEQ ID NO: 2983206 - RNA, 21 nt, Mycobacterium avium subsp. paratuberculosis
cagcgucgacugcaccgacuc

SEQ ID NO: 2983207 - RNA, 16 nt, Mycobacterium avium subsp. paratuberculosis
cagcgucgaugugggc

SEQ ID NO: 2983208 - RNA, 20 nt, Mycobacterium avium subsp. paratuberculosis
cagcgucgccaauccggcgg

SEQ ID NO: 2983209 - RNA, 19 nt, Mycobacterium avium subsp. paratuberculosis
cagcgucgccagccgccgg

SEQ ID NO: 2983210 - RNA, 21 nt, Mycobacterium avium subsp. paratuberculosis
cagcgucgccagccgccggcu

SEQ ID NO: 2983211 - RNA, 14 nt, Mycobacterium avium subsp. paratuberculosis
cagcgucgccgacg

SEQ ID NO: 2983212 - RNA, 18 nt, Mycobacterium avium subsp. paratuberculosis
cagcgucgccgacgggcc

SEQ ID NO: 2983213 - RNA, 22 nt, Mycobacterium avium subsp. paratuberculosis
cagcgucgccgacgggcccagc

SEQ ID NO: 2983214 - RNA, 15 nt, Mycobacterium avium subsp. paratuberculosis
cagcgucgccgcccc

SEQ ID NO: 2983215 - RNA, 17 nt, Mycobacterium avium subsp. paratuberculosis
cagcgucgccgccccga

SEQ ID NO: 2983216 - RNA, 22 nt, Mycobacterium avium subsp. paratuberculosis
cagcgucgccgccccgaguucc

SEQ ID NO: 2983217 - RNA, 14 nt, Mycobacterium avium subsp. paratuberculosis
cagcgucgcgauca

SEQ ID NO: 2983218 - RNA, 15 nt, Mycobacterium avium subsp. paratuberculosis
cagcgucgcgccgcc

SEQ ID NO: 2983219 - RNA, 17 nt, Mycobacterium avium subsp. paratuberculosis
cagcgucgcgccgccac

SEQ ID NO: 2983220 - RNA, 22 nt, Mycobacterium avium subsp. paratuberculosis
cagcgucgcgccgccaccccag

SEQ ID NO: 2983221 - RNA, 14 nt, Mycobacterium avium subsp. paratuberculosis
cagcgucgcggccg

SEQ ID NO: 2983222 - RNA, 17 nt, Mycobacterium avium subsp. paratuberculosis
cagcgucgcggccggga

SEQ ID NO: 2983223 - RNA, 13 nt, Mycobacterium avium subsp. paratuberculosis
cagcgucggcgug

SEQ ID NO: 2983224 - RNA, 21 nt, Mycobacterium avium subsp. paratuberculosis
cagcgucggcgugcccgccga

SEQ ID NO: 2983225 - RNA, 17 nt, Mycobacterium avium subsp. paratuberculosis
cagcgucgggcucgccu

SEQ ID NO: 2983226 - RNA, 20 nt, Mycobacterium avium subsp. paratuberculosis
cagcgucguccaugcccgcc

SEQ ID NO: 2983227 - RNA, 23 nt, Mycobacterium avium subsp. paratuberculosis
cagcgucguccaugcccgcccac

SEQ ID NO: 2983228 - RNA, 15 nt, Mycobacterium avium subsp. paratuberculosis
cagcgucuccggcgg

SEQ ID NO: 2983229 - RNA, 17 nt, Mycobacterium avium subsp. paratuberculosis
cagcgucuccggcgggc

SEQ ID NO: 2983230 - RNA, 20 nt, Mycobacterium avium subsp. paratuberculosis
cagcgucuccggcgggcugg

SEQ ID NO: 2983231 - RNA, 21 nt, Mycobacterium avium subsp. paratuberculosis
cagcgucuccggcgggcuggu

SEQ ID NO: 2983232 - RNA, 23 nt, Mycobacterium avium subsp. paratuberculosis
cagcgucuccggcgggcuggugc

SEQ ID NO: 2983233 - RNA, 15 nt, Mycobacterium avium subsp. paratuberculosis
cagcgucucgaccgc

SEQ ID NO: 2983234 - RNA, 17 nt, Mycobacterium avium subsp. paratuberculosis
cagcgucucgaccgcgg

SEQ ID NO: 2983235 - RNA, 18 nt, Mycobacterium avium subsp. paratuberculosis
cagcgucucgaccgcggu

SEQ ID NO: 2983236 - RNA, 21 nt, Mycobacterium avium subsp. paratuberculosis
cagcgucucgaccgcgguggc

SEQ ID NO: 2983237 - RNA, 17 nt, Mycobacterium avium subsp. paratuberculosis
cagcgucucgacggcgc

SEQ ID NO: 2983238 - RNA, 19 nt, Mycobacterium avium subsp. paratuberculosis
cagcgucucgacggcgccg

SEQ ID NO: 2983239 - RNA, 20 nt, Mycobacterium avium subsp. paratuberculosis
cagcgucucgacggcgccga

SEQ ID NO: 2983240 - RNA, 17 nt, Mycobacterium avium subsp. paratuberculosis
cagcgucucgaucgacg

SEQ ID NO: 2983241 - RNA, 20 nt, Mycobacterium avium subsp. paratuberculosis
cagcgucucgaucgacgacg

SEQ ID NO: 2983242 - RNA, 16 nt, Mycobacterium avium subsp. paratuberculosis
cagcgucucgaugacc

SEQ ID NO: 2983243 - RNA, 19 nt, Mycobacterium avium subsp. paratuberculosis
cagcgucucgaugaccucg

SEQ ID NO: 2983244 - RNA, 15 nt, Mycobacterium avium subsp. paratuberculosis
cagcgucucgccggg

SEQ ID NO: 2983245 - RNA, 14 nt, Mycobacterium avium subsp. paratuberculosis
cagcgucucggcga

SEQ ID NO: 2983246 - RNA, 24 nt, Mycobacterium avium subsp. paratuberculosis
cagcgucucggcgaucagcugccc

SEQ ID NO: 2983247 - RNA, 17 nt, Mycobacterium avium subsp. paratuberculosis
cagcgucugcgccagcu

SEQ ID NO: 2983248 - RNA, 18 nt, Mycobacterium avium subsp. paratuberculosis
cagcgucugcgccagcug

SEQ ID NO: 2983249 - RNA, 22 nt, Mycobacterium avium subsp. paratuberculosis
cagcgucugcgccagcugggug

SEQ ID NO: 2983250 - RNA, 14 nt, Mycobacterium avium subsp. paratuberculosis
cagcgucugcgccc

SEQ ID NO: 2983251 - RNA, 15 nt, Mycobacterium avium subsp. paratuberculosis
cagcgucugcgcccc

SEQ ID NO: 2983252 - RNA, 16 nt, Mycobacterium avium subsp. paratuberculosis
cagcgucugcgccccg

SEQ ID NO: 2983253 - RNA, 17 nt, Mycobacterium avium subsp. paratuberculosis
cagcgucugcgccccgg

SEQ ID NO: 2983254 - RNA, 18 nt, Mycobacterium avium subsp. paratuberculosis
cagcgucugcgccccggc

SEQ ID NO: 2983255 - RNA, 19 nt, Mycobacterium avium subsp. paratuberculosis
cagcgucugcgccccggcg

SEQ ID NO: 2983256 - RNA, 20 nt, Mycobacterium avium subsp. paratuberculosis
cagcgucugcgccccggcgu

SEQ ID NO: 2983257 - RNA, 23 nt, Mycobacterium avium subsp. paratuberculosis
cagcgucugcgccccggcgucga

SEQ ID NO: 2983258 - RNA, 17 nt, Mycobacterium avium subsp. paratuberculosis
cagcgucuggcagccgg

SEQ ID NO: 2983259 - RNA, 20 nt, Mycobacterium avium subsp. paratuberculosis
cagcgucuggcagccggccg

SEQ ID NO: 2983260 - RNA, 21 nt, Mycobacterium avium subsp. paratuberculosis
cagcgucuucuucucgccguc

SEQ ID NO: 2983261 - RNA, 18 nt, Mycobacterium avium subsp. paratuberculosis
cagcgucuugacgaacuc

SEQ ID NO: 2983262 - RNA, 19 nt, Mycobacterium avium subsp. paratuberculosis
cagcgucuugcccagcggg

SEQ ID NO: 2983263 - RNA, 18 nt, Mycobacterium avium subsp. paratuberculosis
cagcgucuuggacgcccg

SEQ ID NO: 2983264 - RNA, 13 nt, Mycobacterium avium subsp. paratuberculosis
cagcgugaaacua

SEQ ID NO: 2983265 - RNA, 13 nt, Mycobacterium avium subsp. paratuberculosis
cagcgugaacacc

SEQ ID NO: 2983266 - RNA, 17 nt, Mycobacterium avium subsp. paratuberculosis
cagcgugaacaccgcgu

SEQ ID NO: 2983267 - RNA, 22 nt, Mycobacterium avium subsp. paratuberculosis
cagcgugacccugccgucaccg

SEQ ID NO: 2983268 - RNA, 15 nt, Mycobacterium avium subsp. paratuberculosis
cagcgugaccucgac

SEQ ID NO: 2983269 - RNA, 20 nt, Mycobacterium avium subsp. paratuberculosis
cagcgugaccucgacggugc

SEQ ID NO: 2983270 - RNA, 16 nt, Mycobacterium avium subsp. paratuberculosis
cagcgugacgcccggc

SEQ ID NO: 2983271 - RNA, 20 nt, Mycobacterium avium subsp. paratuberculosis
cagcgugacgcccggcgccg

SEQ ID NO: 2983272 - RNA, 22 nt, Mycobacterium avium subsp. paratuberculosis
cagcgugacgcccggcgccggc

SEQ ID NO: 2983273 - RNA, 18 nt, Mycobacterium avium subsp. paratuberculosis
cagcgugacgccgggccg

SEQ ID NO: 2983274 - RNA, 21 nt, Mycobacterium avium subsp. paratuberculosis
cagcgugacgccgggccgccg

SEQ ID NO: 2983275 - RNA, 14 nt, Mycobacterium avium subsp. paratuberculosis
cagcgugacgcucg

SEQ ID NO: 2983276 - RNA, 17 nt, Mycobacterium avium subsp. paratuberculosis
cagcgugacgcucgggc

SEQ ID NO: 2983277 - RNA, 20 nt, Mycobacterium avium subsp. paratuberculosis
cagcgugacgcucgggcuuc

SEQ ID NO: 2983278 - RNA, 16 nt, Mycobacterium avium subsp. paratuberculosis
cagcgugacgcugaag

SEQ ID NO: 2983279 - RNA, 19 nt, Mycobacterium avium subsp. paratuberculosis
cagcgugacgcugaagauc

SEQ ID NO: 2983280 - RNA, 22 nt, Mycobacterium avium subsp. paratuberculosis
cagcgugacgcugaagaucgaa

SEQ ID NO: 2983281 - RNA, 20 nt, Mycobacterium avium subsp. paratuberculosis
cagcgugcacacccgcagcg

SEQ ID NO: 2983282 - RNA, 21 nt, Mycobacterium avium subsp. paratuberculosis
cagcgugcacacccgcagcga

SEQ ID NO: 2983283 - RNA, 13 nt, Mycobacterium avium subsp. paratuberculosis
cagcgugcgcggc

SEQ ID NO: 2983284 - RNA, 17 nt, Mycobacterium avium subsp. paratuberculosis
cagcgugcgcggcuggc

SEQ ID NO: 2983285 - RNA, 21 nt, Mycobacterium avium subsp. paratuberculosis
cagcgugcugacgucgucgcc

SEQ ID NO: 2983286 - RNA, 13 nt, Mycobacterium avium subsp. paratuberculosis
cagcguggccagc

SEQ ID NO: 2983287 - RNA, 15 nt, Mycobacterium avium subsp. paratuberculosis
cagcguggccagcac

SEQ ID NO: 2983288 - RNA, 17 nt, Mycobacterium avium subsp. paratuberculosis
cagcguggccggcaggu

SEQ ID NO: 2983289 - RNA, 16 nt, Mycobacterium avium subsp. paratuberculosis
cagcguggcgcgcccc

SEQ ID NO: 2983290 - RNA, 19 nt, Mycobacterium avium subsp. paratuberculosis
cagcguggcgcgccccggc

SEQ ID NO: 2983291 - RNA, 20 nt, Mycobacterium avium subsp. paratuberculosis
cagcguggcgcgccccggcc

SEQ ID NO: 2983292 - RNA, 18 nt, Mycobacterium avium subsp. paratuberculosis
cagcguggcgucggcgcg

SEQ ID NO: 2983293 - RNA, 16 nt, Mycobacterium avium subsp. paratuberculosis
cagcgugggcaccggc

SEQ ID NO: 2983294 - RNA, 16 nt, Mycobacterium avium subsp. paratuberculosis
cagcguggucacccgc

SEQ ID NO: 2983295 - RNA, 13 nt, Mycobacterium avium subsp. paratuberculosis
cagcguggucagc

SEQ ID NO: 2983296 - RNA, 15 nt, Mycobacterium avium subsp. paratuberculosis
cagcguggucagcgu

SEQ ID NO: 2983297 - RNA, 17 nt, Mycobacterium avium subsp. paratuberculosis
cagcguggucagcgucu

SEQ ID NO: 2983298 - RNA, 23 nt, Mycobacterium avium subsp. paratuberculosis
cagcguggucagcgucucgccgg

SEQ ID NO: 2983299 - RNA, 14 nt, Mycobacterium avium subsp. paratuberculosis
cagcguggucgcgc

SEQ ID NO: 2983300 - RNA, 17 nt, Mycobacterium avium subsp. paratuberculosis
cagcguggucuccuggc

SEQ ID NO: 2983301 - RNA, 21 nt, Mycobacterium avium subsp. paratuberculosis
cagcguggucuccuggccgcc

SEQ ID NO: 2983302 - RNA, 23 nt, Mycobacterium avium subsp. paratuberculosis
cagcguggucuccuggccgccgu

SEQ ID NO: 2983303 - RNA, 24 nt, Mycobacterium avium subsp. paratuberculosis
cagcguggucuccuggccgccgug

SEQ ID NO: 2983304 - RNA, 17 nt, Mycobacterium avium subsp. paratuberculosis
cagcguggugcgcccgu

SEQ ID NO: 2983305 - RNA, 21 nt, Mycobacterium avium subsp. paratuberculosis
cagcguggugcgcccgucggu

SEQ ID NO: 2983306 - RNA, 17 nt, Mycobacterium avium subsp. paratuberculosis
cagcguguagacggugc

SEQ ID NO: 2983307 - RNA, 21 nt, Mycobacterium avium subsp. paratuberculosis
cagcguguagacggugcuggc

SEQ ID NO: 2983308 - RNA, 17 nt, Mycobacterium avium subsp. paratuberculosis
cagcgugucgccggggc

SEQ ID NO: 2983309 - RNA, 19 nt, Mycobacterium avium subsp. paratuberculosis
cagcgugucgccggggcgg

SEQ ID NO: 2983310 - RNA, 15 nt, Mycobacterium avium subsp. paratuberculosis
cagcgugucggcgau

SEQ ID NO: 2983311 - RNA, 16 nt, Mycobacterium avium subsp. paratuberculosis
cagcgugucggcgauc

SEQ ID NO: 2983312 - RNA, 18 nt, Mycobacterium avium subsp. paratuberculosis
cagcgugucggggucggc

SEQ ID NO: 2983313 - RNA, 20 nt, Mycobacterium avium subsp. paratuberculosis
cagcgugucggggucggcgc

SEQ ID NO: 2983314 - RNA, 23 nt, Mycobacterium avium subsp. paratuberculosis
cagcgugucggggucggcgccgc

SEQ ID NO: 2983315 - RNA, 15 nt, Mycobacterium avium subsp. paratuberculosis
cagcgugugcguggu

SEQ ID NO: 2983316 - RNA, 22 nt, Mycobacterium avium subsp. paratuberculosis
cagcguguugagcucgcggcgc

SEQ ID NO: 2983317 - RNA, 18 nt, Mycobacterium avium subsp. paratuberculosis
cagcguguuggacgcccg

SEQ ID NO: 2983318 - RNA, 20 nt, Mycobacterium avium subsp. paratuberculosis
cagcguguuggacgcccgcu

SEQ ID NO: 2983319 - RNA, 17 nt, Mycobacterium avium subsp. paratuberculosis
cagcguuauccaccagg

SEQ ID NO: 2983320 - RNA, 17 nt, Mycobacterium avium subsp. paratuberculosis
cagcguucacgucgauc

SEQ ID NO: 2983321 - RNA, 18 nt, Mycobacterium avium subsp. paratuberculosis
cagcguucacgucgauca

SEQ ID NO: 2983322 - RNA, 13 nt, Mycobacterium avium subsp. paratuberculosis
cagcguuccagca

SEQ ID NO: 2983323 - RNA, 19 nt, Mycobacterium avium subsp. paratuberculosis
cagcguuccagcacccggc

SEQ ID NO: 2983324 - RNA, 20 nt, Mycobacterium avium subsp. paratuberculosis
cagcguuccagcacccggcc

SEQ ID NO: 2983325 - RNA, 15 nt, Mycobacterium avium subsp. paratuberculosis
cagcguuccggcggc

SEQ ID NO: 2983326 - RNA, 17 nt, Mycobacterium avium subsp. paratuberculosis
cagcguuccgucggcga

SEQ ID NO: 2983327 - RNA, 13 nt, Mycobacterium avium subsp. paratuberculosis
cagcguucgucgc

SEQ ID NO: 2983328 - RNA, 17 nt, Mycobacterium avium subsp. paratuberculosis
cagcguucgucgccggu

SEQ ID NO: 2983329 - RNA, 18 nt, Mycobacterium avium subsp. paratuberculosis
cagcguucgucgccggug

SEQ ID NO: 2983330 - RNA, 17 nt, Mycobacterium avium subsp. paratuberculosis
cagcguuuccagcgccg

SEQ ID NO: 2983331 - RNA, 20 nt, Mycobacterium avium subsp. paratuberculosis
cagcguuuccagcgccggca

SEQ ID NO: 2983332 - RNA, 23 nt, Mycobacterium avium subsp. paratuberculosis
cagcguuuccagcgccggcacca

SEQ ID NO: 2983333 - RNA, 22 nt, Mycobacterium avium subsp. paratuberculosis
cagcguuuccuggugcaccagg

SEQ ID NO: 2983334 - RNA, 21 nt, Mycobacterium avium subsp. paratuberculosis
cagcguuuggccugcggcaac

SEQ ID NO: 2983335 - RNA, 22 nt, Mycobacterium avium subsp. paratuberculosis
cagcguuuggccugcggcaaca

SEQ ID NO: 2983336 - RNA, 24 nt, Mycobacterium avium subsp. paratuberculosis
cagcguuuggccugcggcaacagc

SEQ ID NO: 2983337 - RNA, 15 nt, Mycobacterium avium subsp. paratuberculosis
cagcuagcccagaac

SEQ ID NO: 2983338 - RNA, 20 nt, Mycobacterium avium subsp. paratuberculosis
cagcuaggaagccagccguc

SEQ ID NO: 2983339 - RNA, 21 nt, Mycobacterium avium subsp. paratuberculosis
cagcuaggaagccagccgucc

SEQ ID NO: 2983340 - RNA, 14 nt, Mycobacterium avium subsp. paratuberculosis
cagcuaggccagca

SEQ ID NO: 2983341 - RNA, 16 nt, Mycobacterium avium subsp. paratuberculosis
cagcuaggccagcagc

SEQ ID NO: 2983342 - RNA, 17 nt, Mycobacterium avium subsp. paratuberculosis
cagcuaggucguggcgc

SEQ ID NO: 2983343 - RNA, 13 nt, Mycobacterium avium subsp. paratuberculosis
cagcucaccggcc

SEQ ID NO: 2983344 - RNA, 23 nt, Mycobacterium avium subsp. paratuberculosis
cagcucaccggccagggccgccg

SEQ ID NO: 2983345 - RNA, 14 nt, Mycobacterium avium subsp. paratuberculosis
cagcucaccugcgu

SEQ ID NO: 2983346 - RNA, 19 nt, Mycobacterium avium subsp. paratuberculosis
cagcucagacugccgagca

SEQ ID NO: 2983347 - RNA, 13 nt, Mycobacterium avium subsp. paratuberculosis
cagcucagcgcgc

SEQ ID NO: 2983348 - RNA, 17 nt, Mycobacterium avium subsp. paratuberculosis
cagcucaggaacggccg

SEQ ID NO: 2983349 - RNA, 18 nt, Mycobacterium avium subsp. paratuberculosis
cagcucaggaacggccgg

SEQ ID NO: 2983350 - RNA, 16 nt, Mycobacterium avium subsp. paratuberculosis
cagcucauacagcggc

SEQ ID NO: 2983351 - RNA, 20 nt, Mycobacterium avium subsp. paratuberculosis
cagcucauacagcggcgcgc

SEQ ID NO: 2983352 - RNA, 20 nt, Mycobacterium avium subsp. paratuberculosis
cagcucauguggggggucgg

SEQ ID NO: 2983353 - RNA, 17 nt, Mycobacterium avium subsp. paratuberculosis
cagcuccaacagccggu

SEQ ID NO: 2983354 - RNA, 18 nt, Mycobacterium avium subsp. paratuberculosis
cagcuccaacagccgguc

SEQ ID NO: 2983355 - RNA, 16 nt, Mycobacterium avium subsp. paratuberculosis
cagcuccaccugcggc

SEQ ID NO: 2983356 - RNA, 18 nt, Mycobacterium avium subsp. paratuberculosis
cagcuccaccugcggcac

SEQ ID NO: 2983357 - RNA, 20 nt, Mycobacterium avium subsp. paratuberculosis
cagcuccaccugcggcaccu

SEQ ID NO: 2983358 - RNA, 23 nt, Mycobacterium avium subsp. paratuberculosis
cagcuccaccugcggcaccucgg

SEQ ID NO: 2983359 - RNA, 13 nt, Mycobacterium avium subsp. paratuberculosis
cagcuccagcagc

SEQ ID NO: 2983360 - RNA, 18 nt, Mycobacterium avium subsp. paratuberculosis
cagcuccagcagcccggg

SEQ ID NO: 2983361 - RNA, 23 nt, Mycobacterium avium subsp. paratuberculosis
cagcuccagguccuugaaccgca

SEQ ID NO: 2983362 - RNA, 14 nt, Mycobacterium avium subsp. paratuberculosis
cagcuccaucgacg

SEQ ID NO: 2983363 - RNA, 12 nt, Mycobacterium avium subsp. paratuberculosis
cagcucccccga

SEQ ID NO: 2983364 - RNA, 16 nt, Mycobacterium avium subsp. paratuberculosis
cagcucccccgacacc

SEQ ID NO: 2983365 - RNA, 18 nt, Mycobacterium avium subsp. paratuberculosis
cagcucccccgacaccgc

SEQ ID NO: 2983366 - RNA, 19 nt, Mycobacterium avium subsp. paratuberculosis
cagcucccccgacaccgcc

SEQ ID NO: 2983367 - RNA, 20 nt, Mycobacterium avium subsp. paratuberculosis
cagcucccccgacaccgcca

SEQ ID NO: 2983368 - RNA, 22 nt, Mycobacterium avium subsp. paratuberculosis
cagcucccccgacaccgccagc

SEQ ID NO: 2983369 - RNA, 15 nt, Mycobacterium avium subsp. paratuberculosis
cagcucccccggcgu

SEQ ID NO: 2983370 - RNA, 15 nt, Mycobacterium avium subsp. paratuberculosis
cagcucccgagcauc

SEQ ID NO: 2983371 - RNA, 17 nt, Mycobacterium avium subsp. paratuberculosis
cagcucccgagcaucgc

SEQ ID NO: 2983372 - RNA, 19 nt, Mycobacterium avium subsp. paratuberculosis
cagcucccgagcaucgccg

SEQ ID NO: 2983373 - RNA, 17 nt, Mycobacterium avium subsp. paratuberculosis
cagcucccgggcggcgc

SEQ ID NO: 2983374 - RNA, 19 nt, Mycobacterium avium subsp. paratuberculosis
cagcucccgggcggcgccg

SEQ ID NO: 2983375 - RNA, 13 nt, Mycobacterium avium subsp. paratuberculosis
cagcuccgccacc

SEQ ID NO: 2983376 - RNA, 14 nt, Mycobacterium avium subsp. paratuberculosis
cagcuccgccaccc

SEQ ID NO: 2983377 - RNA, 15 nt, Mycobacterium avium subsp. paratuberculosis
cagcuccgccgacac

SEQ ID NO: 2983378 - RNA, 23 nt, Mycobacterium avium subsp. paratuberculosis
cagcuccgccgacaccagggugc

SEQ ID NO: 2983379 - RNA, 14 nt, Mycobacterium avium subsp. paratuberculosis
cagcuccgcggcca

SEQ ID NO: 2983380 - RNA, 17 nt, Mycobacterium avium subsp. paratuberculosis
cagcuccgcggccagcu

SEQ ID NO: 2983381 - RNA, 14 nt, Mycobacterium avium subsp. paratuberculosis
cagcuccggcaacg

SEQ ID NO: 2983382 - RNA, 24 nt, Mycobacterium avium subsp. paratuberculosis
cagcuccggcaacgaggccagggc

SEQ ID NO: 2983383 - RNA, 12 nt, Mycobacterium avium subsp. paratuberculosis
cagcuccggguc

SEQ ID NO: 2983384 - RNA, 18 nt, Mycobacterium avium subsp. paratuberculosis
cagcuccguccaccggca

SEQ ID NO: 2983385 - RNA, 13 nt, Mycobacterium avium subsp. paratuberculosis
cagcuccuccugc

SEQ ID NO: 2983386 - RNA, 14 nt, Mycobacterium avium subsp. paratuberculosis
cagcuccuccugcg

SEQ ID NO: 2983387 - RNA, 20 nt, Mycobacterium avium subsp. paratuberculosis
cagcuccucggccagcacca

SEQ ID NO: 2983388 - RNA, 15 nt, Mycobacterium avium subsp. paratuberculosis
cagcuccucggcccc

SEQ ID NO: 2983389 - RNA, 17 nt, Mycobacterium avium subsp. paratuberculosis
cagcuccucggccccaa

SEQ ID NO: 2983390 - RNA, 15 nt, Mycobacterium avium subsp. paratuberculosis
cagcuccucggcggc

SEQ ID NO: 2983391 - RNA, 16 nt, Mycobacterium avium subsp. paratuberculosis
cagcuccucggcggcc

SEQ ID NO: 2983392 - RNA, 18 nt, Mycobacterium avium subsp. paratuberculosis
cagcuccucggcggccuc

SEQ ID NO: 2983393 - RNA, 23 nt, Mycobacterium avium subsp. paratuberculosis
cagcuccucggucagcucggggu

SEQ ID NO: 2983394 - RNA, 23 nt, Mycobacterium avium subsp. paratuberculosis
cagcuccuggaagaagucggugu

SEQ ID NO: 2983395 - RNA, 18 nt, Mycobacterium avium subsp. paratuberculosis
cagcucgaaaagcuucuu

SEQ ID NO: 2983396 - RNA, 14 nt, Mycobacterium avium subsp. paratuberculosis
cagcucgaaccugg

SEQ ID NO: 2983397 - RNA, 22 nt, Mycobacterium avium subsp. paratuberculosis
cagcucgaaggugcccgcaucg

SEQ ID NO: 2983398 - RNA, 14 nt, Mycobacterium avium subsp. paratuberculosis
cagcucgaccagcc

SEQ ID NO: 2983399 - RNA, 17 nt, Mycobacterium avium subsp. paratuberculosis
cagcucgaccagccggg

SEQ ID NO: 2983400 - RNA, 15 nt, Mycobacterium avium subsp. paratuberculosis
cagcucgacgaacuc

SEQ ID NO: 2983401 - RNA, 19 nt, Mycobacterium avium subsp. paratuberculosis
cagcucgacgaccucgccg

SEQ ID NO: 2983402 - RNA, 15 nt, Mycobacterium avium subsp. paratuberculosis
cagcucgagcaucac

SEQ ID NO: 2983403 - RNA, 17 nt, Mycobacterium avium subsp. paratuberculosis
cagcucgagcaucacga

SEQ ID NO: 2983404 - RNA, 23 nt, Mycobacterium avium subsp. paratuberculosis
cagcucgagcaucacgaacccgu

SEQ ID NO: 2983405 - RNA, 16 nt, Mycobacterium avium subsp. paratuberculosis
cagcucgaggccgcgg

SEQ ID NO: 2983406 - RNA, 18 nt, Mycobacterium avium subsp. paratuberculosis
cagcucgaggccgcgggc

SEQ ID NO: 2983407 - RNA, 20 nt, Mycobacterium avium subsp. paratuberculosis
cagcucgaggccgcgggcgu

SEQ ID NO: 2983408 - RNA, 18 nt, Mycobacterium avium subsp. paratuberculosis
cagcucgaucacccaggu

SEQ ID NO: 2983409 - RNA, 15 nt, Mycobacterium avium subsp. paratuberculosis
cagcucgaucgccgc

SEQ ID NO: 2983410 - RNA, 16 nt, Mycobacterium avium subsp. paratuberculosis
cagcucgaucgccgcg

SEQ ID NO: 2983411 - RNA, 22 nt, Mycobacterium avium subsp. paratuberculosis
cagcucgaugccguucgcgccg

SEQ ID NO: 2983412 - RNA, 20 nt, Mycobacterium avium subsp. paratuberculosis
cagcucgauggugccgucgg

SEQ ID NO: 2983413 - RNA, 23 nt, Mycobacterium avium subsp. paratuberculosis
cagcucgauggugccgucggcgg

SEQ ID NO: 2983414 - RNA, 14 nt, Mycobacterium avium subsp. paratuberculosis
cagcucgcccagca

SEQ ID NO: 2983415 - RNA, 17 nt, Mycobacterium avium subsp. paratuberculosis
cagcucgcccagcaccg

SEQ ID NO: 2983416 - RNA, 20 nt, Mycobacterium avium subsp. paratuberculosis
cagcucgccgaugucggccg

SEQ ID NO: 2983417 - RNA, 21 nt, Mycobacterium avium subsp. paratuberculosis
cagcucgccgaugucggccgg

SEQ ID NO: 2983418 - RNA, 23 nt, Mycobacterium avium subsp. paratuberculosis
cagcucgccgaugucggccgguc

SEQ ID NO: 2983419 - RNA, 21 nt, Mycobacterium avium subsp. paratuberculosis
cagcucgccgauguggcgggc

SEQ ID NO: 2983420 - RNA, 16 nt, Mycobacterium avium subsp. paratuberculosis
cagcucgccgccgacg

SEQ ID NO: 2983421 - RNA, 12 nt, Mycobacterium avium subsp. paratuberculosis
cagcucgccggc

SEQ ID NO: 2983422 - RNA, 14 nt, Mycobacterium avium subsp. paratuberculosis
cagcucgccggccg

SEQ ID NO: 2983423 - RNA, 19 nt, Mycobacterium avium subsp. paratuberculosis
cagcucgccggccgcgggc

SEQ ID NO: 2983424 - RNA, 14 nt, Mycobacterium avium subsp. paratuberculosis
cagcucgccggcgc

SEQ ID NO: 2983425 - RNA, 15 nt, Mycobacterium avium subsp. paratuberculosis
cagcucgccggcgcg

SEQ ID NO: 2983426 - RNA, 12 nt, Mycobacterium avium subsp. paratuberculosis
cagcucgccguc

SEQ ID NO: 2983427 - RNA, 15 nt, Mycobacterium avium subsp. paratuberculosis
cagcucgcgaagcgc

SEQ ID NO: 2983428 - RNA, 19 nt, Mycobacterium avium subsp. paratuberculosis
cagcucgcgaagcgcgaug

SEQ ID NO: 2983429 - RNA, 18 nt, Mycobacterium avium subsp. paratuberculosis
cagcucgcgcagccggcc

SEQ ID NO: 2983430 - RNA, 16 nt, Mycobacterium avium subsp. paratuberculosis
cagcucgcgcagcugg

SEQ ID NO: 2983431 - RNA, 20 nt, Mycobacterium avium subsp. paratuberculosis
cagcucgcgcagcuggccgu

SEQ ID NO: 2983432 - RNA, 13 nt, Mycobacterium avium subsp. paratuberculosis
cagcucgcgcccg

SEQ ID NO: 2983433 - RNA, 21 nt, Mycobacterium avium subsp. paratuberculosis
cagcucgcgcugaagccgcug

SEQ ID NO: 2983434 - RNA, 12 nt, Mycobacterium avium subsp. paratuberculosis
cagcucgcggau

SEQ ID NO: 2983435 - RNA, 22 nt, Mycobacterium avium subsp. paratuberculosis
cagcucgcggauccgcagcuga

SEQ ID NO: 2983436 - RNA, 16 nt, Mycobacterium avium subsp. paratuberculosis
cagcucgcgggccugc

SEQ ID NO: 2983437 - RNA, 21 nt, Mycobacterium avium subsp. paratuberculosis
cagcucgcgggccugcucguc

SEQ ID NO: 2983438 - RNA, 18 nt, Mycobacterium avium subsp. paratuberculosis
cagcucgcguucgggccc

SEQ ID NO: 2983439 - RNA, 22 nt, Mycobacterium avium subsp. paratuberculosis
cagcucgcguucgggcccggcc

SEQ ID NO: 2983440 - RNA, 20 nt, Mycobacterium avium subsp. paratuberculosis
cagcucgcugagcgggacgc

SEQ ID NO: 2983441 - RNA, 22 nt, Mycobacterium avium subsp. paratuberculosis
cagcucgcugagcgggacgcgc

SEQ ID NO: 2983442 - RNA, 18 nt, Mycobacterium avium subsp. paratuberculosis
cagcucgcugaucagcuc

SEQ ID NO: 2983443 - RNA, 23 nt, Mycobacterium avium subsp. paratuberculosis
cagcucgcugaucagcucuucga

SEQ ID NO: 2983444 - RNA, 13 nt, Mycobacterium avium subsp. paratuberculosis
cagcucggcagcc

SEQ ID NO: 2983445 - RNA, 17 nt, Mycobacterium avium subsp. paratuberculosis
cagcucggcagccccgu

SEQ ID NO: 2983446 - RNA, 13 nt, Mycobacterium avium subsp. paratuberculosis
cagcucggcccgc

SEQ ID NO: 2983447 - RNA, 14 nt, Mycobacterium avium subsp. paratuberculosis
cagcucggcccgcu

SEQ ID NO: 2983448 - RNA, 17 nt, Mycobacterium avium subsp. paratuberculosis
cagcucggcccgcugcg

SEQ ID NO: 2983449 - RNA, 13 nt, Mycobacterium avium subsp. paratuberculosis
cagcucggcgauc

SEQ ID NO: 2983450 - RNA, 20 nt, Mycobacterium avium subsp. paratuberculosis
cagcucggcgaucaccgcgu

SEQ ID NO: 2983451 - RNA, 14 nt, Mycobacterium avium subsp. paratuberculosis
cagcucggcgcugu

SEQ ID NO: 2983452 - RNA, 12 nt, Mycobacterium avium subsp. paratuberculosis
cagcucggcggc

SEQ ID NO: 2983453 - RNA, 15 nt, Mycobacterium avium subsp. paratuberculosis
cagcucggcggcccg

SEQ ID NO: 2983454 - RNA, 19 nt, Mycobacterium avium subsp. paratuberculosis
cagcucggcggcccgccgg

SEQ ID NO: 2983455 - RNA, 14 nt, Mycobacterium avium subsp. paratuberculosis
cagcucggcggccu

SEQ ID NO: 2983456 - RNA, 18 nt, Mycobacterium avium subsp. paratuberculosis
cagcucggcggccucgcc

SEQ ID NO: 2983457 - RNA, 16 nt, Mycobacterium avium subsp. paratuberculosis
cagcucggcggccugc

SEQ ID NO: 2983458 - RNA, 13 nt, Mycobacterium avium subsp. paratuberculosis
cagcucggcgggc

SEQ ID NO: 2983459 - RNA, 15 nt, Mycobacterium avium subsp. paratuberculosis
cagcucggcgggcuc

SEQ ID NO: 2983460 - RNA, 22 nt, Mycobacterium avium subsp. paratuberculosis
cagcucggcgggcucccucguc

SEQ ID NO: 2983461 - RNA, 13 nt, Mycobacterium avium subsp. paratuberculosis
cagcucgggcagc

SEQ ID NO: 2983462 - RNA, 14 nt, Mycobacterium avium subsp. paratuberculosis
cagcucgggcagcc

SEQ ID NO: 2983463 - RNA, 16 nt, Mycobacterium avium subsp. paratuberculosis
cagcucgggcagcgug

SEQ ID NO: 2983464 - RNA, 23 nt, Mycobacterium avium subsp. paratuberculosis
cagcucgggguaguucagcgcgc

SEQ ID NO: 2983465 - RNA, 17 nt, Mycobacterium avium subsp. paratuberculosis
cagcucggggucggcgu

SEQ ID NO: 2983466 - RNA, 18 nt, Mycobacterium avium subsp. paratuberculosis
cagcucggggucggcguc

SEQ ID NO: 2983467 - RNA, 19 nt, Mycobacterium avium subsp. paratuberculosis
cagcucggggucggcgucg

SEQ ID NO: 2983468 - RNA, 22 nt, Mycobacterium avium subsp. paratuberculosis
cagcucggggucggcgucgggc

SEQ ID NO: 2983469 - RNA, 17 nt, Mycobacterium avium subsp. paratuberculosis
cagcucggucaccagcg

SEQ ID NO: 2983470 - RNA, 18 nt, Mycobacterium avium subsp. paratuberculosis
cagcucggucaccagcgg

SEQ ID NO: 2983471 - RNA, 19 nt, Mycobacterium avium subsp. paratuberculosis
cagcucggucagccgggcg

SEQ ID NO: 2983472 - RNA, 17 nt, Mycobacterium avium subsp. paratuberculosis
cagcucggucgcggucg

SEQ ID NO: 2983473 - RNA, 19 nt, Mycobacterium avium subsp. paratuberculosis
cagcucggucgcggucggc

SEQ ID NO: 2983474 - RNA, 21 nt, Mycobacterium avium subsp. paratuberculosis
cagcucggucgcggucggcgc

SEQ ID NO: 2983475 - RNA, 23 nt, Mycobacterium avium subsp. paratuberculosis
cagcucggugaucugcaccagcg

SEQ ID NO: 2983476 - RNA, 23 nt, Mycobacterium avium subsp. paratuberculosis
cagcucggugcagaccccggcgu

SEQ ID NO: 2983477 - RNA, 15 nt, Mycobacterium avium subsp. paratuberculosis
cagcucgguggccgg

SEQ ID NO: 2983478 - RNA, 17 nt, Mycobacterium avium subsp. paratuberculosis
cagcucgguggcgucgg

SEQ ID NO: 2983479 - RNA, 20 nt, Mycobacterium avium subsp. paratuberculosis
cagcucgguggcgucggcgg

SEQ ID NO: 2983480 - RNA, 21 nt, Mycobacterium avium subsp. paratuberculosis
cagcucgguggcgucggcggc

SEQ ID NO: 2983481 - RNA, 18 nt, Mycobacterium avium subsp. paratuberculosis
cagcucgucagcgcgggc

SEQ ID NO: 2983482 - RNA, 20 nt, Mycobacterium avium subsp. paratuberculosis
cagcucgucagcgcgggcca

SEQ ID NO: 2983483 - RNA, 22 nt, Mycobacterium avium subsp. paratuberculosis
cagcucgucagcgcgggccagc

SEQ ID NO: 2983484 - RNA, 14 nt, Mycobacterium avium subsp. paratuberculosis
cagcucguccagcg

SEQ ID NO: 2983485 - RNA, 15 nt, Mycobacterium avium subsp. paratuberculosis
cagcucguccagcgu

SEQ ID NO: 2983486 - RNA, 17 nt, Mycobacterium avium subsp. paratuberculosis
cagcucguccagcgugc

SEQ ID NO: 2983487 - RNA, 20 nt, Mycobacterium avium subsp. paratuberculosis
cagcucguccagcgugccgc

SEQ ID NO: 2983488 - RNA, 13 nt, Mycobacterium avium subsp. paratuberculosis
cagcucgucgacg

SEQ ID NO: 2983489 - RNA, 16 nt, Mycobacterium avium subsp. paratuberculosis
cagcucgucgagccgg

SEQ ID NO: 2983490 - RNA, 18 nt, Mycobacterium avium subsp. paratuberculosis
cagcucgucgagccggcc

SEQ ID NO: 2983491 - RNA, 19 nt, Mycobacterium avium subsp. paratuberculosis
cagcucgucgagccggccg

SEQ ID NO: 2983492 - RNA, 13 nt, Mycobacterium avium subsp. paratuberculosis
cagcucgucgccg

SEQ ID NO: 2983493 - RNA, 15 nt, Mycobacterium avium subsp. paratuberculosis
cagcucgucgccgac

SEQ ID NO: 2983494 - RNA, 16 nt, Mycobacterium avium subsp. paratuberculosis
cagcucgucgccgacc

SEQ ID NO: 2983495 - RNA, 12 nt, Mycobacterium avium subsp. paratuberculosis
cagcucgucgcg

SEQ ID NO: 2983496 - RNA, 15 nt, Mycobacterium avium subsp. paratuberculosis
cagcucgucgcggaa

SEQ ID NO: 2983497 - RNA, 21 nt, Mycobacterium avium subsp. paratuberculosis
cagcucgucgcggaacagccg

SEQ ID NO: 2983498 - RNA, 23 nt, Mycobacterium avium subsp. paratuberculosis
cagcucgucgcggaacagccggc

SEQ ID NO: 2983499 - RNA, 14 nt, Mycobacterium avium subsp. paratuberculosis
cagcucgucggcgc

SEQ ID NO: 2983500 - RNA, 16 nt, Mycobacterium avium subsp. paratuberculosis
cagcucgucggcgcgc

SEQ ID NO: 2983501 - RNA, 21 nt, Mycobacterium avium subsp. paratuberculosis
cagcucgucggcgcgccaccc

SEQ ID NO: 2983502 - RNA, 21 nt, Mycobacterium avium subsp. paratuberculosis
cagcucgucgugggugacccg

SEQ ID NO: 2983503 - RNA, 22 nt, Mycobacterium avium subsp. paratuberculosis
cagcucgucgugggugacccgg

SEQ ID NO: 2983504 - RNA, 13 nt, Mycobacterium avium subsp. paratuberculosis
cagcucguggcgg

SEQ ID NO: 2983505 - RNA, 15 nt, Mycobacterium avium subsp. paratuberculosis
cagcucguggcgggc

SEQ ID NO: 2983506 - RNA, 17 nt, Mycobacterium avium subsp. paratuberculosis
cagcucguggcgggccc

SEQ ID NO: 2983507 - RNA, 17 nt, Mycobacterium avium subsp. paratuberculosis
cagcucguugccggcgg

SEQ ID NO: 2983508 - RNA, 20 nt, Mycobacterium avium subsp. paratuberculosis
cagcucguugccggcggcca

SEQ ID NO: 2983509 - RNA, 16 nt, Mycobacterium avium subsp. paratuberculosis
cagcucuucgacgaug

SEQ ID NO: 2983510 - RNA, 21 nt, Mycobacterium avium subsp. paratuberculosis
cagcugaacacgaacccggcg

SEQ ID NO: 2983511 - RNA, 23 nt, Mycobacterium avium subsp. paratuberculosis
cagcugaacacgaacccggcggc

SEQ ID NO: 2983512 - RNA, 14 nt, Mycobacterium avium subsp. paratuberculosis
cagcugaacggugc

SEQ ID NO: 2983513 - RNA, 20 nt, Mycobacterium avium subsp. paratuberculosis
cagcugaacggugcccgccg

SEQ ID NO: 2983514 - RNA, 21 nt, Mycobacterium avium subsp. paratuberculosis
cagcugaacggugcccgccga

SEQ ID NO: 2983515 - RNA, 22 nt, Mycobacterium avium subsp. paratuberculosis
cagcugaacggugcccgccgau

SEQ ID NO: 2983516 - RNA, 14 nt, Mycobacterium avium subsp. paratuberculosis
cagcugaccggcga

SEQ ID NO: 2983517 - RNA, 16 nt, Mycobacterium avium subsp. paratuberculosis
cagcugaccggcgauc

SEQ ID NO: 2983518 - RNA, 14 nt, Mycobacterium avium subsp. paratuberculosis
cagcugacgggccg

SEQ ID NO: 2983519 - RNA, 19 nt, Mycobacterium avium subsp. paratuberculosis
cagcugacgggccggcggg

SEQ ID NO: 2983520 - RNA, 14 nt, Mycobacterium avium subsp. paratuberculosis
cagcugagcagccc

SEQ ID NO: 2983521 - RNA, 15 nt, Mycobacterium avium subsp. paratuberculosis
cagcugagcagcccg

SEQ ID NO: 2983522 - RNA, 18 nt, Mycobacterium avium subsp. paratuberculosis
cagcugagcagcccgacc

SEQ ID NO: 2983523 - RNA, 17 nt, Mycobacterium avium subsp. paratuberculosis
cagcugauagcccgccg

SEQ ID NO: 2983524 - RNA, 18 nt, Mycobacterium avium subsp. paratuberculosis
cagcugauagcccgccgc

SEQ ID NO: 2983525 - RNA, 22 nt, Mycobacterium avium subsp. paratuberculosis
cagcugauagcccgccgcggcg

SEQ ID NO: 2983526 - RNA, 21 nt, Mycobacterium avium subsp. paratuberculosis
cagcugauagccgcccugccc

SEQ ID NO: 2983527 - RNA, 20 nt, Mycobacterium avium subsp. paratuberculosis
cagcugaucggggcccaccc

SEQ ID NO: 2983528 - RNA, 22 nt, Mycobacterium avium subsp. paratuberculosis
cagcugaucggggcccaccccg

SEQ ID NO: 2983529 - RNA, 20 nt, Mycobacterium avium subsp. paratuberculosis
cagcugauucgcgguggcga

SEQ ID NO: 2983530 - RNA, 22 nt, Mycobacterium avium subsp. paratuberculosis
cagcugauucgcgguggcgaac

SEQ ID NO: 2983531 - RNA, 19 nt, Mycobacterium avium subsp. paratuberculosis
cagcugauuguugacggug

SEQ ID NO: 2983532 - RNA, 20 nt, Mycobacterium avium subsp. paratuberculosis
cagcugauuguugacgguga

SEQ ID NO: 2983533 - RNA, 22 nt, Mycobacterium avium subsp. paratuberculosis
cagcugcacccgcuccaccgaa

SEQ ID NO: 2983534 - RNA, 13 nt, Mycobacterium avium subsp. paratuberculosis
cagcugcaccggg

SEQ ID NO: 2983535 - RNA, 16 nt, Mycobacterium avium subsp. paratuberculosis
cagcugcaccggggcc

SEQ ID NO: 2983536 - RNA, 20 nt, Mycobacterium avium subsp. paratuberculosis
cagcugcaccggggccggcg

SEQ ID NO: 2983537 - RNA, 22 nt, Mycobacterium avium subsp. paratuberculosis
cagcugcaccggggccggcggg

SEQ ID NO: 2983538 - RNA, 23 nt, Mycobacterium avium subsp. paratuberculosis
cagcugcaccggggccggcgggg

SEQ ID NO: 2983539 - RNA, 14 nt, Mycobacterium avium subsp. paratuberculosis
cagcugcagccggc

SEQ ID NO: 2983540 - RNA, 17 nt, Mycobacterium avium subsp. paratuberculosis
cagcugcagccggccgg

SEQ ID NO: 2983541 - RNA, 22 nt, Mycobacterium avium subsp. paratuberculosis
cagcugcagcgacugcacccgg

SEQ ID NO: 2983542 - RNA, 22 nt, Mycobacterium avium subsp. paratuberculosis
cagcugcagcuccucggcggcc

SEQ ID NO: 2983543 - RNA, 16 nt, Mycobacterium avium subsp. paratuberculosis
cagcugcccaccagca

SEQ ID NO: 2983544 - RNA, 17 nt, Mycobacterium avium subsp. paratuberculosis
cagcugcccaccagcag

SEQ ID NO: 2983545 - RNA, 16 nt, Mycobacterium avium subsp. paratuberculosis
cagcugcccgccgacg

SEQ ID NO: 2983546 - RNA, 12 nt, Mycobacterium avium subsp. paratuberculosis
cagcugcccgga

SEQ ID NO: 2983547 - RNA, 23 nt, Mycobacterium avium subsp. paratuberculosis
cagcugcccggaguccggcucgg

SEQ ID NO: 2983548 - RNA, 15 nt, Mycobacterium avium subsp. paratuberculosis
cagcugccgcaccgc

SEQ ID NO: 2983549 - RNA, 17 nt, Mycobacterium avium subsp. paratuberculosis
cagcugccgcgacucgg

SEQ ID NO: 2983550 - RNA, 13 nt, Mycobacterium avium subsp. paratuberculosis
cagcugccggccg

SEQ ID NO: 2983551 - RNA, 18 nt, Mycobacterium avium subsp. paratuberculosis
cagcugccggccguugcg

SEQ ID NO: 2983552 - RNA, 19 nt, Mycobacterium avium subsp. paratuberculosis
cagcugccguccggguccg

SEQ ID NO: 2983553 - RNA, 21 nt, Mycobacterium avium subsp. paratuberculosis
cagcugcgacagcacgggcgg

SEQ ID NO: 2983554 - RNA, 23 nt, Mycobacterium avium subsp. paratuberculosis
cagcugcgacagcacgggcgggc

SEQ ID NO: 2983555 - RNA, 18 nt, Mycobacterium avium subsp. paratuberculosis
cagcugcgccgcgucgac

SEQ ID NO: 2983556 - RNA, 19 nt, Mycobacterium avium subsp. paratuberculosis
cagcugcgccgcgucgacg

SEQ ID NO: 2983557 - RNA, 22 nt, Mycobacterium avium subsp. paratuberculosis
cagcugcgccgcgucgacgccg

SEQ ID NO: 2983558 - RNA, 13 nt, Mycobacterium avium subsp. paratuberculosis
cagcugcgcgccg

SEQ ID NO: 2983559 - RNA, 21 nt, Mycobacterium avium subsp. paratuberculosis
cagcugcgcgccggcggccgc

SEQ ID NO: 2983560 - RNA, 23 nt, Mycobacterium avium subsp. paratuberculosis
cagcugcgcgccggcggccgccg

SEQ ID NO: 2983561 - RNA, 12 nt, Mycobacterium avium subsp. paratuberculosis
cagcugcgcgga

SEQ ID NO: 2983562 - RNA, 14 nt, Mycobacterium avium subsp. paratuberculosis
cagcugcgcgggcg

SEQ ID NO: 2983563 - RNA, 19 nt, Mycobacterium avium subsp. paratuberculosis
cagcugcgcgggcgcggcc

SEQ ID NO: 2983564 - RNA, 23 nt, Mycobacterium avium subsp. paratuberculosis
cagcugcggaaaugcccgcgccc

SEQ ID NO: 2983565 - RNA, 23 nt, Mycobacterium avium subsp. paratuberculosis
cagcugcggaucgggcguggcgu

SEQ ID NO: 2983566 - RNA, 17 nt, Mycobacterium avium subsp. paratuberculosis
cagcugcgggaccagcg

SEQ ID NO: 2983567 - RNA, 14 nt, Mycobacterium avium subsp. paratuberculosis
cagcugcgucggca

SEQ ID NO: 2983568 - RNA, 16 nt, Mycobacterium avium subsp. paratuberculosis
cagcugcgucggcacc

SEQ ID NO: 2983569 - RNA, 23 nt, Mycobacterium avium subsp. paratuberculosis
cagcugcuccgggggcaccgcca

SEQ ID NO: 2983570 - RNA, 17 nt, Mycobacterium avium subsp. paratuberculosis
cagcugcucguccuggc

SEQ ID NO: 2983571 - RNA, 15 nt, Mycobacterium avium subsp. paratuberculosis
cagcugcugcgcggc

SEQ ID NO: 2983572 - RNA, 16 nt, Mycobacterium avium subsp. paratuberculosis
cagcugcugcgcggcg

SEQ ID NO: 2983573 - RNA, 18 nt, Mycobacterium avium subsp. paratuberculosis
cagcugcugcgcggcggc

SEQ ID NO: 2983574 - RNA, 17 nt, Mycobacterium avium subsp. paratuberculosis
cagcugcugcggccgga

SEQ ID NO: 2983575 - RNA, 12 nt, Mycobacterium avium subsp. paratuberculosis
cagcugcuggaa

SEQ ID NO: 2983576 - RNA, 21 nt, Mycobacterium avium subsp. paratuberculosis
cagcugcuggcugcggccccg

SEQ ID NO: 2983577 - RNA, 22 nt, Mycobacterium avium subsp. paratuberculosis
cagcugcuggcugcggccccgg

SEQ ID NO: 2983578 - RNA, 22 nt, Mycobacterium avium subsp. paratuberculosis
cagcuggaaauaggccgggcag

SEQ ID NO: 2983579 - RNA, 17 nt, Mycobacterium avium subsp. paratuberculosis
cagcuggaacaccacgg

SEQ ID NO: 2983580 - RNA, 22 nt, Mycobacterium avium subsp. paratuberculosis
cagcuggaacaccacggccggc

SEQ ID NO: 2983581 - RNA, 23 nt, Mycobacterium avium subsp. paratuberculosis
cagcuggaacaccacggccggca

SEQ ID NO: 2983582 - RNA, 21 nt, Mycobacterium avium subsp. paratuberculosis
cagcuggagaggcccggcagc

SEQ ID NO: 2983583 - RNA, 23 nt, Mycobacterium avium subsp. paratuberculosis
cagcuggagaggcccggcagccg

SEQ ID NO: 2983584 - RNA, 15 nt, Mycobacterium avium subsp. paratuberculosis
cagcuggaucaucuc

SEQ ID NO: 2983585 - RNA, 16 nt, Mycobacterium avium subsp. paratuberculosis
cagcuggaucaucucg

SEQ ID NO: 2983586 - RNA, 22 nt, Mycobacterium avium subsp. paratuberculosis
cagcuggauggcgcccagcccg

SEQ ID NO: 2983587 - RNA, 17 nt, Mycobacterium avium subsp. paratuberculosis
cagcuggccgugcaccg

SEQ ID NO: 2983588 - RNA, 21 nt, Mycobacterium avium subsp. paratuberculosis
cagcuggccgugcaccgucgc

SEQ ID NO: 2983589 - RNA, 21 nt, Mycobacterium avium subsp. paratuberculosis
cagcuggcgaauccgggccuc

SEQ ID NO: 2983590 - RNA, 13 nt, Mycobacterium avium subsp. paratuberculosis
cagcuggcugaca

SEQ ID NO: 2983591 - RNA, 15 nt, Mycobacterium avium subsp. paratuberculosis
cagcugggaggcgca

SEQ ID NO: 2983592 - RNA, 12 nt, Mycobacterium avium subsp. paratuberculosis
cagcugggcagc

SEQ ID NO: 2983593 - RNA, 14 nt, Mycobacterium avium subsp. paratuberculosis
cagcugggcagcca

SEQ ID NO: 2983594 - RNA, 16 nt, Mycobacterium avium subsp. paratuberculosis
cagcugggcagccaga

SEQ ID NO: 2983595 - RNA, 14 nt, Mycobacterium avium subsp. paratuberculosis
cagcugggccagcg

SEQ ID NO: 2983596 - RNA, 15 nt, Mycobacterium avium subsp. paratuberculosis
cagcugggccagcgc

SEQ ID NO: 2983597 - RNA, 16 nt, Mycobacterium avium subsp. paratuberculosis
cagcugggccagcgcg

SEQ ID NO: 2983598 - RNA, 17 nt, Mycobacterium avium subsp. paratuberculosis
cagcugggccagcgcgg

SEQ ID NO: 2983599 - RNA, 14 nt, Mycobacterium avium subsp. paratuberculosis
cagcugggccgcca

SEQ ID NO: 2983600 - RNA, 18 nt, Mycobacterium avium subsp. paratuberculosis
cagcugggccgccagccg

SEQ ID NO: 2983601 - RNA, 20 nt, Mycobacterium avium subsp. paratuberculosis
cagcugggccgccagccggu

SEQ ID NO: 2983602 - RNA, 17 nt, Mycobacterium avium subsp. paratuberculosis
cagcugggcguacugcu

SEQ ID NO: 2983603 - RNA, 23 nt, Mycobacterium avium subsp. paratuberculosis
cagcugggcguacugcucggcgc

SEQ ID NO: 2983604 - RNA, 17 nt, Mycobacterium avium subsp. paratuberculosis
cagcugggcugccagcg

SEQ ID NO: 2983605 - RNA, 22 nt, Mycobacterium avium subsp. paratuberculosis
cagcugguagaugguggccguc

SEQ ID NO: 2983606 - RNA, 23 nt, Mycobacterium avium subsp. paratuberculosis
cagcugguagaugguggccgucg

SEQ ID NO: 2983607 - RNA, 18 nt, Mycobacterium avium subsp. paratuberculosis
cagcugguccggccggcc

SEQ ID NO: 2983608 - RNA, 16 nt, Mycobacterium avium subsp. paratuberculosis
cagcuggugaagcugc

SEQ ID NO: 2983609 - RNA, 15 nt, Mycobacterium avium subsp. paratuberculosis
cagcuguuccuggua

SEQ ID NO: 2983610 - RNA, 15 nt, Mycobacterium avium subsp. paratuberculosis
cagcuguugacgggc

SEQ ID NO: 2983611 - RNA, 16 nt, Mycobacterium avium subsp. paratuberculosis
cagcuguugacgggcc

SEQ ID NO: 2983612 - RNA, 18 nt, Mycobacterium avium subsp. paratuberculosis
cagcuguugacgggccgc

SEQ ID NO: 2983613 - RNA, 20 nt, Mycobacterium avium subsp. paratuberculosis
cagcuguugacgggccgcgg

SEQ ID NO: 2983614 - RNA, 23 nt, Mycobacterium avium subsp. paratuberculosis
cagcuguugacgggccgcggcca

SEQ ID NO: 2983615 - RNA, 18 nt, Mycobacterium avium subsp. paratuberculosis
cagcuucaccggucgggc

SEQ ID NO: 2983616 - RNA, 19 nt, Mycobacterium avium subsp. paratuberculosis
cagcuuccgccucggcgag

SEQ ID NO: 2983617 - RNA, 16 nt, Mycobacterium avium subsp. paratuberculosis
cagcuucggcgccgag

SEQ ID NO: 2983618 - RNA, 13 nt, Mycobacterium avium subsp. paratuberculosis
cagcuucgggcgc

SEQ ID NO: 2983619 - RNA, 21 nt, Mycobacterium avium subsp. paratuberculosis
cagcuucgggcgcgcgcgcca

SEQ ID NO: 2983620 - RNA, 18 nt, Mycobacterium avium subsp. paratuberculosis
cagcuucgugucaccgcc

SEQ ID NO: 2983621 - RNA, 14 nt, Mycobacterium avium subsp. paratuberculosis
cagcuucucggcgu

SEQ ID NO: 2983622 - RNA, 16 nt, Mycobacterium avium subsp. paratuberculosis
cagcuucucggcgucc

SEQ ID NO: 2983623 - RNA, 17 nt, Mycobacterium avium subsp. paratuberculosis
cagcuucucggcguccc

SEQ ID NO: 2983624 - RNA, 23 nt, Mycobacterium avium subsp. paratuberculosis
cagcuucucggcguccccggcgg

SEQ ID NO: 2983625 - RNA, 18 nt, Mycobacterium avium subsp. paratuberculosis
cagcuucugcagcucgcu

SEQ ID NO: 2983626 - RNA, 22 nt, Mycobacterium avium subsp. paratuberculosis
cagcuucugcagcucgcugagc

SEQ ID NO: 2983627 - RNA, 20 nt, Mycobacterium avium subsp. paratuberculosis
cagcuugaagcccucgucga

SEQ ID NO: 2983628 - RNA, 22 nt, Mycobacterium avium subsp. paratuberculosis
cagcuugaagcccucgucgaag

SEQ ID NO: 2983629 - RNA, 17 nt, Mycobacterium avium subsp. paratuberculosis
cagcuugaccacccggu

SEQ ID NO: 2983630 - RNA, 22 nt, Mycobacterium avium subsp. paratuberculosis
cagcuugaccacccggucgacg

SEQ ID NO: 2983631 - RNA, 23 nt, Mycobacterium avium subsp. paratuberculosis
cagcuugaccacccggucgacga

SEQ ID NO: 2983632 - RNA, 21 nt, Mycobacterium avium subsp. paratuberculosis
cagcuugacgucggucagcau

SEQ ID NO: 2983633 - RNA, 14 nt, Mycobacterium avium subsp. paratuberculosis
cagcuugaucgccg

SEQ ID NO: 2983634 - RNA, 20 nt, Mycobacterium avium subsp. paratuberculosis
cagcuugaucgccggggcgc

SEQ ID NO: 2983635 - RNA, 19 nt, Mycobacterium avium subsp. paratuberculosis
cagcuugaugcuggcaacg

SEQ ID NO: 2983636 - RNA, 15 nt, Mycobacterium avium subsp. paratuberculosis
cagcuugccggagcc

SEQ ID NO: 2983637 - RNA, 18 nt, Mycobacterium avium subsp. paratuberculosis
cagcuugccggagcccag

SEQ ID NO: 2983638 - RNA, 23 nt, Mycobacterium avium subsp. paratuberculosis
cagcuugccggagcccagcuugg

SEQ ID NO: 2983639 - RNA, 20 nt, Mycobacterium avium subsp. paratuberculosis
cagcuugcucuucaggaacc

SEQ ID NO: 2983640 - RNA, 18 nt, Mycobacterium avium subsp. paratuberculosis
cagcuuggagccgagcac

SEQ ID NO: 2983641 - RNA, 19 nt, Mycobacterium avium subsp. paratuberculosis
cagcuuggcgcagccgguc

SEQ ID NO: 2983642 - RNA, 18 nt, Mycobacterium avium subsp. paratuberculosis
cagcuuggcgcccuugcc

SEQ ID NO: 2983643 - RNA, 21 nt, Mycobacterium avium subsp. paratuberculosis
cagcuugggggccgacgcuuc

SEQ ID NO: 2983644 - RNA, 18 nt, Mycobacterium avium subsp. paratuberculosis
cagcuugucccagugcuu

SEQ ID NO: 2983645 - RNA, 22 nt, Mycobacterium avium subsp. paratuberculosis
cagcuuguucgagaguuugccc

SEQ ID NO: 2983646 - RNA, 13 nt, Mycobacterium avium subsp. paratuberculosis
cagcuuuccggcc

SEQ ID NO: 2983647 - RNA, 23 nt, Mycobacterium avium subsp. paratuberculosis
cagcuuuccggccgccucgucga

SEQ ID NO: 2983648 - RNA, 20 nt, Mycobacterium avium subsp. paratuberculosis
cagcuuucgggcggccugcc

SEQ ID NO: 2983649 - RNA, 14 nt, Mycobacterium avium subsp. paratuberculosis
caggaaaaccagcg

SEQ ID NO: 2983650 - RNA, 16 nt, Mycobacterium avium subsp. paratuberculosis
caggaaagcgucacag

SEQ ID NO: 2983651 - RNA, 16 nt, Mycobacterium avium subsp. paratuberculosis
caggaaaggaaggcgc

SEQ ID NO: 2983652 - RNA, 21 nt, Mycobacterium avium subsp. paratuberculosis
caggaaaggaaggcgcaugcc

SEQ ID NO: 2983653 - RNA, 17 nt, Mycobacterium avium subsp. paratuberculosis
caggaacaaccgcagcg

SEQ ID NO: 2983654 - RNA, 17 nt, Mycobacterium avium subsp. paratuberculosis
caggaacaccgagccgg

SEQ ID NO: 2983655 - RNA, 18 nt, Mycobacterium avium subsp. paratuberculosis
caggaacacggcucgggg

SEQ ID NO: 2983656 - RNA, 17 nt, Mycobacterium avium subsp. paratuberculosis
caggaacagacacagca

SEQ ID NO: 2983657 - RNA, 19 nt, Mycobacterium avium subsp. paratuberculosis
caggaacagacacagcacg

SEQ ID NO: 2983658 - RNA, 14 nt, Mycobacterium avium subsp. paratuberculosis
caggaaccacaccc

SEQ ID NO: 2983659 - RNA, 23 nt, Mycobacterium avium subsp. paratuberculosis
caggaaccaccggaaggccaggu

SEQ ID NO: 2983660 - RNA, 23 nt, Mycobacterium avium subsp. paratuberculosis
caggaaccgggucagcaccacca

SEQ ID NO: 2983661 - RNA, 16 nt, Mycobacterium avium subsp. paratuberculosis
caggaaccuggucggg

SEQ ID NO: 2983662 - RNA, 14 nt, Mycobacterium avium subsp. paratuberculosis
caggaacgccuuga

SEQ ID NO: 2983663 - RNA, 18 nt, Mycobacterium avium subsp. paratuberculosis
caggaacgcgcccggcgg

SEQ ID NO: 2983664 - RNA, 16 nt, Mycobacterium avium subsp. paratuberculosis
caggaacgcgccggcg

SEQ ID NO: 2983665 - RNA, 20 nt, Mycobacterium avium subsp. paratuberculosis
caggaacgcgccggcgcaca

SEQ ID NO: 2983666 - RNA, 16 nt, Mycobacterium avium subsp. paratuberculosis
caggaacgcgucgacc

SEQ ID NO: 2983667 - RNA, 23 nt, Mycobacterium avium subsp. paratuberculosis
caggaacgcgucgaccgccgcga

SEQ ID NO: 2983668 - RNA, 23 nt, Mycobacterium avium subsp. paratuberculosis
caggaacggcacccgcagcucca

SEQ ID NO: 2983669 - RNA, 20 nt, Mycobacterium avium subsp. paratuberculosis
caggaacggccggauggcca

SEQ ID NO: 2983670 - RNA, 14 nt, Mycobacterium avium subsp. paratuberculosis
caggaacggcgcca

SEQ ID NO: 2983671 - RNA, 15 nt, Mycobacterium avium subsp. paratuberculosis
caggaacgggccggc

SEQ ID NO: 2983672 - RNA, 17 nt, Mycobacterium avium subsp. paratuberculosis
caggaacgggccggcgu

SEQ ID NO: 2983673 - RNA, 14 nt, Mycobacterium avium subsp. paratuberculosis
caggaacuccagca

SEQ ID NO: 2983674 - RNA, 19 nt, Mycobacterium avium subsp. paratuberculosis
caggaacuccagcagcugu

SEQ ID NO: 2983675 - RNA, 17 nt, Mycobacterium avium subsp. paratuberculosis
caggaacuggucgaaca

SEQ ID NO: 2983676 - RNA, 23 nt, Mycobacterium avium subsp. paratuberculosis
caggaacuggucgaacagcgcgc

SEQ ID NO: 2983677 - RNA, 17 nt, Mycobacterium avium subsp. paratuberculosis
caggaagaacccggcgu

SEQ ID NO: 2983678 - RNA, 20 nt, Mycobacterium avium subsp. paratuberculosis
caggaagacguaggcggcca

SEQ ID NO: 2983679 - RNA, 18 nt, Mycobacterium avium subsp. paratuberculosis
caggaaguacaccaccgc

SEQ ID NO: 2983680 - RNA, 17 nt, Mycobacterium avium subsp. paratuberculosis
caggaaguagccggcca

SEQ ID NO: 2983681 - RNA, 20 nt, Mycobacterium avium subsp. paratuberculosis
caggaaguaguccagggugu

SEQ ID NO: 2983682 - RNA, 15 nt, Mycobacterium avium subsp. paratuberculosis
caggaauagcccgaa

SEQ ID NO: 2983683 - RNA, 13 nt, Mycobacterium avium subsp. paratuberculosis
caggaauucgggc

SEQ ID NO: 2983684 - RNA, 18 nt, Mycobacterium avium subsp. paratuberculosis
caggacagcgucagcccc

SEQ ID NO: 2983685 - RNA, 13 nt, Mycobacterium avium subsp. paratuberculosis
caggacaggaugc

SEQ ID NO: 2983686 - RNA, 22 nt, Mycobacterium avium subsp. paratuberculosis
caggacaucaagugcaagggcg

SEQ ID NO: 2983687 - RNA, 15 nt, Mycobacterium avium subsp. paratuberculosis
caggaccacccacuc

SEQ ID NO: 2983688 - RNA, 21 nt, Mycobacterium avium subsp. paratuberculosis
caggaccacccacucccagcc

SEQ ID NO: 2983689 - RNA, 12 nt, Mycobacterium avium subsp. paratuberculosis
caggaccaggcc

SEQ ID NO: 2983690 - RNA, 21 nt, Mycobacterium avium subsp. paratuberculosis
caggacccggugcccaccguc

SEQ ID NO: 2983691 - RNA, 22 nt, Mycobacterium avium subsp. paratuberculosis
caggacccggugcccaccgucu

SEQ ID NO: 2983692 - RNA, 15 nt, Mycobacterium avium subsp. paratuberculosis
caggaccgagccgcg

SEQ ID NO: 2983693 - RNA, 17 nt, Mycobacterium avium subsp. paratuberculosis
caggaccgagccgcgcg

SEQ ID NO: 2983694 - RNA, 16 nt, Mycobacterium avium subsp. paratuberculosis
caggaccgcgcgccgg

SEQ ID NO: 2983695 - RNA, 18 nt, Mycobacterium avium subsp. paratuberculosis
caggaccgcgcgccggcc

SEQ ID NO: 2983696 - RNA, 19 nt, Mycobacterium avium subsp. paratuberculosis
caggaccgcgcgccggcca

SEQ ID NO: 2983697 - RNA, 21 nt, Mycobacterium avium subsp. paratuberculosis
caggaccgggacgacggcgcc

SEQ ID NO: 2983698 - RNA, 19 nt, Mycobacterium avium subsp. paratuberculosis
caggacgcgcccggcgacg

SEQ ID NO: 2983699 - RNA, 22 nt, Mycobacterium avium subsp. paratuberculosis
caggacgcgcccggcgacgcgg

SEQ ID NO: 2983700 - RNA, 23 nt, Mycobacterium avium subsp. paratuberculosis
caggacgcgcccggcgacgcggc

SEQ ID NO: 2983701 - RNA, 12 nt, Mycobacterium avium subsp. paratuberculosis
caggacgcggug

SEQ ID NO: 2983702 - RNA, 16 nt, Mycobacterium avium subsp. paratuberculosis
caggacgcggugacgg

SEQ ID NO: 2983703 - RNA, 19 nt, Mycobacterium avium subsp. paratuberculosis
caggacgcggugacgguga

SEQ ID NO: 2983704 - RNA, 14 nt, Mycobacterium avium subsp. paratuberculosis
caggacggcgcggu

SEQ ID NO: 2983705 - RNA, 16 nt, Mycobacterium avium subsp. paratuberculosis
caggacggcgcggugg

SEQ ID NO: 2983706 - RNA, 18 nt, Mycobacterium avium subsp. paratuberculosis
caggacgggggccggugc

SEQ ID NO: 2983707 - RNA, 16 nt, Mycobacterium avium subsp. paratuberculosis
caggacgguggccguc

SEQ ID NO: 2983708 - RNA, 18 nt, Mycobacterium avium subsp. paratuberculosis
caggacgguggccgucuc

SEQ ID NO: 2983709 - RNA, 20 nt, Mycobacterium avium subsp. paratuberculosis
caggacgguuucugccggcc

SEQ ID NO: 2983710 - RNA, 21 nt, Mycobacterium avium subsp. paratuberculosis
caggacgguuucugccggccg

SEQ ID NO: 2983711 - RNA, 18 nt, Mycobacterium avium subsp. paratuberculosis
caggacgucggccggcug

SEQ ID NO: 2983712 - RNA, 19 nt, Mycobacterium avium subsp. paratuberculosis
caggacgucggccggcugc

SEQ ID NO: 2983713 - RNA, 14 nt, Mycobacterium avium subsp. paratuberculosis
caggacuccuuggg

SEQ ID NO: 2983714 - RNA, 23 nt, Mycobacterium avium subsp. paratuberculosis
caggacuccuugggagacugcga

SEQ ID NO: 2983715 - RNA, 14 nt, Mycobacterium avium subsp. paratuberculosis
caggagcaccugcg

SEQ ID NO: 2983716 - RNA, 17 nt, Mycobacterium avium subsp. paratuberculosis
caggagcaccugcgcga

SEQ ID NO: 2983717 - RNA, 21 nt, Mycobacterium avium subsp. paratuberculosis
caggaggacaagucaugccgc

SEQ ID NO: 2983718 - RNA, 13 nt, Mycobacterium avium subsp. paratuberculosis
caggaggcggcca

SEQ ID NO: 2983719 - RNA, 13 nt, Mycobacterium avium subsp. paratuberculosis
caggagggccagg

SEQ ID NO: 2983720 - RNA, 14 nt, Mycobacterium avium subsp. paratuberculosis
caggagggccaggg

SEQ ID NO: 2983721 - RNA, 14 nt, Mycobacterium avium subsp. paratuberculosis
caggagugcucggc

SEQ ID NO: 2983722 - RNA, 15 nt, Mycobacterium avium subsp. paratuberculosis
caggagugcucggcg

SEQ ID NO: 2983723 - RNA, 16 nt, Mycobacterium avium subsp. paratuberculosis
caggagugcucggcgu

SEQ ID NO: 2983724 - RNA, 13 nt, Mycobacterium avium subsp. paratuberculosis
caggaucaccggg

SEQ ID NO: 2983725 - RNA, 16 nt, Mycobacterium avium subsp. paratuberculosis
caggaucacgcggcgg

SEQ ID NO: 2983726 - RNA, 19 nt, Mycobacterium avium subsp. paratuberculosis
caggaucagcacuucaugg

SEQ ID NO: 2983727 - RNA, 13 nt, Mycobacterium avium subsp. paratuberculosis
caggaucagcagc

SEQ ID NO: 2983728 - RNA, 14 nt, Mycobacterium avium subsp. paratuberculosis
caggaucagcagcc

SEQ ID NO: 2983729 - RNA, 13 nt, Mycobacterium avium subsp. paratuberculosis
caggauccccguc

SEQ ID NO: 2983730 - RNA, 14 nt, Mycobacterium avium subsp. paratuberculosis
caggauccgcaccg

SEQ ID NO: 2983731 - RNA, 16 nt, Mycobacterium avium subsp. paratuberculosis
caggauccgcucgacg

SEQ ID NO: 2983732 - RNA, 19 nt, Mycobacterium avium subsp. paratuberculosis
caggauccggucgaucacc

SEQ ID NO: 2983733 - RNA, 16 nt, Mycobacterium avium subsp. paratuberculosis
caggaucgacaacgcg

SEQ ID NO: 2983734 - RNA, 13 nt, Mycobacterium avium subsp. paratuberculosis
caggaucgacguc

SEQ ID NO: 2983735 - RNA, 15 nt, Mycobacterium avium subsp. paratuberculosis
caggaucgccggucg

SEQ ID NO: 2983736 - RNA, 23 nt, Mycobacterium avium subsp. paratuberculosis
caggaucgccugauacgacgucc

SEQ ID NO: 2983737 - RNA, 14 nt, Mycobacterium avium subsp. paratuberculosis
caggaucgcgguga

SEQ ID NO: 2983738 - RNA, 18 nt, Mycobacterium avium subsp. paratuberculosis
caggaucgcggugaccgc

SEQ ID NO: 2983739 - RNA, 22 nt, Mycobacterium avium subsp. paratuberculosis
caggaucgcggugaccgccgcc

SEQ ID NO: 2983740 - RNA, 19 nt, Mycobacterium avium subsp. paratuberculosis
caggaucucgcgggcccgc

SEQ ID NO: 2983741 - RNA, 22 nt, Mycobacterium avium subsp. paratuberculosis
caggaucucgcgggcccgcgcg

SEQ ID NO: 2983742 - RNA, 19 nt, Mycobacterium avium subsp. paratuberculosis
caggaucugcagcacgccc

SEQ ID NO: 2983743 - RNA, 17 nt, Mycobacterium avium subsp. paratuberculosis
caggaucugcgcaagaa

SEQ ID NO: 2983744 - RNA, 19 nt, Mycobacterium avium subsp. paratuberculosis
caggaucugcgcaagaagg

SEQ ID NO: 2983745 - RNA, 19 nt, Mycobacterium avium subsp. paratuberculosis
caggaucuggacgaucggc

SEQ ID NO: 2983746 - RNA, 23 nt, Mycobacterium avium subsp. paratuberculosis
caggaucuggugcgcgcgcauca

SEQ ID NO: 2983747 - RNA, 17 nt, Mycobacterium avium subsp. paratuberculosis
caggaucuugucggcgg

SEQ ID NO: 2983748 - RNA, 16 nt, Mycobacterium avium subsp. paratuberculosis
caggaugaccgcccag

SEQ ID NO: 2983749 - RNA, 18 nt, Mycobacterium avium subsp. paratuberculosis
caggaugaccgcccagga

SEQ ID NO: 2983750 - RNA, 17 nt, Mycobacterium avium subsp. paratuberculosis
caggaugaccgcgucgg

SEQ ID NO: 2983751 - RNA, 13 nt, Mycobacterium avium subsp. paratuberculosis
caggaugacgccg

SEQ ID NO: 2983752 - RNA, 14 nt, Mycobacterium avium subsp. paratuberculosis
caggaugacgccga

SEQ ID NO: 2983753 - RNA, 15 nt, Mycobacterium avium subsp. paratuberculosis
caggaugacgccgcg

SEQ ID NO: 2983754 - RNA, 19 nt, Mycobacterium avium subsp. paratuberculosis
caggaugagcugggcggcg

SEQ ID NO: 2983755 - RNA, 16 nt, Mycobacterium avium subsp. paratuberculosis
caggaugaugaccgac

SEQ ID NO: 2983756 - RNA, 19 nt, Mycobacterium avium subsp. paratuberculosis
caggaugauuucggcgugg

SEQ ID NO: 2983757 - RNA, 16 nt, Mycobacterium avium subsp. paratuberculosis
caggaugcagccggcc

SEQ ID NO: 2983758 - RNA, 15 nt, Mycobacterium avium subsp. paratuberculosis
caggaugcccagcac

SEQ ID NO: 2983759 - RNA, 16 nt, Mycobacterium avium subsp. paratuberculosis
caggaugcccagcacc

SEQ ID NO: 2983760 - RNA, 17 nt, Mycobacterium avium subsp. paratuberculosis
caggaugcccagcacca

SEQ ID NO: 2983761 - RNA, 13 nt, Mycobacterium avium subsp. paratuberculosis
caggaugcccagg

SEQ ID NO: 2983762 - RNA, 14 nt, Mycobacterium avium subsp. paratuberculosis
caggaugcccagga

SEQ ID NO: 2983763 - RNA, 20 nt, Mycobacterium avium subsp. paratuberculosis
caggaugcccgggccguccg

SEQ ID NO: 2983764 - RNA, 14 nt, Mycobacterium avium subsp. paratuberculosis
caggaugccgaugu

SEQ ID NO: 2983765 - RNA, 17 nt, Mycobacterium avium subsp. paratuberculosis
caggaugcguucggcca

SEQ ID NO: 2983766 - RNA, 19 nt, Mycobacterium avium subsp. paratuberculosis
caggaugcguucggccagu

SEQ ID NO: 2983767 - RNA, 23 nt, Mycobacterium avium subsp. paratuberculosis
caggaugcguuggccgagcagcc

SEQ ID NO: 2983768 - RNA, 17 nt, Mycobacterium avium subsp. paratuberculosis
caggaugcuggggucgg

SEQ ID NO: 2983769 - RNA, 19 nt, Mycobacterium avium subsp. paratuberculosis
caggaugcuggggucggcc

SEQ ID NO: 2983770 - RNA, 20 nt, Mycobacterium avium subsp. paratuberculosis
caggaugcuggggucggcca

SEQ ID NO: 2983771 - RNA, 23 nt, Mycobacterium avium subsp. paratuberculosis
caggaugcuggggucggccagcg

SEQ ID NO: 2983772 - RNA, 22 nt, Mycobacterium avium subsp. paratuberculosis
caggauggagcugaccuggcug

SEQ ID NO: 2983773 - RNA, 13 nt, Mycobacterium avium subsp. paratuberculosis
caggauggugaaa

SEQ ID NO: 2983774 - RNA, 17 nt, Mycobacterium avium subsp. paratuberculosis
caggauguacccgcagg

SEQ ID NO: 2983775 - RNA, 18 nt, Mycobacterium avium subsp. paratuberculosis
caggauguacccgcaggc

SEQ ID NO: 2983776 - RNA, 20 nt, Mycobacterium avium subsp. paratuberculosis
caggauguacccgcaggcca

SEQ ID NO: 2983777 - RNA, 15 nt, Mycobacterium avium subsp. paratuberculosis
caggaugucgacgac

SEQ ID NO: 2983778 - RNA, 20 nt, Mycobacterium avium subsp. paratuberculosis
caggaugucuccgcgcagcc

SEQ ID NO: 2983779 - RNA, 21 nt, Mycobacterium avium subsp. paratuberculosis
caggaugucuccgcgcagcca

SEQ ID NO: 2983780 - RNA, 17 nt, Mycobacterium avium subsp. paratuberculosis
caggauguucaccccgg

SEQ ID NO: 2983781 - RNA, 18 nt, Mycobacterium avium subsp. paratuberculosis
caggauguucaccccggc

SEQ ID NO: 2983782 - RNA, 19 nt, Mycobacterium avium subsp. paratuberculosis
caggauguucaccccggcg

SEQ ID NO: 2983783 - RNA, 20 nt, Mycobacterium avium subsp. paratuberculosis
caggauguucaccccggcgc

SEQ ID NO: 2983784 - RNA, 21 nt, Mycobacterium avium subsp. paratuberculosis
caggauguucaccccggcgcg

SEQ ID NO: 2983785 - RNA, 15 nt, Mycobacterium avium subsp. paratuberculosis
caggauucccgaccc

SEQ ID NO: 2983786 - RNA, 14 nt, Mycobacterium avium subsp. paratuberculosis
caggauuccgucgg

SEQ ID NO: 2983787 - RNA, 20 nt, Mycobacterium avium subsp. paratuberculosis
caggauuccgucggcggccg

SEQ ID NO: 2983788 - RNA, 21 nt, Mycobacterium avium subsp. paratuberculosis
caggauuccgucggcggccga

SEQ ID NO: 2983789 - RNA, 17 nt, Mycobacterium avium subsp. paratuberculosis
caggauucucagcagcg

SEQ ID NO: 2983790 - RNA, 23 nt, Mycobacterium avium subsp. paratuberculosis
caggauucucagcagcgggccga

SEQ ID NO: 2983791 - RNA, 16 nt, Mycobacterium avium subsp. paratuberculosis
caggcacacgaacacc

SEQ ID NO: 2983792 - RNA, 17 nt, Mycobacterium avium subsp. paratuberculosis
caggcacacgaacaccg

SEQ ID NO: 2983793 - RNA, 21 nt, Mycobacterium avium subsp. paratuberculosis
caggcacacgaacaccggcgg

SEQ ID NO: 2983794 - RNA, 22 nt, Mycobacterium avium subsp. paratuberculosis
caggcacacgaacaccggcgga

SEQ ID NO: 2983795 - RNA, 13 nt, Mycobacterium avium subsp. paratuberculosis
caggcacagcagg

SEQ ID NO: 2983796 - RNA, 13 nt, Mycobacterium avium subsp. paratuberculosis
caggcacagcgaa

SEQ ID NO: 2983797 - RNA, 15 nt, Mycobacterium avium subsp. paratuberculosis
caggcacggcccgug

SEQ ID NO: 2983798 - RNA, 19 nt, Mycobacterium avium subsp. paratuberculosis
caggcacucgaucagcacc

SEQ ID NO: 2983799 - RNA, 20 nt, Mycobacterium avium subsp. paratuberculosis
caggcacucgaucagcaccg

SEQ ID NO: 2983800 - RNA, 19 nt, Mycobacterium avium subsp. paratuberculosis
caggcacucgcccagggcg

SEQ ID NO: 2983801 - RNA, 20 nt, Mycobacterium avium subsp. paratuberculosis
caggcacucgcgcaggguca

SEQ ID NO: 2983802 - RNA, 17 nt, Mycobacterium avium subsp. paratuberculosis
caggcagaagcuccacg

SEQ ID NO: 2983803 - RNA, 20 nt, Mycobacterium avium subsp. paratuberculosis
caggcagaagcuccacgccg

SEQ ID NO: 2983804 - RNA, 22 nt, Mycobacterium avium subsp. paratuberculosis
caggcagaagcuccacgccgcc

SEQ ID NO: 2983805 - RNA, 23 nt, Mycobacterium avium subsp. paratuberculosis
caggcagaagcuccacgccgccg

SEQ ID NO: 2983806 - RNA, 17 nt, Mycobacterium avium subsp. paratuberculosis
caggcagacccccagca

SEQ ID NO: 2983807 - RNA, 19 nt, Mycobacterium avium subsp. paratuberculosis
caggcagacccccagcagc

SEQ ID NO: 2983808 - RNA, 15 nt, Mycobacterium avium subsp. paratuberculosis
caggcagcagcaccc

SEQ ID NO: 2983809 - RNA, 17 nt, Mycobacterium avium subsp. paratuberculosis
caggcagcagcaccccg

SEQ ID NO: 2983810 - RNA, 19 nt, Mycobacterium avium subsp. paratuberculosis
caggcagcagcaccccgau

SEQ ID NO: 2983811 - RNA, 22 nt, Mycobacterium avium subsp. paratuberculosis
caggcagcccggcugcgcagcg

SEQ ID NO: 2983812 - RNA, 16 nt, Mycobacterium avium subsp. paratuberculosis
caggcagccguugucc

SEQ ID NO: 2983813 - RNA, 16 nt, Mycobacterium avium subsp. paratuberculosis
caggcagcgcacgaug

SEQ ID NO: 2983814 - RNA, 19 nt, Mycobacterium avium subsp. paratuberculosis
caggcaggccccuccagcu

SEQ ID NO: 2983815 - RNA, 20 nt, Mycobacterium avium subsp. paratuberculosis
caggcaggccggcagccggc

SEQ ID NO: 2983816 - RNA, 17 nt, Mycobacterium avium subsp. paratuberculosis
caggcaggcggccaggg

SEQ ID NO: 2983817 - RNA, 17 nt, Mycobacterium avium subsp. paratuberculosis
caggcaguagccgaucu

SEQ ID NO: 2983818 - RNA, 22 nt, Mycobacterium avium subsp. paratuberculosis
caggcaguagccgaucuccacc

SEQ ID NO: 2983819 - RNA, 23 nt, Mycobacterium avium subsp. paratuberculosis
caggcaguagccgaucuccaccg

SEQ ID NO: 2983820 - RNA, 22 nt, Mycobacterium avium subsp. paratuberculosis
caggcaugggaucagcagcacc

SEQ ID NO: 2983821 - RNA, 23 nt, Mycobacterium avium subsp. paratuberculosis
caggcaugggaucagcagcaccg

SEQ ID NO: 2983822 - RNA, 18 nt, Mycobacterium avium subsp. paratuberculosis
caggcauuagcgcguguc

SEQ ID NO: 2983823 - RNA, 15 nt, Mycobacterium avium subsp. paratuberculosis
caggcauuccaccgc

SEQ ID NO: 2983824 - RNA, 23 nt, Mycobacterium avium subsp. paratuberculosis
caggcauuccaccgcgcggcgca

SEQ ID NO: 2983825 - RNA, 18 nt, Mycobacterium avium subsp. paratuberculosis
caggcauuuccagguccg

SEQ ID NO: 2983826 - RNA, 14 nt, Mycobacterium avium subsp. paratuberculosis
caggccaacagcag

SEQ ID NO: 2983827 - RNA, 16 nt, Mycobacterium avium subsp. paratuberculosis
caggccaacagcagca

SEQ ID NO: 2983828 - RNA, 16 nt, Mycobacterium avium subsp. paratuberculosis
caggccacaugggcca

SEQ ID NO: 2983829 - RNA, 18 nt, Mycobacterium avium subsp. paratuberculosis
caggccacaugggccacg

SEQ ID NO: 2983830 - RNA, 13 nt, Mycobacterium avium subsp. paratuberculosis
caggccacccggg

SEQ ID NO: 2983831 - RNA, 15 nt, Mycobacterium avium subsp. paratuberculosis
caggccacccgggcg

SEQ ID NO: 2983832 - RNA, 16 nt, Mycobacterium avium subsp. paratuberculosis
caggccacccgggcgc

SEQ ID NO: 2983833 - RNA, 22 nt, Mycobacterium avium subsp. paratuberculosis
caggccacccgggcgccggcga

SEQ ID NO: 2983834 - RNA, 16 nt, Mycobacterium avium subsp. paratuberculosis
caggccacgcaggucc

SEQ ID NO: 2983835 - RNA, 17 nt, Mycobacterium avium subsp. paratuberculosis
caggccacgcaggucca

SEQ ID NO: 2983836 - RNA, 20 nt, Mycobacterium avium subsp. paratuberculosis
caggccacgcagguccagga

SEQ ID NO: 2983837 - RNA, 15 nt, Mycobacterium avium subsp. paratuberculosis
caggccacgcccacg

SEQ ID NO: 2983838 - RNA, 16 nt, Mycobacterium avium subsp. paratuberculosis
caggccacgcccacgc

SEQ ID NO: 2983839 - RNA, 16 nt, Mycobacterium avium subsp. paratuberculosis
caggccagcaccuggc

SEQ ID NO: 2983840 - RNA, 16 nt, Mycobacterium avium subsp. paratuberculosis
caggccaggugcagcu

SEQ ID NO: 2983841 - RNA, 17 nt, Mycobacterium avium subsp. paratuberculosis
caggccaggugcagcug

SEQ ID NO: 2983842 - RNA, 19 nt, Mycobacterium avium subsp. paratuberculosis
caggccaggugcagcugca

SEQ ID NO: 2983843 - RNA, 18 nt, Mycobacterium avium subsp. paratuberculosis
caggccaucagcccggcg

SEQ ID NO: 2983844 - RNA, 19 nt, Mycobacterium avium subsp. paratuberculosis
caggccaucagcccggcgu

SEQ ID NO: 2983845 - RNA, 16 nt, Mycobacterium avium subsp. paratuberculosis
caggcccaccagcugg

SEQ ID NO: 2983846 - RNA, 11 nt, Mycobacterium avium subsp. paratuberculosis
caggcccaccg

SEQ ID NO: 2983847 - RNA, 14 nt, Mycobacterium avium subsp. paratuberculosis
caggcccaccgucg

SEQ ID NO: 2983848 - RNA, 14 nt, Mycobacterium avium subsp. paratuberculosis
caggcccagcagca

SEQ ID NO: 2983849 - RNA, 16 nt, Mycobacterium avium subsp. paratuberculosis
caggcccagcagcacc

SEQ ID NO: 2983850 - RNA, 17 nt, Mycobacterium avium subsp. paratuberculosis
caggcccagcagcaccg

SEQ ID NO: 2983851 - RNA, 19 nt, Mycobacterium avium subsp. paratuberculosis
caggcccagcagcaccgcg

SEQ ID NO: 2983852 - RNA, 20 nt, Mycobacterium avium subsp. paratuberculosis
caggcccagcagcaccgcga

SEQ ID NO: 2983853 - RNA, 16 nt, Mycobacterium avium subsp. paratuberculosis
caggcccagcagcgca

SEQ ID NO: 2983854 - RNA, 17 nt, Mycobacterium avium subsp. paratuberculosis
caggcccagcagcgcac

SEQ ID NO: 2983855 - RNA, 20 nt, Mycobacterium avium subsp. paratuberculosis
caggcccagcagcgcaccgg

SEQ ID NO: 2983856 - RNA, 12 nt, Mycobacterium avium subsp. paratuberculosis
caggcccagccc

SEQ ID NO: 2983857 - RNA, 23 nt, Mycobacterium avium subsp. paratuberculosis
caggcccagcgaggcggccagcg

SEQ ID NO: 2983858 - RNA, 16 nt, Mycobacterium avium subsp. paratuberculosis
caggcccagcugcugg

SEQ ID NO: 2983859 - RNA, 22 nt, Mycobacterium avium subsp. paratuberculosis
caggcccagcugcuggaaucgc

SEQ ID NO: 2983860 - RNA, 11 nt, Mycobacterium avium subsp. paratuberculosis
caggcccaggc

SEQ ID NO: 2983861 - RNA, 17 nt, Mycobacterium avium subsp. paratuberculosis
caggcccaggccgacgc

SEQ ID NO: 2983862 - RNA, 16 nt, Mycobacterium avium subsp. paratuberculosis
caggcccaggccgaug

SEQ ID NO: 2983863 - RNA, 15 nt, Mycobacterium avium subsp. paratuberculosis
caggcccaggcgacc

SEQ ID NO: 2983864 - RNA, 12 nt, Mycobacterium avium subsp. paratuberculosis
caggccccaccc

SEQ ID NO: 2983865 - RNA, 13 nt, Mycobacterium avium subsp. paratuberculosis
caggccccacccg

SEQ ID NO: 2983866 - RNA, 14 nt, Mycobacterium avium subsp. paratuberculosis
caggccccacccgc

SEQ ID NO: 2983867 - RNA, 16 nt, Mycobacterium avium subsp. paratuberculosis
caggccccacccgcag

SEQ ID NO: 2983868 - RNA, 17 nt, Mycobacterium avium subsp. paratuberculosis
caggccccacccgcagu

SEQ ID NO: 2983869 - RNA, 23 nt, Mycobacterium avium subsp. paratuberculosis
caggccccggauccgucgccccg

SEQ ID NO: 2983870 - RNA, 16 nt, Mycobacterium avium subsp. paratuberculosis
caggccccggccgagc

SEQ ID NO: 2983871 - RNA, 23 nt, Mycobacterium avium subsp. paratuberculosis
caggccccguucgguggccaccg

SEQ ID NO: 2983872 - RNA, 17 nt, Mycobacterium avium subsp. paratuberculosis
caggccccuccagcugg

SEQ ID NO: 2983873 - RNA, 18 nt, Mycobacterium avium subsp. paratuberculosis
caggcccgagcccgacgg

SEQ ID NO: 2983874 - RNA, 13 nt, Mycobacterium avium subsp. paratuberculosis
caggcccgcgccg

SEQ ID NO: 2983875 - RNA, 14 nt, Mycobacterium avium subsp. paratuberculosis
caggcccgcgccga

SEQ ID NO: 2983876 - RNA, 16 nt, Mycobacterium avium subsp. paratuberculosis
caggcccgcgccgacg

SEQ ID NO: 2983877 - RNA, 15 nt, Mycobacterium avium subsp. paratuberculosis
caggcccggcaccgg

SEQ ID NO: 2983878 - RNA, 16 nt, Mycobacterium avium subsp. paratuberculosis
caggcccgggcggcga

SEQ ID NO: 2983879 - RNA, 13 nt, Mycobacterium avium subsp. paratuberculosis
caggcccggguag

SEQ ID NO: 2983880 - RNA, 19 nt, Mycobacterium avium subsp. paratuberculosis
caggcccggguagcgcagc

SEQ ID NO: 2983881 - RNA, 23 nt, Mycobacterium avium subsp. paratuberculosis
caggcccgguagauauggcccuc

SEQ ID NO: 2983882 - RNA, 17 nt, Mycobacterium avium subsp. paratuberculosis
caggcccucaucgucga

SEQ ID NO: 2983883 - RNA, 18 nt, Mycobacterium avium subsp. paratuberculosis
caggcccucaucgucgac

SEQ ID NO: 2983884 - RNA, 19 nt, Mycobacterium avium subsp. paratuberculosis
caggcccucaucgucgacc

SEQ ID NO: 2983885 - RNA, 23 nt, Mycobacterium avium subsp. paratuberculosis
caggcccuccugggugaguucgu

SEQ ID NO: 2983886 - RNA, 14 nt, Mycobacterium avium subsp. paratuberculosis
caggcccucgacgu

SEQ ID NO: 2983887 - RNA, 17 nt, Mycobacterium avium subsp. paratuberculosis
caggcccucgccgcggu

SEQ ID NO: 2983888 - RNA, 13 nt, Mycobacterium avium subsp. paratuberculosis
caggcccucggcc

SEQ ID NO: 2983889 - RNA, 17 nt, Mycobacterium avium subsp. paratuberculosis
caggcccucggccagcc

SEQ ID NO: 2983890 - RNA, 14 nt, Mycobacterium avium subsp. paratuberculosis
caggcccucgucgg

SEQ ID NO: 2983891 - RNA, 15 nt, Mycobacterium avium subsp. paratuberculosis
caggcccugccagcg

SEQ ID NO: 2983892 - RNA, 16 nt, Mycobacterium avium subsp. paratuberculosis
caggcccugccagcgc

SEQ ID NO: 2983893 - RNA, 17 nt, Mycobacterium avium subsp. paratuberculosis
caggcccugcccgaagc

SEQ ID NO: 2983894 - RNA, 16 nt, Mycobacterium avium subsp. paratuberculosis
caggcccuugccccac

SEQ ID NO: 2983895 - RNA, 19 nt, Mycobacterium avium subsp. paratuberculosis
caggcccuugccccaccac

SEQ ID NO: 2983896 - RNA, 20 nt, Mycobacterium avium subsp. paratuberculosis
caggcccuugccccaccacc

SEQ ID NO: 2983897 - RNA, 21 nt, Mycobacterium avium subsp. paratuberculosis
caggcccuugccccaccaccg

SEQ ID NO: 2983898 - RNA, 17 nt, Mycobacterium avium subsp. paratuberculosis
caggccgaacagcagcg

SEQ ID NO: 2983899 - RNA, 19 nt, Mycobacterium avium subsp. paratuberculosis
caggccgaacagcagcgaa

SEQ ID NO: 2983900 - RNA, 13 nt, Mycobacterium avium subsp. paratuberculosis
caggccgacgcug

SEQ ID NO: 2983901 - RNA, 15 nt, Mycobacterium avium subsp. paratuberculosis
caggccgacgcuggc

SEQ ID NO: 2983902 - RNA, 14 nt, Mycobacterium avium subsp. paratuberculosis
caggccgagcgcgc

SEQ ID NO: 2983903 - RNA, 23 nt, Mycobacterium avium subsp. paratuberculosis
caggccgaggcugacgaucgucg

SEQ ID NO: 2983904 - RNA, 15 nt, Mycobacterium avium subsp. paratuberculosis
caggccgaguauccg

SEQ ID NO: 2983905 - RNA, 20 nt, Mycobacterium avium subsp. paratuberculosis
caggccgaguauccgcgcag

SEQ ID NO: 2983906 - RNA, 21 nt, Mycobacterium avium subsp. paratuberculosis
caggccgaguauccgcgcagc

SEQ ID NO: 2983907 - RNA, 20 nt, Mycobacterium avium subsp. paratuberculosis
caggccgaugaugaugccgc

SEQ ID NO: 2983908 - RNA, 11 nt, Mycobacterium avium subsp. paratuberculosis
caggccgccag

SEQ ID NO: 2983909 - RNA, 14 nt, Mycobacterium avium subsp. paratuberculosis
caggccgccagcuc

SEQ ID NO: 2983910 - RNA, 23 nt, Mycobacterium avium subsp. paratuberculosis
caggccgcccgacccguccagca

SEQ ID NO: 2983911 - RNA, 13 nt, Mycobacterium avium subsp. paratuberculosis
caggccgcccggc

SEQ ID NO: 2983912 - RNA, 15 nt, Mycobacterium avium subsp. paratuberculosis
caggccgcccggccc

SEQ ID NO: 2983913 - RNA, 17 nt, Mycobacterium avium subsp. paratuberculosis
caggccgcccggcccaa

SEQ ID NO: 2983914 - RNA, 13 nt, Mycobacterium avium subsp. paratuberculosis
caggccgccgacg

SEQ ID NO: 2983915 - RNA, 14 nt, Mycobacterium avium subsp. paratuberculosis
caggccgccgacga

SEQ ID NO: 2983916 - RNA, 12 nt, Mycobacterium avium subsp. paratuberculosis
caggccgccgca

SEQ ID NO: 2983917 - RNA, 13 nt, Mycobacterium avium subsp. paratuberculosis
caggccgccgcau

SEQ ID NO: 2983918 - RNA, 14 nt, Mycobacterium avium subsp. paratuberculosis
caggccgccgcauu

SEQ ID NO: 2983919 - RNA, 22 nt, Mycobacterium avium subsp. paratuberculosis
caggccgccgcauuccucggcc

SEQ ID NO: 2983920 - RNA, 12 nt, Mycobacterium avium subsp. paratuberculosis
caggccgccggg

SEQ ID NO: 2983921 - RNA, 16 nt, Mycobacterium avium subsp. paratuberculosis
caggccgccgggccgc

SEQ ID NO: 2983922 - RNA, 15 nt, Mycobacterium avium subsp. paratuberculosis
caggccgccugcggg

SEQ ID NO: 2983923 - RNA, 20 nt, Mycobacterium avium subsp. paratuberculosis
caggccgcgacgggcugucc

SEQ ID NO: 2983924 - RNA, 21 nt, Mycobacterium avium subsp. paratuberculosis
caggccgcgagcacgacgucg

SEQ ID NO: 2983925 - RNA, 14 nt, Mycobacterium avium subsp. paratuberculosis
caggccgcgccggg

SEQ ID NO: 2983926 - RNA, 13 nt, Mycobacterium avium subsp. paratuberculosis
caggccgcggccg

SEQ ID NO: 2983927 - RNA, 20 nt, Mycobacterium avium subsp. paratuberculosis
caggccgcggccgucgucgu

SEQ ID NO: 2983928 - RNA, 11 nt, Mycobacterium avium subsp. paratuberculosis
caggccgcggg

SEQ ID NO: 2983929 - RNA, 19 nt, Mycobacterium avium subsp. paratuberculosis
caggccgcggguggcgcca

SEQ ID NO: 2983930 - RNA, 20 nt, Mycobacterium avium subsp. paratuberculosis
caggccgcggucgccccggc

SEQ ID NO: 2983931 - RNA, 16 nt, Mycobacterium avium subsp. paratuberculosis
caggccggcagccggc

SEQ ID NO: 2983932 - RNA, 20 nt, Mycobacterium avium subsp. paratuberculosis
caggccggcagccggcgcgg

SEQ ID NO: 2983933 - RNA, 14 nt, Mycobacterium avium subsp. paratuberculosis
caggccggccacca

SEQ ID NO: 2983934 - RNA, 16 nt, Mycobacterium avium subsp. paratuberculosis
caggccggccaccagg

SEQ ID NO: 2983935 - RNA, 12 nt, Mycobacterium avium subsp. paratuberculosis
caggccggccgc

SEQ ID NO: 2983936 - RNA, 14 nt, Mycobacterium avium subsp. paratuberculosis
caggccggccgcua

SEQ ID NO: 2983937 - RNA, 20 nt, Mycobacterium avium subsp. paratuberculosis
caggccggccgcuacccggc

SEQ ID NO: 2983938 - RNA, 14 nt, Mycobacterium avium subsp. paratuberculosis
caggccggccugcc

SEQ ID NO: 2983939 - RNA, 19 nt, Mycobacterium avium subsp. paratuberculosis
caggccggccugccaccgc

SEQ ID NO: 2983940 - RNA, 20 nt, Mycobacterium avium subsp. paratuberculosis
caggccggccuugcucgccg

SEQ ID NO: 2983941 - RNA, 21 nt, Mycobacterium avium subsp. paratuberculosis
caggccggccuugcucgccgc

SEQ ID NO: 2983942 - RNA, 22 nt, Mycobacterium avium subsp. paratuberculosis
caggccggccuugcucgccgcg

SEQ ID NO: 2983943 - RNA, 13 nt, Mycobacterium avium subsp. paratuberculosis
caggccggcgacg

SEQ ID NO: 2983944 - RNA, 16 nt, Mycobacterium avium subsp. paratuberculosis
caggccggcgacgccg

SEQ ID NO: 2983945 - RNA, 20 nt, Mycobacterium avium subsp. paratuberculosis
caggccggcgacgccggcga

SEQ ID NO: 2983946 - RNA, 16 nt, Mycobacterium avium subsp. paratuberculosis
caggccggcgacggcg

SEQ ID NO: 2983947 - RNA, 17 nt, Mycobacterium avium subsp. paratuberculosis
caggccggcgacggcga

SEQ ID NO: 2983948 - RNA, 23 nt, Mycobacterium avium subsp. paratuberculosis
caggccggcgacggcgaguucga

SEQ ID NO: 2983949 - RNA, 16 nt, Mycobacterium avium subsp. paratuberculosis
caggccggcgagcucg

SEQ ID NO: 2983950 - RNA, 15 nt, Mycobacterium avium subsp. paratuberculosis
caggccggcgccgcg

SEQ ID NO: 2983951 - RNA, 16 nt, Mycobacterium avium subsp. paratuberculosis
caggccggcgccgcgg

SEQ ID NO: 2983952 - RNA, 14 nt, Mycobacterium avium subsp. paratuberculosis
caggccggcgccgg

SEQ ID NO: 2983953 - RNA, 20 nt, Mycobacterium avium subsp. paratuberculosis
caggccggcgccgggaaagu

SEQ ID NO: 2983954 - RNA, 20 nt, Mycobacterium avium subsp. paratuberculosis
caggccggcgguggugccgc

SEQ ID NO: 2983955 - RNA, 22 nt, Mycobacterium avium subsp. paratuberculosis
caggccgggaaugucgcgcagc

SEQ ID NO: 2983956 - RNA, 21 nt, Mycobacterium avium subsp. paratuberculosis
caggccgggauagagcaccgc

SEQ ID NO: 2983957 - RNA, 22 nt, Mycobacterium avium subsp. paratuberculosis
caggccgggauagagcaccgcg

SEQ ID NO: 2983958 - RNA, 23 nt, Mycobacterium avium subsp. paratuberculosis
caggccgggauagagcaccgcgc

SEQ ID NO: 2983959 - RNA, 17 nt, Mycobacterium avium subsp. paratuberculosis
caggccggucacccagg

SEQ ID NO: 2983960 - RNA, 15 nt, Mycobacterium avium subsp. paratuberculosis
caggccggucagcga

SEQ ID NO: 2983961 - RNA, 17 nt, Mycobacterium avium subsp. paratuberculosis
caggccggugcugucca

SEQ ID NO: 2983962 - RNA, 22 nt, Mycobacterium avium subsp. paratuberculosis
caggccggugcuguccacaucg

SEQ ID NO: 2983963 - RNA, 14 nt, Mycobacterium avium subsp. paratuberculosis
caggccgguggcga

SEQ ID NO: 2983964 - RNA, 23 nt, Mycobacterium avium subsp. paratuberculosis
caggccgguggcgacaacaggcg

SEQ ID NO: 2983965 - RNA, 18 nt, Mycobacterium avium subsp. paratuberculosis
caggccguagcgagcgcu

SEQ ID NO: 2983966 - RNA, 15 nt, Mycobacterium avium subsp. paratuberculosis
caggccguagcggcu

SEQ ID NO: 2983967 - RNA, 18 nt, Mycobacterium avium subsp. paratuberculosis
caggccguagcggcucgc

SEQ ID NO: 2983968 - RNA, 16 nt, Mycobacterium avium subsp. paratuberculosis
caggccguccaccaga

SEQ ID NO: 2983969 - RNA, 20 nt, Mycobacterium avium subsp. paratuberculosis
caggccguccaccagaucgc

SEQ ID NO: 2983970 - RNA, 15 nt, Mycobacterium avium subsp. paratuberculosis
caggccguccagcag

SEQ ID NO: 2983971 - RNA, 19 nt, Mycobacterium avium subsp. paratuberculosis
caggccguccagcagcagc

SEQ ID NO: 2983972 - RNA, 19 nt, Mycobacterium avium subsp. paratuberculosis
caggccgucgaggcgcugc

SEQ ID NO: 2983973 - RNA, 16 nt, Mycobacterium avium subsp. paratuberculosis
caggccgucgccgguc

SEQ ID NO: 2983974 - RNA, 15 nt, Mycobacterium avium subsp. paratuberculosis
caggccgucggcgcg

SEQ ID NO: 2983975 - RNA, 17 nt, Mycobacterium avium subsp. paratuberculosis
caggccgucggcgcggc

SEQ ID NO: 2983976 - RNA, 13 nt, Mycobacterium avium subsp. paratuberculosis
caggccgucucga

SEQ ID NO: 2983977 - RNA, 18 nt, Mycobacterium avium subsp. paratuberculosis
caggccgucucgagccgg

SEQ ID NO: 2983978 - RNA, 21 nt, Mycobacterium avium subsp. paratuberculosis
caggccgucucgagccggcgc

SEQ ID NO: 2983979 - RNA, 17 nt, Mycobacterium avium subsp. paratuberculosis
caggccgugaucggcca

SEQ ID NO: 2983980 - RNA, 17 nt, Mycobacterium avium subsp. paratuberculosis
caggccgugcacgaaca

SEQ ID NO: 2983981 - RNA, 17 nt, Mycobacterium avium subsp. paratuberculosis
caggccguuguccgucg

SEQ ID NO: 2983982 - RNA, 18 nt, Mycobacterium avium subsp. paratuberculosis
caggccguuguccgucga

SEQ ID NO: 2983983 - RNA, 18 nt, Mycobacterium avium subsp. paratuberculosis
caggccguuguggccacc

SEQ ID NO: 2983984 - RNA, 20 nt, Mycobacterium avium subsp. paratuberculosis
caggccguuguggccacccu

SEQ ID NO: 2983985 - RNA, 18 nt, Mycobacterium avium subsp. paratuberculosis
caggccucgaggaucgcg

SEQ ID NO: 2983986 - RNA, 18 nt, Mycobacterium avium subsp. paratuberculosis
caggccucuacucagccg

SEQ ID NO: 2983987 - RNA, 18 nt, Mycobacterium avium subsp. paratuberculosis
caggccugguaggccgcc

SEQ ID NO: 2983988 - RNA, 19 nt, Mycobacterium avium subsp. paratuberculosis
caggccuuguacgccccgg

SEQ ID NO: 2983989 - RNA, 20 nt, Mycobacterium avium subsp. paratuberculosis
caggccuuguacgccccgga

SEQ ID NO: 2983990 - RNA, 17 nt, Mycobacterium avium subsp. paratuberculosis
caggccuugucguccuc

SEQ ID NO: 2983991 - RNA, 19 nt, Mycobacterium avium subsp. paratuberculosis
caggccuugucguccucga

SEQ ID NO: 2983992 - RNA, 16 nt, Mycobacterium avium subsp. paratuberculosis
caggcgaacaccucgg

SEQ ID NO: 2983993 - RNA, 19 nt, Mycobacterium avium subsp. paratuberculosis
caggcgaacaccucgguga

SEQ ID NO: 2983994 - RNA, 17 nt, Mycobacterium avium subsp. paratuberculosis
caggcgaacauggcggc

SEQ ID NO: 2983995 - RNA, 19 nt, Mycobacterium avium subsp. paratuberculosis
caggcgaacauggcggcca

SEQ ID NO: 2983996 - RNA, 23 nt, Mycobacterium avium subsp. paratuberculosis
caggcgaacauggcggccagccg

SEQ ID NO: 2983997 - RNA, 15 nt, Mycobacterium avium subsp. paratuberculosis
caggcgaaggucaga

SEQ ID NO: 2983998 - RNA, 22 nt, Mycobacterium avium subsp. paratuberculosis
caggcgaaggugggcagcgcca

SEQ ID NO: 2983999 - RNA, 22 nt, Mycobacterium avium subsp. paratuberculosis
caggcgaaguuggucaccacca

SEQ ID NO: 2984000 - RNA, 23 nt, Mycobacterium avium subsp. paratuberculosis
caggcgaaguuggucaccaccaa

SEQ ID NO: 2984001 - RNA, 16 nt, Mycobacterium avium subsp. paratuberculosis
caggcgaaucggcgca

SEQ ID NO: 2984002 - RNA, 17 nt, Mycobacterium avium subsp. paratuberculosis
caggcgaaucggcgcac

SEQ ID NO: 2984003 - RNA, 13 nt, Mycobacterium avium subsp. paratuberculosis
caggcgaccggcc

SEQ ID NO: 2984004 - RNA, 14 nt, Mycobacterium avium subsp. paratuberculosis
caggcgaccggccc

SEQ ID NO: 2984005 - RNA, 14 nt, Mycobacterium avium subsp. paratuberculosis
caggcgagcacccg

SEQ ID NO: 2984006 - RNA, 15 nt, Mycobacterium avium subsp. paratuberculosis
caggcgagcacccgg

SEQ ID NO: 2984007 - RNA, 15 nt, Mycobacterium avium subsp. paratuberculosis
caggcgagccgacag

SEQ ID NO: 2984008 - RNA, 13 nt, Mycobacterium avium subsp. paratuberculosis
caggcgagccggu

SEQ ID NO: 2984009 - RNA, 20 nt, Mycobacterium avium subsp. paratuberculosis
caggcgaguuaugccgucac

SEQ ID NO: 2984010 - RNA, 15 nt, Mycobacterium avium subsp. paratuberculosis
caggcgaucucgccg

SEQ ID NO: 2984011 - RNA, 14 nt, Mycobacterium avium subsp. paratuberculosis
caggcgaugccgcc

SEQ ID NO: 2984012 - RNA, 15 nt, Mycobacterium avium subsp. paratuberculosis
caggcgaugccgccg

SEQ ID NO: 2984013 - RNA, 18 nt, Mycobacterium avium subsp. paratuberculosis
caggcgaugccgccgacg

SEQ ID NO: 2984014 - RNA, 22 nt, Mycobacterium avium subsp. paratuberculosis
caggcgauggcgucggccagcg

SEQ ID NO: 2984015 - RNA, 16 nt, Mycobacterium avium subsp. paratuberculosis
caggcgauggugccgg

SEQ ID NO: 2984016 - RNA, 15 nt, Mycobacterium avium subsp. paratuberculosis
caggcgcaacagcac

SEQ ID NO: 2984017 - RNA, 20 nt, Mycobacterium avium subsp. paratuberculosis
caggcgcaacagcaccucgu

SEQ ID NO: 2984018 - RNA, 22 nt, Mycobacterium avium subsp. paratuberculosis
caggcgcaacagcaccucgucg

SEQ ID NO: 2984019 - RNA, 11 nt, Mycobacterium avium subsp. paratuberculosis
caggcgcacca

SEQ ID NO: 2984020 - RNA, 13 nt, Mycobacterium avium subsp. paratuberculosis
caggcgcaccacc

SEQ ID NO: 2984021 - RNA, 14 nt, Mycobacterium avium subsp. paratuberculosis
caggcgcaccacca

SEQ ID NO: 2984022 - RNA, 17 nt, Mycobacterium avium subsp. paratuberculosis
caggcgcaccaccagcu

SEQ ID NO: 2984023 - RNA, 20 nt, Mycobacterium avium subsp. paratuberculosis
caggcgcaccaccagcucgu

SEQ ID NO: 2984024 - RNA, 14 nt, Mycobacterium avium subsp. paratuberculosis
caggcgcaccagcu

SEQ ID NO: 2984025 - RNA, 15 nt, Mycobacterium avium subsp. paratuberculosis
caggcgcaccagcug

SEQ ID NO: 2984026 - RNA, 16 nt, Mycobacterium avium subsp. paratuberculosis
caggcgcaccagcuga

SEQ ID NO: 2984027 - RNA, 16 nt, Mycobacterium avium subsp. paratuberculosis
caggcgcaccgccacc

SEQ ID NO: 2984028 - RNA, 15 nt, Mycobacterium avium subsp. paratuberculosis
caggcgcagccagcg

SEQ ID NO: 2984029 - RNA, 17 nt, Mycobacterium avium subsp. paratuberculosis
caggcgcagccagcggu

SEQ ID NO: 2984030 - RNA, 22 nt, Mycobacterium avium subsp. paratuberculosis
caggcgcagccagcggucacgg

SEQ ID NO: 2984031 - RNA, 15 nt, Mycobacterium avium subsp. paratuberculosis
caggcgcagcccgag

SEQ ID NO: 2984032 - RNA, 16 nt, Mycobacterium avium subsp. paratuberculosis
caggcgcagcccgagc

SEQ ID NO: 2984033 - RNA, 19 nt, Mycobacterium avium subsp. paratuberculosis
caggcgcagcccgagcggc

SEQ ID NO: 2984034 - RNA, 21 nt, Mycobacterium avium subsp. paratuberculosis
caggcgcagcccgagcggcau

SEQ ID NO: 2984035 - RNA, 22 nt, Mycobacterium avium subsp. paratuberculosis
caggcgcagcccgagcggcauc

SEQ ID NO: 2984036 - RNA, 15 nt, Mycobacterium avium subsp. paratuberculosis
caggcgccacagcag

SEQ ID NO: 2984037 - RNA, 17 nt, Mycobacterium avium subsp. paratuberculosis
caggcgccacagcagca

SEQ ID NO: 2984038 - RNA, 21 nt, Mycobacterium avium subsp. paratuberculosis
caggcgccacagcagcaccag

SEQ ID NO: 2984039 - RNA, 16 nt, Mycobacterium avium subsp. paratuberculosis
caggcgcccagcaccc

SEQ ID NO: 2984040 - RNA, 17 nt, Mycobacterium avium subsp. paratuberculosis
caggcgcccagcacccg

SEQ ID NO: 2984041 - RNA, 16 nt, Mycobacterium avium subsp. paratuberculosis
caggcgcccaggauca

SEQ ID NO: 2984042 - RNA, 12 nt, Mycobacterium avium subsp. paratuberculosis
caggcgccccag

SEQ ID NO: 2984043 - RNA, 21 nt, Mycobacterium avium subsp. paratuberculosis
caggcgccccagcuccucggc

SEQ ID NO: 2984044 - RNA, 16 nt, Mycobacterium avium subsp. paratuberculosis
caggcgcccugcacga

SEQ ID NO: 2984045 - RNA, 18 nt, Mycobacterium avium subsp. paratuberculosis
caggcgcccugcacgaac

SEQ ID NO: 2984046 - RNA, 23 nt, Mycobacterium avium subsp. paratuberculosis
caggcgcccugcacgaacaacug

SEQ ID NO: 2984047 - RNA, 13 nt, Mycobacterium avium subsp. paratuberculosis
caggcgccggcca

SEQ ID NO: 2984048 - RNA, 14 nt, Mycobacterium avium subsp. paratuberculosis
caggcgccggccag

SEQ ID NO: 2984049 - RNA, 11 nt, Mycobacterium avium subsp. paratuberculosis
caggcgccggg

SEQ ID NO: 2984050 - RNA, 13 nt, Mycobacterium avium subsp. paratuberculosis
caggcgccgucga

SEQ ID NO: 2984051 - RNA, 22 nt, Mycobacterium avium subsp. paratuberculosis
caggcgccgucgauggcgcggc

SEQ ID NO: 2984052 - RNA, 13 nt, Mycobacterium avium subsp. paratuberculosis
caggcgcgcagca

SEQ ID NO: 2984053 - RNA, 23 nt, Mycobacterium avium subsp. paratuberculosis
caggcgcgcgcuggugcgggcca

SEQ ID NO: 2984054 - RNA, 17 nt, Mycobacterium avium subsp. paratuberculosis
caggcgcgcggccagcc

SEQ ID NO: 2984055 - RNA, 20 nt, Mycobacterium avium subsp. paratuberculosis
caggcgcgcggccagccccg

SEQ ID NO: 2984056 - RNA, 23 nt, Mycobacterium avium subsp. paratuberculosis
caggcgcgcggccagccccggga

SEQ ID NO: 2984057 - RNA, 21 nt, Mycobacterium avium subsp. paratuberculosis
caggcgcucgucgaugcgcgg

SEQ ID NO: 2984058 - RNA, 13 nt, Mycobacterium avium subsp. paratuberculosis
caggcggaaugca

SEQ ID NO: 2984059 - RNA, 20 nt, Mycobacterium avium subsp. paratuberculosis
caggcggaaugcaggaucgc

SEQ ID NO: 2984060 - RNA, 21 nt, Mycobacterium avium subsp. paratuberculosis
caggcggaaugcaggaucgcg

SEQ ID NO: 2984061 - RNA, 13 nt, Mycobacterium avium subsp. paratuberculosis
caggcggaccugg

SEQ ID NO: 2984062 - RNA, 19 nt, Mycobacterium avium subsp. paratuberculosis
caggcggaccugggugcgc

SEQ ID NO: 2984063 - RNA, 17 nt, Mycobacterium avium subsp. paratuberculosis
caggcggacggcgaccu

SEQ ID NO: 2984064 - RNA, 20 nt, Mycobacterium avium subsp. paratuberculosis
caggcggaucacaucggaca

SEQ ID NO: 2984065 - RNA, 15 nt, Mycobacterium avium subsp. paratuberculosis
caggcggaucggccc

SEQ ID NO: 2984066 - RNA, 19 nt, Mycobacterium avium subsp. paratuberculosis
caggcggccagcaccaguu

SEQ ID NO: 2984067 - RNA, 17 nt, Mycobacterium avium subsp. paratuberculosis
caggcggccggcccggc

SEQ ID NO: 2984068 - RNA, 16 nt, Mycobacterium avium subsp. paratuberculosis
caggcggcgacggccg

SEQ ID NO: 2984069 - RNA, 13 nt, Mycobacterium avium subsp. paratuberculosis
caggcggcgcgca

SEQ ID NO: 2984070 - RNA, 16 nt, Mycobacterium avium subsp. paratuberculosis
caggcggcgcgcagcc

SEQ ID NO: 2984071 - RNA, 19 nt, Mycobacterium avium subsp. paratuberculosis
caggcggcgcgcagccggc

SEQ ID NO: 2984072 - RNA, 14 nt, Mycobacterium avium subsp. paratuberculosis
caggcggcgcgcca

SEQ ID NO: 2984073 - RNA, 11 nt, Mycobacterium avium subsp. paratuberculosis
caggcgggcca

SEQ ID NO: 2984074 - RNA, 15 nt, Mycobacterium avium subsp. paratuberculosis
caggcgggugauccc

SEQ ID NO: 2984075 - RNA, 16 nt, Mycobacterium avium subsp. paratuberculosis
caggcgguagcggcag

SEQ ID NO: 2984076 - RNA, 19 nt, Mycobacterium avium subsp. paratuberculosis
caggcgguggccgaaccgc

SEQ ID NO: 2984077 - RNA, 21 nt, Mycobacterium avium subsp. paratuberculosis
caggcgguggccgaaccgcuc

SEQ ID NO: 2984078 - RNA, 14 nt, Mycobacterium avium subsp. paratuberculosis
caggcggugguggg

SEQ ID NO: 2984079 - RNA, 16 nt, Mycobacterium avium subsp. paratuberculosis
caggcguccagcaccu

SEQ ID NO: 2984080 - RNA, 15 nt, Mycobacterium avium subsp. paratuberculosis
caggcguccagccag

SEQ ID NO: 2984081 - RNA, 17 nt, Mycobacterium avium subsp. paratuberculosis
caggcguccagccagcg

SEQ ID NO: 2984082 - RNA, 15 nt, Mycobacterium avium subsp. paratuberculosis
caggcguccgcaagc

SEQ ID NO: 2984083 - RNA, 19 nt, Mycobacterium avium subsp. paratuberculosis
caggcguccgcaagcaccu

SEQ ID NO: 2984084 - RNA, 16 nt, Mycobacterium avium subsp. paratuberculosis
caggcgucggucagca

SEQ ID NO: 2984085 - RNA, 21 nt, Mycobacterium avium subsp. paratuberculosis
caggcgucggucagcaggcgc

SEQ ID NO: 2984086 - RNA, 13 nt, Mycobacterium avium subsp. paratuberculosis
caggcguggccca

SEQ ID NO: 2984087 - RNA, 15 nt, Mycobacterium avium subsp. paratuberculosis
caggcguggcccagc

SEQ ID NO: 2984088 - RNA, 17 nt, Mycobacterium avium subsp. paratuberculosis
caggcguggcccagccg

SEQ ID NO: 2984089 - RNA, 17 nt, Mycobacterium avium subsp. paratuberculosis
caggcguggucggcgcg

SEQ ID NO: 2984090 - RNA, 18 nt, Mycobacterium avium subsp. paratuberculosis
caggcguggucggcgcgg

SEQ ID NO: 2984091 - RNA, 19 nt, Mycobacterium avium subsp. paratuberculosis
caggcguggucggcgcggu

SEQ ID NO: 2984092 - RNA, 21 nt, Mycobacterium avium subsp. paratuberculosis
caggcguggucggcgcggucc

SEQ ID NO: 2984093 - RNA, 22 nt, Mycobacterium avium subsp. paratuberculosis
caggcguggucggcgcggucca

SEQ ID NO: 2984094 - RNA, 23 nt, Mycobacterium avium subsp. paratuberculosis
caggcguucgaccccaacccgaa

SEQ ID NO: 2984095 - RNA, 16 nt, Mycobacterium avium subsp. paratuberculosis
caggcguugcaccgcg

SEQ ID NO: 2984096 - RNA, 20 nt, Mycobacterium avium subsp. paratuberculosis
caggcguugcaccgcgggca

SEQ ID NO: 2984097 - RNA, 23 nt, Mycobacterium avium subsp. paratuberculosis
caggcguuggucaccaucagcgg

SEQ ID NO: 2984098 - RNA, 21 nt, Mycobacterium avium subsp. paratuberculosis
caggcucacguagucgaccgg

SEQ ID NO: 2984099 - RNA, 13 nt, Mycobacterium avium subsp. paratuberculosis
caggcucagcagc

SEQ ID NO: 2984100 - RNA, 14 nt, Mycobacterium avium subsp. paratuberculosis
caggcucagcagca

SEQ ID NO: 2984101 - RNA, 16 nt, Mycobacterium avium subsp. paratuberculosis
caggcucagcagcacc

SEQ ID NO: 2984102 - RNA, 17 nt, Mycobacterium avium subsp. paratuberculosis
caggcucagcagcaccg

SEQ ID NO: 2984103 - RNA, 22 nt, Mycobacterium avium subsp. paratuberculosis
caggcucaggaucagcagccgu

SEQ ID NO: 2984104 - RNA, 23 nt, Mycobacterium avium subsp. paratuberculosis
caggcucagguaauugggaaagu

SEQ ID NO: 2984105 - RNA, 14 nt, Mycobacterium avium subsp. paratuberculosis
caggcucagguagg

SEQ ID NO: 2984106 - RNA, 13 nt, Mycobacterium avium subsp. paratuberculosis
caggcugaacacc

SEQ ID NO: 2984107 - RNA, 17 nt, Mycobacterium avium subsp. paratuberculosis
caggcugaacaccacca

SEQ ID NO: 2984108 - RNA, 20 nt, Mycobacterium avium subsp. paratuberculosis
caggcugaacgucgucagca

SEQ ID NO: 2984109 - RNA, 15 nt, Mycobacterium avium subsp. paratuberculosis
caggcugaccagcgc

SEQ ID NO: 2984110 - RNA, 20 nt, Mycobacterium avium subsp. paratuberculosis
caggcugaccagcgccucgc

SEQ ID NO: 2984111 - RNA, 21 nt, Mycobacterium avium subsp. paratuberculosis
caggcugaccagcgccucgcg

SEQ ID NO: 2984112 - RNA, 20 nt, Mycobacterium avium subsp. paratuberculosis
caggcugacgccacgcguca

SEQ ID NO: 2984113 - RNA, 20 nt, Mycobacterium avium subsp. paratuberculosis
caggcugacgcgaccgcgcg

SEQ ID NO: 2984114 - RNA, 22 nt, Mycobacterium avium subsp. paratuberculosis
caggcugacgcgaccgcgcggc

SEQ ID NO: 2984115 - RNA, 15 nt, Mycobacterium avium subsp. paratuberculosis
caggcugaucucggc

SEQ ID NO: 2984116 - RNA, 17 nt, Mycobacterium avium subsp. paratuberculosis
caggcugaucucggcgg

SEQ ID NO: 2984117 - RNA, 21 nt, Mycobacterium avium subsp. paratuberculosis
caggcugaucuggaugcggcc

SEQ ID NO: 2984118 - RNA, 14 nt, Mycobacterium avium subsp. paratuberculosis
caggcugcucggcg

SEQ ID NO: 2984119 - RNA, 15 nt, Mycobacterium avium subsp. paratuberculosis
caggcugcucggcgg

SEQ ID NO: 2984120 - RNA, 16 nt, Mycobacterium avium subsp. paratuberculosis
caggcugcucggcggg

SEQ ID NO: 2984121 - RNA, 19 nt, Mycobacterium avium subsp. paratuberculosis
caggcugcucggcgggcuc

SEQ ID NO: 2984122 - RNA, 17 nt, Mycobacterium avium subsp. paratuberculosis
caggcuggacaccacgu

SEQ ID NO: 2984123 - RNA, 14 nt, Mycobacterium avium subsp. paratuberculosis
caggcuggcaucgu

SEQ ID NO: 2984124 - RNA, 20 nt, Mycobacterium avium subsp. paratuberculosis
caggcuggcaucgucggcgc

SEQ ID NO: 2984125 - RNA, 19 nt, Mycobacterium avium subsp. paratuberculosis
caggcuggcaugccggaac

SEQ ID NO: 2984126 - RNA, 15 nt, Mycobacterium avium subsp. paratuberculosis
caggcuggccagcuc

SEQ ID NO: 2984127 - RNA, 19 nt, Mycobacterium avium subsp. paratuberculosis
caggcuggccagcucggcg

SEQ ID NO: 2984128 - RNA, 22 nt, Mycobacterium avium subsp. paratuberculosis
caggcuggccaggcuggcgucg

SEQ ID NO: 2984129 - RNA, 14 nt, Mycobacterium avium subsp. paratuberculosis
caggcuggcggcga

SEQ ID NO: 2984130 - RNA, 16 nt, Mycobacterium avium subsp. paratuberculosis
caggcuggcggcgauc

SEQ ID NO: 2984131 - RNA, 20 nt, Mycobacterium avium subsp. paratuberculosis
caggcuggcguugggcggga

SEQ ID NO: 2984132 - RNA, 24 nt, Mycobacterium avium subsp. paratuberculosis
caggcuggcguugggcgggaucgc

SEQ ID NO: 2984133 - RNA, 14 nt, Mycobacterium avium subsp. paratuberculosis
caggcuugccccgu

SEQ ID NO: 2984134 - RNA, 17 nt, Mycobacterium avium subsp. paratuberculosis
caggcuuggcccgccgc

SEQ ID NO: 2984135 - RNA, 18 nt, Mycobacterium avium subsp. paratuberculosis
caggcuuggcccgccgcc

SEQ ID NO: 2984136 - RNA, 21 nt, Mycobacterium avium subsp. paratuberculosis
caggcuuggcccgccgccggc

SEQ ID NO: 2984137 - RNA, 22 nt, Mycobacterium avium subsp. paratuberculosis
caggcuuggcccgccgccggcg

SEQ ID NO: 2984138 - RNA, 23 nt, Mycobacterium avium subsp. paratuberculosis
caggcuuggcccgccgccggcgc

SEQ ID NO: 2984139 - RNA, 13 nt, Mycobacterium avium subsp. paratuberculosis
cagggaauucagc

SEQ ID NO: 2984140 - RNA, 19 nt, Mycobacterium avium subsp. paratuberculosis
cagggaauucagccugccu

SEQ ID NO: 2984141 - RNA, 14 nt, Mycobacterium avium subsp. paratuberculosis
cagggacaugccga

SEQ ID NO: 2984142 - RNA, 16 nt, Mycobacterium avium subsp. paratuberculosis
cagggacaugccgagc

SEQ ID NO: 2984143 - RNA, 18 nt, Mycobacterium avium subsp. paratuberculosis
cagggacaugccgagcag

SEQ ID NO: 2984144 - RNA, 21 nt, Mycobacterium avium subsp. paratuberculosis
cagggacaugccgagcagcac

SEQ ID NO: 2984145 - RNA, 13 nt, Mycobacterium avium subsp. paratuberculosis
cagggaggacagc

SEQ ID NO: 2984146 - RNA, 17 nt, Mycobacterium avium subsp. paratuberculosis
cagggaggacagcaccg

SEQ ID NO: 2984147 - RNA, 14 nt, Mycobacterium avium subsp. paratuberculosis
cagggaugccccgu

SEQ ID NO: 2984148 - RNA, 16 nt, Mycobacterium avium subsp. paratuberculosis
cagggcaacgaacgcg

SEQ ID NO: 2984149 - RNA, 20 nt, Mycobacterium avium subsp. paratuberculosis
cagggcaacgaacgcggcgc

SEQ ID NO: 2984150 - RNA, 16 nt, Mycobacterium avium subsp. paratuberculosis
cagggcaccgacggcc

SEQ ID NO: 2984151 - RNA, 21 nt, Mycobacterium avium subsp. paratuberculosis
cagggcaccgacggccgcacc

SEQ ID NO: 2984152 - RNA, 16 nt, Mycobacterium avium subsp. paratuberculosis
cagggcagccagcccg

SEQ ID NO: 2984153 - RNA, 19 nt, Mycobacterium avium subsp. paratuberculosis
cagggcagccagcccgcgc

SEQ ID NO: 2984154 - RNA, 23 nt, Mycobacterium avium subsp. paratuberculosis
cagggcagcgcgaccagcccggc

SEQ ID NO: 2984155 - RNA, 21 nt, Mycobacterium avium subsp. paratuberculosis
cagggcagcggugucaccgac

SEQ ID NO: 2984156 - RNA, 15 nt, Mycobacterium avium subsp. paratuberculosis
cagggcauccgggag

SEQ ID NO: 2984157 - RNA, 19 nt, Mycobacterium avium subsp. paratuberculosis
cagggcauccgggaggcca

SEQ ID NO: 2984158 - RNA, 21 nt, Mycobacterium avium subsp. paratuberculosis
cagggcauccgggaggccagc

SEQ ID NO: 2984159 - RNA, 17 nt, Mycobacterium avium subsp. paratuberculosis
cagggccaagacacgcu

SEQ ID NO: 2984160 - RNA, 12 nt, Mycobacterium avium subsp. paratuberculosis
cagggccaccgc

SEQ ID NO: 2984161 - RNA, 13 nt, Mycobacterium avium subsp. paratuberculosis
cagggccaccgcg

SEQ ID NO: 2984162 - RNA, 21 nt, Mycobacterium avium subsp. paratuberculosis
cagggccaccgcgucgcugcc

SEQ ID NO: 2984163 - RNA, 14 nt, Mycobacterium avium subsp. paratuberculosis
cagggccaccguca

SEQ ID NO: 2984164 - RNA, 14 nt, Mycobacterium avium subsp. paratuberculosis
cagggccagcaaca

SEQ ID NO: 2984165 - RNA, 23 nt, Mycobacterium avium subsp. paratuberculosis
cagggccagcaacaccagcugga

SEQ ID NO: 2984166 - RNA, 14 nt, Mycobacterium avium subsp. paratuberculosis
cagggccagcacca

SEQ ID NO: 2984167 - RNA, 14 nt, Mycobacterium avium subsp. paratuberculosis
cagggccagcagcc

SEQ ID NO: 2984168 - RNA, 15 nt, Mycobacterium avium subsp. paratuberculosis
cagggccagcagccc

SEQ ID NO: 2984169 - RNA, 17 nt, Mycobacterium avium subsp. paratuberculosis
cagggccagcagcccgg

SEQ ID NO: 2984170 - RNA, 12 nt, Mycobacterium avium subsp. paratuberculosis
cagggccagcgc

SEQ ID NO: 2984171 - RNA, 15 nt, Mycobacterium avium subsp. paratuberculosis
cagggccagcgccau

SEQ ID NO: 2984172 - RNA, 14 nt, Mycobacterium avium subsp. paratuberculosis
cagggccagcgccu

SEQ ID NO: 2984173 - RNA, 13 nt, Mycobacterium avium subsp. paratuberculosis
cagggccagcggc

SEQ ID NO: 2984174 - RNA, 14 nt, Mycobacterium avium subsp. paratuberculosis
cagggccagcggca

SEQ ID NO: 2984175 - RNA, 16 nt, Mycobacterium avium subsp. paratuberculosis
cagggccagcggcaac

SEQ ID NO: 2984176 - RNA, 19 nt, Mycobacterium avium subsp. paratuberculosis
cagggccagguucaggccc

SEQ ID NO: 2984177 - RNA, 16 nt, Mycobacterium avium subsp. paratuberculosis
cagggcccacagcagc

SEQ ID NO: 2984178 - RNA, 17 nt, Mycobacterium avium subsp. paratuberculosis
cagggccccguuggugc

SEQ ID NO: 2984179 - RNA, 14 nt, Mycobacterium avium subsp. paratuberculosis
cagggcccgcagcc

SEQ ID NO: 2984180 - RNA, 15 nt, Mycobacterium avium subsp. paratuberculosis
cagggcccgcagccg

SEQ ID NO: 2984181 - RNA, 13 nt, Mycobacterium avium subsp. paratuberculosis
cagggccgccgca

SEQ ID NO: 2984182 - RNA, 22 nt, Mycobacterium avium subsp. paratuberculosis
cagggccgccgcauaccgcccg

SEQ ID NO: 2984183 - RNA, 11 nt, Mycobacterium avium subsp. paratuberculosis
cagggccgcga

SEQ ID NO: 2984184 - RNA, 13 nt, Mycobacterium avium subsp. paratuberculosis
cagggccgcgcgg

SEQ ID NO: 2984185 - RNA, 18 nt, Mycobacterium avium subsp. paratuberculosis
cagggccgcgcgggcgac

SEQ ID NO: 2984186 - RNA, 21 nt, Mycobacterium avium subsp. paratuberculosis
cagggccgcgcgggcgaccug

SEQ ID NO: 2984187 - RNA, 12 nt, Mycobacterium avium subsp. paratuberculosis
cagggccgcggc

SEQ ID NO: 2984188 - RNA, 14 nt, Mycobacterium avium subsp. paratuberculosis
cagggccgcggccg

SEQ ID NO: 2984189 - RNA, 19 nt, Mycobacterium avium subsp. paratuberculosis
cagggccgcuacgccgagg

SEQ ID NO: 2984190 - RNA, 12 nt, Mycobacterium avium subsp. paratuberculosis
cagggccgggcg

SEQ ID NO: 2984191 - RNA, 15 nt, Mycobacterium avium subsp. paratuberculosis
cagggccucggcgac

SEQ ID NO: 2984192 - RNA, 18 nt, Mycobacterium avium subsp. paratuberculosis
cagggccucggcgaccgc

SEQ ID NO: 2984193 - RNA, 19 nt, Mycobacterium avium subsp. paratuberculosis
cagggccucggcgaccgcc

SEQ ID NO: 2984194 - RNA, 14 nt, Mycobacterium avium subsp. paratuberculosis
cagggccucgucgu

SEQ ID NO: 2984195 - RNA, 22 nt, Mycobacterium avium subsp. paratuberculosis
cagggccucgucgucgucgagc

SEQ ID NO: 2984196 - RNA, 23 nt, Mycobacterium avium subsp. paratuberculosis
cagggccucgucgucgucgagca

SEQ ID NO: 2984197 - RNA, 14 nt, Mycobacterium avium subsp. paratuberculosis
cagggccugcagca

SEQ ID NO: 2984198 - RNA, 16 nt, Mycobacterium avium subsp. paratuberculosis
cagggcgacaucggca

SEQ ID NO: 2984199 - RNA, 14 nt, Mycobacterium avium subsp. paratuberculosis
cagggcgaccgccg

SEQ ID NO: 2984200 - RNA, 16 nt, Mycobacterium avium subsp. paratuberculosis
cagggcgaccgccgcg

SEQ ID NO: 2984201 - RNA, 22 nt, Mycobacterium avium subsp. paratuberculosis
cagggcgaccgccgcguacagc

SEQ ID NO: 2984202 - RNA, 21 nt, Mycobacterium avium subsp. paratuberculosis
cagggcgacgccgcggaagcc

SEQ ID NO: 2984203 - RNA, 14 nt, Mycobacterium avium subsp. paratuberculosis
cagggcgacggcgg

SEQ ID NO: 2984204 - RNA, 19 nt, Mycobacterium avium subsp. paratuberculosis
cagggcgacggcggcgacg

SEQ ID NO: 2984205 - RNA, 17 nt, Mycobacterium avium subsp. paratuberculosis
cagggcgacuccggcgc

SEQ ID NO: 2984206 - RNA, 18 nt, Mycobacterium avium subsp. paratuberculosis
cagggcgacuccggcgcc

SEQ ID NO: 2984207 - RNA, 22 nt, Mycobacterium avium subsp. paratuberculosis
cagggcgacuccggcgccgguc

SEQ ID NO: 2984208 - RNA, 18 nt, Mycobacterium avium subsp. paratuberculosis
cagggcgaggaacccgac

SEQ ID NO: 2984209 - RNA, 19 nt, Mycobacterium avium subsp. paratuberculosis
cagggcgaggaacccgacc

SEQ ID NO: 2984210 - RNA, 20 nt, Mycobacterium avium subsp. paratuberculosis
cagggcgaggaacccgaccg

SEQ ID NO: 2984211 - RNA, 21 nt, Mycobacterium avium subsp. paratuberculosis
cagggcgaggaacccgaccgc

SEQ ID NO: 2984212 - RNA, 24 nt, Mycobacterium avium subsp. paratuberculosis
cagggcgauaaccucggcggcggc

SEQ ID NO: 2984213 - RNA, 15 nt, Mycobacterium avium subsp. paratuberculosis
cagggcgaucaccgc

SEQ ID NO: 2984214 - RNA, 19 nt, Mycobacterium avium subsp. paratuberculosis
cagggcgaucaccgcggcc

SEQ ID NO: 2984215 - RNA, 14 nt, Mycobacterium avium subsp. paratuberculosis
cagggcgccgacga

SEQ ID NO: 2984216 - RNA, 14 nt, Mycobacterium avium subsp. paratuberculosis
cagggcgccgguga

SEQ ID NO: 2984217 - RNA, 16 nt, Mycobacterium avium subsp. paratuberculosis
cagggcgccggugaag

SEQ ID NO: 2984218 - RNA, 16 nt, Mycobacterium avium subsp. paratuberculosis
cagggcgcgcaccggu

SEQ ID NO: 2984219 - RNA, 17 nt, Mycobacterium avium subsp. paratuberculosis
cagggcgcgcaccgguu

SEQ ID NO: 2984220 - RNA, 22 nt, Mycobacterium avium subsp. paratuberculosis
cagggcgcgcaucugcucggcg

SEQ ID NO: 2984221 - RNA, 20 nt, Mycobacterium avium subsp. paratuberculosis
cagggcgcgcugucgacgcg

SEQ ID NO: 2984222 - RNA, 14 nt, Mycobacterium avium subsp. paratuberculosis
cagggcggcaccga

SEQ ID NO: 2984223 - RNA, 22 nt, Mycobacterium avium subsp. paratuberculosis
cagggcggcaccgaucggcacg

SEQ ID NO: 2984224 - RNA, 24 nt, Mycobacterium avium subsp. paratuberculosis
cagggcggcaccgaucggcacguc

SEQ ID NO: 2984225 - RNA, 12 nt, Mycobacterium avium subsp. paratuberculosis
cagggcggccgg

SEQ ID NO: 2984226 - RNA, 19 nt, Mycobacterium avium subsp. paratuberculosis
cagggcggcgaucgagggg

SEQ ID NO: 2984227 - RNA, 14 nt, Mycobacterium avium subsp. paratuberculosis
cagggcggcgccgc

SEQ ID NO: 2984228 - RNA, 17 nt, Mycobacterium avium subsp. paratuberculosis
cagggcggcgccgcggc

SEQ ID NO: 2984229 - RNA, 18 nt, Mycobacterium avium subsp. paratuberculosis
cagggcggcgccgcggcc

SEQ ID NO: 2984230 - RNA, 19 nt, Mycobacterium avium subsp. paratuberculosis
cagggcggcgccgcggccc

SEQ ID NO: 2984231 - RNA, 13 nt, Mycobacterium avium subsp. paratuberculosis
cagggcggcgcgc

SEQ ID NO: 2984232 - RNA, 15 nt, Mycobacterium avium subsp. paratuberculosis
cagggcggcgggccc

SEQ ID NO: 2984233 - RNA, 12 nt, Mycobacterium avium subsp. paratuberculosis
cagggcgggcag

SEQ ID NO: 2984234 - RNA, 17 nt, Mycobacterium avium subsp. paratuberculosis
cagggcgggcaggcccg

SEQ ID NO: 2984235 - RNA, 15 nt, Mycobacterium avium subsp. paratuberculosis
cagggcggugcggug

SEQ ID NO: 2984236 - RNA, 15 nt, Mycobacterium avium subsp. paratuberculosis
cagggcgguggcggc

SEQ ID NO: 2984237 - RNA, 22 nt, Mycobacterium avium subsp. paratuberculosis
cagggcgguggcggcgaacgcg

SEQ ID NO: 2984238 - RNA, 14 nt, Mycobacterium avium subsp. paratuberculosis
cagggcgucgagcg

SEQ ID NO: 2984239 - RNA, 16 nt, Mycobacterium avium subsp. paratuberculosis
cagggcgucgagcgcg

SEQ ID NO: 2984240 - RNA, 19 nt, Mycobacterium avium subsp. paratuberculosis
cagggcgucgagcgcgucg

SEQ ID NO: 2984241 - RNA, 17 nt, Mycobacterium avium subsp. paratuberculosis
cagggcgucggacaugc

SEQ ID NO: 2984242 - RNA, 23 nt, Mycobacterium avium subsp. paratuberculosis
cagggcgucggacaugccggcgc

SEQ ID NO: 2984243 - RNA, 19 nt, Mycobacterium avium subsp. paratuberculosis
cagggcgugcgcggccgcc

SEQ ID NO: 2984244 - RNA, 19 nt, Mycobacterium avium subsp. paratuberculosis
cagggcguggaacgcgucg

SEQ ID NO: 2984245 - RNA, 17 nt, Mycobacterium avium subsp. paratuberculosis
cagggcguucgacgucc

SEQ ID NO: 2984246 - RNA, 14 nt, Mycobacterium avium subsp. paratuberculosis
caggggcagcagca

SEQ ID NO: 2984247 - RNA, 15 nt, Mycobacterium avium subsp. paratuberculosis
caggggcagcagcag

SEQ ID NO: 2984248 - RNA, 21 nt, Mycobacterium avium subsp. paratuberculosis
caggggcagcugauagcccgc

SEQ ID NO: 2984249 - RNA, 22 nt, Mycobacterium avium subsp. paratuberculosis
caggggcagcugauagcccgcc

SEQ ID NO: 2984250 - RNA, 19 nt, Mycobacterium avium subsp. paratuberculosis
cagggggaguagucggcga

SEQ ID NO: 2984251 - RNA, 20 nt, Mycobacterium avium subsp. paratuberculosis
cagggggaguagucggcgau

SEQ ID NO: 2984252 - RNA, 14 nt, Mycobacterium avium subsp. paratuberculosis
cagggggcgcagcc

SEQ ID NO: 2984253 - RNA, 15 nt, Mycobacterium avium subsp. paratuberculosis
cagggggcgcagccg

SEQ ID NO: 2984254 - RNA, 19 nt, Mycobacterium avium subsp. paratuberculosis
cagggggcgcagccgaucg

SEQ ID NO: 2984255 - RNA, 16 nt, Mycobacterium avium subsp. paratuberculosis
cagggguuggcgcgca

SEQ ID NO: 2984256 - RNA, 17 nt, Mycobacterium avium subsp. paratuberculosis
caggguagaggcggcga

SEQ ID NO: 2984257 - RNA, 21 nt, Mycobacterium avium subsp. paratuberculosis
caggguagaggcggcgaccgc

SEQ ID NO: 2984258 - RNA, 15 nt, Mycobacterium avium subsp. paratuberculosis
cagggucagcagcac

SEQ ID NO: 2984259 - RNA, 22 nt, Mycobacterium avium subsp. paratuberculosis
cagggucagcuuggagccgagc

SEQ ID NO: 2984260 - RNA, 18 nt, Mycobacterium avium subsp. paratuberculosis
cagggucaucgcgccgga

SEQ ID NO: 2984261 - RNA, 12 nt, Mycobacterium avium subsp. paratuberculosis
caggguccaggg

SEQ ID NO: 2984262 - RNA, 22 nt, Mycobacterium avium subsp. paratuberculosis
caggguccagggcgggucgucg

SEQ ID NO: 2984263 - RNA, 23 nt, Mycobacterium avium subsp. paratuberculosis
caggguccagggcgggucgucga

SEQ ID NO: 2984264 - RNA, 14 nt, Mycobacterium avium subsp. paratuberculosis
caggguccgccguc

SEQ ID NO: 2984265 - RNA, 19 nt, Mycobacterium avium subsp. paratuberculosis
cagggucgagaucagcacc

SEQ ID NO: 2984266 - RNA, 20 nt, Mycobacterium avium subsp. paratuberculosis
cagggucgagaucagcaccg

SEQ ID NO: 2984267 - RNA, 21 nt, Mycobacterium avium subsp. paratuberculosis
cagggucgagaucagcaccgg

SEQ ID NO: 2984268 - RNA, 15 nt, Mycobacterium avium subsp. paratuberculosis
cagggucgcggagcg

SEQ ID NO: 2984269 - RNA, 16 nt, Mycobacterium avium subsp. paratuberculosis
cagggucgcggagcgg

SEQ ID NO: 2984270 - RNA, 20 nt, Mycobacterium avium subsp. paratuberculosis
cagggucgcggagcggguca

SEQ ID NO: 2984271 - RNA, 17 nt, Mycobacterium avium subsp. paratuberculosis
cagggucguucagcuga

SEQ ID NO: 2984272 - RNA, 20 nt, Mycobacterium avium subsp. paratuberculosis
cagggucucgcgcagcacga

SEQ ID NO: 2984273 - RNA, 15 nt, Mycobacterium avium subsp. paratuberculosis
cagggucucgggcag

SEQ ID NO: 2984274 - RNA, 22 nt, Mycobacterium avium subsp. paratuberculosis
cagggucucgggcagcagcacc

SEQ ID NO: 2984275 - RNA, 18 nt, Mycobacterium avium subsp. paratuberculosis
cagggucuggcccggugc

SEQ ID NO: 2984276 - RNA, 20 nt, Mycobacterium avium subsp. paratuberculosis
cagggucuggcccggugcga

SEQ ID NO: 2984277 - RNA, 23 nt, Mycobacterium avium subsp. paratuberculosis
cagggugacgcgaaugucgacca

SEQ ID NO: 2984278 - RNA, 19 nt, Mycobacterium avium subsp. paratuberculosis
cagggugacguggcggccg

SEQ ID NO: 2984279 - RNA, 23 nt, Mycobacterium avium subsp. paratuberculosis
cagggugcaggcccgggcggcga

SEQ ID NO: 2984280 - RNA, 12 nt, Mycobacterium avium subsp. paratuberculosis
cagggugccccg

SEQ ID NO: 2984281 - RNA, 16 nt, Mycobacterium avium subsp. paratuberculosis
cagggugccccgcacc

SEQ ID NO: 2984282 - RNA, 21 nt, Mycobacterium avium subsp. paratuberculosis
cagggugccccgcaccgccag

SEQ ID NO: 2984283 - RNA, 19 nt, Mycobacterium avium subsp. paratuberculosis
cagggugccccgcgaccgc

SEQ ID NO: 2984284 - RNA, 23 nt, Mycobacterium avium subsp. paratuberculosis
cagggugccccgcgaccgcagca

SEQ ID NO: 2984285 - RNA, 16 nt, Mycobacterium avium subsp. paratuberculosis
cagggugccgaacagc

SEQ ID NO: 2984286 - RNA, 18 nt, Mycobacterium avium subsp. paratuberculosis
cagggugccgaacagcga

SEQ ID NO: 2984287 - RNA, 20 nt, Mycobacterium avium subsp. paratuberculosis
cagggugccgaacagcgacg

SEQ ID NO: 2984288 - RNA, 14 nt, Mycobacterium avium subsp. paratuberculosis
cagggugccgacga

SEQ ID NO: 2984289 - RNA, 16 nt, Mycobacterium avium subsp. paratuberculosis
cagggugccgacgacc

SEQ ID NO: 2984290 - RNA, 21 nt, Mycobacterium avium subsp. paratuberculosis
cagggugccgauguaggacag

SEQ ID NO: 2984291 - RNA, 11 nt, Mycobacterium avium subsp. paratuberculosis
cagggugccgc

SEQ ID NO: 2984292 - RNA, 16 nt, Mycobacterium avium subsp. paratuberculosis
cagggugccgccgccc

SEQ ID NO: 2984293 - RNA, 14 nt, Mycobacterium avium subsp. paratuberculosis
cagggugccgccgg

SEQ ID NO: 2984294 - RNA, 15 nt, Mycobacterium avium subsp. paratuberculosis
cagggugccgccggg

SEQ ID NO: 2984295 - RNA, 16 nt, Mycobacterium avium subsp. paratuberculosis
cagggugccgccgggc

SEQ ID NO: 2984296 - RNA, 24 nt, Mycobacterium avium subsp. paratuberculosis
cagggugccgccgggcaccucggc

SEQ ID NO: 2984297 - RNA, 14 nt, Mycobacterium avium subsp. paratuberculosis
cagggugccgcugc

SEQ ID NO: 2984298 - RNA, 22 nt, Mycobacterium avium subsp. paratuberculosis
cagggugccgcugcccgccgcg

SEQ ID NO: 2984299 - RNA, 23 nt, Mycobacterium avium subsp. paratuberculosis
cagggugcgcacgaucugcaggc

SEQ ID NO: 2984300 - RNA, 14 nt, Mycobacterium avium subsp. paratuberculosis
cagggugcgcagcg

SEQ ID NO: 2984301 - RNA, 16 nt, Mycobacterium avium subsp. paratuberculosis
cagggugcucagccgc

SEQ ID NO: 2984302 - RNA, 14 nt, Mycobacterium avium subsp. paratuberculosis
caggguggccagca

SEQ ID NO: 2984303 - RNA, 16 nt, Mycobacterium avium subsp. paratuberculosis
caggguggccagcacg

SEQ ID NO: 2984304 - RNA, 18 nt, Mycobacterium avium subsp. paratuberculosis
caggguggccccagcccg

SEQ ID NO: 2984305 - RNA, 14 nt, Mycobacterium avium subsp. paratuberculosis
caggguggccgcca

SEQ ID NO: 2984306 - RNA, 18 nt, Mycobacterium avium subsp. paratuberculosis
caggguggccgccaccag

SEQ ID NO: 2984307 - RNA, 22 nt, Mycobacterium avium subsp. paratuberculosis
caggguggccucgucggcgccg

SEQ ID NO: 2984308 - RNA, 13 nt, Mycobacterium avium subsp. paratuberculosis
caggguggggauc

SEQ ID NO: 2984309 - RNA, 20 nt, Mycobacterium avium subsp. paratuberculosis
caggguggggaucacgucgg

SEQ ID NO: 2984310 - RNA, 22 nt, Mycobacterium avium subsp. paratuberculosis
caggguggggaucacgucggcg

SEQ ID NO: 2984311 - RNA, 16 nt, Mycobacterium avium subsp. paratuberculosis
caggguggucagcguc

SEQ ID NO: 2984312 - RNA, 20 nt, Mycobacterium avium subsp. paratuberculosis
caggguggugcccccgcccg

SEQ ID NO: 2984313 - RNA, 22 nt, Mycobacterium avium subsp. paratuberculosis
caggguggugcccccgcccggc

SEQ ID NO: 2984314 - RNA, 20 nt, Mycobacterium avium subsp. paratuberculosis
caggguggugguggugccca

SEQ ID NO: 2984315 - RNA, 16 nt, Mycobacterium avium subsp. paratuberculosis
caggguguaggccgcg

SEQ ID NO: 2984316 - RNA, 16 nt, Mycobacterium avium subsp. paratuberculosis
cagggugucccagcgc

SEQ ID NO: 2984317 - RNA, 17 nt, Mycobacterium avium subsp. paratuberculosis
cagggugucccagcgcc

SEQ ID NO: 2984318 - RNA, 14 nt, Mycobacterium avium subsp. paratuberculosis
cagggugucgaaca

SEQ ID NO: 2984319 - RNA, 19 nt, Mycobacterium avium subsp. paratuberculosis
cagggugucgaacagcagg

SEQ ID NO: 2984320 - RNA, 20 nt, Mycobacterium avium subsp. paratuberculosis
cagggugucgaacagcaggc

SEQ ID NO: 2984321 - RNA, 22 nt, Mycobacterium avium subsp. paratuberculosis
cagggugucgucgcgcacccag

SEQ ID NO: 2984322 - RNA, 14 nt, Mycobacterium avium subsp. paratuberculosis
cagggugucgucgu

SEQ ID NO: 2984323 - RNA, 15 nt, Mycobacterium avium subsp. paratuberculosis
cagggugucgucguc

SEQ ID NO: 2984324 - RNA, 23 nt, Mycobacterium avium subsp. paratuberculosis
caggguguuguccgagccgccca

SEQ ID NO: 2984325 - RNA, 21 nt, Mycobacterium avium subsp. paratuberculosis
caggguucucgcggcggccga

SEQ ID NO: 2984326 - RNA, 24 nt, Mycobacterium avium subsp. paratuberculosis
caggguucucgcggcggccgacgc

SEQ ID NO: 2984327 - RNA, 15 nt, Mycobacterium avium subsp. paratuberculosis
caggguuggucggag

SEQ ID NO: 2984328 - RNA, 18 nt, Mycobacterium avium subsp. paratuberculosis
caggguuggucggagccg

SEQ ID NO: 2984329 - RNA, 14 nt, Mycobacterium avium subsp. paratuberculosis
caggguuuccucga

SEQ ID NO: 2984330 - RNA, 17 nt, Mycobacterium avium subsp. paratuberculosis
caggguuuucacgucga

SEQ ID NO: 2984331 - RNA, 18 nt, Mycobacterium avium subsp. paratuberculosis
caggguuuucacgucgag

SEQ ID NO: 2984332 - RNA, 22 nt, Mycobacterium avium subsp. paratuberculosis
caggguuuucacgucgagcggc

SEQ ID NO: 2984333 - RNA, 17 nt, Mycobacterium avium subsp. paratuberculosis
cagguaaaccagcagcg

SEQ ID NO: 2984334 - RNA, 19 nt, Mycobacterium avium subsp. paratuberculosis
cagguaaaccagcagcgcc

SEQ ID NO: 2984335 - RNA, 22 nt, Mycobacterium avium subsp. paratuberculosis
cagguaaucgaaggccaggugc

SEQ ID NO: 2984336 - RNA, 14 nt, Mycobacterium avium subsp. paratuberculosis
cagguacacguagc

SEQ ID NO: 2984337 - RNA, 15 nt, Mycobacterium avium subsp. paratuberculosis
cagguacacguagcg

SEQ ID NO: 2984338 - RNA, 18 nt, Mycobacterium avium subsp. paratuberculosis
cagguacagggucaucgc

SEQ ID NO: 2984339 - RNA, 15 nt, Mycobacterium avium subsp. paratuberculosis
cagguaccggcgggc

SEQ ID NO: 2984340 - RNA, 19 nt, Mycobacterium avium subsp. paratuberculosis
cagguaccgguuccgggcg

SEQ ID NO: 2984341 - RNA, 13 nt, Mycobacterium avium subsp. paratuberculosis
cagguacgcgacg

SEQ ID NO: 2984342 - RNA, 15 nt, Mycobacterium avium subsp. paratuberculosis
cagguacgcgacggg

SEQ ID NO: 2984343 - RNA, 18 nt, Mycobacterium avium subsp. paratuberculosis
cagguacgcgacgggcau

SEQ ID NO: 2984344 - RNA, 13 nt, Mycobacterium avium subsp. paratuberculosis
cagguacgcggcg

SEQ ID NO: 2984345 - RNA, 22 nt, Mycobacterium avium subsp. paratuberculosis
cagguacgcggcguugccgccg

SEQ ID NO: 2984346 - RNA, 18 nt, Mycobacterium avium subsp. paratuberculosis
cagguacuccucggugug

SEQ ID NO: 2984347 - RNA, 18 nt, Mycobacterium avium subsp. paratuberculosis
cagguacugaucaccgcg

SEQ ID NO: 2984348 - RNA, 19 nt, Mycobacterium avium subsp. paratuberculosis
cagguacugaucaccgcgc

SEQ ID NO: 2984349 - RNA, 19 nt, Mycobacterium avium subsp. paratuberculosis
cagguacugcuugccgccg

SEQ ID NO: 2984350 - RNA, 21 nt, Mycobacterium avium subsp. paratuberculosis
cagguacugcuugccgccggg

SEQ ID NO: 2984351 - RNA, 22 nt, Mycobacterium avium subsp. paratuberculosis
cagguacugcuugccgccgggc

SEQ ID NO: 2984352 - RNA, 23 nt, Mycobacterium avium subsp. paratuberculosis
cagguacugggcguggucgccgu

SEQ ID NO: 2984353 - RNA, 15 nt, Mycobacterium avium subsp. paratuberculosis
cagguagaagccgcg

SEQ ID NO: 2984354 - RNA, 16 nt, Mycobacterium avium subsp. paratuberculosis
cagguagaagccgcga

SEQ ID NO: 2984355 - RNA, 21 nt, Mycobacterium avium subsp. paratuberculosis
cagguagacgaugcccagccc

SEQ ID NO: 2984356 - RNA, 22 nt, Mycobacterium avium subsp. paratuberculosis
cagguagacgaugcccagcccc

SEQ ID NO: 2984357 - RNA, 22 nt, Mycobacterium avium subsp. paratuberculosis
cagguagaggcuguccagcagc

SEQ ID NO: 2984358 - RNA, 23 nt, Mycobacterium avium subsp. paratuberculosis
cagguagaggcuguccagcagcg

SEQ ID NO: 2984359 - RNA, 14 nt, Mycobacterium avium subsp. paratuberculosis
cagguagaucgcca

SEQ ID NO: 2984360 - RNA, 13 nt, Mycobacterium avium subsp. paratuberculosis
cagguagcaggcg

SEQ ID NO: 2984361 - RNA, 20 nt, Mycobacterium avium subsp. paratuberculosis
cagguagcaggcgcgcagca

SEQ ID NO: 2984362 - RNA, 19 nt, Mycobacterium avium subsp. paratuberculosis
cagguagccgaggucgccg

SEQ ID NO: 2984363 - RNA, 14 nt, Mycobacterium avium subsp. paratuberculosis
cagguagccgccgu

SEQ ID NO: 2984364 - RNA, 17 nt, Mycobacterium avium subsp. paratuberculosis
cagguagcgcagcccgg

SEQ ID NO: 2984365 - RNA, 18 nt, Mycobacterium avium subsp. paratuberculosis
cagguagcgcagcccggu

SEQ ID NO: 2984366 - RNA, 17 nt, Mycobacterium avium subsp. paratuberculosis
cagguagcgcaucagcu

SEQ ID NO: 2984367 - RNA, 17 nt, Mycobacterium avium subsp. paratuberculosis
cagguagcggcugaccg

SEQ ID NO: 2984368 - RNA, 20 nt, Mycobacterium avium subsp. paratuberculosis
cagguagcggcugaccgagc

SEQ ID NO: 2984369 - RNA, 14 nt, Mycobacterium avium subsp. paratuberculosis
cagguaggacaccg

SEQ ID NO: 2984370 - RNA, 14 nt, Mycobacterium avium subsp. paratuberculosis
cagguaggcgacca

SEQ ID NO: 2984371 - RNA, 22 nt, Mycobacterium avium subsp. paratuberculosis
cagguaggcgaccaugcccagc

SEQ ID NO: 2984372 - RNA, 14 nt, Mycobacterium avium subsp. paratuberculosis
cagguaggcgcccu

SEQ ID NO: 2984373 - RNA, 13 nt, Mycobacterium avium subsp. paratuberculosis
cagguaggcggcg

SEQ ID NO: 2984374 - RNA, 16 nt, Mycobacterium avium subsp. paratuberculosis
cagguaggcggcgccg

SEQ ID NO: 2984375 - RNA, 17 nt, Mycobacterium avium subsp. paratuberculosis
cagguaggcggcgccgu

SEQ ID NO: 2984376 - RNA, 20 nt, Mycobacterium avium subsp. paratuberculosis
cagguaggcggcgccgucga

SEQ ID NO: 2984377 - RNA, 23 nt, Mycobacterium avium subsp. paratuberculosis
cagguaggcggcgccgucgacca

SEQ ID NO: 2984378 - RNA, 14 nt, Mycobacterium avium subsp. paratuberculosis
cagguaggcgucga

SEQ ID NO: 2984379 - RNA, 16 nt, Mycobacterium avium subsp. paratuberculosis
cagguagggcacaccg

SEQ ID NO: 2984380 - RNA, 19 nt, Mycobacterium avium subsp. paratuberculosis
cagguagggcacaccggug

SEQ ID NO: 2984381 - RNA, 16 nt, Mycobacterium avium subsp. paratuberculosis
cagguagguggccagc

SEQ ID NO: 2984382 - RNA, 20 nt, Mycobacterium avium subsp. paratuberculosis
cagguagguggccagccggg

SEQ ID NO: 2984383 - RNA, 22 nt, Mycobacterium avium subsp. paratuberculosis
cagguaguacaggugcagcagc

SEQ ID NO: 2984384 - RNA, 23 nt, Mycobacterium avium subsp. paratuberculosis
cagguaguacaggugcagcagca

SEQ ID NO: 2984385 - RNA, 17 nt, Mycobacterium avium subsp. paratuberculosis
cagguaguagcgcgccg

SEQ ID NO: 2984386 - RNA, 23 nt, Mycobacterium avium subsp. paratuberculosis
cagguaguggugggcgugccggg

SEQ ID NO: 2984387 - RNA, 23 nt, Mycobacterium avium subsp. paratuberculosis
cagguauucaucgcggccgccgg

SEQ ID NO: 2984388 - RNA, 22 nt, Mycobacterium avium subsp. paratuberculosis
cagguauucgcgggaggacagc

SEQ ID NO: 2984389 - RNA, 23 nt, Mycobacterium avium subsp. paratuberculosis
cagguauucgcgggaggacagcg

SEQ ID NO: 2984390 - RNA, 16 nt, Mycobacterium avium subsp. paratuberculosis
caggucaaccaggccu

SEQ ID NO: 2984391 - RNA, 14 nt, Mycobacterium avium subsp. paratuberculosis
caggucacccuccu

SEQ ID NO: 2984392 - RNA, 14 nt, Mycobacterium avium subsp. paratuberculosis
caggucaccgagcg

SEQ ID NO: 2984393 - RNA, 12 nt, Mycobacterium avium subsp. paratuberculosis
caggucaccgcg

SEQ ID NO: 2984394 - RNA, 23 nt, Mycobacterium avium subsp. paratuberculosis
caggucaccgcgcgaagucccac

SEQ ID NO: 2984395 - RNA, 14 nt, Mycobacterium avium subsp. paratuberculosis
caggucagccaggu

SEQ ID NO: 2984396 - RNA, 15 nt, Mycobacterium avium subsp. paratuberculosis
caggucaugguggcg

SEQ ID NO: 2984397 - RNA, 19 nt, Mycobacterium avium subsp. paratuberculosis
caggucaugguggcggcgc

SEQ ID NO: 2984398 - RNA, 13 nt, Mycobacterium avium subsp. paratuberculosis
cagguccacaccg

SEQ ID NO: 2984399 - RNA, 16 nt, Mycobacterium avium subsp. paratuberculosis
cagguccacaccgugg

SEQ ID NO: 2984400 - RNA, 15 nt, Mycobacterium avium subsp. paratuberculosis
cagguccacccgccc

SEQ ID NO: 2984401 - RNA, 22 nt, Mycobacterium avium subsp. paratuberculosis
cagguccacccgccccgccgcg

SEQ ID NO: 2984402 - RNA, 23 nt, Mycobacterium avium subsp. paratuberculosis
cagguccaccguugucucggcgc

SEQ ID NO: 2984403 - RNA, 21 nt, Mycobacterium avium subsp. paratuberculosis
cagguccaggaucacgcggcg

SEQ ID NO: 2984404 - RNA, 22 nt, Mycobacterium avium subsp. paratuberculosis
caggucccaggcguggucggcg

SEQ ID NO: 2984405 - RNA, 17 nt, Mycobacterium avium subsp. paratuberculosis
cagguccgcgguggugg

SEQ ID NO: 2984406 - RNA, 21 nt, Mycobacterium avium subsp. paratuberculosis
cagguccggaaucaccuugcc

SEQ ID NO: 2984407 - RNA, 23 nt, Mycobacterium avium subsp. paratuberculosis
cagguccggcagcgcgcccaggc

SEQ ID NO: 2984408 - RNA, 21 nt, Mycobacterium avium subsp. paratuberculosis
cagguccgggaacagcgacuc

SEQ ID NO: 2984409 - RNA, 20 nt, Mycobacterium avium subsp. paratuberculosis
cagguccgguucgaccggcg

SEQ ID NO: 2984410 - RNA, 21 nt, Mycobacterium avium subsp. paratuberculosis
cagguccgguucgaccggcgu

SEQ ID NO: 2984411 - RNA, 14 nt, Mycobacterium avium subsp. paratuberculosis
cagguccgugguga

SEQ ID NO: 2984412 - RNA, 15 nt, Mycobacterium avium subsp. paratuberculosis
cagguccucgcuggc

SEQ ID NO: 2984413 - RNA, 18 nt, Mycobacterium avium subsp. paratuberculosis
cagguccucuucauaccg

SEQ ID NO: 2984414 - RNA, 13 nt, Mycobacterium avium subsp. paratuberculosis
cagguccuugagg

SEQ ID NO: 2984415 - RNA, 19 nt, Mycobacterium avium subsp. paratuberculosis
cagguccuugaggaugcgc

SEQ ID NO: 2984416 - RNA, 16 nt, Mycobacterium avium subsp. paratuberculosis
cagguccuugcccagc

SEQ ID NO: 2984417 - RNA, 17 nt, Mycobacterium avium subsp. paratuberculosis
cagguccuugcccagca

SEQ ID NO: 2984418 - RNA, 15 nt, Mycobacterium avium subsp. paratuberculosis
cagguccuugcgcgc

SEQ ID NO: 2984419 - RNA, 16 nt, Mycobacterium avium subsp. paratuberculosis
cagguccuugcgcgcc

SEQ ID NO: 2984420 - RNA, 17 nt, Mycobacterium avium subsp. paratuberculosis
cagguccuugcgcgccg

SEQ ID NO: 2984421 - RNA, 20 nt, Mycobacterium avium subsp. paratuberculosis
cagguccuugcgcgccgcga

SEQ ID NO: 2984422 - RNA, 22 nt, Mycobacterium avium subsp. paratuberculosis
cagguccuugcgcgccgcgacg

SEQ ID NO: 2984423 - RNA, 19 nt, Mycobacterium avium subsp. paratuberculosis
caggucgaaacccguugcc

SEQ ID NO: 2984424 - RNA, 23 nt, Mycobacterium avium subsp. paratuberculosis
caggucgaagaggugcucgacgg

SEQ ID NO: 2984425 - RNA, 20 nt, Mycobacterium avium subsp. paratuberculosis
caggucgaagcccgccguca

SEQ ID NO: 2984426 - RNA, 16 nt, Mycobacterium avium subsp. paratuberculosis
caggucgaagcgcagc

SEQ ID NO: 2984427 - RNA, 17 nt, Mycobacterium avium subsp. paratuberculosis
caggucgaagcgcagca

SEQ ID NO: 2984428 - RNA, 19 nt, Mycobacterium avium subsp. paratuberculosis
caggucgaagcgcagcacc

SEQ ID NO: 2984429 - RNA, 20 nt, Mycobacterium avium subsp. paratuberculosis
caggucgaagcgcagcaccu

SEQ ID NO: 2984430 - RNA, 17 nt, Mycobacterium avium subsp. paratuberculosis
caggucgaaggcggccg

SEQ ID NO: 2984431 - RNA, 18 nt, Mycobacterium avium subsp. paratuberculosis
caggucgaaggcggccgc

SEQ ID NO: 2984432 - RNA, 20 nt, Mycobacterium avium subsp. paratuberculosis
caggucgaaggcggccgcga

SEQ ID NO: 2984433 - RNA, 16 nt, Mycobacterium avium subsp. paratuberculosis
caggucgaagggcauc

SEQ ID NO: 2984434 - RNA, 17 nt, Mycobacterium avium subsp. paratuberculosis
caggucgaagggcaucg

SEQ ID NO: 2984435 - RNA, 22 nt, Mycobacterium avium subsp. paratuberculosis
caggucgaccaucugccggcgc

SEQ ID NO: 2984436 - RNA, 16 nt, Mycobacterium avium subsp. paratuberculosis
caggucgaccggcucg

SEQ ID NO: 2984437 - RNA, 20 nt, Mycobacterium avium subsp. paratuberculosis
caggucgaccggcucgccgu

SEQ ID NO: 2984438 - RNA, 17 nt, Mycobacterium avium subsp. paratuberculosis
caggucgacggggucgg

SEQ ID NO: 2984439 - RNA, 22 nt, Mycobacterium avium subsp. paratuberculosis
caggucgacggggucggacaga

SEQ ID NO: 2984440 - RNA, 12 nt, Mycobacterium avium subsp. paratuberculosis
caggucgaggcc

SEQ ID NO: 2984441 - RNA, 20 nt, Mycobacterium avium subsp. paratuberculosis
caggucgagguagugcgcga

SEQ ID NO: 2984442 - RNA, 13 nt, Mycobacterium avium subsp. paratuberculosis
caggucgaguuca

SEQ ID NO: 2984443 - RNA, 15 nt, Mycobacterium avium subsp. paratuberculosis
caggucgaucucggc

SEQ ID NO: 2984444 - RNA, 17 nt, Mycobacterium avium subsp. paratuberculosis
caggucgaucucggcca

SEQ ID NO: 2984445 - RNA, 16 nt, Mycobacterium avium subsp. paratuberculosis
caggucgaucugcggc

SEQ ID NO: 2984446 - RNA, 19 nt, Mycobacterium avium subsp. paratuberculosis
caggucgaucugcggcacg

SEQ ID NO: 2984447 - RNA, 18 nt, Mycobacterium avium subsp. paratuberculosis
caggucgauggucugccc

SEQ ID NO: 2984448 - RNA, 19 nt, Mycobacterium avium subsp. paratuberculosis
caggucgcacaccagcacg

SEQ ID NO: 2984449 - RNA, 22 nt, Mycobacterium avium subsp. paratuberculosis
caggucgcacaccagcacggcg

SEQ ID NO: 2984450 - RNA, 22 nt, Mycobacterium avium subsp. paratuberculosis
caggucgcccggcucgccgggc

SEQ ID NO: 2984451 - RNA, 20 nt, Mycobacterium avium subsp. paratuberculosis
caggucgccgauccagccgu

SEQ ID NO: 2984452 - RNA, 16 nt, Mycobacterium avium subsp. paratuberculosis
caggucgccgcgcagc

SEQ ID NO: 2984453 - RNA, 20 nt, Mycobacterium avium subsp. paratuberculosis
caggucgccgcgcagcaccg

SEQ ID NO: 2984454 - RNA, 21 nt, Mycobacterium avium subsp. paratuberculosis
caggucgccgcgcagcaccgc

SEQ ID NO: 2984455 - RNA, 23 nt, Mycobacterium avium subsp. paratuberculosis
caggucgccgcgcagcaccgcgu

SEQ ID NO: 2984456 - RNA, 14 nt, Mycobacterium avium subsp. paratuberculosis
caggucgccggcgg

SEQ ID NO: 2984457 - RNA, 15 nt, Mycobacterium avium subsp. paratuberculosis
caggucgccggcggc

SEQ ID NO: 2984458 - RNA, 16 nt, Mycobacterium avium subsp. paratuberculosis
caggucgcgccggagc

SEQ ID NO: 2984459 - RNA, 16 nt, Mycobacterium avium subsp. paratuberculosis
caggucgcggcgcugc

SEQ ID NO: 2984460 - RNA, 21 nt, Mycobacterium avium subsp. paratuberculosis
caggucgcggcgcugcgccgu

SEQ ID NO: 2984461 - RNA, 13 nt, Mycobacterium avium subsp. paratuberculosis
caggucgcgguag

SEQ ID NO: 2984462 - RNA, 16 nt, Mycobacterium avium subsp. paratuberculosis
caggucgcgguagcgc

SEQ ID NO: 2984463 - RNA, 19 nt, Mycobacterium avium subsp. paratuberculosis
caggucgcgguagcgcucg

SEQ ID NO: 2984464 - RNA, 21 nt, Mycobacterium avium subsp. paratuberculosis
caggucgcggugggcgcgggc

SEQ ID NO: 2984465 - RNA, 18 nt, Mycobacterium avium subsp. paratuberculosis
caggucgcugcccggcgu

SEQ ID NO: 2984466 - RNA, 19 nt, Mycobacterium avium subsp. paratuberculosis
caggucgcugcccggcgug

SEQ ID NO: 2984467 - RNA, 20 nt, Mycobacterium avium subsp. paratuberculosis
caggucgcugcgcucgccgu

SEQ ID NO: 2984468 - RNA, 21 nt, Mycobacterium avium subsp. paratuberculosis
caggucgcugcgcucgccguc

SEQ ID NO: 2984469 - RNA, 22 nt, Mycobacterium avium subsp. paratuberculosis
caggucgcugcgcucgccgucg

SEQ ID NO: 2984470 - RNA, 15 nt, Mycobacterium avium subsp. paratuberculosis
caggucggccagcgc

SEQ ID NO: 2984471 - RNA, 16 nt, Mycobacterium avium subsp. paratuberculosis
caggucggccagcgcc

SEQ ID NO: 2984472 - RNA, 19 nt, Mycobacterium avium subsp. paratuberculosis
caggucggccagcgccgcc

SEQ ID NO: 2984473 - RNA, 15 nt, Mycobacterium avium subsp. paratuberculosis
caggucggccgcggc

SEQ ID NO: 2984474 - RNA, 19 nt, Mycobacterium avium subsp. paratuberculosis
caggucggccgcggccggc

SEQ ID NO: 2984475 - RNA, 12 nt, Mycobacterium avium subsp. paratuberculosis
caggucggcgau

SEQ ID NO: 2984476 - RNA, 13 nt, Mycobacterium avium subsp. paratuberculosis
caggucggcgaug

SEQ ID NO: 2984477 - RNA, 14 nt, Mycobacterium avium subsp. paratuberculosis
caggucggcgaugg

SEQ ID NO: 2984478 - RNA, 16 nt, Mycobacterium avium subsp. paratuberculosis
caggucggcgauggug

SEQ ID NO: 2984479 - RNA, 12 nt, Mycobacterium avium subsp. paratuberculosis
caggucggcggg

SEQ ID NO: 2984480 - RNA, 13 nt, Mycobacterium avium subsp. paratuberculosis
caggucggcggga

SEQ ID NO: 2984481 - RNA, 15 nt, Mycobacterium avium subsp. paratuberculosis
caggucggcgggagc

SEQ ID NO: 2984482 - RNA, 20 nt, Mycobacterium avium subsp. paratuberculosis
caggucggcgggagccggcg

SEQ ID NO: 2984483 - RNA, 16 nt, Mycobacterium avium subsp. paratuberculosis
caggucggcggucgcg

SEQ ID NO: 2984484 - RNA, 18 nt, Mycobacterium avium subsp. paratuberculosis
caggucggcggucgcggu

SEQ ID NO: 2984485 - RNA, 13 nt, Mycobacterium avium subsp. paratuberculosis
caggucggcguga

SEQ ID NO: 2984486 - RNA, 13 nt, Mycobacterium avium subsp. paratuberculosis
caggucggcgugc

SEQ ID NO: 2984487 - RNA, 23 nt, Mycobacterium avium subsp. paratuberculosis
caggucggcgugcagcacgggga

SEQ ID NO: 2984488 - RNA, 20 nt, Mycobacterium avium subsp. paratuberculosis
caggucggcgugcucgucgc

SEQ ID NO: 2984489 - RNA, 22 nt, Mycobacterium avium subsp. paratuberculosis
caggucgggcucgcgcacccgu

SEQ ID NO: 2984490 - RNA, 21 nt, Mycobacterium avium subsp. paratuberculosis
caggucggggcccguccccac

SEQ ID NO: 2984491 - RNA, 17 nt, Mycobacterium avium subsp. paratuberculosis
caggucgggguccaggc

SEQ ID NO: 2984492 - RNA, 21 nt, Mycobacterium avium subsp. paratuberculosis
caggucgggguccaggccgcg

SEQ ID NO: 2984493 - RNA, 22 nt, Mycobacterium avium subsp. paratuberculosis
caggucggggugggcgacgucg

SEQ ID NO: 2984494 - RNA, 13 nt, Mycobacterium avium subsp. paratuberculosis
caggucggucacc

SEQ ID NO: 2984495 - RNA, 18 nt, Mycobacterium avium subsp. paratuberculosis
caggucggucaccgagcu

SEQ ID NO: 2984496 - RNA, 20 nt, Mycobacterium avium subsp. paratuberculosis
caggucggugccgcggcgca

SEQ ID NO: 2984497 - RNA, 22 nt, Mycobacterium avium subsp. paratuberculosis
caggucggugcgcgggguggcg

SEQ ID NO: 2984498 - RNA, 17 nt, Mycobacterium avium subsp. paratuberculosis
caggucguaguaggcgc

SEQ ID NO: 2984499 - RNA, 19 nt, Mycobacterium avium subsp. paratuberculosis
caggucguaguaggcgccg

SEQ ID NO: 2984500 - RNA, 22 nt, Mycobacterium avium subsp. paratuberculosis
caggucguaguaggcgccgaac

SEQ ID NO: 2984501 - RNA, 13 nt, Mycobacterium avium subsp. paratuberculosis
caggucgucgacg

SEQ ID NO: 2984502 - RNA, 14 nt, Mycobacterium avium subsp. paratuberculosis
caggucgucgacgu

SEQ ID NO: 2984503 - RNA, 16 nt, Mycobacterium avium subsp. paratuberculosis
caggucgucgacgucg

SEQ ID NO: 2984504 - RNA, 17 nt, Mycobacterium avium subsp. paratuberculosis
caggucgucgacgucgc

SEQ ID NO: 2984505 - RNA, 12 nt, Mycobacterium avium subsp. paratuberculosis
caggucgucgau

SEQ ID NO: 2984506 - RNA, 18 nt, Mycobacterium avium subsp. paratuberculosis
caggucgucgaucagggc

SEQ ID NO: 2984507 - RNA, 17 nt, Mycobacterium avium subsp. paratuberculosis
caggucgucgucgccgc

SEQ ID NO: 2984508 - RNA, 23 nt, Mycobacterium avium subsp. paratuberculosis
caggucgucgucgccgcgcgcgu

SEQ ID NO: 2984509 - RNA, 20 nt, Mycobacterium avium subsp. paratuberculosis
caggucguucauucagcacc

SEQ ID NO: 2984510 - RNA, 21 nt, Mycobacterium avium subsp. paratuberculosis
caggucguucauucagcaccu

SEQ ID NO: 2984511 - RNA, 15 nt, Mycobacterium avium subsp. paratuberculosis
caggucguugccggu

SEQ ID NO: 2984512 - RNA, 17 nt, Mycobacterium avium subsp. paratuberculosis
caggucguugccggugc

SEQ ID NO: 2984513 - RNA, 20 nt, Mycobacterium avium subsp. paratuberculosis
caggucguugccggugccga

SEQ ID NO: 2984514 - RNA, 19 nt, Mycobacterium avium subsp. paratuberculosis
caggucuccguugucgagg

SEQ ID NO: 2984515 - RNA, 15 nt, Mycobacterium avium subsp. paratuberculosis
caggucuucggucgc

SEQ ID NO: 2984516 - RNA, 16 nt, Mycobacterium avium subsp. paratuberculosis
caggucuucggucgcg

SEQ ID NO: 2984517 - RNA, 17 nt, Mycobacterium avium subsp. paratuberculosis
caggugaacagcagcca

SEQ ID NO: 2984518 - RNA, 13 nt, Mycobacterium avium subsp. paratuberculosis
caggugaccggcc

SEQ ID NO: 2984519 - RNA, 15 nt, Mycobacterium avium subsp. paratuberculosis
caggugaccggccug

SEQ ID NO: 2984520 - RNA, 16 nt, Mycobacterium avium subsp. paratuberculosis
caggugacgacgcucu

SEQ ID NO: 2984521 - RNA, 14 nt, Mycobacterium avium subsp. paratuberculosis
caggugacgccgca

SEQ ID NO: 2984522 - RNA, 15 nt, Mycobacterium avium subsp. paratuberculosis
caggugacgccgcac

SEQ ID NO: 2984523 - RNA, 22 nt, Mycobacterium avium subsp. paratuberculosis
caggugagccgggugcccgcgu

SEQ ID NO: 2984524 - RNA, 20 nt, Mycobacterium avium subsp. paratuberculosis
caggugaucaaagccggugg

SEQ ID NO: 2984525 - RNA, 20 nt, Mycobacterium avium subsp. paratuberculosis
caggugaucuugcccagcca

SEQ ID NO: 2984526 - RNA, 13 nt, Mycobacterium avium subsp. paratuberculosis
caggugaugcggc

SEQ ID NO: 2984527 - RNA, 20 nt, Mycobacterium avium subsp. paratuberculosis
caggugcaccacccaggcca

SEQ ID NO: 2984528 - RNA, 13 nt, Mycobacterium avium subsp. paratuberculosis
caggugcacccga

SEQ ID NO: 2984529 - RNA, 17 nt, Mycobacterium avium subsp. paratuberculosis
caggugcacccgaugcu

SEQ ID NO: 2984530 - RNA, 20 nt, Mycobacterium avium subsp. paratuberculosis
caggugcacccgcggcgcga

SEQ ID NO: 2984531 - RNA, 18 nt, Mycobacterium avium subsp. paratuberculosis
caggugcacgccgagcag

SEQ ID NO: 2984532 - RNA, 20 nt, Mycobacterium avium subsp. paratuberculosis
caggugcacgccgagcagca

SEQ ID NO: 2984533 - RNA, 22 nt, Mycobacterium avium subsp. paratuberculosis
caggugcacgccgagcagcacc

SEQ ID NO: 2984534 - RNA, 17 nt, Mycobacterium avium subsp. paratuberculosis
caggugcagaccggaca

SEQ ID NO: 2984535 - RNA, 19 nt, Mycobacterium avium subsp. paratuberculosis
caggugcagaccggacagc

SEQ ID NO: 2984536 - RNA, 20 nt, Mycobacterium avium subsp. paratuberculosis
caggugcagaccggacagcu

SEQ ID NO: 2984537 - RNA, 24 nt, Mycobacterium avium subsp. paratuberculosis
caggugcagcagcagccacgccag

SEQ ID NO: 2984538 - RNA, 12 nt, Mycobacterium avium subsp. paratuberculosis
caggugcagcgu

SEQ ID NO: 2984539 - RNA, 17 nt, Mycobacterium avium subsp. paratuberculosis
caggugcagcuccuuga

SEQ ID NO: 2984540 - RNA, 23 nt, Mycobacterium avium subsp. paratuberculosis
caggugcagcuccuugagccgcc

SEQ ID NO: 2984541 - RNA, 17 nt, Mycobacterium avium subsp. paratuberculosis
caggugcauccagucgg

SEQ ID NO: 2984542 - RNA, 23 nt, Mycobacterium avium subsp. paratuberculosis
caggugcauccagucggcgccga

SEQ ID NO: 2984543 - RNA, 15 nt, Mycobacterium avium subsp. paratuberculosis
caggugcaucgaccg

SEQ ID NO: 2984544 - RNA, 16 nt, Mycobacterium avium subsp. paratuberculosis
caggugcaucgaccgg

SEQ ID NO: 2984545 - RNA, 18 nt, Mycobacterium avium subsp. paratuberculosis
caggugcaucgaccggcg

SEQ ID NO: 2984546 - RNA, 15 nt, Mycobacterium avium subsp. paratuberculosis
caggugcaucgccac

SEQ ID NO: 2984547 - RNA, 17 nt, Mycobacterium avium subsp. paratuberculosis
caggugcaucgccaccg

SEQ ID NO: 2984548 - RNA, 17 nt, Mycobacterium avium subsp. paratuberculosis
caggugcccgucggccu

SEQ ID NO: 2984549 - RNA, 13 nt, Mycobacterium avium subsp. paratuberculosis
caggugccggcgg

SEQ ID NO: 2984550 - RNA, 15 nt, Mycobacterium avium subsp. paratuberculosis
caggugccggcggcg

SEQ ID NO: 2984551 - RNA, 17 nt, Mycobacterium avium subsp. paratuberculosis
caggugccggcggcgcg

SEQ ID NO: 2984552 - RNA, 18 nt, Mycobacterium avium subsp. paratuberculosis
caggugccggcggcgcgg

SEQ ID NO: 2984553 - RNA, 20 nt, Mycobacterium avium subsp. paratuberculosis
caggugccggcggcgcggca

SEQ ID NO: 2984554 - RNA, 13 nt, Mycobacterium avium subsp. paratuberculosis
caggugccgguga

SEQ ID NO: 2984555 - RNA, 16 nt, Mycobacterium avium subsp. paratuberculosis
caggugccggugacgg

SEQ ID NO: 2984556 - RNA, 18 nt, Mycobacterium avium subsp. paratuberculosis
caggugccggugacgguc

SEQ ID NO: 2984557 - RNA, 22 nt, Mycobacterium avium subsp. paratuberculosis
caggugccggugacggucaggg

SEQ ID NO: 2984558 - RNA, 17 nt, Mycobacterium avium subsp. paratuberculosis
caggugcgccgccgcgu

SEQ ID NO: 2984559 - RNA, 22 nt, Mycobacterium avium subsp. paratuberculosis
caggugcgccgccgcgucgccg

SEQ ID NO: 2984560 - RNA, 13 nt, Mycobacterium avium subsp. paratuberculosis
caggugcgccgcu

SEQ ID NO: 2984561 - RNA, 20 nt, Mycobacterium avium subsp. paratuberculosis
caggugcgccgcucgucggc

SEQ ID NO: 2984562 - RNA, 14 nt, Mycobacterium avium subsp. paratuberculosis
caggugcgcgguca

SEQ ID NO: 2984563 - RNA, 23 nt, Mycobacterium avium subsp. paratuberculosis
caggugcgcggucagcgcgucca

SEQ ID NO: 2984564 - RNA, 19 nt, Mycobacterium avium subsp. paratuberculosis
caggugcggcaccuccagc

SEQ ID NO: 2984565 - RNA, 20 nt, Mycobacterium avium subsp. paratuberculosis
caggugcggggacagugcgg

SEQ ID NO: 2984566 - RNA, 18 nt, Mycobacterium avium subsp. paratuberculosis
caggugcucgccggcgcg

SEQ ID NO: 2984567 - RNA, 20 nt, Mycobacterium avium subsp. paratuberculosis
caggugcuuggucagcgcgg

SEQ ID NO: 2984568 - RNA, 22 nt, Mycobacterium avium subsp. paratuberculosis
cagguggaugcgagccagcugc

SEQ ID NO: 2984569 - RNA, 23 nt, Mycobacterium avium subsp. paratuberculosis
cagguggaugcgagccagcugcg

SEQ ID NO: 2984570 - RNA, 19 nt, Mycobacterium avium subsp. paratuberculosis
cagguggauggucaccggg

SEQ ID NO: 2984571 - RNA, 22 nt, Mycobacterium avium subsp. paratuberculosis
cagguggauugucggccgcccg

SEQ ID NO: 2984572 - RNA, 24 nt, Mycobacterium avium subsp. paratuberculosis
cagguggcccacacgcgauagacc

SEQ ID NO: 2984573 - RNA, 18 nt, Mycobacterium avium subsp. paratuberculosis
cagguggccgaucagcgg

SEQ ID NO: 2984574 - RNA, 20 nt, Mycobacterium avium subsp. paratuberculosis
cagguggccgaucagcggcg

SEQ ID NO: 2984575 - RNA, 13 nt, Mycobacterium avium subsp. paratuberculosis
cagguggccgcuu

SEQ ID NO: 2984576 - RNA, 22 nt, Mycobacterium avium subsp. paratuberculosis
cagguggccgcuuuccaccccg

SEQ ID NO: 2984577 - RNA, 13 nt, Mycobacterium avium subsp. paratuberculosis
cagguggcgcccg

SEQ ID NO: 2984578 - RNA, 14 nt, Mycobacterium avium subsp. paratuberculosis
cagguggcgcccgg

SEQ ID NO: 2984579 - RNA, 19 nt, Mycobacterium avium subsp. paratuberculosis
cagguggcguagucggugc

SEQ ID NO: 2984580 - RNA, 20 nt, Mycobacterium avium subsp. paratuberculosis
cagguggcguagucggugca

SEQ ID NO: 2984581 - RNA, 21 nt, Mycobacterium avium subsp. paratuberculosis
cagguggcguagucggugcag

SEQ ID NO: 2984582 - RNA, 22 nt, Mycobacterium avium subsp. paratuberculosis
cagguggcgucggcgucgaacg

SEQ ID NO: 2984583 - RNA, 13 nt, Mycobacterium avium subsp. paratuberculosis
caggugggcgcgc

SEQ ID NO: 2984584 - RNA, 14 nt, Mycobacterium avium subsp. paratuberculosis
caggugggcgcgca

SEQ ID NO: 2984585 - RNA, 16 nt, Mycobacterium avium subsp. paratuberculosis
caggugggcgcgcagc

SEQ ID NO: 2984586 - RNA, 17 nt, Mycobacterium avium subsp. paratuberculosis
caggugggcgcgcagca

SEQ ID NO: 2984587 - RNA, 16 nt, Mycobacterium avium subsp. paratuberculosis
caggugggcggccacc

SEQ ID NO: 2984588 - RNA, 17 nt, Mycobacterium avium subsp. paratuberculosis
cagguggggcacgggcg

SEQ ID NO: 2984589 - RNA, 18 nt, Mycobacterium avium subsp. paratuberculosis
cagguggggcacgggcgg

SEQ ID NO: 2984590 - RNA, 19 nt, Mycobacterium avium subsp. paratuberculosis
caggugggugaacgccugc

SEQ ID NO: 2984591 - RNA, 14 nt, Mycobacterium avium subsp. paratuberculosis
cagguggucggcga

SEQ ID NO: 2984592 - RNA, 17 nt, Mycobacterium avium subsp. paratuberculosis
cagguguccagcccuac

SEQ ID NO: 2984593 - RNA, 19 nt, Mycobacterium avium subsp. paratuberculosis
cagguguccagcccuaccc

SEQ ID NO: 2984594 - RNA, 13 nt, Mycobacterium avium subsp. paratuberculosis
cagguguccggcc

SEQ ID NO: 2984595 - RNA, 15 nt, Mycobacterium avium subsp. paratuberculosis
caggugugccgcugg

SEQ ID NO: 2984596 - RNA, 21 nt, Mycobacterium avium subsp. paratuberculosis
caggugugccgcugguaggcg

SEQ ID NO: 2984597 - RNA, 23 nt, Mycobacterium avium subsp. paratuberculosis
caggugugggcguacgggcgggc

SEQ ID NO: 2984598 - RNA, 14 nt, Mycobacterium avium subsp. paratuberculosis
cagguucaccagca

SEQ ID NO: 2984599 - RNA, 14 nt, Mycobacterium avium subsp. paratuberculosis
cagguucagcccgg

SEQ ID NO: 2984600 - RNA, 16 nt, Mycobacterium avium subsp. paratuberculosis
cagguucagcccggcg

SEQ ID NO: 2984601 - RNA, 20 nt, Mycobacterium avium subsp. paratuberculosis
cagguucaggcccgcgccga

SEQ ID NO: 2984602 - RNA, 14 nt, Mycobacterium avium subsp. paratuberculosis
cagguucaucacca

SEQ ID NO: 2984603 - RNA, 17 nt, Mycobacterium avium subsp. paratuberculosis
cagguucaucaccacga

SEQ ID NO: 2984604 - RNA, 14 nt, Mycobacterium avium subsp. paratuberculosis
cagguuccaccggg

SEQ ID NO: 2984605 - RNA, 22 nt, Mycobacterium avium subsp. paratuberculosis
cagguuccggaucaaccacacc

SEQ ID NO: 2984606 - RNA, 16 nt, Mycobacterium avium subsp. paratuberculosis
cagguuccggugucga

SEQ ID NO: 2984607 - RNA, 23 nt, Mycobacterium avium subsp. paratuberculosis
cagguucgacacgccccgauggu

SEQ ID NO: 2984608 - RNA, 13 nt, Mycobacterium avium subsp. paratuberculosis
cagguucgccgcc

SEQ ID NO: 2984609 - RNA, 14 nt, Mycobacterium avium subsp. paratuberculosis
cagguucgccgccc

SEQ ID NO: 2984610 - RNA, 15 nt, Mycobacterium avium subsp. paratuberculosis
cagguucgccgccca

SEQ ID NO: 2984611 - RNA, 16 nt, Mycobacterium avium subsp. paratuberculosis
cagguucuccggcccg

SEQ ID NO: 2984612 - RNA, 19 nt, Mycobacterium avium subsp. paratuberculosis
cagguucugcacgugguga

SEQ ID NO: 2984613 - RNA, 14 nt, Mycobacterium avium subsp. paratuberculosis
cagguucuuggcgg

SEQ ID NO: 2984614 - RNA, 18 nt, Mycobacterium avium subsp. paratuberculosis
cagguucuuggcggccug

SEQ ID NO: 2984615 - RNA, 19 nt, Mycobacterium avium subsp. paratuberculosis
cagguugaccaggugggcg

SEQ ID NO: 2984616 - RNA, 13 nt, Mycobacterium avium subsp. paratuberculosis
cagguugacgccg

SEQ ID NO: 2984617 - RNA, 15 nt, Mycobacterium avium subsp. paratuberculosis
cagguugauccgcgc

SEQ ID NO: 2984618 - RNA, 16 nt, Mycobacterium avium subsp. paratuberculosis
cagguugauccgcgcg

SEQ ID NO: 2984619 - RNA, 17 nt, Mycobacterium avium subsp. paratuberculosis
cagguugcgcagcagcc

SEQ ID NO: 2984620 - RNA, 20 nt, Mycobacterium avium subsp. paratuberculosis
cagguugcgccguccggcca

SEQ ID NO: 2984621 - RNA, 21 nt, Mycobacterium avium subsp. paratuberculosis
cagguugcgccguccggccac

SEQ ID NO: 2984622 - RNA, 22 nt, Mycobacterium avium subsp. paratuberculosis
cagguugcgccguccggccacg

SEQ ID NO: 2984623 - RNA, 17 nt, Mycobacterium avium subsp. paratuberculosis
cagguuggggacggcga

SEQ ID NO: 2984624 - RNA, 20 nt, Mycobacterium avium subsp. paratuberculosis
cagguuggggacggcgagga

SEQ ID NO: 2984625 - RNA, 15 nt, Mycobacterium avium subsp. paratuberculosis
cagguuggggccgau

SEQ ID NO: 2984626 - RNA, 21 nt, Mycobacterium avium subsp. paratuberculosis
cagguuggucagcagcagcgc

SEQ ID NO: 2984627 - RNA, 22 nt, Mycobacterium avium subsp. paratuberculosis
cagguuggucagcagcagcgcc

SEQ ID NO: 2984628 - RNA, 19 nt, Mycobacterium avium subsp. paratuberculosis
cagguuguagucggcgccg

SEQ ID NO: 2984629 - RNA, 20 nt, Mycobacterium avium subsp. paratuberculosis
cagguuguagucggcgccga

SEQ ID NO: 2984630 - RNA, 16 nt, Mycobacterium avium subsp. paratuberculosis
cagguuguccagccgg

SEQ ID NO: 2984631 - RNA, 18 nt, Mycobacterium avium subsp. paratuberculosis
cagguuguccagccggug

SEQ ID NO: 2984632 - RNA, 19 nt, Mycobacterium avium subsp. paratuberculosis
cagguuguccagccggugc

SEQ ID NO: 2984633 - RNA, 22 nt, Mycobacterium avium subsp. paratuberculosis
cagguugucgccgcgccagccg

SEQ ID NO: 2984634 - RNA, 14 nt, Mycobacterium avium subsp. paratuberculosis
cagguugucggcca

SEQ ID NO: 2984635 - RNA, 20 nt, Mycobacterium avium subsp. paratuberculosis
cagguugucgucgggcacca

SEQ ID NO: 2984636 - RNA, 15 nt, Mycobacterium avium subsp. paratuberculosis
cagguuucgcucguc

SEQ ID NO: 2984637 - RNA, 19 nt, Mycobacterium avium subsp. paratuberculosis
cagguuucgcucgucggcg

SEQ ID NO: 2984638 - RNA, 24 nt, Mycobacterium avium subsp. paratuberculosis
cagguuucgcucgucggcgcgggc

SEQ ID NO: 2984639 - RNA, 15 nt, Mycobacterium avium subsp. paratuberculosis
cagguuugagcgugc

SEQ ID NO: 2984640 - RNA, 20 nt, Mycobacterium avium subsp. paratuberculosis
cagguuugagcgugccgccg

SEQ ID NO: 2984641 - RNA, 21 nt, Mycobacterium avium subsp. paratuberculosis
cagguuugagcgugccgccgg

SEQ ID NO: 2984642 - RNA, 20 nt, Mycobacterium avium subsp. paratuberculosis
caguacagcuaggccagcag

SEQ ID NO: 2984643 - RNA, 23 nt, Mycobacterium avium subsp. paratuberculosis
caguacagcuaggccagcagcgc

SEQ ID NO: 2984644 - RNA, 15 nt, Mycobacterium avium subsp. paratuberculosis
caguaccagcggccg

SEQ ID NO: 2984645 - RNA, 14 nt, Mycobacterium avium subsp. paratuberculosis
caguaccggcgaug

SEQ ID NO: 2984646 - RNA, 18 nt, Mycobacterium avium subsp. paratuberculosis
caguaccggcgaugccag

SEQ ID NO: 2984647 - RNA, 16 nt, Mycobacterium avium subsp. paratuberculosis
caguacgcaucggcgc

SEQ ID NO: 2984648 - RNA, 20 nt, Mycobacterium avium subsp. paratuberculosis
caguacgcaucggcgccgga

SEQ ID NO: 2984649 - RNA, 15 nt, Mycobacterium avium subsp. paratuberculosis
caguagacgccgccg

SEQ ID NO: 2984650 - RNA, 14 nt, Mycobacterium avium subsp. paratuberculosis
caguagcagcgucu

SEQ ID NO: 2984651 - RNA, 16 nt, Mycobacterium avium subsp. paratuberculosis
caguagccgacgugcc

SEQ ID NO: 2984652 - RNA, 23 nt, Mycobacterium avium subsp. paratuberculosis
caguagccgccgggcguagucga

SEQ ID NO: 2984653 - RNA, 13 nt, Mycobacterium avium subsp. paratuberculosis
caguagcgacgcg

SEQ ID NO: 2984654 - RNA, 19 nt, Mycobacterium avium subsp. paratuberculosis
caguagcgcaccggucagc

SEQ ID NO: 2984655 - RNA, 20 nt, Mycobacterium avium subsp. paratuberculosis
caguagcgcauaggccgcga

SEQ ID NO: 2984656 - RNA, 15 nt, Mycobacterium avium subsp. paratuberculosis
caguaggcggcuguc

SEQ ID NO: 2984657 - RNA, 17 nt, Mycobacterium avium subsp. paratuberculosis
caguagugguccaccgc

SEQ ID NO: 2984658 - RNA, 15 nt, Mycobacterium avium subsp. paratuberculosis
caguaugcccgccgc

SEQ ID NO: 2984659 - RNA, 15 nt, Mycobacterium avium subsp. paratuberculosis
cagucauggcaguug

SEQ ID NO: 2984660 - RNA, 15 nt, Mycobacterium avium subsp. paratuberculosis
caguccaggccgccg

SEQ ID NO: 2984661 - RNA, 17 nt, Mycobacterium avium subsp. paratuberculosis
caguccagucgcgccga

SEQ ID NO: 2984662 - RNA, 13 nt, Mycobacterium avium subsp. paratuberculosis
cagucccagaucg

SEQ ID NO: 2984663 - RNA, 14 nt, Mycobacterium avium subsp. paratuberculosis
cagucccagcacag

SEQ ID NO: 2984664 - RNA, 20 nt, Mycobacterium avium subsp. paratuberculosis
cagucccagcacagccgucg

SEQ ID NO: 2984665 - RNA, 22 nt, Mycobacterium avium subsp. paratuberculosis
caguccccgccuucgaugcccu

SEQ ID NO: 2984666 - RNA, 18 nt, Mycobacterium avium subsp. paratuberculosis
caguccccgguucaccag

SEQ ID NO: 2984667 - RNA, 21 nt, Mycobacterium avium subsp. paratuberculosis
cagucccgcguugugcaccaa

SEQ ID NO: 2984668 - RNA, 13 nt, Mycobacterium avium subsp. paratuberculosis
cagucccguugcg

SEQ ID NO: 2984669 - RNA, 16 nt, Mycobacterium avium subsp. paratuberculosis
cagucccguugcggga

SEQ ID NO: 2984670 - RNA, 22 nt, Mycobacterium avium subsp. paratuberculosis
cagucccguugcgggacugggc

SEQ ID NO: 2984671 - RNA, 15 nt, Mycobacterium avium subsp. paratuberculosis
caguccgacgcgacg

SEQ ID NO: 2984672 - RNA, 17 nt, Mycobacterium avium subsp. paratuberculosis
caguccgccccgaugcg

SEQ ID NO: 2984673 - RNA, 12 nt, Mycobacterium avium subsp. paratuberculosis
caguccgccgcc

SEQ ID NO: 2984674 - RNA, 14 nt, Mycobacterium avium subsp. paratuberculosis
caguccgccgccgu

SEQ ID NO: 2984675 - RNA, 21 nt, Mycobacterium avium subsp. paratuberculosis
caguccgccggagaccagcag

SEQ ID NO: 2984676 - RNA, 22 nt, Mycobacterium avium subsp. paratuberculosis
caguccgccggagaccagcagc

SEQ ID NO: 2984677 - RNA, 23 nt, Mycobacterium avium subsp. paratuberculosis
caguccgccggagaccagcagcu

SEQ ID NO: 2984678 - RNA, 15 nt, Mycobacterium avium subsp. paratuberculosis
caguccgcgccgguc

SEQ ID NO: 2984679 - RNA, 23 nt, Mycobacterium avium subsp. paratuberculosis
caguccgcgccggucccgcggcg

SEQ ID NO: 2984680 - RNA, 18 nt, Mycobacterium avium subsp. paratuberculosis
caguccgcgugacaagcc

SEQ ID NO: 2984681 - RNA, 18 nt, Mycobacterium avium subsp. paratuberculosis
caguccggacacggccag

SEQ ID NO: 2984682 - RNA, 21 nt, Mycobacterium avium subsp. paratuberculosis
caguccggacacggccagcgc

SEQ ID NO: 2984683 - RNA, 12 nt, Mycobacterium avium subsp. paratuberculosis
caguccggcagc

SEQ ID NO: 2984684 - RNA, 20 nt, Mycobacterium avium subsp. paratuberculosis
caguccggcgaguacccgcc

SEQ ID NO: 2984685 - RNA, 22 nt, Mycobacterium avium subsp. paratuberculosis
caguccggcgaguacccgccgc

SEQ ID NO: 2984686 - RNA, 17 nt, Mycobacterium avium subsp. paratuberculosis
caguccggcgccgaccc

SEQ ID NO: 2984687 - RNA, 14 nt, Mycobacterium avium subsp. paratuberculosis
caguccggcgguca

SEQ ID NO: 2984688 - RNA, 15 nt, Mycobacterium avium subsp. paratuberculosis
caguccggcggucag

SEQ ID NO: 2984689 - RNA, 21 nt, Mycobacterium avium subsp. paratuberculosis
caguccggcgugccaccgcug

SEQ ID NO: 2984690 - RNA, 19 nt, Mycobacterium avium subsp. paratuberculosis
caguccggguugggcgccu

SEQ ID NO: 2984691 - RNA, 17 nt, Mycobacterium avium subsp. paratuberculosis
caguccugggccagauc

SEQ ID NO: 2984692 - RNA, 18 nt, Mycobacterium avium subsp. paratuberculosis
caguccugggccagaucg

SEQ ID NO: 2984693 - RNA, 21 nt, Mycobacterium avium subsp. paratuberculosis
caguccugggccagaucgacc

SEQ ID NO: 2984694 - RNA, 17 nt, Mycobacterium avium subsp. paratuberculosis
cagucgaagaccacgaa

SEQ ID NO: 2984695 - RNA, 19 nt, Mycobacterium avium subsp. paratuberculosis
cagucgaagaugucgcggc

SEQ ID NO: 2984696 - RNA, 20 nt, Mycobacterium avium subsp. paratuberculosis
cagucgaagaugucgcggcg

SEQ ID NO: 2984697 - RNA, 22 nt, Mycobacterium avium subsp. paratuberculosis
cagucgaagaugucgcggcgca

SEQ ID NO: 2984698 - RNA, 18 nt, Mycobacterium avium subsp. paratuberculosis
cagucgaccucgcgcguc

SEQ ID NO: 2984699 - RNA, 19 nt, Mycobacterium avium subsp. paratuberculosis
cagucgaccucgcgcguca

SEQ ID NO: 2984700 - RNA, 14 nt, Mycobacterium avium subsp. paratuberculosis
cagucgaucagcga

SEQ ID NO: 2984701 - RNA, 22 nt, Mycobacterium avium subsp. paratuberculosis
cagucgaugucgguggcgcgca

SEQ ID NO: 2984702 - RNA, 17 nt, Mycobacterium avium subsp. paratuberculosis
cagucgcagcagcagcc

SEQ ID NO: 2984703 - RNA, 19 nt, Mycobacterium avium subsp. paratuberculosis
cagucgcagcagcagcccg

SEQ ID NO: 2984704 - RNA, 14 nt, Mycobacterium avium subsp. paratuberculosis
cagucgcaggcccc

SEQ ID NO: 2984705 - RNA, 17 nt, Mycobacterium avium subsp. paratuberculosis
cagucgcaggccccgga

SEQ ID NO: 2984706 - RNA, 13 nt, Mycobacterium avium subsp. paratuberculosis
cagucgccgccgc

SEQ ID NO: 2984707 - RNA, 15 nt, Mycobacterium avium subsp. paratuberculosis
cagucgccgccgcgc

SEQ ID NO: 2984708 - RNA, 21 nt, Mycobacterium avium subsp. paratuberculosis
cagucgccgccgcgcaccgcg

SEQ ID NO: 2984709 - RNA, 14 nt, Mycobacterium avium subsp. paratuberculosis
cagucgccgcgcag

SEQ ID NO: 2984710 - RNA, 22 nt, Mycobacterium avium subsp. paratuberculosis
cagucgccgcgcagaucgaugg

SEQ ID NO: 2984711 - RNA, 17 nt, Mycobacterium avium subsp. paratuberculosis
cagucgccggccaggcc

SEQ ID NO: 2984712 - RNA, 20 nt, Mycobacterium avium subsp. paratuberculosis
cagucgccggccaggccggc

SEQ ID NO: 2984713 - RNA, 13 nt, Mycobacterium avium subsp. paratuberculosis
cagucgcgcagcg

SEQ ID NO: 2984714 - RNA, 14 nt, Mycobacterium avium subsp. paratuberculosis
cagucgcgcagcgu

SEQ ID NO: 2984715 - RNA, 21 nt, Mycobacterium avium subsp. paratuberculosis
cagucgcgcagcgucaucgcg

SEQ ID NO: 2984716 - RNA, 14 nt, Mycobacterium avium subsp. paratuberculosis
cagucgcgccgcca

SEQ ID NO: 2984717 - RNA, 13 nt, Mycobacterium avium subsp. paratuberculosis
cagucgcggcgaa

SEQ ID NO: 2984718 - RNA, 20 nt, Mycobacterium avium subsp. paratuberculosis
cagucgcggcgaaccagcau

SEQ ID NO: 2984719 - RNA, 14 nt, Mycobacterium avium subsp. paratuberculosis
cagucgcgggcagc

SEQ ID NO: 2984720 - RNA, 18 nt, Mycobacterium avium subsp. paratuberculosis
cagucgcgggcagccggc

SEQ ID NO: 2984721 - RNA, 19 nt, Mycobacterium avium subsp. paratuberculosis
cagucgcgggcagccggcg

SEQ ID NO: 2984722 - RNA, 21 nt, Mycobacterium avium subsp. paratuberculosis
cagucgcgggcagccggcgcc

SEQ ID NO: 2984723 - RNA, 16 nt, Mycobacterium avium subsp. paratuberculosis
cagucgcgggcgagcc

SEQ ID NO: 2984724 - RNA, 14 nt, Mycobacterium avium subsp. paratuberculosis
cagucgcuggucga

SEQ ID NO: 2984725 - RNA, 15 nt, Mycobacterium avium subsp. paratuberculosis
cagucggccaccgcg

SEQ ID NO: 2984726 - RNA, 13 nt, Mycobacterium avium subsp. paratuberculosis
cagucggccauca

SEQ ID NO: 2984727 - RNA, 13 nt, Mycobacterium avium subsp. paratuberculosis
cagucggccggcg

SEQ ID NO: 2984728 - RNA, 23 nt, Mycobacterium avium subsp. paratuberculosis
cagucggccggcguuguccaggu

SEQ ID NO: 2984729 - RNA, 21 nt, Mycobacterium avium subsp. paratuberculosis
cagucggccgugaaccggcgu

SEQ ID NO: 2984730 - RNA, 16 nt, Mycobacterium avium subsp. paratuberculosis
cagucggccugcagcu

SEQ ID NO: 2984731 - RNA, 22 nt, Mycobacterium avium subsp. paratuberculosis
cagucggccugcagcucggugc

SEQ ID NO: 2984732 - RNA, 16 nt, Mycobacterium avium subsp. paratuberculosis
cagucggcgccgaugc

SEQ ID NO: 2984733 - RNA, 12 nt, Mycobacterium avium subsp. paratuberculosis
cagucggcgcgu

SEQ ID NO: 2984734 - RNA, 16 nt, Mycobacterium avium subsp. paratuberculosis
cagucggcgucgcggc

SEQ ID NO: 2984735 - RNA, 19 nt, Mycobacterium avium subsp. paratuberculosis
cagucggucaacgugucga

SEQ ID NO: 2984736 - RNA, 21 nt, Mycobacterium avium subsp. paratuberculosis
cagucggucaacgugucgagc

SEQ ID NO: 2984737 - RNA, 22 nt, Mycobacterium avium subsp. paratuberculosis
cagucguacucccaggccgcgg

SEQ ID NO: 2984738 - RNA, 23 nt, Mycobacterium avium subsp. paratuberculosis
cagucguacucccaggccgcggc

SEQ ID NO: 2984739 - RNA, 17 nt, Mycobacterium avium subsp. paratuberculosis
cagucgucgaugaaguc

SEQ ID NO: 2984740 - RNA, 18 nt, Mycobacterium avium subsp. paratuberculosis
cagucguucggccagcac

SEQ ID NO: 2984741 - RNA, 21 nt, Mycobacterium avium subsp. paratuberculosis
cagucguugccgcccgggaag

SEQ ID NO: 2984742 - RNA, 23 nt, Mycobacterium avium subsp. paratuberculosis
cagucguuggugcgcaccagcag

SEQ ID NO: 2984743 - RNA, 15 nt, Mycobacterium avium subsp. paratuberculosis
cagucugccgguggc

SEQ ID NO: 2984744 - RNA, 18 nt, Mycobacterium avium subsp. paratuberculosis
cagucuuguugaccuucu

SEQ ID NO: 2984745 - RNA, 17 nt, Mycobacterium avium subsp. paratuberculosis
cagugaccgcacgauca

SEQ ID NO: 2984746 - RNA, 16 nt, Mycobacterium avium subsp. paratuberculosis
cagugacgccugcggc

SEQ ID NO: 2984747 - RNA, 14 nt, Mycobacterium avium subsp. paratuberculosis
cagugaggccagca

SEQ ID NO: 2984748 - RNA, 19 nt, Mycobacterium avium subsp. paratuberculosis
cagugagggaacgccgauc

SEQ ID NO: 2984749 - RNA, 14 nt, Mycobacterium avium subsp. paratuberculosis
cagugaucggcgga

SEQ ID NO: 2984750 - RNA, 20 nt, Mycobacterium avium subsp. paratuberculosis
cagugaucggcggaacccgg

SEQ ID NO: 2984751 - RNA, 13 nt, Mycobacterium avium subsp. paratuberculosis
cagugcaccucga

SEQ ID NO: 2984752 - RNA, 17 nt, Mycobacterium avium subsp. paratuberculosis
cagugcaccucgacgaa

SEQ ID NO: 2984753 - RNA, 15 nt, Mycobacterium avium subsp. paratuberculosis
cagugcacgacgacc

SEQ ID NO: 2984754 - RNA, 18 nt, Mycobacterium avium subsp. paratuberculosis
cagugcacgacgaccgcg

SEQ ID NO: 2984755 - RNA, 15 nt, Mycobacterium avium subsp. paratuberculosis
cagugcacgcucggc

SEQ ID NO: 2984756 - RNA, 18 nt, Mycobacterium avium subsp. paratuberculosis
cagugcacgcucggcgcg

SEQ ID NO: 2984757 - RNA, 17 nt, Mycobacterium avium subsp. paratuberculosis
cagugcacgcucggcgg

SEQ ID NO: 2984758 - RNA, 19 nt, Mycobacterium avium subsp. paratuberculosis
cagugcacgcucggcgggg

SEQ ID NO: 2984759 - RNA, 15 nt, Mycobacterium avium subsp. paratuberculosis
cagugcacugccgac

SEQ ID NO: 2984760 - RNA, 13 nt, Mycobacterium avium subsp. paratuberculosis
cagugcaggcuga

SEQ ID NO: 2984761 - RNA, 18 nt, Mycobacterium avium subsp. paratuberculosis
cagugcaucgcugccguc

SEQ ID NO: 2984762 - RNA, 13 nt, Mycobacterium avium subsp. paratuberculosis
cagugcaugccgg

SEQ ID NO: 2984763 - RNA, 17 nt, Mycobacterium avium subsp. paratuberculosis
cagugccaacacggcgg

SEQ ID NO: 2984764 - RNA, 18 nt, Mycobacterium avium subsp. paratuberculosis
cagugccaacacggcggc

SEQ ID NO: 2984765 - RNA, 19 nt, Mycobacterium avium subsp. paratuberculosis
cagugccaccaccacggcc

SEQ ID NO: 2984766 - RNA, 21 nt, Mycobacterium avium subsp. paratuberculosis
cagugccaccaccacggccag

SEQ ID NO: 2984767 - RNA, 17 nt, Mycobacterium avium subsp. paratuberculosis
cagugccaguaccagcg

SEQ ID NO: 2984768 - RNA, 18 nt, Mycobacterium avium subsp. paratuberculosis
cagugccccguccggcgc

SEQ ID NO: 2984769 - RNA, 19 nt, Mycobacterium avium subsp. paratuberculosis
cagugccccguccggcgcc

SEQ ID NO: 2984770 - RNA, 18 nt, Mycobacterium avium subsp. paratuberculosis
cagugcccgcccagcugc

SEQ ID NO: 2984771 - RNA, 20 nt, Mycobacterium avium subsp. paratuberculosis
cagugcccgcccagcugcac

SEQ ID NO: 2984772 - RNA, 15 nt, Mycobacterium avium subsp. paratuberculosis
cagugccgcaccagc

SEQ ID NO: 2984773 - RNA, 20 nt, Mycobacterium avium subsp. paratuberculosis
cagugccgcagguggugggc

SEQ ID NO: 2984774 - RNA, 13 nt, Mycobacterium avium subsp. paratuberculosis
cagugccgcgcca

SEQ ID NO: 2984775 - RNA, 19 nt, Mycobacterium avium subsp. paratuberculosis
cagugccgcgcggacgcgg

SEQ ID NO: 2984776 - RNA, 13 nt, Mycobacterium avium subsp. paratuberculosis
cagugccggcgag

SEQ ID NO: 2984777 - RNA, 14 nt, Mycobacterium avium subsp. paratuberculosis
cagugccggcgcac

SEQ ID NO: 2984778 - RNA, 18 nt, Mycobacterium avium subsp. paratuberculosis
cagugccggcgcaccgcg

SEQ ID NO: 2984779 - RNA, 14 nt, Mycobacterium avium subsp. paratuberculosis
cagugccgggccag

SEQ ID NO: 2984780 - RNA, 17 nt, Mycobacterium avium subsp. paratuberculosis
cagugccgggccagcug

SEQ ID NO: 2984781 - RNA, 20 nt, Mycobacterium avium subsp. paratuberculosis
cagugccgggccagcugcuc

SEQ ID NO: 2984782 - RNA, 21 nt, Mycobacterium avium subsp. paratuberculosis
cagugccgggccagcugcucg

SEQ ID NO: 2984783 - RNA, 22 nt, Mycobacterium avium subsp. paratuberculosis
cagugccggugcagcaccucga

SEQ ID NO: 2984784 - RNA, 13 nt, Mycobacterium avium subsp. paratuberculosis
cagugcgagaaaa

SEQ ID NO: 2984785 - RNA, 23 nt, Mycobacterium avium subsp. paratuberculosis
cagugcgagaaaaucgcccgcga

SEQ ID NO: 2984786 - RNA, 18 nt, Mycobacterium avium subsp. paratuberculosis
cagugcgcaggcggcgcg

SEQ ID NO: 2984787 - RNA, 15 nt, Mycobacterium avium subsp. paratuberculosis
cagugcgcauucggc

SEQ ID NO: 2984788 - RNA, 19 nt, Mycobacterium avium subsp. paratuberculosis
cagugcgcauucggcgacg

SEQ ID NO: 2984789 - RNA, 20 nt, Mycobacterium avium subsp. paratuberculosis
cagugcgccgucccggacgc

SEQ ID NO: 2984790 - RNA, 19 nt, Mycobacterium avium subsp. paratuberculosis
cagugcgccuugucgaugg

SEQ ID NO: 2984791 - RNA, 13 nt, Mycobacterium avium subsp. paratuberculosis
cagugcgcggcgu

SEQ ID NO: 2984792 - RNA, 19 nt, Mycobacterium avium subsp. paratuberculosis
cagugcgcggcguccucga

SEQ ID NO: 2984793 - RNA, 16 nt, Mycobacterium avium subsp. paratuberculosis
cagugcggacgccaca

SEQ ID NO: 2984794 - RNA, 16 nt, Mycobacterium avium subsp. paratuberculosis
cagugcggcccgccgg

SEQ ID NO: 2984795 - RNA, 21 nt, Mycobacterium avium subsp. paratuberculosis
cagugcggcccgccgggcguc

SEQ ID NO: 2984796 - RNA, 13 nt, Mycobacterium avium subsp. paratuberculosis
cagugcgggcauc

SEQ ID NO: 2984797 - RNA, 21 nt, Mycobacterium avium subsp. paratuberculosis
cagugcgggcaucggcugguc

SEQ ID NO: 2984798 - RNA, 22 nt, Mycobacterium avium subsp. paratuberculosis
cagugcgggcucgauguugauc

SEQ ID NO: 2984799 - RNA, 20 nt, Mycobacterium avium subsp. paratuberculosis
cagugcgucagaaccggggc

SEQ ID NO: 2984800 - RNA, 22 nt, Mycobacterium avium subsp. paratuberculosis
cagugcgucagaaccggggcca

SEQ ID NO: 2984801 - RNA, 14 nt, Mycobacterium avium subsp. paratuberculosis
cagugcgucgccca

SEQ ID NO: 2984802 - RNA, 19 nt, Mycobacterium avium subsp. paratuberculosis
cagugcgucgcccaucacc

SEQ ID NO: 2984803 - RNA, 17 nt, Mycobacterium avium subsp. paratuberculosis
cagugcucgaccagauu

SEQ ID NO: 2984804 - RNA, 22 nt, Mycobacterium avium subsp. paratuberculosis
caguggcugcacgucacgggcc

SEQ ID NO: 2984805 - RNA, 23 nt, Mycobacterium avium subsp. paratuberculosis
caguggcugcacgucacgggcca

SEQ ID NO: 2984806 - RNA, 20 nt, Mycobacterium avium subsp. paratuberculosis
caguggcugucgggugccgc

SEQ ID NO: 2984807 - RNA, 20 nt, Mycobacterium avium subsp. paratuberculosis
caguggguggugugcucggu

SEQ ID NO: 2984808 - RNA, 23 nt, Mycobacterium avium subsp. paratuberculosis
cagugguugagcagcagaccgcc

SEQ ID NO: 2984809 - RNA, 17 nt, Mycobacterium avium subsp. paratuberculosis
caguguccagucggccg

SEQ ID NO: 2984810 - RNA, 17 nt, Mycobacterium avium subsp. paratuberculosis
caguguccgaucgccuc

SEQ ID NO: 2984811 - RNA, 21 nt, Mycobacterium avium subsp. paratuberculosis
caguguccgaucgccuccuca

SEQ ID NO: 2984812 - RNA, 14 nt, Mycobacterium avium subsp. paratuberculosis
caguguccgggcgc

SEQ ID NO: 2984813 - RNA, 18 nt, Mycobacterium avium subsp. paratuberculosis
cagugucggaaucggcgc

SEQ ID NO: 2984814 - RNA, 22 nt, Mycobacterium avium subsp. paratuberculosis
cagugucguggcgacaucgccg

SEQ ID NO: 2984815 - RNA, 14 nt, Mycobacterium avium subsp. paratuberculosis
caguguggccgcgg

SEQ ID NO: 2984816 - RNA, 13 nt, Mycobacterium avium subsp. paratuberculosis
caguuaccggcgu

SEQ ID NO: 2984817 - RNA, 13 nt, Mycobacterium avium subsp. paratuberculosis
caguucaccgcgc

SEQ ID NO: 2984818 - RNA, 11 nt, Mycobacterium avium subsp. paratuberculosis
caguucccggc

SEQ ID NO: 2984819 - RNA, 14 nt, Mycobacterium avium subsp. paratuberculosis
caguucccggcggg

SEQ ID NO: 2984820 - RNA, 14 nt, Mycobacterium avium subsp. paratuberculosis
caguuccgacauca

SEQ ID NO: 2984821 - RNA, 22 nt, Mycobacterium avium subsp. paratuberculosis
caguuccgacaucagugcgggc

SEQ ID NO: 2984822 - RNA, 23 nt, Mycobacterium avium subsp. paratuberculosis
caguuccgacaucagugcgggca

SEQ ID NO: 2984823 - RNA, 14 nt, Mycobacterium avium subsp. paratuberculosis
caguuccucgccgg

SEQ ID NO: 2984824 - RNA, 17 nt, Mycobacterium avium subsp. paratuberculosis
caguuccugcaugccgg

SEQ ID NO: 2984825 - RNA, 18 nt, Mycobacterium avium subsp. paratuberculosis
caguuccuugauccggcc

SEQ ID NO: 2984826 - RNA, 19 nt, Mycobacterium avium subsp. paratuberculosis
caguuccuugauccggccg

SEQ ID NO: 2984827 - RNA, 20 nt, Mycobacterium avium subsp. paratuberculosis
caguuccuugauccggccgc

SEQ ID NO: 2984828 - RNA, 23 nt, Mycobacterium avium subsp. paratuberculosis
caguuccuugauccggccgcgga

SEQ ID NO: 2984829 - RNA, 17 nt, Mycobacterium avium subsp. paratuberculosis
caguuccuugcgcagca

SEQ ID NO: 2984830 - RNA, 19 nt, Mycobacterium avium subsp. paratuberculosis
caguuccuugcgcagcacc

SEQ ID NO: 2984831 - RNA, 20 nt, Mycobacterium avium subsp. paratuberculosis
caguuccuugcgcagcaccu

SEQ ID NO: 2984832 - RNA, 21 nt, Mycobacterium avium subsp. paratuberculosis
caguucgaccggcaccagcag

SEQ ID NO: 2984833 - RNA, 23 nt, Mycobacterium avium subsp. paratuberculosis
caguucgaccggcaccagcagcc

SEQ ID NO: 2984834 - RNA, 20 nt, Mycobacterium avium subsp. paratuberculosis
caguucgacguagcccgccg

SEQ ID NO: 2984835 - RNA, 16 nt, Mycobacterium avium subsp. paratuberculosis
caguucgagcgccgcg

SEQ ID NO: 2984836 - RNA, 18 nt, Mycobacterium avium subsp. paratuberculosis
caguucgagcgccgcggc

SEQ ID NO: 2984837 - RNA, 20 nt, Mycobacterium avium subsp. paratuberculosis
caguucgagcgccgcggcca

SEQ ID NO: 2984838 - RNA, 17 nt, Mycobacterium avium subsp. paratuberculosis
caguucgaucagcagcu

SEQ ID NO: 2984839 - RNA, 19 nt, Mycobacterium avium subsp. paratuberculosis
caguucgaucagcagcucg

SEQ ID NO: 2984840 - RNA, 18 nt, Mycobacterium avium subsp. paratuberculosis
caguucgaugccgaugag

SEQ ID NO: 2984841 - RNA, 20 nt, Mycobacterium avium subsp. paratuberculosis
caguucgaugcgcucggcga

SEQ ID NO: 2984842 - RNA, 23 nt, Mycobacterium avium subsp. paratuberculosis
caguucgcaccccaccgacagcc

SEQ ID NO: 2984843 - RNA, 16 nt, Mycobacterium avium subsp. paratuberculosis
caguucgccaccacgg

SEQ ID NO: 2984844 - RNA, 16 nt, Mycobacterium avium subsp. paratuberculosis
caguucgccagcaugc

SEQ ID NO: 2984845 - RNA, 23 nt, Mycobacterium avium subsp. paratuberculosis
caguucgccggugaccugcagcg

SEQ ID NO: 2984846 - RNA, 19 nt, Mycobacterium avium subsp. paratuberculosis
caguucgcguacccgcgcg

SEQ ID NO: 2984847 - RNA, 23 nt, Mycobacterium avium subsp. paratuberculosis
caguucgcguacccgcgcggcgu

SEQ ID NO: 2984848 - RNA, 15 nt, Mycobacterium avium subsp. paratuberculosis
caguucggccgccgu

SEQ ID NO: 2984849 - RNA, 15 nt, Mycobacterium avium subsp. paratuberculosis
caguucggccggcuu

SEQ ID NO: 2984850 - RNA, 19 nt, Mycobacterium avium subsp. paratuberculosis
caguucgggaucgucgccg

SEQ ID NO: 2984851 - RNA, 20 nt, Mycobacterium avium subsp. paratuberculosis
caguucgggaucgucgccgg

SEQ ID NO: 2984852 - RNA, 17 nt, Mycobacterium avium subsp. paratuberculosis
caguucggguccgcggu

SEQ ID NO: 2984853 - RNA, 13 nt, Mycobacterium avium subsp. paratuberculosis
caguucggugcac

SEQ ID NO: 2984854 - RNA, 15 nt, Mycobacterium avium subsp. paratuberculosis
caguucggugcacgg

SEQ ID NO: 2984855 - RNA, 20 nt, Mycobacterium avium subsp. paratuberculosis
caguucggugcacggcgcca

SEQ ID NO: 2984856 - RNA, 22 nt, Mycobacterium avium subsp. paratuberculosis
caguucggugcacggcgccacc

SEQ ID NO: 2984857 - RNA, 22 nt, Mycobacterium avium subsp. paratuberculosis
caguucgguggggccgccgucu

SEQ ID NO: 2984858 - RNA, 15 nt, Mycobacterium avium subsp. paratuberculosis
caguucguccagccc

SEQ ID NO: 2984859 - RNA, 16 nt, Mycobacterium avium subsp. paratuberculosis
caguucguccagcccg

SEQ ID NO: 2984860 - RNA, 17 nt, Mycobacterium avium subsp. paratuberculosis
caguucgucgcgcgacu

SEQ ID NO: 2984861 - RNA, 21 nt, Mycobacterium avium subsp. paratuberculosis
caguucgucgcgcgacugggc

SEQ ID NO: 2984862 - RNA, 13 nt, Mycobacterium avium subsp. paratuberculosis
caguucgucggcc

SEQ ID NO: 2984863 - RNA, 16 nt, Mycobacterium avium subsp. paratuberculosis
caguucgucggccguc

SEQ ID NO: 2984864 - RNA, 20 nt, Mycobacterium avium subsp. paratuberculosis
caguucgucggccgucggcg

SEQ ID NO: 2984865 - RNA, 16 nt, Mycobacterium avium subsp. paratuberculosis
caguucguucauccgg

SEQ ID NO: 2984866 - RNA, 18 nt, Mycobacterium avium subsp. paratuberculosis
caguugaaguccggcggu

SEQ ID NO: 2984867 - RNA, 18 nt, Mycobacterium avium subsp. paratuberculosis
caguugacguugaucgcg

SEQ ID NO: 2984868 - RNA, 23 nt, Mycobacterium avium subsp. paratuberculosis
caguugacguugaucgcgccgau

SEQ ID NO: 2984869 - RNA, 14 nt, Mycobacterium avium subsp. paratuberculosis
caguugcacggugu

SEQ ID NO: 2984870 - RNA, 19 nt, Mycobacterium avium subsp. paratuberculosis
caguugcgaccccgccguc

SEQ ID NO: 2984871 - RNA, 21 nt, Mycobacterium avium subsp. paratuberculosis
caguugcgcggcgggcgagcc

SEQ ID NO: 2984872 - RNA, 18 nt, Mycobacterium avium subsp. paratuberculosis
caguugcgcguugcgcgg

SEQ ID NO: 2984873 - RNA, 20 nt, Mycobacterium avium subsp. paratuberculosis
caguuggcgucgucggcggc

SEQ ID NO: 2984874 - RNA, 18 nt, Mycobacterium avium subsp. paratuberculosis
caguugggggccagcgcc

SEQ ID NO: 2984875 - RNA, 15 nt, Mycobacterium avium subsp. paratuberculosis
caguuucccgucggg

SEQ ID NO: 2984876 - RNA, 19 nt, Mycobacterium avium subsp. paratuberculosis
cauacaccgggaucggcgg

SEQ ID NO: 2984877 - RNA, 20 nt, Mycobacterium avium subsp. paratuberculosis
cauacaccgggaucggcggc

SEQ ID NO: 2984878 - RNA, 22 nt, Mycobacterium avium subsp. paratuberculosis
cauacaccgggaucggcggcgg

SEQ ID NO: 2984879 - RNA, 17 nt, Mycobacterium avium subsp. paratuberculosis
cauacaccuugucggcg

SEQ ID NO: 2984880 - RNA, 14 nt, Mycobacterium avium subsp. paratuberculosis
cauacacgggccgu

SEQ ID NO: 2984881 - RNA, 21 nt, Mycobacterium avium subsp. paratuberculosis
cauacacgggccguccauccc

SEQ ID NO: 2984882 - RNA, 20 nt, Mycobacterium avium subsp. paratuberculosis
cauaccagccguucucgucc

SEQ ID NO: 2984883 - RNA, 19 nt, Mycobacterium avium subsp. paratuberculosis
cauaccagugcccgagcac

SEQ ID NO: 2984884 - RNA, 20 nt, Mycobacterium avium subsp. paratuberculosis
cauaccccccacgcucggcg

SEQ ID NO: 2984885 - RNA, 14 nt, Mycobacterium avium subsp. paratuberculosis
cauaccgcccgcgc

SEQ ID NO: 2984886 - RNA, 20 nt, Mycobacterium avium subsp. paratuberculosis
cauaccgggacaucgucgcg

SEQ ID NO: 2984887 - RNA, 14 nt, Mycobacterium avium subsp. paratuberculosis
cauacgcggcggcc

SEQ ID NO: 2984888 - RNA, 11 nt, Mycobacterium avium subsp. paratuberculosis
cauacggcggc

SEQ ID NO: 2984889 - RNA, 15 nt, Mycobacterium avium subsp. paratuberculosis
cauacggcggcucgg

SEQ ID NO: 2984890 - RNA, 16 nt, Mycobacterium avium subsp. paratuberculosis
cauacggcggcucggg

SEQ ID NO: 2984891 - RNA, 19 nt, Mycobacterium avium subsp. paratuberculosis
cauacugcuugccgucgac

SEQ ID NO: 2984892 - RNA, 22 nt, Mycobacterium avium subsp. paratuberculosis
cauacugcuugccgucgacgcg

SEQ ID NO: 2984893 - RNA, 17 nt, Mycobacterium avium subsp. paratuberculosis
cauagcccaucagcacg

SEQ ID NO: 2984894 - RNA, 15 nt, Mycobacterium avium subsp. paratuberculosis
cauagccggccgcgu

SEQ ID NO: 2984895 - RNA, 16 nt, Mycobacterium avium subsp. paratuberculosis
cauagccggccgcguc

SEQ ID NO: 2984896 - RNA, 16 nt, Mycobacterium avium subsp. paratuberculosis
cauagcgccgcucggc

SEQ ID NO: 2984897 - RNA, 16 nt, Mycobacterium avium subsp. paratuberculosis
cauagcucaggugcga

SEQ ID NO: 2984898 - RNA, 17 nt, Mycobacterium avium subsp. paratuberculosis
cauagcuggcgccgaac

SEQ ID NO: 2984899 - RNA, 12 nt, Mycobacterium avium subsp. paratuberculosis
cauaggaccgga

SEQ ID NO: 2984900 - RNA, 16 nt, Mycobacterium avium subsp. paratuberculosis
cauaggccagcaccag

SEQ ID NO: 2984901 - RNA, 21 nt, Mycobacterium avium subsp. paratuberculosis
cauaggccgcgaggauuucgc

SEQ ID NO: 2984902 - RNA, 15 nt, Mycobacterium avium subsp. paratuberculosis
cauaggcguacacca

SEQ ID NO: 2984903 - RNA, 16 nt, Mycobacterium avium subsp. paratuberculosis
cauaggcguacaccag

SEQ ID NO: 2984904 - RNA, 18 nt, Mycobacterium avium subsp. paratuberculosis
cauagggcucguccucga

SEQ ID NO: 2984905 - RNA, 16 nt, Mycobacterium avium subsp. paratuberculosis
cauaguccagcucgcg

SEQ ID NO: 2984906 - RNA, 15 nt, Mycobacterium avium subsp. paratuberculosis
cauagucgaggggcu

SEQ ID NO: 2984907 - RNA, 20 nt, Mycobacterium avium subsp. paratuberculosis
cauaucgagguaggccaccg

SEQ ID NO: 2984908 - RNA, 17 nt, Mycobacterium avium subsp. paratuberculosis
cauaugacgccggccuc

SEQ ID NO: 2984909 - RNA, 15 nt, Mycobacterium avium subsp. paratuberculosis
cauaugcgugggccc

SEQ ID NO: 2984910 - RNA, 19 nt, Mycobacterium avium subsp. paratuberculosis
cauauugguucgcucgucu

SEQ ID NO: 2984911 - RNA, 20 nt, Mycobacterium avium subsp. paratuberculosis
caucaaccgauuucggccag

SEQ ID NO: 2984912 - RNA, 15 nt, Mycobacterium avium subsp. paratuberculosis
caucaacugcaccag

SEQ ID NO: 2984913 - RNA, 19 nt, Mycobacterium avium subsp. paratuberculosis
caucaagugcaagggcgac

SEQ ID NO: 2984914 - RNA, 17 nt, Mycobacterium avium subsp. paratuberculosis
caucaccaccgccgccg

SEQ ID NO: 2984915 - RNA, 14 nt, Mycobacterium avium subsp. paratuberculosis
caucaccacgcugu

SEQ ID NO: 2984916 - RNA, 17 nt, Mycobacterium avium subsp. paratuberculosis
caucaccagcagacccg

SEQ ID NO: 2984917 - RNA, 13 nt, Mycobacterium avium subsp. paratuberculosis
caucaccagcgcg

SEQ ID NO: 2984918 - RNA, 14 nt, Mycobacterium avium subsp. paratuberculosis
caucaccagcgcgu

SEQ ID NO: 2984919 - RNA, 13 nt, Mycobacterium avium subsp. paratuberculosis
caucaccagcggc

SEQ ID NO: 2984920 - RNA, 15 nt, Mycobacterium avium subsp. paratuberculosis
caucaccagcggcug

SEQ ID NO: 2984921 - RNA, 12 nt, Mycobacterium avium subsp. paratuberculosis
caucacccggcg

SEQ ID NO: 2984922 - RNA, 15 nt, Mycobacterium avium subsp. paratuberculosis
caucacccggcgcgc

SEQ ID NO: 2984923 - RNA, 13 nt, Mycobacterium avium subsp. paratuberculosis
caucacccggcgg

SEQ ID NO: 2984924 - RNA, 14 nt, Mycobacterium avium subsp. paratuberculosis
caucacccggcggc

SEQ ID NO: 2984925 - RNA, 17 nt, Mycobacterium avium subsp. paratuberculosis
caucaccgaggucaccg

SEQ ID NO: 2984926 - RNA, 18 nt, Mycobacterium avium subsp. paratuberculosis
caucaccgaggucaccgc

SEQ ID NO: 2984927 - RNA, 15 nt, Mycobacterium avium subsp. paratuberculosis
caucaccgcaccgac

SEQ ID NO: 2984928 - RNA, 16 nt, Mycobacterium avium subsp. paratuberculosis
caucaccgcaccgacg

SEQ ID NO: 2984929 - RNA, 23 nt, Mycobacterium avium subsp. paratuberculosis
caucaccgccgagggcccgggca

SEQ ID NO: 2984930 - RNA, 19 nt, Mycobacterium avium subsp. paratuberculosis
caucaccgcgggcgcgccg

SEQ ID NO: 2984931 - RNA, 14 nt, Mycobacterium avium subsp. paratuberculosis
caucaccggaccgg

SEQ ID NO: 2984932 - RNA, 22 nt, Mycobacterium avium subsp. paratuberculosis
caucaccggaccggccagcagc

SEQ ID NO: 2984933 - RNA, 12 nt, Mycobacterium avium subsp. paratuberculosis
caucaccgggga

SEQ ID NO: 2984934 - RNA, 20 nt, Mycobacterium avium subsp. paratuberculosis
caucaccggggaucaccucg

SEQ ID NO: 2984935 - RNA, 19 nt, Mycobacterium avium subsp. paratuberculosis
caucaccuucugcgcgccg

SEQ ID NO: 2984936 - RNA, 22 nt, Mycobacterium avium subsp. paratuberculosis
caucaccuucugcgcgccgucg

SEQ ID NO: 2984937 - RNA, 18 nt, Mycobacterium avium subsp. paratuberculosis
caucaccuucugcgucgg

SEQ ID NO: 2984938 - RNA, 13 nt, Mycobacterium avium subsp. paratuberculosis
caucaccuugucg

SEQ ID NO: 2984939 - RNA, 23 nt, Mycobacterium avium subsp. paratuberculosis
caucaccuugucgcugaccaccg

SEQ ID NO: 2984940 - RNA, 24 nt, Mycobacterium avium subsp. paratuberculosis
caucacgaacgcguucgucggcgc

SEQ ID NO: 2984941 - RNA, 17 nt, Mycobacterium avium subsp. paratuberculosis
caucacgaccucgaaca

SEQ ID NO: 2984942 - RNA, 17 nt, Mycobacterium avium subsp. paratuberculosis
caucacgauggugcccg

SEQ ID NO: 2984943 - RNA, 20 nt, Mycobacterium avium subsp. paratuberculosis
caucacgcagaacucgucgc

SEQ ID NO: 2984944 - RNA, 23 nt, Mycobacterium avium subsp. paratuberculosis
caucacggugccgaguucgaccu

SEQ ID NO: 2984945 - RNA, 18 nt, Mycobacterium avium subsp. paratuberculosis
caucacgguggccgccac

SEQ ID NO: 2984946 - RNA, 15 nt, Mycobacterium avium subsp. paratuberculosis
caucacgucccgcuc

SEQ ID NO: 2984947 - RNA, 22 nt, Mycobacterium avium subsp. paratuberculosis
caucagcaccacguugcgcccg

SEQ ID NO: 2984948 - RNA, 13 nt, Mycobacterium avium subsp. paratuberculosis
caucagcaccgcg

SEQ ID NO: 2984949 - RNA, 13 nt, Mycobacterium avium subsp. paratuberculosis
caucagcaccucc

SEQ ID NO: 2984950 - RNA, 20 nt, Mycobacterium avium subsp. paratuberculosis
caucagcaccuccggcagcg

SEQ ID NO: 2984951 - RNA, 14 nt, Mycobacterium avium subsp. paratuberculosis
caucagcagcgccu

SEQ ID NO: 2984952 - RNA, 12 nt, Mycobacterium avium subsp. paratuberculosis
caucagccccuu

SEQ ID NO: 2984953 - RNA, 14 nt, Mycobacterium avium subsp. paratuberculosis
caucagcccggcgu

SEQ ID NO: 2984954 - RNA, 12 nt, Mycobacterium avium subsp. paratuberculosis
caucagccgccg

SEQ ID NO: 2984955 - RNA, 19 nt, Mycobacterium avium subsp. paratuberculosis
caucagcgacgucaggucg

SEQ ID NO: 2984956 - RNA, 17 nt, Mycobacterium avium subsp. paratuberculosis
caucagcgagacgacca

SEQ ID NO: 2984957 - RNA, 23 nt, Mycobacterium avium subsp. paratuberculosis
caucagcgagacgaccaggaugc

SEQ ID NO: 2984958 - RNA, 14 nt, Mycobacterium avium subsp. paratuberculosis
caucagcgccacca

SEQ ID NO: 2984959 - RNA, 16 nt, Mycobacterium avium subsp. paratuberculosis
caucagcgccaccagc

SEQ ID NO: 2984960 - RNA, 18 nt, Mycobacterium avium subsp. paratuberculosis
caucagcgccaccagcac

SEQ ID NO: 2984961 - RNA, 16 nt, Mycobacterium avium subsp. paratuberculosis
caucagcgcccgcgcg

SEQ ID NO: 2984962 - RNA, 22 nt, Mycobacterium avium subsp. paratuberculosis
caucagcgcccgcgcgggcugc

SEQ ID NO: 2984963 - RNA, 14 nt, Mycobacterium avium subsp. paratuberculosis
caucagcgcccggg

SEQ ID NO: 2984964 - RNA, 20 nt, Mycobacterium avium subsp. paratuberculosis
caucagcgcccgggugggcg

SEQ ID NO: 2984965 - RNA, 13 nt, Mycobacterium avium subsp. paratuberculosis
caucagcggcucg

SEQ ID NO: 2984966 - RNA, 15 nt, Mycobacterium avium subsp. paratuberculosis
caucagcggcucgcg

SEQ ID NO: 2984967 - RNA, 19 nt, Mycobacterium avium subsp. paratuberculosis
caucagcggcucgcgggug

SEQ ID NO: 2984968 - RNA, 18 nt, Mycobacterium avium subsp. paratuberculosis
caucagcggggcguccag

SEQ ID NO: 2984969 - RNA, 21 nt, Mycobacterium avium subsp. paratuberculosis
caucagcggggcguccagcga

SEQ ID NO: 2984970 - RNA, 19 nt, Mycobacterium avium subsp. paratuberculosis
caucagcucggcagccccg

SEQ ID NO: 2984971 - RNA, 13 nt, Mycobacterium avium subsp. paratuberculosis
caucagcucggcg

SEQ ID NO: 2984972 - RNA, 15 nt, Mycobacterium avium subsp. paratuberculosis
caucagcucggcggc

SEQ ID NO: 2984973 - RNA, 16 nt, Mycobacterium avium subsp. paratuberculosis
caucagcucggcggcc

SEQ ID NO: 2984974 - RNA, 14 nt, Mycobacterium avium subsp. paratuberculosis
caucagcucgucag

SEQ ID NO: 2984975 - RNA, 15 nt, Mycobacterium avium subsp. paratuberculosis
caucagcucgucagc

SEQ ID NO: 2984976 - RNA, 12 nt, Mycobacterium avium subsp. paratuberculosis
caucagcugccg

SEQ ID NO: 2984977 - RNA, 17 nt, Mycobacterium avium subsp. paratuberculosis
caucaggaugcccgggc

SEQ ID NO: 2984978 - RNA, 22 nt, Mycobacterium avium subsp. paratuberculosis
caucaggcccuugccccaccac

SEQ ID NO: 2984979 - RNA, 23 nt, Mycobacterium avium subsp. paratuberculosis
caucaggcccuugccccaccacc

SEQ ID NO: 2984980 - RNA, 18 nt, Mycobacterium avium subsp. paratuberculosis
caucaggccggccugcca

SEQ ID NO: 2984981 - RNA, 14 nt, Mycobacterium avium subsp. paratuberculosis
caucaggcggccgg

SEQ ID NO: 2984982 - RNA, 18 nt, Mycobacterium avium subsp. paratuberculosis
caucaggcggccggcccg

SEQ ID NO: 2984983 - RNA, 21 nt, Mycobacterium avium subsp. paratuberculosis
caucaggcggccggcccggcc

SEQ ID NO: 2984984 - RNA, 20 nt, Mycobacterium avium subsp. paratuberculosis
caucagggccagccgaugcg

SEQ ID NO: 2984985 - RNA, 20 nt, Mycobacterium avium subsp. paratuberculosis
caucagggcguugaucacga

SEQ ID NO: 2984986 - RNA, 20 nt, Mycobacterium avium subsp. paratuberculosis
caucaggucggugccgcggc

SEQ ID NO: 2984987 - RNA, 22 nt, Mycobacterium avium subsp. paratuberculosis
caucaggucggugccgcggcgc

SEQ ID NO: 2984988 - RNA, 17 nt, Mycobacterium avium subsp. paratuberculosis
caucagguugaccaggu

SEQ ID NO: 2984989 - RNA, 22 nt, Mycobacterium avium subsp. paratuberculosis
caucagguugaccaggugggcg

SEQ ID NO: 2984990 - RNA, 14 nt, Mycobacterium avium subsp. paratuberculosis
caucagugaccgca

SEQ ID NO: 2984991 - RNA, 16 nt, Mycobacterium avium subsp. paratuberculosis
caucagugcggcccgc

SEQ ID NO: 2984992 - RNA, 20 nt, Mycobacterium avium subsp. paratuberculosis
caucagugcggcccgccggg

SEQ ID NO: 2984993 - RNA, 14 nt, Mycobacterium avium subsp. paratuberculosis
caucagugcgggca

SEQ ID NO: 2984994 - RNA, 16 nt, Mycobacterium avium subsp. paratuberculosis
caucaucggcacgccg

SEQ ID NO: 2984995 - RNA, 22 nt, Mycobacterium avium subsp. paratuberculosis
caucaucggcacgccggggccc

SEQ ID NO: 2984996 - RNA, 23 nt, Mycobacterium avium subsp. paratuberculosis
caucaucggcacgccggggcccu

SEQ ID NO: 2984997 - RNA, 16 nt, Mycobacterium avium subsp. paratuberculosis
caucaucucggcgaag

SEQ ID NO: 2984998 - RNA, 15 nt, Mycobacterium avium subsp. paratuberculosis
caucaugcccaccau

SEQ ID NO: 2984999 - RNA, 22 nt, Mycobacterium avium subsp. paratuberculosis
caucaugcguuugccgucgagg

SEQ ID NO: 2985000 - RNA, 15 nt, Mycobacterium avium subsp. paratuberculosis
caucauguccagguu

SEQ ID NO: 2985001 - RNA, 14 nt, Mycobacterium avium subsp. paratuberculosis
caucaugucgaaga

SEQ ID NO: 2985002 - RNA, 22 nt, Mycobacterium avium subsp. paratuberculosis
caucaugucgaagaagcggccg

SEQ ID NO: 2985003 - RNA, 14 nt, Mycobacterium avium subsp. paratuberculosis
cauccacucggcca

SEQ ID NO: 2985004 - RNA, 13 nt, Mycobacterium avium subsp. paratuberculosis
cauccacucgggc

SEQ ID NO: 2985005 - RNA, 20 nt, Mycobacterium avium subsp. paratuberculosis
cauccacucgggccagccca

SEQ ID NO: 2985006 - RNA, 18 nt, Mycobacterium avium subsp. paratuberculosis
cauccagcacggccgcca

SEQ ID NO: 2985007 - RNA, 22 nt, Mycobacterium avium subsp. paratuberculosis
cauccagccgugggugucggcg

SEQ ID NO: 2985008 - RNA, 14 nt, Mycobacterium avium subsp. paratuberculosis
cauccaggaccgcg

SEQ ID NO: 2985009 - RNA, 17 nt, Mycobacterium avium subsp. paratuberculosis
cauccaggaccgcgcgc

SEQ ID NO: 2985010 - RNA, 19 nt, Mycobacterium avium subsp. paratuberculosis
cauccaggaccgcgcgccg

SEQ ID NO: 2985011 - RNA, 19 nt, Mycobacterium avium subsp. paratuberculosis
cauccaggccagcaccugg

SEQ ID NO: 2985012 - RNA, 22 nt, Mycobacterium avium subsp. paratuberculosis
cauccaggccagcaccuggcgc

SEQ ID NO: 2985013 - RNA, 15 nt, Mycobacterium avium subsp. paratuberculosis
cauccagguggcgcc

SEQ ID NO: 2985014 - RNA, 15 nt, Mycobacterium avium subsp. paratuberculosis
cauccagucggcgcc

SEQ ID NO: 2985015 - RNA, 16 nt, Mycobacterium avium subsp. paratuberculosis
cauccagucggcgccg

SEQ ID NO: 2985016 - RNA, 16 nt, Mycobacterium avium subsp. paratuberculosis
cauccagugcaguucg

SEQ ID NO: 2985017 - RNA, 17 nt, Mycobacterium avium subsp. paratuberculosis
cauccccagcacgguga

SEQ ID NO: 2985018 - RNA, 14 nt, Mycobacterium avium subsp. paratuberculosis
cauccccaggaugg

SEQ ID NO: 2985019 - RNA, 19 nt, Mycobacterium avium subsp. paratuberculosis
cauccccaggauggccgcu

SEQ ID NO: 2985020 - RNA, 15 nt, Mycobacterium avium subsp. paratuberculosis
caucccccucggcgg

SEQ ID NO: 2985021 - RNA, 18 nt, Mycobacterium avium subsp. paratuberculosis
cauccccgcguuggccag

SEQ ID NO: 2985022 - RNA, 13 nt, Mycobacterium avium subsp. paratuberculosis
cauccccgugcgg

SEQ ID NO: 2985023 - RNA, 21 nt, Mycobacterium avium subsp. paratuberculosis
cauccccgugcggggccucgu

SEQ ID NO: 2985024 - RNA, 14 nt, Mycobacterium avium subsp. paratuberculosis
cauccccuuggugc

SEQ ID NO: 2985025 - RNA, 19 nt, Mycobacterium avium subsp. paratuberculosis
cauccccuuggugcggucg

SEQ ID NO: 2985026 - RNA, 23 nt, Mycobacterium avium subsp. paratuberculosis
caucccgaaugagacgacccgag

SEQ ID NO: 2985027 - RNA, 15 nt, Mycobacterium avium subsp. paratuberculosis
caucccgaccagcug

SEQ ID NO: 2985028 - RNA, 16 nt, Mycobacterium avium subsp. paratuberculosis
caucccgaccagcuga

SEQ ID NO: 2985029 - RNA, 12 nt, Mycobacterium avium subsp. paratuberculosis
caucccgauccg

SEQ ID NO: 2985030 - RNA, 22 nt, Mycobacterium avium subsp. paratuberculosis
caucccgaucgacgucagcucc

SEQ ID NO: 2985031 - RNA, 16 nt, Mycobacterium avium subsp. paratuberculosis
caucccgaugucggcg

SEQ ID NO: 2985032 - RNA, 20 nt, Mycobacterium avium subsp. paratuberculosis
caucccgcaauugcgccagc

SEQ ID NO: 2985033 - RNA, 21 nt, Mycobacterium avium subsp. paratuberculosis
caucccgcaauugcgccagca

SEQ ID NO: 2985034 - RNA, 19 nt, Mycobacterium avium subsp. paratuberculosis
caucccgccgaacccgccc

SEQ ID NO: 2985035 - RNA, 15 nt, Mycobacterium avium subsp. paratuberculosis
caucccgccgaccca

SEQ ID NO: 2985036 - RNA, 13 nt, Mycobacterium avium subsp. paratuberculosis
caucccgccgccg

SEQ ID NO: 2985037 - RNA, 15 nt, Mycobacterium avium subsp. paratuberculosis
caucccgccgccgaa

SEQ ID NO: 2985038 - RNA, 13 nt, Mycobacterium avium subsp. paratuberculosis
caucccgccgggc

SEQ ID NO: 2985039 - RNA, 22 nt, Mycobacterium avium subsp. paratuberculosis
caucccgcugaagccgaacgcg

SEQ ID NO: 2985040 - RNA, 18 nt, Mycobacterium avium subsp. paratuberculosis
caucccggagccgucggc

SEQ ID NO: 2985041 - RNA, 13 nt, Mycobacterium avium subsp. paratuberculosis
caucccggccacc

SEQ ID NO: 2985042 - RNA, 14 nt, Mycobacterium avium subsp. paratuberculosis
caucccggccaccc

SEQ ID NO: 2985043 - RNA, 15 nt, Mycobacterium avium subsp. paratuberculosis
caucccggccacccc

SEQ ID NO: 2985044 - RNA, 17 nt, Mycobacterium avium subsp. paratuberculosis
caucccggccaccccgc

SEQ ID NO: 2985045 - RNA, 14 nt, Mycobacterium avium subsp. paratuberculosis
caucccggugccgc

SEQ ID NO: 2985046 - RNA, 24 nt, Mycobacterium avium subsp. paratuberculosis
caucccgguggacgcgauggcgcu

SEQ ID NO: 2985047 - RNA, 19 nt, Mycobacterium avium subsp. paratuberculosis
caucccgugcggagaucgu

SEQ ID NO: 2985048 - RNA, 17 nt, Mycobacterium avium subsp. paratuberculosis
caucccuagcgugccgu

SEQ ID NO: 2985049 - RNA, 23 nt, Mycobacterium avium subsp. paratuberculosis
caucccugacacgaccgccuguc

SEQ ID NO: 2985050 - RNA, 13 nt, Mycobacterium avium subsp. paratuberculosis
caucccuggugac

SEQ ID NO: 2985051 - RNA, 19 nt, Mycobacterium avium subsp. paratuberculosis
caucccuggugaccgacga

SEQ ID NO: 2985052 - RNA, 23 nt, Mycobacterium avium subsp. paratuberculosis
caucccuuccugggacagccggu

SEQ ID NO: 2985053 - RNA, 13 nt, Mycobacterium avium subsp. paratuberculosis
cauccgcagcccg

SEQ ID NO: 2985054 - RNA, 19 nt, Mycobacterium avium subsp. paratuberculosis
cauccgcagcccgucgauc

SEQ ID NO: 2985055 - RNA, 19 nt, Mycobacterium avium subsp. paratuberculosis
cauccgccacccgcugcuc

SEQ ID NO: 2985056 - RNA, 22 nt, Mycobacterium avium subsp. paratuberculosis
cauccgccacccgcugcucgac

SEQ ID NO: 2985057 - RNA, 14 nt, Mycobacterium avium subsp. paratuberculosis
cauccgccagaucg

SEQ ID NO: 2985058 - RNA, 20 nt, Mycobacterium avium subsp. paratuberculosis
cauccgccagaucgccuggc

SEQ ID NO: 2985059 - RNA, 14 nt, Mycobacterium avium subsp. paratuberculosis
cauccgccgacgau

SEQ ID NO: 2985060 - RNA, 17 nt, Mycobacterium avium subsp. paratuberculosis
cauccgccgggcggcgu

SEQ ID NO: 2985061 - RNA, 19 nt, Mycobacterium avium subsp. paratuberculosis
cauccgccgggcggcgucc

SEQ ID NO: 2985062 - RNA, 14 nt, Mycobacterium avium subsp. paratuberculosis
cauccgcgacgcca

SEQ ID NO: 2985063 - RNA, 15 nt, Mycobacterium avium subsp. paratuberculosis
cauccgcgacgccag

SEQ ID NO: 2985064 - RNA, 17 nt, Mycobacterium avium subsp. paratuberculosis
cauccgcgacgccagca

SEQ ID NO: 2985065 - RNA, 18 nt, Mycobacterium avium subsp. paratuberculosis
cauccgcgacgccagcac

SEQ ID NO: 2985066 - RNA, 19 nt, Mycobacterium avium subsp. paratuberculosis
cauccgcgagccgagccgg

SEQ ID NO: 2985067 - RNA, 22 nt, Mycobacterium avium subsp. paratuberculosis
cauccgcuggugcgcgccggcg

SEQ ID NO: 2985068 - RNA, 23 nt, Mycobacterium avium subsp. paratuberculosis
cauccgcuggugcgcgccggcgu

SEQ ID NO: 2985069 - RNA, 18 nt, Mycobacterium avium subsp. paratuberculosis
cauccggaacacgugauc

SEQ ID NO: 2985070 - RNA, 19 nt, Mycobacterium avium subsp. paratuberculosis
cauccggaaccgggcaccc

SEQ ID NO: 2985071 - RNA, 23 nt, Mycobacterium avium subsp. paratuberculosis
cauccggcauuugcccuccuucc

SEQ ID NO: 2985072 - RNA, 13 nt, Mycobacterium avium subsp. paratuberculosis
cauccggccggcg

SEQ ID NO: 2985073 - RNA, 15 nt, Mycobacterium avium subsp. paratuberculosis
cauccggccggcgag

SEQ ID NO: 2985074 - RNA, 17 nt, Mycobacterium avium subsp. paratuberculosis
cauccggcgcacggcgc

SEQ ID NO: 2985075 - RNA, 18 nt, Mycobacterium avium subsp. paratuberculosis
cauccggcgcacggcgcc

SEQ ID NO: 2985076 - RNA, 20 nt, Mycobacterium avium subsp. paratuberculosis
cauccggcgcacggcgccca

SEQ ID NO: 2985077 - RNA, 12 nt, Mycobacterium avium subsp. paratuberculosis
cauccggcgccg

SEQ ID NO: 2985078 - RNA, 14 nt, Mycobacterium avium subsp. paratuberculosis
cauccggcgccgcg

SEQ ID NO: 2985079 - RNA, 22 nt, Mycobacterium avium subsp. paratuberculosis
cauccggcgggggaucgggaag

SEQ ID NO: 2985080 - RNA, 17 nt, Mycobacterium avium subsp. paratuberculosis
cauccgggaggccagca

SEQ ID NO: 2985081 - RNA, 18 nt, Mycobacterium avium subsp. paratuberculosis
cauccgggccaccaccac

SEQ ID NO: 2985082 - RNA, 20 nt, Mycobacterium avium subsp. paratuberculosis
cauccgggccaccaccacgg

SEQ ID NO: 2985083 - RNA, 14 nt, Mycobacterium avium subsp. paratuberculosis
cauccgggccgccg

SEQ ID NO: 2985084 - RNA, 16 nt, Mycobacterium avium subsp. paratuberculosis
cauccgggccgccgcg

SEQ ID NO: 2985085 - RNA, 18 nt, Mycobacterium avium subsp. paratuberculosis
cauccgggccgccgcgga

SEQ ID NO: 2985086 - RNA, 15 nt, Mycobacterium avium subsp. paratuberculosis
cauccgggcggccag

SEQ ID NO: 2985087 - RNA, 19 nt, Mycobacterium avium subsp. paratuberculosis
cauccgggcggccagccgc

SEQ ID NO: 2985088 - RNA, 20 nt, Mycobacterium avium subsp. paratuberculosis
cauccgggcggccagccgcg

SEQ ID NO: 2985089 - RNA, 23 nt, Mycobacterium avium subsp. paratuberculosis
cauccggucauccucgccgcgcc

SEQ ID NO: 2985090 - RNA, 15 nt, Mycobacterium avium subsp. paratuberculosis
cauccgguccagauc

SEQ ID NO: 2985091 - RNA, 19 nt, Mycobacterium avium subsp. paratuberculosis
cauccgguccagaucggcg

SEQ ID NO: 2985092 - RNA, 20 nt, Mycobacterium avium subsp. paratuberculosis
cauccgguccagaucggcgc

SEQ ID NO: 2985093 - RNA, 22 nt, Mycobacterium avium subsp. paratuberculosis
cauccgguccagaucggcgcgc

SEQ ID NO: 2985094 - RNA, 16 nt, Mycobacterium avium subsp. paratuberculosis
cauccggugccgagcg

SEQ ID NO: 2985095 - RNA, 22 nt, Mycobacterium avium subsp. paratuberculosis
cauccggugccgagcgcgcuug

SEQ ID NO: 2985096 - RNA, 16 nt, Mycobacterium avium subsp. paratuberculosis
cauccgguugcaccgc

SEQ ID NO: 2985097 - RNA, 18 nt, Mycobacterium avium subsp. paratuberculosis
cauccgguugcaccgcga

SEQ ID NO: 2985098 - RNA, 20 nt, Mycobacterium avium subsp. paratuberculosis
cauccgugagggaccuccag

SEQ ID NO: 2985099 - RNA, 23 nt, Mycobacterium avium subsp. paratuberculosis
cauccgugagggaccuccagcgg

SEQ ID NO: 2985100 - RNA, 16 nt, Mycobacterium avium subsp. paratuberculosis
cauccguucggcucug

SEQ ID NO: 2985101 - RNA, 23 nt, Mycobacterium avium subsp. paratuberculosis
cauccguucggcucugcagagcg

SEQ ID NO: 2985102 - RNA, 20 nt, Mycobacterium avium subsp. paratuberculosis
cauccucauagccggccgcg

SEQ ID NO: 2985103 - RNA, 14 nt, Mycobacterium avium subsp. paratuberculosis
cauccucggcgcgu

SEQ ID NO: 2985104 - RNA, 17 nt, Mycobacterium avium subsp. paratuberculosis
cauccugcgcaucgagc

SEQ ID NO: 2985105 - RNA, 16 nt, Mycobacterium avium subsp. paratuberculosis
cauccugcuggccggg

SEQ ID NO: 2985106 - RNA, 15 nt, Mycobacterium avium subsp. paratuberculosis
cauccugggcgucga

SEQ ID NO: 2985107 - RNA, 19 nt, Mycobacterium avium subsp. paratuberculosis
cauccugguccggcgcccg

SEQ ID NO: 2985108 - RNA, 16 nt, Mycobacterium avium subsp. paratuberculosis
caucgaaugcagcggc

SEQ ID NO: 2985109 - RNA, 18 nt, Mycobacterium avium subsp. paratuberculosis
caucgaaugcagcggcuc

SEQ ID NO: 2985110 - RNA, 19 nt, Mycobacterium avium subsp. paratuberculosis
caucgaaugcagcggcucc

SEQ ID NO: 2985111 - RNA, 16 nt, Mycobacterium avium subsp. paratuberculosis
caucgacaugcccggc

SEQ ID NO: 2985112 - RNA, 17 nt, Mycobacterium avium subsp. paratuberculosis
caucgacaugcccggcg

SEQ ID NO: 2985113 - RNA, 18 nt, Mycobacterium avium subsp. paratuberculosis
caucgacaugcccggcga

SEQ ID NO: 2985114 - RNA, 21 nt, Mycobacterium avium subsp. paratuberculosis
caucgacgacgggugggugga

SEQ ID NO: 2985115 - RNA, 18 nt, Mycobacterium avium subsp. paratuberculosis
caucgacgcgaccggccc

SEQ ID NO: 2985116 - RNA, 19 nt, Mycobacterium avium subsp. paratuberculosis
caucgacgcgaccggcccg

SEQ ID NO: 2985117 - RNA, 19 nt, Mycobacterium avium subsp. paratuberculosis
caucgacgugccguugacg

SEQ ID NO: 2985118 - RNA, 15 nt, Mycobacterium avium subsp. paratuberculosis
caucgacuccagcac

SEQ ID NO: 2985119 - RNA, 20 nt, Mycobacterium avium subsp. paratuberculosis
caucgacuccagcaccggcg

SEQ ID NO: 2985120 - RNA, 23 nt, Mycobacterium avium subsp. paratuberculosis
caucgacuccagcaccggcgcca

SEQ ID NO: 2985121 - RNA, 17 nt, Mycobacterium avium subsp. paratuberculosis
caucgacuugccgccgc

SEQ ID NO: 2985122 - RNA, 18 nt, Mycobacterium avium subsp. paratuberculosis
caucgacuugccgccgca

SEQ ID NO: 2985123 - RNA, 19 nt, Mycobacterium avium subsp. paratuberculosis
caucgacuugccgccgcac

SEQ ID NO: 2985124 - RNA, 21 nt, Mycobacterium avium subsp. paratuberculosis
caucgagaugccgggaagcga

SEQ ID NO: 2985125 - RNA, 13 nt, Mycobacterium avium subsp. paratuberculosis
caucgagaugcug

SEQ ID NO: 2985126 - RNA, 19 nt, Mycobacterium avium subsp. paratuberculosis
caucgagcaguagacgccg

SEQ ID NO: 2985127 - RNA, 19 nt, Mycobacterium avium subsp. paratuberculosis
caucgagcccaccgcgccc

SEQ ID NO: 2985128 - RNA, 21 nt, Mycobacterium avium subsp. paratuberculosis
caucgagcccaccgcgcccag

SEQ ID NO: 2985129 - RNA, 17 nt, Mycobacterium avium subsp. paratuberculosis
caucgagccgagcaccg

SEQ ID NO: 2985130 - RNA, 19 nt, Mycobacterium avium subsp. paratuberculosis
caucgagccgagcaccggc

SEQ ID NO: 2985131 - RNA, 21 nt, Mycobacterium avium subsp. paratuberculosis
caucgagccgagcaccggcag

SEQ ID NO: 2985132 - RNA, 20 nt, Mycobacterium avium subsp. paratuberculosis
caucgagccgguacggcucg

SEQ ID NO: 2985133 - RNA, 17 nt, Mycobacterium avium subsp. paratuberculosis
caucgaggaccggcgcc

SEQ ID NO: 2985134 - RNA, 19 nt, Mycobacterium avium subsp. paratuberculosis
caucgaggaccggcgccgg

SEQ ID NO: 2985135 - RNA, 20 nt, Mycobacterium avium subsp. paratuberculosis
caucgaggaccggcgccggc

SEQ ID NO: 2985136 - RNA, 16 nt, Mycobacterium avium subsp. paratuberculosis
caucgaggaucgccaa

SEQ ID NO: 2985137 - RNA, 14 nt, Mycobacterium avium subsp. paratuberculosis
caucgaggcgauca

SEQ ID NO: 2985138 - RNA, 16 nt, Mycobacterium avium subsp. paratuberculosis
caucgaggcgaucauc

SEQ ID NO: 2985139 - RNA, 15 nt, Mycobacterium avium subsp. paratuberculosis
caucgagggcguccu

SEQ ID NO: 2985140 - RNA, 22 nt, Mycobacterium avium subsp. paratuberculosis
caucgaucggguggcccaaucg

SEQ ID NO: 2985141 - RNA, 22 nt, Mycobacterium avium subsp. paratuberculosis
caucgauggcgggcgcgccggc

SEQ ID NO: 2985142 - RNA, 14 nt, Mycobacterium avium subsp. paratuberculosis
caucgcaccgcgag

SEQ ID NO: 2985143 - RNA, 16 nt, Mycobacterium avium subsp. paratuberculosis
caucgcaccgcgagca

SEQ ID NO: 2985144 - RNA, 12 nt, Mycobacterium avium subsp. paratuberculosis
caucgcagcgcg

SEQ ID NO: 2985145 - RNA, 16 nt, Mycobacterium avium subsp. paratuberculosis
caucgccaaggcgcug

SEQ ID NO: 2985146 - RNA, 14 nt, Mycobacterium avium subsp. paratuberculosis
caucgccacccgca

SEQ ID NO: 2985147 - RNA, 16 nt, Mycobacterium avium subsp. paratuberculosis
caucgccacccgcacc

SEQ ID NO: 2985148 - RNA, 14 nt, Mycobacterium avium subsp. paratuberculosis
caucgccaccgucg

SEQ ID NO: 2985149 - RNA, 16 nt, Mycobacterium avium subsp. paratuberculosis
caucgccaccgucguc

SEQ ID NO: 2985150 - RNA, 13 nt, Mycobacterium avium subsp. paratuberculosis
caucgccaccugg

SEQ ID NO: 2985151 - RNA, 14 nt, Mycobacterium avium subsp. paratuberculosis
caucgccaccugga

SEQ ID NO: 2985152 - RNA, 15 nt, Mycobacterium avium subsp. paratuberculosis
caucgccacgccgug

SEQ ID NO: 2985153 - RNA, 21 nt, Mycobacterium avium subsp. paratuberculosis
caucgccagcaacgacccggc

SEQ ID NO: 2985154 - RNA, 13 nt, Mycobacterium avium subsp. paratuberculosis
caucgccagcaca

SEQ ID NO: 2985155 - RNA, 14 nt, Mycobacterium avium subsp. paratuberculosis
caucgccaggaacc

SEQ ID NO: 2985156 - RNA, 17 nt, Mycobacterium avium subsp. paratuberculosis
caucgccaucagcagcg

SEQ ID NO: 2985157 - RNA, 14 nt, Mycobacterium avium subsp. paratuberculosis
caucgcccagccgg

SEQ ID NO: 2985158 - RNA, 16 nt, Mycobacterium avium subsp. paratuberculosis
caucgcccagccggcg

SEQ ID NO: 2985159 - RNA, 23 nt, Mycobacterium avium subsp. paratuberculosis
caucgcccagccggcggauauag

SEQ ID NO: 2985160 - RNA, 17 nt, Mycobacterium avium subsp. paratuberculosis
caucgcccagcgcagcg

SEQ ID NO: 2985161 - RNA, 12 nt, Mycobacterium avium subsp. paratuberculosis
caucgccccggc

SEQ ID NO: 2985162 - RNA, 14 nt, Mycobacterium avium subsp. paratuberculosis
caucgccccggcga

SEQ ID NO: 2985163 - RNA, 20 nt, Mycobacterium avium subsp. paratuberculosis
caucgcccggugcgccagcg

SEQ ID NO: 2985164 - RNA, 22 nt, Mycobacterium avium subsp. paratuberculosis
caucgcccggugcgccagcgug

SEQ ID NO: 2985165 - RNA, 17 nt, Mycobacterium avium subsp. paratuberculosis
caucgccgaaccgggcg

SEQ ID NO: 2985166 - RNA, 18 nt, Mycobacterium avium subsp. paratuberculosis
caucgccgaaccguccca

SEQ ID NO: 2985167 - RNA, 21 nt, Mycobacterium avium subsp. paratuberculosis
caucgccgaaccgucccacac

SEQ ID NO: 2985168 - RNA, 15 nt, Mycobacterium avium subsp. paratuberculosis
caucgccgacgguga

SEQ ID NO: 2985169 - RNA, 21 nt, Mycobacterium avium subsp. paratuberculosis
caucgccgacggugagcaccg

SEQ ID NO: 2985170 - RNA, 23 nt, Mycobacterium avium subsp. paratuberculosis
caucgccgacggugagcaccgcc

SEQ ID NO: 2985171 - RNA, 17 nt, Mycobacterium avium subsp. paratuberculosis
caucgccgagacgaucc

SEQ ID NO: 2985172 - RNA, 19 nt, Mycobacterium avium subsp. paratuberculosis
caucgccgccaucgccgcc

SEQ ID NO: 2985173 - RNA, 23 nt, Mycobacterium avium subsp. paratuberculosis
caucgccgccaucgccgccgcca

SEQ ID NO: 2985174 - RNA, 14 nt, Mycobacterium avium subsp. paratuberculosis
caucgccgccgcca

SEQ ID NO: 2985175 - RNA, 13 nt, Mycobacterium avium subsp. paratuberculosis
caucgccgcgacc

SEQ ID NO: 2985176 - RNA, 14 nt, Mycobacterium avium subsp. paratuberculosis
caucgccgcggccg

SEQ ID NO: 2985177 - RNA, 15 nt, Mycobacterium avium subsp. paratuberculosis
caucgccgcggccgg

SEQ ID NO: 2985178 - RNA, 16 nt, Mycobacterium avium subsp. paratuberculosis
caucgccgcggccgga

SEQ ID NO: 2985179 - RNA, 18 nt, Mycobacterium avium subsp. paratuberculosis
caucgccgcggccggaga

SEQ ID NO: 2985180 - RNA, 12 nt, Mycobacterium avium subsp. paratuberculosis
caucgccgcggu

SEQ ID NO: 2985181 - RNA, 15 nt, Mycobacterium avium subsp. paratuberculosis
caucgccgcgguggc

SEQ ID NO: 2985182 - RNA, 18 nt, Mycobacterium avium subsp. paratuberculosis
caucgccgcgguggcgcc

SEQ ID NO: 2985183 - RNA, 22 nt, Mycobacterium avium subsp. paratuberculosis
caucgccgcgguggcgccgcgg

SEQ ID NO: 2985184 - RNA, 14 nt, Mycobacterium avium subsp. paratuberculosis
caucgccggcgacc

SEQ ID NO: 2985185 - RNA, 22 nt, Mycobacterium avium subsp. paratuberculosis
caucgccggcgaccgugcccac

SEQ ID NO: 2985186 - RNA, 15 nt, Mycobacterium avium subsp. paratuberculosis
caucgccggcgaugc

SEQ ID NO: 2985187 - RNA, 13 nt, Mycobacterium avium subsp. paratuberculosis
caucgccggcgcg

SEQ ID NO: 2985188 - RNA, 16 nt, Mycobacterium avium subsp. paratuberculosis
caucgccggcgcgcug

SEQ ID NO: 2985189 - RNA, 21 nt, Mycobacterium avium subsp. paratuberculosis
caucgccggcgcgcugaagcg

SEQ ID NO: 2985190 - RNA, 14 nt, Mycobacterium avium subsp. paratuberculosis
caucgccgucaugg

SEQ ID NO: 2985191 - RNA, 17 nt, Mycobacterium avium subsp. paratuberculosis
caucgccguccacgggu

SEQ ID NO: 2985192 - RNA, 18 nt, Mycobacterium avium subsp. paratuberculosis
caucgccguccacggguc

SEQ ID NO: 2985193 - RNA, 14 nt, Mycobacterium avium subsp. paratuberculosis
caucgccgucgcca

SEQ ID NO: 2985194 - RNA, 19 nt, Mycobacterium avium subsp. paratuberculosis
caucgccgucgccaccgag

SEQ ID NO: 2985195 - RNA, 21 nt, Mycobacterium avium subsp. paratuberculosis
caucgccgucgccaccgaguc

SEQ ID NO: 2985196 - RNA, 20 nt, Mycobacterium avium subsp. paratuberculosis
caucgccgucgucagccggg

SEQ ID NO: 2985197 - RNA, 16 nt, Mycobacterium avium subsp. paratuberculosis
caucgccucgaccagc

SEQ ID NO: 2985198 - RNA, 18 nt, Mycobacterium avium subsp. paratuberculosis
caucgccucgaccagcac

SEQ ID NO: 2985199 - RNA, 22 nt, Mycobacterium avium subsp. paratuberculosis
caucgccucgaccagcaccgca

SEQ ID NO: 2985200 - RNA, 15 nt, Mycobacterium avium subsp. paratuberculosis
caucgccucggccgc

SEQ ID NO: 2985201 - RNA, 16 nt, Mycobacterium avium subsp. paratuberculosis
caucgccucggcggcc

SEQ ID NO: 2985202 - RNA, 17 nt, Mycobacterium avium subsp. paratuberculosis
caucgccucggcggccg

SEQ ID NO: 2985203 - RNA, 18 nt, Mycobacterium avium subsp. paratuberculosis
caucgccucggcggccgc

SEQ ID NO: 2985204 - RNA, 16 nt, Mycobacterium avium subsp. paratuberculosis
caucgccucggucgcg

SEQ ID NO: 2985205 - RNA, 17 nt, Mycobacterium avium subsp. paratuberculosis
caucgccucggucgcgu

SEQ ID NO: 2985206 - RNA, 16 nt, Mycobacterium avium subsp. paratuberculosis
caucgccucgucccuc

SEQ ID NO: 2985207 - RNA, 20 nt, Mycobacterium avium subsp. paratuberculosis
caucgcgaucgacagcucca

SEQ ID NO: 2985208 - RNA, 22 nt, Mycobacterium avium subsp. paratuberculosis
caucgcgaucgacagcuccaac

SEQ ID NO: 2985209 - RNA, 17 nt, Mycobacterium avium subsp. paratuberculosis
caucgcgauggaagcgc

SEQ ID NO: 2985210 - RNA, 14 nt, Mycobacterium avium subsp. paratuberculosis
caucgcgccgcaug

SEQ ID NO: 2985211 - RNA, 17 nt, Mycobacterium avium subsp. paratuberculosis
caucgcgccgcaugaug

SEQ ID NO: 2985212 - RNA, 14 nt, Mycobacterium avium subsp. paratuberculosis
caucgcgcgcggcg

SEQ ID NO: 2985213 - RNA, 15 nt, Mycobacterium avium subsp. paratuberculosis
caucgcgcgcggcga

SEQ ID NO: 2985214 - RNA, 21 nt, Mycobacterium avium subsp. paratuberculosis
caucgcgcgcggcgacggugg

SEQ ID NO: 2985215 - RNA, 16 nt, Mycobacterium avium subsp. paratuberculosis
caucgcgcgcggcggc

SEQ ID NO: 2985216 - RNA, 18 nt, Mycobacterium avium subsp. paratuberculosis
caucgcgcgcggcggcca

SEQ ID NO: 2985217 - RNA, 21 nt, Mycobacterium avium subsp. paratuberculosis
caucgcgcgcggcggccaccg

SEQ ID NO: 2985218 - RNA, 22 nt, Mycobacterium avium subsp. paratuberculosis
caucgcgcgcggcggccaccgc

SEQ ID NO: 2985219 - RNA, 12 nt, Mycobacterium avium subsp. paratuberculosis
caucgcggccgc

SEQ ID NO: 2985220 - RNA, 15 nt, Mycobacterium avium subsp. paratuberculosis
caucgcggccgcccg

SEQ ID NO: 2985221 - RNA, 20 nt, Mycobacterium avium subsp. paratuberculosis
caucgcggccgcccgguccg

SEQ ID NO: 2985222 - RNA, 14 nt, Mycobacterium avium subsp. paratuberculosis
caucgcggccgccg

SEQ ID NO: 2985223 - RNA, 20 nt, Mycobacterium avium subsp. paratuberculosis
caucgcggccgccggggccc

SEQ ID NO: 2985224 - RNA, 13 nt, Mycobacterium avium subsp. paratuberculosis
caucgcggcgauc

SEQ ID NO: 2985225 - RNA, 15 nt, Mycobacterium avium subsp. paratuberculosis
caucgcgggccaccg

SEQ ID NO: 2985226 - RNA, 19 nt, Mycobacterium avium subsp. paratuberculosis
caucgcgggccaccggcgc

SEQ ID NO: 2985227 - RNA, 20 nt, Mycobacterium avium subsp. paratuberculosis
caucgcgggccaccggcgcc

SEQ ID NO: 2985228 - RNA, 21 nt, Mycobacterium avium subsp. paratuberculosis
caucgcgggccaccggcgcca

SEQ ID NO: 2985229 - RNA, 17 nt, Mycobacterium avium subsp. paratuberculosis
caucgcggucagcgucu

SEQ ID NO: 2985230 - RNA, 19 nt, Mycobacterium avium subsp. paratuberculosis
caucgcgucggugucgccg

SEQ ID NO: 2985231 - RNA, 20 nt, Mycobacterium avium subsp. paratuberculosis
caucgcuacaccccaccgga

SEQ ID NO: 2985232 - RNA, 22 nt, Mycobacterium avium subsp. paratuberculosis
caucgcuacaccccaccggaag

SEQ ID NO: 2985233 - RNA, 23 nt, Mycobacterium avium subsp. paratuberculosis
caucgcugccacguacaccggga

SEQ ID NO: 2985234 - RNA, 22 nt, Mycobacterium avium subsp. paratuberculosis
caucgcugguggccgacgugcc

SEQ ID NO: 2985235 - RNA, 16 nt, Mycobacterium avium subsp. paratuberculosis
caucgcuuuccgguca

SEQ ID NO: 2985236 - RNA, 18 nt, Mycobacterium avium subsp. paratuberculosis
caucggacaucggcagca

SEQ ID NO: 2985237 - RNA, 21 nt, Mycobacterium avium subsp. paratuberculosis
caucggagagcuugccgcgga

SEQ ID NO: 2985238 - RNA, 16 nt, Mycobacterium avium subsp. paratuberculosis
caucggcacacgcgga

SEQ ID NO: 2985239 - RNA, 14 nt, Mycobacterium avium subsp. paratuberculosis
caucggcacgccgg

SEQ ID NO: 2985240 - RNA, 15 nt, Mycobacterium avium subsp. paratuberculosis
caucggcacgccggg

SEQ ID NO: 2985241 - RNA, 17 nt, Mycobacterium avium subsp. paratuberculosis
caucggcacgccggggc

SEQ ID NO: 2985242 - RNA, 21 nt, Mycobacterium avium subsp. paratuberculosis
caucggcacguguccgacgcc

SEQ ID NO: 2985243 - RNA, 18 nt, Mycobacterium avium subsp. paratuberculosis
caucggcagacccagcag

SEQ ID NO: 2985244 - RNA, 13 nt, Mycobacterium avium subsp. paratuberculosis
caucggcagaucg

SEQ ID NO: 2985245 - RNA, 14 nt, Mycobacterium avium subsp. paratuberculosis
caucggcagcccgg

SEQ ID NO: 2985246 - RNA, 21 nt, Mycobacterium avium subsp. paratuberculosis
caucggcaguccgcgccgguc

SEQ ID NO: 2985247 - RNA, 13 nt, Mycobacterium avium subsp. paratuberculosis
caucggcaucgcg

SEQ ID NO: 2985248 - RNA, 20 nt, Mycobacterium avium subsp. paratuberculosis
caucggcaucgcgcgcggcg

SEQ ID NO: 2985249 - RNA, 13 nt, Mycobacterium avium subsp. paratuberculosis
caucggcgacgcc

SEQ ID NO: 2985250 - RNA, 17 nt, Mycobacterium avium subsp. paratuberculosis
caucggcgacgccgccg

SEQ ID NO: 2985251 - RNA, 20 nt, Mycobacterium avium subsp. paratuberculosis
caucggcgacgccgccgucg

SEQ ID NO: 2985252 - RNA, 15 nt, Mycobacterium avium subsp. paratuberculosis
caucggcgacggcga

SEQ ID NO: 2985253 - RNA, 12 nt, Mycobacterium avium subsp. paratuberculosis
caucggcgcccu

SEQ ID NO: 2985254 - RNA, 14 nt, Mycobacterium avium subsp. paratuberculosis
caucggcgccgacg

SEQ ID NO: 2985255 - RNA, 23 nt, Mycobacterium avium subsp. paratuberculosis
caucggcgccggauugucgcugu

SEQ ID NO: 2985256 - RNA, 11 nt, Mycobacterium avium subsp. paratuberculosis
caucggcgccu

SEQ ID NO: 2985257 - RNA, 20 nt, Mycobacterium avium subsp. paratuberculosis
caucggcggaagcucaucga

SEQ ID NO: 2985258 - RNA, 11 nt, Mycobacterium avium subsp. paratuberculosis
caucggcgugu

SEQ ID NO: 2985259 - RNA, 17 nt, Mycobacterium avium subsp. paratuberculosis
caucggcuggucggcgg

SEQ ID NO: 2985260 - RNA, 18 nt, Mycobacterium avium subsp. paratuberculosis
caucggcuggucggcggc

SEQ ID NO: 2985261 - RNA, 19 nt, Mycobacterium avium subsp. paratuberculosis
caucggcuggucggcggcc

SEQ ID NO: 2985262 - RNA, 15 nt, Mycobacterium avium subsp. paratuberculosis
caucgggcccagcag

SEQ ID NO: 2985263 - RNA, 16 nt, Mycobacterium avium subsp. paratuberculosis
caucgggcccagcagc

SEQ ID NO: 2985264 - RNA, 17 nt, Mycobacterium avium subsp. paratuberculosis
caucgggcgcaggucca

SEQ ID NO: 2985265 - RNA, 16 nt, Mycobacterium avium subsp. paratuberculosis
caucgggcgcucggcc

SEQ ID NO: 2985266 - RNA, 16 nt, Mycobacterium avium subsp. paratuberculosis
caucggggcuacaaaa

SEQ ID NO: 2985267 - RNA, 16 nt, Mycobacterium avium subsp. paratuberculosis
caucggggugaccguc

SEQ ID NO: 2985268 - RNA, 23 nt, Mycobacterium avium subsp. paratuberculosis
caucggggugaccgucacccccg

SEQ ID NO: 2985269 - RNA, 20 nt, Mycobacterium avium subsp. paratuberculosis
caucgggguuccaccguucg

SEQ ID NO: 2985270 - RNA, 22 nt, Mycobacterium avium subsp. paratuberculosis
caucgggguuuugaucagcccg

SEQ ID NO: 2985271 - RNA, 20 nt, Mycobacterium avium subsp. paratuberculosis
caucggguagaucuccucgg

SEQ ID NO: 2985272 - RNA, 16 nt, Mycobacterium avium subsp. paratuberculosis
caucgggucgucggcg

SEQ ID NO: 2985273 - RNA, 20 nt, Mycobacterium avium subsp. paratuberculosis
caucggguugccggcggcca

SEQ ID NO: 2985274 - RNA, 15 nt, Mycobacterium avium subsp. paratuberculosis
caucggucaccagcu

SEQ ID NO: 2985275 - RNA, 16 nt, Mycobacterium avium subsp. paratuberculosis
caucggucagcaacag

SEQ ID NO: 2985276 - RNA, 21 nt, Mycobacterium avium subsp. paratuberculosis
caucggugaccgucgccgacc

SEQ ID NO: 2985277 - RNA, 20 nt, Mycobacterium avium subsp. paratuberculosis
caucgguggcaccccgcgcc

SEQ ID NO: 2985278 - RNA, 21 nt, Mycobacterium avium subsp. paratuberculosis
caucgguggcaccccgcgccg

SEQ ID NO: 2985279 - RNA, 16 nt, Mycobacterium avium subsp. paratuberculosis
caucgguugcuccggc

SEQ ID NO: 2985280 - RNA, 20 nt, Mycobacterium avium subsp. paratuberculosis
caucgguugcuccggcgucg

SEQ ID NO: 2985281 - RNA, 20 nt, Mycobacterium avium subsp. paratuberculosis
caucgguuugaccacggcgc

SEQ ID NO: 2985282 - RNA, 21 nt, Mycobacterium avium subsp. paratuberculosis
caucgguuugaccacggcgcg

SEQ ID NO: 2985283 - RNA, 22 nt, Mycobacterium avium subsp. paratuberculosis
caucgucacuucgccgggcugg

SEQ ID NO: 2985284 - RNA, 22 nt, Mycobacterium avium subsp. paratuberculosis
caucgucgcggcgcuaaagcca

SEQ ID NO: 2985285 - RNA, 16 nt, Mycobacterium avium subsp. paratuberculosis
caucgucgcggcgguc

SEQ ID NO: 2985286 - RNA, 17 nt, Mycobacterium avium subsp. paratuberculosis
caucgucgcggcgguca

SEQ ID NO: 2985287 - RNA, 14 nt, Mycobacterium avium subsp. paratuberculosis
caucgucggcgccg

SEQ ID NO: 2985288 - RNA, 17 nt, Mycobacterium avium subsp. paratuberculosis
caucgucguuggcgcuc

SEQ ID NO: 2985289 - RNA, 21 nt, Mycobacterium avium subsp. paratuberculosis
caucgucuccgcugucgucgu

SEQ ID NO: 2985290 - RNA, 16 nt, Mycobacterium avium subsp. paratuberculosis
caucgucucggaccgg

SEQ ID NO: 2985291 - RNA, 13 nt, Mycobacterium avium subsp. paratuberculosis
caucgucuucccc

SEQ ID NO: 2985292 - RNA, 22 nt, Mycobacterium avium subsp. paratuberculosis
caucgucuuccccguugucguu

SEQ ID NO: 2985293 - RNA, 13 nt, Mycobacterium avium subsp. paratuberculosis
caucgugacgcga

SEQ ID NO: 2985294 - RNA, 21 nt, Mycobacterium avium subsp. paratuberculosis
caucgugaucgaaacgccgcg

SEQ ID NO: 2985295 - RNA, 21 nt, Mycobacterium avium subsp. paratuberculosis
caucgugaucgcccaccuggu

SEQ ID NO: 2985296 - RNA, 14 nt, Mycobacterium avium subsp. paratuberculosis
caucguggccgcgu

SEQ ID NO: 2985297 - RNA, 14 nt, Mycobacterium avium subsp. paratuberculosis
caucguggcgacga

SEQ ID NO: 2985298 - RNA, 16 nt, Mycobacterium avium subsp. paratuberculosis
caucguggcgacgacg

SEQ ID NO: 2985299 - RNA, 21 nt, Mycobacterium avium subsp. paratuberculosis
caucguggcgacgacgccgau

SEQ ID NO: 2985300 - RNA, 13 nt, Mycobacterium avium subsp. paratuberculosis
caucguggcgcga

SEQ ID NO: 2985301 - RNA, 15 nt, Mycobacterium avium subsp. paratuberculosis
caucguggcgcgacg

SEQ ID NO: 2985302 - RNA, 14 nt, Mycobacterium avium subsp. paratuberculosis
caucgugggcgccg

SEQ ID NO: 2985303 - RNA, 23 nt, Mycobacterium avium subsp. paratuberculosis
caucgugggcgccgucgccgccg

SEQ ID NO: 2985304 - RNA, 18 nt, Mycobacterium avium subsp. paratuberculosis
caucguguccagcaugug

SEQ ID NO: 2985305 - RNA, 20 nt, Mycobacterium avium subsp. paratuberculosis
caucguucccugcgcggcga

SEQ ID NO: 2985306 - RNA, 22 nt, Mycobacterium avium subsp. paratuberculosis
caucguucccugcgcggcgaug

SEQ ID NO: 2985307 - RNA, 16 nt, Mycobacterium avium subsp. paratuberculosis
caucguugccggcggc

SEQ ID NO: 2985308 - RNA, 13 nt, Mycobacterium avium subsp. paratuberculosis
caucuacgucguc

SEQ ID NO: 2985309 - RNA, 19 nt, Mycobacterium avium subsp. paratuberculosis
caucuacgucgucgccggg

SEQ ID NO: 2985310 - RNA, 13 nt, Mycobacterium avium subsp. paratuberculosis
caucuccagccgc

SEQ ID NO: 2985311 - RNA, 15 nt, Mycobacterium avium subsp. paratuberculosis
caucuccagccgcgg

SEQ ID NO: 2985312 - RNA, 13 nt, Mycobacterium avium subsp. paratuberculosis
caucuccagcgcg

SEQ ID NO: 2985313 - RNA, 14 nt, Mycobacterium avium subsp. paratuberculosis
caucuccagcgcgg

SEQ ID NO: 2985314 - RNA, 14 nt, Mycobacterium avium subsp. paratuberculosis
caucuccagcuccg

SEQ ID NO: 2985315 - RNA, 23 nt, Mycobacterium avium subsp. paratuberculosis
caucuccagcuccgcggccagcu

SEQ ID NO: 2985316 - RNA, 16 nt, Mycobacterium avium subsp. paratuberculosis
caucucccgcacccgu

SEQ ID NO: 2985317 - RNA, 13 nt, Mycobacterium avium subsp. paratuberculosis
caucucccgcgcg

SEQ ID NO: 2985318 - RNA, 14 nt, Mycobacterium avium subsp. paratuberculosis
caucuccgacucga

SEQ ID NO: 2985319 - RNA, 13 nt, Mycobacterium avium subsp. paratuberculosis
caucuccgagucg

SEQ ID NO: 2985320 - RNA, 19 nt, Mycobacterium avium subsp. paratuberculosis
caucuccggcacguugacg

SEQ ID NO: 2985321 - RNA, 24 nt, Mycobacterium avium subsp. paratuberculosis
caucuccggcacguugacguagac

SEQ ID NO: 2985322 - RNA, 14 nt, Mycobacterium avium subsp. paratuberculosis
caucuccguggacg

SEQ ID NO: 2985323 - RNA, 19 nt, Mycobacterium avium subsp. paratuberculosis
caucuccguggacggcgag

SEQ ID NO: 2985324 - RNA, 20 nt, Mycobacterium avium subsp. paratuberculosis
caucuccguggacggcgagc

SEQ ID NO: 2985325 - RNA, 21 nt, Mycobacterium avium subsp. paratuberculosis
caucuccuccgggcugaccuc

SEQ ID NO: 2985326 - RNA, 17 nt, Mycobacterium avium subsp. paratuberculosis
caucuccugcacgcgcg

SEQ ID NO: 2985327 - RNA, 20 nt, Mycobacterium avium subsp. paratuberculosis
caucuccugcacgcgcgggu

SEQ ID NO: 2985328 - RNA, 22 nt, Mycobacterium avium subsp. paratuberculosis
caucuccugcacgcgcgggucg

SEQ ID NO: 2985329 - RNA, 15 nt, Mycobacterium avium subsp. paratuberculosis
caucucgacccgggc

SEQ ID NO: 2985330 - RNA, 14 nt, Mycobacterium avium subsp. paratuberculosis
caucucgacgguga

SEQ ID NO: 2985331 - RNA, 23 nt, Mycobacterium avium subsp. paratuberculosis
caucucgacggugaccggcucga

SEQ ID NO: 2985332 - RNA, 15 nt, Mycobacterium avium subsp. paratuberculosis
caucucgagcaggaa

SEQ ID NO: 2985333 - RNA, 13 nt, Mycobacterium avium subsp. paratuberculosis
caucucggccgga

SEQ ID NO: 2985334 - RNA, 12 nt, Mycobacterium avium subsp. paratuberculosis
caucucggcggc

SEQ ID NO: 2985335 - RNA, 18 nt, Mycobacterium avium subsp. paratuberculosis
caucucgggagugcggcc

SEQ ID NO: 2985336 - RNA, 19 nt, Mycobacterium avium subsp. paratuberculosis
caucucggugaggugggcg

SEQ ID NO: 2985337 - RNA, 19 nt, Mycobacterium avium subsp. paratuberculosis
caucucggugccgucgauc

SEQ ID NO: 2985338 - RNA, 22 nt, Mycobacterium avium subsp. paratuberculosis
caucucggugguggccaucgcg

SEQ ID NO: 2985339 - RNA, 13 nt, Mycobacterium avium subsp. paratuberculosis
caucucgugcccg

SEQ ID NO: 2985340 - RNA, 16 nt, Mycobacterium avium subsp. paratuberculosis
caucucgugcccgggc

SEQ ID NO: 2985341 - RNA, 20 nt, Mycobacterium avium subsp. paratuberculosis
caucucgugcccgggcccgu

SEQ ID NO: 2985342 - RNA, 22 nt, Mycobacterium avium subsp. paratuberculosis
caucucuuucgauuucgccugc

SEQ ID NO: 2985343 - RNA, 19 nt, Mycobacterium avium subsp. paratuberculosis
caucugcacagcuucggcg

SEQ ID NO: 2985344 - RNA, 22 nt, Mycobacterium avium subsp. paratuberculosis
caucugcacagcuucggcgccg

SEQ ID NO: 2985345 - RNA, 16 nt, Mycobacterium avium subsp. paratuberculosis
caucugccgggcggcg

SEQ ID NO: 2985346 - RNA, 17 nt, Mycobacterium avium subsp. paratuberculosis
caucugccgggcggcga

SEQ ID NO: 2985347 - RNA, 20 nt, Mycobacterium avium subsp. paratuberculosis
caucugccgggcggcgacgu

SEQ ID NO: 2985348 - RNA, 16 nt, Mycobacterium avium subsp. paratuberculosis
caucugccggucgaug

SEQ ID NO: 2985349 - RNA, 16 nt, Mycobacterium avium subsp. paratuberculosis
caucugcucggcgucc

SEQ ID NO: 2985350 - RNA, 23 nt, Mycobacterium avium subsp. paratuberculosis
caucugcuugaugaugucggcgg

SEQ ID NO: 2985351 - RNA, 17 nt, Mycobacterium avium subsp. paratuberculosis
caucuggccgcgggugc

SEQ ID NO: 2985352 - RNA, 21 nt, Mycobacterium avium subsp. paratuberculosis
caucuggccgcgggugcggcc

SEQ ID NO: 2985353 - RNA, 17 nt, Mycobacterium avium subsp. paratuberculosis
caucugguucaccucgg

SEQ ID NO: 2985354 - RNA, 21 nt, Mycobacterium avium subsp. paratuberculosis
caucugguucaccucgggaua

SEQ ID NO: 2985355 - RNA, 20 nt, Mycobacterium avium subsp. paratuberculosis
caucuucacgugcgcggcgu

SEQ ID NO: 2985356 - RNA, 17 nt, Mycobacterium avium subsp. paratuberculosis
caucuucggcacgaagc

SEQ ID NO: 2985357 - RNA, 20 nt, Mycobacterium avium subsp. paratuberculosis
caucuugaucugggugccgc

SEQ ID NO: 2985358 - RNA, 23 nt, Mycobacterium avium subsp. paratuberculosis
caucuugguguugaucagguuca

SEQ ID NO: 2985359 - RNA, 17 nt, Mycobacterium avium subsp. paratuberculosis
caugaacaucggccggg

SEQ ID NO: 2985360 - RNA, 18 nt, Mycobacterium avium subsp. paratuberculosis
caugaacaucggccgggu

SEQ ID NO: 2985361 - RNA, 14 nt, Mycobacterium avium subsp. paratuberculosis
caugaaccaggccg

SEQ ID NO: 2985362 - RNA, 15 nt, Mycobacterium avium subsp. paratuberculosis
caugaaccaggccgc

SEQ ID NO: 2985363 - RNA, 12 nt, Mycobacterium avium subsp. paratuberculosis
caugaaccgguc

SEQ ID NO: 2985364 - RNA, 20 nt, Mycobacterium avium subsp. paratuberculosis
caugaacgacccuuccggaa

SEQ ID NO: 2985365 - RNA, 15 nt, Mycobacterium avium subsp. paratuberculosis
caugaacgccggguc

SEQ ID NO: 2985366 - RNA, 17 nt, Mycobacterium avium subsp. paratuberculosis
caugaacggcagcucgu

SEQ ID NO: 2985367 - RNA, 12 nt, Mycobacterium avium subsp. paratuberculosis
caugaacggcgg

SEQ ID NO: 2985368 - RNA, 20 nt, Mycobacterium avium subsp. paratuberculosis
caugaacuccgacuccagca

SEQ ID NO: 2985369 - RNA, 22 nt, Mycobacterium avium subsp. paratuberculosis
caugaacuccgacuccagcagc

SEQ ID NO: 2985370 - RNA, 23 nt, Mycobacterium avium subsp. paratuberculosis
caugaacuccgacuccagcagcg

SEQ ID NO: 2985371 - RNA, 20 nt, Mycobacterium avium subsp. paratuberculosis
caugaagaucagcaccgucc

SEQ ID NO: 2985372 - RNA, 16 nt, Mycobacterium avium subsp. paratuberculosis
caugaagccguugaug

SEQ ID NO: 2985373 - RNA, 21 nt, Mycobacterium avium subsp. paratuberculosis
caugaagccguugccgccgcg

SEQ ID NO: 2985374 - RNA, 16 nt, Mycobacterium avium subsp. paratuberculosis
caugaccaccgcgucg

SEQ ID NO: 2985375 - RNA, 17 nt, Mycobacterium avium subsp. paratuberculosis
caugaccaccgcgucgg

SEQ ID NO: 2985376 - RNA, 20 nt, Mycobacterium avium subsp. paratuberculosis
caugaccaugucgacgcuga

SEQ ID NO: 2985377 - RNA, 19 nt, Mycobacterium avium subsp. paratuberculosis
caugacccgguugaaggcc

SEQ ID NO: 2985378 - RNA, 19 nt, Mycobacterium avium subsp. paratuberculosis
caugaccgauccgccggcg

SEQ ID NO: 2985379 - RNA, 20 nt, Mycobacterium avium subsp. paratuberculosis
caugaccgauccgccggcga

SEQ ID NO: 2985380 - RNA, 17 nt, Mycobacterium avium subsp. paratuberculosis
caugacggccugcacca

SEQ ID NO: 2985381 - RNA, 18 nt, Mycobacterium avium subsp. paratuberculosis
caugagcuaggucaccgg

SEQ ID NO: 2985382 - RNA, 19 nt, Mycobacterium avium subsp. paratuberculosis
caugagcuaggucaccgga

SEQ ID NO: 2985383 - RNA, 19 nt, Mycobacterium avium subsp. paratuberculosis
caugaucacaccgcugucg

SEQ ID NO: 2985384 - RNA, 15 nt, Mycobacterium avium subsp. paratuberculosis
caugaucaccgccag

SEQ ID NO: 2985385 - RNA, 17 nt, Mycobacterium avium subsp. paratuberculosis
caugaucaccgccagcg

SEQ ID NO: 2985386 - RNA, 20 nt, Mycobacterium avium subsp. paratuberculosis
caugaucaccgccagcgcgc

SEQ ID NO: 2985387 - RNA, 21 nt, Mycobacterium avium subsp. paratuberculosis
caugaucaggccccacccgca

SEQ ID NO: 2985388 - RNA, 15 nt, Mycobacterium avium subsp. paratuberculosis
caugauccggaagcc

SEQ ID NO: 2985389 - RNA, 12 nt, Mycobacterium avium subsp. paratuberculosis
caugaucggcag

SEQ ID NO: 2985390 - RNA, 18 nt, Mycobacterium avium subsp. paratuberculosis
caugaucggcaggauccg

SEQ ID NO: 2985391 - RNA, 18 nt, Mycobacterium avium subsp. paratuberculosis
caugaucucguugcggcg

SEQ ID NO: 2985392 - RNA, 20 nt, Mycobacterium avium subsp. paratuberculosis
caugauggugggcaccgcga

SEQ ID NO: 2985393 - RNA, 19 nt, Mycobacterium avium subsp. paratuberculosis
caugauguagcggcggucg

SEQ ID NO: 2985394 - RNA, 22 nt, Mycobacterium avium subsp. paratuberculosis
caugauguagcggcggucggcg

SEQ ID NO: 2985395 - RNA, 17 nt, Mycobacterium avium subsp. paratuberculosis
caugauuccgccgggcg

SEQ ID NO: 2985396 - RNA, 14 nt, Mycobacterium avium subsp. paratuberculosis
caugcaccggugca

SEQ ID NO: 2985397 - RNA, 21 nt, Mycobacterium avium subsp. paratuberculosis
caugcaccggugcaccgcgcg

SEQ ID NO: 2985398 - RNA, 20 nt, Mycobacterium avium subsp. paratuberculosis
caugcacggcgcuggcgacc

SEQ ID NO: 2985399 - RNA, 13 nt, Mycobacterium avium subsp. paratuberculosis
caugcagccgccg

SEQ ID NO: 2985400 - RNA, 12 nt, Mycobacterium avium subsp. paratuberculosis
caugccacuugc

SEQ ID NO: 2985401 - RNA, 18 nt, Mycobacterium avium subsp. paratuberculosis
caugccacuugcgcacgu

SEQ ID NO: 2985402 - RNA, 14 nt, Mycobacterium avium subsp. paratuberculosis
caugccagaccaca

SEQ ID NO: 2985403 - RNA, 14 nt, Mycobacterium avium subsp. paratuberculosis
caugccagacgcgc

SEQ ID NO: 2985404 - RNA, 20 nt, Mycobacterium avium subsp. paratuberculosis
caugcccaccaucccgccgc

SEQ ID NO: 2985405 - RNA, 22 nt, Mycobacterium avium subsp. paratuberculosis
caugcccaccaucccgccgccg

SEQ ID NO: 2985406 - RNA, 22 nt, Mycobacterium avium subsp. paratuberculosis
caugcccacgccgucgacccgu

SEQ ID NO: 2985407 - RNA, 12 nt, Mycobacterium avium subsp. paratuberculosis
caugcccagcag

SEQ ID NO: 2985408 - RNA, 16 nt, Mycobacterium avium subsp. paratuberculosis
caugcccagcaguccg

SEQ ID NO: 2985409 - RNA, 20 nt, Mycobacterium avium subsp. paratuberculosis
caugcccaugucgaucggcu

SEQ ID NO: 2985410 - RNA, 17 nt, Mycobacterium avium subsp. paratuberculosis
caugccccaggugacgc

SEQ ID NO: 2985411 - RNA, 22 nt, Mycobacterium avium subsp. paratuberculosis
caugccccaggugacgccgcac

SEQ ID NO: 2985412 - RNA, 23 nt, Mycobacterium avium subsp. paratuberculosis
caugcccgcccacgggucgccga

SEQ ID NO: 2985413 - RNA, 16 nt, Mycobacterium avium subsp. paratuberculosis
caugcccgcggugcag

SEQ ID NO: 2985414 - RNA, 14 nt, Mycobacterium avium subsp. paratuberculosis
caugcccggcgacg

SEQ ID NO: 2985415 - RNA, 16 nt, Mycobacterium avium subsp. paratuberculosis
caugcccggcgacggc

SEQ ID NO: 2985416 - RNA, 13 nt, Mycobacterium avium subsp. paratuberculosis
caugcccgggcga

SEQ ID NO: 2985417 - RNA, 17 nt, Mycobacterium avium subsp. paratuberculosis
caugcccgggcgacuuc

SEQ ID NO: 2985418 - RNA, 20 nt, Mycobacterium avium subsp. paratuberculosis
caugcccuuggcccgggcgu

SEQ ID NO: 2985419 - RNA, 19 nt, Mycobacterium avium subsp. paratuberculosis
caugcccuugucgcuggcg

SEQ ID NO: 2985420 - RNA, 17 nt, Mycobacterium avium subsp. paratuberculosis
caugccgaacaacaggg

SEQ ID NO: 2985421 - RNA, 15 nt, Mycobacterium avium subsp. paratuberculosis
caugccgagcaccuc

SEQ ID NO: 2985422 - RNA, 17 nt, Mycobacterium avium subsp. paratuberculosis
caugccgagcagcaccg

SEQ ID NO: 2985423 - RNA, 18 nt, Mycobacterium avium subsp. paratuberculosis
caugccgagcagcaccgc

SEQ ID NO: 2985424 - RNA, 20 nt, Mycobacterium avium subsp. paratuberculosis
caugccgagcagcaccgcga

SEQ ID NO: 2985425 - RNA, 22 nt, Mycobacterium avium subsp. paratuberculosis
caugccgagcagcaccgcgacc

SEQ ID NO: 2985426 - RNA, 15 nt, Mycobacterium avium subsp. paratuberculosis
caugccgagccgcuu

SEQ ID NO: 2985427 - RNA, 19 nt, Mycobacterium avium subsp. paratuberculosis
caugccgagccgcuuggug

SEQ ID NO: 2985428 - RNA, 17 nt, Mycobacterium avium subsp. paratuberculosis
caugccgaugcccauca

SEQ ID NO: 2985429 - RNA, 14 nt, Mycobacterium avium subsp. paratuberculosis
caugccgcccauca

SEQ ID NO: 2985430 - RNA, 23 nt, Mycobacterium avium subsp. paratuberculosis
caugccgcccaucaccccgaagc

SEQ ID NO: 2985431 - RNA, 20 nt, Mycobacterium avium subsp. paratuberculosis
caugccgccgaccgccgagc

SEQ ID NO: 2985432 - RNA, 22 nt, Mycobacterium avium subsp. paratuberculosis
caugccgcgcuugguggcgacg

SEQ ID NO: 2985433 - RNA, 23 nt, Mycobacterium avium subsp. paratuberculosis
caugccggagaugaauucggcga

SEQ ID NO: 2985434 - RNA, 12 nt, Mycobacterium avium subsp. paratuberculosis
caugccggccgg

SEQ ID NO: 2985435 - RNA, 14 nt, Mycobacterium avium subsp. paratuberculosis
caugccggccggca

SEQ ID NO: 2985436 - RNA, 15 nt, Mycobacterium avium subsp. paratuberculosis
caugccggccggcac

SEQ ID NO: 2985437 - RNA, 11 nt, Mycobacterium avium subsp. paratuberculosis
caugccggccu

SEQ ID NO: 2985438 - RNA, 12 nt, Mycobacterium avium subsp. paratuberculosis
caugccggcgcc

SEQ ID NO: 2985439 - RNA, 15 nt, Mycobacterium avium subsp. paratuberculosis
caugccggcgccgau

SEQ ID NO: 2985440 - RNA, 14 nt, Mycobacterium avium subsp. paratuberculosis
caugccggcgucca

SEQ ID NO: 2985441 - RNA, 21 nt, Mycobacterium avium subsp. paratuberculosis
caugccgggcaggaugccgcg

SEQ ID NO: 2985442 - RNA, 12 nt, Mycobacterium avium subsp. paratuberculosis
caugccgggcca

SEQ ID NO: 2985443 - RNA, 15 nt, Mycobacterium avium subsp. paratuberculosis
caugccgggccagcc

SEQ ID NO: 2985444 - RNA, 20 nt, Mycobacterium avium subsp. paratuberculosis
caugccgggccagccggccc

SEQ ID NO: 2985445 - RNA, 21 nt, Mycobacterium avium subsp. paratuberculosis
caugccggguuucggcccggc

SEQ ID NO: 2985446 - RNA, 23 nt, Mycobacterium avium subsp. paratuberculosis
caugccggguuucggcccggcuc

SEQ ID NO: 2985447 - RNA, 23 nt, Mycobacterium avium subsp. paratuberculosis
caugccggucauccgggccacca

SEQ ID NO: 2985448 - RNA, 20 nt, Mycobacterium avium subsp. paratuberculosis
caugccguagcggucgcccc

SEQ ID NO: 2985449 - RNA, 16 nt, Mycobacterium avium subsp. paratuberculosis
caugccgucggcgccc

SEQ ID NO: 2985450 - RNA, 19 nt, Mycobacterium avium subsp. paratuberculosis
caugccgucggcgcccggc

SEQ ID NO: 2985451 - RNA, 19 nt, Mycobacterium avium subsp. paratuberculosis
caugccguucagcgcggcc

SEQ ID NO: 2985452 - RNA, 20 nt, Mycobacterium avium subsp. paratuberculosis
caugccguucagcgcggcca

SEQ ID NO: 2985453 - RNA, 22 nt, Mycobacterium avium subsp. paratuberculosis
caugccguucagcgcggccacc

SEQ ID NO: 2985454 - RNA, 23 nt, Mycobacterium avium subsp. paratuberculosis
caugccguucagcgcggccaccu

SEQ ID NO: 2985455 - RNA, 16 nt, Mycobacterium avium subsp. paratuberculosis
caugccucuucggcgc

SEQ ID NO: 2985456 - RNA, 18 nt, Mycobacterium avium subsp. paratuberculosis
caugccucuucggcgcgc

SEQ ID NO: 2985457 - RNA, 19 nt, Mycobacterium avium subsp. paratuberculosis
caugccucuucggcgcgcc

SEQ ID NO: 2985458 - RNA, 16 nt, Mycobacterium avium subsp. paratuberculosis
caugcgaccacgaccg

SEQ ID NO: 2985459 - RNA, 17 nt, Mycobacterium avium subsp. paratuberculosis
caugcgaccacgaccgg

SEQ ID NO: 2985460 - RNA, 20 nt, Mycobacterium avium subsp. paratuberculosis
caugcgaccacgaccggguc

SEQ ID NO: 2985461 - RNA, 16 nt, Mycobacterium avium subsp. paratuberculosis
caugcgcagcgcccag

SEQ ID NO: 2985462 - RNA, 18 nt, Mycobacterium avium subsp. paratuberculosis
caugcgcagcgcccaggc

SEQ ID NO: 2985463 - RNA, 20 nt, Mycobacterium avium subsp. paratuberculosis
caugcgccagagcgcgaaaa

SEQ ID NO: 2985464 - RNA, 17 nt, Mycobacterium avium subsp. paratuberculosis
caugcgcgagucgagca

SEQ ID NO: 2985465 - RNA, 19 nt, Mycobacterium avium subsp. paratuberculosis
caugcgcgucauggccguc

SEQ ID NO: 2985466 - RNA, 20 nt, Mycobacterium avium subsp. paratuberculosis
caugcgcgucauggccgucg

SEQ ID NO: 2985467 - RNA, 15 nt, Mycobacterium avium subsp. paratuberculosis
caugcguuugccguc

SEQ ID NO: 2985468 - RNA, 17 nt, Mycobacterium avium subsp. paratuberculosis
caugcugaucuuggcac

SEQ ID NO: 2985469 - RNA, 17 nt, Mycobacterium avium subsp. paratuberculosis
caugcuggcacuccuug

SEQ ID NO: 2985470 - RNA, 18 nt, Mycobacterium avium subsp. paratuberculosis
caugcuggcacuccuugc

SEQ ID NO: 2985471 - RNA, 15 nt, Mycobacterium avium subsp. paratuberculosis
caugcugggcuacca

SEQ ID NO: 2985472 - RNA, 17 nt, Mycobacterium avium subsp. paratuberculosis
caugcuggugccgccga

SEQ ID NO: 2985473 - RNA, 18 nt, Mycobacterium avium subsp. paratuberculosis
caugcuggugccgccgau

SEQ ID NO: 2985474 - RNA, 20 nt, Mycobacterium avium subsp. paratuberculosis
caugcuggugccgccgauga

SEQ ID NO: 2985475 - RNA, 21 nt, Mycobacterium avium subsp. paratuberculosis
caugcuuucgaucaucgagca

SEQ ID NO: 2985476 - RNA, 17 nt, Mycobacterium avium subsp. paratuberculosis
cauggaaaccggcggga

SEQ ID NO: 2985477 - RNA, 21 nt, Mycobacterium avium subsp. paratuberculosis
cauggacacgcccugguaggc

SEQ ID NO: 2985478 - RNA, 12 nt, Mycobacterium avium subsp. paratuberculosis
cauggacagcca

SEQ ID NO: 2985479 - RNA, 17 nt, Mycobacterium avium subsp. paratuberculosis
cauggccagcaccaucc

SEQ ID NO: 2985480 - RNA, 11 nt, Mycobacterium avium subsp. paratuberculosis
cauggccagcu

SEQ ID NO: 2985481 - RNA, 14 nt, Mycobacterium avium subsp. paratuberculosis
cauggccaggaacg

SEQ ID NO: 2985482 - RNA, 20 nt, Mycobacterium avium subsp. paratuberculosis
cauggccggcgaaccgccgc

SEQ ID NO: 2985483 - RNA, 21 nt, Mycobacterium avium subsp. paratuberculosis
cauggccggcgaaccgccgca

SEQ ID NO: 2985484 - RNA, 14 nt, Mycobacterium avium subsp. paratuberculosis
cauggccgucgggu

SEQ ID NO: 2985485 - RNA, 17 nt, Mycobacterium avium subsp. paratuberculosis
cauggccgucgggucgg

SEQ ID NO: 2985486 - RNA, 22 nt, Mycobacterium avium subsp. paratuberculosis
cauggccuccccauccgcggcc

SEQ ID NO: 2985487 - RNA, 16 nt, Mycobacterium avium subsp. paratuberculosis
cauggccuugaacucg

SEQ ID NO: 2985488 - RNA, 20 nt, Mycobacterium avium subsp. paratuberculosis
cauggccuugaacucggcca

SEQ ID NO: 2985489 - RNA, 23 nt, Mycobacterium avium subsp. paratuberculosis
cauggccuugaacucggccaggg

SEQ ID NO: 2985490 - RNA, 23 nt, Mycobacterium avium subsp. paratuberculosis
cauggcgaacacgucggccagcg

SEQ ID NO: 2985491 - RNA, 20 nt, Mycobacterium avium subsp. paratuberculosis
cauggcgaaguagucggcgu

SEQ ID NO: 2985492 - RNA, 15 nt, Mycobacterium avium subsp. paratuberculosis
cauggcgaccgcgac

SEQ ID NO: 2985493 - RNA, 17 nt, Mycobacterium avium subsp. paratuberculosis
cauggcgaucaccccgg

SEQ ID NO: 2985494 - RNA, 17 nt, Mycobacterium avium subsp. paratuberculosis
cauggcgaugacgucgu

SEQ ID NO: 2985495 - RNA, 14 nt, Mycobacterium avium subsp. paratuberculosis
cauggcgcaccgcg

SEQ ID NO: 2985496 - RNA, 13 nt, Mycobacterium avium subsp. paratuberculosis
cauggcgcagaac

SEQ ID NO: 2985497 - RNA, 14 nt, Mycobacterium avium subsp. paratuberculosis
cauggcgcagaaca

SEQ ID NO: 2985498 - RNA, 17 nt, Mycobacterium avium subsp. paratuberculosis
cauggcgcugcgcgaca

SEQ ID NO: 2985499 - RNA, 19 nt, Mycobacterium avium subsp. paratuberculosis
cauggcgcugcgcgacacc

SEQ ID NO: 2985500 - RNA, 15 nt, Mycobacterium avium subsp. paratuberculosis
cauggcggccagccg

SEQ ID NO: 2985501 - RNA, 15 nt, Mycobacterium avium subsp. paratuberculosis
cauggcggcccgcgc

SEQ ID NO: 2985502 - RNA, 19 nt, Mycobacterium avium subsp. paratuberculosis
cauggcggcgaccaaugcc

SEQ ID NO: 2985503 - RNA, 18 nt, Mycobacterium avium subsp. paratuberculosis
cauggcgugcugaugcug

SEQ ID NO: 2985504 - RNA, 15 nt, Mycobacterium avium subsp. paratuberculosis
cauggcuuccgccga

SEQ ID NO: 2985505 - RNA, 17 nt, Mycobacterium avium subsp. paratuberculosis
cauggcuuccgccgaga

SEQ ID NO: 2985506 - RNA, 20 nt, Mycobacterium avium subsp. paratuberculosis
caugggcaucgucucggacc

SEQ ID NO: 2985507 - RNA, 17 nt, Mycobacterium avium subsp. paratuberculosis
caugggccacggcgcga

SEQ ID NO: 2985508 - RNA, 21 nt, Mycobacterium avium subsp. paratuberculosis
caugggcgugccggcccggcg

SEQ ID NO: 2985509 - RNA, 22 nt, Mycobacterium avium subsp. paratuberculosis
cauggucaggguguaggccgcg

SEQ ID NO: 2985510 - RNA, 18 nt, Mycobacterium avium subsp. paratuberculosis
caugguccugcaccgagu

SEQ ID NO: 2985511 - RNA, 12 nt, Mycobacterium avium subsp. paratuberculosis
cauggucgagcc

SEQ ID NO: 2985512 - RNA, 16 nt, Mycobacterium avium subsp. paratuberculosis
cauggucgcccacacc

SEQ ID NO: 2985513 - RNA, 18 nt, Mycobacterium avium subsp. paratuberculosis
cauggucgcccacaccgg

SEQ ID NO: 2985514 - RNA, 22 nt, Mycobacterium avium subsp. paratuberculosis
cauggucgcggccguguacagc

SEQ ID NO: 2985515 - RNA, 14 nt, Mycobacterium avium subsp. paratuberculosis
cauggucggcgacg

SEQ ID NO: 2985516 - RNA, 12 nt, Mycobacterium avium subsp. paratuberculosis
cauggugaacug

SEQ ID NO: 2985517 - RNA, 17 nt, Mycobacterium avium subsp. paratuberculosis
cauggugaagcccagcg

SEQ ID NO: 2985518 - RNA, 18 nt, Mycobacterium avium subsp. paratuberculosis
cauggugaaggcgaacac

SEQ ID NO: 2985519 - RNA, 23 nt, Mycobacterium avium subsp. paratuberculosis
cauggugaaggcgaacaccagcc

SEQ ID NO: 2985520 - RNA, 23 nt, Mycobacterium avium subsp. paratuberculosis
cauggugcgcggguucacccugg

SEQ ID NO: 2985521 - RNA, 18 nt, Mycobacterium avium subsp. paratuberculosis
cauggugcggguguccga

SEQ ID NO: 2985522 - RNA, 16 nt, Mycobacterium avium subsp. paratuberculosis
caugguggcggcgccg

SEQ ID NO: 2985523 - RNA, 17 nt, Mycobacterium avium subsp. paratuberculosis
caugguggcggcgccgg

SEQ ID NO: 2985524 - RNA, 21 nt, Mycobacterium avium subsp. paratuberculosis
cauggugucaggaucgccggu

SEQ ID NO: 2985525 - RNA, 23 nt, Mycobacterium avium subsp. paratuberculosis
cauggugucaggaucgccggucg

SEQ ID NO: 2985526 - RNA, 13 nt, Mycobacterium avium subsp. paratuberculosis
cauguacagaccc

SEQ ID NO: 2985527 - RNA, 16 nt, Mycobacterium avium subsp. paratuberculosis
cauguacagaccccac

SEQ ID NO: 2985528 - RNA, 20 nt, Mycobacterium avium subsp. paratuberculosis
cauguacagaccccacaccu

SEQ ID NO: 2985529 - RNA, 15 nt, Mycobacterium avium subsp. paratuberculosis
cauguacaggaucaa

SEQ ID NO: 2985530 - RNA, 14 nt, Mycobacterium avium subsp. paratuberculosis
cauguagcagcgcg

SEQ ID NO: 2985531 - RNA, 14 nt, Mycobacterium avium subsp. paratuberculosis
cauguagcggucgu

SEQ ID NO: 2985532 - RNA, 17 nt, Mycobacterium avium subsp. paratuberculosis
cauguagcggucguaga

SEQ ID NO: 2985533 - RNA, 19 nt, Mycobacterium avium subsp. paratuberculosis
cauguagguggcgaccacc

SEQ ID NO: 2985534 - RNA, 17 nt, Mycobacterium avium subsp. paratuberculosis
cauguaguucagcagcc

SEQ ID NO: 2985535 - RNA, 22 nt, Mycobacterium avium subsp. paratuberculosis
caugucaaugccgcagccgauc

SEQ ID NO: 2985536 - RNA, 18 nt, Mycobacterium avium subsp. paratuberculosis
cauguccagguacgcgac

SEQ ID NO: 2985537 - RNA, 12 nt, Mycobacterium avium subsp. paratuberculosis
cauguccagguu

SEQ ID NO: 2985538 - RNA, 23 nt, Mycobacterium avium subsp. paratuberculosis
cauguccccgccgguggcggcga

SEQ ID NO: 2985539 - RNA, 16 nt, Mycobacterium avium subsp. paratuberculosis
caugucccgggcacgc

SEQ ID NO: 2985540 - RNA, 22 nt, Mycobacterium avium subsp. paratuberculosis
cauguccgccgucaucggcgga

SEQ ID NO: 2985541 - RNA, 23 nt, Mycobacterium avium subsp. paratuberculosis
cauguccggagcgaaggugccgc

SEQ ID NO: 2985542 - RNA, 14 nt, Mycobacterium avium subsp. paratuberculosis
cauguccggcaggc

SEQ ID NO: 2985543 - RNA, 17 nt, Mycobacterium avium subsp. paratuberculosis
cauguccggcaggcuca

SEQ ID NO: 2985544 - RNA, 23 nt, Mycobacterium avium subsp. paratuberculosis
cauguccggcaggcucagcagca

SEQ ID NO: 2985545 - RNA, 21 nt, Mycobacterium avium subsp. paratuberculosis
caugucgaagaagcggccgac

SEQ ID NO: 2985546 - RNA, 23 nt, Mycobacterium avium subsp. paratuberculosis
caugucgaagaagcggccgacga

SEQ ID NO: 2985547 - RNA, 17 nt, Mycobacterium avium subsp. paratuberculosis
caugucgaccucggcca

SEQ ID NO: 2985548 - RNA, 14 nt, Mycobacterium avium subsp. paratuberculosis
caugucgacgcuga

SEQ ID NO: 2985549 - RNA, 16 nt, Mycobacterium avium subsp. paratuberculosis
caugucgacgcugagc

SEQ ID NO: 2985550 - RNA, 20 nt, Mycobacterium avium subsp. paratuberculosis
caugucgacgcugagccgcu

SEQ ID NO: 2985551 - RNA, 16 nt, Mycobacterium avium subsp. paratuberculosis
caugucgaugccgagc

SEQ ID NO: 2985552 - RNA, 13 nt, Mycobacterium avium subsp. paratuberculosis
caugucgcccgcg

SEQ ID NO: 2985553 - RNA, 16 nt, Mycobacterium avium subsp. paratuberculosis
caugucgccgaacgcc

SEQ ID NO: 2985554 - RNA, 14 nt, Mycobacterium avium subsp. paratuberculosis
caugucgccggugc

SEQ ID NO: 2985555 - RNA, 18 nt, Mycobacterium avium subsp. paratuberculosis
caugucgccggugcuggu

SEQ ID NO: 2985556 - RNA, 16 nt, Mycobacterium avium subsp. paratuberculosis
caugucggagcugcgc

SEQ ID NO: 2985557 - RNA, 20 nt, Mycobacterium avium subsp. paratuberculosis
caugucggagcugcgcgccc

SEQ ID NO: 2985558 - RNA, 14 nt, Mycobacterium avium subsp. paratuberculosis
caugucggcgucgc

SEQ ID NO: 2985559 - RNA, 21 nt, Mycobacterium avium subsp. paratuberculosis
caugucgguaaggcaggcacu

SEQ ID NO: 2985560 - RNA, 18 nt, Mycobacterium avium subsp. paratuberculosis
caugucgguggacagcgc

SEQ ID NO: 2985561 - RNA, 16 nt, Mycobacterium avium subsp. paratuberculosis
caugucguacgggcgc

SEQ ID NO: 2985562 - RNA, 19 nt, Mycobacterium avium subsp. paratuberculosis
caugucguacgggcgcagc

SEQ ID NO: 2985563 - RNA, 22 nt, Mycobacterium avium subsp. paratuberculosis
caugucguacgggcgcagcgcc

SEQ ID NO: 2985564 - RNA, 15 nt, Mycobacterium avium subsp. paratuberculosis
caugucguaguagcg

SEQ ID NO: 2985565 - RNA, 17 nt, Mycobacterium avium subsp. paratuberculosis
caugucgucgagcucga

SEQ ID NO: 2985566 - RNA, 16 nt, Mycobacterium avium subsp. paratuberculosis
caugucgucggcggac

SEQ ID NO: 2985567 - RNA, 17 nt, Mycobacterium avium subsp. paratuberculosis
caugucguugacgcugg

SEQ ID NO: 2985568 - RNA, 20 nt, Mycobacterium avium subsp. paratuberculosis
caugucguugaugccgucga

SEQ ID NO: 2985569 - RNA, 16 nt, Mycobacterium avium subsp. paratuberculosis
caugugaccggggucg

SEQ ID NO: 2985570 - RNA, 19 nt, Mycobacterium avium subsp. paratuberculosis
caugugaccggggucggcg

SEQ ID NO: 2985571 - RNA, 22 nt, Mycobacterium avium subsp. paratuberculosis
caugugaccggggucggcgccc

SEQ ID NO: 2985572 - RNA, 20 nt, Mycobacterium avium subsp. paratuberculosis
caugugaugauuccgcgucu

SEQ ID NO: 2985573 - RNA, 16 nt, Mycobacterium avium subsp. paratuberculosis
caugugccacagguac

SEQ ID NO: 2985574 - RNA, 18 nt, Mycobacterium avium subsp. paratuberculosis
caugugccacagguacag

SEQ ID NO: 2985575 - RNA, 20 nt, Mycobacterium avium subsp. paratuberculosis
caugugccacagguacaggg

SEQ ID NO: 2985576 - RNA, 22 nt, Mycobacterium avium subsp. paratuberculosis
caugugccgaugucugaucgcg

SEQ ID NO: 2985577 - RNA, 23 nt, Mycobacterium avium subsp. paratuberculosis
caugugccggcgcucgucgucgc

SEQ ID NO: 2985578 - RNA, 16 nt, Mycobacterium avium subsp. paratuberculosis
caugugcucccagcuc

SEQ ID NO: 2985579 - RNA, 20 nt, Mycobacterium avium subsp. paratuberculosis
caugugcucccagcucagac

SEQ ID NO: 2985580 - RNA, 13 nt, Mycobacterium avium subsp. paratuberculosis
caugugcucggcg

SEQ ID NO: 2985581 - RNA, 16 nt, Mycobacterium avium subsp. paratuberculosis
cauguggaagccgcga

SEQ ID NO: 2985582 - RNA, 21 nt, Mycobacterium avium subsp. paratuberculosis
cauguggccugagugaaaugc

SEQ ID NO: 2985583 - RNA, 17 nt, Mycobacterium avium subsp. paratuberculosis
caugugguugggccagg

SEQ ID NO: 2985584 - RNA, 18 nt, Mycobacterium avium subsp. paratuberculosis
caugugguugggccaggc

SEQ ID NO: 2985585 - RNA, 20 nt, Mycobacterium avium subsp. paratuberculosis
cauguucuccucgucgcggg

SEQ ID NO: 2985586 - RNA, 14 nt, Mycobacterium avium subsp. paratuberculosis
cauguugugcaggc

SEQ ID NO: 2985587 - RNA, 20 nt, Mycobacterium avium subsp. paratuberculosis
cauguugugcaggcagccgu

SEQ ID NO: 2985588 - RNA, 14 nt, Mycobacterium avium subsp. paratuberculosis
cauucacgaggccg

SEQ ID NO: 2985589 - RNA, 16 nt, Mycobacterium avium subsp. paratuberculosis
cauucaggucaccgcg

SEQ ID NO: 2985590 - RNA, 18 nt, Mycobacterium avium subsp. paratuberculosis
cauucaucgcgcaccagg

SEQ ID NO: 2985591 - RNA, 14 nt, Mycobacterium avium subsp. paratuberculosis
cauucccgccgccg

SEQ ID NO: 2985592 - RNA, 15 nt, Mycobacterium avium subsp. paratuberculosis
cauucccgccgccgc

SEQ ID NO: 2985593 - RNA, 20 nt, Mycobacterium avium subsp. paratuberculosis
cauuccgccgaaacccgcug

SEQ ID NO: 2985594 - RNA, 15 nt, Mycobacterium avium subsp. paratuberculosis
cauuccgccgcgccc

SEQ ID NO: 2985595 - RNA, 16 nt, Mycobacterium avium subsp. paratuberculosis
cauuccgccgcgcccg

SEQ ID NO: 2985596 - RNA, 18 nt, Mycobacterium avium subsp. paratuberculosis
cauuccgccgcgcccguc

SEQ ID NO: 2985597 - RNA, 19 nt, Mycobacterium avium subsp. paratuberculosis
cauuccgccgcgcccgucg

SEQ ID NO: 2985598 - RNA, 21 nt, Mycobacterium avium subsp. paratuberculosis
cauuccgucuuggccaggccc

SEQ ID NO: 2985599 - RNA, 17 nt, Mycobacterium avium subsp. paratuberculosis
cauucgcgugugcccag

SEQ ID NO: 2985600 - RNA, 14 nt, Mycobacterium avium subsp. paratuberculosis
cauucggccgccac

SEQ ID NO: 2985601 - RNA, 13 nt, Mycobacterium avium subsp. paratuberculosis
cauucggcgacgc

SEQ ID NO: 2985602 - RNA, 20 nt, Mycobacterium avium subsp. paratuberculosis
cauucggcgacgcucaggcg

SEQ ID NO: 2985603 - RNA, 17 nt, Mycobacterium avium subsp. paratuberculosis
cauucgggccagcgccg

SEQ ID NO: 2985604 - RNA, 20 nt, Mycobacterium avium subsp. paratuberculosis
cauucgggccagcgccgagc

SEQ ID NO: 2985605 - RNA, 21 nt, Mycobacterium avium subsp. paratuberculosis
cauucgggccagcgccgagcc

SEQ ID NO: 2985606 - RNA, 15 nt, Mycobacterium avium subsp. paratuberculosis
cauucggggccacca

SEQ ID NO: 2985607 - RNA, 19 nt, Mycobacterium avium subsp. paratuberculosis
cauucggggccaccaggcc

SEQ ID NO: 2985608 - RNA, 20 nt, Mycobacterium avium subsp. paratuberculosis
cauucggggccaccaggccg

SEQ ID NO: 2985609 - RNA, 16 nt, Mycobacterium avium subsp. paratuberculosis
cauucgguuuccccuu

SEQ ID NO: 2985610 - RNA, 15 nt, Mycobacterium avium subsp. paratuberculosis
cauucguccauccgc

SEQ ID NO: 2985611 - RNA, 22 nt, Mycobacterium avium subsp. paratuberculosis
cauucgucggcggucuuggcgg

SEQ ID NO: 2985612 - RNA, 20 nt, Mycobacterium avium subsp. paratuberculosis
cauucugaauucggccaccg

SEQ ID NO: 2985613 - RNA, 22 nt, Mycobacterium avium subsp. paratuberculosis
cauucugaauucggccaccgac

SEQ ID NO: 2985614 - RNA, 21 nt, Mycobacterium avium subsp. paratuberculosis
cauugagccgcucgccgggga

SEQ ID NO: 2985615 - RNA, 17 nt, Mycobacterium avium subsp. paratuberculosis
cauugauauugaucgag

SEQ ID NO: 2985616 - RNA, 15 nt, Mycobacterium avium subsp. paratuberculosis
cauugaucuccgcgg

SEQ ID NO: 2985617 - RNA, 16 nt, Mycobacterium avium subsp. paratuberculosis
cauugaucuccgcggc

SEQ ID NO: 2985618 - RNA, 17 nt, Mycobacterium avium subsp. paratuberculosis
cauugaucuccgcggcg

SEQ ID NO: 2985619 - RNA, 15 nt, Mycobacterium avium subsp. paratuberculosis
cauugcccaucgcca

SEQ ID NO: 2985620 - RNA, 12 nt, Mycobacterium avium subsp. paratuberculosis
cauugccgcgcc

SEQ ID NO: 2985621 - RNA, 18 nt, Mycobacterium avium subsp. paratuberculosis
cauugcgauacgacggga

SEQ ID NO: 2985622 - RNA, 18 nt, Mycobacterium avium subsp. paratuberculosis
cauuggcaccgucgaccu

SEQ ID NO: 2985623 - RNA, 15 nt, Mycobacterium avium subsp. paratuberculosis
cauuggccgcgcgca

SEQ ID NO: 2985624 - RNA, 16 nt, Mycobacterium avium subsp. paratuberculosis
cauuggugccggccuc

SEQ ID NO: 2985625 - RNA, 17 nt, Mycobacterium avium subsp. paratuberculosis
cauugucgccgugcggc

SEQ ID NO: 2985626 - RNA, 13 nt, Mycobacterium avium subsp. paratuberculosis
cauuucagcagcg

SEQ ID NO: 2985627 - RNA, 15 nt, Mycobacterium avium subsp. paratuberculosis
cauuucagcagcgcg

SEQ ID NO: 2985628 - RNA, 16 nt, Mycobacterium avium subsp. paratuberculosis
cauuuccgagcgacga

SEQ ID NO: 2985629 - RNA, 19 nt, Mycobacterium avium subsp. paratuberculosis
cauuuccguugugccaccg

SEQ ID NO: 2985630 - RNA, 19 nt, Mycobacterium avium subsp. paratuberculosis
cauuucggacggcgacggc

SEQ ID NO: 2985631 - RNA, 23 nt, Mycobacterium avium subsp. paratuberculosis
cauuucggacggcgacggcagcg

SEQ ID NO: 2985632 - RNA, 14 nt, Mycobacterium avium subsp. paratuberculosis
cauuucggcguccu

SEQ ID NO: 2985633 - RNA, 15 nt, Mycobacterium avium subsp. paratuberculosis
cauuucggcuuccac

SEQ ID NO: 2985634 - RNA, 17 nt, Mycobacterium avium subsp. paratuberculosis
ccaaagccuacggcgcc

SEQ ID NO: 2985635 - RNA, 19 nt, Mycobacterium avium subsp. paratuberculosis
ccaacaacuacgagcagca

SEQ ID NO: 2985636 - RNA, 20 nt, Mycobacterium avium subsp. paratuberculosis
ccaacaacucgacguucggc

SEQ ID NO: 2985637 - RNA, 16 nt, Mycobacterium avium subsp. paratuberculosis
ccaacacggcggcgcg

SEQ ID NO: 2985638 - RNA, 19 nt, Mycobacterium avium subsp. paratuberculosis
ccaacacuuuuaaggagca

SEQ ID NO: 2985639 - RNA, 14 nt, Mycobacterium avium subsp. paratuberculosis
ccaacagcagcaga

SEQ ID NO: 2985640 - RNA, 17 nt, Mycobacterium avium subsp. paratuberculosis
ccaacaggucggcgugc

SEQ ID NO: 2985641 - RNA, 21 nt, Mycobacterium avium subsp. paratuberculosis
ccaacaggugcuuggucagcg

SEQ ID NO: 2985642 - RNA, 15 nt, Mycobacterium avium subsp. paratuberculosis
ccaacaugaucggcg

SEQ ID NO: 2985643 - RNA, 18 nt, Mycobacterium avium subsp. paratuberculosis
ccaaccaccguggcccca

SEQ ID NO: 2985644 - RNA, 19 nt, Mycobacterium avium subsp. paratuberculosis
ccaaccaggcgcucgucga

SEQ ID NO: 2985645 - RNA, 13 nt, Mycobacterium avium subsp. paratuberculosis
ccaaccccgggcg

SEQ ID NO: 2985646 - RNA, 15 nt, Mycobacterium avium subsp. paratuberculosis
ccaaccccgggcggc

SEQ ID NO: 2985647 - RNA, 20 nt, Mycobacterium avium subsp. paratuberculosis
ccaacccgaaggugguggcg

SEQ ID NO: 2985648 - RNA, 22 nt, Mycobacterium avium subsp. paratuberculosis
ccaacccgaaggugguggcguu

SEQ ID NO: 2985649 - RNA, 14 nt, Mycobacterium avium subsp. paratuberculosis
ccaacccgggcgcc

SEQ ID NO: 2985650 - RNA, 16 nt, Mycobacterium avium subsp. paratuberculosis
ccaacccgggcgccau

SEQ ID NO: 2985651 - RNA, 15 nt, Mycobacterium avium subsp. paratuberculosis
ccaaccgcauucggc

SEQ ID NO: 2985652 - RNA, 14 nt, Mycobacterium avium subsp. paratuberculosis
ccaaccgcccggcg

SEQ ID NO: 2985653 - RNA, 17 nt, Mycobacterium avium subsp. paratuberculosis
ccaaccgcccggcgccg

SEQ ID NO: 2985654 - RNA, 20 nt, Mycobacterium avium subsp. paratuberculosis
ccaaccgcccggcgccgauc

SEQ ID NO: 2985655 - RNA, 16 nt, Mycobacterium avium subsp. paratuberculosis
ccaaccgcucggcgau

SEQ ID NO: 2985656 - RNA, 18 nt, Mycobacterium avium subsp. paratuberculosis
ccaaccgcucggcgaucu

SEQ ID NO: 2985657 - RNA, 13 nt, Mycobacterium avium subsp. paratuberculosis
ccaaccggccccg

SEQ ID NO: 2985658 - RNA, 18 nt, Mycobacterium avium subsp. paratuberculosis
ccaaccgggcaggcacgg

SEQ ID NO: 2985659 - RNA, 20 nt, Mycobacterium avium subsp. paratuberculosis
ccaaccguuggugcgguguc

SEQ ID NO: 2985660 - RNA, 12 nt, Mycobacterium avium subsp. paratuberculosis
ccaacgacagcg

SEQ ID NO: 2985661 - RNA, 18 nt, Mycobacterium avium subsp. paratuberculosis
ccaacgacagcgacgggc

SEQ ID NO: 2985662 - RNA, 21 nt, Mycobacterium avium subsp. paratuberculosis
ccaacgacagcgacgggccgg

SEQ ID NO: 2985663 - RNA, 13 nt, Mycobacterium avium subsp. paratuberculosis
ccaacgacgucgg

SEQ ID NO: 2985664 - RNA, 15 nt, Mycobacterium avium subsp. paratuberculosis
ccaacgacgucggcg

SEQ ID NO: 2985665 - RNA, 23 nt, Mycobacterium avium subsp. paratuberculosis
ccaacgacgucggcgucaucgac

SEQ ID NO: 2985666 - RNA, 15 nt, Mycobacterium avium subsp. paratuberculosis
ccaacgagcgcgccg

SEQ ID NO: 2985667 - RNA, 15 nt, Mycobacterium avium subsp. paratuberculosis
ccaacgcagcgcauc

SEQ ID NO: 2985668 - RNA, 17 nt, Mycobacterium avium subsp. paratuberculosis
ccaacgccgccuccgac

SEQ ID NO: 2985669 - RNA, 20 nt, Mycobacterium avium subsp. paratuberculosis
ccaacgccgccuccgacagc

SEQ ID NO: 2985670 - RNA, 15 nt, Mycobacterium avium subsp. paratuberculosis
ccaacgccucgucga

SEQ ID NO: 2985671 - RNA, 22 nt, Mycobacterium avium subsp. paratuberculosis
ccaacgccucgucgaccgcggc

SEQ ID NO: 2985672 - RNA, 13 nt, Mycobacterium avium subsp. paratuberculosis
ccaacgcggcgcc

SEQ ID NO: 2985673 - RNA, 14 nt, Mycobacterium avium subsp. paratuberculosis
ccaacgcggcgccg

SEQ ID NO: 2985674 - RNA, 15 nt, Mycobacterium avium subsp. paratuberculosis
ccaacgcggcgccgg

SEQ ID NO: 2985675 - RNA, 19 nt, Mycobacterium avium subsp. paratuberculosis
ccaacgcguucuccucgaa

SEQ ID NO: 2985676 - RNA, 23 nt, Mycobacterium avium subsp. paratuberculosis
ccaacgcguucuccucgaacacc

SEQ ID NO: 2985677 - RNA, 14 nt, Mycobacterium avium subsp. paratuberculosis
ccaacggaagcggu

SEQ ID NO: 2985678 - RNA, 19 nt, Mycobacterium avium subsp. paratuberculosis
ccaacggauucagcgucgc

SEQ ID NO: 2985679 - RNA, 15 nt, Mycobacterium avium subsp. paratuberculosis
ccaacggcaccacca

SEQ ID NO: 2985680 - RNA, 13 nt, Mycobacterium avium subsp. paratuberculosis
ccaacggccgcac

SEQ ID NO: 2985681 - RNA, 13 nt, Mycobacterium avium subsp. paratuberculosis
ccaacggcgugca

SEQ ID NO: 2985682 - RNA, 14 nt, Mycobacterium avium subsp. paratuberculosis
ccaacggcgugcag

SEQ ID NO: 2985683 - RNA, 18 nt, Mycobacterium avium subsp. paratuberculosis
ccaacgggaagagcggcg

SEQ ID NO: 2985684 - RNA, 14 nt, Mycobacterium avium subsp. paratuberculosis
ccaacgggcggcgg

SEQ ID NO: 2985685 - RNA, 15 nt, Mycobacterium avium subsp. paratuberculosis
ccaacgguucggccg

SEQ ID NO: 2985686 - RNA, 18 nt, Mycobacterium avium subsp. paratuberculosis
ccaacgguucggccgcuc

SEQ ID NO: 2985687 - RNA, 17 nt, Mycobacterium avium subsp. paratuberculosis
ccaacgguuuccaccac

SEQ ID NO: 2985688 - RNA, 16 nt, Mycobacterium avium subsp. paratuberculosis
ccaacguggguggccc

SEQ ID NO: 2985689 - RNA, 16 nt, Mycobacterium avium subsp. paratuberculosis
ccaacuacccgccgac

SEQ ID NO: 2985690 - RNA, 15 nt, Mycobacterium avium subsp. paratuberculosis
ccaacucaugggccc

SEQ ID NO: 2985691 - RNA, 19 nt, Mycobacterium avium subsp. paratuberculosis
ccaacuccaccgcccggau

SEQ ID NO: 2985692 - RNA, 15 nt, Mycobacterium avium subsp. paratuberculosis
ccaacucgaccugcc

SEQ ID NO: 2985693 - RNA, 18 nt, Mycobacterium avium subsp. paratuberculosis
ccaacucgaccugcccgg

SEQ ID NO: 2985694 - RNA, 23 nt, Mycobacterium avium subsp. paratuberculosis
ccaacugcagauaggacccggcg

SEQ ID NO: 2985695 - RNA, 15 nt, Mycobacterium avium subsp. paratuberculosis
ccaacugcagcaacg

SEQ ID NO: 2985696 - RNA, 17 nt, Mycobacterium avium subsp. paratuberculosis
ccaacugcaucgccagc

SEQ ID NO: 2985697 - RNA, 21 nt, Mycobacterium avium subsp. paratuberculosis
ccaacugcaucgccagcacau

SEQ ID NO: 2985698 - RNA, 21 nt, Mycobacterium avium subsp. paratuberculosis
ccaacugcauuucggacggcg

SEQ ID NO: 2985699 - RNA, 22 nt, Mycobacterium avium subsp. paratuberculosis
ccaacuggcgaccgguccgcgg

SEQ ID NO: 2985700 - RNA, 22 nt, Mycobacterium avium subsp. paratuberculosis
ccaagaaccaacugagcgcggc

SEQ ID NO: 2985701 - RNA, 21 nt, Mycobacterium avium subsp. paratuberculosis
ccaagaccgcggucaccgguc

SEQ ID NO: 2985702 - RNA, 20 nt, Mycobacterium avium subsp. paratuberculosis
ccaagacggugggcccgccg

SEQ ID NO: 2985703 - RNA, 15 nt, Mycobacterium avium subsp. paratuberculosis
ccaagacguccgcgu

SEQ ID NO: 2985704 - RNA, 16 nt, Mycobacterium avium subsp. paratuberculosis
ccaagacguccgcguc

SEQ ID NO: 2985705 - RNA, 19 nt, Mycobacterium avium subsp. paratuberculosis
ccaagacguccgcgucggc

SEQ ID NO: 2985706 - RNA, 22 nt, Mycobacterium avium subsp. paratuberculosis
ccaagacguccgcgucggcgcc

SEQ ID NO: 2985707 - RNA, 17 nt, Mycobacterium avium subsp. paratuberculosis
ccaagccauuucagcag

SEQ ID NO: 2985708 - RNA, 18 nt, Mycobacterium avium subsp. paratuberculosis
ccaagccauuucagcagc

SEQ ID NO: 2985709 - RNA, 19 nt, Mycobacterium avium subsp. paratuberculosis
ccaagccauuucagcagcg

SEQ ID NO: 2985710 - RNA, 21 nt, Mycobacterium avium subsp. paratuberculosis
ccaagccauuucagcagcgcg

SEQ ID NO: 2985711 - RNA, 20 nt, Mycobacterium avium subsp. paratuberculosis
ccaagcgguuccagaccggc

SEQ ID NO: 2985712 - RNA, 22 nt, Mycobacterium avium subsp. paratuberculosis
ccaagcgguuccagaccggcgg

SEQ ID NO: 2985713 - RNA, 14 nt, Mycobacterium avium subsp. paratuberculosis
ccaaggacaagcug

SEQ ID NO: 2985714 - RNA, 19 nt, Mycobacterium avium subsp. paratuberculosis
ccaaggagaaggccgcgcg

SEQ ID NO: 2985715 - RNA, 18 nt, Mycobacterium avium subsp. paratuberculosis
ccaaggcaaucaggcggu

SEQ ID NO: 2985716 - RNA, 15 nt, Mycobacterium avium subsp. paratuberculosis
ccaaggccagcaacc

SEQ ID NO: 2985717 - RNA, 16 nt, Mycobacterium avium subsp. paratuberculosis
ccaaggccagcaaccg

SEQ ID NO: 2985718 - RNA, 16 nt, Mycobacterium avium subsp. paratuberculosis
ccaaggcggacaacgg

SEQ ID NO: 2985719 - RNA, 22 nt, Mycobacterium avium subsp. paratuberculosis
ccaaggggaggggacgggacgu

SEQ ID NO: 2985720 - RNA, 14 nt, Mycobacterium avium subsp. paratuberculosis
ccaaggugcgguga

SEQ ID NO: 2985721 - RNA, 15 nt, Mycobacterium avium subsp. paratuberculosis
ccaagugcccgcggg

SEQ ID NO: 2985722 - RNA, 12 nt, Mycobacterium avium subsp. paratuberculosis
ccaagugcgguc

SEQ ID NO: 2985723 - RNA, 17 nt, Mycobacterium avium subsp. paratuberculosis
ccaagugcggucgguuc

SEQ ID NO: 2985724 - RNA, 13 nt, Mycobacterium avium subsp. paratuberculosis
ccaagugcggugu

SEQ ID NO: 2985725 - RNA, 15 nt, Mycobacterium avium subsp. paratuberculosis
ccaagugcggugugg

SEQ ID NO: 2985726 - RNA, 19 nt, Mycobacterium avium subsp. paratuberculosis
ccaauaccguuccgccccu

SEQ ID NO: 2985727 - RNA, 14 nt, Mycobacterium avium subsp. paratuberculosis
ccaauacggcccgg

SEQ ID NO: 2985728 - RNA, 22 nt, Mycobacterium avium subsp. paratuberculosis
ccaauccggcgggccucgccgc

SEQ ID NO: 2985729 - RNA, 14 nt, Mycobacterium avium subsp. paratuberculosis
ccaauccucgccga

SEQ ID NO: 2985730 - RNA, 15 nt, Mycobacterium avium subsp. paratuberculosis
ccaauccucgccgag

SEQ ID NO: 2985731 - RNA, 24 nt, Mycobacterium avium subsp. paratuberculosis
ccaaugaaauucaggccacgcagg

SEQ ID NO: 2985732 - RNA, 14 nt, Mycobacterium avium subsp. paratuberculosis
ccaaugccggaucg

SEQ ID NO: 2985733 - RNA, 20 nt, Mycobacterium avium subsp. paratuberculosis
ccaaugcgcccugguugauc

SEQ ID NO: 2985734 - RNA, 13 nt, Mycobacterium avium subsp. paratuberculosis
ccaaugcgccggc

SEQ ID NO: 2985735 - RNA, 15 nt, Mycobacterium avium subsp. paratuberculosis
ccaaugcgccggcgg

SEQ ID NO: 2985736 - RNA, 16 nt, Mycobacterium avium subsp. paratuberculosis
ccaaugcgccggcggc

SEQ ID NO: 2985737 - RNA, 18 nt, Mycobacterium avium subsp. paratuberculosis
ccaaugcgccggcggccg

SEQ ID NO: 2985738 - RNA, 15 nt, Mycobacterium avium subsp. paratuberculosis
ccaauggcggccacg

SEQ ID NO: 2985739 - RNA, 16 nt, Mycobacterium avium subsp. paratuberculosis
ccaaugucacggcggg

SEQ ID NO: 2985740 - RNA, 19 nt, Mycobacterium avium subsp. paratuberculosis
ccaauuacgcugcggcgcc

SEQ ID NO: 2985741 - RNA, 15 nt, Mycobacterium avium subsp. paratuberculosis
ccaauucgcgcugcc

SEQ ID NO: 2985742 - RNA, 22 nt, Mycobacterium avium subsp. paratuberculosis
ccaauucgcgcugccagggccg

SEQ ID NO: 2985743 - RNA, 18 nt, Mycobacterium avium subsp. paratuberculosis
ccacaaacagcgcggccg

SEQ ID NO: 2985744 - RNA, 16 nt, Mycobacterium avium subsp. paratuberculosis
ccacaacaugucccgg

SEQ ID NO: 2985745 - RNA, 14 nt, Mycobacterium avium subsp. paratuberculosis
ccacaacuggccgg

SEQ ID NO: 2985746 - RNA, 15 nt, Mycobacterium avium subsp. paratuberculosis
ccacaacuggccggg

SEQ ID NO: 2985747 - RNA, 14 nt, Mycobacterium avium subsp. paratuberculosis
ccacaagggccacc

SEQ ID NO: 2985748 - RNA, 21 nt, Mycobacterium avium subsp. paratuberculosis
ccacaagggccaccgggccga

SEQ ID NO: 2985749 - RNA, 21 nt, Mycobacterium avium subsp. paratuberculosis
ccacaauggauccgaucagca

SEQ ID NO: 2985750 - RNA, 14 nt, Mycobacterium avium subsp. paratuberculosis
ccacacccagcgcc

SEQ ID NO: 2985751 - RNA, 20 nt, Mycobacterium avium subsp. paratuberculosis
ccacacccagcgccaggacg

SEQ ID NO: 2985752 - RNA, 14 nt, Mycobacterium avium subsp. paratuberculosis
ccacacccgcggcc

SEQ ID NO: 2985753 - RNA, 15 nt, Mycobacterium avium subsp. paratuberculosis
ccacacccgcggccg

SEQ ID NO: 2985754 - RNA, 13 nt, Mycobacterium avium subsp. paratuberculosis
ccacacccgucga

SEQ ID NO: 2985755 - RNA, 13 nt, Mycobacterium avium subsp. paratuberculosis
ccacaccgacacc

SEQ ID NO: 2985756 - RNA, 18 nt, Mycobacterium avium subsp. paratuberculosis
ccacaccgacaccggccg

SEQ ID NO: 2985757 - RNA, 22 nt, Mycobacterium avium subsp. paratuberculosis
ccacaccgacaccggccgggac

SEQ ID NO: 2985758 - RNA, 13 nt, Mycobacterium avium subsp. paratuberculosis
ccacaccgccgcg

SEQ ID NO: 2985759 - RNA, 15 nt, Mycobacterium avium subsp. paratuberculosis
ccacaccgccgcggc

SEQ ID NO: 2985760 - RNA, 12 nt, Mycobacterium avium subsp. paratuberculosis
ccacaccgccgg

SEQ ID NO: 2985761 - RNA, 13 nt, Mycobacterium avium subsp. paratuberculosis
ccacaccgccggc

SEQ ID NO: 2985762 - RNA, 17 nt, Mycobacterium avium subsp. paratuberculosis
ccacaccgccggccacg

SEQ ID NO: 2985763 - RNA, 15 nt, Mycobacterium avium subsp. paratuberculosis
ccacaccgccggcgc

SEQ ID NO: 2985764 - RNA, 16 nt, Mycobacterium avium subsp. paratuberculosis
ccacaccgccggcgcg

SEQ ID NO: 2985765 - RNA, 18 nt, Mycobacterium avium subsp. paratuberculosis
ccacaccgccggcgcgga

SEQ ID NO: 2985766 - RNA, 12 nt, Mycobacterium avium subsp. paratuberculosis
ccacaccggcgc

SEQ ID NO: 2985767 - RNA, 20 nt, Mycobacterium avium subsp. paratuberculosis
ccacaccggcgcugcccgcg

SEQ ID NO: 2985768 - RNA, 16 nt, Mycobacterium avium subsp. paratuberculosis
ccacaccggggccagg

SEQ ID NO: 2985769 - RNA, 14 nt, Mycobacterium avium subsp. paratuberculosis
ccacaccucggcga

SEQ ID NO: 2985770 - RNA, 13 nt, Mycobacterium avium subsp. paratuberculosis
ccacacgaugcgc

SEQ ID NO: 2985771 - RNA, 15 nt, Mycobacterium avium subsp. paratuberculosis
ccacacgcucggcga

SEQ ID NO: 2985772 - RNA, 17 nt, Mycobacterium avium subsp. paratuberculosis
ccacacgcucggcgagc

SEQ ID NO: 2985773 - RNA, 16 nt, Mycobacterium avium subsp. paratuberculosis
ccacacgcucggcgcg

SEQ ID NO: 2985774 - RNA, 17 nt, Mycobacterium avium subsp. paratuberculosis
ccacacgcucggcgcgc

SEQ ID NO: 2985775 - RNA, 16 nt, Mycobacterium avium subsp. paratuberculosis
ccacacggcaggcggc

SEQ ID NO: 2985776 - RNA, 17 nt, Mycobacterium avium subsp. paratuberculosis
ccacacggcaggcggcc

SEQ ID NO: 2985777 - RNA, 18 nt, Mycobacterium avium subsp. paratuberculosis
ccacacggcaggcggccc

SEQ ID NO: 2985778 - RNA, 19 nt, Mycobacterium avium subsp. paratuberculosis
ccacacggcaggcggcccg

SEQ ID NO: 2985779 - RNA, 22 nt, Mycobacterium avium subsp. paratuberculosis
ccacacgggugugacauccccg

SEQ ID NO: 2985780 - RNA, 17 nt, Mycobacterium avium subsp. paratuberculosis
ccacacguugagcccgg

SEQ ID NO: 2985781 - RNA, 18 nt, Mycobacterium avium subsp. paratuberculosis
ccacacguugagcccgga

SEQ ID NO: 2985782 - RNA, 14 nt, Mycobacterium avium subsp. paratuberculosis
ccacagcagcacca

SEQ ID NO: 2985783 - RNA, 19 nt, Mycobacterium avium subsp. paratuberculosis
ccacagcagcaccagcgcg

SEQ ID NO: 2985784 - RNA, 22 nt, Mycobacterium avium subsp. paratuberculosis
ccacagcaguuccgacaucagu

SEQ ID NO: 2985785 - RNA, 23 nt, Mycobacterium avium subsp. paratuberculosis
ccacagcaugaagaucagcaccg

SEQ ID NO: 2985786 - RNA, 21 nt, Mycobacterium avium subsp. paratuberculosis
ccacagccaggugugcggcac

SEQ ID NO: 2985787 - RNA, 22 nt, Mycobacterium avium subsp. paratuberculosis
ccacagccaggugugcggcacg

SEQ ID NO: 2985788 - RNA, 19 nt, Mycobacterium avium subsp. paratuberculosis
ccacagccgcauguugugc

SEQ ID NO: 2985789 - RNA, 15 nt, Mycobacterium avium subsp. paratuberculosis
ccacagccggcggcu

SEQ ID NO: 2985790 - RNA, 17 nt, Mycobacterium avium subsp. paratuberculosis
ccacagccggcggcugu

SEQ ID NO: 2985791 - RNA, 22 nt, Mycobacterium avium subsp. paratuberculosis
ccacagccggucauaggccgcg

SEQ ID NO: 2985792 - RNA, 23 nt, Mycobacterium avium subsp. paratuberculosis
ccacagccggucauaggccgcgc

SEQ ID NO: 2985793 - RNA, 20 nt, Mycobacterium avium subsp. paratuberculosis
ccacagcgacagggugccga

SEQ ID NO: 2985794 - RNA, 13 nt, Mycobacterium avium subsp. paratuberculosis
ccacagcgccagc

SEQ ID NO: 2985795 - RNA, 15 nt, Mycobacterium avium subsp. paratuberculosis
ccacagcgccagcac

SEQ ID NO: 2985796 - RNA, 16 nt, Mycobacterium avium subsp. paratuberculosis
ccacagcgccagcacg

SEQ ID NO: 2985797 - RNA, 17 nt, Mycobacterium avium subsp. paratuberculosis
ccacagcgccagcacgg

SEQ ID NO: 2985798 - RNA, 19 nt, Mycobacterium avium subsp. paratuberculosis
ccacagcgccagcacggcc

SEQ ID NO: 2985799 - RNA, 20 nt, Mycobacterium avium subsp. paratuberculosis
ccacagcgccucgcggucga

SEQ ID NO: 2985800 - RNA, 22 nt, Mycobacterium avium subsp. paratuberculosis
ccacagcgccucgucgagccgg

SEQ ID NO: 2985801 - RNA, 18 nt, Mycobacterium avium subsp. paratuberculosis
ccacagcgcgaauccggu

SEQ ID NO: 2985802 - RNA, 13 nt, Mycobacterium avium subsp. paratuberculosis
ccacagcgcgccc

SEQ ID NO: 2985803 - RNA, 15 nt, Mycobacterium avium subsp. paratuberculosis
ccacagcgcgcccca

SEQ ID NO: 2985804 - RNA, 13 nt, Mycobacterium avium subsp. paratuberculosis
ccacagcggaucg

SEQ ID NO: 2985805 - RNA, 18 nt, Mycobacterium avium subsp. paratuberculosis
ccacagcggaucggccug

SEQ ID NO: 2985806 - RNA, 11 nt, Mycobacterium avium subsp. paratuberculosis
ccacagcggcg

SEQ ID NO: 2985807 - RNA, 20 nt, Mycobacterium avium subsp. paratuberculosis
ccacagcggcgacagcggcc

SEQ ID NO: 2985808 - RNA, 17 nt, Mycobacterium avium subsp. paratuberculosis
ccacagcgguucggcga

SEQ ID NO: 2985809 - RNA, 18 nt, Mycobacterium avium subsp. paratuberculosis
ccacagcgguucggcgac

SEQ ID NO: 2985810 - RNA, 12 nt, Mycobacterium avium subsp. paratuberculosis
ccacagcgucaa

SEQ ID NO: 2985811 - RNA, 22 nt, Mycobacterium avium subsp. paratuberculosis
ccacagcgucaauacgucacgg

SEQ ID NO: 2985812 - RNA, 16 nt, Mycobacterium avium subsp. paratuberculosis
ccacagcgucucgacc

SEQ ID NO: 2985813 - RNA, 23 nt, Mycobacterium avium subsp. paratuberculosis
ccacagcgucucgaccgcggugg

SEQ ID NO: 2985814 - RNA, 16 nt, Mycobacterium avium subsp. paratuberculosis
ccacagcucgggcagc

SEQ ID NO: 2985815 - RNA, 17 nt, Mycobacterium avium subsp. paratuberculosis
ccacagcugacgggccg

SEQ ID NO: 2985816 - RNA, 20 nt, Mycobacterium avium subsp. paratuberculosis
ccacagcugacgggccggcg

SEQ ID NO: 2985817 - RNA, 21 nt, Mycobacterium avium subsp. paratuberculosis
ccacagcugacgggccggcgg

SEQ ID NO: 2985818 - RNA, 22 nt, Mycobacterium avium subsp. paratuberculosis
ccacagcugacgggccggcggg

SEQ ID NO: 2985819 - RNA, 19 nt, Mycobacterium avium subsp. paratuberculosis
ccacagcugccggccguug

SEQ ID NO: 2985820 - RNA, 21 nt, Mycobacterium avium subsp. paratuberculosis
ccacagcuugccggagcccag

SEQ ID NO: 2985821 - RNA, 22 nt, Mycobacterium avium subsp. paratuberculosis
ccacagcuugccggagcccagc

SEQ ID NO: 2985822 - RNA, 19 nt, Mycobacterium avium subsp. paratuberculosis
ccacaggacguugaggcgg

SEQ ID NO: 2985823 - RNA, 14 nt, Mycobacterium avium subsp. paratuberculosis
ccacaggccgaaca

SEQ ID NO: 2985824 - RNA, 20 nt, Mycobacterium avium subsp. paratuberculosis
ccacaggccgaacagcagcg

SEQ ID NO: 2985825 - RNA, 17 nt, Mycobacterium avium subsp. paratuberculosis
ccacaggucgaaacccg

SEQ ID NO: 2985826 - RNA, 16 nt, Mycobacterium avium subsp. paratuberculosis
ccacauacgcggcggc

SEQ ID NO: 2985827 - RNA, 19 nt, Mycobacterium avium subsp. paratuberculosis
ccacauacgcggcggccug

SEQ ID NO: 2985828 - RNA, 23 nt, Mycobacterium avium subsp. paratuberculosis
ccacauacgcggcggccugcgcg

SEQ ID NO: 2985829 - RNA, 19 nt, Mycobacterium avium subsp. paratuberculosis
ccacaucggauucgucggu

SEQ ID NO: 2985830 - RNA, 20 nt, Mycobacterium avium subsp. paratuberculosis
ccacaucgggauuggcggcc

SEQ ID NO: 2985831 - RNA, 15 nt, Mycobacterium avium subsp. paratuberculosis
ccacaucggucucga

SEQ ID NO: 2985832 - RNA, 23 nt, Mycobacterium avium subsp. paratuberculosis
ccacaucgguugcuccggcgucg

SEQ ID NO: 2985833 - RNA, 22 nt, Mycobacterium avium subsp. paratuberculosis
ccacaucuccuuggggcugacc

SEQ ID NO: 2985834 - RNA, 16 nt, Mycobacterium avium subsp. paratuberculosis
ccacaucugccggcag

SEQ ID NO: 2985835 - RNA, 13 nt, Mycobacterium avium subsp. paratuberculosis
ccacaugccguug

SEQ ID NO: 2985836 - RNA, 16 nt, Mycobacterium avium subsp. paratuberculosis
ccacaugggccacggc

SEQ ID NO: 2985837 - RNA, 21 nt, Mycobacterium avium subsp. paratuberculosis
ccacauuggcgaccgcggccg

SEQ ID NO: 2985838 - RNA, 15 nt, Mycobacterium avium subsp. paratuberculosis
ccaccaacagcagcg

SEQ ID NO: 2985839 - RNA, 13 nt, Mycobacterium avium subsp. paratuberculosis
ccaccaacgccac

SEQ ID NO: 2985840 - RNA, 23 nt, Mycobacterium avium subsp. paratuberculosis
ccaccaacgccacguagcagcag

SEQ ID NO: 2985841 - RNA, 14 nt, Mycobacterium avium subsp. paratuberculosis
ccaccaacggcagc

SEQ ID NO: 2985842 - RNA, 14 nt, Mycobacterium avium subsp. paratuberculosis
ccaccaacggcucg

SEQ ID NO: 2985843 - RNA, 18 nt, Mycobacterium avium subsp. paratuberculosis
ccaccaacggcucgccgc

SEQ ID NO: 2985844 - RNA, 14 nt, Mycobacterium avium subsp. paratuberculosis
ccaccaaggucucc

SEQ ID NO: 2985845 - RNA, 18 nt, Mycobacterium avium subsp. paratuberculosis
ccaccaaggucuccgggc

SEQ ID NO: 2985846 - RNA, 19 nt, Mycobacterium avium subsp. paratuberculosis
ccaccaaggucuccgggcu

SEQ ID NO: 2985847 - RNA, 16 nt, Mycobacterium avium subsp. paratuberculosis
ccaccaauucgcgcug

SEQ ID NO: 2985848 - RNA, 18 nt, Mycobacterium avium subsp. paratuberculosis
ccaccacacccgcggccg

SEQ ID NO: 2985849 - RNA, 17 nt, Mycobacterium avium subsp. paratuberculosis
ccaccacauucccgccg

SEQ ID NO: 2985850 - RNA, 18 nt, Mycobacterium avium subsp. paratuberculosis
ccaccacauucccgccgc

SEQ ID NO: 2985851 - RNA, 21 nt, Mycobacterium avium subsp. paratuberculosis
ccaccacauucccgccgccgc

SEQ ID NO: 2985852 - RNA, 17 nt, Mycobacterium avium subsp. paratuberculosis
ccaccaccacggccagg

SEQ ID NO: 2985853 - RNA, 15 nt, Mycobacterium avium subsp. paratuberculosis
ccaccaccacggccg

SEQ ID NO: 2985854 - RNA, 12 nt, Mycobacterium avium subsp. paratuberculosis
ccaccaccagcg

SEQ ID NO: 2985855 - RNA, 13 nt, Mycobacterium avium subsp. paratuberculosis
ccaccaccagcgg

SEQ ID NO: 2985856 - RNA, 18 nt, Mycobacterium avium subsp. paratuberculosis
ccaccaccagucggcgcg

SEQ ID NO: 2985857 - RNA, 19 nt, Mycobacterium avium subsp. paratuberculosis
ccaccaccagucggcgcgu

SEQ ID NO: 2985858 - RNA, 11 nt, Mycobacterium avium subsp. paratuberculosis
ccaccaccaug

SEQ ID NO: 2985859 - RNA, 21 nt, Mycobacterium avium subsp. paratuberculosis
ccaccacccggaagaacucgu

SEQ ID NO: 2985860 - RNA, 12 nt, Mycobacterium avium subsp. paratuberculosis
ccaccacccggc

SEQ ID NO: 2985861 - RNA, 13 nt, Mycobacterium avium subsp. paratuberculosis
ccaccaccgacac

SEQ ID NO: 2985862 - RNA, 13 nt, Mycobacterium avium subsp. paratuberculosis
ccaccaccgagcc

SEQ ID NO: 2985863 - RNA, 15 nt, Mycobacterium avium subsp. paratuberculosis
ccaccaccgagccgg

SEQ ID NO: 2985864 - RNA, 19 nt, Mycobacterium avium subsp. paratuberculosis
ccaccaccgagccggcguc

SEQ ID NO: 2985865 - RNA, 22 nt, Mycobacterium avium subsp. paratuberculosis
ccaccaccgagguggcccagcc

SEQ ID NO: 2985866 - RNA, 18 nt, Mycobacterium avium subsp. paratuberculosis
ccaccaccgccaccagcg

SEQ ID NO: 2985867 - RNA, 16 nt, Mycobacterium avium subsp. paratuberculosis
ccaccaccgccacggc

SEQ ID NO: 2985868 - RNA, 14 nt, Mycobacterium avium subsp. paratuberculosis
ccaccaccgccucg

SEQ ID NO: 2985869 - RNA, 19 nt, Mycobacterium avium subsp. paratuberculosis
ccaccaccgccucgacggu

SEQ ID NO: 2985870 - RNA, 13 nt, Mycobacterium avium subsp. paratuberculosis
ccaccaccgcgcc

SEQ ID NO: 2985871 - RNA, 15 nt, Mycobacterium avium subsp. paratuberculosis
ccaccaccgcgccgu

SEQ ID NO: 2985872 - RNA, 14 nt, Mycobacterium avium subsp. paratuberculosis
ccaccaccgcggcg

SEQ ID NO: 2985873 - RNA, 15 nt, Mycobacterium avium subsp. paratuberculosis
ccaccaccgcggcgc

SEQ ID NO: 2985874 - RNA, 21 nt, Mycobacterium avium subsp. paratuberculosis
ccaccaccgcggcgccgucga

SEQ ID NO: 2985875 - RNA, 15 nt, Mycobacterium avium subsp. paratuberculosis
ccaccaccggccgcg

SEQ ID NO: 2985876 - RNA, 12 nt, Mycobacterium avium subsp. paratuberculosis
ccaccaccggcu

SEQ ID NO: 2985877 - RNA, 20 nt, Mycobacterium avium subsp. paratuberculosis
ccaccaccuccucgcgggcg

SEQ ID NO: 2985878 - RNA, 21 nt, Mycobacterium avium subsp. paratuberculosis
ccaccaccuccucgcgggcga

SEQ ID NO: 2985879 - RNA, 18 nt, Mycobacterium avium subsp. paratuberculosis
ccaccaccucgcgggcga

SEQ ID NO: 2985880 - RNA, 15 nt, Mycobacterium avium subsp. paratuberculosis
ccaccaccuggccgg

SEQ ID NO: 2985881 - RNA, 20 nt, Mycobacterium avium subsp. paratuberculosis
ccaccaccuucaucgccguc

SEQ ID NO: 2985882 - RNA, 22 nt, Mycobacterium avium subsp. paratuberculosis
ccaccacgaaccaggcgccggc

SEQ ID NO: 2985883 - RNA, 20 nt, Mycobacterium avium subsp. paratuberculosis
ccaccacgaccagugcccgg

SEQ ID NO: 2985884 - RNA, 20 nt, Mycobacterium avium subsp. paratuberculosis
ccaccacgacgacguggugg

SEQ ID NO: 2985885 - RNA, 13 nt, Mycobacterium avium subsp. paratuberculosis
ccaccacgacgcc

SEQ ID NO: 2985886 - RNA, 15 nt, Mycobacterium avium subsp. paratuberculosis
ccaccacgacgccgg

SEQ ID NO: 2985887 - RNA, 18 nt, Mycobacterium avium subsp. paratuberculosis
ccaccacgacgccgggcg

SEQ ID NO: 2985888 - RNA, 20 nt, Mycobacterium avium subsp. paratuberculosis
ccaccacgacgccgggcgcc

SEQ ID NO: 2985889 - RNA, 23 nt, Mycobacterium avium subsp. paratuberculosis
ccaccacgacgccgggcgcccgc

SEQ ID NO: 2985890 - RNA, 13 nt, Mycobacterium avium subsp. paratuberculosis
ccaccacgacggg

SEQ ID NO: 2985891 - RNA, 12 nt, Mycobacterium avium subsp. paratuberculosis
ccaccacgcugg

SEQ ID NO: 2985892 - RNA, 13 nt, Mycobacterium avium subsp. paratuberculosis
ccaccacggccag

SEQ ID NO: 2985893 - RNA, 23 nt, Mycobacterium avium subsp. paratuberculosis
ccaccacggccaggaagccggcg

SEQ ID NO: 2985894 - RNA, 15 nt, Mycobacterium avium subsp. paratuberculosis
ccaccacggccgaug

SEQ ID NO: 2985895 - RNA, 13 nt, Mycobacterium avium subsp. paratuberculosis
ccaccacggccgc

SEQ ID NO: 2985896 - RNA, 18 nt, Mycobacterium avium subsp. paratuberculosis
ccaccacggccgcagcgg

SEQ ID NO: 2985897 - RNA, 20 nt, Mycobacterium avium subsp. paratuberculosis
ccaccacggccgcagcggca

SEQ ID NO: 2985898 - RNA, 14 nt, Mycobacterium avium subsp. paratuberculosis
ccaccacggccgcc

SEQ ID NO: 2985899 - RNA, 17 nt, Mycobacterium avium subsp. paratuberculosis
ccaccacggccgccgag

SEQ ID NO: 2985900 - RNA, 13 nt, Mycobacterium avium subsp. paratuberculosis
ccaccacggcgcc

SEQ ID NO: 2985901 - RNA, 14 nt, Mycobacterium avium subsp. paratuberculosis
ccaccacggcgucg

SEQ ID NO: 2985902 - RNA, 15 nt, Mycobacterium avium subsp. paratuberculosis
ccaccacggcgucgc

SEQ ID NO: 2985903 - RNA, 14 nt, Mycobacterium avium subsp. paratuberculosis
ccaccacggggcgg

SEQ ID NO: 2985904 - RNA, 18 nt, Mycobacterium avium subsp. paratuberculosis
ccaccacggggcgggucg

SEQ ID NO: 2985905 - RNA, 19 nt, Mycobacterium avium subsp. paratuberculosis
ccaccacggggcgggucgu

SEQ ID NO: 2985906 - RNA, 20 nt, Mycobacterium avium subsp. paratuberculosis
ccaccacgggucggucggcc

SEQ ID NO: 2985907 - RNA, 22 nt, Mycobacterium avium subsp. paratuberculosis
ccaccacgggucggucggcccg

SEQ ID NO: 2985908 - RNA, 17 nt, Mycobacterium avium subsp. paratuberculosis
ccaccacgguggcgccg

SEQ ID NO: 2985909 - RNA, 19 nt, Mycobacterium avium subsp. paratuberculosis
ccaccacgguggcgccggc

SEQ ID NO: 2985910 - RNA, 22 nt, Mycobacterium avium subsp. paratuberculosis
ccaccacgguggcgccggcauc

SEQ ID NO: 2985911 - RNA, 12 nt, Mycobacterium avium subsp. paratuberculosis
ccaccacguagg

SEQ ID NO: 2985912 - RNA, 23 nt, Mycobacterium avium subsp. paratuberculosis
ccaccacguaggcgaucagcgcg

SEQ ID NO: 2985913 - RNA, 19 nt, Mycobacterium avium subsp. paratuberculosis
ccaccacguugcgcggccg

SEQ ID NO: 2985914 - RNA, 17 nt, Mycobacterium avium subsp. paratuberculosis
ccaccacugcgccguca

SEQ ID NO: 2985915 - RNA, 23 nt, Mycobacterium avium subsp. paratuberculosis
ccaccacugcgccgucaucgaca

SEQ ID NO: 2985916 - RNA, 19 nt, Mycobacterium avium subsp. paratuberculosis
ccaccagaaguggucgauc

SEQ ID NO: 2985917 - RNA, 16 nt, Mycobacterium avium subsp. paratuberculosis
ccaccagaugccgggc

SEQ ID NO: 2985918 - RNA, 20 nt, Mycobacterium avium subsp. paratuberculosis
ccaccagcacaccggaucgg

SEQ ID NO: 2985919 - RNA, 11 nt, Mycobacterium avium subsp. paratuberculosis
ccaccagcacc

SEQ ID NO: 2985920 - RNA, 14 nt, Mycobacterium avium subsp. paratuberculosis
ccaccagcaccggg

SEQ ID NO: 2985921 - RNA, 15 nt, Mycobacterium avium subsp. paratuberculosis
ccaccagcaccggga

SEQ ID NO: 2985922 - RNA, 23 nt, Mycobacterium avium subsp. paratuberculosis
ccaccagcagcgagaccggcacg

SEQ ID NO: 2985923 - RNA, 23 nt, Mycobacterium avium subsp. paratuberculosis
ccaccagccgcaggugcucgccg

SEQ ID NO: 2985924 - RNA, 13 nt, Mycobacterium avium subsp. paratuberculosis
ccaccagccggcc

SEQ ID NO: 2985925 - RNA, 18 nt, Mycobacterium avium subsp. paratuberculosis
ccaccagccggccggcga

SEQ ID NO: 2985926 - RNA, 21 nt, Mycobacterium avium subsp. paratuberculosis
ccaccagcgcacacagcagca

SEQ ID NO: 2985927 - RNA, 15 nt, Mycobacterium avium subsp. paratuberculosis
ccaccagcgcccgcc

SEQ ID NO: 2985928 - RNA, 16 nt, Mycobacterium avium subsp. paratuberculosis
ccaccagcgcccgccc

SEQ ID NO: 2985929 - RNA, 14 nt, Mycobacterium avium subsp. paratuberculosis
ccaccagcgccugg

SEQ ID NO: 2985930 - RNA, 17 nt, Mycobacterium avium subsp. paratuberculosis
ccaccagcgccugggcg

SEQ ID NO: 2985931 - RNA, 17 nt, Mycobacterium avium subsp. paratuberculosis
ccaccagcgcggccacc

SEQ ID NO: 2985932 - RNA, 12 nt, Mycobacterium avium subsp. paratuberculosis
ccaccagcggcc

SEQ ID NO: 2985933 - RNA, 13 nt, Mycobacterium avium subsp. paratuberculosis
ccaccagcggccg

SEQ ID NO: 2985934 - RNA, 16 nt, Mycobacterium avium subsp. paratuberculosis
ccaccagcggccgucg

SEQ ID NO: 2985935 - RNA, 17 nt, Mycobacterium avium subsp. paratuberculosis
ccaccagcggccgucgc

SEQ ID NO: 2985936 - RNA, 20 nt, Mycobacterium avium subsp. paratuberculosis
ccaccagcggccgucgccgg

SEQ ID NO: 2985937 - RNA, 21 nt, Mycobacterium avium subsp. paratuberculosis
ccaccagcggccgucgccggg

SEQ ID NO: 2985938 - RNA, 20 nt, Mycobacterium avium subsp. paratuberculosis
ccaccagcgggcugugccgg

SEQ ID NO: 2985939 - RNA, 22 nt, Mycobacterium avium subsp. paratuberculosis
ccaccagcgggcugugccggcg

SEQ ID NO: 2985940 - RNA, 12 nt, Mycobacterium avium subsp. paratuberculosis
ccaccagcgugc

SEQ ID NO: 2985941 - RNA, 16 nt, Mycobacterium avium subsp. paratuberculosis
ccaccagcucgucgcc

SEQ ID NO: 2985942 - RNA, 14 nt, Mycobacterium avium subsp. paratuberculosis
ccaccaggagcacc

SEQ ID NO: 2985943 - RNA, 20 nt, Mycobacterium avium subsp. paratuberculosis
ccaccaggagcaccugcgcg

SEQ ID NO: 2985944 - RNA, 12 nt, Mycobacterium avium subsp. paratuberculosis
ccaccaggccga

SEQ ID NO: 2985945 - RNA, 19 nt, Mycobacterium avium subsp. paratuberculosis
ccaccaggccguagagcac

SEQ ID NO: 2985946 - RNA, 15 nt, Mycobacterium avium subsp. paratuberculosis
ccaccaggcgguccg

SEQ ID NO: 2985947 - RNA, 19 nt, Mycobacterium avium subsp. paratuberculosis
ccaccaggcgguccgacac

SEQ ID NO: 2985948 - RNA, 11 nt, Mycobacterium avium subsp. paratuberculosis
ccaccaggcug

SEQ ID NO: 2985949 - RNA, 15 nt, Mycobacterium avium subsp. paratuberculosis
ccaccaggcugaacg

SEQ ID NO: 2985950 - RNA, 17 nt, Mycobacterium avium subsp. paratuberculosis
ccaccagggacaugccg

SEQ ID NO: 2985951 - RNA, 20 nt, Mycobacterium avium subsp. paratuberculosis
ccaccagggacaugccgagc

SEQ ID NO: 2985952 - RNA, 23 nt, Mycobacterium avium subsp. paratuberculosis
ccaccagggacaugccgagcagc

SEQ ID NO: 2985953 - RNA, 20 nt, Mycobacterium avium subsp. paratuberculosis
ccaccagggcgaccgccgcg

SEQ ID NO: 2985954 - RNA, 19 nt, Mycobacterium avium subsp. paratuberculosis
ccaccagggucucgcgcag

SEQ ID NO: 2985955 - RNA, 15 nt, Mycobacterium avium subsp. paratuberculosis
ccaccaggguggccg

SEQ ID NO: 2985956 - RNA, 17 nt, Mycobacterium avium subsp. paratuberculosis
ccaccaggguggccgcc

SEQ ID NO: 2985957 - RNA, 18 nt, Mycobacterium avium subsp. paratuberculosis
ccaccaggguggccgcca

SEQ ID NO: 2985958 - RNA, 23 nt, Mycobacterium avium subsp. paratuberculosis
ccaccagguccuugaucgggaac

SEQ ID NO: 2985959 - RNA, 23 nt, Mycobacterium avium subsp. paratuberculosis
ccaccaggucgcacaccagcacg

SEQ ID NO: 2985960 - RNA, 19 nt, Mycobacterium avium subsp. paratuberculosis
ccaccaggugcggggacag

SEQ ID NO: 2985961 - RNA, 15 nt, Mycobacterium avium subsp. paratuberculosis
ccaccagguuggaca

SEQ ID NO: 2985962 - RNA, 22 nt, Mycobacterium avium subsp. paratuberculosis
ccaccagucggcgcguuggccg

SEQ ID NO: 2985963 - RNA, 18 nt, Mycobacterium avium subsp. paratuberculosis
ccaccagugucagggcag

SEQ ID NO: 2985964 - RNA, 17 nt, Mycobacterium avium subsp. paratuberculosis
ccaccaguguccgggcg

SEQ ID NO: 2985965 - RNA, 20 nt, Mycobacterium avium subsp. paratuberculosis
ccaccaguguccgggcgccc

SEQ ID NO: 2985966 - RNA, 21 nt, Mycobacterium avium subsp. paratuberculosis
ccaccaguguccgggcgccca

SEQ ID NO: 2985967 - RNA, 17 nt, Mycobacterium avium subsp. paratuberculosis
ccaccaguuccaccagu

SEQ ID NO: 2985968 - RNA, 14 nt, Mycobacterium avium subsp. paratuberculosis
ccaccaucaggccg

SEQ ID NO: 2985969 - RNA, 18 nt, Mycobacterium avium subsp. paratuberculosis
ccaccaucaggccggccu

SEQ ID NO: 2985970 - RNA, 19 nt, Mycobacterium avium subsp. paratuberculosis
ccaccaucaggccggccug

SEQ ID NO: 2985971 - RNA, 20 nt, Mycobacterium avium subsp. paratuberculosis
ccaccaucaggccggccugc

SEQ ID NO: 2985972 - RNA, 21 nt, Mycobacterium avium subsp. paratuberculosis
ccaccaucaggccggccugcc

SEQ ID NO: 2985973 - RNA, 12 nt, Mycobacterium avium subsp. paratuberculosis
ccaccaucccgc

SEQ ID NO: 2985974 - RNA, 14 nt, Mycobacterium avium subsp. paratuberculosis
ccaccaucccgccg

SEQ ID NO: 2985975 - RNA, 17 nt, Mycobacterium avium subsp. paratuberculosis
ccaccaugagcagaccg

SEQ ID NO: 2985976 - RNA, 14 nt, Mycobacterium avium subsp. paratuberculosis
ccaccaugauguag

SEQ ID NO: 2985977 - RNA, 20 nt, Mycobacterium avium subsp. paratuberculosis
ccaccaugauguagcggcgg

SEQ ID NO: 2985978 - RNA, 21 nt, Mycobacterium avium subsp. paratuberculosis
ccaccaugauguagcggcggu

SEQ ID NO: 2985979 - RNA, 22 nt, Mycobacterium avium subsp. paratuberculosis
ccaccaugauguagcggcgguc

SEQ ID NO: 2985980 - RNA, 15 nt, Mycobacterium avium subsp. paratuberculosis
ccaccaugccggcgu

SEQ ID NO: 2985981 - RNA, 20 nt, Mycobacterium avium subsp. paratuberculosis
ccaccauggcuuccgccgag

SEQ ID NO: 2985982 - RNA, 23 nt, Mycobacterium avium subsp. paratuberculosis
ccaccauggcuuccgccgagacg

SEQ ID NO: 2985983 - RNA, 17 nt, Mycobacterium avium subsp. paratuberculosis
ccaccaugggcgggacg

SEQ ID NO: 2985984 - RNA, 21 nt, Mycobacterium avium subsp. paratuberculosis
ccaccaugggcgggacgaaug

SEQ ID NO: 2985985 - RNA, 15 nt, Mycobacterium avium subsp. paratuberculosis
ccaccaugucggcgu

SEQ ID NO: 2985986 - RNA, 21 nt, Mycobacterium avium subsp. paratuberculosis
ccaccaugucggcgucgccga

SEQ ID NO: 2985987 - RNA, 22 nt, Mycobacterium avium subsp. paratuberculosis
ccaccaugucggcgucgccgag

SEQ ID NO: 2985988 - RNA, 23 nt, Mycobacterium avium subsp. paratuberculosis
ccaccaugucggcgucgccgagc

SEQ ID NO: 2985989 - RNA, 15 nt, Mycobacterium avium subsp. paratuberculosis
ccacccacucccagc

SEQ ID NO: 2985990 - RNA, 20 nt, Mycobacterium avium subsp. paratuberculosis
ccacccacucccagccgccg

SEQ ID NO: 2985991 - RNA, 23 nt, Mycobacterium avium subsp. paratuberculosis
ccacccacucccagccgccggcc

SEQ ID NO: 2985992 - RNA, 20 nt, Mycobacterium avium subsp. paratuberculosis
ccacccacucggacaggugg

SEQ ID NO: 2985993 - RNA, 12 nt, Mycobacterium avium subsp. paratuberculosis
ccacccaggcca

SEQ ID NO: 2985994 - RNA, 14 nt, Mycobacterium avium subsp. paratuberculosis
ccacccaggccacc

SEQ ID NO: 2985995 - RNA, 16 nt, Mycobacterium avium subsp. paratuberculosis
ccacccaggccacccg

SEQ ID NO: 2985996 - RNA, 22 nt, Mycobacterium avium subsp. paratuberculosis
ccacccagguggaugcgagcca

SEQ ID NO: 2985997 - RNA, 20 nt, Mycobacterium avium subsp. paratuberculosis
ccacccagguguccggcccg

SEQ ID NO: 2985998 - RNA, 22 nt, Mycobacterium avium subsp. paratuberculosis
ccacccagguguccggcccgau

SEQ ID NO: 2985999 - RNA, 23 nt, Mycobacterium avium subsp. paratuberculosis
ccacccagguguccggcccgaug

SEQ ID NO: 2986000 - RNA, 12 nt, Mycobacterium avium subsp. paratuberculosis
ccaccccaggcg

SEQ ID NO: 2986001 - RNA, 17 nt, Mycobacterium avium subsp. paratuberculosis
ccacccccagcccgccg

SEQ ID NO: 2986002 - RNA, 15 nt, Mycobacterium avium subsp. paratuberculosis
ccacccccgcgguga

SEQ ID NO: 2986003 - RNA, 14 nt, Mycobacterium avium subsp. paratuberculosis
ccaccccgagcagg

SEQ ID NO: 2986004 - RNA, 14 nt, Mycobacterium avium subsp. paratuberculosis
ccaccccgagcucg

SEQ ID NO: 2986005 - RNA, 13 nt, Mycobacterium avium subsp. paratuberculosis
ccacccgaggccg

SEQ ID NO: 2986006 - RNA, 18 nt, Mycobacterium avium subsp. paratuberculosis
ccacccgaugaccggccc

SEQ ID NO: 2986007 - RNA, 21 nt, Mycobacterium avium subsp. paratuberculosis
ccacccgaugaccggcccggc

SEQ ID NO: 2986008 - RNA, 23 nt, Mycobacterium avium subsp. paratuberculosis
ccacccgcaccucgcccggcucg

SEQ ID NO: 2986009 - RNA, 17 nt, Mycobacterium avium subsp. paratuberculosis
ccacccgcacgcccggg

SEQ ID NO: 2986010 - RNA, 12 nt, Mycobacterium avium subsp. paratuberculosis
ccacccgcacgg

SEQ ID NO: 2986011 - RNA, 18 nt, Mycobacterium avium subsp. paratuberculosis
ccacccgcagcgcggcgg

SEQ ID NO: 2986012 - RNA, 12 nt, Mycobacterium avium subsp. paratuberculosis
ccacccgcagcu

SEQ ID NO: 2986013 - RNA, 14 nt, Mycobacterium avium subsp. paratuberculosis
ccacccgccagccc

SEQ ID NO: 2986014 - RNA, 14 nt, Mycobacterium avium subsp. paratuberculosis
ccacccgccccgcc

SEQ ID NO: 2986015 - RNA, 17 nt, Mycobacterium avium subsp. paratuberculosis
ccacccgccccgccgcg

SEQ ID NO: 2986016 - RNA, 19 nt, Mycobacterium avium subsp. paratuberculosis
ccacccgccccuccaggca

SEQ ID NO: 2986017 - RNA, 11 nt, Mycobacterium avium subsp. paratuberculosis
ccacccgcgcc

SEQ ID NO: 2986018 - RNA, 12 nt, Mycobacterium avium subsp. paratuberculosis
ccacccgcgccg

SEQ ID NO: 2986019 - RNA, 13 nt, Mycobacterium avium subsp. paratuberculosis
ccacccgcgccgg

SEQ ID NO: 2986020 - RNA, 17 nt, Mycobacterium avium subsp. paratuberculosis
ccacccgcgccggcaga

SEQ ID NO: 2986021 - RNA, 13 nt, Mycobacterium avium subsp. paratuberculosis
ccacccgcggccg

SEQ ID NO: 2986022 - RNA, 16 nt, Mycobacterium avium subsp. paratuberculosis
ccacccgcggccggcc

SEQ ID NO: 2986023 - RNA, 18 nt, Mycobacterium avium subsp. paratuberculosis
ccacccgcggccggccca

SEQ ID NO: 2986024 - RNA, 19 nt, Mycobacterium avium subsp. paratuberculosis
ccacccgcggccggcccag

SEQ ID NO: 2986025 - RNA, 16 nt, Mycobacterium avium subsp. paratuberculosis
ccacccgcuccucgca

SEQ ID NO: 2986026 - RNA, 15 nt, Mycobacterium avium subsp. paratuberculosis
ccacccgcucggcga

SEQ ID NO: 2986027 - RNA, 16 nt, Mycobacterium avium subsp. paratuberculosis
ccacccggacgaugac

SEQ ID NO: 2986028 - RNA, 20 nt, Mycobacterium avium subsp. paratuberculosis
ccacccggaugucgugcggu

SEQ ID NO: 2986029 - RNA, 13 nt, Mycobacterium avium subsp. paratuberculosis
ccacccggcaucc

SEQ ID NO: 2986030 - RNA, 14 nt, Mycobacterium avium subsp. paratuberculosis
ccacccgggcgccg

SEQ ID NO: 2986031 - RNA, 15 nt, Mycobacterium avium subsp. paratuberculosis
ccacccgggcgccgg

SEQ ID NO: 2986032 - RNA, 12 nt, Mycobacterium avium subsp. paratuberculosis
ccacccggggcc

SEQ ID NO: 2986033 - RNA, 13 nt, Mycobacterium avium subsp. paratuberculosis
ccacccggggccg

SEQ ID NO: 2986034 - RNA, 22 nt, Mycobacterium avium subsp. paratuberculosis
ccacccggguugcgugcagccg

SEQ ID NO: 2986035 - RNA, 14 nt, Mycobacterium avium subsp. paratuberculosis
ccacccgucgguga

SEQ ID NO: 2986036 - RNA, 21 nt, Mycobacterium avium subsp. paratuberculosis
ccacccguuggcaggcccggu

SEQ ID NO: 2986037 - RNA, 12 nt, Mycobacterium avium subsp. paratuberculosis
ccacccucacca

SEQ ID NO: 2986038 - RNA, 15 nt, Mycobacterium avium subsp. paratuberculosis
ccacccugccgaccu

SEQ ID NO: 2986039 - RNA, 19 nt, Mycobacterium avium subsp. paratuberculosis
ccaccgaaaagcccgccgc

SEQ ID NO: 2986040 - RNA, 21 nt, Mycobacterium avium subsp. paratuberculosis
ccaccgaaaagcccgccgccu

SEQ ID NO: 2986041 - RNA, 20 nt, Mycobacterium avium subsp. paratuberculosis
ccaccgaagccgacgucgac

SEQ ID NO: 2986042 - RNA, 20 nt, Mycobacterium avium subsp. paratuberculosis
ccaccgaaucacccacggcc

SEQ ID NO: 2986043 - RNA, 13 nt, Mycobacterium avium subsp. paratuberculosis
ccaccgacaccac

SEQ ID NO: 2986044 - RNA, 15 nt, Mycobacterium avium subsp. paratuberculosis
ccaccgacaccaccg

SEQ ID NO: 2986045 - RNA, 18 nt, Mycobacterium avium subsp. paratuberculosis
ccaccgacaccaccggcc

SEQ ID NO: 2986046 - RNA, 14 nt, Mycobacterium avium subsp. paratuberculosis
ccaccgacaggucg

SEQ ID NO: 2986047 - RNA, 15 nt, Mycobacterium avium subsp. paratuberculosis
ccaccgacaggucga

SEQ ID NO: 2986048 - RNA, 15 nt, Mycobacterium avium subsp. paratuberculosis
ccaccgaccccugca

SEQ ID NO: 2986049 - RNA, 13 nt, Mycobacterium avium subsp. paratuberculosis
ccaccgacgcggc

SEQ ID NO: 2986050 - RNA, 15 nt, Mycobacterium avium subsp. paratuberculosis
ccaccgacgcggcgg

SEQ ID NO: 2986051 - RNA, 17 nt, Mycobacterium avium subsp. paratuberculosis
ccaccgacgcggcggcc

SEQ ID NO: 2986052 - RNA, 23 nt, Mycobacterium avium subsp. paratuberculosis
ccaccgacgcggcggccgacagc

SEQ ID NO: 2986053 - RNA, 15 nt, Mycobacterium avium subsp. paratuberculosis
ccaccgacgcgucgc

SEQ ID NO: 2986054 - RNA, 19 nt, Mycobacterium avium subsp. paratuberculosis
ccaccgacgcgucgcggcg

SEQ ID NO: 2986055 - RNA, 20 nt, Mycobacterium avium subsp. paratuberculosis
ccaccgacgcgucgcggcgg

SEQ ID NO: 2986056 - RNA, 19 nt, Mycobacterium avium subsp. paratuberculosis
ccaccgagaucaugccggc

SEQ ID NO: 2986057 - RNA, 20 nt, Mycobacterium avium subsp. paratuberculosis
ccaccgagaucaugccggcg

SEQ ID NO: 2986058 - RNA, 21 nt, Mycobacterium avium subsp. paratuberculosis
ccaccgagaucaugccggcga

SEQ ID NO: 2986059 - RNA, 20 nt, Mycobacterium avium subsp. paratuberculosis
ccaccgagauguaucugcgg

SEQ ID NO: 2986060 - RNA, 19 nt, Mycobacterium avium subsp. paratuberculosis
ccaccgagcagcugcaugu

SEQ ID NO: 2986061 - RNA, 12 nt, Mycobacterium avium subsp. paratuberculosis
ccaccgagccgg

SEQ ID NO: 2986062 - RNA, 16 nt, Mycobacterium avium subsp. paratuberculosis
ccaccgagccggcguc

SEQ ID NO: 2986063 - RNA, 17 nt, Mycobacterium avium subsp. paratuberculosis
ccaccgagccggcgucg

SEQ ID NO: 2986064 - RNA, 14 nt, Mycobacterium avium subsp. paratuberculosis
ccaccgagccgggc

SEQ ID NO: 2986065 - RNA, 20 nt, Mycobacterium avium subsp. paratuberculosis
ccaccgagccggugccgccc

SEQ ID NO: 2986066 - RNA, 14 nt, Mycobacterium avium subsp. paratuberculosis
ccaccgaggccagc

SEQ ID NO: 2986067 - RNA, 18 nt, Mycobacterium avium subsp. paratuberculosis
ccaccgaggugacgaggc

SEQ ID NO: 2986068 - RNA, 20 nt, Mycobacterium avium subsp. paratuberculosis
ccaccgaggugacgucgcgc

SEQ ID NO: 2986069 - RNA, 22 nt, Mycobacterium avium subsp. paratuberculosis
ccaccgaggugacgucgcgccg

SEQ ID NO: 2986070 - RNA, 16 nt, Mycobacterium avium subsp. paratuberculosis
ccaccgagguggccca

SEQ ID NO: 2986071 - RNA, 19 nt, Mycobacterium avium subsp. paratuberculosis
ccaccgagguggcccagcc

SEQ ID NO: 2986072 - RNA, 20 nt, Mycobacterium avium subsp. paratuberculosis
ccaccgagguggcccagccg

SEQ ID NO: 2986073 - RNA, 22 nt, Mycobacterium avium subsp. paratuberculosis
ccaccgagguggcccagccgcu

SEQ ID NO: 2986074 - RNA, 23 nt, Mycobacterium avium subsp. paratuberculosis
ccaccgagguggcccagccgcug

SEQ ID NO: 2986075 - RNA, 12 nt, Mycobacterium avium subsp. paratuberculosis
ccaccgagucgc

SEQ ID NO: 2986076 - RNA, 16 nt, Mycobacterium avium subsp. paratuberculosis
ccaccgagugcggcgc

SEQ ID NO: 2986077 - RNA, 22 nt, Mycobacterium avium subsp. paratuberculosis
ccaccgagugcggcgcggugcg

SEQ ID NO: 2986078 - RNA, 21 nt, Mycobacterium avium subsp. paratuberculosis
ccaccgaucaggaucggcggg

SEQ ID NO: 2986079 - RNA, 22 nt, Mycobacterium avium subsp. paratuberculosis
ccaccgaucaggaucggcgggc

SEQ ID NO: 2986080 - RNA, 13 nt, Mycobacterium avium subsp. paratuberculosis
ccaccgaucgcga

SEQ ID NO: 2986081 - RNA, 18 nt, Mycobacterium avium subsp. paratuberculosis
ccaccgaucgcgagggcc

SEQ ID NO: 2986082 - RNA, 19 nt, Mycobacterium avium subsp. paratuberculosis
ccaccgaucgcgagggccg

SEQ ID NO: 2986083 - RNA, 18 nt, Mycobacterium avium subsp. paratuberculosis
ccaccgaugcccgacacc

SEQ ID NO: 2986084 - RNA, 14 nt, Mycobacterium avium subsp. paratuberculosis
ccaccgaugcgggc

SEQ ID NO: 2986085 - RNA, 12 nt, Mycobacterium avium subsp. paratuberculosis
ccaccgccaccg

SEQ ID NO: 2986086 - RNA, 13 nt, Mycobacterium avium subsp. paratuberculosis
ccaccgccaccgc

SEQ ID NO: 2986087 - RNA, 15 nt, Mycobacterium avium subsp. paratuberculosis
ccaccgccacggcgg

SEQ ID NO: 2986088 - RNA, 14 nt, Mycobacterium avium subsp. paratuberculosis
ccaccgccagguag

SEQ ID NO: 2986089 - RNA, 15 nt, Mycobacterium avium subsp. paratuberculosis
ccaccgccaucucgg

SEQ ID NO: 2986090 - RNA, 13 nt, Mycobacterium avium subsp. paratuberculosis
ccaccgccccagc

SEQ ID NO: 2986091 - RNA, 15 nt, Mycobacterium avium subsp. paratuberculosis
ccaccgccccagccg

SEQ ID NO: 2986092 - RNA, 18 nt, Mycobacterium avium subsp. paratuberculosis
ccaccgccccagccgacc

SEQ ID NO: 2986093 - RNA, 20 nt, Mycobacterium avium subsp. paratuberculosis
ccaccgccccagccgaccag

SEQ ID NO: 2986094 - RNA, 21 nt, Mycobacterium avium subsp. paratuberculosis
ccaccgcccgaaccgcgucca

SEQ ID NO: 2986095 - RNA, 12 nt, Mycobacterium avium subsp. paratuberculosis
ccaccgcccgga

SEQ ID NO: 2986096 - RNA, 17 nt, Mycobacterium avium subsp. paratuberculosis
ccaccgcccggaccggc

SEQ ID NO: 2986097 - RNA, 20 nt, Mycobacterium avium subsp. paratuberculosis
ccaccgcccggaccggcucg

SEQ ID NO: 2986098 - RNA, 21 nt, Mycobacterium avium subsp. paratuberculosis
ccaccgcccggaccggcucgu

SEQ ID NO: 2986099 - RNA, 14 nt, Mycobacterium avium subsp. paratuberculosis
ccaccgcccggaug

SEQ ID NO: 2986100 - RNA, 20 nt, Mycobacterium avium subsp. paratuberculosis
ccaccgcccggaugccggcg

SEQ ID NO: 2986101 - RNA, 22 nt, Mycobacterium avium subsp. paratuberculosis
ccaccgcccggaugccggcgcc

SEQ ID NO: 2986102 - RNA, 12 nt, Mycobacterium avium subsp. paratuberculosis
ccaccgccgaug

SEQ ID NO: 2986103 - RNA, 13 nt, Mycobacterium avium subsp. paratuberculosis
ccaccgccgccag

SEQ ID NO: 2986104 - RNA, 15 nt, Mycobacterium avium subsp. paratuberculosis
ccaccgccgccagca

SEQ ID NO: 2986105 - RNA, 18 nt, Mycobacterium avium subsp. paratuberculosis
ccaccgccgccagcagca

SEQ ID NO: 2986106 - RNA, 21 nt, Mycobacterium avium subsp. paratuberculosis
ccaccgccgccagcagcagcg

SEQ ID NO: 2986107 - RNA, 13 nt, Mycobacterium avium subsp. paratuberculosis
ccaccgccgccga

SEQ ID NO: 2986108 - RNA, 14 nt, Mycobacterium avium subsp. paratuberculosis
ccaccgccgccgac

SEQ ID NO: 2986109 - RNA, 13 nt, Mycobacterium avium subsp. paratuberculosis
ccaccgccgcgcc

SEQ ID NO: 2986110 - RNA, 13 nt, Mycobacterium avium subsp. paratuberculosis
ccaccgccgcugc

SEQ ID NO: 2986111 - RNA, 15 nt, Mycobacterium avium subsp. paratuberculosis
ccaccgccggcccag

SEQ ID NO: 2986112 - RNA, 17 nt, Mycobacterium avium subsp. paratuberculosis
ccaccgccggcccaggc

SEQ ID NO: 2986113 - RNA, 14 nt, Mycobacterium avium subsp. paratuberculosis
ccaccgccggcccg

SEQ ID NO: 2986114 - RNA, 16 nt, Mycobacterium avium subsp. paratuberculosis
ccaccgccggcccggc

SEQ ID NO: 2986115 - RNA, 18 nt, Mycobacterium avium subsp. paratuberculosis
ccaccgccggcccggcgu

SEQ ID NO: 2986116 - RNA, 13 nt, Mycobacterium avium subsp. paratuberculosis
ccaccgccgucac

SEQ ID NO: 2986117 - RNA, 19 nt, Mycobacterium avium subsp. paratuberculosis
ccaccgccgucaccgccag

SEQ ID NO: 2986118 - RNA, 16 nt, Mycobacterium avium subsp. paratuberculosis
ccaccgccucgacggu

SEQ ID NO: 2986119 - RNA, 14 nt, Mycobacterium avium subsp. paratuberculosis
ccaccgccugcgcg

SEQ ID NO: 2986120 - RNA, 18 nt, Mycobacterium avium subsp. paratuberculosis
ccaccgcgaaagcgucgg

SEQ ID NO: 2986121 - RNA, 17 nt, Mycobacterium avium subsp. paratuberculosis
ccaccgcgacacgucga

SEQ ID NO: 2986122 - RNA, 19 nt, Mycobacterium avium subsp. paratuberculosis
ccaccgcgacccggccgag

SEQ ID NO: 2986123 - RNA, 14 nt, Mycobacterium avium subsp. paratuberculosis
ccaccgcgacgcug

SEQ ID NO: 2986124 - RNA, 22 nt, Mycobacterium avium subsp. paratuberculosis
ccaccgcgacgcugccggggcg

SEQ ID NO: 2986125 - RNA, 14 nt, Mycobacterium avium subsp. paratuberculosis
ccaccgcgcccagc

SEQ ID NO: 2986126 - RNA, 15 nt, Mycobacterium avium subsp. paratuberculosis
ccaccgcgcccagcc

SEQ ID NO: 2986127 - RNA, 16 nt, Mycobacterium avium subsp. paratuberculosis
ccaccgcgcccagccc

SEQ ID NO: 2986128 - RNA, 18 nt, Mycobacterium avium subsp. paratuberculosis
ccaccgcgccccggcgca

SEQ ID NO: 2986129 - RNA, 15 nt, Mycobacterium avium subsp. paratuberculosis
ccaccgcgccggcgg

SEQ ID NO: 2986130 - RNA, 22 nt, Mycobacterium avium subsp. paratuberculosis
ccaccgcgccggcggcggcggu

SEQ ID NO: 2986131 - RNA, 18 nt, Mycobacterium avium subsp. paratuberculosis
ccaccgcgccgucgucga

SEQ ID NO: 2986132 - RNA, 13 nt, Mycobacterium avium subsp. paratuberculosis
ccaccgcgccgug

SEQ ID NO: 2986133 - RNA, 14 nt, Mycobacterium avium subsp. paratuberculosis
ccaccgcgccgugg

SEQ ID NO: 2986134 - RNA, 21 nt, Mycobacterium avium subsp. paratuberculosis
ccaccgcgcgcaacgaggcgg

SEQ ID NO: 2986135 - RNA, 14 nt, Mycobacterium avium subsp. paratuberculosis
ccaccgcgcgcggg

SEQ ID NO: 2986136 - RNA, 15 nt, Mycobacterium avium subsp. paratuberculosis
ccaccgcgcgcgggu

SEQ ID NO: 2986137 - RNA, 15 nt, Mycobacterium avium subsp. paratuberculosis
ccaccgcgcgcugca

SEQ ID NO: 2986138 - RNA, 18 nt, Mycobacterium avium subsp. paratuberculosis
ccaccgcgcgcugccgcg

SEQ ID NO: 2986139 - RNA, 21 nt, Mycobacterium avium subsp. paratuberculosis
ccaccgcgcgcugccgcgccc

SEQ ID NO: 2986140 - RNA, 13 nt, Mycobacterium avium subsp. paratuberculosis
ccaccgcgcggcg

SEQ ID NO: 2986141 - RNA, 14 nt, Mycobacterium avium subsp. paratuberculosis
ccaccgcgcggcgg

SEQ ID NO: 2986142 - RNA, 15 nt, Mycobacterium avium subsp. paratuberculosis
ccaccgcgcggcggu

SEQ ID NO: 2986143 - RNA, 16 nt, Mycobacterium avium subsp. paratuberculosis
ccaccgcgcggcgguc

SEQ ID NO: 2986144 - RNA, 12 nt, Mycobacterium avium subsp. paratuberculosis
ccaccgcggcca

SEQ ID NO: 2986145 - RNA, 13 nt, Mycobacterium avium subsp. paratuberculosis
ccaccgcggccag

SEQ ID NO: 2986146 - RNA, 18 nt, Mycobacterium avium subsp. paratuberculosis
ccaccgcggccagcugcg

SEQ ID NO: 2986147 - RNA, 23 nt, Mycobacterium avium subsp. paratuberculosis
ccaccgcggccagcugcgacagc

SEQ ID NO: 2986148 - RNA, 15 nt, Mycobacterium avium subsp. paratuberculosis
ccaccgcggcgauga

SEQ ID NO: 2986149 - RNA, 13 nt, Mycobacterium avium subsp. paratuberculosis
ccaccgcggcgcc

SEQ ID NO: 2986150 - RNA, 14 nt, Mycobacterium avium subsp. paratuberculosis
ccaccgcggcgccg

SEQ ID NO: 2986151 - RNA, 18 nt, Mycobacterium avium subsp. paratuberculosis
ccaccgcggcgccgucga

SEQ ID NO: 2986152 - RNA, 14 nt, Mycobacterium avium subsp. paratuberculosis
ccaccgcggcgcgc

SEQ ID NO: 2986153 - RNA, 19 nt, Mycobacterium avium subsp. paratuberculosis
ccaccgcggcgcgcggccg

SEQ ID NO: 2986154 - RNA, 12 nt, Mycobacterium avium subsp. paratuberculosis
ccaccgcggcgg

SEQ ID NO: 2986155 - RNA, 14 nt, Mycobacterium avium subsp. paratuberculosis
ccaccgcggcggcc

SEQ ID NO: 2986156 - RNA, 19 nt, Mycobacterium avium subsp. paratuberculosis
ccaccgcggcguugcccgg

SEQ ID NO: 2986157 - RNA, 20 nt, Mycobacterium avium subsp. paratuberculosis
ccaccgcggcguugcccggg

SEQ ID NO: 2986158 - RNA, 20 nt, Mycobacterium avium subsp. paratuberculosis
ccaccgcggucgacgggaag

SEQ ID NO: 2986159 - RNA, 13 nt, Mycobacterium avium subsp. paratuberculosis
ccaccgcggugag

SEQ ID NO: 2986160 - RNA, 15 nt, Mycobacterium avium subsp. paratuberculosis
ccaccgcggugagcg

SEQ ID NO: 2986161 - RNA, 21 nt, Mycobacterium avium subsp. paratuberculosis
ccaccgcggugagcggccgca

SEQ ID NO: 2986162 - RNA, 18 nt, Mycobacterium avium subsp. paratuberculosis
ccaccgcggugggccagu

SEQ ID NO: 2986163 - RNA, 19 nt, Mycobacterium avium subsp. paratuberculosis
ccaccgcggugggccaguc

SEQ ID NO: 2986164 - RNA, 20 nt, Mycobacterium avium subsp. paratuberculosis
ccaccgcgucgcagugccgg

SEQ ID NO: 2986165 - RNA, 21 nt, Mycobacterium avium subsp. paratuberculosis
ccaccgcgucgcagugccggu

SEQ ID NO: 2986166 - RNA, 22 nt, Mycobacterium avium subsp. paratuberculosis
ccaccgcgucgcagugccggug

SEQ ID NO: 2986167 - RNA, 17 nt, Mycobacterium avium subsp. paratuberculosis
ccaccgcgucggaggcc

SEQ ID NO: 2986168 - RNA, 17 nt, Mycobacterium avium subsp. paratuberculosis
ccaccgcgugcgagccg

SEQ ID NO: 2986169 - RNA, 18 nt, Mycobacterium avium subsp. paratuberculosis
ccaccgcguugaucagcg

SEQ ID NO: 2986170 - RNA, 14 nt, Mycobacterium avium subsp. paratuberculosis
ccaccgcucgucgg

SEQ ID NO: 2986171 - RNA, 19 nt, Mycobacterium avium subsp. paratuberculosis
ccaccgcucgucgggcucg

SEQ ID NO: 2986172 - RNA, 18 nt, Mycobacterium avium subsp. paratuberculosis
ccaccgcugggcggcgcg

SEQ ID NO: 2986173 - RNA, 20 nt, Mycobacterium avium subsp. paratuberculosis
ccaccgcugggcggcgcggc

SEQ ID NO: 2986174 - RNA, 22 nt, Mycobacterium avium subsp. paratuberculosis
ccaccgcugggcggcgcggcgg

SEQ ID NO: 2986175 - RNA, 15 nt, Mycobacterium avium subsp. paratuberculosis
ccaccgcuguggaca

SEQ ID NO: 2986176 - RNA, 19 nt, Mycobacterium avium subsp. paratuberculosis
ccaccggaagcgcgcaucg

SEQ ID NO: 2986177 - RNA, 16 nt, Mycobacterium avium subsp. paratuberculosis
ccaccggagcggcggu

SEQ ID NO: 2986178 - RNA, 23 nt, Mycobacterium avium subsp. paratuberculosis
ccaccggauggcgcccggcagcc

SEQ ID NO: 2986179 - RNA, 17 nt, Mycobacterium avium subsp. paratuberculosis
ccaccggcaaccgccac

SEQ ID NO: 2986180 - RNA, 14 nt, Mycobacterium avium subsp. paratuberculosis
ccaccggcaaucgg

SEQ ID NO: 2986181 - RNA, 18 nt, Mycobacterium avium subsp. paratuberculosis
ccaccggcaaucgggacg

SEQ ID NO: 2986182 - RNA, 20 nt, Mycobacterium avium subsp. paratuberculosis
ccaccggcaaucgggacgcc

SEQ ID NO: 2986183 - RNA, 17 nt, Mycobacterium avium subsp. paratuberculosis
ccaccggcacggcaccg

SEQ ID NO: 2986184 - RNA, 21 nt, Mycobacterium avium subsp. paratuberculosis
ccaccggcacggcaccgcgag

SEQ ID NO: 2986185 - RNA, 12 nt, Mycobacterium avium subsp. paratuberculosis
ccaccggcaucg

SEQ ID NO: 2986186 - RNA, 20 nt, Mycobacterium avium subsp. paratuberculosis
ccaccggccacucgcguccc

SEQ ID NO: 2986187 - RNA, 17 nt, Mycobacterium avium subsp. paratuberculosis
ccaccggcccagccggc

SEQ ID NO: 2986188 - RNA, 12 nt, Mycobacterium avium subsp. paratuberculosis
ccaccggcccgg

SEQ ID NO: 2986189 - RNA, 14 nt, Mycobacterium avium subsp. paratuberculosis
ccaccggcccggcc

SEQ ID NO: 2986190 - RNA, 18 nt, Mycobacterium avium subsp. paratuberculosis
ccaccggcccggccggcg

SEQ ID NO: 2986191 - RNA, 19 nt, Mycobacterium avium subsp. paratuberculosis
ccaccggcccggccggcgc

SEQ ID NO: 2986192 - RNA, 20 nt, Mycobacterium avium subsp. paratuberculosis
ccaccggcccggccggcgcg

SEQ ID NO: 2986193 - RNA, 15 nt, Mycobacterium avium subsp. paratuberculosis
ccaccggcccggcgg

SEQ ID NO: 2986194 - RNA, 16 nt, Mycobacterium avium subsp. paratuberculosis
ccaccggcccggcggg

SEQ ID NO: 2986195 - RNA, 23 nt, Mycobacterium avium subsp. paratuberculosis
ccaccggccgauggcccaggccg

SEQ ID NO: 2986196 - RNA, 12 nt, Mycobacterium avium subsp. paratuberculosis
ccaccggccgcc

SEQ ID NO: 2986197 - RNA, 13 nt, Mycobacterium avium subsp. paratuberculosis
ccaccggccgccc

SEQ ID NO: 2986198 - RNA, 15 nt, Mycobacterium avium subsp. paratuberculosis
ccaccggccgcccgg

SEQ ID NO: 2986199 - RNA, 22 nt, Mycobacterium avium subsp. paratuberculosis
ccaccggccgcccggcgagcag

SEQ ID NO: 2986200 - RNA, 14 nt, Mycobacterium avium subsp. paratuberculosis
ccaccggccgcgcg

SEQ ID NO: 2986201 - RNA, 13 nt, Mycobacterium avium subsp. paratuberculosis
ccaccggccgguc

SEQ ID NO: 2986202 - RNA, 15 nt, Mycobacterium avium subsp. paratuberculosis
ccaccggcgcgacgg

SEQ ID NO: 2986203 - RNA, 16 nt, Mycobacterium avium subsp. paratuberculosis
ccaccggcgcgacggc

SEQ ID NO: 2986204 - RNA, 17 nt, Mycobacterium avium subsp. paratuberculosis
ccaccggcgcgacggcg

SEQ ID NO: 2986205 - RNA, 19 nt, Mycobacterium avium subsp. paratuberculosis
ccaccggcgcgacggcggc

SEQ ID NO: 2986206 - RNA, 19 nt, Mycobacterium avium subsp. paratuberculosis
ccaccggcuccuugcgccg

SEQ ID NO: 2986207 - RNA, 20 nt, Mycobacterium avium subsp. paratuberculosis
ccaccggcuccuugcgccgc

SEQ ID NO: 2986208 - RNA, 19 nt, Mycobacterium avium subsp. paratuberculosis
ccaccggcuuggccacgau

SEQ ID NO: 2986209 - RNA, 20 nt, Mycobacterium avium subsp. paratuberculosis
ccaccgggcaguagaacggc

SEQ ID NO: 2986210 - RNA, 14 nt, Mycobacterium avium subsp. paratuberculosis
ccaccgggccgcca

SEQ ID NO: 2986211 - RNA, 14 nt, Mycobacterium avium subsp. paratuberculosis
ccaccgggcgucgg

SEQ ID NO: 2986212 - RNA, 16 nt, Mycobacterium avium subsp. paratuberculosis
ccaccgggcgucggcg

SEQ ID NO: 2986213 - RNA, 17 nt, Mycobacterium avium subsp. paratuberculosis
ccaccgggcgucggcgg

SEQ ID NO: 2986214 - RNA, 21 nt, Mycobacterium avium subsp. paratuberculosis
ccaccggggucaccuuggccg

SEQ ID NO: 2986215 - RNA, 21 nt, Mycobacterium avium subsp. paratuberculosis
ccaccggguagcccgcgugca

SEQ ID NO: 2986216 - RNA, 12 nt, Mycobacterium avium subsp. paratuberculosis
ccaccgggucgc

SEQ ID NO: 2986217 - RNA, 13 nt, Mycobacterium avium subsp. paratuberculosis
ccaccggucggaa

SEQ ID NO: 2986218 - RNA, 18 nt, Mycobacterium avium subsp. paratuberculosis
ccaccggugacgaccggc

SEQ ID NO: 2986219 - RNA, 21 nt, Mycobacterium avium subsp. paratuberculosis
ccaccggugacgaccggcagc

SEQ ID NO: 2986220 - RNA, 15 nt, Mycobacterium avium subsp. paratuberculosis
ccaccgguggccggg

SEQ ID NO: 2986221 - RNA, 15 nt, Mycobacterium avium subsp. paratuberculosis
ccaccgucagcguca

SEQ ID NO: 2986222 - RNA, 17 nt, Mycobacterium avium subsp. paratuberculosis
ccaccgucagcgucagc

SEQ ID NO: 2986223 - RNA, 15 nt, Mycobacterium avium subsp. paratuberculosis
ccaccgucagggugg

SEQ ID NO: 2986224 - RNA, 23 nt, Mycobacterium avium subsp. paratuberculosis
ccaccgucaggguggugcccccg

SEQ ID NO: 2986225 - RNA, 22 nt, Mycobacterium avium subsp. paratuberculosis
ccaccgucccggugucgccguc

SEQ ID NO: 2986226 - RNA, 23 nt, Mycobacterium avium subsp. paratuberculosis
ccaccgucccggugucgccgucg

SEQ ID NO: 2986227 - RNA, 15 nt, Mycobacterium avium subsp. paratuberculosis
ccaccgucgccacga

SEQ ID NO: 2986228 - RNA, 17 nt, Mycobacterium avium subsp. paratuberculosis
ccaccgucgccggcuga

SEQ ID NO: 2986229 - RNA, 20 nt, Mycobacterium avium subsp. paratuberculosis
ccaccgucgucgagcgcucg

SEQ ID NO: 2986230 - RNA, 21 nt, Mycobacterium avium subsp. paratuberculosis
ccaccgucgucgagcgcucgc

SEQ ID NO: 2986231 - RNA, 17 nt, Mycobacterium avium subsp. paratuberculosis
ccaccgucuucggggcc

SEQ ID NO: 2986232 - RNA, 21 nt, Mycobacterium avium subsp. paratuberculosis
ccaccgucuucggggccgccg

SEQ ID NO: 2986233 - RNA, 21 nt, Mycobacterium avium subsp. paratuberculosis
ccaccgucuuggucucgccga

SEQ ID NO: 2986234 - RNA, 12 nt, Mycobacterium avium subsp. paratuberculosis
ccaccgugacgu

SEQ ID NO: 2986235 - RNA, 17 nt, Mycobacterium avium subsp. paratuberculosis
ccaccgugacguuguag

SEQ ID NO: 2986236 - RNA, 14 nt, Mycobacterium avium subsp. paratuberculosis
ccaccgugccgucg

SEQ ID NO: 2986237 - RNA, 15 nt, Mycobacterium avium subsp. paratuberculosis
ccaccgugccgucgc

SEQ ID NO: 2986238 - RNA, 16 nt, Mycobacterium avium subsp. paratuberculosis
ccaccgugccgucgcg

SEQ ID NO: 2986239 - RNA, 20 nt, Mycobacterium avium subsp. paratuberculosis
ccaccgugccgucgcgggcg

SEQ ID NO: 2986240 - RNA, 17 nt, Mycobacterium avium subsp. paratuberculosis
ccaccgugcuggccacc

SEQ ID NO: 2986241 - RNA, 15 nt, Mycobacterium avium subsp. paratuberculosis
ccaccguggccccag

SEQ ID NO: 2986242 - RNA, 15 nt, Mycobacterium avium subsp. paratuberculosis
ccaccguggucggca

SEQ ID NO: 2986243 - RNA, 23 nt, Mycobacterium avium subsp. paratuberculosis
ccaccguguucaccagcggggug

SEQ ID NO: 2986244 - RNA, 21 nt, Mycobacterium avium subsp. paratuberculosis
ccaccguguugaucucgucga

SEQ ID NO: 2986245 - RNA, 15 nt, Mycobacterium avium subsp. paratuberculosis
ccaccguucgggugc

SEQ ID NO: 2986246 - RNA, 16 nt, Mycobacterium avium subsp. paratuberculosis
ccaccguucgggugcg

SEQ ID NO: 2986247 - RNA, 19 nt, Mycobacterium avium subsp. paratuberculosis
ccaccguugucucggcgcc

SEQ ID NO: 2986248 - RNA, 21 nt, Mycobacterium avium subsp. paratuberculosis
ccaccguugucucggcgccgu

SEQ ID NO: 2986249 - RNA, 14 nt, Mycobacterium avium subsp. paratuberculosis
ccaccuccagcccg

SEQ ID NO: 2986250 - RNA, 19 nt, Mycobacterium avium subsp. paratuberculosis
ccaccuccucgcgggcgau

SEQ ID NO: 2986251 - RNA, 23 nt, Mycobacterium avium subsp. paratuberculosis
ccaccuccucgcgggcgaucucc

SEQ ID NO: 2986252 - RNA, 13 nt, Mycobacterium avium subsp. paratuberculosis
ccaccucgacggc

SEQ ID NO: 2986253 - RNA, 14 nt, Mycobacterium avium subsp. paratuberculosis
ccaccucgacggcg

SEQ ID NO: 2986254 - RNA, 17 nt, Mycobacterium avium subsp. paratuberculosis
ccaccucgacggcgugg

SEQ ID NO: 2986255 - RNA, 22 nt, Mycobacterium avium subsp. paratuberculosis
ccaccucgagcacgcccugcgg

SEQ ID NO: 2986256 - RNA, 18 nt, Mycobacterium avium subsp. paratuberculosis
ccaccucgaucagcggca

SEQ ID NO: 2986257 - RNA, 19 nt, Mycobacterium avium subsp. paratuberculosis
ccaccucgaucagcggcau

SEQ ID NO: 2986258 - RNA, 23 nt, Mycobacterium avium subsp. paratuberculosis
ccaccucggcgacgauggccagg

SEQ ID NO: 2986259 - RNA, 15 nt, Mycobacterium avium subsp. paratuberculosis
ccaccucggcggcac

SEQ ID NO: 2986260 - RNA, 21 nt, Mycobacterium avium subsp. paratuberculosis
ccaccucgggcauuggcagcu

SEQ ID NO: 2986261 - RNA, 13 nt, Mycobacterium avium subsp. paratuberculosis
ccaccucgggccg

SEQ ID NO: 2986262 - RNA, 15 nt, Mycobacterium avium subsp. paratuberculosis
ccaccucgggccggg

SEQ ID NO: 2986263 - RNA, 18 nt, Mycobacterium avium subsp. paratuberculosis
ccaccucgggccgggcgg

SEQ ID NO: 2986264 - RNA, 19 nt, Mycobacterium avium subsp. paratuberculosis
ccaccucgguggacgccgc

SEQ ID NO: 2986265 - RNA, 21 nt, Mycobacterium avium subsp. paratuberculosis
ccaccucgguggacgccgcgc

SEQ ID NO: 2986266 - RNA, 22 nt, Mycobacterium avium subsp. paratuberculosis
ccaccucgguggacgccgcgca

SEQ ID NO: 2986267 - RNA, 23 nt, Mycobacterium avium subsp. paratuberculosis
ccaccucgguggacgccgcgcac

SEQ ID NO: 2986268 - RNA, 16 nt, Mycobacterium avium subsp. paratuberculosis
ccaccucuucgcgguc

SEQ ID NO: 2986269 - RNA, 14 nt, Mycobacterium avium subsp. paratuberculosis
ccaccugaccgcgg

SEQ ID NO: 2986270 - RNA, 17 nt, Mycobacterium avium subsp. paratuberculosis
ccaccugaccgcgggcc

SEQ ID NO: 2986271 - RNA, 14 nt, Mycobacterium avium subsp. paratuberculosis
ccaccugaucgcgg

SEQ ID NO: 2986272 - RNA, 15 nt, Mycobacterium avium subsp. paratuberculosis
ccaccugaucgcggc

SEQ ID NO: 2986273 - RNA, 16 nt, Mycobacterium avium subsp. paratuberculosis
ccaccugaucgcggcg

SEQ ID NO: 2986274 - RNA, 18 nt, Mycobacterium avium subsp. paratuberculosis
ccaccugaucgcggcgag

SEQ ID NO: 2986275 - RNA, 23 nt, Mycobacterium avium subsp. paratuberculosis
ccaccugaucgcggcgagcagcg

SEQ ID NO: 2986276 - RNA, 24 nt, Mycobacterium avium subsp. paratuberculosis
ccaccugaucgcggcgagcagcgc

SEQ ID NO: 2986277 - RNA, 20 nt, Mycobacterium avium subsp. paratuberculosis
ccaccugcaccugggugauc

SEQ ID NO: 2986278 - RNA, 21 nt, Mycobacterium avium subsp. paratuberculosis
ccaccugcaccugggugaucu

SEQ ID NO: 2986279 - RNA, 15 nt, Mycobacterium avium subsp. paratuberculosis
ccaccugcacgggga

SEQ ID NO: 2986280 - RNA, 19 nt, Mycobacterium avium subsp. paratuberculosis
ccaccugccgcaacgggcc

SEQ ID NO: 2986281 - RNA, 20 nt, Mycobacterium avium subsp. paratuberculosis
ccaccugcggcaccucggcc

SEQ ID NO: 2986282 - RNA, 21 nt, Mycobacterium avium subsp. paratuberculosis
ccaccugcggcaccucggccu

SEQ ID NO: 2986283 - RNA, 23 nt, Mycobacterium avium subsp. paratuberculosis
ccaccugcggcaccucggccuug

SEQ ID NO: 2986284 - RNA, 21 nt, Mycobacterium avium subsp. paratuberculosis
ccaccugcgguucgucgcggc

SEQ ID NO: 2986285 - RNA, 22 nt, Mycobacterium avium subsp. paratuberculosis
ccaccugcgguucgucgcggcg

SEQ ID NO: 2986286 - RNA, 23 nt, Mycobacterium avium subsp. paratuberculosis
ccaccugcgguucgucgcggcgg

SEQ ID NO: 2986287 - RNA, 15 nt, Mycobacterium avium subsp. paratuberculosis
ccaccuggaggccaa

SEQ ID NO: 2986288 - RNA, 22 nt, Mycobacterium avium subsp. paratuberculosis
ccaccuggaggccaacgagcgc

SEQ ID NO: 2986289 - RNA, 23 nt, Mycobacterium avium subsp. paratuberculosis
ccaccuggaggccaacgagcgcg

SEQ ID NO: 2986290 - RNA, 12 nt, Mycobacterium avium subsp. paratuberculosis
ccaccuggccgg

SEQ ID NO: 2986291 - RNA, 14 nt, Mycobacterium avium subsp. paratuberculosis
ccaccuggccggcc

SEQ ID NO: 2986292 - RNA, 17 nt, Mycobacterium avium subsp. paratuberculosis
ccaccugggcggggcug

SEQ ID NO: 2986293 - RNA, 15 nt, Mycobacterium avium subsp. paratuberculosis
ccaccugggcgucgu

SEQ ID NO: 2986294 - RNA, 18 nt, Mycobacterium avium subsp. paratuberculosis
ccaccugggcgucgucgg

SEQ ID NO: 2986295 - RNA, 18 nt, Mycobacterium avium subsp. paratuberculosis
ccaccugguccugccccg

SEQ ID NO: 2986296 - RNA, 13 nt, Mycobacterium avium subsp. paratuberculosis
ccaccuucaccgc

SEQ ID NO: 2986297 - RNA, 14 nt, Mycobacterium avium subsp. paratuberculosis
ccaccuucaccgcg

SEQ ID NO: 2986298 - RNA, 22 nt, Mycobacterium avium subsp. paratuberculosis
ccaccuucaccgcgccgguccg

SEQ ID NO: 2986299 - RNA, 19 nt, Mycobacterium avium subsp. paratuberculosis
ccaccuucaucgccgucgc

SEQ ID NO: 2986300 - RNA, 21 nt, Mycobacterium avium subsp. paratuberculosis
ccaccuucaucgccgucgcca

SEQ ID NO: 2986301 - RNA, 21 nt, Mycobacterium avium subsp. paratuberculosis
ccaccuucccaaccccgggcg

SEQ ID NO: 2986302 - RNA, 15 nt, Mycobacterium avium subsp. paratuberculosis
ccaccuugcgcagca

SEQ ID NO: 2986303 - RNA, 18 nt, Mycobacterium avium subsp. paratuberculosis
ccaccuugcgcagcagca

SEQ ID NO: 2986304 - RNA, 17 nt, Mycobacterium avium subsp. paratuberculosis
ccaccuugcgcgggucg

SEQ ID NO: 2986305 - RNA, 20 nt, Mycobacterium avium subsp. paratuberculosis
ccaccuugcgcgggucgccg

SEQ ID NO: 2986306 - RNA, 23 nt, Mycobacterium avium subsp. paratuberculosis
ccaccuugcgcgggucgccgggc

SEQ ID NO: 2986307 - RNA, 20 nt, Mycobacterium avium subsp. paratuberculosis
ccaccuuggacaggcccagc

SEQ ID NO: 2986308 - RNA, 22 nt, Mycobacterium avium subsp. paratuberculosis
ccaccuuggacaggcccagcgg

SEQ ID NO: 2986309 - RNA, 15 nt, Mycobacterium avium subsp. paratuberculosis
ccaccuuggccggug

SEQ ID NO: 2986310 - RNA, 17 nt, Mycobacterium avium subsp. paratuberculosis
ccaccuuggccggugcg

SEQ ID NO: 2986311 - RNA, 21 nt, Mycobacterium avium subsp. paratuberculosis
ccaccuuggccggugcgccga

SEQ ID NO: 2986312 - RNA, 17 nt, Mycobacterium avium subsp. paratuberculosis
ccaccuuggcgucgauc

SEQ ID NO: 2986313 - RNA, 21 nt, Mycobacterium avium subsp. paratuberculosis
ccaccuuggcgucgaucagcg

SEQ ID NO: 2986314 - RNA, 17 nt, Mycobacterium avium subsp. paratuberculosis
ccaccuugguggccgcg

SEQ ID NO: 2986315 - RNA, 21 nt, Mycobacterium avium subsp. paratuberculosis
ccaccuugguggccgcggccg

SEQ ID NO: 2986316 - RNA, 23 nt, Mycobacterium avium subsp. paratuberculosis
ccaccuugguggccgcggccgcc

SEQ ID NO: 2986317 - RNA, 15 nt, Mycobacterium avium subsp. paratuberculosis
ccaccuugucaccga

SEQ ID NO: 2986318 - RNA, 16 nt, Mycobacterium avium subsp. paratuberculosis
ccaccuugucaccgaa

SEQ ID NO: 2986319 - RNA, 16 nt, Mycobacterium avium subsp. paratuberculosis
ccaccuugucggcgcc

SEQ ID NO: 2986320 - RNA, 18 nt, Mycobacterium avium subsp. paratuberculosis
ccaccuugucggcgccca

SEQ ID NO: 2986321 - RNA, 20 nt, Mycobacterium avium subsp. paratuberculosis
ccacgaaacugaccuucucc

SEQ ID NO: 2986322 - RNA, 18 nt, Mycobacterium avium subsp. paratuberculosis
ccacgaacaccggcgcga

SEQ ID NO: 2986323 - RNA, 14 nt, Mycobacterium avium subsp. paratuberculosis
ccacgaaccaggcg

SEQ ID NO: 2986324 - RNA, 23 nt, Mycobacterium avium subsp. paratuberculosis
ccacgaaccaggcgccggccagc

SEQ ID NO: 2986325 - RNA, 18 nt, Mycobacterium avium subsp. paratuberculosis
ccacgaaccgguugcggg

SEQ ID NO: 2986326 - RNA, 21 nt, Mycobacterium avium subsp. paratuberculosis
ccacgaaccgguugcgggccg

SEQ ID NO: 2986327 - RNA, 19 nt, Mycobacterium avium subsp. paratuberculosis
ccacgaacgcgccgccgag

SEQ ID NO: 2986328 - RNA, 14 nt, Mycobacterium avium subsp. paratuberculosis
ccacgaacgcugcc

SEQ ID NO: 2986329 - RNA, 22 nt, Mycobacterium avium subsp. paratuberculosis
ccacgaacggguccuugccggc

SEQ ID NO: 2986330 - RNA, 13 nt, Mycobacterium avium subsp. paratuberculosis
ccacgaacgucag

SEQ ID NO: 2986331 - RNA, 17 nt, Mycobacterium avium subsp. paratuberculosis
ccacgaacgucaggccg

SEQ ID NO: 2986332 - RNA, 21 nt, Mycobacterium avium subsp. paratuberculosis
ccacgaacgucaggccgugca

SEQ ID NO: 2986333 - RNA, 20 nt, Mycobacterium avium subsp. paratuberculosis
ccacgaacucccccgcccgg

SEQ ID NO: 2986334 - RNA, 19 nt, Mycobacterium avium subsp. paratuberculosis
ccacgaagaugaucagcgc

SEQ ID NO: 2986335 - RNA, 20 nt, Mycobacterium avium subsp. paratuberculosis
ccacgaagaugaucagcgcg

SEQ ID NO: 2986336 - RNA, 23 nt, Mycobacterium avium subsp. paratuberculosis
ccacgaagaugaucagcgcgccc

SEQ ID NO: 2986337 - RNA, 14 nt, Mycobacterium avium subsp. paratuberculosis
ccacgaagcgggcg

SEQ ID NO: 2986338 - RNA, 16 nt, Mycobacterium avium subsp. paratuberculosis
ccacgaagcgggcggc

SEQ ID NO: 2986339 - RNA, 13 nt, Mycobacterium avium subsp. paratuberculosis
ccacgaagcuggc

SEQ ID NO: 2986340 - RNA, 20 nt, Mycobacterium avium subsp. paratuberculosis
ccacgaagcuggcgaacagc

SEQ ID NO: 2986341 - RNA, 14 nt, Mycobacterium avium subsp. paratuberculosis
ccacgaagggcgcc

SEQ ID NO: 2986342 - RNA, 16 nt, Mycobacterium avium subsp. paratuberculosis
ccacgaagggcgccag

SEQ ID NO: 2986343 - RNA, 19 nt, Mycobacterium avium subsp. paratuberculosis
ccacgaagggcgccagcac

SEQ ID NO: 2986344 - RNA, 17 nt, Mycobacterium avium subsp. paratuberculosis
ccacgaagucaaacccc

SEQ ID NO: 2986345 - RNA, 20 nt, Mycobacterium avium subsp. paratuberculosis
ccacgaagucaaaccccuug

SEQ ID NO: 2986346 - RNA, 23 nt, Mycobacterium avium subsp. paratuberculosis
ccacgaagucguuggggaugucg

SEQ ID NO: 2986347 - RNA, 17 nt, Mycobacterium avium subsp. paratuberculosis
ccacgacaccagcgucg

SEQ ID NO: 2986348 - RNA, 22 nt, Mycobacterium avium subsp. paratuberculosis
ccacgacaccagcgucgcgauc

SEQ ID NO: 2986349 - RNA, 14 nt, Mycobacterium avium subsp. paratuberculosis
ccacgaccagugcc

SEQ ID NO: 2986350 - RNA, 18 nt, Mycobacterium avium subsp. paratuberculosis
ccacgaccccggcggcac

SEQ ID NO: 2986351 - RNA, 20 nt, Mycobacterium avium subsp. paratuberculosis
ccacgaccccggcggcaccg

SEQ ID NO: 2986352 - RNA, 19 nt, Mycobacterium avium subsp. paratuberculosis
ccacgaccuccgugccgau

SEQ ID NO: 2986353 - RNA, 16 nt, Mycobacterium avium subsp. paratuberculosis
ccacgaccuggcgggc

SEQ ID NO: 2986354 - RNA, 18 nt, Mycobacterium avium subsp. paratuberculosis
ccacgaccuggcgggcca

SEQ ID NO: 2986355 - RNA, 15 nt, Mycobacterium avium subsp. paratuberculosis
ccacgacgacguggu

SEQ ID NO: 2986356 - RNA, 15 nt, Mycobacterium avium subsp. paratuberculosis
ccacgacgccgggcg

SEQ ID NO: 2986357 - RNA, 17 nt, Mycobacterium avium subsp. paratuberculosis
ccacgacgccgggcgcc

SEQ ID NO: 2986358 - RNA, 14 nt, Mycobacterium avium subsp. paratuberculosis
ccacgacgcggcga

SEQ ID NO: 2986359 - RNA, 14 nt, Mycobacterium avium subsp. paratuberculosis
ccacgacgcggcgc

SEQ ID NO: 2986360 - RNA, 15 nt, Mycobacterium avium subsp. paratuberculosis
ccacgacgcggcgcg

SEQ ID NO: 2986361 - RNA, 16 nt, Mycobacterium avium subsp. paratuberculosis
ccacgacgcggcgcgc

SEQ ID NO: 2986362 - RNA, 18 nt, Mycobacterium avium subsp. paratuberculosis
ccacgacgcggcgcgcga

SEQ ID NO: 2986363 - RNA, 21 nt, Mycobacterium avium subsp. paratuberculosis
ccacgacggcgcuggccgcgg

SEQ ID NO: 2986364 - RNA, 23 nt, Mycobacterium avium subsp. paratuberculosis
ccacgacggggaacucggugaug

SEQ ID NO: 2986365 - RNA, 17 nt, Mycobacterium avium subsp. paratuberculosis
ccacgacguacccccgc

SEQ ID NO: 2986366 - RNA, 15 nt, Mycobacterium avium subsp. paratuberculosis
ccacgacguccucga

SEQ ID NO: 2986367 - RNA, 19 nt, Mycobacterium avium subsp. paratuberculosis
ccacgacguccucgacgau

SEQ ID NO: 2986368 - RNA, 20 nt, Mycobacterium avium subsp. paratuberculosis
ccacgacgucugggccgccg

SEQ ID NO: 2986369 - RNA, 23 nt, Mycobacterium avium subsp. paratuberculosis
ccacgacugcgcggccggcgugu

SEQ ID NO: 2986370 - RNA, 20 nt, Mycobacterium avium subsp. paratuberculosis
ccacgacuucacaggccgcc

SEQ ID NO: 2986371 - RNA, 13 nt, Mycobacterium avium subsp. paratuberculosis
ccacgagcccagc

SEQ ID NO: 2986372 - RNA, 19 nt, Mycobacterium avium subsp. paratuberculosis
ccacgagcccagccgucgc

SEQ ID NO: 2986373 - RNA, 13 nt, Mycobacterium avium subsp. paratuberculosis
ccacgagccgguc

SEQ ID NO: 2986374 - RNA, 21 nt, Mycobacterium avium subsp. paratuberculosis
ccacgagccggucgggaucga

SEQ ID NO: 2986375 - RNA, 18 nt, Mycobacterium avium subsp. paratuberculosis
ccacgaggcugugggcca

SEQ ID NO: 2986376 - RNA, 21 nt, Mycobacterium avium subsp. paratuberculosis
ccacgaggcugugggccagca

SEQ ID NO: 2986377 - RNA, 24 nt, Mycobacterium avium subsp. paratuberculosis
ccacgaggcugugggccagcagcg

SEQ ID NO: 2986378 - RNA, 20 nt, Mycobacterium avium subsp. paratuberculosis
ccacgaguaaccggugcgcu

SEQ ID NO: 2986379 - RNA, 19 nt, Mycobacterium avium subsp. paratuberculosis
ccacgaucaauucgaagcc

SEQ ID NO: 2986380 - RNA, 23 nt, Mycobacterium avium subsp. paratuberculosis
ccacgaucaauucgaagcccgug

SEQ ID NO: 2986381 - RNA, 13 nt, Mycobacterium avium subsp. paratuberculosis
ccacgaucaccac

SEQ ID NO: 2986382 - RNA, 15 nt, Mycobacterium avium subsp. paratuberculosis
ccacgaucaccacca

SEQ ID NO: 2986383 - RNA, 18 nt, Mycobacterium avium subsp. paratuberculosis
ccacgaucaccaccaccg

SEQ ID NO: 2986384 - RNA, 22 nt, Mycobacterium avium subsp. paratuberculosis
ccacgaucaccaccaccgccgu

SEQ ID NO: 2986385 - RNA, 17 nt, Mycobacterium avium subsp. paratuberculosis
ccacgaucaccagaccg

SEQ ID NO: 2986386 - RNA, 18 nt, Mycobacterium avium subsp. paratuberculosis
ccacgaucaccagaccgg

SEQ ID NO: 2986387 - RNA, 13 nt, Mycobacterium avium subsp. paratuberculosis
ccacgaucagcgc

SEQ ID NO: 2986388 - RNA, 14 nt, Mycobacterium avium subsp. paratuberculosis
ccacgaucagcgcg

SEQ ID NO: 2986389 - RNA, 16 nt, Mycobacterium avium subsp. paratuberculosis
ccacgaucagcgcguc

SEQ ID NO: 2986390 - RNA, 18 nt, Mycobacterium avium subsp. paratuberculosis
ccacgaucagcgcgucga

SEQ ID NO: 2986391 - RNA, 20 nt, Mycobacterium avium subsp. paratuberculosis
ccacgauccaaccgagucgc

SEQ ID NO: 2986392 - RNA, 13 nt, Mycobacterium avium subsp. paratuberculosis
ccacgauccgcgc

SEQ ID NO: 2986393 - RNA, 14 nt, Mycobacterium avium subsp. paratuberculosis
ccacgauccgcgcg

SEQ ID NO: 2986394 - RNA, 16 nt, Mycobacterium avium subsp. paratuberculosis
ccacgauccgcgcggc

SEQ ID NO: 2986395 - RNA, 21 nt, Mycobacterium avium subsp. paratuberculosis
ccacgauccgcgcggccacca

SEQ ID NO: 2986396 - RNA, 23 nt, Mycobacterium avium subsp. paratuberculosis
ccacgauccgcgcggccaccagc

SEQ ID NO: 2986397 - RNA, 20 nt, Mycobacterium avium subsp. paratuberculosis
ccacgaucgcgaucgccgau

SEQ ID NO: 2986398 - RNA, 21 nt, Mycobacterium avium subsp. paratuberculosis
ccacgaucgcgaucgccgauc

SEQ ID NO: 2986399 - RNA, 20 nt, Mycobacterium avium subsp. paratuberculosis
ccacgaucgcggccagcgug

SEQ ID NO: 2986400 - RNA, 18 nt, Mycobacterium avium subsp. paratuberculosis
ccacgaugaucgucggca

SEQ ID NO: 2986401 - RNA, 21 nt, Mycobacterium avium subsp. paratuberculosis
ccacgaugaucgucggcagcg

SEQ ID NO: 2986402 - RNA, 17 nt, Mycobacterium avium subsp. paratuberculosis
ccacgaugaugcccccg

SEQ ID NO: 2986403 - RNA, 14 nt, Mycobacterium avium subsp. paratuberculosis
ccacgaugcccguc

SEQ ID NO: 2986404 - RNA, 16 nt, Mycobacterium avium subsp. paratuberculosis
ccacgaugccgggcac

SEQ ID NO: 2986405 - RNA, 16 nt, Mycobacterium avium subsp. paratuberculosis
ccacgaugcggugccg

SEQ ID NO: 2986406 - RNA, 18 nt, Mycobacterium avium subsp. paratuberculosis
ccacgaugcggugccggg

SEQ ID NO: 2986407 - RNA, 19 nt, Mycobacterium avium subsp. paratuberculosis
ccacgaugcggugccgggu

SEQ ID NO: 2986408 - RNA, 22 nt, Mycobacterium avium subsp. paratuberculosis
ccacgaugcggugccgggugcu

SEQ ID NO: 2986409 - RNA, 19 nt, Mycobacterium avium subsp. paratuberculosis
ccacgauuccucggaccgg

SEQ ID NO: 2986410 - RNA, 12 nt, Mycobacterium avium subsp. paratuberculosis
ccacgcacacca

SEQ ID NO: 2986411 - RNA, 13 nt, Mycobacterium avium subsp. paratuberculosis
ccacgcacaccac

SEQ ID NO: 2986412 - RNA, 15 nt, Mycobacterium avium subsp. paratuberculosis
ccacgcacaccaccg

SEQ ID NO: 2986413 - RNA, 19 nt, Mycobacterium avium subsp. paratuberculosis
ccacgcacaccaccgacgc

SEQ ID NO: 2986414 - RNA, 22 nt, Mycobacterium avium subsp. paratuberculosis
ccacgcacaccaccgacgcguc

SEQ ID NO: 2986415 - RNA, 16 nt, Mycobacterium avium subsp. paratuberculosis
ccacgcacaccgcgcg

SEQ ID NO: 2986416 - RNA, 23 nt, Mycobacterium avium subsp. paratuberculosis
ccacgcagaucuugugccagccg

SEQ ID NO: 2986417 - RNA, 15 nt, Mycobacterium avium subsp. paratuberculosis
ccacgcagccgucga

SEQ ID NO: 2986418 - RNA, 17 nt, Mycobacterium avium subsp. paratuberculosis
ccacgcagccgucgauc

SEQ ID NO: 2986419 - RNA, 15 nt, Mycobacterium avium subsp. paratuberculosis
ccacgcagcggugca

SEQ ID NO: 2986420 - RNA, 21 nt, Mycobacterium avium subsp. paratuberculosis
ccacgcagcggugcagccccg

SEQ ID NO: 2986421 - RNA, 15 nt, Mycobacterium avium subsp. paratuberculosis
ccacgcagguccagg

SEQ ID NO: 2986422 - RNA, 15 nt, Mycobacterium avium subsp. paratuberculosis
ccacgcagucgucga

SEQ ID NO: 2986423 - RNA, 12 nt, Mycobacterium avium subsp. paratuberculosis
ccacgccagccg

SEQ ID NO: 2986424 - RNA, 13 nt, Mycobacterium avium subsp. paratuberculosis
ccacgccagccgg

SEQ ID NO: 2986425 - RNA, 14 nt, Mycobacterium avium subsp. paratuberculosis
ccacgccagccucu

SEQ ID NO: 2986426 - RNA, 17 nt, Mycobacterium avium subsp. paratuberculosis
ccacgccagccucuuga

SEQ ID NO: 2986427 - RNA, 19 nt, Mycobacterium avium subsp. paratuberculosis
ccacgccaugugccggcgc

SEQ ID NO: 2986428 - RNA, 22 nt, Mycobacterium avium subsp. paratuberculosis
ccacgccaugugccggcgcucg

SEQ ID NO: 2986429 - RNA, 13 nt, Mycobacterium avium subsp. paratuberculosis
ccacgcccacgcc

SEQ ID NO: 2986430 - RNA, 13 nt, Mycobacterium avium subsp. paratuberculosis
ccacgcccagcgc

SEQ ID NO: 2986431 - RNA, 15 nt, Mycobacterium avium subsp. paratuberculosis
ccacgcccagcgccc

SEQ ID NO: 2986432 - RNA, 18 nt, Mycobacterium avium subsp. paratuberculosis
ccacgcccagggcgccag

SEQ ID NO: 2986433 - RNA, 20 nt, Mycobacterium avium subsp. paratuberculosis
ccacgccccauugccgcgcc

SEQ ID NO: 2986434 - RNA, 22 nt, Mycobacterium avium subsp. paratuberculosis
ccacgccccauugccgcgccgg

SEQ ID NO: 2986435 - RNA, 15 nt, Mycobacterium avium subsp. paratuberculosis
ccacgccccggcgcc

SEQ ID NO: 2986436 - RNA, 17 nt, Mycobacterium avium subsp. paratuberculosis
ccacgcccgacgacgac

SEQ ID NO: 2986437 - RNA, 24 nt, Mycobacterium avium subsp. paratuberculosis
ccacgcccgacgacgacgucgacg

SEQ ID NO: 2986438 - RNA, 16 nt, Mycobacterium avium subsp. paratuberculosis
ccacgcccuggccgcc

SEQ ID NO: 2986439 - RNA, 17 nt, Mycobacterium avium subsp. paratuberculosis
ccacgcccuggccgccg

SEQ ID NO: 2986440 - RNA, 23 nt, Mycobacterium avium subsp. paratuberculosis
ccacgcccuggccgccggccgcg

SEQ ID NO: 2986441 - RNA, 14 nt, Mycobacterium avium subsp. paratuberculosis
ccacgccgaccagg

SEQ ID NO: 2986442 - RNA, 17 nt, Mycobacterium avium subsp. paratuberculosis
ccacgccgacuagcgcg

SEQ ID NO: 2986443 - RNA, 21 nt, Mycobacterium avium subsp. paratuberculosis
ccacgccgacuagcgcggcgg

SEQ ID NO: 2986444 - RNA, 22 nt, Mycobacterium avium subsp. paratuberculosis
ccacgccgacuagcgcggcggc

SEQ ID NO: 2986445 - RNA, 23 nt, Mycobacterium avium subsp. paratuberculosis
ccacgccgacuagcgcggcggcc

SEQ ID NO: 2986446 - RNA, 18 nt, Mycobacterium avium subsp. paratuberculosis
ccacgccgagggcggcgg

SEQ ID NO: 2986447 - RNA, 19 nt, Mycobacterium avium subsp. paratuberculosis
ccacgccgagggcggcggc

SEQ ID NO: 2986448 - RNA, 19 nt, Mycobacterium avium subsp. paratuberculosis
ccacgccgagggugccggc

SEQ ID NO: 2986449 - RNA, 20 nt, Mycobacterium avium subsp. paratuberculosis
ccacgccgauggccuggugg

SEQ ID NO: 2986450 - RNA, 13 nt, Mycobacterium avium subsp. paratuberculosis
ccacgccgcccag

SEQ ID NO: 2986451 - RNA, 19 nt, Mycobacterium avium subsp. paratuberculosis
ccacgccgcccccgccgcg

SEQ ID NO: 2986452 - RNA, 12 nt, Mycobacterium avium subsp. paratuberculosis
ccacgccgccgg

SEQ ID NO: 2986453 - RNA, 20 nt, Mycobacterium avium subsp. paratuberculosis
ccacgccgccgggaacagcg

SEQ ID NO: 2986454 - RNA, 13 nt, Mycobacterium avium subsp. paratuberculosis
ccacgccgcgauc

SEQ ID NO: 2986455 - RNA, 15 nt, Mycobacterium avium subsp. paratuberculosis
ccacgccgcggucgc

SEQ ID NO: 2986456 - RNA, 17 nt, Mycobacterium avium subsp. paratuberculosis
ccacgccgcggucgcug

SEQ ID NO: 2986457 - RNA, 12 nt, Mycobacterium avium subsp. paratuberculosis
ccacgccggcac

SEQ ID NO: 2986458 - RNA, 12 nt, Mycobacterium avium subsp. paratuberculosis
ccacgccggcga

SEQ ID NO: 2986459 - RNA, 19 nt, Mycobacterium avium subsp. paratuberculosis
ccacgccgggcauccgccc

SEQ ID NO: 2986460 - RNA, 12 nt, Mycobacterium avium subsp. paratuberculosis
ccacgccgucga

SEQ ID NO: 2986461 - RNA, 15 nt, Mycobacterium avium subsp. paratuberculosis
ccacgccgucgacga

SEQ ID NO: 2986462 - RNA, 17 nt, Mycobacterium avium subsp. paratuberculosis
ccacgccgucgacgauc

SEQ ID NO: 2986463 - RNA, 13 nt, Mycobacterium avium subsp. paratuberculosis
ccacgccgucguc

SEQ ID NO: 2986464 - RNA, 16 nt, Mycobacterium avium subsp. paratuberculosis
ccacgccgugcagaac

SEQ ID NO: 2986465 - RNA, 17 nt, Mycobacterium avium subsp. paratuberculosis
ccacgccgugcagaaca

SEQ ID NO: 2986466 - RNA, 22 nt, Mycobacterium avium subsp. paratuberculosis
ccacgccgugcagaacagcacg

SEQ ID NO: 2986467 - RNA, 15 nt, Mycobacterium avium subsp. paratuberculosis
ccacgccgugcccgg

SEQ ID NO: 2986468 - RNA, 17 nt, Mycobacterium avium subsp. paratuberculosis
ccacgccguggcccgcc

SEQ ID NO: 2986469 - RNA, 23 nt, Mycobacterium avium subsp. paratuberculosis
ccacgccuggcggaaggccgcgc

SEQ ID NO: 2986470 - RNA, 16 nt, Mycobacterium avium subsp. paratuberculosis
ccacgcgaucaggucc

SEQ ID NO: 2986471 - RNA, 19 nt, Mycobacterium avium subsp. paratuberculosis
ccacgcgcucagcgcggcc

SEQ ID NO: 2986472 - RNA, 22 nt, Mycobacterium avium subsp. paratuberculosis
ccacgcggauagcccagcgugg

SEQ ID NO: 2986473 - RNA, 16 nt, Mycobacterium avium subsp. paratuberculosis
ccacgcggcgcgcauc

SEQ ID NO: 2986474 - RNA, 17 nt, Mycobacterium avium subsp. paratuberculosis
ccacgcggcgcgcaucg

SEQ ID NO: 2986475 - RNA, 13 nt, Mycobacterium avium subsp. paratuberculosis
ccacgcggcggcg

SEQ ID NO: 2986476 - RNA, 14 nt, Mycobacterium avium subsp. paratuberculosis
ccacgcggcggcgg

SEQ ID NO: 2986477 - RNA, 15 nt, Mycobacterium avium subsp. paratuberculosis
ccacgcggcggcggu

SEQ ID NO: 2986478 - RNA, 15 nt, Mycobacterium avium subsp. paratuberculosis
ccacgcguagccgac

SEQ ID NO: 2986479 - RNA, 15 nt, Mycobacterium avium subsp. paratuberculosis
ccacgcuagcgugac

SEQ ID NO: 2986480 - RNA, 17 nt, Mycobacterium avium subsp. paratuberculosis
ccacgcuagcgugacgc

SEQ ID NO: 2986481 - RNA, 17 nt, Mycobacterium avium subsp. paratuberculosis
ccacgcucaugcccgcc

SEQ ID NO: 2986482 - RNA, 18 nt, Mycobacterium avium subsp. paratuberculosis
ccacgcucaugcccgcca

SEQ ID NO: 2986483 - RNA, 23 nt, Mycobacterium avium subsp. paratuberculosis
ccacgcuccagaugcgguggugg

SEQ ID NO: 2986484 - RNA, 13 nt, Mycobacterium avium subsp. paratuberculosis
ccacgcucgacgc

SEQ ID NO: 2986485 - RNA, 17 nt, Mycobacterium avium subsp. paratuberculosis
ccacgcucgacgcgucg

SEQ ID NO: 2986486 - RNA, 13 nt, Mycobacterium avium subsp. paratuberculosis
ccacgcucgccag

SEQ ID NO: 2986487 - RNA, 15 nt, Mycobacterium avium subsp. paratuberculosis
ccacgcucgccagac

SEQ ID NO: 2986488 - RNA, 17 nt, Mycobacterium avium subsp. paratuberculosis
ccacgcucgccagaccg

SEQ ID NO: 2986489 - RNA, 18 nt, Mycobacterium avium subsp. paratuberculosis
ccacgcucgccagaccgg

SEQ ID NO: 2986490 - RNA, 19 nt, Mycobacterium avium subsp. paratuberculosis
ccacgcucgccagaccggu

SEQ ID NO: 2986491 - RNA, 12 nt, Mycobacterium avium subsp. paratuberculosis
ccacgcucggcg

SEQ ID NO: 2986492 - RNA, 14 nt, Mycobacterium avium subsp. paratuberculosis
ccacgcucggcgag

SEQ ID NO: 2986493 - RNA, 21 nt, Mycobacterium avium subsp. paratuberculosis
ccacgcucggcgcaacgggau

SEQ ID NO: 2986494 - RNA, 15 nt, Mycobacterium avium subsp. paratuberculosis
ccacgcucggcggcg

SEQ ID NO: 2986495 - RNA, 18 nt, Mycobacterium avium subsp. paratuberculosis
ccacgcucggcggcgcgc

SEQ ID NO: 2986496 - RNA, 14 nt, Mycobacterium avium subsp. paratuberculosis
ccacgcucgggccg

SEQ ID NO: 2986497 - RNA, 16 nt, Mycobacterium avium subsp. paratuberculosis
ccacgcucgggccggc

SEQ ID NO: 2986498 - RNA, 18 nt, Mycobacterium avium subsp. paratuberculosis
ccacgcucgggccggcgc

SEQ ID NO: 2986499 - RNA, 19 nt, Mycobacterium avium subsp. paratuberculosis
ccacgcucgggccggcgcc

SEQ ID NO: 2986500 - RNA, 21 nt, Mycobacterium avium subsp. paratuberculosis
ccacgcucgggccggcgccga

SEQ ID NO: 2986501 - RNA, 22 nt, Mycobacterium avium subsp. paratuberculosis
ccacgcucgggccggcgccgac

SEQ ID NO: 2986502 - RNA, 15 nt, Mycobacterium avium subsp. paratuberculosis
ccacgcucucgccgg

SEQ ID NO: 2986503 - RNA, 16 nt, Mycobacterium avium subsp. paratuberculosis
ccacgcucucgccggu

SEQ ID NO: 2986504 - RNA, 19 nt, Mycobacterium avium subsp. paratuberculosis
ccacgcucucgccggucag

SEQ ID NO: 2986505 - RNA, 23 nt, Mycobacterium avium subsp. paratuberculosis
ccacgcucucgccggucagcacg

SEQ ID NO: 2986506 - RNA, 21 nt, Mycobacterium avium subsp. paratuberculosis
ccacgcugagcaaccgccgaa

SEQ ID NO: 2986507 - RNA, 13 nt, Mycobacterium avium subsp. paratuberculosis
ccacgcuggcccc

SEQ ID NO: 2986508 - RNA, 13 nt, Mycobacterium avium subsp. paratuberculosis
ccacgcuggcguc

SEQ ID NO: 2986509 - RNA, 17 nt, Mycobacterium avium subsp. paratuberculosis
ccacgcuggcgugacgc

SEQ ID NO: 2986510 - RNA, 17 nt, Mycobacterium avium subsp. paratuberculosis
ccacgcuggugugacgc

SEQ ID NO: 2986511 - RNA, 21 nt, Mycobacterium avium subsp. paratuberculosis
ccacgcuggugugacgcucgc

SEQ ID NO: 2986512 - RNA, 14 nt, Mycobacterium avium subsp. paratuberculosis
ccacgcuguagggc

SEQ ID NO: 2986513 - RNA, 18 nt, Mycobacterium avium subsp. paratuberculosis
ccacgcuguagggccacc

SEQ ID NO: 2986514 - RNA, 13 nt, Mycobacterium avium subsp. paratuberculosis
ccacggagcgccc

SEQ ID NO: 2986515 - RNA, 17 nt, Mycobacterium avium subsp. paratuberculosis
ccacggcaccgccgcgc

SEQ ID NO: 2986516 - RNA, 18 nt, Mycobacterium avium subsp. paratuberculosis
ccacggcaccgccgcgcg

SEQ ID NO: 2986517 - RNA, 20 nt, Mycobacterium avium subsp. paratuberculosis
ccacggcaccgccgcgcggc

SEQ ID NO: 2986518 - RNA, 12 nt, Mycobacterium avium subsp. paratuberculosis
ccacggcagcug

SEQ ID NO: 2986519 - RNA, 14 nt, Mycobacterium avium subsp. paratuberculosis
ccacggcaugguga

SEQ ID NO: 2986520 - RNA, 16 nt, Mycobacterium avium subsp. paratuberculosis
ccacggccacaacguc

SEQ ID NO: 2986521 - RNA, 20 nt, Mycobacterium avium subsp. paratuberculosis
ccacggccacaacgucucug

SEQ ID NO: 2986522 - RNA, 15 nt, Mycobacterium avium subsp. paratuberculosis
ccacggccaccacgg

SEQ ID NO: 2986523 - RNA, 20 nt, Mycobacterium avium subsp. paratuberculosis
ccacggccaccacggcaccg

SEQ ID NO: 2986524 - RNA, 21 nt, Mycobacterium avium subsp. paratuberculosis
ccacggccaccacggcaccgc

SEQ ID NO: 2986525 - RNA, 15 nt, Mycobacterium avium subsp. paratuberculosis
ccacggccaccgccg

SEQ ID NO: 2986526 - RNA, 17 nt, Mycobacterium avium subsp. paratuberculosis
ccacggccagcaccgcc

SEQ ID NO: 2986527 - RNA, 19 nt, Mycobacterium avium subsp. paratuberculosis
ccacggccagcaccgccag

SEQ ID NO: 2986528 - RNA, 16 nt, Mycobacterium avium subsp. paratuberculosis
ccacggccaugcagac

SEQ ID NO: 2986529 - RNA, 22 nt, Mycobacterium avium subsp. paratuberculosis
ccacggccaugcagaccagccc

SEQ ID NO: 2986530 - RNA, 16 nt, Mycobacterium avium subsp. paratuberculosis
ccacggccccagccgc

SEQ ID NO: 2986531 - RNA, 18 nt, Mycobacterium avium subsp. paratuberculosis
ccacggcccgcgccccgg

SEQ ID NO: 2986532 - RNA, 22 nt, Mycobacterium avium subsp. paratuberculosis
ccacggcccgcgccccggcggc

SEQ ID NO: 2986533 - RNA, 15 nt, Mycobacterium avium subsp. paratuberculosis
ccacggccgaugcag

SEQ ID NO: 2986534 - RNA, 20 nt, Mycobacterium avium subsp. paratuberculosis
ccacggccgcaacggcgguc

SEQ ID NO: 2986535 - RNA, 18 nt, Mycobacterium avium subsp. paratuberculosis
ccacggccgcagcggcag

SEQ ID NO: 2986536 - RNA, 14 nt, Mycobacterium avium subsp. paratuberculosis
ccacggccgcggcc

SEQ ID NO: 2986537 - RNA, 19 nt, Mycobacterium avium subsp. paratuberculosis
ccacggccgcggcccggcc

SEQ ID NO: 2986538 - RNA, 23 nt, Mycobacterium avium subsp. paratuberculosis
ccacggccgcggcccggccacca

SEQ ID NO: 2986539 - RNA, 13 nt, Mycobacterium avium subsp. paratuberculosis
ccacggccggcaa

SEQ ID NO: 2986540 - RNA, 14 nt, Mycobacterium avium subsp. paratuberculosis
ccacggcgaacacc

SEQ ID NO: 2986541 - RNA, 20 nt, Mycobacterium avium subsp. paratuberculosis
ccacggcgaccccguucgcc

SEQ ID NO: 2986542 - RNA, 20 nt, Mycobacterium avium subsp. paratuberculosis
ccacggcgacgaccaccagg

SEQ ID NO: 2986543 - RNA, 12 nt, Mycobacterium avium subsp. paratuberculosis
ccacggcgccau

SEQ ID NO: 2986544 - RNA, 18 nt, Mycobacterium avium subsp. paratuberculosis
ccacggcgcgaggacgau

SEQ ID NO: 2986545 - RNA, 15 nt, Mycobacterium avium subsp. paratuberculosis
ccacggcgcgugcug

SEQ ID NO: 2986546 - RNA, 19 nt, Mycobacterium avium subsp. paratuberculosis
ccacggcggaucaguaccg

SEQ ID NO: 2986547 - RNA, 12 nt, Mycobacterium avium subsp. paratuberculosis
ccacggcggccg

SEQ ID NO: 2986548 - RNA, 22 nt, Mycobacterium avium subsp. paratuberculosis
ccacggcggccgaauccggccg

SEQ ID NO: 2986549 - RNA, 22 nt, Mycobacterium avium subsp. paratuberculosis
ccacggcggggucaagcggcag

SEQ ID NO: 2986550 - RNA, 23 nt, Mycobacterium avium subsp. paratuberculosis
ccacggcggggucaagcggcaga

SEQ ID NO: 2986551 - RNA, 14 nt, Mycobacterium avium subsp. paratuberculosis
ccacgggaugcggc

SEQ ID NO: 2986552 - RNA, 16 nt, Mycobacterium avium subsp. paratuberculosis
ccacgggaugcggcac

SEQ ID NO: 2986553 - RNA, 17 nt, Mycobacterium avium subsp. paratuberculosis
ccacgggaugcggcacg

SEQ ID NO: 2986554 - RNA, 18 nt, Mycobacterium avium subsp. paratuberculosis
ccacgggaugcggcacgc

SEQ ID NO: 2986555 - RNA, 15 nt, Mycobacterium avium subsp. paratuberculosis
ccacgggccaugucc

SEQ ID NO: 2986556 - RNA, 15 nt, Mycobacterium avium subsp. paratuberculosis
ccacgggcggucgga

SEQ ID NO: 2986557 - RNA, 20 nt, Mycobacterium avium subsp. paratuberculosis
ccacgggcggucggacgcgg

SEQ ID NO: 2986558 - RNA, 23 nt, Mycobacterium avium subsp. paratuberculosis
ccacgggcggucggacgcgggga

SEQ ID NO: 2986559 - RNA, 16 nt, Mycobacterium avium subsp. paratuberculosis
ccacggggcccgcgac

SEQ ID NO: 2986560 - RNA, 15 nt, Mycobacterium avium subsp. paratuberculosis
ccacggggcgccgcu

SEQ ID NO: 2986561 - RNA, 17 nt, Mycobacterium avium subsp. paratuberculosis
ccacggggucgagaagc

SEQ ID NO: 2986562 - RNA, 14 nt, Mycobacterium avium subsp. paratuberculosis
ccacgggucgccga

SEQ ID NO: 2986563 - RNA, 13 nt, Mycobacterium avium subsp. paratuberculosis
ccacgggucgcug

SEQ ID NO: 2986564 - RNA, 13 nt, Mycobacterium avium subsp. paratuberculosis
ccacggucacagc

SEQ ID NO: 2986565 - RNA, 16 nt, Mycobacterium avium subsp. paratuberculosis
ccacggucacagccgc

SEQ ID NO: 2986566 - RNA, 15 nt, Mycobacterium avium subsp. paratuberculosis
ccacggucaccccga

SEQ ID NO: 2986567 - RNA, 16 nt, Mycobacterium avium subsp. paratuberculosis
ccacggucaccccgag

SEQ ID NO: 2986568 - RNA, 14 nt, Mycobacterium avium subsp. paratuberculosis
ccacggucagcgcg

SEQ ID NO: 2986569 - RNA, 15 nt, Mycobacterium avium subsp. paratuberculosis
ccacggucagcgcgu

SEQ ID NO: 2986570 - RNA, 17 nt, Mycobacterium avium subsp. paratuberculosis
ccacggucagcgcgucg

SEQ ID NO: 2986571 - RNA, 18 nt, Mycobacterium avium subsp. paratuberculosis
ccacggucagcgcgucgg

SEQ ID NO: 2986572 - RNA, 18 nt, Mycobacterium avium subsp. paratuberculosis
ccacggucagggccagca

SEQ ID NO: 2986573 - RNA, 18 nt, Mycobacterium avium subsp. paratuberculosis
ccacgguccccgcgcccg

SEQ ID NO: 2986574 - RNA, 19 nt, Mycobacterium avium subsp. paratuberculosis
ccacgguccccgcgcccgc

SEQ ID NO: 2986575 - RNA, 15 nt, Mycobacterium avium subsp. paratuberculosis
ccacggucgccgcgc

SEQ ID NO: 2986576 - RNA, 21 nt, Mycobacterium avium subsp. paratuberculosis
ccacggucgccgcgccgccgg

SEQ ID NO: 2986577 - RNA, 19 nt, Mycobacterium avium subsp. paratuberculosis
ccacggucuuugccggcca

SEQ ID NO: 2986578 - RNA, 16 nt, Mycobacterium avium subsp. paratuberculosis
ccacggugaggacacc

SEQ ID NO: 2986579 - RNA, 17 nt, Mycobacterium avium subsp. paratuberculosis
ccacggugaucucgccg

SEQ ID NO: 2986580 - RNA, 20 nt, Mycobacterium avium subsp. paratuberculosis
ccacggugaucucgccgagc

SEQ ID NO: 2986581 - RNA, 22 nt, Mycobacterium avium subsp. paratuberculosis
ccacggugaucucgccgagcac

SEQ ID NO: 2986582 - RNA, 23 nt, Mycobacterium avium subsp. paratuberculosis
ccacggugauuccggcacccgcc

SEQ ID NO: 2986583 - RNA, 21 nt, Mycobacterium avium subsp. paratuberculosis
ccacggugcgcaccgacauca

SEQ ID NO: 2986584 - RNA, 21 nt, Mycobacterium avium subsp. paratuberculosis
ccacggugcgcucgugaccgg

SEQ ID NO: 2986585 - RNA, 13 nt, Mycobacterium avium subsp. paratuberculosis
ccacgguggccgc

SEQ ID NO: 2986586 - RNA, 15 nt, Mycobacterium avium subsp. paratuberculosis
ccacgguggcgccgc

SEQ ID NO: 2986587 - RNA, 14 nt, Mycobacterium avium subsp. paratuberculosis
ccacgguggcgguc

SEQ ID NO: 2986588 - RNA, 17 nt, Mycobacterium avium subsp. paratuberculosis
ccacgguggcguccagc

SEQ ID NO: 2986589 - RNA, 18 nt, Mycobacterium avium subsp. paratuberculosis
ccacgguggcguccagcg

SEQ ID NO: 2986590 - RNA, 18 nt, Mycobacterium avium subsp. paratuberculosis
ccacguacaccgggaucg

SEQ ID NO: 2986591 - RNA, 15 nt, Mycobacterium avium subsp. paratuberculosis
ccacguacuccugcg

SEQ ID NO: 2986592 - RNA, 17 nt, Mycobacterium avium subsp. paratuberculosis
ccacguacuccugcgcg

SEQ ID NO: 2986593 - RNA, 21 nt, Mycobacterium avium subsp. paratuberculosis
ccacguagcagcagaccgcga

SEQ ID NO: 2986594 - RNA, 20 nt, Mycobacterium avium subsp. paratuberculosis
ccacguaggcgaucagcgcg

SEQ ID NO: 2986595 - RNA, 17 nt, Mycobacterium avium subsp. paratuberculosis
ccacguaggcgaugucg

SEQ ID NO: 2986596 - RNA, 19 nt, Mycobacterium avium subsp. paratuberculosis
ccacguaggcgaugucgac

SEQ ID NO: 2986597 - RNA, 21 nt, Mycobacterium avium subsp. paratuberculosis
ccacguaggcgaugucgacgu

SEQ ID NO: 2986598 - RNA, 17 nt, Mycobacterium avium subsp. paratuberculosis
ccacguaggggcccggg

SEQ ID NO: 2986599 - RNA, 13 nt, Mycobacterium avium subsp. paratuberculosis
ccacgucaccgac

SEQ ID NO: 2986600 - RNA, 15 nt, Mycobacterium avium subsp. paratuberculosis
ccacguccaccagca

SEQ ID NO: 2986601 - RNA, 13 nt, Mycobacterium avium subsp. paratuberculosis
ccacguccagcug

SEQ ID NO: 2986602 - RNA, 13 nt, Mycobacterium avium subsp. paratuberculosis
ccacguccccggg

SEQ ID NO: 2986603 - RNA, 14 nt, Mycobacterium avium subsp. paratuberculosis
ccacguccccgggc

SEQ ID NO: 2986604 - RNA, 17 nt, Mycobacterium avium subsp. paratuberculosis
ccacguccccgggcgug

SEQ ID NO: 2986605 - RNA, 15 nt, Mycobacterium avium subsp. paratuberculosis
ccacguccgcgguga

SEQ ID NO: 2986606 - RNA, 21 nt, Mycobacterium avium subsp. paratuberculosis
ccacguccgcggugagcaccg

SEQ ID NO: 2986607 - RNA, 17 nt, Mycobacterium avium subsp. paratuberculosis
ccacguccggaugcggc

SEQ ID NO: 2986608 - RNA, 19 nt, Mycobacterium avium subsp. paratuberculosis
ccacguccggaugcggcgc

SEQ ID NO: 2986609 - RNA, 20 nt, Mycobacterium avium subsp. paratuberculosis
ccacguccggaugcggcgcc

SEQ ID NO: 2986610 - RNA, 21 nt, Mycobacterium avium subsp. paratuberculosis
ccacgucgaacccgaccccgg

SEQ ID NO: 2986611 - RNA, 23 nt, Mycobacterium avium subsp. paratuberculosis
ccacgucgaacccgaccccggcg

SEQ ID NO: 2986612 - RNA, 17 nt, Mycobacterium avium subsp. paratuberculosis
ccacgucgaagcccggg

SEQ ID NO: 2986613 - RNA, 13 nt, Mycobacterium avium subsp. paratuberculosis
ccacgucgaugcc

SEQ ID NO: 2986614 - RNA, 21 nt, Mycobacterium avium subsp. paratuberculosis
ccacgucgaugccgaaccgcu

SEQ ID NO: 2986615 - RNA, 16 nt, Mycobacterium avium subsp. paratuberculosis
ccacgucgcccagcgu

SEQ ID NO: 2986616 - RNA, 12 nt, Mycobacterium avium subsp. paratuberculosis
ccacgucgccgu

SEQ ID NO: 2986617 - RNA, 12 nt, Mycobacterium avium subsp. paratuberculosis
ccacgucgcgcc

SEQ ID NO: 2986618 - RNA, 15 nt, Mycobacterium avium subsp. paratuberculosis
ccacgucgcgccgau

SEQ ID NO: 2986619 - RNA, 14 nt, Mycobacterium avium subsp. paratuberculosis
ccacgucggugccg

SEQ ID NO: 2986620 - RNA, 22 nt, Mycobacterium avium subsp. paratuberculosis
ccacgucggugccgcguucgga

SEQ ID NO: 2986621 - RNA, 15 nt, Mycobacterium avium subsp. paratuberculosis
ccacgucguccagcu

SEQ ID NO: 2986622 - RNA, 15 nt, Mycobacterium avium subsp. paratuberculosis
ccacgucgucggaca

SEQ ID NO: 2986623 - RNA, 17 nt, Mycobacterium avium subsp. paratuberculosis
ccacgucgucggacagc

SEQ ID NO: 2986624 - RNA, 20 nt, Mycobacterium avium subsp. paratuberculosis
ccacgucgucggacagcagc

SEQ ID NO: 2986625 - RNA, 13 nt, Mycobacterium avium subsp. paratuberculosis
ccacgucgucggc

SEQ ID NO: 2986626 - RNA, 14 nt, Mycobacterium avium subsp. paratuberculosis
ccacgucgucggcc

SEQ ID NO: 2986627 - RNA, 15 nt, Mycobacterium avium subsp. paratuberculosis
ccacgucgucggccu

SEQ ID NO: 2986628 - RNA, 19 nt, Mycobacterium avium subsp. paratuberculosis
ccacgucgucggccugcac

SEQ ID NO: 2986629 - RNA, 21 nt, Mycobacterium avium subsp. paratuberculosis
ccacgucgucggccugcacgu

SEQ ID NO: 2986630 - RNA, 15 nt, Mycobacterium avium subsp. paratuberculosis
ccacgugcacggcgc

SEQ ID NO: 2986631 - RNA, 15 nt, Mycobacterium avium subsp. paratuberculosis
ccacgugccacuggc

SEQ ID NO: 2986632 - RNA, 22 nt, Mycobacterium avium subsp. paratuberculosis
ccacgugccacuggcgccaccu

SEQ ID NO: 2986633 - RNA, 16 nt, Mycobacterium avium subsp. paratuberculosis
ccacgugccaucgcug

SEQ ID NO: 2986634 - RNA, 17 nt, Mycobacterium avium subsp. paratuberculosis
ccacgugccaucgcugg

SEQ ID NO: 2986635 - RNA, 15 nt, Mycobacterium avium subsp. paratuberculosis
ccacguggucgagca

SEQ ID NO: 2986636 - RNA, 19 nt, Mycobacterium avium subsp. paratuberculosis
ccacguggucgagcaugcg

SEQ ID NO: 2986637 - RNA, 14 nt, Mycobacterium avium subsp. paratuberculosis
ccacgugucggcgu

SEQ ID NO: 2986638 - RNA, 17 nt, Mycobacterium avium subsp. paratuberculosis
ccacgugucggcgucga

SEQ ID NO: 2986639 - RNA, 18 nt, Mycobacterium avium subsp. paratuberculosis
ccacgugucggcgucgau

SEQ ID NO: 2986640 - RNA, 14 nt, Mycobacterium avium subsp. paratuberculosis
ccacguugagcacg

SEQ ID NO: 2986641 - RNA, 17 nt, Mycobacterium avium subsp. paratuberculosis
ccacguugaugccgccc

SEQ ID NO: 2986642 - RNA, 19 nt, Mycobacterium avium subsp. paratuberculosis
ccacguugaugccgcccag

SEQ ID NO: 2986643 - RNA, 22 nt, Mycobacterium avium subsp. paratuberculosis
ccacguugaugccgcccagcag

SEQ ID NO: 2986644 - RNA, 18 nt, Mycobacterium avium subsp. paratuberculosis
ccacguugcacggcagca

SEQ ID NO: 2986645 - RNA, 15 nt, Mycobacterium avium subsp. paratuberculosis
ccacguugccgggua

SEQ ID NO: 2986646 - RNA, 19 nt, Mycobacterium avium subsp. paratuberculosis
ccacguugccggguaucga

SEQ ID NO: 2986647 - RNA, 15 nt, Mycobacterium avium subsp. paratuberculosis
ccacguugcgcccgg

SEQ ID NO: 2986648 - RNA, 22 nt, Mycobacterium avium subsp. paratuberculosis
ccacguugcgcccggccaucug

SEQ ID NO: 2986649 - RNA, 16 nt, Mycobacterium avium subsp. paratuberculosis
ccacguugcgcggccg

SEQ ID NO: 2986650 - RNA, 18 nt, Mycobacterium avium subsp. paratuberculosis
ccacguugcgcggccgca

SEQ ID NO: 2986651 - RNA, 18 nt, Mycobacterium avium subsp. paratuberculosis
ccacuccaauacggcccg

SEQ ID NO: 2986652 - RNA, 14 nt, Mycobacterium avium subsp. paratuberculosis
ccacuccaccaccg

SEQ ID NO: 2986653 - RNA, 14 nt, Mycobacterium avium subsp. paratuberculosis
ccacuccagcaccg

SEQ ID NO: 2986654 - RNA, 16 nt, Mycobacterium avium subsp. paratuberculosis
ccacuccagcaccgga

SEQ ID NO: 2986655 - RNA, 21 nt, Mycobacterium avium subsp. paratuberculosis
ccacuccaggguucucgcggc

SEQ ID NO: 2986656 - RNA, 18 nt, Mycobacterium avium subsp. paratuberculosis
ccacucccagccgccggc

SEQ ID NO: 2986657 - RNA, 19 nt, Mycobacterium avium subsp. paratuberculosis
ccacucccagccgccggcc

SEQ ID NO: 2986658 - RNA, 14 nt, Mycobacterium avium subsp. paratuberculosis
ccacucccgcgcgc

SEQ ID NO: 2986659 - RNA, 20 nt, Mycobacterium avium subsp. paratuberculosis
ccacucgcguccccgcgccg

SEQ ID NO: 2986660 - RNA, 13 nt, Mycobacterium avium subsp. paratuberculosis
ccacucggacagg

SEQ ID NO: 2986661 - RNA, 19 nt, Mycobacterium avium subsp. paratuberculosis
ccacucggacagguggccg

SEQ ID NO: 2986662 - RNA, 22 nt, Mycobacterium avium subsp. paratuberculosis
ccacucggacagguggccgauc

SEQ ID NO: 2986663 - RNA, 13 nt, Mycobacterium avium subsp. paratuberculosis
ccacucggccacc

SEQ ID NO: 2986664 - RNA, 22 nt, Mycobacterium avium subsp. paratuberculosis
ccacucgggaaaugcgucggca

SEQ ID NO: 2986665 - RNA, 15 nt, Mycobacterium avium subsp. paratuberculosis
ccacucgggcggccg

SEQ ID NO: 2986666 - RNA, 16 nt, Mycobacterium avium subsp. paratuberculosis
ccacucgggcggccgc

SEQ ID NO: 2986667 - RNA, 17 nt, Mycobacterium avium subsp. paratuberculosis
ccacucgucgaucgacg

SEQ ID NO: 2986668 - RNA, 14 nt, Mycobacterium avium subsp. paratuberculosis
ccacucgucgaugu

SEQ ID NO: 2986669 - RNA, 17 nt, Mycobacterium avium subsp. paratuberculosis
ccacugagcgcaggccg

SEQ ID NO: 2986670 - RNA, 21 nt, Mycobacterium avium subsp. paratuberculosis
ccacugccaagacguccgcgu

SEQ ID NO: 2986671 - RNA, 17 nt, Mycobacterium avium subsp. paratuberculosis
ccacugcccguagucgg

SEQ ID NO: 2986672 - RNA, 23 nt, Mycobacterium avium subsp. paratuberculosis
ccacugcccguagucggcggcga

SEQ ID NO: 2986673 - RNA, 14 nt, Mycobacterium avium subsp. paratuberculosis
ccacugccgccgcc

SEQ ID NO: 2986674 - RNA, 19 nt, Mycobacterium avium subsp. paratuberculosis
ccacugccgccgcccaggc

SEQ ID NO: 2986675 - RNA, 20 nt, Mycobacterium avium subsp. paratuberculosis
ccacugccgccgcccaggcc

SEQ ID NO: 2986676 - RNA, 21 nt, Mycobacterium avium subsp. paratuberculosis
ccacugccgccgcccaggccg

SEQ ID NO: 2986677 - RNA, 20 nt, Mycobacterium avium subsp. paratuberculosis
ccacugccugacccggccgu

SEQ ID NO: 2986678 - RNA, 15 nt, Mycobacterium avium subsp. paratuberculosis
ccacugcgccgucau

SEQ ID NO: 2986679 - RNA, 13 nt, Mycobacterium avium subsp. paratuberculosis
ccacugcgcgccc

SEQ ID NO: 2986680 - RNA, 14 nt, Mycobacterium avium subsp. paratuberculosis
ccacugcgcgcccg

SEQ ID NO: 2986681 - RNA, 16 nt, Mycobacterium avium subsp. paratuberculosis
ccacuggcgccaccuc

SEQ ID NO: 2986682 - RNA, 14 nt, Mycobacterium avium subsp. paratuberculosis
ccacuggcggccgg

SEQ ID NO: 2986683 - RNA, 15 nt, Mycobacterium avium subsp. paratuberculosis
ccacuggcggccggc

SEQ ID NO: 2986684 - RNA, 16 nt, Mycobacterium avium subsp. paratuberculosis
ccacuggcggccggcc

SEQ ID NO: 2986685 - RNA, 17 nt, Mycobacterium avium subsp. paratuberculosis
ccacuggcggccggccg

SEQ ID NO: 2986686 - RNA, 21 nt, Mycobacterium avium subsp. paratuberculosis
ccacuggcggccggccgcgcc

SEQ ID NO: 2986687 - RNA, 19 nt, Mycobacterium avium subsp. paratuberculosis
ccacuggcuggucacccac

SEQ ID NO: 2986688 - RNA, 21 nt, Mycobacterium avium subsp. paratuberculosis
ccacugggcgucggcgccccc

SEQ ID NO: 2986689 - RNA, 16 nt, Mycobacterium avium subsp. paratuberculosis
ccacugguaaccgccc

SEQ ID NO: 2986690 - RNA, 20 nt, Mycobacterium avium subsp. paratuberculosis
ccacuggucguugcacaccc

SEQ ID NO: 2986691 - RNA, 21 nt, Mycobacterium avium subsp. paratuberculosis
ccacuggucguugcacacccg

SEQ ID NO: 2986692 - RNA, 15 nt, Mycobacterium avium subsp. paratuberculosis
ccacuuacgcgagcg

SEQ ID NO: 2986693 - RNA, 12 nt, Mycobacterium avium subsp. paratuberculosis
ccacuuccagca

SEQ ID NO: 2986694 - RNA, 22 nt, Mycobacterium avium subsp. paratuberculosis
ccacuuccgcgcagggacgggc

SEQ ID NO: 2986695 - RNA, 16 nt, Mycobacterium avium subsp. paratuberculosis
ccacuucgacggcagc

SEQ ID NO: 2986696 - RNA, 21 nt, Mycobacterium avium subsp. paratuberculosis
ccacuucgacggcagcggcac

SEQ ID NO: 2986697 - RNA, 16 nt, Mycobacterium avium subsp. paratuberculosis
ccacuucuccacgccg

SEQ ID NO: 2986698 - RNA, 16 nt, Mycobacterium avium subsp. paratuberculosis
ccagaaaucgccggga

SEQ ID NO: 2986699 - RNA, 20 nt, Mycobacterium avium subsp. paratuberculosis
ccagaacacgccccggcggg

SEQ ID NO: 2986700 - RNA, 19 nt, Mycobacterium avium subsp. paratuberculosis
ccagaacacguuucggccc

SEQ ID NO: 2986701 - RNA, 20 nt, Mycobacterium avium subsp. paratuberculosis
ccagaacacguuucggcccu

SEQ ID NO: 2986702 - RNA, 17 nt, Mycobacterium avium subsp. paratuberculosis
ccagaacagccagucga

SEQ ID NO: 2986703 - RNA, 16 nt, Mycobacterium avium subsp. paratuberculosis
ccagaaccgcucggcg

SEQ ID NO: 2986704 - RNA, 19 nt, Mycobacterium avium subsp. paratuberculosis
ccagaaccgcucggcggcg

SEQ ID NO: 2986705 - RNA, 22 nt, Mycobacterium avium subsp. paratuberculosis
ccagaaccgcucggcggcgccg

SEQ ID NO: 2986706 - RNA, 13 nt, Mycobacterium avium subsp. paratuberculosis
ccagaaccggcag

SEQ ID NO: 2986707 - RNA, 14 nt, Mycobacterium avium subsp. paratuberculosis
ccagaacgacgcgc

SEQ ID NO: 2986708 - RNA, 22 nt, Mycobacterium avium subsp. paratuberculosis
ccagaacgacgcgcucagcccc

SEQ ID NO: 2986709 - RNA, 23 nt, Mycobacterium avium subsp. paratuberculosis
ccagaacgacgcgcucagcccca

SEQ ID NO: 2986710 - RNA, 14 nt, Mycobacterium avium subsp. paratuberculosis
ccagaacggcggca

SEQ ID NO: 2986711 - RNA, 16 nt, Mycobacterium avium subsp. paratuberculosis
ccagaacggcggcagc

SEQ ID NO: 2986712 - RNA, 17 nt, Mycobacterium avium subsp. paratuberculosis
ccagaacggcggcagcg

SEQ ID NO: 2986713 - RNA, 23 nt, Mycobacterium avium subsp. paratuberculosis
ccagaacggcggcagcgaggcgc

SEQ ID NO: 2986714 - RNA, 19 nt, Mycobacterium avium subsp. paratuberculosis
ccagaacucggcggcgguu

SEQ ID NO: 2986715 - RNA, 15 nt, Mycobacterium avium subsp. paratuberculosis
ccagaacugguccuc

SEQ ID NO: 2986716 - RNA, 18 nt, Mycobacterium avium subsp. paratuberculosis
ccagaagaucugccggug

SEQ ID NO: 2986717 - RNA, 22 nt, Mycobacterium avium subsp. paratuberculosis
ccagaagaucugccggugccgc

SEQ ID NO: 2986718 - RNA, 23 nt, Mycobacterium avium subsp. paratuberculosis
ccagaagaucugccggugccgcc

SEQ ID NO: 2986719 - RNA, 16 nt, Mycobacterium avium subsp. paratuberculosis
ccagacaggccggccg

SEQ ID NO: 2986720 - RNA, 17 nt, Mycobacterium avium subsp. paratuberculosis
ccagacaggccggccgc

SEQ ID NO: 2986721 - RNA, 15 nt, Mycobacterium avium subsp. paratuberculosis
ccagaccacaagggc

SEQ ID NO: 2986722 - RNA, 20 nt, Mycobacterium avium subsp. paratuberculosis
ccagaccacaagggccaccg

SEQ ID NO: 2986723 - RNA, 23 nt, Mycobacterium avium subsp. paratuberculosis
ccagaccacaagggccaccgggc

SEQ ID NO: 2986724 - RNA, 15 nt, Mycobacterium avium subsp. paratuberculosis
ccagacccagcaucg

SEQ ID NO: 2986725 - RNA, 18 nt, Mycobacterium avium subsp. paratuberculosis
ccagacccagcaucgccg

SEQ ID NO: 2986726 - RNA, 21 nt, Mycobacterium avium subsp. paratuberculosis
ccagaccgaagaucaccgcga

SEQ ID NO: 2986727 - RNA, 15 nt, Mycobacterium avium subsp. paratuberculosis
ccagaccggccgggg

SEQ ID NO: 2986728 - RNA, 21 nt, Mycobacterium avium subsp. paratuberculosis
ccagaccggccggggcgggca

SEQ ID NO: 2986729 - RNA, 23 nt, Mycobacterium avium subsp. paratuberculosis
ccagaccggccggggcgggcacg

SEQ ID NO: 2986730 - RNA, 15 nt, Mycobacterium avium subsp. paratuberculosis
ccagaccggcggcga

SEQ ID NO: 2986731 - RNA, 17 nt, Mycobacterium avium subsp. paratuberculosis
ccagaccggcggcgauc

SEQ ID NO: 2986732 - RNA, 23 nt, Mycobacterium avium subsp. paratuberculosis
ccagaccguggaggacgaggccc

SEQ ID NO: 2986733 - RNA, 19 nt, Mycobacterium avium subsp. paratuberculosis
ccagaccguucuccgaggc

SEQ ID NO: 2986734 - RNA, 15 nt, Mycobacterium avium subsp. paratuberculosis
ccagaccucgccgac

SEQ ID NO: 2986735 - RNA, 15 nt, Mycobacterium avium subsp. paratuberculosis
ccagacgaacgcggc

SEQ ID NO: 2986736 - RNA, 17 nt, Mycobacterium avium subsp. paratuberculosis
ccagacgaacgcggccg

SEQ ID NO: 2986737 - RNA, 19 nt, Mycobacterium avium subsp. paratuberculosis
ccagacgaacgcggccgcc

SEQ ID NO: 2986738 - RNA, 20 nt, Mycobacterium avium subsp. paratuberculosis
ccagacgaacgcggccgcca

SEQ ID NO: 2986739 - RNA, 19 nt, Mycobacterium avium subsp. paratuberculosis
ccagacgauuugggcgguc

SEQ ID NO: 2986740 - RNA, 21 nt, Mycobacterium avium subsp. paratuberculosis
ccagacgauuugggcgguccg

SEQ ID NO: 2986741 - RNA, 23 nt, Mycobacterium avium subsp. paratuberculosis
ccagacgauuugggcgguccgcu

SEQ ID NO: 2986742 - RNA, 16 nt, Mycobacterium avium subsp. paratuberculosis
ccagacgcgcaccgcc

SEQ ID NO: 2986743 - RNA, 19 nt, Mycobacterium avium subsp. paratuberculosis
ccagacgcgcaccgccacc

SEQ ID NO: 2986744 - RNA, 23 nt, Mycobacterium avium subsp. paratuberculosis
ccagacgcgcaccgccaccgccc

SEQ ID NO: 2986745 - RNA, 13 nt, Mycobacterium avium subsp. paratuberculosis
ccagacgcgggcg

SEQ ID NO: 2986746 - RNA, 17 nt, Mycobacterium avium subsp. paratuberculosis
ccagacgcgggcgccca

SEQ ID NO: 2986747 - RNA, 19 nt, Mycobacterium avium subsp. paratuberculosis
ccagacgcgggcgcccagc

SEQ ID NO: 2986748 - RNA, 20 nt, Mycobacterium avium subsp. paratuberculosis
ccagacgcgggcgcccagca

SEQ ID NO: 2986749 - RNA, 21 nt, Mycobacterium avium subsp. paratuberculosis
ccagacgcgggcgcccagcaa

SEQ ID NO: 2986750 - RNA, 20 nt, Mycobacterium avium subsp. paratuberculosis
ccagacgguggggcuggccg

SEQ ID NO: 2986751 - RNA, 24 nt, Mycobacterium avium subsp. paratuberculosis
ccagacgguggggcuggccgcacg

SEQ ID NO: 2986752 - RNA, 20 nt, Mycobacterium avium subsp. paratuberculosis
ccagacgguuccaccggucg

SEQ ID NO: 2986753 - RNA, 15 nt, Mycobacterium avium subsp. paratuberculosis
ccagacguccagcgc

SEQ ID NO: 2986754 - RNA, 16 nt, Mycobacterium avium subsp. paratuberculosis
ccagacguccagcgcc

SEQ ID NO: 2986755 - RNA, 18 nt, Mycobacterium avium subsp. paratuberculosis
ccagacguccagcgccgc

SEQ ID NO: 2986756 - RNA, 20 nt, Mycobacterium avium subsp. paratuberculosis
ccagacguccagcgccgcca

SEQ ID NO: 2986757 - RNA, 22 nt, Mycobacterium avium subsp. paratuberculosis
ccagacguccagcgccgccauc

SEQ ID NO: 2986758 - RNA, 14 nt, Mycobacterium avium subsp. paratuberculosis
ccagacgucggcgu

SEQ ID NO: 2986759 - RNA, 15 nt, Mycobacterium avium subsp. paratuberculosis
ccagacgucggcgua

SEQ ID NO: 2986760 - RNA, 15 nt, Mycobacterium avium subsp. paratuberculosis
ccagacguguggcac

SEQ ID NO: 2986761 - RNA, 18 nt, Mycobacterium avium subsp. paratuberculosis
ccagacguguggcacccg

SEQ ID NO: 2986762 - RNA, 21 nt, Mycobacterium avium subsp. paratuberculosis
ccagacguuuccguccggcga

SEQ ID NO: 2986763 - RNA, 15 nt, Mycobacterium avium subsp. paratuberculosis
ccagacucacggcgg

SEQ ID NO: 2986764 - RNA, 18 nt, Mycobacterium avium subsp. paratuberculosis
ccagacucacggcggcag

SEQ ID NO: 2986765 - RNA, 19 nt, Mycobacterium avium subsp. paratuberculosis
ccagacucacggcggcagc

SEQ ID NO: 2986766 - RNA, 16 nt, Mycobacterium avium subsp. paratuberculosis
ccagacugaugcccuc

SEQ ID NO: 2986767 - RNA, 14 nt, Mycobacterium avium subsp. paratuberculosis
ccagacugcgcacc

SEQ ID NO: 2986768 - RNA, 22 nt, Mycobacterium avium subsp. paratuberculosis
ccagacugcgcaccgccagcac

SEQ ID NO: 2986769 - RNA, 16 nt, Mycobacterium avium subsp. paratuberculosis
ccagacuugggcagca

SEQ ID NO: 2986770 - RNA, 22 nt, Mycobacterium avium subsp. paratuberculosis
ccagagcaucagggcguugauc

SEQ ID NO: 2986771 - RNA, 17 nt, Mycobacterium avium subsp. paratuberculosis
ccagagcgccggacucg

SEQ ID NO: 2986772 - RNA, 19 nt, Mycobacterium avium subsp. paratuberculosis
ccagagcgcgaaaaccagc

SEQ ID NO: 2986773 - RNA, 21 nt, Mycobacterium avium subsp. paratuberculosis
ccagagcgcgaaaaccagcac

SEQ ID NO: 2986774 - RNA, 23 nt, Mycobacterium avium subsp. paratuberculosis
ccagagcgcgaaaaccagcaccg

SEQ ID NO: 2986775 - RNA, 19 nt, Mycobacterium avium subsp. paratuberculosis
ccagauacgccgcgacgau

SEQ ID NO: 2986776 - RNA, 22 nt, Mycobacterium avium subsp. paratuberculosis
ccagauagaugagccgcagccg

SEQ ID NO: 2986777 - RNA, 14 nt, Mycobacterium avium subsp. paratuberculosis
ccagauaggccagc

SEQ ID NO: 2986778 - RNA, 16 nt, Mycobacterium avium subsp. paratuberculosis
ccagauaggccagcgc

SEQ ID NO: 2986779 - RNA, 17 nt, Mycobacterium avium subsp. paratuberculosis
ccagauaggccagcgcg

SEQ ID NO: 2986780 - RNA, 18 nt, Mycobacterium avium subsp. paratuberculosis
ccagauaggccagcgcgu

SEQ ID NO: 2986781 - RNA, 22 nt, Mycobacterium avium subsp. paratuberculosis
ccagauaggccagcgcgugauc

SEQ ID NO: 2986782 - RNA, 14 nt, Mycobacterium avium subsp. paratuberculosis
ccagauagggcagc

SEQ ID NO: 2986783 - RNA, 16 nt, Mycobacterium avium subsp. paratuberculosis
ccagauagggcagcgu

SEQ ID NO: 2986784 - RNA, 21 nt, Mycobacterium avium subsp. paratuberculosis
ccagauagggcagcgucccgu

SEQ ID NO: 2986785 - RNA, 20 nt, Mycobacterium avium subsp. paratuberculosis
ccagaucagcguggucagcg

SEQ ID NO: 2986786 - RNA, 12 nt, Mycobacterium avium subsp. paratuberculosis
ccagaucgaccc

SEQ ID NO: 2986787 - RNA, 20 nt, Mycobacterium avium subsp. paratuberculosis
ccagaucgacccccaccgcg

SEQ ID NO: 2986788 - RNA, 23 nt, Mycobacterium avium subsp. paratuberculosis
ccagaucgacccccaccgcgaca

SEQ ID NO: 2986789 - RNA, 14 nt, Mycobacterium avium subsp. paratuberculosis
ccagaucgacgccg

SEQ ID NO: 2986790 - RNA, 16 nt, Mycobacterium avium subsp. paratuberculosis
ccagaucgacgccgac

SEQ ID NO: 2986791 - RNA, 21 nt, Mycobacterium avium subsp. paratuberculosis
ccagaucgacgccgaccgcgg

SEQ ID NO: 2986792 - RNA, 15 nt, Mycobacterium avium subsp. paratuberculosis
ccagaucgacgccgc

SEQ ID NO: 2986793 - RNA, 18 nt, Mycobacterium avium subsp. paratuberculosis
ccagaucgagcugggccc

SEQ ID NO: 2986794 - RNA, 22 nt, Mycobacterium avium subsp. paratuberculosis
ccagaucgagcugggcccgcgc

SEQ ID NO: 2986795 - RNA, 17 nt, Mycobacterium avium subsp. paratuberculosis
ccagaucgccccgcugg

SEQ ID NO: 2986796 - RNA, 17 nt, Mycobacterium avium subsp. paratuberculosis
ccagaucgcccgggcgg

SEQ ID NO: 2986797 - RNA, 18 nt, Mycobacterium avium subsp. paratuberculosis
ccagaucgcccgggcggc

SEQ ID NO: 2986798 - RNA, 20 nt, Mycobacterium avium subsp. paratuberculosis
ccagaucgcccgggcggcgg

SEQ ID NO: 2986799 - RNA, 21 nt, Mycobacterium avium subsp. paratuberculosis
ccagaucgcccgggcggcggg

SEQ ID NO: 2986800 - RNA, 13 nt, Mycobacterium avium subsp. paratuberculosis
ccagaucgccgac

SEQ ID NO: 2986801 - RNA, 17 nt, Mycobacterium avium subsp. paratuberculosis
ccagaucgccgacccgg

SEQ ID NO: 2986802 - RNA, 12 nt, Mycobacterium avium subsp. paratuberculosis
ccagaucgccgc

SEQ ID NO: 2986803 - RNA, 14 nt, Mycobacterium avium subsp. paratuberculosis
ccagaucgccuggc

SEQ ID NO: 2986804 - RNA, 12 nt, Mycobacterium avium subsp. paratuberculosis
ccagaucggcca

SEQ ID NO: 2986805 - RNA, 16 nt, Mycobacterium avium subsp. paratuberculosis
ccagaucggccagcca

SEQ ID NO: 2986806 - RNA, 18 nt, Mycobacterium avium subsp. paratuberculosis
ccagaucggccagccacg

SEQ ID NO: 2986807 - RNA, 23 nt, Mycobacterium avium subsp. paratuberculosis
ccagaucggccagccacgccgac

SEQ ID NO: 2986808 - RNA, 17 nt, Mycobacterium avium subsp. paratuberculosis
ccagaucggccagcgcg

SEQ ID NO: 2986809 - RNA, 21 nt, Mycobacterium avium subsp. paratuberculosis
ccagaucggccagcgcggccg

SEQ ID NO: 2986810 - RNA, 13 nt, Mycobacterium avium subsp. paratuberculosis
ccagaucggcgcg

SEQ ID NO: 2986811 - RNA, 13 nt, Mycobacterium avium subsp. paratuberculosis
ccagaucggcggg

SEQ ID NO: 2986812 - RNA, 21 nt, Mycobacterium avium subsp. paratuberculosis
ccagaucggcgggugcgggcg

SEQ ID NO: 2986813 - RNA, 21 nt, Mycobacterium avium subsp. paratuberculosis
ccagaucguagggcucggcgu

SEQ ID NO: 2986814 - RNA, 14 nt, Mycobacterium avium subsp. paratuberculosis
ccagaucgucgggc

SEQ ID NO: 2986815 - RNA, 20 nt, Mycobacterium avium subsp. paratuberculosis
ccagaucguguccgcgccgg

SEQ ID NO: 2986816 - RNA, 21 nt, Mycobacterium avium subsp. paratuberculosis
ccagaucguguccgcgccggc

SEQ ID NO: 2986817 - RNA, 21 nt, Mycobacterium avium subsp. paratuberculosis
ccagaucuccgccuucgacga

SEQ ID NO: 2986818 - RNA, 13 nt, Mycobacterium avium subsp. paratuberculosis
ccagaugcaggcu

SEQ ID NO: 2986819 - RNA, 14 nt, Mycobacterium avium subsp. paratuberculosis
ccagaugcccagca

SEQ ID NO: 2986820 - RNA, 16 nt, Mycobacterium avium subsp. paratuberculosis
ccagaugcccagcagg

SEQ ID NO: 2986821 - RNA, 20 nt, Mycobacterium avium subsp. paratuberculosis
ccagaugcccagcggcaugg

SEQ ID NO: 2986822 - RNA, 14 nt, Mycobacterium avium subsp. paratuberculosis
ccagaugcccgccc

SEQ ID NO: 2986823 - RNA, 15 nt, Mycobacterium avium subsp. paratuberculosis
ccagaugcccgcccc

SEQ ID NO: 2986824 - RNA, 16 nt, Mycobacterium avium subsp. paratuberculosis
ccagaugcccgccccg

SEQ ID NO: 2986825 - RNA, 22 nt, Mycobacterium avium subsp. paratuberculosis
ccagaugcccgccccgcccggc

SEQ ID NO: 2986826 - RNA, 23 nt, Mycobacterium avium subsp. paratuberculosis
ccagaugcccgccccgcccggcg

SEQ ID NO: 2986827 - RNA, 17 nt, Mycobacterium avium subsp. paratuberculosis
ccagaugccgccgccag

SEQ ID NO: 2986828 - RNA, 16 nt, Mycobacterium avium subsp. paratuberculosis
ccagaugccgcucggc

SEQ ID NO: 2986829 - RNA, 12 nt, Mycobacterium avium subsp. paratuberculosis
ccagaugccggg

SEQ ID NO: 2986830 - RNA, 15 nt, Mycobacterium avium subsp. paratuberculosis
ccagaugccgggugg

SEQ ID NO: 2986831 - RNA, 14 nt, Mycobacterium avium subsp. paratuberculosis
ccagaugcgccgcg

SEQ ID NO: 2986832 - RNA, 15 nt, Mycobacterium avium subsp. paratuberculosis
ccagaugcgccgcgg

SEQ ID NO: 2986833 - RNA, 14 nt, Mycobacterium avium subsp. paratuberculosis
ccagauucaccagc

SEQ ID NO: 2986834 - RNA, 15 nt, Mycobacterium avium subsp. paratuberculosis
ccagauucaccagcg

SEQ ID NO: 2986835 - RNA, 17 nt, Mycobacterium avium subsp. paratuberculosis
ccagauucaccagcgcc

SEQ ID NO: 2986836 - RNA, 16 nt, Mycobacterium avium subsp. paratuberculosis
ccagauugcggcacca

SEQ ID NO: 2986837 - RNA, 22 nt, Mycobacterium avium subsp. paratuberculosis
ccagauugcggcaccagucgcg

SEQ ID NO: 2986838 - RNA, 14 nt, Mycobacterium avium subsp. paratuberculosis
ccagcaaacccagc

SEQ ID NO: 2986839 - RNA, 18 nt, Mycobacterium avium subsp. paratuberculosis
ccagcaaacccagcacca

SEQ ID NO: 2986840 - RNA, 22 nt, Mycobacterium avium subsp. paratuberculosis
ccagcaaacccagcaccaacag

SEQ ID NO: 2986841 - RNA, 17 nt, Mycobacterium avium subsp. paratuberculosis
ccagcaacaccagcugg

SEQ ID NO: 2986842 - RNA, 21 nt, Mycobacterium avium subsp. paratuberculosis
ccagcaacaccuuucggccgc

SEQ ID NO: 2986843 - RNA, 22 nt, Mycobacterium avium subsp. paratuberculosis
ccagcaacaccuuucggccgcg

SEQ ID NO: 2986844 - RNA, 23 nt, Mycobacterium avium subsp. paratuberculosis
ccagcaacaccuuucggccgcgg

SEQ ID NO: 2986845 - RNA, 18 nt, Mycobacterium avium subsp. paratuberculosis
ccagcaaccccgcggugc

SEQ ID NO: 2986846 - RNA, 20 nt, Mycobacterium avium subsp. paratuberculosis
ccagcaaccccgcggugcac

SEQ ID NO: 2986847 - RNA, 21 nt, Mycobacterium avium subsp. paratuberculosis
ccagcaaccccgcggugcacg

SEQ ID NO: 2986848 - RNA, 16 nt, Mycobacterium avium subsp. paratuberculosis
ccagcaaccgccgugg

SEQ ID NO: 2986849 - RNA, 19 nt, Mycobacterium avium subsp. paratuberculosis
ccagcaaccggaauggcag

SEQ ID NO: 2986850 - RNA, 14 nt, Mycobacterium avium subsp. paratuberculosis
ccagcaacgacccg

SEQ ID NO: 2986851 - RNA, 17 nt, Mycobacterium avium subsp. paratuberculosis
ccagcaacgacccggcc

SEQ ID NO: 2986852 - RNA, 20 nt, Mycobacterium avium subsp. paratuberculosis
ccagcaacgacccggccacc

SEQ ID NO: 2986853 - RNA, 21 nt, Mycobacterium avium subsp. paratuberculosis
ccagcaacgacccggccaccg

SEQ ID NO: 2986854 - RNA, 11 nt, Mycobacterium avium subsp. paratuberculosis
ccagcaacgcc

SEQ ID NO: 2986855 - RNA, 14 nt, Mycobacterium avium subsp. paratuberculosis
ccagcaacgccgac

SEQ ID NO: 2986856 - RNA, 16 nt, Mycobacterium avium subsp. paratuberculosis
ccagcaacgccgacau

SEQ ID NO: 2986857 - RNA, 17 nt, Mycobacterium avium subsp. paratuberculosis
ccagcaacgccgacauc

SEQ ID NO: 2986858 - RNA, 15 nt, Mycobacterium avium subsp. paratuberculosis
ccagcacagccgucg

SEQ ID NO: 2986859 - RNA, 19 nt, Mycobacterium avium subsp. paratuberculosis
ccagcacagccgucgcacu

SEQ ID NO: 2986860 - RNA, 17 nt, Mycobacterium avium subsp. paratuberculosis
ccagcacagcgaggcga

SEQ ID NO: 2986861 - RNA, 18 nt, Mycobacterium avium subsp. paratuberculosis
ccagcaccaacagcggcc

SEQ ID NO: 2986862 - RNA, 19 nt, Mycobacterium avium subsp. paratuberculosis
ccagcaccaacagcggccc

SEQ ID NO: 2986863 - RNA, 13 nt, Mycobacterium avium subsp. paratuberculosis
ccagcaccaccac

SEQ ID NO: 2986864 - RNA, 14 nt, Mycobacterium avium subsp. paratuberculosis
ccagcaccaccacg

SEQ ID NO: 2986865 - RNA, 15 nt, Mycobacterium avium subsp. paratuberculosis
ccagcaccaccacgc

SEQ ID NO: 2986866 - RNA, 18 nt, Mycobacterium avium subsp. paratuberculosis
ccagcaccaccacgcugg

SEQ ID NO: 2986867 - RNA, 20 nt, Mycobacterium avium subsp. paratuberculosis
ccagcaccaccacgcuggcc

SEQ ID NO: 2986868 - RNA, 21 nt, Mycobacterium avium subsp. paratuberculosis
ccagcaccacccggucgaugu

SEQ ID NO: 2986869 - RNA, 14 nt, Mycobacterium avium subsp. paratuberculosis
ccagcaccaccguc

SEQ ID NO: 2986870 - RNA, 15 nt, Mycobacterium avium subsp. paratuberculosis
ccagcaccaccgugg

SEQ ID NO: 2986871 - RNA, 19 nt, Mycobacterium avium subsp. paratuberculosis
ccagcaccaccguggcgau

SEQ ID NO: 2986872 - RNA, 20 nt, Mycobacterium avium subsp. paratuberculosis
ccagcaccaccguggcgaug

SEQ ID NO: 2986873 - RNA, 23 nt, Mycobacterium avium subsp. paratuberculosis
ccagcaccaccguggcgaugggc

SEQ ID NO: 2986874 - RNA, 19 nt, Mycobacterium avium subsp. paratuberculosis
ccagcaccaccucgcgcgg

SEQ ID NO: 2986875 - RNA, 15 nt, Mycobacterium avium subsp. paratuberculosis
ccagcaccaccuugu

SEQ ID NO: 2986876 - RNA, 15 nt, Mycobacterium avium subsp. paratuberculosis
ccagcaccacgguga

SEQ ID NO: 2986877 - RNA, 20 nt, Mycobacterium avium subsp. paratuberculosis
ccagcaccacguccgcggug

SEQ ID NO: 2986878 - RNA, 14 nt, Mycobacterium avium subsp. paratuberculosis
ccagcaccagcacg

SEQ ID NO: 2986879 - RNA, 14 nt, Mycobacterium avium subsp. paratuberculosis
ccagcaccagcagc

SEQ ID NO: 2986880 - RNA, 17 nt, Mycobacterium avium subsp. paratuberculosis
ccagcaccagcagccgg

SEQ ID NO: 2986881 - RNA, 12 nt, Mycobacterium avium subsp. paratuberculosis
ccagcaccagcc

SEQ ID NO: 2986882 - RNA, 15 nt, Mycobacterium avium subsp. paratuberculosis
ccagcaccagcccga

SEQ ID NO: 2986883 - RNA, 20 nt, Mycobacterium avium subsp. paratuberculosis
ccagcaccaggaaggcgacc

SEQ ID NO: 2986884 - RNA, 23 nt, Mycobacterium avium subsp. paratuberculosis
ccagcaccaggaaggcgaccgcg

SEQ ID NO: 2986885 - RNA, 20 nt, Mycobacterium avium subsp. paratuberculosis
ccagcaccaguucgcguacc

SEQ ID NO: 2986886 - RNA, 12 nt, Mycobacterium avium subsp. paratuberculosis
ccagcacccaga

SEQ ID NO: 2986887 - RNA, 14 nt, Mycobacterium avium subsp. paratuberculosis
ccagcacccagcac

SEQ ID NO: 2986888 - RNA, 15 nt, Mycobacterium avium subsp. paratuberculosis
ccagcacccagcaca

SEQ ID NO: 2986889 - RNA, 12 nt, Mycobacterium avium subsp. paratuberculosis
ccagcaccccgc

SEQ ID NO: 2986890 - RNA, 16 nt, Mycobacterium avium subsp. paratuberculosis
ccagcaccccggucca

SEQ ID NO: 2986891 - RNA, 20 nt, Mycobacterium avium subsp. paratuberculosis
ccagcaccccgguccaggcg

SEQ ID NO: 2986892 - RNA, 13 nt, Mycobacterium avium subsp. paratuberculosis
ccagcaccccguc

SEQ ID NO: 2986893 - RNA, 16 nt, Mycobacterium avium subsp. paratuberculosis
ccagcacccgcucgcc

SEQ ID NO: 2986894 - RNA, 19 nt, Mycobacterium avium subsp. paratuberculosis
ccagcacccgcucgccgau

SEQ ID NO: 2986895 - RNA, 22 nt, Mycobacterium avium subsp. paratuberculosis
ccagcacccgcugauccagcag

SEQ ID NO: 2986896 - RNA, 13 nt, Mycobacterium avium subsp. paratuberculosis
ccagcacccggcc

SEQ ID NO: 2986897 - RNA, 14 nt, Mycobacterium avium subsp. paratuberculosis
ccagcacccggccc

SEQ ID NO: 2986898 - RNA, 15 nt, Mycobacterium avium subsp. paratuberculosis
ccagcacccggccca

SEQ ID NO: 2986899 - RNA, 21 nt, Mycobacterium avium subsp. paratuberculosis
ccagcacccggcccacgccgu

SEQ ID NO: 2986900 - RNA, 15 nt, Mycobacterium avium subsp. paratuberculosis
ccagcacccgggccu

SEQ ID NO: 2986901 - RNA, 22 nt, Mycobacterium avium subsp. paratuberculosis
ccagcacccgguuccaccgggc

SEQ ID NO: 2986902 - RNA, 19 nt, Mycobacterium avium subsp. paratuberculosis
ccagcaccgacagucccac

SEQ ID NO: 2986903 - RNA, 17 nt, Mycobacterium avium subsp. paratuberculosis
ccagcaccgagaucucg

SEQ ID NO: 2986904 - RNA, 15 nt, Mycobacterium avium subsp. paratuberculosis
ccagcaccgcauccc

SEQ ID NO: 2986905 - RNA, 22 nt, Mycobacterium avium subsp. paratuberculosis
ccagcaccgcaucccccucggc

SEQ ID NO: 2986906 - RNA, 11 nt, Mycobacterium avium subsp. paratuberculosis
ccagcaccgcc

SEQ ID NO: 2986907 - RNA, 12 nt, Mycobacterium avium subsp. paratuberculosis
ccagcaccgcca

SEQ ID NO: 2986908 - RNA, 13 nt, Mycobacterium avium subsp. paratuberculosis
ccagcaccgccac

SEQ ID NO: 2986909 - RNA, 15 nt, Mycobacterium avium subsp. paratuberculosis
ccagcaccgccaccg

SEQ ID NO: 2986910 - RNA, 16 nt, Mycobacterium avium subsp. paratuberculosis
ccagcaccgccagcgc

SEQ ID NO: 2986911 - RNA, 14 nt, Mycobacterium avium subsp. paratuberculosis
ccagcaccgccccg

SEQ ID NO: 2986912 - RNA, 20 nt, Mycobacterium avium subsp. paratuberculosis
ccagcaccgccccggucacc

SEQ ID NO: 2986913 - RNA, 12 nt, Mycobacterium avium subsp. paratuberculosis
ccagcaccgccg

SEQ ID NO: 2986914 - RNA, 15 nt, Mycobacterium avium subsp. paratuberculosis
ccagcaccgccgcgg

SEQ ID NO: 2986915 - RNA, 16 nt, Mycobacterium avium subsp. paratuberculosis
ccagcaccgccgcggc

SEQ ID NO: 2986916 - RNA, 17 nt, Mycobacterium avium subsp. paratuberculosis
ccagcaccgccgcggcc

SEQ ID NO: 2986917 - RNA, 20 nt, Mycobacterium avium subsp. paratuberculosis
ccagcaccgccgcggccgcg

SEQ ID NO: 2986918 - RNA, 13 nt, Mycobacterium avium subsp. paratuberculosis
ccagcaccgccgg

SEQ ID NO: 2986919 - RNA, 16 nt, Mycobacterium avium subsp. paratuberculosis
ccagcaccgccggcgc

SEQ ID NO: 2986920 - RNA, 14 nt, Mycobacterium avium subsp. paratuberculosis
ccagcaccgcgacg

SEQ ID NO: 2986921 - RNA, 18 nt, Mycobacterium avium subsp. paratuberculosis
ccagcaccgcgacgaucg

SEQ ID NO: 2986922 - RNA, 12 nt, Mycobacterium avium subsp. paratuberculosis
ccagcaccgcgg

SEQ ID NO: 2986923 - RNA, 13 nt, Mycobacterium avium subsp. paratuberculosis
ccagcaccgcggc

SEQ ID NO: 2986924 - RNA, 14 nt, Mycobacterium avium subsp. paratuberculosis
ccagcaccgcggcc

SEQ ID NO: 2986925 - RNA, 17 nt, Mycobacterium avium subsp. paratuberculosis
ccagcaccgcggccguc

SEQ ID NO: 2986926 - RNA, 18 nt, Mycobacterium avium subsp. paratuberculosis
ccagcaccgcggccgucg

SEQ ID NO: 2986927 - RNA, 15 nt, Mycobacterium avium subsp. paratuberculosis
ccagcaccgcggcga

SEQ ID NO: 2986928 - RNA, 22 nt, Mycobacterium avium subsp. paratuberculosis
ccagcaccgcggcgaucgccgu

SEQ ID NO: 2986929 - RNA, 16 nt, Mycobacterium avium subsp. paratuberculosis
ccagcaccgcgucgau

SEQ ID NO: 2986930 - RNA, 20 nt, Mycobacterium avium subsp. paratuberculosis
ccagcaccggaugcucaccg

SEQ ID NO: 2986931 - RNA, 23 nt, Mycobacterium avium subsp. paratuberculosis
ccagcaccggaugcucaccgguc

SEQ ID NO: 2986932 - RNA, 17 nt, Mycobacterium avium subsp. paratuberculosis
ccagcaccggcaccgcc

SEQ ID NO: 2986933 - RNA, 13 nt, Mycobacterium avium subsp. paratuberculosis
ccagcaccggcgc

SEQ ID NO: 2986934 - RNA, 14 nt, Mycobacterium avium subsp. paratuberculosis
ccagcaccggcgcc

SEQ ID NO: 2986935 - RNA, 15 nt, Mycobacterium avium subsp. paratuberculosis
ccagcaccggcgcca

SEQ ID NO: 2986936 - RNA, 15 nt, Mycobacterium avium subsp. paratuberculosis
ccagcaccggcgccc

SEQ ID NO: 2986937 - RNA, 22 nt, Mycobacterium avium subsp. paratuberculosis
ccagcaccggcgccccgggcag

SEQ ID NO: 2986938 - RNA, 14 nt, Mycobacterium avium subsp. paratuberculosis
ccagcaccggcugg

SEQ ID NO: 2986939 - RNA, 16 nt, Mycobacterium avium subsp. paratuberculosis
ccagcaccgggcccag

SEQ ID NO: 2986940 - RNA, 17 nt, Mycobacterium avium subsp. paratuberculosis
ccagcaccgucggcgug

SEQ ID NO: 2986941 - RNA, 12 nt, Mycobacterium avium subsp. paratuberculosis
ccagcaccgucu

SEQ ID NO: 2986942 - RNA, 16 nt, Mycobacterium avium subsp. paratuberculosis
ccagcaccgucugcgc

SEQ ID NO: 2986943 - RNA, 16 nt, Mycobacterium avium subsp. paratuberculosis
ccagcaccucgaacgc

SEQ ID NO: 2986944 - RNA, 15 nt, Mycobacterium avium subsp. paratuberculosis
ccagcaccucgcggc

SEQ ID NO: 2986945 - RNA, 18 nt, Mycobacterium avium subsp. paratuberculosis
ccagcaccucgcggcagc

SEQ ID NO: 2986946 - RNA, 20 nt, Mycobacterium avium subsp. paratuberculosis
ccagcaccucggcgaccacg

SEQ ID NO: 2986947 - RNA, 18 nt, Mycobacterium avium subsp. paratuberculosis
ccagcaccugaccgucgg

SEQ ID NO: 2986948 - RNA, 20 nt, Mycobacterium avium subsp. paratuberculosis
ccagcaccugaccgucggcc

SEQ ID NO: 2986949 - RNA, 19 nt, Mycobacterium avium subsp. paratuberculosis
ccagcaccuggcgcaccgc

SEQ ID NO: 2986950 - RNA, 18 nt, Mycobacterium avium subsp. paratuberculosis
ccagcaccuucagcgggc

SEQ ID NO: 2986951 - RNA, 17 nt, Mycobacterium avium subsp. paratuberculosis
ccagcacgaaggccgcc

SEQ ID NO: 2986952 - RNA, 18 nt, Mycobacterium avium subsp. paratuberculosis
ccagcacgaaggccgccg

SEQ ID NO: 2986953 - RNA, 19 nt, Mycobacterium avium subsp. paratuberculosis
ccagcacgaaggccgccgg

SEQ ID NO: 2986954 - RNA, 13 nt, Mycobacterium avium subsp. paratuberculosis
ccagcacgacacc

SEQ ID NO: 2986955 - RNA, 19 nt, Mycobacterium avium subsp. paratuberculosis
ccagcacgacaccgacgac

SEQ ID NO: 2986956 - RNA, 16 nt, Mycobacterium avium subsp. paratuberculosis
ccagcacgaccccgcc

SEQ ID NO: 2986957 - RNA, 19 nt, Mycobacterium avium subsp. paratuberculosis
ccagcacgaccccgcccac

SEQ ID NO: 2986958 - RNA, 20 nt, Mycobacterium avium subsp. paratuberculosis
ccagcacgaccccgcccacg

SEQ ID NO: 2986959 - RNA, 19 nt, Mycobacterium avium subsp. paratuberculosis
ccagcacgacgccgcuggg

SEQ ID NO: 2986960 - RNA, 18 nt, Mycobacterium avium subsp. paratuberculosis
ccagcacgaucccgccgc

SEQ ID NO: 2986961 - RNA, 14 nt, Mycobacterium avium subsp. paratuberculosis
ccagcacgaugacg

SEQ ID NO: 2986962 - RNA, 16 nt, Mycobacterium avium subsp. paratuberculosis
ccagcacgaugacgac

SEQ ID NO: 2986963 - RNA, 20 nt, Mycobacterium avium subsp. paratuberculosis
ccagcacgaugacgaccggg

SEQ ID NO: 2986964 - RNA, 13 nt, Mycobacterium avium subsp. paratuberculosis
ccagcacgcaggc

SEQ ID NO: 2986965 - RNA, 22 nt, Mycobacterium avium subsp. paratuberculosis
ccagcacgcccagaugcaggcu

SEQ ID NO: 2986966 - RNA, 17 nt, Mycobacterium avium subsp. paratuberculosis
ccagcacgccggucagc

SEQ ID NO: 2986967 - RNA, 14 nt, Mycobacterium avium subsp. paratuberculosis
ccagcacgccuucc

SEQ ID NO: 2986968 - RNA, 13 nt, Mycobacterium avium subsp. paratuberculosis
ccagcacgcugcg

SEQ ID NO: 2986969 - RNA, 17 nt, Mycobacterium avium subsp. paratuberculosis
ccagcacgcugcggaug

SEQ ID NO: 2986970 - RNA, 21 nt, Mycobacterium avium subsp. paratuberculosis
ccagcacgcugcggaugucgg

SEQ ID NO: 2986971 - RNA, 12 nt, Mycobacterium avium subsp. paratuberculosis
ccagcacggcca

SEQ ID NO: 2986972 - RNA, 14 nt, Mycobacterium avium subsp. paratuberculosis
ccagcacggccacc

SEQ ID NO: 2986973 - RNA, 19 nt, Mycobacterium avium subsp. paratuberculosis
ccagcacggccaccagcag

SEQ ID NO: 2986974 - RNA, 22 nt, Mycobacterium avium subsp. paratuberculosis
ccagcacggccagccagccgcc

SEQ ID NO: 2986975 - RNA, 14 nt, Mycobacterium avium subsp. paratuberculosis
ccagcacggcgaag

SEQ ID NO: 2986976 - RNA, 17 nt, Mycobacterium avium subsp. paratuberculosis
ccagcacggcgaccagc

SEQ ID NO: 2986977 - RNA, 12 nt, Mycobacterium avium subsp. paratuberculosis
ccagcacggcgg

SEQ ID NO: 2986978 - RNA, 13 nt, Mycobacterium avium subsp. paratuberculosis
ccagcacggcggc

SEQ ID NO: 2986979 - RNA, 15 nt, Mycobacterium avium subsp. paratuberculosis
ccagcacggcggcgc

SEQ ID NO: 2986980 - RNA, 17 nt, Mycobacterium avium subsp. paratuberculosis
ccagcacggcggcgcug

SEQ ID NO: 2986981 - RNA, 18 nt, Mycobacterium avium subsp. paratuberculosis
ccagcacggcggcgcuga

SEQ ID NO: 2986982 - RNA, 19 nt, Mycobacterium avium subsp. paratuberculosis
ccagcacggcggcgcugau

SEQ ID NO: 2986983 - RNA, 17 nt, Mycobacterium avium subsp. paratuberculosis
ccagcacggucagcggc

SEQ ID NO: 2986984 - RNA, 18 nt, Mycobacterium avium subsp. paratuberculosis
ccagcacggucagcggcc

SEQ ID NO: 2986985 - RNA, 20 nt, Mycobacterium avium subsp. paratuberculosis
ccagcacggucagcggccag

SEQ ID NO: 2986986 - RNA, 15 nt, Mycobacterium avium subsp. paratuberculosis
ccagcacggucccgu

SEQ ID NO: 2986987 - RNA, 14 nt, Mycobacterium avium subsp. paratuberculosis
ccagcacggugaug

SEQ ID NO: 2986988 - RNA, 19 nt, Mycobacterium avium subsp. paratuberculosis
ccagcacggugaugcgggu

SEQ ID NO: 2986989 - RNA, 13 nt, Mycobacterium avium subsp. paratuberculosis
ccagcacggugcg

SEQ ID NO: 2986990 - RNA, 22 nt, Mycobacterium avium subsp. paratuberculosis
ccagcacggugcguucgcguuc

SEQ ID NO: 2986991 - RNA, 15 nt, Mycobacterium avium subsp. paratuberculosis
ccagcacgucaccgc

SEQ ID NO: 2986992 - RNA, 18 nt, Mycobacterium avium subsp. paratuberculosis
ccagcacgucaccgcuga

SEQ ID NO: 2986993 - RNA, 16 nt, Mycobacterium avium subsp. paratuberculosis
ccagcacgucggggug

SEQ ID NO: 2986994 - RNA, 21 nt, Mycobacterium avium subsp. paratuberculosis
ccagcacgucgggguggccgg

SEQ ID NO: 2986995 - RNA, 23 nt, Mycobacterium avium subsp. paratuberculosis
ccagcacgucgggguggccggcc

SEQ ID NO: 2986996 - RNA, 16 nt, Mycobacterium avium subsp. paratuberculosis
ccagcacgugaugcag

SEQ ID NO: 2986997 - RNA, 17 nt, Mycobacterium avium subsp. paratuberculosis
ccagcacgugaugcagc

SEQ ID NO: 2986998 - RNA, 20 nt, Mycobacterium avium subsp. paratuberculosis
ccagcacgugaugcagcuga

SEQ ID NO: 2986999 - RNA, 17 nt, Mycobacterium avium subsp. paratuberculosis
ccagcacgugcccagcc

SEQ ID NO: 2987000 - RNA, 15 nt, Mycobacterium avium subsp. paratuberculosis
ccagcacguggccgg

SEQ ID NO: 2987001 - RNA, 19 nt, Mycobacterium avium subsp. paratuberculosis
ccagcacguggccgggcuc

SEQ ID NO: 2987002 - RNA, 20 nt, Mycobacterium avium subsp. paratuberculosis
ccagcacguggccgggcucg

SEQ ID NO: 2987003 - RNA, 21 nt, Mycobacterium avium subsp. paratuberculosis
ccagcacguugugcucgucga

SEQ ID NO: 2987004 - RNA, 18 nt, Mycobacterium avium subsp. paratuberculosis
ccagcagauacuccucgc

SEQ ID NO: 2987005 - RNA, 14 nt, Mycobacterium avium subsp. paratuberculosis
ccagcagcaacgcg

SEQ ID NO: 2987006 - RNA, 18 nt, Mycobacterium avium subsp. paratuberculosis
ccagcagcaacgcggugu

SEQ ID NO: 2987007 - RNA, 13 nt, Mycobacterium avium subsp. paratuberculosis
ccagcagcaccag

SEQ ID NO: 2987008 - RNA, 22 nt, Mycobacterium avium subsp. paratuberculosis
ccagcagcaccagaugcaccuc

SEQ ID NO: 2987009 - RNA, 14 nt, Mycobacterium avium subsp. paratuberculosis
ccagcagcaccagg

SEQ ID NO: 2987010 - RNA, 18 nt, Mycobacterium avium subsp. paratuberculosis
ccagcagcaccagggcgu

SEQ ID NO: 2987011 - RNA, 13 nt, Mycobacterium avium subsp. paratuberculosis
ccagcagcaccgc

SEQ ID NO: 2987012 - RNA, 14 nt, Mycobacterium avium subsp. paratuberculosis
ccagcagcaccgcg

SEQ ID NO: 2987013 - RNA, 15 nt, Mycobacterium avium subsp. paratuberculosis
ccagcagcaccgcga

SEQ ID NO: 2987014 - RNA, 17 nt, Mycobacterium avium subsp. paratuberculosis
ccagcagcaccgcgacc

SEQ ID NO: 2987015 - RNA, 14 nt, Mycobacterium avium subsp. paratuberculosis
ccagcagcacggca

SEQ ID NO: 2987016 - RNA, 23 nt, Mycobacterium avium subsp. paratuberculosis
ccagcagcagcaggucgucgauc

SEQ ID NO: 2987017 - RNA, 16 nt, Mycobacterium avium subsp. paratuberculosis
ccagcagcagcccgcc

SEQ ID NO: 2987018 - RNA, 18 nt, Mycobacterium avium subsp. paratuberculosis
ccagcagcagcccgccga

SEQ ID NO: 2987019 - RNA, 20 nt, Mycobacterium avium subsp. paratuberculosis
ccagcagcagcccgccgaug

SEQ ID NO: 2987020 - RNA, 13 nt, Mycobacterium avium subsp. paratuberculosis
ccagcagcagccg

SEQ ID NO: 2987021 - RNA, 20 nt, Mycobacterium avium subsp. paratuberculosis
ccagcagcagccgcgccgcc

SEQ ID NO: 2987022 - RNA, 21 nt, Mycobacterium avium subsp. paratuberculosis
ccagcagcagccgcgccgccg

SEQ ID NO: 2987023 - RNA, 17 nt, Mycobacterium avium subsp. paratuberculosis
ccagcagcagcgccgcc

SEQ ID NO: 2987024 - RNA, 19 nt, Mycobacterium avium subsp. paratuberculosis
ccagcagcagcgccgccac

SEQ ID NO: 2987025 - RNA, 20 nt, Mycobacterium avium subsp. paratuberculosis
ccagcagcagcgccgccacc

SEQ ID NO: 2987026 - RNA, 21 nt, Mycobacterium avium subsp. paratuberculosis
ccagcagcagcgccgccaccg

SEQ ID NO: 2987027 - RNA, 23 nt, Mycobacterium avium subsp. paratuberculosis
ccagcagcagcgccgccaccggc

SEQ ID NO: 2987028 - RNA, 14 nt, Mycobacterium avium subsp. paratuberculosis
ccagcagcagcgcg

SEQ ID NO: 2987029 - RNA, 18 nt, Mycobacterium avium subsp. paratuberculosis
ccagcagcagcgcggcau

SEQ ID NO: 2987030 - RNA, 22 nt, Mycobacterium avium subsp. paratuberculosis
ccagcagcagcgcggcauggcu

SEQ ID NO: 2987031 - RNA, 13 nt, Mycobacterium avium subsp. paratuberculosis
ccagcagcaggua

SEQ ID NO: 2987032 - RNA, 23 nt, Mycobacterium avium subsp. paratuberculosis
ccagcagcagguagcggcugacc

SEQ ID NO: 2987033 - RNA, 16 nt, Mycobacterium avium subsp. paratuberculosis
ccagcagccagcccag

SEQ ID NO: 2987034 - RNA, 17 nt, Mycobacterium avium subsp. paratuberculosis
ccagcagccagcccagc

SEQ ID NO: 2987035 - RNA, 16 nt, Mycobacterium avium subsp. paratuberculosis
ccagcagccagcuggu

SEQ ID NO: 2987036 - RNA, 15 nt, Mycobacterium avium subsp. paratuberculosis
ccagcagccaggauc

SEQ ID NO: 2987037 - RNA, 20 nt, Mycobacterium avium subsp. paratuberculosis
ccagcagccaggauccgaug

SEQ ID NO: 2987038 - RNA, 15 nt, Mycobacterium avium subsp. paratuberculosis
ccagcagcccggcca

SEQ ID NO: 2987039 - RNA, 13 nt, Mycobacterium avium subsp. paratuberculosis
ccagcagcccggg

SEQ ID NO: 2987040 - RNA, 15 nt, Mycobacterium avium subsp. paratuberculosis
ccagcagcccgggcu

SEQ ID NO: 2987041 - RNA, 17 nt, Mycobacterium avium subsp. paratuberculosis
ccagcagccgcagcgcg

SEQ ID NO: 2987042 - RNA, 17 nt, Mycobacterium avium subsp. paratuberculosis
ccagcagccgcgccgac

SEQ ID NO: 2987043 - RNA, 20 nt, Mycobacterium avium subsp. paratuberculosis
ccagcagccgcgccgacgcc

SEQ ID NO: 2987044 - RNA, 14 nt, Mycobacterium avium subsp. paratuberculosis
ccagcagccgcgcg

SEQ ID NO: 2987045 - RNA, 15 nt, Mycobacterium avium subsp. paratuberculosis
ccagcagccgcgcga

SEQ ID NO: 2987046 - RNA, 17 nt, Mycobacterium avium subsp. paratuberculosis
ccagcagccgguacagc

SEQ ID NO: 2987047 - RNA, 21 nt, Mycobacterium avium subsp. paratuberculosis
ccagcagccggucgaggucgc

SEQ ID NO: 2987048 - RNA, 9 nt, Mycobacterium avium subsp. paratuberculosis
ccagcagcg

SEQ ID NO: 2987049 - RNA, 20 nt, Mycobacterium avium subsp. paratuberculosis
ccagcagcgagaaccggcgc

SEQ ID NO: 2987050 - RNA, 22 nt, Mycobacterium avium subsp. paratuberculosis
ccagcagcgagaaccggcgcag

SEQ ID NO: 2987051 - RNA, 23 nt, Mycobacterium avium subsp. paratuberculosis
ccagcagcgagaaccggcgcaga

SEQ ID NO: 2987052 - RNA, 16 nt, Mycobacterium avium subsp. paratuberculosis
ccagcagcgagaccgg

SEQ ID NO: 2987053 - RNA, 19 nt, Mycobacterium avium subsp. paratuberculosis
ccagcagcgagaccggcac

SEQ ID NO: 2987054 - RNA, 15 nt, Mycobacterium avium subsp. paratuberculosis
ccagcagcgcaccgg

SEQ ID NO: 2987055 - RNA, 16 nt, Mycobacterium avium subsp. paratuberculosis
ccagcagcgcaccggc

SEQ ID NO: 2987056 - RNA, 21 nt, Mycobacterium avium subsp. paratuberculosis
ccagcagcgcaccggcgaugc

SEQ ID NO: 2987057 - RNA, 23 nt, Mycobacterium avium subsp. paratuberculosis
ccagcagcgcaccggcgaugcag

SEQ ID NO: 2987058 - RNA, 12 nt, Mycobacterium avium subsp. paratuberculosis
ccagcagcgcca

SEQ ID NO: 2987059 - RNA, 13 nt, Mycobacterium avium subsp. paratuberculosis
ccagcagcgccag

SEQ ID NO: 2987060 - RNA, 17 nt, Mycobacterium avium subsp. paratuberculosis
ccagcagcgccagcacc

SEQ ID NO: 2987061 - RNA, 19 nt, Mycobacterium avium subsp. paratuberculosis
ccagcagcgccagcaccgc

SEQ ID NO: 2987062 - RNA, 13 nt, Mycobacterium avium subsp. paratuberculosis
ccagcagcgccgc

SEQ ID NO: 2987063 - RNA, 14 nt, Mycobacterium avium subsp. paratuberculosis
ccagcagcgccgcu

SEQ ID NO: 2987064 - RNA, 16 nt, Mycobacterium avium subsp. paratuberculosis
ccagcagcgccgcuuc

SEQ ID NO: 2987065 - RNA, 14 nt, Mycobacterium avium subsp. paratuberculosis
ccagcagcgccggc

SEQ ID NO: 2987066 - RNA, 15 nt, Mycobacterium avium subsp. paratuberculosis
ccagcagcgccggca

SEQ ID NO: 2987067 - RNA, 16 nt, Mycobacterium avium subsp. paratuberculosis
ccagcagcgccggcag

SEQ ID NO: 2987068 - RNA, 19 nt, Mycobacterium avium subsp. paratuberculosis
ccagcagcgccggcagcgc

SEQ ID NO: 2987069 - RNA, 12 nt, Mycobacterium avium subsp. paratuberculosis
ccagcagcgccu

SEQ ID NO: 2987070 - RNA, 13 nt, Mycobacterium avium subsp. paratuberculosis
ccagcagcgccuc

SEQ ID NO: 2987071 - RNA, 20 nt, Mycobacterium avium subsp. paratuberculosis
ccagcagcgccucggcgauc

SEQ ID NO: 2987072 - RNA, 22 nt, Mycobacterium avium subsp. paratuberculosis
ccagcagcgccucggcgaucgg

SEQ ID NO: 2987073 - RNA, 16 nt, Mycobacterium avium subsp. paratuberculosis
ccagcagcgccuugcc

SEQ ID NO: 2987074 - RNA, 21 nt, Mycobacterium avium subsp. paratuberculosis
ccagcagcgccuugccgacga

SEQ ID NO: 2987075 - RNA, 17 nt, Mycobacterium avium subsp. paratuberculosis
ccagcagcgcgccgcgc

SEQ ID NO: 2987076 - RNA, 17 nt, Mycobacterium avium subsp. paratuberculosis
ccagcagcgcggcgauc

SEQ ID NO: 2987077 - RNA, 21 nt, Mycobacterium avium subsp. paratuberculosis
ccagcagcgcgucgcgggccc

SEQ ID NO: 2987078 - RNA, 13 nt, Mycobacterium avium subsp. paratuberculosis
ccagcagcggcac

SEQ ID NO: 2987079 - RNA, 14 nt, Mycobacterium avium subsp. paratuberculosis
ccagcagcggcacc

SEQ ID NO: 2987080 - RNA, 14 nt, Mycobacterium avium subsp. paratuberculosis
ccagcagcggccgg

SEQ ID NO: 2987081 - RNA, 15 nt, Mycobacterium avium subsp. paratuberculosis
ccagcagcggccggc

SEQ ID NO: 2987082 - RNA, 17 nt, Mycobacterium avium subsp. paratuberculosis
ccagcagcggccggcgc

SEQ ID NO: 2987083 - RNA, 18 nt, Mycobacterium avium subsp. paratuberculosis
ccagcagcggccggcgca

SEQ ID NO: 2987084 - RNA, 18 nt, Mycobacterium avium subsp. paratuberculosis
ccagcagcggcucggccu

SEQ ID NO: 2987085 - RNA, 16 nt, Mycobacterium avium subsp. paratuberculosis
ccagcagcgggcccgg

SEQ ID NO: 2987086 - RNA, 14 nt, Mycobacterium avium subsp. paratuberculosis
ccagcagcggggcg

SEQ ID NO: 2987087 - RNA, 14 nt, Mycobacterium avium subsp. paratuberculosis
ccagcagcggggug

SEQ ID NO: 2987088 - RNA, 21 nt, Mycobacterium avium subsp. paratuberculosis
ccagcagcggggugugcucgg

SEQ ID NO: 2987089 - RNA, 19 nt, Mycobacterium avium subsp. paratuberculosis
ccagcagcgucacgucgac

SEQ ID NO: 2987090 - RNA, 14 nt, Mycobacterium avium subsp. paratuberculosis
ccagcagcgucguc

SEQ ID NO: 2987091 - RNA, 12 nt, Mycobacterium avium subsp. paratuberculosis
ccagcagcgugg

SEQ ID NO: 2987092 - RNA, 13 nt, Mycobacterium avium subsp. paratuberculosis
ccagcagcguggg

SEQ ID NO: 2987093 - RNA, 22 nt, Mycobacterium avium subsp. paratuberculosis
ccagcagcugcgcgucgaagaa

SEQ ID NO: 2987094 - RNA, 22 nt, Mycobacterium avium subsp. paratuberculosis
ccagcagcuguugcggcgucag

SEQ ID NO: 2987095 - RNA, 20 nt, Mycobacterium avium subsp. paratuberculosis
ccagcagcuucaugcccgcg

SEQ ID NO: 2987096 - RNA, 19 nt, Mycobacterium avium subsp. paratuberculosis
ccagcaggacgcgcccggc

SEQ ID NO: 2987097 - RNA, 21 nt, Mycobacterium avium subsp. paratuberculosis
ccagcaggacgcgcccggcga

SEQ ID NO: 2987098 - RNA, 23 nt, Mycobacterium avium subsp. paratuberculosis
ccagcaggacgcgcccggcgacg

SEQ ID NO: 2987099 - RNA, 23 nt, Mycobacterium avium subsp. paratuberculosis
ccagcaggaucuggugcgcgcgc

SEQ ID NO: 2987100 - RNA, 16 nt, Mycobacterium avium subsp. paratuberculosis
ccagcaggccccguuc

SEQ ID NO: 2987101 - RNA, 14 nt, Mycobacterium avium subsp. paratuberculosis
ccagcaggcgcgcc

SEQ ID NO: 2987102 - RNA, 16 nt, Mycobacterium avium subsp. paratuberculosis
ccagcaggcgcgccga

SEQ ID NO: 2987103 - RNA, 17 nt, Mycobacterium avium subsp. paratuberculosis
ccagcaggcgcgccgag

SEQ ID NO: 2987104 - RNA, 18 nt, Mycobacterium avium subsp. paratuberculosis
ccagcaggcgcgccgagc

SEQ ID NO: 2987105 - RNA, 16 nt, Mycobacterium avium subsp. paratuberculosis
ccagcaggcuggcguu

SEQ ID NO: 2987106 - RNA, 16 nt, Mycobacterium avium subsp. paratuberculosis
ccagcagggacauccg

SEQ ID NO: 2987107 - RNA, 22 nt, Mycobacterium avium subsp. paratuberculosis
ccagcagggcaucucccgcgcg

SEQ ID NO: 2987108 - RNA, 14 nt, Mycobacterium avium subsp. paratuberculosis
ccagcagggcgccg

SEQ ID NO: 2987109 - RNA, 15 nt, Mycobacterium avium subsp. paratuberculosis
ccagcagggcgccga

SEQ ID NO: 2987110 - RNA, 15 nt, Mycobacterium avium subsp. paratuberculosis
ccagcagggcggcga

SEQ ID NO: 2987111 - RNA, 13 nt, Mycobacterium avium subsp. paratuberculosis
ccagcagggucag

SEQ ID NO: 2987112 - RNA, 23 nt, Mycobacterium avium subsp. paratuberculosis
ccagcagguagaagccgcgacgg

SEQ ID NO: 2987113 - RNA, 23 nt, Mycobacterium avium subsp. paratuberculosis
ccagcagguagaucgccagcgcc

SEQ ID NO: 2987114 - RNA, 21 nt, Mycobacterium avium subsp. paratuberculosis
ccagcagguccauggccuuga

SEQ ID NO: 2987115 - RNA, 15 nt, Mycobacterium avium subsp. paratuberculosis
ccagcagguccgccg

SEQ ID NO: 2987116 - RNA, 16 nt, Mycobacterium avium subsp. paratuberculosis
ccagcagguccgccgg

SEQ ID NO: 2987117 - RNA, 18 nt, Mycobacterium avium subsp. paratuberculosis
ccagcagguccgccggug

SEQ ID NO: 2987118 - RNA, 20 nt, Mycobacterium avium subsp. paratuberculosis
ccagcaggucgaaggcggcc

SEQ ID NO: 2987119 - RNA, 22 nt, Mycobacterium avium subsp. paratuberculosis
ccagcaggucgaaggcggccgc

SEQ ID NO: 2987120 - RNA, 19 nt, Mycobacterium avium subsp. paratuberculosis
ccagcaggucgaucugcgg

SEQ ID NO: 2987121 - RNA, 13 nt, Mycobacterium avium subsp. paratuberculosis
ccagcaggucguc

SEQ ID NO: 2987122 - RNA, 18 nt, Mycobacterium avium subsp. paratuberculosis
ccagcaggucgucgacgu

SEQ ID NO: 2987123 - RNA, 20 nt, Mycobacterium avium subsp. paratuberculosis
ccagcaggucgucgacgucc

SEQ ID NO: 2987124 - RNA, 20 nt, Mycobacterium avium subsp. paratuberculosis
ccagcaguccggcggucagc

SEQ ID NO: 2987125 - RNA, 15 nt, Mycobacterium avium subsp. paratuberculosis
ccagcagucgugacg

SEQ ID NO: 2987126 - RNA, 18 nt, Mycobacterium avium subsp. paratuberculosis
ccagcagugccaacacgg

SEQ ID NO: 2987127 - RNA, 21 nt, Mycobacterium avium subsp. paratuberculosis
ccagcagugccaacacggcgg

SEQ ID NO: 2987128 - RNA, 23 nt, Mycobacterium avium subsp. paratuberculosis
ccagcagugccaacacggcggcg

SEQ ID NO: 2987129 - RNA, 17 nt, Mycobacterium avium subsp. paratuberculosis
ccagcagugccaccacc

SEQ ID NO: 2987130 - RNA, 15 nt, Mycobacterium avium subsp. paratuberculosis
ccagcaguguccagu

SEQ ID NO: 2987131 - RNA, 22 nt, Mycobacterium avium subsp. paratuberculosis
ccagcaguguccagucggccgu

SEQ ID NO: 2987132 - RNA, 23 nt, Mycobacterium avium subsp. paratuberculosis
ccagcaguguccagucggccgug

SEQ ID NO: 2987133 - RNA, 13 nt, Mycobacterium avium subsp. paratuberculosis
ccagcaguucguc

SEQ ID NO: 2987134 - RNA, 22 nt, Mycobacterium avium subsp. paratuberculosis
ccagcaguucguccacgcuggc

SEQ ID NO: 2987135 - RNA, 21 nt, Mycobacterium avium subsp. paratuberculosis
ccagcaguuuggucauccgcu

SEQ ID NO: 2987136 - RNA, 24 nt, Mycobacterium avium subsp. paratuberculosis
ccagcaguuuguccugcucggcga

SEQ ID NO: 2987137 - RNA, 19 nt, Mycobacterium avium subsp. paratuberculosis
ccagcaucgccgcggugcg

SEQ ID NO: 2987138 - RNA, 21 nt, Mycobacterium avium subsp. paratuberculosis
ccagcaucggaugccggggca

SEQ ID NO: 2987139 - RNA, 16 nt, Mycobacterium avium subsp. paratuberculosis
ccagcaucucggcgaa

SEQ ID NO: 2987140 - RNA, 23 nt, Mycobacterium avium subsp. paratuberculosis
ccagcaugaucaccgccagcgcg

SEQ ID NO: 2987141 - RNA, 21 nt, Mycobacterium avium subsp. paratuberculosis
ccagcaugcgccagagcgcga

SEQ ID NO: 2987142 - RNA, 19 nt, Mycobacterium avium subsp. paratuberculosis
ccagcaugguucguggggu

SEQ ID NO: 2987143 - RNA, 22 nt, Mycobacterium avium subsp. paratuberculosis
ccagcaugugcucccagcucag

SEQ ID NO: 2987144 - RNA, 21 nt, Mycobacterium avium subsp. paratuberculosis
ccagccacaccgccgcggcgg

SEQ ID NO: 2987145 - RNA, 13 nt, Mycobacterium avium subsp. paratuberculosis
ccagccacagccg

SEQ ID NO: 2987146 - RNA, 15 nt, Mycobacterium avium subsp. paratuberculosis
ccagccacagccgca

SEQ ID NO: 2987147 - RNA, 20 nt, Mycobacterium avium subsp. paratuberculosis
ccagccaccacaucgcuggg

SEQ ID NO: 2987148 - RNA, 14 nt, Mycobacterium avium subsp. paratuberculosis
ccagccaccguggc

SEQ ID NO: 2987149 - RNA, 16 nt, Mycobacterium avium subsp. paratuberculosis
ccagccacgccgacac

SEQ ID NO: 2987150 - RNA, 18 nt, Mycobacterium avium subsp. paratuberculosis
ccagccacgccgacaccg

SEQ ID NO: 2987151 - RNA, 22 nt, Mycobacterium avium subsp. paratuberculosis
ccagccacgccgacaccgucgc

SEQ ID NO: 2987152 - RNA, 15 nt, Mycobacterium avium subsp. paratuberculosis
ccagccacuccacca

SEQ ID NO: 2987153 - RNA, 20 nt, Mycobacterium avium subsp. paratuberculosis
ccagccacuccaccaccggc

SEQ ID NO: 2987154 - RNA, 22 nt, Mycobacterium avium subsp. paratuberculosis
ccagccagaacacgccccggcg

SEQ ID NO: 2987155 - RNA, 23 nt, Mycobacterium avium subsp. paratuberculosis
ccagccagaacacgccccggcgg

SEQ ID NO: 2987156 - RNA, 13 nt, Mycobacterium avium subsp. paratuberculosis
ccagccagccgcg

SEQ ID NO: 2987157 - RNA, 19 nt, Mycobacterium avium subsp. paratuberculosis
ccagccagccgcgccgcgc

SEQ ID NO: 2987158 - RNA, 23 nt, Mycobacterium avium subsp. paratuberculosis
ccagccagccgcgccgcgccgcc

SEQ ID NO: 2987159 - RNA, 15 nt, Mycobacterium avium subsp. paratuberculosis
ccagccagccggugg

SEQ ID NO: 2987160 - RNA, 23 nt, Mycobacterium avium subsp. paratuberculosis
ccagccagccgguggcggccacg

SEQ ID NO: 2987161 - RNA, 12 nt, Mycobacterium avium subsp. paratuberculosis
ccagccagcgcg

SEQ ID NO: 2987162 - RNA, 13 nt, Mycobacterium avium subsp. paratuberculosis
ccagccagcgcgc

SEQ ID NO: 2987163 - RNA, 16 nt, Mycobacterium avium subsp. paratuberculosis
ccagccagcguuuggc

SEQ ID NO: 2987164 - RNA, 17 nt, Mycobacterium avium subsp. paratuberculosis
ccagccagcguuuggcc

SEQ ID NO: 2987165 - RNA, 14 nt, Mycobacterium avium subsp. paratuberculosis
ccagccaggccgcc

SEQ ID NO: 2987166 - RNA, 16 nt, Mycobacterium avium subsp. paratuberculosis
ccagccaggccgccgg

SEQ ID NO: 2987167 - RNA, 17 nt, Mycobacterium avium subsp. paratuberculosis
ccagccaggccgccggg

SEQ ID NO: 2987168 - RNA, 18 nt, Mycobacterium avium subsp. paratuberculosis
ccagccaggccgccgggc

SEQ ID NO: 2987169 - RNA, 15 nt, Mycobacterium avium subsp. paratuberculosis
ccagccaggccgucg

SEQ ID NO: 2987170 - RNA, 17 nt, Mycobacterium avium subsp. paratuberculosis
ccagccaggccgucggc

SEQ ID NO: 2987171 - RNA, 16 nt, Mycobacterium avium subsp. paratuberculosis
ccagccaggucuugag

SEQ ID NO: 2987172 - RNA, 20 nt, Mycobacterium avium subsp. paratuberculosis
ccagccagguguaggcggcc

SEQ ID NO: 2987173 - RNA, 12 nt, Mycobacterium avium subsp. paratuberculosis
ccagccaguccg

SEQ ID NO: 2987174 - RNA, 15 nt, Mycobacterium avium subsp. paratuberculosis
ccagccaguccgccg

SEQ ID NO: 2987175 - RNA, 16 nt, Mycobacterium avium subsp. paratuberculosis
ccagccaguccgccgc

SEQ ID NO: 2987176 - RNA, 17 nt, Mycobacterium avium subsp. paratuberculosis
ccagccaguccgccgcc

SEQ ID NO: 2987177 - RNA, 19 nt, Mycobacterium avium subsp. paratuberculosis
ccagccaguugggggccag

SEQ ID NO: 2987178 - RNA, 18 nt, Mycobacterium avium subsp. paratuberculosis
ccagccauacugacgccg

SEQ ID NO: 2987179 - RNA, 12 nt, Mycobacterium avium subsp. paratuberculosis
ccagcccagccg

SEQ ID NO: 2987180 - RNA, 16 nt, Mycobacterium avium subsp. paratuberculosis
ccagcccagccgccag

SEQ ID NO: 2987181 - RNA, 12 nt, Mycobacterium avium subsp. paratuberculosis
ccagcccagcgc

SEQ ID NO: 2987182 - RNA, 18 nt, Mycobacterium avium subsp. paratuberculosis
ccagcccaggucgggacg

SEQ ID NO: 2987183 - RNA, 16 nt, Mycobacterium avium subsp. paratuberculosis
ccagccccaccaccgc

SEQ ID NO: 2987184 - RNA, 20 nt, Mycobacterium avium subsp. paratuberculosis
ccagccccaccaccgccacc

SEQ ID NO: 2987185 - RNA, 14 nt, Mycobacterium avium subsp. paratuberculosis
ccagccccaccggc

SEQ ID NO: 2987186 - RNA, 12 nt, Mycobacterium avium subsp. paratuberculosis
ccagccccagca

SEQ ID NO: 2987187 - RNA, 14 nt, Mycobacterium avium subsp. paratuberculosis
ccagccccagcacg

SEQ ID NO: 2987188 - RNA, 15 nt, Mycobacterium avium subsp. paratuberculosis
ccagccccgggaacc

SEQ ID NO: 2987189 - RNA, 18 nt, Mycobacterium avium subsp. paratuberculosis
ccagccccucgaccaccu

SEQ ID NO: 2987190 - RNA, 17 nt, Mycobacterium avium subsp. paratuberculosis
ccagccccucgccgggc

SEQ ID NO: 2987191 - RNA, 22 nt, Mycobacterium avium subsp. paratuberculosis
ccagccccucgccgggcgucac

SEQ ID NO: 2987192 - RNA, 19 nt, Mycobacterium avium subsp. paratuberculosis
ccagcccgaaaguccccgg

SEQ ID NO: 2987193 - RNA, 16 nt, Mycobacterium avium subsp. paratuberculosis
ccagcccgagcaccag

SEQ ID NO: 2987194 - RNA, 14 nt, Mycobacterium avium subsp. paratuberculosis
ccagcccgaugccg

SEQ ID NO: 2987195 - RNA, 17 nt, Mycobacterium avium subsp. paratuberculosis
ccagcccgcccagcgcc

SEQ ID NO: 2987196 - RNA, 15 nt, Mycobacterium avium subsp. paratuberculosis
ccagcccgccgaacc

SEQ ID NO: 2987197 - RNA, 18 nt, Mycobacterium avium subsp. paratuberculosis
ccagcccgccgcguccgg

SEQ ID NO: 2987198 - RNA, 19 nt, Mycobacterium avium subsp. paratuberculosis
ccagcccgccgcguccggg

SEQ ID NO: 2987199 - RNA, 15 nt, Mycobacterium avium subsp. paratuberculosis
ccagcccgccgucgg

SEQ ID NO: 2987200 - RNA, 12 nt, Mycobacterium avium subsp. paratuberculosis
ccagcccgcgcc

SEQ ID NO: 2987201 - RNA, 13 nt, Mycobacterium avium subsp. paratuberculosis
ccagcccgcgcca

SEQ ID NO: 2987202 - RNA, 14 nt, Mycobacterium avium subsp. paratuberculosis
ccagcccgcgccag

SEQ ID NO: 2987203 - RNA, 20 nt, Mycobacterium avium subsp. paratuberculosis
ccagcccgcgccagcucggc

SEQ ID NO: 2987204 - RNA, 14 nt, Mycobacterium avium subsp. paratuberculosis
ccagcccgcgccga

SEQ ID NO: 2987205 - RNA, 23 nt, Mycobacterium avium subsp. paratuberculosis
ccagcccgcgcgagcgcagcgcc

SEQ ID NO: 2987206 - RNA, 17 nt, Mycobacterium avium subsp. paratuberculosis
ccagcccgcggcagcca

SEQ ID NO: 2987207 - RNA, 18 nt, Mycobacterium avium subsp. paratuberculosis
ccagcccgcggcagccag

SEQ ID NO: 2987208 - RNA, 23 nt, Mycobacterium avium subsp. paratuberculosis
ccagcccgcggcagccagccugg

SEQ ID NO: 2987209 - RNA, 13 nt, Mycobacterium avium subsp. paratuberculosis
ccagcccgcucag

SEQ ID NO: 2987210 - RNA, 22 nt, Mycobacterium avium subsp. paratuberculosis
ccagcccgcucagagcugcacc

SEQ ID NO: 2987211 - RNA, 21 nt, Mycobacterium avium subsp. paratuberculosis
ccagcccggaaucgucggcca

SEQ ID NO: 2987212 - RNA, 23 nt, Mycobacterium avium subsp. paratuberculosis
ccagcccggaaucgucggccacg

SEQ ID NO: 2987213 - RNA, 11 nt, Mycobacterium avium subsp. paratuberculosis
ccagcccggcc

SEQ ID NO: 2987214 - RNA, 13 nt, Mycobacterium avium subsp. paratuberculosis
ccagcccggccag

SEQ ID NO: 2987215 - RNA, 14 nt, Mycobacterium avium subsp. paratuberculosis
ccagcccggccagc

SEQ ID NO: 2987216 - RNA, 16 nt, Mycobacterium avium subsp. paratuberculosis
ccagcccggccagcac

SEQ ID NO: 2987217 - RNA, 16 nt, Mycobacterium avium subsp. paratuberculosis
ccagcccggccagcgg

SEQ ID NO: 2987218 - RNA, 19 nt, Mycobacterium avium subsp. paratuberculosis
ccagcccggccagcggcau

SEQ ID NO: 2987219 - RNA, 16 nt, Mycobacterium avium subsp. paratuberculosis
ccagcccggccaguug

SEQ ID NO: 2987220 - RNA, 17 nt, Mycobacterium avium subsp. paratuberculosis
ccagcccggccaguuga

SEQ ID NO: 2987221 - RNA, 12 nt, Mycobacterium avium subsp. paratuberculosis
ccagcccggccc

SEQ ID NO: 2987222 - RNA, 21 nt, Mycobacterium avium subsp. paratuberculosis
ccagcccggccccaccgccgc

SEQ ID NO: 2987223 - RNA, 13 nt, Mycobacterium avium subsp. paratuberculosis
ccagcccggcccg

SEQ ID NO: 2987224 - RNA, 14 nt, Mycobacterium avium subsp. paratuberculosis
ccagcccggcccgu

SEQ ID NO: 2987225 - RNA, 17 nt, Mycobacterium avium subsp. paratuberculosis
ccagcccggcccgucga

SEQ ID NO: 2987226 - RNA, 19 nt, Mycobacterium avium subsp. paratuberculosis
ccagcccggcccgucgagc

SEQ ID NO: 2987227 - RNA, 21 nt, Mycobacterium avium subsp. paratuberculosis
ccagcccggcccgucgagcgg

SEQ ID NO: 2987228 - RNA, 13 nt, Mycobacterium avium subsp. paratuberculosis
ccagcccggccgc

SEQ ID NO: 2987229 - RNA, 15 nt, Mycobacterium avium subsp. paratuberculosis
ccagcccggccgccg

SEQ ID NO: 2987230 - RNA, 22 nt, Mycobacterium avium subsp. paratuberculosis
ccagcccggcgacgaagcagcu

SEQ ID NO: 2987231 - RNA, 13 nt, Mycobacterium avium subsp. paratuberculosis
ccagcccggcgug

SEQ ID NO: 2987232 - RNA, 13 nt, Mycobacterium avium subsp. paratuberculosis
ccagcccgggaaa

SEQ ID NO: 2987233 - RNA, 20 nt, Mycobacterium avium subsp. paratuberculosis
ccagcccggggguggcgguc

SEQ ID NO: 2987234 - RNA, 14 nt, Mycobacterium avium subsp. paratuberculosis
ccagcccggucacc

SEQ ID NO: 2987235 - RNA, 19 nt, Mycobacterium avium subsp. paratuberculosis
ccagcccggugaucgccgc

SEQ ID NO: 2987236 - RNA, 21 nt, Mycobacterium avium subsp. paratuberculosis
ccagcccgucggccuccagcc

SEQ ID NO: 2987237 - RNA, 13 nt, Mycobacterium avium subsp. paratuberculosis
ccagcccgucguc

SEQ ID NO: 2987238 - RNA, 14 nt, Mycobacterium avium subsp. paratuberculosis
ccagcccguggcca

SEQ ID NO: 2987239 - RNA, 17 nt, Mycobacterium avium subsp. paratuberculosis
ccagcccguggccagcg

SEQ ID NO: 2987240 - RNA, 18 nt, Mycobacterium avium subsp. paratuberculosis
ccagcccguggccagcgc

SEQ ID NO: 2987241 - RNA, 19 nt, Mycobacterium avium subsp. paratuberculosis
ccagcccguggccagcgcc

SEQ ID NO: 2987242 - RNA, 23 nt, Mycobacterium avium subsp. paratuberculosis
ccagcccguggccagcgccagcg

SEQ ID NO: 2987243 - RNA, 20 nt, Mycobacterium avium subsp. paratuberculosis
ccagcccguugucgagcacc

SEQ ID NO: 2987244 - RNA, 21 nt, Mycobacterium avium subsp. paratuberculosis
ccagcccguuguggcggccag

SEQ ID NO: 2987245 - RNA, 22 nt, Mycobacterium avium subsp. paratuberculosis
ccagcccucgucgaugacgucc

SEQ ID NO: 2987246 - RNA, 18 nt, Mycobacterium avium subsp. paratuberculosis
ccagcccugcucggccag

SEQ ID NO: 2987247 - RNA, 19 nt, Mycobacterium avium subsp. paratuberculosis
ccagcccugcucggccagc

SEQ ID NO: 2987248 - RNA, 21 nt, Mycobacterium avium subsp. paratuberculosis
ccagcccugcucggccagcgg

SEQ ID NO: 2987249 - RNA, 22 nt, Mycobacterium avium subsp. paratuberculosis
ccagccgaaguauccggucagc

SEQ ID NO: 2987250 - RNA, 21 nt, Mycobacterium avium subsp. paratuberculosis
ccagccgagaucgacccgcuc

SEQ ID NO: 2987251 - RNA, 15 nt, Mycobacterium avium subsp. paratuberculosis
ccagccgagccgggc

SEQ ID NO: 2987252 - RNA, 16 nt, Mycobacterium avium subsp. paratuberculosis
ccagccgagccgggcc

SEQ ID NO: 2987253 - RNA, 14 nt, Mycobacterium avium subsp. paratuberculosis
ccagccgaucgcgg

SEQ ID NO: 2987254 - RNA, 17 nt, Mycobacterium avium subsp. paratuberculosis
ccagccgaucgcggugc

SEQ ID NO: 2987255 - RNA, 15 nt, Mycobacterium avium subsp. paratuberculosis
ccagccgaugcgccc

SEQ ID NO: 2987256 - RNA, 20 nt, Mycobacterium avium subsp. paratuberculosis
ccagccgaugcgcccgcgcc

SEQ ID NO: 2987257 - RNA, 23 nt, Mycobacterium avium subsp. paratuberculosis
ccagccgaugcgcccgcgccacc

SEQ ID NO: 2987258 - RNA, 15 nt, Mycobacterium avium subsp. paratuberculosis
ccagccgcaccgcga

SEQ ID NO: 2987259 - RNA, 21 nt, Mycobacterium avium subsp. paratuberculosis
ccagccgcaccgcgaccguca

SEQ ID NO: 2987260 - RNA, 23 nt, Mycobacterium avium subsp. paratuberculosis
ccagccgcagcaggcacuccugg

SEQ ID NO: 2987261 - RNA, 22 nt, Mycobacterium avium subsp. paratuberculosis
ccagccgcaggugcucgccggc

SEQ ID NO: 2987262 - RNA, 23 nt, Mycobacterium avium subsp. paratuberculosis
ccagccgcaggugcucgccggcg

SEQ ID NO: 2987263 - RNA, 14 nt, Mycobacterium avium subsp. paratuberculosis
ccagccgcaucacc

SEQ ID NO: 2987264 - RNA, 18 nt, Mycobacterium avium subsp. paratuberculosis
ccagccgcauucggugag

SEQ ID NO: 2987265 - RNA, 13 nt, Mycobacterium avium subsp. paratuberculosis
ccagccgcccagc

SEQ ID NO: 2987266 - RNA, 15 nt, Mycobacterium avium subsp. paratuberculosis
ccagccgccgccgac

SEQ ID NO: 2987267 - RNA, 20 nt, Mycobacterium avium subsp. paratuberculosis
ccagccgccgccgaccacau

SEQ ID NO: 2987268 - RNA, 15 nt, Mycobacterium avium subsp. paratuberculosis
ccagccgccgcgugg

SEQ ID NO: 2987269 - RNA, 14 nt, Mycobacterium avium subsp. paratuberculosis
ccagccgccggcca

SEQ ID NO: 2987270 - RNA, 19 nt, Mycobacterium avium subsp. paratuberculosis
ccagccgccggccaccagg

SEQ ID NO: 2987271 - RNA, 13 nt, Mycobacterium avium subsp. paratuberculosis
ccagccgccggcg

SEQ ID NO: 2987272 - RNA, 17 nt, Mycobacterium avium subsp. paratuberculosis
ccagccgccggcucagc

SEQ ID NO: 2987273 - RNA, 19 nt, Mycobacterium avium subsp. paratuberculosis
ccagccgccggcucagcgg

SEQ ID NO: 2987274 - RNA, 20 nt, Mycobacterium avium subsp. paratuberculosis
ccagccgccggcucagcggc

SEQ ID NO: 2987275 - RNA, 13 nt, Mycobacterium avium subsp. paratuberculosis
ccagccgccgguc

SEQ ID NO: 2987276 - RNA, 21 nt, Mycobacterium avium subsp. paratuberculosis
ccagccgccgguccagugccg

SEQ ID NO: 2987277 - RNA, 14 nt, Mycobacterium avium subsp. paratuberculosis
ccagccgcgccgcg

SEQ ID NO: 2987278 - RNA, 15 nt, Mycobacterium avium subsp. paratuberculosis
ccagccgcgccgcgc

SEQ ID NO: 2987279 - RNA, 20 nt, Mycobacterium avium subsp. paratuberculosis
ccagccgcgccgcgccgccu

SEQ ID NO: 2987280 - RNA, 15 nt, Mycobacterium avium subsp. paratuberculosis
ccagccgcgcggccg

SEQ ID NO: 2987281 - RNA, 15 nt, Mycobacterium avium subsp. paratuberculosis
ccagccgcgcggcgu

SEQ ID NO: 2987282 - RNA, 16 nt, Mycobacterium avium subsp. paratuberculosis
ccagccgcgcggcguc

SEQ ID NO: 2987283 - RNA, 22 nt, Mycobacterium avium subsp. paratuberculosis
ccagccgcgcggcgucggccgg

SEQ ID NO: 2987284 - RNA, 15 nt, Mycobacterium avium subsp. paratuberculosis
ccagccgcggacggc

SEQ ID NO: 2987285 - RNA, 16 nt, Mycobacterium avium subsp. paratuberculosis
ccagccgcggacggcc

SEQ ID NO: 2987286 - RNA, 18 nt, Mycobacterium avium subsp. paratuberculosis
ccagccgcggacggccag

SEQ ID NO: 2987287 - RNA, 21 nt, Mycobacterium avium subsp. paratuberculosis
ccagccgcggacggccagccc

SEQ ID NO: 2987288 - RNA, 11 nt, Mycobacterium avium subsp. paratuberculosis
ccagccgcggu

SEQ ID NO: 2987289 - RNA, 20 nt, Mycobacterium avium subsp. paratuberculosis
ccagccgcgucacgucggcc

SEQ ID NO: 2987290 - RNA, 22 nt, Mycobacterium avium subsp. paratuberculosis
ccagccgcgucacgucggccug

SEQ ID NO: 2987291 - RNA, 23 nt, Mycobacterium avium subsp. paratuberculosis
ccagccgcgucacgucggccugc

SEQ ID NO: 2987292 - RNA, 21 nt, Mycobacterium avium subsp. paratuberculosis
ccagccgcucccggcgcagca

SEQ ID NO: 2987293 - RNA, 21 nt, Mycobacterium avium subsp. paratuberculosis
ccagccgcuccgcggcgggcg

SEQ ID NO: 2987294 - RNA, 14 nt, Mycobacterium avium subsp. paratuberculosis
ccagccgcugacga

SEQ ID NO: 2987295 - RNA, 14 nt, Mycobacterium avium subsp. paratuberculosis
ccagccgcugcgac

SEQ ID NO: 2987296 - RNA, 15 nt, Mycobacterium avium subsp. paratuberculosis
ccagccggacagcgg

SEQ ID NO: 2987297 - RNA, 16 nt, Mycobacterium avium subsp. paratuberculosis
ccagccggcccgcauc

SEQ ID NO: 2987298 - RNA, 12 nt, Mycobacterium avium subsp. paratuberculosis
ccagccggcccu

SEQ ID NO: 2987299 - RNA, 17 nt, Mycobacterium avium subsp. paratuberculosis
ccagccggccgacgcgg

SEQ ID NO: 2987300 - RNA, 16 nt, Mycobacterium avium subsp. paratuberculosis
ccagccggccgcugag

SEQ ID NO: 2987301 - RNA, 12 nt, Mycobacterium avium subsp. paratuberculosis
ccagccggccgg

SEQ ID NO: 2987302 - RNA, 13 nt, Mycobacterium avium subsp. paratuberculosis
ccagccggccggc

SEQ ID NO: 2987303 - RNA, 14 nt, Mycobacterium avium subsp. paratuberculosis
ccagccggccggcg

SEQ ID NO: 2987304 - RNA, 17 nt, Mycobacterium avium subsp. paratuberculosis
ccagccggccggcgaag

SEQ ID NO: 2987305 - RNA, 13 nt, Mycobacterium avium subsp. paratuberculosis
ccagccggcgcac

SEQ ID NO: 2987306 - RNA, 17 nt, Mycobacterium avium subsp. paratuberculosis
ccagccggcgcaccagg

SEQ ID NO: 2987307 - RNA, 16 nt, Mycobacterium avium subsp. paratuberculosis
ccagccggcggugcag

SEQ ID NO: 2987308 - RNA, 22 nt, Mycobacterium avium subsp. paratuberculosis
ccagccggcucuuggcgaccuc

SEQ ID NO: 2987309 - RNA, 23 nt, Mycobacterium avium subsp. paratuberculosis
ccagccggcucuuggcgaccucg

SEQ ID NO: 2987310 - RNA, 21 nt, Mycobacterium avium subsp. paratuberculosis
ccagccgggccgagcgcgccg

SEQ ID NO: 2987311 - RNA, 17 nt, Mycobacterium avium subsp. paratuberculosis
ccagccgggcgaccguc

SEQ ID NO: 2987312 - RNA, 13 nt, Mycobacterium avium subsp. paratuberculosis
ccagccgggcggc

SEQ ID NO: 2987313 - RNA, 16 nt, Mycobacterium avium subsp. paratuberculosis
ccagccgggcggccag

SEQ ID NO: 2987314 - RNA, 13 nt, Mycobacterium avium subsp. paratuberculosis
ccagccgggggau

SEQ ID NO: 2987315 - RNA, 19 nt, Mycobacterium avium subsp. paratuberculosis
ccagccgggggaucaccuc

SEQ ID NO: 2987316 - RNA, 21 nt, Mycobacterium avium subsp. paratuberculosis
ccagccgggguagggcggcgg

SEQ ID NO: 2987317 - RNA, 19 nt, Mycobacterium avium subsp. paratuberculosis
ccagccggguccgcacccg

SEQ ID NO: 2987318 - RNA, 22 nt, Mycobacterium avium subsp. paratuberculosis
ccagccggguccgcacccgggc

SEQ ID NO: 2987319 - RNA, 17 nt, Mycobacterium avium subsp. paratuberculosis
ccagccggguggcccgc

SEQ ID NO: 2987320 - RNA, 21 nt, Mycobacterium avium subsp. paratuberculosis
ccagccgguacggaucgccgg

SEQ ID NO: 2987321 - RNA, 20 nt, Mycobacterium avium subsp. paratuberculosis
ccagccgguaugcgaucgcg

SEQ ID NO: 2987322 - RNA, 17 nt, Mycobacterium avium subsp. paratuberculosis
ccagccggucgccgggc

SEQ ID NO: 2987323 - RNA, 20 nt, Mycobacterium avium subsp. paratuberculosis
ccagccggucgccgggccgg

SEQ ID NO: 2987324 - RNA, 12 nt, Mycobacterium avium subsp. paratuberculosis
ccagccggucgu

SEQ ID NO: 2987325 - RNA, 18 nt, Mycobacterium avium subsp. paratuberculosis
ccagccggucgucggggc

SEQ ID NO: 2987326 - RNA, 19 nt, Mycobacterium avium subsp. paratuberculosis
ccagccggucuuggacagc

SEQ ID NO: 2987327 - RNA, 23 nt, Mycobacterium avium subsp. paratuberculosis
ccagccggucuuggacagcagca

SEQ ID NO: 2987328 - RNA, 14 nt, Mycobacterium avium subsp. paratuberculosis
ccagccggugcacc

SEQ ID NO: 2987329 - RNA, 12 nt, Mycobacterium avium subsp. paratuberculosis
ccagccggugcg

SEQ ID NO: 2987330 - RNA, 19 nt, Mycobacterium avium subsp. paratuberculosis
ccagccggugcugacccgg

SEQ ID NO: 2987331 - RNA, 20 nt, Mycobacterium avium subsp. paratuberculosis
ccagccggugcugacccggu

SEQ ID NO: 2987332 - RNA, 23 nt, Mycobacterium avium subsp. paratuberculosis
ccagccggugcugacccggucgc

SEQ ID NO: 2987333 - RNA, 15 nt, Mycobacterium avium subsp. paratuberculosis
ccagccgguggcggc

SEQ ID NO: 2987334 - RNA, 16 nt, Mycobacterium avium subsp. paratuberculosis
ccagccgguggcggcc

SEQ ID NO: 2987335 - RNA, 17 nt, Mycobacterium avium subsp. paratuberculosis
ccagccgguggcggcca

SEQ ID NO: 2987336 - RNA, 18 nt, Mycobacterium avium subsp. paratuberculosis
ccagccgguggcggccac

SEQ ID NO: 2987337 - RNA, 20 nt, Mycobacterium avium subsp. paratuberculosis
ccagccgguggcggccacga

SEQ ID NO: 2987338 - RNA, 19 nt, Mycobacterium avium subsp. paratuberculosis
ccagccgguugcgguggcc

SEQ ID NO: 2987339 - RNA, 21 nt, Mycobacterium avium subsp. paratuberculosis
ccagccgguugcgguggccga

SEQ ID NO: 2987340 - RNA, 15 nt, Mycobacterium avium subsp. paratuberculosis
ccagccgucccgccg

SEQ ID NO: 2987341 - RNA, 23 nt, Mycobacterium avium subsp. paratuberculosis
ccagccguccuggucgucccagg

SEQ ID NO: 2987342 - RNA, 15 nt, Mycobacterium avium subsp. paratuberculosis
ccagccgucgcaccg

SEQ ID NO: 2987343 - RNA, 19 nt, Mycobacterium avium subsp. paratuberculosis
ccagccgucgcaccgccuc

SEQ ID NO: 2987344 - RNA, 14 nt, Mycobacterium avium subsp. paratuberculosis
ccagccgucgccgc

SEQ ID NO: 2987345 - RNA, 15 nt, Mycobacterium avium subsp. paratuberculosis
ccagccgucgccgcg

SEQ ID NO: 2987346 - RNA, 16 nt, Mycobacterium avium subsp. paratuberculosis
ccagccgucgccgcgc

SEQ ID NO: 2987347 - RNA, 22 nt, Mycobacterium avium subsp. paratuberculosis
ccagccgucgccgcgcccgccg

SEQ ID NO: 2987348 - RNA, 21 nt, Mycobacterium avium subsp. paratuberculosis
ccagccgucguugcgggcggc

SEQ ID NO: 2987349 - RNA, 18 nt, Mycobacterium avium subsp. paratuberculosis
ccagccgugccccagguc

SEQ ID NO: 2987350 - RNA, 21 nt, Mycobacterium avium subsp. paratuberculosis
ccagccgugccccaggucggg

SEQ ID NO: 2987351 - RNA, 11 nt, Mycobacterium avium subsp. paratuberculosis
ccagccgugcg

SEQ ID NO: 2987352 - RNA, 18 nt, Mycobacterium avium subsp. paratuberculosis
ccagccgugcggcacgcc

SEQ ID NO: 2987353 - RNA, 20 nt, Mycobacterium avium subsp. paratuberculosis
ccagccgugcggcacgccgc

SEQ ID NO: 2987354 - RNA, 15 nt, Mycobacterium avium subsp. paratuberculosis
ccagccgugcggcgg

SEQ ID NO: 2987355 - RNA, 22 nt, Mycobacterium avium subsp. paratuberculosis
ccagccgugcggcggcggcggu

SEQ ID NO: 2987356 - RNA, 15 nt, Mycobacterium avium subsp. paratuberculosis
ccagccgugcugggc

SEQ ID NO: 2987357 - RNA, 14 nt, Mycobacterium avium subsp. paratuberculosis
ccagccguucccgg

SEQ ID NO: 2987358 - RNA, 22 nt, Mycobacterium avium subsp. paratuberculosis
ccagccguucucguccugggcc

SEQ ID NO: 2987359 - RNA, 16 nt, Mycobacterium avium subsp. paratuberculosis
ccagccguugggcagc

SEQ ID NO: 2987360 - RNA, 20 nt, Mycobacterium avium subsp. paratuberculosis
ccagccguugggcagcucgg

SEQ ID NO: 2987361 - RNA, 17 nt, Mycobacterium avium subsp. paratuberculosis
ccagccucuugaacgcg

SEQ ID NO: 2987362 - RNA, 23 nt, Mycobacterium avium subsp. paratuberculosis
ccagccucuugaacgcguacagc

SEQ ID NO: 2987363 - RNA, 13 nt, Mycobacterium avium subsp. paratuberculosis
ccagccuggcggc

SEQ ID NO: 2987364 - RNA, 20 nt, Mycobacterium avium subsp. paratuberculosis
ccagccuggcggcgacccgg

SEQ ID NO: 2987365 - RNA, 14 nt, Mycobacterium avium subsp. paratuberculosis
ccagccuucgccgc

SEQ ID NO: 2987366 - RNA, 17 nt, Mycobacterium avium subsp. paratuberculosis
ccagccuucgccgcacg

SEQ ID NO: 2987367 - RNA, 18 nt, Mycobacterium avium subsp. paratuberculosis
ccagccuucgccgcacgu

SEQ ID NO: 2987368 - RNA, 17 nt, Mycobacterium avium subsp. paratuberculosis
ccagccuugcagccgcu

SEQ ID NO: 2987369 - RNA, 20 nt, Mycobacterium avium subsp. paratuberculosis
ccagccuugcagccgcugcc

SEQ ID NO: 2987370 - RNA, 16 nt, Mycobacterium avium subsp. paratuberculosis
ccagcgaaucgaccgg

SEQ ID NO: 2987371 - RNA, 21 nt, Mycobacterium avium subsp. paratuberculosis
ccagcgacaacagcacgaaca

SEQ ID NO: 2987372 - RNA, 15 nt, Mycobacterium avium subsp. paratuberculosis
ccagcgacagcaccc

SEQ ID NO: 2987373 - RNA, 13 nt, Mycobacterium avium subsp. paratuberculosis
ccagcgacgccag

SEQ ID NO: 2987374 - RNA, 17 nt, Mycobacterium avium subsp. paratuberculosis
ccagcgacgccagcggc

SEQ ID NO: 2987375 - RNA, 18 nt, Mycobacterium avium subsp. paratuberculosis
ccagcgacgccagcggca

SEQ ID NO: 2987376 - RNA, 19 nt, Mycobacterium avium subsp. paratuberculosis
ccagcgacgccagcggcag

SEQ ID NO: 2987377 - RNA, 20 nt, Mycobacterium avium subsp. paratuberculosis
ccagcgacgccaugucgaug

SEQ ID NO: 2987378 - RNA, 17 nt, Mycobacterium avium subsp. paratuberculosis
ccagcgacggcaggucg

SEQ ID NO: 2987379 - RNA, 15 nt, Mycobacterium avium subsp. paratuberculosis
ccagcgacucggcca

SEQ ID NO: 2987380 - RNA, 16 nt, Mycobacterium avium subsp. paratuberculosis
ccagcgacucggccag

SEQ ID NO: 2987381 - RNA, 15 nt, Mycobacterium avium subsp. paratuberculosis
ccagcgagaagucgc

SEQ ID NO: 2987382 - RNA, 21 nt, Mycobacterium avium subsp. paratuberculosis
ccagcgagaagucgcucagcg

SEQ ID NO: 2987383 - RNA, 17 nt, Mycobacterium avium subsp. paratuberculosis
ccagcgagcaggucacc

SEQ ID NO: 2987384 - RNA, 15 nt, Mycobacterium avium subsp. paratuberculosis
ccagcgagcccagcu

SEQ ID NO: 2987385 - RNA, 18 nt, Mycobacterium avium subsp. paratuberculosis
ccagcgagcccagcugcg

SEQ ID NO: 2987386 - RNA, 14 nt, Mycobacterium avium subsp. paratuberculosis
ccagcgagccgaug

SEQ ID NO: 2987387 - RNA, 20 nt, Mycobacterium avium subsp. paratuberculosis
ccagcgagcucaggccggcc

SEQ ID NO: 2987388 - RNA, 23 nt, Mycobacterium avium subsp. paratuberculosis
ccagcgagcucaggccggccuug

SEQ ID NO: 2987389 - RNA, 18 nt, Mycobacterium avium subsp. paratuberculosis
ccagcgagcugccggcgg

SEQ ID NO: 2987390 - RNA, 12 nt, Mycobacterium avium subsp. paratuberculosis
ccagcgaggcgg

SEQ ID NO: 2987391 - RNA, 15 nt, Mycobacterium avium subsp. paratuberculosis
ccagcgaggcggcca

SEQ ID NO: 2987392 - RNA, 17 nt, Mycobacterium avium subsp. paratuberculosis
ccagcgaggcggccagc

SEQ ID NO: 2987393 - RNA, 19 nt, Mycobacterium avium subsp. paratuberculosis
ccagcgaggcggccagcgg

SEQ ID NO: 2987394 - RNA, 13 nt, Mycobacterium avium subsp. paratuberculosis
ccagcgaggucuc

SEQ ID NO: 2987395 - RNA, 16 nt, Mycobacterium avium subsp. paratuberculosis
ccagcgaggugguuuc

SEQ ID NO: 2987396 - RNA, 16 nt, Mycobacterium avium subsp. paratuberculosis
ccagcgaguccagcca

SEQ ID NO: 2987397 - RNA, 20 nt, Mycobacterium avium subsp. paratuberculosis
ccagcgaguccagccagccg

SEQ ID NO: 2987398 - RNA, 15 nt, Mycobacterium avium subsp. paratuberculosis
ccagcgagucgagaa

SEQ ID NO: 2987399 - RNA, 22 nt, Mycobacterium avium subsp. paratuberculosis
ccagcgagucgagaaacgcgcg

SEQ ID NO: 2987400 - RNA, 20 nt, Mycobacterium avium subsp. paratuberculosis
ccagcgagucgaugaccucg

SEQ ID NO: 2987401 - RNA, 21 nt, Mycobacterium avium subsp. paratuberculosis
ccagcgagucgaugaccucgc

SEQ ID NO: 2987402 - RNA, 18 nt, Mycobacterium avium subsp. paratuberculosis
ccagcgaguuggccaucg

SEQ ID NO: 2987403 - RNA, 19 nt, Mycobacterium avium subsp. paratuberculosis
ccagcgaguuggccaucgu

SEQ ID NO: 2987404 - RNA, 19 nt, Mycobacterium avium subsp. paratuberculosis
ccagcgauacccguugcgc

SEQ ID NO: 2987405 - RNA, 15 nt, Mycobacterium avium subsp. paratuberculosis
ccagcgauccggcgc

SEQ ID NO: 2987406 - RNA, 16 nt, Mycobacterium avium subsp. paratuberculosis
ccagcgauccggcgcg

SEQ ID NO: 2987407 - RNA, 17 nt, Mycobacterium avium subsp. paratuberculosis
ccagcgauucccgccgg

SEQ ID NO: 2987408 - RNA, 14 nt, Mycobacterium avium subsp. paratuberculosis
ccagcgcaaccgcg

SEQ ID NO: 2987409 - RNA, 15 nt, Mycobacterium avium subsp. paratuberculosis
ccagcgcaaccgcgg

SEQ ID NO: 2987410 - RNA, 15 nt, Mycobacterium avium subsp. paratuberculosis
ccagcgcaacggcgu

SEQ ID NO: 2987411 - RNA, 16 nt, Mycobacterium avium subsp. paratuberculosis
ccagcgcaacggcguc

SEQ ID NO: 2987412 - RNA, 17 nt, Mycobacterium avium subsp. paratuberculosis
ccagcgcaacggcgucg

SEQ ID NO: 2987413 - RNA, 13 nt, Mycobacterium avium subsp. paratuberculosis
ccagcgcacacag

SEQ ID NO: 2987414 - RNA, 19 nt, Mycobacterium avium subsp. paratuberculosis
ccagcgcacacagcagcag

SEQ ID NO: 2987415 - RNA, 22 nt, Mycobacterium avium subsp. paratuberculosis
ccagcgcacacagcagcagcac

SEQ ID NO: 2987416 - RNA, 14 nt, Mycobacterium avium subsp. paratuberculosis
ccagcgcaccgagc

SEQ ID NO: 2987417 - RNA, 17 nt, Mycobacterium avium subsp. paratuberculosis
ccagcgcaccgagcccg

SEQ ID NO: 2987418 - RNA, 14 nt, Mycobacterium avium subsp. paratuberculosis
ccagcgcagcacug

SEQ ID NO: 2987419 - RNA, 20 nt, Mycobacterium avium subsp. paratuberculosis
ccagcgcagcacugagcggc

SEQ ID NO: 2987420 - RNA, 22 nt, Mycobacterium avium subsp. paratuberculosis
ccagcgcagcacugagcggcag

SEQ ID NO: 2987421 - RNA, 14 nt, Mycobacterium avium subsp. paratuberculosis
ccagcgcagcaucg

SEQ ID NO: 2987422 - RNA, 14 nt, Mycobacterium avium subsp. paratuberculosis
ccagcgcagcgacc

SEQ ID NO: 2987423 - RNA, 20 nt, Mycobacterium avium subsp. paratuberculosis
ccagcgcagcgaccuggucc

SEQ ID NO: 2987424 - RNA, 15 nt, Mycobacterium avium subsp. paratuberculosis
ccagcgcagcgccuc

SEQ ID NO: 2987425 - RNA, 17 nt, Mycobacterium avium subsp. paratuberculosis
ccagcgcagcgccucgg

SEQ ID NO: 2987426 - RNA, 20 nt, Mycobacterium avium subsp. paratuberculosis
ccagcgcagcgccucggcgg

SEQ ID NO: 2987427 - RNA, 21 nt, Mycobacterium avium subsp. paratuberculosis
ccagcgcagcgccucggcggc

SEQ ID NO: 2987428 - RNA, 22 nt, Mycobacterium avium subsp. paratuberculosis
ccagcgcagcgccucggcggcc

SEQ ID NO: 2987429 - RNA, 23 nt, Mycobacterium avium subsp. paratuberculosis
ccagcgcagcgccucggcggccc

SEQ ID NO: 2987430 - RNA, 18 nt, Mycobacterium avium subsp. paratuberculosis
ccagcgcagguacgcggc

SEQ ID NO: 2987431 - RNA, 20 nt, Mycobacterium avium subsp. paratuberculosis
ccagcgcagguacgcggcgu

SEQ ID NO: 2987432 - RNA, 13 nt, Mycobacterium avium subsp. paratuberculosis
ccagcgcaggucc

SEQ ID NO: 2987433 - RNA, 19 nt, Mycobacterium avium subsp. paratuberculosis
ccagcgcauccaccagggc

SEQ ID NO: 2987434 - RNA, 17 nt, Mycobacterium avium subsp. paratuberculosis
ccagcgcaucggucacc

SEQ ID NO: 2987435 - RNA, 20 nt, Mycobacterium avium subsp. paratuberculosis
ccagcgcaucggucaccagc

SEQ ID NO: 2987436 - RNA, 24 nt, Mycobacterium avium subsp. paratuberculosis
ccagcgcaugccacuugcgcacgu

SEQ ID NO: 2987437 - RNA, 12 nt, Mycobacterium avium subsp. paratuberculosis
ccagcgccacgg

SEQ ID NO: 2987438 - RNA, 20 nt, Mycobacterium avium subsp. paratuberculosis
ccagcgccacgguggcgguc

SEQ ID NO: 2987439 - RNA, 21 nt, Mycobacterium avium subsp. paratuberculosis
ccagcgccacuggcuggucac

SEQ ID NO: 2987440 - RNA, 13 nt, Mycobacterium avium subsp. paratuberculosis
ccagcgccagcga

SEQ ID NO: 2987441 - RNA, 16 nt, Mycobacterium avium subsp. paratuberculosis
ccagcgccagcgccag

SEQ ID NO: 2987442 - RNA, 17 nt, Mycobacterium avium subsp. paratuberculosis
ccagcgccagcgccagc

SEQ ID NO: 2987443 - RNA, 12 nt, Mycobacterium avium subsp. paratuberculosis
ccagcgccagga

SEQ ID NO: 2987444 - RNA, 20 nt, Mycobacterium avium subsp. paratuberculosis
ccagcgccaggacgaaaacc

SEQ ID NO: 2987445 - RNA, 15 nt, Mycobacterium avium subsp. paratuberculosis
ccagcgccaugccgc

SEQ ID NO: 2987446 - RNA, 18 nt, Mycobacterium avium subsp. paratuberculosis
ccagcgccaugccgccga

SEQ ID NO: 2987447 - RNA, 20 nt, Mycobacterium avium subsp. paratuberculosis
ccagcgcccccagcggggca

SEQ ID NO: 2987448 - RNA, 19 nt, Mycobacterium avium subsp. paratuberculosis
ccagcgccccgccggggga

SEQ ID NO: 2987449 - RNA, 21 nt, Mycobacterium avium subsp. paratuberculosis
ccagcgcccgauucgcggcca

SEQ ID NO: 2987450 - RNA, 17 nt, Mycobacterium avium subsp. paratuberculosis
ccagcgcccgcccggac

SEQ ID NO: 2987451 - RNA, 20 nt, Mycobacterium avium subsp. paratuberculosis
ccagcgcccgcccggacacc

SEQ ID NO: 2987452 - RNA, 14 nt, Mycobacterium avium subsp. paratuberculosis
ccagcgcccgccgc

SEQ ID NO: 2987453 - RNA, 13 nt, Mycobacterium avium subsp. paratuberculosis
ccagcgcccgcgc

SEQ ID NO: 2987454 - RNA, 14 nt, Mycobacterium avium subsp. paratuberculosis
ccagcgcccgcgcg

SEQ ID NO: 2987455 - RNA, 15 nt, Mycobacterium avium subsp. paratuberculosis
ccagcgcccgcgcga

SEQ ID NO: 2987456 - RNA, 16 nt, Mycobacterium avium subsp. paratuberculosis
ccagcgcccgcgcgau

SEQ ID NO: 2987457 - RNA, 16 nt, Mycobacterium avium subsp. paratuberculosis
ccagcgcccgcgggug

SEQ ID NO: 2987458 - RNA, 17 nt, Mycobacterium avium subsp. paratuberculosis
ccagcgcccgcgggugc

SEQ ID NO: 2987459 - RNA, 14 nt, Mycobacterium avium subsp. paratuberculosis
ccagcgcccggcga

SEQ ID NO: 2987460 - RNA, 15 nt, Mycobacterium avium subsp. paratuberculosis
ccagcgcccggcgac

SEQ ID NO: 2987461 - RNA, 13 nt, Mycobacterium avium subsp. paratuberculosis
ccagcgcccgggc

SEQ ID NO: 2987462 - RNA, 15 nt, Mycobacterium avium subsp. paratuberculosis
ccagcgcccgggcgc

SEQ ID NO: 2987463 - RNA, 11 nt, Mycobacterium avium subsp. paratuberculosis
ccagcgccgag

SEQ ID NO: 2987464 - RNA, 19 nt, Mycobacterium avium subsp. paratuberculosis
ccagcgccgagaccagcca

SEQ ID NO: 2987465 - RNA, 16 nt, Mycobacterium avium subsp. paratuberculosis
ccagcgccgagaucgc

SEQ ID NO: 2987466 - RNA, 19 nt, Mycobacterium avium subsp. paratuberculosis
ccagcgccgagaucgcggu

SEQ ID NO: 2987467 - RNA, 20 nt, Mycobacterium avium subsp. paratuberculosis
ccagcgccgagaucgcggug

SEQ ID NO: 2987468 - RNA, 21 nt, Mycobacterium avium subsp. paratuberculosis
ccagcgccgagccgaggcaga

SEQ ID NO: 2987469 - RNA, 15 nt, Mycobacterium avium subsp. paratuberculosis
ccagcgccgaggugc

SEQ ID NO: 2987470 - RNA, 19 nt, Mycobacterium avium subsp. paratuberculosis
ccagcgccgaggugcuguc

SEQ ID NO: 2987471 - RNA, 12 nt, Mycobacterium avium subsp. paratuberculosis
ccagcgccgcag

SEQ ID NO: 2987472 - RNA, 13 nt, Mycobacterium avium subsp. paratuberculosis
ccagcgccgccaa

SEQ ID NO: 2987473 - RNA, 15 nt, Mycobacterium avium subsp. paratuberculosis
ccagcgccgccacgg

SEQ ID NO: 2987474 - RNA, 16 nt, Mycobacterium avium subsp. paratuberculosis
ccagcgccgccagccg

SEQ ID NO: 2987475 - RNA, 13 nt, Mycobacterium avium subsp. paratuberculosis
ccagcgccgccau

SEQ ID NO: 2987476 - RNA, 18 nt, Mycobacterium avium subsp. paratuberculosis
ccagcgccgccaucgccu

SEQ ID NO: 2987477 - RNA, 21 nt, Mycobacterium avium subsp. paratuberculosis
ccagcgccgccaucgccucgu

SEQ ID NO: 2987478 - RNA, 23 nt, Mycobacterium avium subsp. paratuberculosis
ccagcgccgccaucgccucgucc

SEQ ID NO: 2987479 - RNA, 14 nt, Mycobacterium avium subsp. paratuberculosis
ccagcgccgcccgg

SEQ ID NO: 2987480 - RNA, 16 nt, Mycobacterium avium subsp. paratuberculosis
ccagcgccgcccgggc

SEQ ID NO: 2987481 - RNA, 17 nt, Mycobacterium avium subsp. paratuberculosis
ccagcgccgcccgggcg

SEQ ID NO: 2987482 - RNA, 12 nt, Mycobacterium avium subsp. paratuberculosis
ccagcgccgcga

SEQ ID NO: 2987483 - RNA, 18 nt, Mycobacterium avium subsp. paratuberculosis
ccagcgccgcgcgcgcgg

SEQ ID NO: 2987484 - RNA, 19 nt, Mycobacterium avium subsp. paratuberculosis
ccagcgccgcgcgcgcggc

SEQ ID NO: 2987485 - RNA, 20 nt, Mycobacterium avium subsp. paratuberculosis
ccagcgccgcgcgcgcggcc

SEQ ID NO: 2987486 - RNA, 21 nt, Mycobacterium avium subsp. paratuberculosis
ccagcgccgcgcgcgcggccu

SEQ ID NO: 2987487 - RNA, 13 nt, Mycobacterium avium subsp. paratuberculosis
ccagcgccgcggc

SEQ ID NO: 2987488 - RNA, 13 nt, Mycobacterium avium subsp. paratuberculosis
ccagcgccggcac

SEQ ID NO: 2987489 - RNA, 14 nt, Mycobacterium avium subsp. paratuberculosis
ccagcgccggcacc

SEQ ID NO: 2987490 - RNA, 15 nt, Mycobacterium avium subsp. paratuberculosis
ccagcgccggcacca

SEQ ID NO: 2987491 - RNA, 16 nt, Mycobacterium avium subsp. paratuberculosis
ccagcgccggcaccag

SEQ ID NO: 2987492 - RNA, 17 nt, Mycobacterium avium subsp. paratuberculosis
ccagcgccggcaccagc

SEQ ID NO: 2987493 - RNA, 16 nt, Mycobacterium avium subsp. paratuberculosis
ccagcgccggcagcaa

SEQ ID NO: 2987494 - RNA, 19 nt, Mycobacterium avium subsp. paratuberculosis
ccagcgccgucaucaccgc

SEQ ID NO: 2987495 - RNA, 21 nt, Mycobacterium avium subsp. paratuberculosis
ccagcgccgucaucaccgccg

SEQ ID NO: 2987496 - RNA, 17 nt, Mycobacterium avium subsp. paratuberculosis
ccagcgccucgagcacc

SEQ ID NO: 2987497 - RNA, 21 nt, Mycobacterium avium subsp. paratuberculosis
ccagcgccucgagcaccacgg

SEQ ID NO: 2987498 - RNA, 22 nt, Mycobacterium avium subsp. paratuberculosis
ccagcgccucggccucgucgac

SEQ ID NO: 2987499 - RNA, 23 nt, Mycobacterium avium subsp. paratuberculosis
ccagcgccucggccugcgcccgg

SEQ ID NO: 2987500 - RNA, 16 nt, Mycobacterium avium subsp. paratuberculosis
ccagcgccucggcguc

SEQ ID NO: 2987501 - RNA, 19 nt, Mycobacterium avium subsp. paratuberculosis
ccagcgccucggcgucacc

SEQ ID NO: 2987502 - RNA, 23 nt, Mycobacterium avium subsp. paratuberculosis
ccagcgccucggcgucaccgcgg

SEQ ID NO: 2987503 - RNA, 16 nt, Mycobacterium avium subsp. paratuberculosis
ccagcgccuucggcgc

SEQ ID NO: 2987504 - RNA, 17 nt, Mycobacterium avium subsp. paratuberculosis
ccagcgccuucggcgcc

SEQ ID NO: 2987505 - RNA, 19 nt, Mycobacterium avium subsp. paratuberculosis
ccagcgccuucggcgccag

SEQ ID NO: 2987506 - RNA, 20 nt, Mycobacterium avium subsp. paratuberculosis
ccagcgccuucggcgccagc

SEQ ID NO: 2987507 - RNA, 16 nt, Mycobacterium avium subsp. paratuberculosis
ccagcgcgaacagcgc

SEQ ID NO: 2987508 - RNA, 20 nt, Mycobacterium avium subsp. paratuberculosis
ccagcgcgaacagcgcggcc

SEQ ID NO: 2987509 - RNA, 15 nt, Mycobacterium avium subsp. paratuberculosis
ccagcgcgaccgccc

SEQ ID NO: 2987510 - RNA, 21 nt, Mycobacterium avium subsp. paratuberculosis
ccagcgcgaccgcccgggcca

SEQ ID NO: 2987511 - RNA, 15 nt, Mycobacterium avium subsp. paratuberculosis
ccagcgcgacgcgca

SEQ ID NO: 2987512 - RNA, 18 nt, Mycobacterium avium subsp. paratuberculosis
ccagcgcgacgcgcaugc

SEQ ID NO: 2987513 - RNA, 14 nt, Mycobacterium avium subsp. paratuberculosis
ccagcgcgacggug

SEQ ID NO: 2987514 - RNA, 22 nt, Mycobacterium avium subsp. paratuberculosis
ccagcgcgacgucgaccgcgac

SEQ ID NO: 2987515 - RNA, 15 nt, Mycobacterium avium subsp. paratuberculosis
ccagcgcgaggucga

SEQ ID NO: 2987516 - RNA, 13 nt, Mycobacterium avium subsp. paratuberculosis
ccagcgcgaucaa

SEQ ID NO: 2987517 - RNA, 15 nt, Mycobacterium avium subsp. paratuberculosis
ccagcgcgaucgccg

SEQ ID NO: 2987518 - RNA, 16 nt, Mycobacterium avium subsp. paratuberculosis
ccagcgcgaucgccgg

SEQ ID NO: 2987519 - RNA, 18 nt, Mycobacterium avium subsp. paratuberculosis
ccagcgcgaucuccuuga

SEQ ID NO: 2987520 - RNA, 14 nt, Mycobacterium avium subsp. paratuberculosis
ccagcgcgcacgcg

SEQ ID NO: 2987521 - RNA, 18 nt, Mycobacterium avium subsp. paratuberculosis
ccagcgcgcagaacacca

SEQ ID NO: 2987522 - RNA, 22 nt, Mycobacterium avium subsp. paratuberculosis
ccagcgcgcagaacaccaccgc

SEQ ID NO: 2987523 - RNA, 14 nt, Mycobacterium avium subsp. paratuberculosis
ccagcgcgcccgcc

SEQ ID NO: 2987524 - RNA, 17 nt, Mycobacterium avium subsp. paratuberculosis
ccagcgcgcccgccauc

SEQ ID NO: 2987525 - RNA, 20 nt, Mycobacterium avium subsp. paratuberculosis
ccagcgcgcccgccaucugg

SEQ ID NO: 2987526 - RNA, 13 nt, Mycobacterium avium subsp. paratuberculosis
ccagcgcgccgau

SEQ ID NO: 2987527 - RNA, 14 nt, Mycobacterium avium subsp. paratuberculosis
ccagcgcgccgcac

SEQ ID NO: 2987528 - RNA, 14 nt, Mycobacterium avium subsp. paratuberculosis
ccagcgcgccgccc

SEQ ID NO: 2987529 - RNA, 16 nt, Mycobacterium avium subsp. paratuberculosis
ccagcgcgccgcccag

SEQ ID NO: 2987530 - RNA, 19 nt, Mycobacterium avium subsp. paratuberculosis
ccagcgcgccgcccagcgg

SEQ ID NO: 2987531 - RNA, 20 nt, Mycobacterium avium subsp. paratuberculosis
ccagcgcgccgcccagcggc

SEQ ID NO: 2987532 - RNA, 15 nt, Mycobacterium avium subsp. paratuberculosis
ccagcgcgccgccga

SEQ ID NO: 2987533 - RNA, 13 nt, Mycobacterium avium subsp. paratuberculosis
ccagcgcgccggc

SEQ ID NO: 2987534 - RNA, 16 nt, Mycobacterium avium subsp. paratuberculosis
ccagcgcgccggccag

SEQ ID NO: 2987535 - RNA, 17 nt, Mycobacterium avium subsp. paratuberculosis
ccagcgcgcgaucagcg

SEQ ID NO: 2987536 - RNA, 17 nt, Mycobacterium avium subsp. paratuberculosis
ccagcgcgcgaucgccg

SEQ ID NO: 2987537 - RNA, 17 nt, Mycobacterium avium subsp. paratuberculosis
ccagcgcgcgcagcgcu

SEQ ID NO: 2987538 - RNA, 12 nt, Mycobacterium avium subsp. paratuberculosis
ccagcgcgcggc

SEQ ID NO: 2987539 - RNA, 20 nt, Mycobacterium avium subsp. paratuberculosis
ccagcgcgcgggcgcgcgcc

SEQ ID NO: 2987540 - RNA, 22 nt, Mycobacterium avium subsp. paratuberculosis
ccagcgcgcgggcgcgcgccgc

SEQ ID NO: 2987541 - RNA, 14 nt, Mycobacterium avium subsp. paratuberculosis
ccagcgcgcgggug

SEQ ID NO: 2987542 - RNA, 13 nt, Mycobacterium avium subsp. paratuberculosis
ccagcgcgcggug

SEQ ID NO: 2987543 - RNA, 14 nt, Mycobacterium avium subsp. paratuberculosis
ccagcgcgcggugc

SEQ ID NO: 2987544 - RNA, 15 nt, Mycobacterium avium subsp. paratuberculosis
ccagcgcgcggugcg

SEQ ID NO: 2987545 - RNA, 21 nt, Mycobacterium avium subsp. paratuberculosis
ccagcgcggccaccaccacgg

SEQ ID NO: 2987546 - RNA, 13 nt, Mycobacterium avium subsp. paratuberculosis
ccagcgcggccgg

SEQ ID NO: 2987547 - RNA, 15 nt, Mycobacterium avium subsp. paratuberculosis
ccagcgcggccgggc

SEQ ID NO: 2987548 - RNA, 19 nt, Mycobacterium avium subsp. paratuberculosis
ccagcgcggcgaacccgag

SEQ ID NO: 2987549 - RNA, 20 nt, Mycobacterium avium subsp. paratuberculosis
ccagcgcggcgaucagcagc

SEQ ID NO: 2987550 - RNA, 22 nt, Mycobacterium avium subsp. paratuberculosis
ccagcgcggcgaucagcagcac

SEQ ID NO: 2987551 - RNA, 13 nt, Mycobacterium avium subsp. paratuberculosis
ccagcgcggcggc

SEQ ID NO: 2987552 - RNA, 15 nt, Mycobacterium avium subsp. paratuberculosis
ccagcgcggcggcca

SEQ ID NO: 2987553 - RNA, 17 nt, Mycobacterium avium subsp. paratuberculosis
ccagcgcggcggccacc

SEQ ID NO: 2987554 - RNA, 21 nt, Mycobacterium avium subsp. paratuberculosis
ccagcgcggcggccagcucgg

SEQ ID NO: 2987555 - RNA, 19 nt, Mycobacterium avium subsp. paratuberculosis
ccagcgcggcggcgccguc

SEQ ID NO: 2987556 - RNA, 21 nt, Mycobacterium avium subsp. paratuberculosis
ccagcgcggcggcgccgucgc

SEQ ID NO: 2987557 - RNA, 12 nt, Mycobacterium avium subsp. paratuberculosis
ccagcgcggcgu

SEQ ID NO: 2987558 - RNA, 13 nt, Mycobacterium avium subsp. paratuberculosis
ccagcgcggcguc

SEQ ID NO: 2987559 - RNA, 13 nt, Mycobacterium avium subsp. paratuberculosis
ccagcgcggucaa

SEQ ID NO: 2987560 - RNA, 23 nt, Mycobacterium avium subsp. paratuberculosis
ccagcgcggucgccaccaccagc

SEQ ID NO: 2987561 - RNA, 15 nt, Mycobacterium avium subsp. paratuberculosis
ccagcgcggucucga

SEQ ID NO: 2987562 - RNA, 12 nt, Mycobacterium avium subsp. paratuberculosis
ccagcgcgguga

SEQ ID NO: 2987563 - RNA, 21 nt, Mycobacterium avium subsp. paratuberculosis
ccagcgcggugaagucggugc

SEQ ID NO: 2987564 - RNA, 13 nt, Mycobacterium avium subsp. paratuberculosis
ccagcgcggugag

SEQ ID NO: 2987565 - RNA, 16 nt, Mycobacterium avium subsp. paratuberculosis
ccagcgcggugagcag

SEQ ID NO: 2987566 - RNA, 18 nt, Mycobacterium avium subsp. paratuberculosis
ccagcgcggugagcagca

SEQ ID NO: 2987567 - RNA, 22 nt, Mycobacterium avium subsp. paratuberculosis
ccagcgcggugagcagcaugcc

SEQ ID NO: 2987568 - RNA, 14 nt, Mycobacterium avium subsp. paratuberculosis
ccagcgcggugaug

SEQ ID NO: 2987569 - RNA, 14 nt, Mycobacterium avium subsp. paratuberculosis
ccagcgcggugccc

SEQ ID NO: 2987570 - RNA, 17 nt, Mycobacterium avium subsp. paratuberculosis
ccagcgcggugcccagc

SEQ ID NO: 2987571 - RNA, 18 nt, Mycobacterium avium subsp. paratuberculosis
ccagcgcggugcccagcc

SEQ ID NO: 2987572 - RNA, 19 nt, Mycobacterium avium subsp. paratuberculosis
ccagcgcggugcccagcca

SEQ ID NO: 2987573 - RNA, 23 nt, Mycobacterium avium subsp. paratuberculosis
ccagcgcggugcccagccaggcc

SEQ ID NO: 2987574 - RNA, 17 nt, Mycobacterium avium subsp. paratuberculosis
ccagcgcgguggccagc

SEQ ID NO: 2987575 - RNA, 20 nt, Mycobacterium avium subsp. paratuberculosis
ccagcgcgguggccagcagg

SEQ ID NO: 2987576 - RNA, 18 nt, Mycobacterium avium subsp. paratuberculosis
ccagcgcggugugcggcg

SEQ ID NO: 2987577 - RNA, 20 nt, Mycobacterium avium subsp. paratuberculosis
ccagcgcggugugcggcggc

SEQ ID NO: 2987578 - RNA, 14 nt, Mycobacterium avium subsp. paratuberculosis
ccagcgcguagucg

SEQ ID NO: 2987579 - RNA, 17 nt, Mycobacterium avium subsp. paratuberculosis
ccagcgcguagucggcg

SEQ ID NO: 2987580 - RNA, 12 nt, Mycobacterium avium subsp. paratuberculosis
ccagcgcgucgc

SEQ ID NO: 2987581 - RNA, 20 nt, Mycobacterium avium subsp. paratuberculosis
ccagcgcgucgcacagcgcc

SEQ ID NO: 2987582 - RNA, 22 nt, Mycobacterium avium subsp. paratuberculosis
ccagcgcgucgcacagcgccgc

SEQ ID NO: 2987583 - RNA, 14 nt, Mycobacterium avium subsp. paratuberculosis
ccagcgcgucggcc

SEQ ID NO: 2987584 - RNA, 15 nt, Mycobacterium avium subsp. paratuberculosis
ccagcgcgucggcca

SEQ ID NO: 2987585 - RNA, 17 nt, Mycobacterium avium subsp. paratuberculosis
ccagcgcgucggccagc

SEQ ID NO: 2987586 - RNA, 20 nt, Mycobacterium avium subsp. paratuberculosis
ccagcgcgucggccagcacc

SEQ ID NO: 2987587 - RNA, 22 nt, Mycobacterium avium subsp. paratuberculosis
ccagcgcgucggccagcaccac

SEQ ID NO: 2987588 - RNA, 13 nt, Mycobacterium avium subsp. paratuberculosis
ccagcgcgugauc

SEQ ID NO: 2987589 - RNA, 17 nt, Mycobacterium avium subsp. paratuberculosis
ccagcgcgugcggggug

SEQ ID NO: 2987590 - RNA, 19 nt, Mycobacterium avium subsp. paratuberculosis
ccagcgcgugcggggugug

SEQ ID NO: 2987591 - RNA, 19 nt, Mycobacterium avium subsp. paratuberculosis
ccagcgcguugaagcugac

SEQ ID NO: 2987592 - RNA, 22 nt, Mycobacterium avium subsp. paratuberculosis
ccagcgcguugaagcugacgau

SEQ ID NO: 2987593 - RNA, 17 nt, Mycobacterium avium subsp. paratuberculosis
ccagcgcguugcggccg

SEQ ID NO: 2987594 - RNA, 19 nt, Mycobacterium avium subsp. paratuberculosis
ccagcgcguugcggccguc

SEQ ID NO: 2987595 - RNA, 19 nt, Mycobacterium avium subsp. paratuberculosis
ccagcgcucgacgaggcgg

SEQ ID NO: 2987596 - RNA, 13 nt, Mycobacterium avium subsp. paratuberculosis
ccagcgcuggccg

SEQ ID NO: 2987597 - RNA, 24 nt, Mycobacterium avium subsp. paratuberculosis
ccagcgcuggccggccaccagcgg

SEQ ID NO: 2987598 - RNA, 16 nt, Mycobacterium avium subsp. paratuberculosis
ccagcgcugguaccgg

SEQ ID NO: 2987599 - RNA, 19 nt, Mycobacterium avium subsp. paratuberculosis
ccagcggaaccgggggccg

SEQ ID NO: 2987600 - RNA, 19 nt, Mycobacterium avium subsp. paratuberculosis
ccagcggacccuucagcca

SEQ ID NO: 2987601 - RNA, 21 nt, Mycobacterium avium subsp. paratuberculosis
ccagcggacccuucagccaga

SEQ ID NO: 2987602 - RNA, 12 nt, Mycobacterium avium subsp. paratuberculosis
ccagcggagcgu

SEQ ID NO: 2987603 - RNA, 21 nt, Mycobacterium avium subsp. paratuberculosis
ccagcggcaacugggcggccu

SEQ ID NO: 2987604 - RNA, 16 nt, Mycobacterium avium subsp. paratuberculosis
ccagcggcacgaucuc

SEQ ID NO: 2987605 - RNA, 14 nt, Mycobacterium avium subsp. paratuberculosis
ccagcggcacgggc

SEQ ID NO: 2987606 - RNA, 22 nt, Mycobacterium avium subsp. paratuberculosis
ccagcggcacgggcaccgacga

SEQ ID NO: 2987607 - RNA, 13 nt, Mycobacterium avium subsp. paratuberculosis
ccagcggcagcag

SEQ ID NO: 2987608 - RNA, 15 nt, Mycobacterium avium subsp. paratuberculosis
ccagcggcagcagca

SEQ ID NO: 2987609 - RNA, 17 nt, Mycobacterium avium subsp. paratuberculosis
ccagcggcagcagcacc

SEQ ID NO: 2987610 - RNA, 20 nt, Mycobacterium avium subsp. paratuberculosis
ccagcggcagcagcaccagc

SEQ ID NO: 2987611 - RNA, 23 nt, Mycobacterium avium subsp. paratuberculosis
ccagcggcagcagcaccagcgug

SEQ ID NO: 2987612 - RNA, 12 nt, Mycobacterium avium subsp. paratuberculosis
ccagcggcagcg

SEQ ID NO: 2987613 - RNA, 15 nt, Mycobacterium avium subsp. paratuberculosis
ccagcggcagcgaca

SEQ ID NO: 2987614 - RNA, 22 nt, Mycobacterium avium subsp. paratuberculosis
ccagcggcagcgacagcgcguc

SEQ ID NO: 2987615 - RNA, 15 nt, Mycobacterium avium subsp. paratuberculosis
ccagcggcagcgcca

SEQ ID NO: 2987616 - RNA, 22 nt, Mycobacterium avium subsp. paratuberculosis
ccagcggcagcgccagcgggau

SEQ ID NO: 2987617 - RNA, 16 nt, Mycobacterium avium subsp. paratuberculosis
ccagcggcagcggcgu

SEQ ID NO: 2987618 - RNA, 12 nt, Mycobacterium avium subsp. paratuberculosis
ccagcggcaucc

SEQ ID NO: 2987619 - RNA, 20 nt, Mycobacterium avium subsp. paratuberculosis
ccagcggcaucgccgccaag

SEQ ID NO: 2987620 - RNA, 21 nt, Mycobacterium avium subsp. paratuberculosis
ccagcggccacaccggggcca

SEQ ID NO: 2987621 - RNA, 14 nt, Mycobacterium avium subsp. paratuberculosis
ccagcggccagccc

SEQ ID NO: 2987622 - RNA, 19 nt, Mycobacterium avium subsp. paratuberculosis
ccagcggccagcccgcggc

SEQ ID NO: 2987623 - RNA, 19 nt, Mycobacterium avium subsp. paratuberculosis
ccagcggcccaccgcgacc

SEQ ID NO: 2987624 - RNA, 22 nt, Mycobacterium avium subsp. paratuberculosis
ccagcggcccaccgcgacccgg

SEQ ID NO: 2987625 - RNA, 16 nt, Mycobacterium avium subsp. paratuberculosis
ccagcggccccggcuc

SEQ ID NO: 2987626 - RNA, 13 nt, Mycobacterium avium subsp. paratuberculosis
ccagcggccgcag

SEQ ID NO: 2987627 - RNA, 15 nt, Mycobacterium avium subsp. paratuberculosis
ccagcggccgcagcg

SEQ ID NO: 2987628 - RNA, 14 nt, Mycobacterium avium subsp. paratuberculosis
ccagcggccgggcg

SEQ ID NO: 2987629 - RNA, 12 nt, Mycobacterium avium subsp. paratuberculosis
ccagcggccguc

SEQ ID NO: 2987630 - RNA, 14 nt, Mycobacterium avium subsp. paratuberculosis
ccagcggccgucgc

SEQ ID NO: 2987631 - RNA, 21 nt, Mycobacterium avium subsp. paratuberculosis
ccagcggcgaugcccacagcc

SEQ ID NO: 2987632 - RNA, 13 nt, Mycobacterium avium subsp. paratuberculosis
ccagcggcgcacc

SEQ ID NO: 2987633 - RNA, 16 nt, Mycobacterium avium subsp. paratuberculosis
ccagcggcgcaccgug

SEQ ID NO: 2987634 - RNA, 12 nt, Mycobacterium avium subsp. paratuberculosis
ccagcggcgccg

SEQ ID NO: 2987635 - RNA, 13 nt, Mycobacterium avium subsp. paratuberculosis
ccagcggcgccga

SEQ ID NO: 2987636 - RNA, 14 nt, Mycobacterium avium subsp. paratuberculosis
ccagcggcgccgaa

SEQ ID NO: 2987637 - RNA, 14 nt, Mycobacterium avium subsp. paratuberculosis
ccagcggcgccggg

SEQ ID NO: 2987638 - RNA, 16 nt, Mycobacterium avium subsp. paratuberculosis
ccagcggcgccggguc

SEQ ID NO: 2987639 - RNA, 12 nt, Mycobacterium avium subsp. paratuberculosis
ccagcggcgcgc

SEQ ID NO: 2987640 - RNA, 14 nt, Mycobacterium avium subsp. paratuberculosis
ccagcggcgcgccg

SEQ ID NO: 2987641 - RNA, 17 nt, Mycobacterium avium subsp. paratuberculosis
ccagcggcgcgccgggc

SEQ ID NO: 2987642 - RNA, 19 nt, Mycobacterium avium subsp. paratuberculosis
ccagcggcgcgccgggcag

SEQ ID NO: 2987643 - RNA, 14 nt, Mycobacterium avium subsp. paratuberculosis
ccagcggcgcggcc

SEQ ID NO: 2987644 - RNA, 21 nt, Mycobacterium avium subsp. paratuberculosis
ccagcggcgcgucgcugggca

SEQ ID NO: 2987645 - RNA, 12 nt, Mycobacterium avium subsp. paratuberculosis
ccagcggcggcc

SEQ ID NO: 2987646 - RNA, 18 nt, Mycobacterium avium subsp. paratuberculosis
ccagcggcuguagcaccc

SEQ ID NO: 2987647 - RNA, 22 nt, Mycobacterium avium subsp. paratuberculosis
ccagcggcuguagcacccggcc

SEQ ID NO: 2987648 - RNA, 20 nt, Mycobacterium avium subsp. paratuberculosis
ccagcggcuugagccggauc

SEQ ID NO: 2987649 - RNA, 16 nt, Mycobacterium avium subsp. paratuberculosis
ccagcggcuuggccgu

SEQ ID NO: 2987650 - RNA, 18 nt, Mycobacterium avium subsp. paratuberculosis
ccagcggcuuggccgugc

SEQ ID NO: 2987651 - RNA, 13 nt, Mycobacterium avium subsp. paratuberculosis
ccagcgggacagc

SEQ ID NO: 2987652 - RNA, 16 nt, Mycobacterium avium subsp. paratuberculosis
ccagcgggacagcacc

SEQ ID NO: 2987653 - RNA, 21 nt, Mycobacterium avium subsp. paratuberculosis
ccagcgggacagcaccaccag

SEQ ID NO: 2987654 - RNA, 22 nt, Mycobacterium avium subsp. paratuberculosis
ccagcgggaugaaggcacccag

SEQ ID NO: 2987655 - RNA, 23 nt, Mycobacterium avium subsp. paratuberculosis
ccagcgggaugaaggcacccagg

SEQ ID NO: 2987656 - RNA, 12 nt, Mycobacterium avium subsp. paratuberculosis
ccagcgggccga

SEQ ID NO: 2987657 - RNA, 20 nt, Mycobacterium avium subsp. paratuberculosis
ccagcgggccgacagcacgc

SEQ ID NO: 2987658 - RNA, 21 nt, Mycobacterium avium subsp. paratuberculosis
ccagcgggccgaccuggcggc

SEQ ID NO: 2987659 - RNA, 22 nt, Mycobacterium avium subsp. paratuberculosis
ccagcgggccgaccuggcggcc

SEQ ID NO: 2987660 - RNA, 16 nt, Mycobacterium avium subsp. paratuberculosis
ccagcgggccgugccg

SEQ ID NO: 2987661 - RNA, 20 nt, Mycobacterium avium subsp. paratuberculosis
ccagcgggccgugccgccau

SEQ ID NO: 2987662 - RNA, 14 nt, Mycobacterium avium subsp. paratuberculosis
ccagcgggcgacgu

SEQ ID NO: 2987663 - RNA, 16 nt, Mycobacterium avium subsp. paratuberculosis
ccagcgggcgacgucg

SEQ ID NO: 2987664 - RNA, 16 nt, Mycobacterium avium subsp. paratuberculosis
ccagcgggcggccccg

SEQ ID NO: 2987665 - RNA, 19 nt, Mycobacterium avium subsp. paratuberculosis
ccagcgggcggccccgggc

SEQ ID NO: 2987666 - RNA, 20 nt, Mycobacterium avium subsp. paratuberculosis
ccagcgggcggccccgggcg

SEQ ID NO: 2987667 - RNA, 22 nt, Mycobacterium avium subsp. paratuberculosis
ccagcgggcggccccgggcgcu

SEQ ID NO: 2987668 - RNA, 19 nt, Mycobacterium avium subsp. paratuberculosis
ccagcgggcggcgguggcc

SEQ ID NO: 2987669 - RNA, 13 nt, Mycobacterium avium subsp. paratuberculosis
ccagcgggcuguc

SEQ ID NO: 2987670 - RNA, 21 nt, Mycobacterium avium subsp. paratuberculosis
ccagcgggcugucggcgccca

SEQ ID NO: 2987671 - RNA, 20 nt, Mycobacterium avium subsp. paratuberculosis
ccagcgggcugugccggcgg

SEQ ID NO: 2987672 - RNA, 16 nt, Mycobacterium avium subsp. paratuberculosis
ccagcggggcaagcag

SEQ ID NO: 2987673 - RNA, 19 nt, Mycobacterium avium subsp. paratuberculosis
ccagcggggcaagcagcgg

SEQ ID NO: 2987674 - RNA, 22 nt, Mycobacterium avium subsp. paratuberculosis
ccagcggggcaagcagcggcag

SEQ ID NO: 2987675 - RNA, 20 nt, Mycobacterium avium subsp. paratuberculosis
ccagcgggguguucaccgcg

SEQ ID NO: 2987676 - RNA, 21 nt, Mycobacterium avium subsp. paratuberculosis
ccagcgggguguucaccgcgc

SEQ ID NO: 2987677 - RNA, 15 nt, Mycobacterium avium subsp. paratuberculosis
ccagcggguccagcc

SEQ ID NO: 2987678 - RNA, 16 nt, Mycobacterium avium subsp. paratuberculosis
ccagcggguccagccg

SEQ ID NO: 2987679 - RNA, 17 nt, Mycobacterium avium subsp. paratuberculosis
ccagcggguccagccgc

SEQ ID NO: 2987680 - RNA, 18 nt, Mycobacterium avium subsp. paratuberculosis
ccagcggguccagccgcc

SEQ ID NO: 2987681 - RNA, 19 nt, Mycobacterium avium subsp. paratuberculosis
ccagcggguccagccgccg

SEQ ID NO: 2987682 - RNA, 21 nt, Mycobacterium avium subsp. paratuberculosis
ccagcggguccagccgccggc

SEQ ID NO: 2987683 - RNA, 21 nt, Mycobacterium avium subsp. paratuberculosis
ccagcgggucgugcaucggcg

SEQ ID NO: 2987684 - RNA, 22 nt, Mycobacterium avium subsp. paratuberculosis
ccagcgggugauggccgccgca

SEQ ID NO: 2987685 - RNA, 15 nt, Mycobacterium avium subsp. paratuberculosis
ccagcggguugccgc

SEQ ID NO: 2987686 - RNA, 21 nt, Mycobacterium avium subsp. paratuberculosis
ccagcggguugucgucgucgg

SEQ ID NO: 2987687 - RNA, 19 nt, Mycobacterium avium subsp. paratuberculosis
ccagcgguaaccacccgug

SEQ ID NO: 2987688 - RNA, 13 nt, Mycobacterium avium subsp. paratuberculosis
ccagcgguccagc

SEQ ID NO: 2987689 - RNA, 14 nt, Mycobacterium avium subsp. paratuberculosis
ccagcggucggcgg

SEQ ID NO: 2987690 - RNA, 17 nt, Mycobacterium avium subsp. paratuberculosis
ccagcggucggcgguuc

SEQ ID NO: 2987691 - RNA, 22 nt, Mycobacterium avium subsp. paratuberculosis
ccagcggucgggugcgcucacc

SEQ ID NO: 2987692 - RNA, 21 nt, Mycobacterium avium subsp. paratuberculosis
ccagcgguuuggauggcccgc

SEQ ID NO: 2987693 - RNA, 23 nt, Mycobacterium avium subsp. paratuberculosis
ccagcguagaacauccacggcau

SEQ ID NO: 2987694 - RNA, 14 nt, Mycobacterium avium subsp. paratuberculosis
ccagcgucaacucg

SEQ ID NO: 2987695 - RNA, 18 nt, Mycobacterium avium subsp. paratuberculosis
ccagcgucaacucgucgg

SEQ ID NO: 2987696 - RNA, 20 nt, Mycobacterium avium subsp. paratuberculosis
ccagcgucaacucgucggcg

SEQ ID NO: 2987697 - RNA, 13 nt, Mycobacterium avium subsp. paratuberculosis
ccagcgucgacgc

SEQ ID NO: 2987698 - RNA, 16 nt, Mycobacterium avium subsp. paratuberculosis
ccagcgucgacugcac

SEQ ID NO: 2987699 - RNA, 19 nt, Mycobacterium avium subsp. paratuberculosis
ccagcgucgacugcaccga

SEQ ID NO: 2987700 - RNA, 20 nt, Mycobacterium avium subsp. paratuberculosis
ccagcgucgacugcaccgac

SEQ ID NO: 2987701 - RNA, 12 nt, Mycobacterium avium subsp. paratuberculosis
ccagcgucgcga

SEQ ID NO: 2987702 - RNA, 16 nt, Mycobacterium avium subsp. paratuberculosis
ccagcgucgcgaucag

SEQ ID NO: 2987703 - RNA, 16 nt, Mycobacterium avium subsp. paratuberculosis
ccagcgucgcgccgcc

SEQ ID NO: 2987704 - RNA, 17 nt, Mycobacterium avium subsp. paratuberculosis
ccagcgucgcgccgcca

SEQ ID NO: 2987705 - RNA, 18 nt, Mycobacterium avium subsp. paratuberculosis
ccagcgucgcgccgccac

SEQ ID NO: 2987706 - RNA, 23 nt, Mycobacterium avium subsp. paratuberculosis
ccagcgucgcgccgccaccccag

SEQ ID NO: 2987707 - RNA, 15 nt, Mycobacterium avium subsp. paratuberculosis
ccagcgucgcggccg

SEQ ID NO: 2987708 - RNA, 17 nt, Mycobacterium avium subsp. paratuberculosis
ccagcgucgcggccggg

SEQ ID NO: 2987709 - RNA, 21 nt, Mycobacterium avium subsp. paratuberculosis
ccagcgucucgaugaccucgc

SEQ ID NO: 2987710 - RNA, 17 nt, Mycobacterium avium subsp. paratuberculosis
ccagcgucucggcggcc

SEQ ID NO: 2987711 - RNA, 19 nt, Mycobacterium avium subsp. paratuberculosis
ccagcgucugcugcgccau

SEQ ID NO: 2987712 - RNA, 20 nt, Mycobacterium avium subsp. paratuberculosis
ccagcgucugcugcgccauc

SEQ ID NO: 2987713 - RNA, 16 nt, Mycobacterium avium subsp. paratuberculosis
ccagcgucuggcagcc

SEQ ID NO: 2987714 - RNA, 19 nt, Mycobacterium avium subsp. paratuberculosis
ccagcgucuggcagccggc

SEQ ID NO: 2987715 - RNA, 20 nt, Mycobacterium avium subsp. paratuberculosis
ccagcgucuggcagccggcc

SEQ ID NO: 2987716 - RNA, 21 nt, Mycobacterium avium subsp. paratuberculosis
ccagcgucuggcagccggccg

SEQ ID NO: 2987717 - RNA, 19 nt, Mycobacterium avium subsp. paratuberculosis
ccagcgugaacaccgcguu

SEQ ID NO: 2987718 - RNA, 16 nt, Mycobacterium avium subsp. paratuberculosis
ccagcgugaacagcgc

SEQ ID NO: 2987719 - RNA, 15 nt, Mycobacterium avium subsp. paratuberculosis
ccagcgugaccucga

SEQ ID NO: 2987720 - RNA, 20 nt, Mycobacterium avium subsp. paratuberculosis
ccagcgugaccucgacggug

SEQ ID NO: 2987721 - RNA, 17 nt, Mycobacterium avium subsp. paratuberculosis
ccagcgugacgcccggc

SEQ ID NO: 2987722 - RNA, 18 nt, Mycobacterium avium subsp. paratuberculosis
ccagcgugacgcccggcg

SEQ ID NO: 2987723 - RNA, 20 nt, Mycobacterium avium subsp. paratuberculosis
ccagcgugacgcccggcgcc

SEQ ID NO: 2987724 - RNA, 21 nt, Mycobacterium avium subsp. paratuberculosis
ccagcgugacgcccggcgccg

SEQ ID NO: 2987725 - RNA, 22 nt, Mycobacterium avium subsp. paratuberculosis
ccagcgugacgcccggcgccgg

SEQ ID NO: 2987726 - RNA, 14 nt, Mycobacterium avium subsp. paratuberculosis
ccagcgugacgccg

SEQ ID NO: 2987727 - RNA, 17 nt, Mycobacterium avium subsp. paratuberculosis
ccagcgugacgccgggc

SEQ ID NO: 2987728 - RNA, 23 nt, Mycobacterium avium subsp. paratuberculosis
ccagcgugacgccgggccgccgc

SEQ ID NO: 2987729 - RNA, 17 nt, Mycobacterium avium subsp. paratuberculosis
ccagcgugacgcucggg

SEQ ID NO: 2987730 - RNA, 15 nt, Mycobacterium avium subsp. paratuberculosis
ccagcgugacgcuga

SEQ ID NO: 2987731 - RNA, 15 nt, Mycobacterium avium subsp. paratuberculosis
ccagcgugacgucga

SEQ ID NO: 2987732 - RNA, 16 nt, Mycobacterium avium subsp. paratuberculosis
ccagcgugccgcgcac

SEQ ID NO: 2987733 - RNA, 18 nt, Mycobacterium avium subsp. paratuberculosis
ccagcgugccgcgcacca

SEQ ID NO: 2987734 - RNA, 13 nt, Mycobacterium avium subsp. paratuberculosis
ccagcgugcgcgg

SEQ ID NO: 2987735 - RNA, 17 nt, Mycobacterium avium subsp. paratuberculosis
ccagcgugcgcggcugg

SEQ ID NO: 2987736 - RNA, 22 nt, Mycobacterium avium subsp. paratuberculosis
ccagcgugcgcggcuggccguc

SEQ ID NO: 2987737 - RNA, 19 nt, Mycobacterium avium subsp. paratuberculosis
ccagcgugcugccggacac

SEQ ID NO: 2987738 - RNA, 22 nt, Mycobacterium avium subsp. paratuberculosis
ccagcgugcugccggacacccc

SEQ ID NO: 2987739 - RNA, 14 nt, Mycobacterium avium subsp. paratuberculosis
ccagcguggccagc

SEQ ID NO: 2987740 - RNA, 15 nt, Mycobacterium avium subsp. paratuberculosis
ccagcguggccagca

SEQ ID NO: 2987741 - RNA, 16 nt, Mycobacterium avium subsp. paratuberculosis
ccagcguggccagcac

SEQ ID NO: 2987742 - RNA, 19 nt, Mycobacterium avium subsp. paratuberculosis
ccagcguggcgaacgcgac

SEQ ID NO: 2987743 - RNA, 12 nt, Mycobacterium avium subsp. paratuberculosis
ccagcguggcgc

SEQ ID NO: 2987744 - RNA, 14 nt, Mycobacterium avium subsp. paratuberculosis
ccagcguggcgcgc

SEQ ID NO: 2987745 - RNA, 18 nt, Mycobacterium avium subsp. paratuberculosis
ccagcguggcgcgccccg

SEQ ID NO: 2987746 - RNA, 19 nt, Mycobacterium avium subsp. paratuberculosis
ccagcguggcgcgccccgg

SEQ ID NO: 2987747 - RNA, 20 nt, Mycobacterium avium subsp. paratuberculosis
ccagcguggcgcgccccggc

SEQ ID NO: 2987748 - RNA, 23 nt, Mycobacterium avium subsp. paratuberculosis
ccagcguggcgcgccccggcccg

SEQ ID NO: 2987749 - RNA, 18 nt, Mycobacterium avium subsp. paratuberculosis
ccagcgugguaacggaau

SEQ ID NO: 2987750 - RNA, 22 nt, Mycobacterium avium subsp. paratuberculosis
ccagcguggucacccgcagccc

SEQ ID NO: 2987751 - RNA, 15 nt, Mycobacterium avium subsp. paratuberculosis
ccagcguggugcgcc

SEQ ID NO: 2987752 - RNA, 21 nt, Mycobacterium avium subsp. paratuberculosis
ccagcguggugcgcccgucgg

SEQ ID NO: 2987753 - RNA, 23 nt, Mycobacterium avium subsp. paratuberculosis
ccagcguggugcgcccgucggug

SEQ ID NO: 2987754 - RNA, 15 nt, Mycobacterium avium subsp. paratuberculosis
ccagcgugucgccgg

SEQ ID NO: 2987755 - RNA, 16 nt, Mycobacterium avium subsp. paratuberculosis
ccagcgugucggcgau

SEQ ID NO: 2987756 - RNA, 17 nt, Mycobacterium avium subsp. paratuberculosis
ccagcgugucggcgauc

SEQ ID NO: 2987757 - RNA, 14 nt, Mycobacterium avium subsp. paratuberculosis
ccagcgugugcgug

SEQ ID NO: 2987758 - RNA, 23 nt, Mycobacterium avium subsp. paratuberculosis
ccagcguguggcccugcgucauc

SEQ ID NO: 2987759 - RNA, 23 nt, Mycobacterium avium subsp. paratuberculosis
ccagcguguugagcucgcggcgc

SEQ ID NO: 2987760 - RNA, 23 nt, Mycobacterium avium subsp. paratuberculosis
ccagcguucgucgccggugagca

SEQ ID NO: 2987761 - RNA, 17 nt, Mycobacterium avium subsp. paratuberculosis
ccagcguuuccagcgcc

SEQ ID NO: 2987762 - RNA, 19 nt, Mycobacterium avium subsp. paratuberculosis
ccagcguuuccagcgccgg

SEQ ID NO: 2987763 - RNA, 22 nt, Mycobacterium avium subsp. paratuberculosis
ccagcguuuccagcgccggcac

SEQ ID NO: 2987764 - RNA, 22 nt, Mycobacterium avium subsp. paratuberculosis
ccagcguuuccuggugcaccag

SEQ ID NO: 2987765 - RNA, 21 nt, Mycobacterium avium subsp. paratuberculosis
ccagcguuuggccugcggcaa

SEQ ID NO: 2987766 - RNA, 13 nt, Mycobacterium avium subsp. paratuberculosis
ccagcuaggagcc

SEQ ID NO: 2987767 - RNA, 20 nt, Mycobacterium avium subsp. paratuberculosis
ccagcucaccggccagggcc

SEQ ID NO: 2987768 - RNA, 15 nt, Mycobacterium avium subsp. paratuberculosis
ccagcucaccgggag

SEQ ID NO: 2987769 - RNA, 19 nt, Mycobacterium avium subsp. paratuberculosis
ccagcucagacugccgagc

SEQ ID NO: 2987770 - RNA, 13 nt, Mycobacterium avium subsp. paratuberculosis
ccagcucagcgcg

SEQ ID NO: 2987771 - RNA, 21 nt, Mycobacterium avium subsp. paratuberculosis
ccagcuccacgcguagccgac

SEQ ID NO: 2987772 - RNA, 15 nt, Mycobacterium avium subsp. paratuberculosis
ccagcuccagcagcc

SEQ ID NO: 2987773 - RNA, 17 nt, Mycobacterium avium subsp. paratuberculosis
ccagcuccagcagcccg

SEQ ID NO: 2987774 - RNA, 15 nt, Mycobacterium avium subsp. paratuberculosis
ccagcucccacgacg

SEQ ID NO: 2987775 - RNA, 16 nt, Mycobacterium avium subsp. paratuberculosis
ccagcucccacgacga

SEQ ID NO: 2987776 - RNA, 21 nt, Mycobacterium avium subsp. paratuberculosis
ccagcucccacgacgacuggg

SEQ ID NO: 2987777 - RNA, 20 nt, Mycobacterium avium subsp. paratuberculosis
ccagcucccaggacgcggug

SEQ ID NO: 2987778 - RNA, 13 nt, Mycobacterium avium subsp. paratuberculosis
ccagcucccgggc

SEQ ID NO: 2987779 - RNA, 14 nt, Mycobacterium avium subsp. paratuberculosis
ccagcucccgggcg

SEQ ID NO: 2987780 - RNA, 20 nt, Mycobacterium avium subsp. paratuberculosis
ccagcucccgggcggcgccg

SEQ ID NO: 2987781 - RNA, 21 nt, Mycobacterium avium subsp. paratuberculosis
ccagcucccgggcggcgccga

SEQ ID NO: 2987782 - RNA, 18 nt, Mycobacterium avium subsp. paratuberculosis
ccagcuccgccacccugc

SEQ ID NO: 2987783 - RNA, 14 nt, Mycobacterium avium subsp. paratuberculosis
ccagcuccgccgac

SEQ ID NO: 2987784 - RNA, 17 nt, Mycobacterium avium subsp. paratuberculosis
ccagcuccgccgacacc

SEQ ID NO: 2987785 - RNA, 20 nt, Mycobacterium avium subsp. paratuberculosis
ccagcuccggcaacgaggcc

SEQ ID NO: 2987786 - RNA, 12 nt, Mycobacterium avium subsp. paratuberculosis
ccagcuccgggu

SEQ ID NO: 2987787 - RNA, 23 nt, Mycobacterium avium subsp. paratuberculosis
ccagcuccgggucgaccgccucg

SEQ ID NO: 2987788 - RNA, 14 nt, Mycobacterium avium subsp. paratuberculosis
ccagcuccucggcc

SEQ ID NO: 2987789 - RNA, 15 nt, Mycobacterium avium subsp. paratuberculosis
ccagcuccucggcca

SEQ ID NO: 2987790 - RNA, 17 nt, Mycobacterium avium subsp. paratuberculosis
ccagcuccucggccagc

SEQ ID NO: 2987791 - RNA, 17 nt, Mycobacterium avium subsp. paratuberculosis
ccagcuccucggggaug

SEQ ID NO: 2987792 - RNA, 16 nt, Mycobacterium avium subsp. paratuberculosis
ccagcuccucggucag

SEQ ID NO: 2987793 - RNA, 17 nt, Mycobacterium avium subsp. paratuberculosis
ccagcuccucggucagc

SEQ ID NO: 2987794 - RNA, 19 nt, Mycobacterium avium subsp. paratuberculosis
ccagcuccuggaagaaguc

SEQ ID NO: 2987795 - RNA, 18 nt, Mycobacterium avium subsp. paratuberculosis
ccagcucgaacaccgucg

SEQ ID NO: 2987796 - RNA, 20 nt, Mycobacterium avium subsp. paratuberculosis
ccagcucgaacaccgucgag

SEQ ID NO: 2987797 - RNA, 21 nt, Mycobacterium avium subsp. paratuberculosis
ccagcucgaacaccgucgagg

SEQ ID NO: 2987798 - RNA, 12 nt, Mycobacterium avium subsp. paratuberculosis
ccagcucgaacc

SEQ ID NO: 2987799 - RNA, 16 nt, Mycobacterium avium subsp. paratuberculosis
ccagcucgaccgcggc

SEQ ID NO: 2987800 - RNA, 17 nt, Mycobacterium avium subsp. paratuberculosis
ccagcucgaccgcggcg

SEQ ID NO: 2987801 - RNA, 18 nt, Mycobacterium avium subsp. paratuberculosis
ccagcucgaccgcggcga

SEQ ID NO: 2987802 - RNA, 21 nt, Mycobacterium avium subsp. paratuberculosis
ccagcucgaccgcggcgaugg

SEQ ID NO: 2987803 - RNA, 13 nt, Mycobacterium avium subsp. paratuberculosis
ccagcucgacgac

SEQ ID NO: 2987804 - RNA, 17 nt, Mycobacterium avium subsp. paratuberculosis
ccagcucgacgacuucg

SEQ ID NO: 2987805 - RNA, 17 nt, Mycobacterium avium subsp. paratuberculosis
ccagcucgagcaucacg

SEQ ID NO: 2987806 - RNA, 21 nt, Mycobacterium avium subsp. paratuberculosis
ccagcucgagcaucacgaacc

SEQ ID NO: 2987807 - RNA, 20 nt, Mycobacterium avium subsp. paratuberculosis
ccagcucgaggccgcgggcg

SEQ ID NO: 2987808 - RNA, 14 nt, Mycobacterium avium subsp. paratuberculosis
ccagcucgaugccg

SEQ ID NO: 2987809 - RNA, 12 nt, Mycobacterium avium subsp. paratuberculosis
ccagcucgccga

SEQ ID NO: 2987810 - RNA, 13 nt, Mycobacterium avium subsp. paratuberculosis
ccagcucgccgau

SEQ ID NO: 2987811 - RNA, 22 nt, Mycobacterium avium subsp. paratuberculosis
ccagcucgccgauguggcgggc

SEQ ID NO: 2987812 - RNA, 24 nt, Mycobacterium avium subsp. paratuberculosis
ccagcucgccgauguggcgggcgu

SEQ ID NO: 2987813 - RNA, 12 nt, Mycobacterium avium subsp. paratuberculosis
ccagcucgccgc

SEQ ID NO: 2987814 - RNA, 14 nt, Mycobacterium avium subsp. paratuberculosis
ccagcucgccgccg

SEQ ID NO: 2987815 - RNA, 17 nt, Mycobacterium avium subsp. paratuberculosis
ccagcucgccgccgacg

SEQ ID NO: 2987816 - RNA, 20 nt, Mycobacterium avium subsp. paratuberculosis
ccagcucgcgaagcgcgaug

SEQ ID NO: 2987817 - RNA, 13 nt, Mycobacterium avium subsp. paratuberculosis
ccagcucgcguuc

SEQ ID NO: 2987818 - RNA, 22 nt, Mycobacterium avium subsp. paratuberculosis
ccagcucgcguucgggcccggc

SEQ ID NO: 2987819 - RNA, 13 nt, Mycobacterium avium subsp. paratuberculosis
ccagcucggcccg

SEQ ID NO: 2987820 - RNA, 14 nt, Mycobacterium avium subsp. paratuberculosis
ccagcucggcccgc

SEQ ID NO: 2987821 - RNA, 12 nt, Mycobacterium avium subsp. paratuberculosis
ccagcucggcgc

SEQ ID NO: 2987822 - RNA, 14 nt, Mycobacterium avium subsp. paratuberculosis
ccagcucggcgcug

SEQ ID NO: 2987823 - RNA, 18 nt, Mycobacterium avium subsp. paratuberculosis
ccagcucggcgcugucgg

SEQ ID NO: 2987824 - RNA, 21 nt, Mycobacterium avium subsp. paratuberculosis
ccagcucggcgcugucggcgg

SEQ ID NO: 2987825 - RNA, 22 nt, Mycobacterium avium subsp. paratuberculosis
ccagcucggcgcugucggcggg

SEQ ID NO: 2987826 - RNA, 14 nt, Mycobacterium avium subsp. paratuberculosis
ccagcucggcggcc

SEQ ID NO: 2987827 - RNA, 15 nt, Mycobacterium avium subsp. paratuberculosis
ccagcucggcggcca

SEQ ID NO: 2987828 - RNA, 17 nt, Mycobacterium avium subsp. paratuberculosis
ccagcucggcggccaug

SEQ ID NO: 2987829 - RNA, 17 nt, Mycobacterium avium subsp. paratuberculosis
ccagcucggcggccggg

SEQ ID NO: 2987830 - RNA, 20 nt, Mycobacterium avium subsp. paratuberculosis
ccagcucggcggccgggugu

SEQ ID NO: 2987831 - RNA, 14 nt, Mycobacterium avium subsp. paratuberculosis
ccagcucggcgugg

SEQ ID NO: 2987832 - RNA, 13 nt, Mycobacterium avium subsp. paratuberculosis
ccagcucggucag

SEQ ID NO: 2987833 - RNA, 14 nt, Mycobacterium avium subsp. paratuberculosis
ccagcucggucagc

SEQ ID NO: 2987834 - RNA, 19 nt, Mycobacterium avium subsp. paratuberculosis
ccagcucggucagccgggc

SEQ ID NO: 2987835 - RNA, 20 nt, Mycobacterium avium subsp. paratuberculosis
ccagcucggucagccgggcg

SEQ ID NO: 2987836 - RNA, 21 nt, Mycobacterium avium subsp. paratuberculosis
ccagcucggucagccgggcgg

SEQ ID NO: 2987837 - RNA, 23 nt, Mycobacterium avium subsp. paratuberculosis
ccagcucggucagccgggcggcc

SEQ ID NO: 2987838 - RNA, 16 nt, Mycobacterium avium subsp. paratuberculosis
ccagcucggucgcggu

SEQ ID NO: 2987839 - RNA, 17 nt, Mycobacterium avium subsp. paratuberculosis
ccagcucggucgcgguc

SEQ ID NO: 2987840 - RNA, 12 nt, Mycobacterium avium subsp. paratuberculosis
ccagcucggugc

SEQ ID NO: 2987841 - RNA, 15 nt, Mycobacterium avium subsp. paratuberculosis
ccagcucguccagcg

SEQ ID NO: 2987842 - RNA, 14 nt, Mycobacterium avium subsp. paratuberculosis
ccagcucgucgagc

SEQ ID NO: 2987843 - RNA, 18 nt, Mycobacterium avium subsp. paratuberculosis
ccagcucgucgagccggc

SEQ ID NO: 2987844 - RNA, 23 nt, Mycobacterium avium subsp. paratuberculosis
ccagcucgucgagccggccggac

SEQ ID NO: 2987845 - RNA, 16 nt, Mycobacterium avium subsp. paratuberculosis
ccagcucgucgccgac

SEQ ID NO: 2987846 - RNA, 18 nt, Mycobacterium avium subsp. paratuberculosis
ccagcucgucgccgacca

SEQ ID NO: 2987847 - RNA, 21 nt, Mycobacterium avium subsp. paratuberculosis
ccagcucguugccggcggcca

SEQ ID NO: 2987848 - RNA, 23 nt, Mycobacterium avium subsp. paratuberculosis
ccagcucguugccggcggccagc

SEQ ID NO: 2987849 - RNA, 24 nt, Mycobacterium avium subsp. paratuberculosis
ccagcucuucauagcugaucacau

SEQ ID NO: 2987850 - RNA, 14 nt, Mycobacterium avium subsp. paratuberculosis
ccagcugaacacga

SEQ ID NO: 2987851 - RNA, 21 nt, Mycobacterium avium subsp. paratuberculosis
ccagcugauagccgcccugcc

SEQ ID NO: 2987852 - RNA, 18 nt, Mycobacterium avium subsp. paratuberculosis
ccagcugauucgcggugg

SEQ ID NO: 2987853 - RNA, 16 nt, Mycobacterium avium subsp. paratuberculosis
ccagcugauuguugac

SEQ ID NO: 2987854 - RNA, 22 nt, Mycobacterium avium subsp. paratuberculosis
ccagcugauuguugacggugac

SEQ ID NO: 2987855 - RNA, 23 nt, Mycobacterium avium subsp. paratuberculosis
ccagcugauuguugacggugacc

SEQ ID NO: 2987856 - RNA, 14 nt, Mycobacterium avium subsp. paratuberculosis
ccagcugcacccac

SEQ ID NO: 2987857 - RNA, 18 nt, Mycobacterium avium subsp. paratuberculosis
ccagcugcacccaccggc

SEQ ID NO: 2987858 - RNA, 14 nt, Mycobacterium avium subsp. paratuberculosis
ccagcugcaccggg

SEQ ID NO: 2987859 - RNA, 15 nt, Mycobacterium avium subsp. paratuberculosis
ccagcugcaccgggg

SEQ ID NO: 2987860 - RNA, 18 nt, Mycobacterium avium subsp. paratuberculosis
ccagcugcaccggggccg

SEQ ID NO: 2987861 - RNA, 21 nt, Mycobacterium avium subsp. paratuberculosis
ccagcugcaccggggccggcg

SEQ ID NO: 2987862 - RNA, 22 nt, Mycobacterium avium subsp. paratuberculosis
ccagcugcaccggggccggcgg

SEQ ID NO: 2987863 - RNA, 16 nt, Mycobacterium avium subsp. paratuberculosis
ccagcugcccaccagc

SEQ ID NO: 2987864 - RNA, 15 nt, Mycobacterium avium subsp. paratuberculosis
ccagcugcccgccga

SEQ ID NO: 2987865 - RNA, 18 nt, Mycobacterium avium subsp. paratuberculosis
ccagcugcccgccgacgc

SEQ ID NO: 2987866 - RNA, 19 nt, Mycobacterium avium subsp. paratuberculosis
ccagcugcccgccgacgcc

SEQ ID NO: 2987867 - RNA, 20 nt, Mycobacterium avium subsp. paratuberculosis
ccagcugcccgccgacgccc

SEQ ID NO: 2987868 - RNA, 15 nt, Mycobacterium avium subsp. paratuberculosis
ccagcugccgcgacu

SEQ ID NO: 2987869 - RNA, 14 nt, Mycobacterium avium subsp. paratuberculosis
ccagcugcgacagc

SEQ ID NO: 2987870 - RNA, 20 nt, Mycobacterium avium subsp. paratuberculosis
ccagcugcgacagcacgggc

SEQ ID NO: 2987871 - RNA, 14 nt, Mycobacterium avium subsp. paratuberculosis
ccagcugcgcgccg

SEQ ID NO: 2987872 - RNA, 15 nt, Mycobacterium avium subsp. paratuberculosis
ccagcugcgcgccgg

SEQ ID NO: 2987873 - RNA, 17 nt, Mycobacterium avium subsp. paratuberculosis
ccagcugcgcgccggcg

SEQ ID NO: 2987874 - RNA, 18 nt, Mycobacterium avium subsp. paratuberculosis
ccagcugcgcgccggcgg

SEQ ID NO: 2987875 - RNA, 19 nt, Mycobacterium avium subsp. paratuberculosis
ccagcugcgcgccggcggc

SEQ ID NO: 2987876 - RNA, 21 nt, Mycobacterium avium subsp. paratuberculosis
ccagcugcggaaaugcccgcg

SEQ ID NO: 2987877 - RNA, 12 nt, Mycobacterium avium subsp. paratuberculosis
ccagcugcgggu

SEQ ID NO: 2987878 - RNA, 22 nt, Mycobacterium avium subsp. paratuberculosis
ccagcugcggguugcgggccag

SEQ ID NO: 2987879 - RNA, 15 nt, Mycobacterium avium subsp. paratuberculosis
ccagcugcuggaauc

SEQ ID NO: 2987880 - RNA, 16 nt, Mycobacterium avium subsp. paratuberculosis
ccagcuggagaggccc

SEQ ID NO: 2987881 - RNA, 18 nt, Mycobacterium avium subsp. paratuberculosis
ccagcuggagaggcccgg

SEQ ID NO: 2987882 - RNA, 19 nt, Mycobacterium avium subsp. paratuberculosis
ccagcuggagaggcccggc

SEQ ID NO: 2987883 - RNA, 20 nt, Mycobacterium avium subsp. paratuberculosis
ccagcuggauggcgcccagc

SEQ ID NO: 2987884 - RNA, 22 nt, Mycobacterium avium subsp. paratuberculosis
ccagcuggauggcgcccagccc

SEQ ID NO: 2987885 - RNA, 23 nt, Mycobacterium avium subsp. paratuberculosis
ccagcuggauggcgcccagcccg

SEQ ID NO: 2987886 - RNA, 17 nt, Mycobacterium avium subsp. paratuberculosis
ccagcugggaggcgcac

SEQ ID NO: 2987887 - RNA, 14 nt, Mycobacterium avium subsp. paratuberculosis
ccagcugggcagcc

SEQ ID NO: 2987888 - RNA, 16 nt, Mycobacterium avium subsp. paratuberculosis
ccagcugggcagccag

SEQ ID NO: 2987889 - RNA, 17 nt, Mycobacterium avium subsp. paratuberculosis
ccagcugggcagccaga

SEQ ID NO: 2987890 - RNA, 19 nt, Mycobacterium avium subsp. paratuberculosis
ccagcugggcagccagauc

SEQ ID NO: 2987891 - RNA, 16 nt, Mycobacterium avium subsp. paratuberculosis
ccagcugggccagcgc

SEQ ID NO: 2987892 - RNA, 17 nt, Mycobacterium avium subsp. paratuberculosis
ccagcugggccagcgcg

SEQ ID NO: 2987893 - RNA, 14 nt, Mycobacterium avium subsp. paratuberculosis
ccagcugggccgcc

SEQ ID NO: 2987894 - RNA, 18 nt, Mycobacterium avium subsp. paratuberculosis
ccagcugggccgccagcc

SEQ ID NO: 2987895 - RNA, 23 nt, Mycobacterium avium subsp. paratuberculosis
ccagcugggccgccagccgguac

SEQ ID NO: 2987896 - RNA, 21 nt, Mycobacterium avium subsp. paratuberculosis
ccagcuggguggucaccagcg

SEQ ID NO: 2987897 - RNA, 21 nt, Mycobacterium avium subsp. paratuberculosis
ccagcuggugaagcugccgac

SEQ ID NO: 2987898 - RNA, 14 nt, Mycobacterium avium subsp. paratuberculosis
ccagcugucccagu

SEQ ID NO: 2987899 - RNA, 17 nt, Mycobacterium avium subsp. paratuberculosis
ccagcugucccagugcg

SEQ ID NO: 2987900 - RNA, 19 nt, Mycobacterium avium subsp. paratuberculosis
ccagcugucccagugcgug

SEQ ID NO: 2987901 - RNA, 15 nt, Mycobacterium avium subsp. paratuberculosis
ccagcugucgggugg

SEQ ID NO: 2987902 - RNA, 20 nt, Mycobacterium avium subsp. paratuberculosis
ccagcuguugacgggccgcg

SEQ ID NO: 2987903 - RNA, 21 nt, Mycobacterium avium subsp. paratuberculosis
ccagcuguugacgggccgcgg

SEQ ID NO: 2987904 - RNA, 22 nt, Mycobacterium avium subsp. paratuberculosis
ccagcuguugacgggccgcggc

SEQ ID NO: 2987905 - RNA, 23 nt, Mycobacterium avium subsp. paratuberculosis
ccagcuguugacgggccgcggcc

SEQ ID NO: 2987906 - RNA, 19 nt, Mycobacterium avium subsp. paratuberculosis
ccagcuguuuuaggcagcc

SEQ ID NO: 2987907 - RNA, 22 nt, Mycobacterium avium subsp. paratuberculosis
ccagcuuagguucguccaccuc

SEQ ID NO: 2987908 - RNA, 21 nt, Mycobacterium avium subsp. paratuberculosis
ccagcuucaccggucgggcca

SEQ ID NO: 2987909 - RNA, 15 nt, Mycobacterium avium subsp. paratuberculosis
ccagcuucucggcgu

SEQ ID NO: 2987910 - RNA, 17 nt, Mycobacterium avium subsp. paratuberculosis
ccagcuugaagcccucg

SEQ ID NO: 2987911 - RNA, 20 nt, Mycobacterium avium subsp. paratuberculosis
ccagcuugaagcccucgucg

SEQ ID NO: 2987912 - RNA, 21 nt, Mycobacterium avium subsp. paratuberculosis
ccagcuugaagcccucgucga

SEQ ID NO: 2987913 - RNA, 16 nt, Mycobacterium avium subsp. paratuberculosis
ccagcuugaccacccg

SEQ ID NO: 2987914 - RNA, 17 nt, Mycobacterium avium subsp. paratuberculosis
ccagcuugaccacccgg

SEQ ID NO: 2987915 - RNA, 23 nt, Mycobacterium avium subsp. paratuberculosis
ccagcuuggcgcccuugccgaug

SEQ ID NO: 2987916 - RNA, 16 nt, Mycobacterium avium subsp. paratuberculosis
ccagcuugucgaucuc

SEQ ID NO: 2987917 - RNA, 22 nt, Mycobacterium avium subsp. paratuberculosis
ccagcuugucguagcggcgcca

SEQ ID NO: 2987918 - RNA, 23 nt, Mycobacterium avium subsp. paratuberculosis
ccagcuugucguagcggcgccac

SEQ ID NO: 2987919 - RNA, 16 nt, Mycobacterium avium subsp. paratuberculosis
ccagcuuuccggccgc

SEQ ID NO: 2987920 - RNA, 18 nt, Mycobacterium avium subsp. paratuberculosis
ccagcuuuccggccgccu

SEQ ID NO: 2987921 - RNA, 20 nt, Mycobacterium avium subsp. paratuberculosis
ccagcuuuccggccgccucg

SEQ ID NO: 2987922 - RNA, 17 nt, Mycobacterium avium subsp. paratuberculosis
ccaggaaaaccagcgac

SEQ ID NO: 2987923 - RNA, 18 nt, Mycobacterium avium subsp. paratuberculosis
ccaggaaaaccagcgacg

SEQ ID NO: 2987924 - RNA, 20 nt, Mycobacterium avium subsp. paratuberculosis
ccaggaaaaccagcgacgcc

SEQ ID NO: 2987925 - RNA, 17 nt, Mycobacterium avium subsp. paratuberculosis
ccaggaaacggcccauc

SEQ ID NO: 2987926 - RNA, 21 nt, Mycobacterium avium subsp. paratuberculosis
ccaggaaccacaccccggcca

SEQ ID NO: 2987927 - RNA, 17 nt, Mycobacterium avium subsp. paratuberculosis
ccaggaaccaccggaag

SEQ ID NO: 2987928 - RNA, 17 nt, Mycobacterium avium subsp. paratuberculosis
ccaggaacgacacgugg

SEQ ID NO: 2987929 - RNA, 17 nt, Mycobacterium avium subsp. paratuberculosis
ccaggaacgcgcccggc

SEQ ID NO: 2987930 - RNA, 14 nt, Mycobacterium avium subsp. paratuberculosis
ccaggaacgcgccg

SEQ ID NO: 2987931 - RNA, 18 nt, Mycobacterium avium subsp. paratuberculosis
ccaggaacgcgccggcgc

SEQ ID NO: 2987932 - RNA, 19 nt, Mycobacterium avium subsp. paratuberculosis
ccaggaacgcgccggcgca

SEQ ID NO: 2987933 - RNA, 16 nt, Mycobacterium avium subsp. paratuberculosis
ccaggaacggcgccau

SEQ ID NO: 2987934 - RNA, 20 nt, Mycobacterium avium subsp. paratuberculosis
ccaggaacuggucgaacagc

SEQ ID NO: 2987935 - RNA, 19 nt, Mycobacterium avium subsp. paratuberculosis
ccaggaagaacccggcgug

SEQ ID NO: 2987936 - RNA, 20 nt, Mycobacterium avium subsp. paratuberculosis
ccaggaagaacccggcgugc

SEQ ID NO: 2987937 - RNA, 13 nt, Mycobacterium avium subsp. paratuberculosis
ccaggaagaacuc

SEQ ID NO: 2987938 - RNA, 17 nt, Mycobacterium avium subsp. paratuberculosis
ccaggaagaugccgauc

SEQ ID NO: 2987939 - RNA, 16 nt, Mycobacterium avium subsp. paratuberculosis
ccaggaagccggcgac

SEQ ID NO: 2987940 - RNA, 19 nt, Mycobacterium avium subsp. paratuberculosis
ccaggaagccggcgacgac

SEQ ID NO: 2987941 - RNA, 16 nt, Mycobacterium avium subsp. paratuberculosis
ccaggaaggccaguuc

SEQ ID NO: 2987942 - RNA, 22 nt, Mycobacterium avium subsp. paratuberculosis
ccaggaaggccaguucgacgau

SEQ ID NO: 2987943 - RNA, 18 nt, Mycobacterium avium subsp. paratuberculosis
ccaggaaggcgaccgcgu

SEQ ID NO: 2987944 - RNA, 19 nt, Mycobacterium avium subsp. paratuberculosis
ccaggaaggucccggucag

SEQ ID NO: 2987945 - RNA, 18 nt, Mycobacterium avium subsp. paratuberculosis
ccaggaaguacaccaccg

SEQ ID NO: 2987946 - RNA, 20 nt, Mycobacterium avium subsp. paratuberculosis
ccaggaaguacucggucacc

SEQ ID NO: 2987947 - RNA, 23 nt, Mycobacterium avium subsp. paratuberculosis
ccaggaaguacucggucaccucg

SEQ ID NO: 2987948 - RNA, 16 nt, Mycobacterium avium subsp. paratuberculosis
ccaggaaguagccggc

SEQ ID NO: 2987949 - RNA, 18 nt, Mycobacterium avium subsp. paratuberculosis
ccaggaaguagccggcca

SEQ ID NO: 2987950 - RNA, 19 nt, Mycobacterium avium subsp. paratuberculosis
ccaggaaguagccggccag

SEQ ID NO: 2987951 - RNA, 24 nt, Mycobacterium avium subsp. paratuberculosis
ccaggaaguagccggccagcgucg

SEQ ID NO: 2987952 - RNA, 17 nt, Mycobacterium avium subsp. paratuberculosis
ccaggaauaacgccggc

SEQ ID NO: 2987953 - RNA, 15 nt, Mycobacterium avium subsp. paratuberculosis
ccaggaauucgggca

SEQ ID NO: 2987954 - RNA, 20 nt, Mycobacterium avium subsp. paratuberculosis
ccaggacaggaugcguucgg

SEQ ID NO: 2987955 - RNA, 14 nt, Mycobacterium avium subsp. paratuberculosis
ccaggaccacccac

SEQ ID NO: 2987956 - RNA, 13 nt, Mycobacterium avium subsp. paratuberculosis
ccaggaccagcgg

SEQ ID NO: 2987957 - RNA, 15 nt, Mycobacterium avium subsp. paratuberculosis
ccaggaccagcgggu

SEQ ID NO: 2987958 - RNA, 17 nt, Mycobacterium avium subsp. paratuberculosis
ccaggaccagcgggucg

SEQ ID NO: 2987959 - RNA, 18 nt, Mycobacterium avium subsp. paratuberculosis
ccaggacccguacuucuc

SEQ ID NO: 2987960 - RNA, 12 nt, Mycobacterium avium subsp. paratuberculosis
ccaggaccgcgc

SEQ ID NO: 2987961 - RNA, 20 nt, Mycobacterium avium subsp. paratuberculosis
ccaggaccgcgcgccggcca

SEQ ID NO: 2987962 - RNA, 14 nt, Mycobacterium avium subsp. paratuberculosis
ccaggaccgggacg

SEQ ID NO: 2987963 - RNA, 12 nt, Mycobacterium avium subsp. paratuberculosis
ccaggacggcgc

SEQ ID NO: 2987964 - RNA, 15 nt, Mycobacterium avium subsp. paratuberculosis
ccaggacggcgcggu

SEQ ID NO: 2987965 - RNA, 23 nt, Mycobacterium avium subsp. paratuberculosis
ccaggacgguuucugccggccgc

SEQ ID NO: 2987966 - RNA, 23 nt, Mycobacterium avium subsp. paratuberculosis
ccaggacucgggguugacccggc

SEQ ID NO: 2987967 - RNA, 13 nt, Mycobacterium avium subsp. paratuberculosis
ccaggagcaccug

SEQ ID NO: 2987968 - RNA, 15 nt, Mycobacterium avium subsp. paratuberculosis
ccaggaucaccggga

SEQ ID NO: 2987969 - RNA, 15 nt, Mycobacterium avium subsp. paratuberculosis
ccaggaucacgcggc

SEQ ID NO: 2987970 - RNA, 18 nt, Mycobacterium avium subsp. paratuberculosis
ccaggaucacgcggcggg

SEQ ID NO: 2987971 - RNA, 20 nt, Mycobacterium avium subsp. paratuberculosis
ccaggauccgaugacgcugc

SEQ ID NO: 2987972 - RNA, 16 nt, Mycobacterium avium subsp. paratuberculosis
ccaggauccgcaccgg

SEQ ID NO: 2987973 - RNA, 22 nt, Mycobacterium avium subsp. paratuberculosis
ccaggauccgcaccgggcagcc

SEQ ID NO: 2987974 - RNA, 18 nt, Mycobacterium avium subsp. paratuberculosis
ccaggauccgcccgccgg

SEQ ID NO: 2987975 - RNA, 22 nt, Mycobacterium avium subsp. paratuberculosis
ccaggauccgcccgccgguggc

SEQ ID NO: 2987976 - RNA, 12 nt, Mycobacterium avium subsp. paratuberculosis
ccaggaucgccu

SEQ ID NO: 2987977 - RNA, 14 nt, Mycobacterium avium subsp. paratuberculosis
ccaggaucgggauc

SEQ ID NO: 2987978 - RNA, 16 nt, Mycobacterium avium subsp. paratuberculosis
ccaggaucucgcgggc

SEQ ID NO: 2987979 - RNA, 23 nt, Mycobacterium avium subsp. paratuberculosis
ccaggaucucgcgggcccgcgcg

SEQ ID NO: 2987980 - RNA, 13 nt, Mycobacterium avium subsp. paratuberculosis
ccaggaucugcag

SEQ ID NO: 2987981 - RNA, 17 nt, Mycobacterium avium subsp. paratuberculosis
ccaggaucugcagcacg

SEQ ID NO: 2987982 - RNA, 20 nt, Mycobacterium avium subsp. paratuberculosis
ccaggaucugcagcacgccc

SEQ ID NO: 2987983 - RNA, 14 nt, Mycobacterium avium subsp. paratuberculosis
ccaggaucugggug

SEQ ID NO: 2987984 - RNA, 17 nt, Mycobacterium avium subsp. paratuberculosis
ccaggaucugggugagc

SEQ ID NO: 2987985 - RNA, 18 nt, Mycobacterium avium subsp. paratuberculosis
ccaggaucuugucggcgg

SEQ ID NO: 2987986 - RNA, 19 nt, Mycobacterium avium subsp. paratuberculosis
ccaggaucuugucggcggc

SEQ ID NO: 2987987 - RNA, 17 nt, Mycobacterium avium subsp. paratuberculosis
ccaggaugaaccgggag

SEQ ID NO: 2987988 - RNA, 20 nt, Mycobacterium avium subsp. paratuberculosis
ccaggaugaccgcccaggac

SEQ ID NO: 2987989 - RNA, 22 nt, Mycobacterium avium subsp. paratuberculosis
ccaggaugaccgcccaggaccc

SEQ ID NO: 2987990 - RNA, 13 nt, Mycobacterium avium subsp. paratuberculosis
ccaggaugacgcc

SEQ ID NO: 2987991 - RNA, 14 nt, Mycobacterium avium subsp. paratuberculosis
ccaggaugacgccg

SEQ ID NO: 2987992 - RNA, 16 nt, Mycobacterium avium subsp. paratuberculosis
ccaggaugacgccgaa

SEQ ID NO: 2987993 - RNA, 13 nt, Mycobacterium avium subsp. paratuberculosis
ccaggaugagcug

SEQ ID NO: 2987994 - RNA, 15 nt, Mycobacterium avium subsp. paratuberculosis
ccaggaugagcuggg

SEQ ID NO: 2987995 - RNA, 17 nt, Mycobacterium avium subsp. paratuberculosis
ccaggaugagcugggcg

SEQ ID NO: 2987996 - RNA, 14 nt, Mycobacterium avium subsp. paratuberculosis
ccaggaugcccagg

SEQ ID NO: 2987997 - RNA, 15 nt, Mycobacterium avium subsp. paratuberculosis
ccaggaugcccagga

SEQ ID NO: 2987998 - RNA, 21 nt, Mycobacterium avium subsp. paratuberculosis
ccaggauggagcugaccuggc

SEQ ID NO: 2987999 - RNA, 13 nt, Mycobacterium avium subsp. paratuberculosis
ccaggauggccgc

SEQ ID NO: 2988000 - RNA, 21 nt, Mycobacterium avium subsp. paratuberculosis
ccaggauggggaaguccgggu

SEQ ID NO: 2988001 - RNA, 16 nt, Mycobacterium avium subsp. paratuberculosis
ccaggauguacccgca

SEQ ID NO: 2988002 - RNA, 21 nt, Mycobacterium avium subsp. paratuberculosis
ccaggauguacccgcaggcca

SEQ ID NO: 2988003 - RNA, 19 nt, Mycobacterium avium subsp. paratuberculosis
ccaggaugucgacgacacc

SEQ ID NO: 2988004 - RNA, 14 nt, Mycobacterium avium subsp. paratuberculosis
ccaggaugucgucc

SEQ ID NO: 2988005 - RNA, 22 nt, Mycobacterium avium subsp. paratuberculosis
ccaggaugucguccucggucag

SEQ ID NO: 2988006 - RNA, 18 nt, Mycobacterium avium subsp. paratuberculosis
ccaggauguucaccccgg

SEQ ID NO: 2988007 - RNA, 20 nt, Mycobacterium avium subsp. paratuberculosis
ccaggauguucaccccggcg

SEQ ID NO: 2988008 - RNA, 23 nt, Mycobacterium avium subsp. paratuberculosis
ccaggauguucaccccggcgcgg

SEQ ID NO: 2988009 - RNA, 18 nt, Mycobacterium avium subsp. paratuberculosis
ccaggauuccgucggcgg

SEQ ID NO: 2988010 - RNA, 20 nt, Mycobacterium avium subsp. paratuberculosis
ccaggauuccgucggcggcc

SEQ ID NO: 2988011 - RNA, 21 nt, Mycobacterium avium subsp. paratuberculosis
ccaggauuccgucggcggccg

SEQ ID NO: 2988012 - RNA, 12 nt, Mycobacterium avium subsp. paratuberculosis
ccaggcacagca

SEQ ID NO: 2988013 - RNA, 22 nt, Mycobacterium avium subsp. paratuberculosis
ccaggcacagcagggcaccgac

SEQ ID NO: 2988014 - RNA, 14 nt, Mycobacterium avium subsp. paratuberculosis
ccaggcacggcccg

SEQ ID NO: 2988015 - RNA, 17 nt, Mycobacterium avium subsp. paratuberculosis
ccaggcagaagcuccac

SEQ ID NO: 2988016 - RNA, 20 nt, Mycobacterium avium subsp. paratuberculosis
ccaggcagaagcuccacgcc

SEQ ID NO: 2988017 - RNA, 21 nt, Mycobacterium avium subsp. paratuberculosis
ccaggcagaagcuccacgccg

SEQ ID NO: 2988018 - RNA, 22 nt, Mycobacterium avium subsp. paratuberculosis
ccaggcagaagcuccacgccgc

SEQ ID NO: 2988019 - RNA, 18 nt, Mycobacterium avium subsp. paratuberculosis
ccaggcagacccccagca

SEQ ID NO: 2988020 - RNA, 22 nt, Mycobacterium avium subsp. paratuberculosis
ccaggcagacccccagcagcgg

SEQ ID NO: 2988021 - RNA, 20 nt, Mycobacterium avium subsp. paratuberculosis
ccaggcaugggaucagcagc

SEQ ID NO: 2988022 - RNA, 22 nt, Mycobacterium avium subsp. paratuberculosis
ccaggcaugggaucagcagcac

SEQ ID NO: 2988023 - RNA, 19 nt, Mycobacterium avium subsp. paratuberculosis
ccaggccacccgggcgccg

SEQ ID NO: 2988024 - RNA, 18 nt, Mycobacterium avium subsp. paratuberculosis
ccaggccaccgcacgucu

SEQ ID NO: 2988025 - RNA, 14 nt, Mycobacterium avium subsp. paratuberculosis
ccaggccagcaccu

SEQ ID NO: 2988026 - RNA, 15 nt, Mycobacterium avium subsp. paratuberculosis
ccaggccagcaccug

SEQ ID NO: 2988027 - RNA, 15 nt, Mycobacterium avium subsp. paratuberculosis
ccaggccauggcgca

SEQ ID NO: 2988028 - RNA, 18 nt, Mycobacterium avium subsp. paratuberculosis
ccaggccauggcgcaccg

SEQ ID NO: 2988029 - RNA, 21 nt, Mycobacterium avium subsp. paratuberculosis
ccaggccauggcgcaccgcgg

SEQ ID NO: 2988030 - RNA, 13 nt, Mycobacterium avium subsp. paratuberculosis
ccaggcccaccac

SEQ ID NO: 2988031 - RNA, 14 nt, Mycobacterium avium subsp. paratuberculosis
ccaggcccaccguc

SEQ ID NO: 2988032 - RNA, 16 nt, Mycobacterium avium subsp. paratuberculosis
ccaggcccaccgucgc

SEQ ID NO: 2988033 - RNA, 22 nt, Mycobacterium avium subsp. paratuberculosis
ccaggcccaccgucgccacgau

SEQ ID NO: 2988034 - RNA, 15 nt, Mycobacterium avium subsp. paratuberculosis
ccaggcccagcagca

SEQ ID NO: 2988035 - RNA, 13 nt, Mycobacterium avium subsp. paratuberculosis
ccaggcccagccc

SEQ ID NO: 2988036 - RNA, 14 nt, Mycobacterium avium subsp. paratuberculosis
ccaggcccagccca

SEQ ID NO: 2988037 - RNA, 15 nt, Mycobacterium avium subsp. paratuberculosis
ccaggcccagcccac

SEQ ID NO: 2988038 - RNA, 17 nt, Mycobacterium avium subsp. paratuberculosis
ccaggcccagcccaccg

SEQ ID NO: 2988039 - RNA, 14 nt, Mycobacterium avium subsp. paratuberculosis
ccaggcccagcccg

SEQ ID NO: 2988040 - RNA, 15 nt, Mycobacterium avium subsp. paratuberculosis
ccaggcccagcccgg

SEQ ID NO: 2988041 - RNA, 22 nt, Mycobacterium avium subsp. paratuberculosis
ccaggcccagcccggccccacc

SEQ ID NO: 2988042 - RNA, 13 nt, Mycobacterium avium subsp. paratuberculosis
ccaggcccagcgg

SEQ ID NO: 2988043 - RNA, 14 nt, Mycobacterium avium subsp. paratuberculosis
ccaggcccaggccg

SEQ ID NO: 2988044 - RNA, 16 nt, Mycobacterium avium subsp. paratuberculosis
ccaggcccaucgcggu

SEQ ID NO: 2988045 - RNA, 14 nt, Mycobacterium avium subsp. paratuberculosis
ccaggccccggccg

SEQ ID NO: 2988046 - RNA, 12 nt, Mycobacterium avium subsp. paratuberculosis
ccaggcccggca

SEQ ID NO: 2988047 - RNA, 15 nt, Mycobacterium avium subsp. paratuberculosis
ccaggcccggcaccg

SEQ ID NO: 2988048 - RNA, 16 nt, Mycobacterium avium subsp. paratuberculosis
ccaggcccggcaccgg

SEQ ID NO: 2988049 - RNA, 17 nt, Mycobacterium avium subsp. paratuberculosis
ccaggcccggcaccggu

SEQ ID NO: 2988050 - RNA, 12 nt, Mycobacterium avium subsp. paratuberculosis
ccaggcccuccu

SEQ ID NO: 2988051 - RNA, 17 nt, Mycobacterium avium subsp. paratuberculosis
ccaggcccucgccgcgg

SEQ ID NO: 2988052 - RNA, 18 nt, Mycobacterium avium subsp. paratuberculosis
ccaggcccugccagcgcc

SEQ ID NO: 2988053 - RNA, 19 nt, Mycobacterium avium subsp. paratuberculosis
ccaggcccugccagcgccc

SEQ ID NO: 2988054 - RNA, 17 nt, Mycobacterium avium subsp. paratuberculosis
ccaggccgaagacgaug

SEQ ID NO: 2988055 - RNA, 18 nt, Mycobacterium avium subsp. paratuberculosis
ccaggccgaagacgauga

SEQ ID NO: 2988056 - RNA, 18 nt, Mycobacterium avium subsp. paratuberculosis
ccaggccgacgccggcca

SEQ ID NO: 2988057 - RNA, 20 nt, Mycobacterium avium subsp. paratuberculosis
ccaggccgacgccggccacc

SEQ ID NO: 2988058 - RNA, 23 nt, Mycobacterium avium subsp. paratuberculosis
ccaggccgacgccggccaccaac

SEQ ID NO: 2988059 - RNA, 21 nt, Mycobacterium avium subsp. paratuberculosis
ccaggccgaguauccgcgcag

SEQ ID NO: 2988060 - RNA, 16 nt, Mycobacterium avium subsp. paratuberculosis
ccaggccgccagcucg

SEQ ID NO: 2988061 - RNA, 19 nt, Mycobacterium avium subsp. paratuberculosis
ccaggccgccagcucgucc

SEQ ID NO: 2988062 - RNA, 14 nt, Mycobacterium avium subsp. paratuberculosis
ccaggccgccgcca

SEQ ID NO: 2988063 - RNA, 15 nt, Mycobacterium avium subsp. paratuberculosis
ccaggccgccgccac

SEQ ID NO: 2988064 - RNA, 14 nt, Mycobacterium avium subsp. paratuberculosis
ccaggccgccgggc

SEQ ID NO: 2988065 - RNA, 11 nt, Mycobacterium avium subsp. paratuberculosis
ccaggccgcga

SEQ ID NO: 2988066 - RNA, 15 nt, Mycobacterium avium subsp. paratuberculosis
ccaggccgcgagcac

SEQ ID NO: 2988067 - RNA, 14 nt, Mycobacterium avium subsp. paratuberculosis
ccaggccgcgccgg

SEQ ID NO: 2988068 - RNA, 17 nt, Mycobacterium avium subsp. paratuberculosis
ccaggccgcgccgggcg

SEQ ID NO: 2988069 - RNA, 14 nt, Mycobacterium avium subsp. paratuberculosis
ccaggccgcgcugg

SEQ ID NO: 2988070 - RNA, 16 nt, Mycobacterium avium subsp. paratuberculosis
ccaggccgcgcuggcg

SEQ ID NO: 2988071 - RNA, 14 nt, Mycobacterium avium subsp. paratuberculosis
ccaggccgcggcca

SEQ ID NO: 2988072 - RNA, 22 nt, Mycobacterium avium subsp. paratuberculosis
ccaggccgcggccaagugcggu

SEQ ID NO: 2988073 - RNA, 12 nt, Mycobacterium avium subsp. paratuberculosis
ccaggccggcga

SEQ ID NO: 2988074 - RNA, 18 nt, Mycobacterium avium subsp. paratuberculosis
ccaggccggcgacgccgg

SEQ ID NO: 2988075 - RNA, 19 nt, Mycobacterium avium subsp. paratuberculosis
ccaggccggcgacgccggc

SEQ ID NO: 2988076 - RNA, 22 nt, Mycobacterium avium subsp. paratuberculosis
ccaggccggcgacgccggcgag

SEQ ID NO: 2988077 - RNA, 13 nt, Mycobacterium avium subsp. paratuberculosis
ccaggccggcgag

SEQ ID NO: 2988078 - RNA, 17 nt, Mycobacterium avium subsp. paratuberculosis
ccaggccggcgagcucg

SEQ ID NO: 2988079 - RNA, 23 nt, Mycobacterium avium subsp. paratuberculosis
ccaggccggcgagcucgcggccg

SEQ ID NO: 2988080 - RNA, 13 nt, Mycobacterium avium subsp. paratuberculosis
ccaggccggcgcc

SEQ ID NO: 2988081 - RNA, 15 nt, Mycobacterium avium subsp. paratuberculosis
ccaggccggcgccgc

SEQ ID NO: 2988082 - RNA, 13 nt, Mycobacterium avium subsp. paratuberculosis
ccaggccggcggu

SEQ ID NO: 2988083 - RNA, 17 nt, Mycobacterium avium subsp. paratuberculosis
ccaggccgucgaggcgc

SEQ ID NO: 2988084 - RNA, 18 nt, Mycobacterium avium subsp. paratuberculosis
ccaggccgucgaggcgcu

SEQ ID NO: 2988085 - RNA, 19 nt, Mycobacterium avium subsp. paratuberculosis
ccaggccgucgaggcgcug

SEQ ID NO: 2988086 - RNA, 22 nt, Mycobacterium avium subsp. paratuberculosis
ccaggccgucgaggcgcugcag

SEQ ID NO: 2988087 - RNA, 20 nt, Mycobacterium avium subsp. paratuberculosis
ccaggccgucggcgcggccg

SEQ ID NO: 2988088 - RNA, 17 nt, Mycobacterium avium subsp. paratuberculosis
ccaggccucccacagcg

SEQ ID NO: 2988089 - RNA, 15 nt, Mycobacterium avium subsp. paratuberculosis
ccaggccuuguacgc

SEQ ID NO: 2988090 - RNA, 22 nt, Mycobacterium avium subsp. paratuberculosis
ccaggcgaaguuggucaccacc

SEQ ID NO: 2988091 - RNA, 15 nt, Mycobacterium avium subsp. paratuberculosis
ccaggcgaccggccc

SEQ ID NO: 2988092 - RNA, 22 nt, Mycobacterium avium subsp. paratuberculosis
ccaggcgaccggccccaacggc

SEQ ID NO: 2988093 - RNA, 14 nt, Mycobacterium avium subsp. paratuberculosis
ccaggcgacguucg

SEQ ID NO: 2988094 - RNA, 16 nt, Mycobacterium avium subsp. paratuberculosis
ccaggcgaugaagccg

SEQ ID NO: 2988095 - RNA, 19 nt, Mycobacterium avium subsp. paratuberculosis
ccaggcgaugaagccggcg

SEQ ID NO: 2988096 - RNA, 17 nt, Mycobacterium avium subsp. paratuberculosis
ccaggcgaugccgccga

SEQ ID NO: 2988097 - RNA, 14 nt, Mycobacterium avium subsp. paratuberculosis
ccaggcgcaccagc

SEQ ID NO: 2988098 - RNA, 15 nt, Mycobacterium avium subsp. paratuberculosis
ccaggcgcaccagcu

SEQ ID NO: 2988099 - RNA, 17 nt, Mycobacterium avium subsp. paratuberculosis
ccaggcgcaccgccacc

SEQ ID NO: 2988100 - RNA, 18 nt, Mycobacterium avium subsp. paratuberculosis
ccaggcgcaccgccaccg

SEQ ID NO: 2988101 - RNA, 20 nt, Mycobacterium avium subsp. paratuberculosis
ccaggcgcaccgccaccgcg

SEQ ID NO: 2988102 - RNA, 14 nt, Mycobacterium avium subsp. paratuberculosis
ccaggcgccacagc

SEQ ID NO: 2988103 - RNA, 15 nt, Mycobacterium avium subsp. paratuberculosis
ccaggcgccacagca

SEQ ID NO: 2988104 - RNA, 17 nt, Mycobacterium avium subsp. paratuberculosis
ccaggcgccacagcagc

SEQ ID NO: 2988105 - RNA, 19 nt, Mycobacterium avium subsp. paratuberculosis
ccaggcgccacagcagcac

SEQ ID NO: 2988106 - RNA, 20 nt, Mycobacterium avium subsp. paratuberculosis
ccaggcgccacagcagcacc

SEQ ID NO: 2988107 - RNA, 19 nt, Mycobacterium avium subsp. paratuberculosis
ccaggcgcccagcacccgg

SEQ ID NO: 2988108 - RNA, 17 nt, Mycobacterium avium subsp. paratuberculosis
ccaggcgcccugcacga

SEQ ID NO: 2988109 - RNA, 17 nt, Mycobacterium avium subsp. paratuberculosis
ccaggcgccggccagca

SEQ ID NO: 2988110 - RNA, 19 nt, Mycobacterium avium subsp. paratuberculosis
ccaggcgccggccagcacg

SEQ ID NO: 2988111 - RNA, 13 nt, Mycobacterium avium subsp. paratuberculosis
ccaggcgccgucg

SEQ ID NO: 2988112 - RNA, 16 nt, Mycobacterium avium subsp. paratuberculosis
ccaggcgccgucgaug

SEQ ID NO: 2988113 - RNA, 15 nt, Mycobacterium avium subsp. paratuberculosis
ccaggcgcgcgcugg

SEQ ID NO: 2988114 - RNA, 18 nt, Mycobacterium avium subsp. paratuberculosis
ccaggcggaucacaucgg

SEQ ID NO: 2988115 - RNA, 21 nt, Mycobacterium avium subsp. paratuberculosis
ccaggcggaucacaucggaca

SEQ ID NO: 2988116 - RNA, 21 nt, Mycobacterium avium subsp. paratuberculosis
ccaggcggcgacgaacgccgg

SEQ ID NO: 2988117 - RNA, 22 nt, Mycobacterium avium subsp. paratuberculosis
ccaggcgggccaccacaguggc

SEQ ID NO: 2988118 - RNA, 13 nt, Mycobacterium avium subsp. paratuberculosis
ccaggcgggccag

SEQ ID NO: 2988119 - RNA, 17 nt, Mycobacterium avium subsp. paratuberculosis
ccaggcgguccgacacc

SEQ ID NO: 2988120 - RNA, 18 nt, Mycobacterium avium subsp. paratuberculosis
ccaggcgguggccgaacc

SEQ ID NO: 2988121 - RNA, 16 nt, Mycobacterium avium subsp. paratuberculosis
ccaggcgugcacccgg

SEQ ID NO: 2988122 - RNA, 21 nt, Mycobacterium avium subsp. paratuberculosis
ccaggcgugcacccgguucug

SEQ ID NO: 2988123 - RNA, 16 nt, Mycobacterium avium subsp. paratuberculosis
ccaggcgugcgcgugg

SEQ ID NO: 2988124 - RNA, 16 nt, Mycobacterium avium subsp. paratuberculosis
ccaggcguggucggcg

SEQ ID NO: 2988125 - RNA, 17 nt, Mycobacterium avium subsp. paratuberculosis
ccaggcguggucggcgc

SEQ ID NO: 2988126 - RNA, 19 nt, Mycobacterium avium subsp. paratuberculosis
ccaggcguucgaccccaac

SEQ ID NO: 2988127 - RNA, 17 nt, Mycobacterium avium subsp. paratuberculosis
ccaggcguugcaccgcg

SEQ ID NO: 2988128 - RNA, 18 nt, Mycobacterium avium subsp. paratuberculosis
ccaggcguugcaccgcgg

SEQ ID NO: 2988129 - RNA, 23 nt, Mycobacterium avium subsp. paratuberculosis
ccaggcguugcaccgcgggcacg

SEQ ID NO: 2988130 - RNA, 16 nt, Mycobacterium avium subsp. paratuberculosis
ccaggcguuggucacc

SEQ ID NO: 2988131 - RNA, 21 nt, Mycobacterium avium subsp. paratuberculosis
ccaggcucacgcugccaaagu

SEQ ID NO: 2988132 - RNA, 22 nt, Mycobacterium avium subsp. paratuberculosis
ccaggcucacguagucgaccgg

SEQ ID NO: 2988133 - RNA, 20 nt, Mycobacterium avium subsp. paratuberculosis
ccaggcucaggaucagcagc

SEQ ID NO: 2988134 - RNA, 22 nt, Mycobacterium avium subsp. paratuberculosis
ccaggcucaggaucagcagccg

SEQ ID NO: 2988135 - RNA, 17 nt, Mycobacterium avium subsp. paratuberculosis
ccaggcucgacaacugc

SEQ ID NO: 2988136 - RNA, 18 nt, Mycobacterium avium subsp. paratuberculosis
ccaggcucgcgagggcgg

SEQ ID NO: 2988137 - RNA, 14 nt, Mycobacterium avium subsp. paratuberculosis
ccaggcucgcuccc

SEQ ID NO: 2988138 - RNA, 18 nt, Mycobacterium avium subsp. paratuberculosis
ccaggcucgcucccgcgc

SEQ ID NO: 2988139 - RNA, 17 nt, Mycobacterium avium subsp. paratuberculosis
ccaggcugaacaccacc

SEQ ID NO: 2988140 - RNA, 22 nt, Mycobacterium avium subsp. paratuberculosis
ccaggcugaacaccaccaggcc

SEQ ID NO: 2988141 - RNA, 23 nt, Mycobacterium avium subsp. paratuberculosis
ccaggcugaacaccaccaggccg

SEQ ID NO: 2988142 - RNA, 14 nt, Mycobacterium avium subsp. paratuberculosis
ccaggcugaacguc

SEQ ID NO: 2988143 - RNA, 14 nt, Mycobacterium avium subsp. paratuberculosis
ccaggcugaccagc

SEQ ID NO: 2988144 - RNA, 19 nt, Mycobacterium avium subsp. paratuberculosis
ccaggcugcucggcgggcu

SEQ ID NO: 2988145 - RNA, 21 nt, Mycobacterium avium subsp. paratuberculosis
ccaggcugcucggcgggcucg

SEQ ID NO: 2988146 - RNA, 13 nt, Mycobacterium avium subsp. paratuberculosis
ccaggcuugcccc

SEQ ID NO: 2988147 - RNA, 17 nt, Mycobacterium avium subsp. paratuberculosis
ccaggcuugccccguac

SEQ ID NO: 2988148 - RNA, 20 nt, Mycobacterium avium subsp. paratuberculosis
ccaggcuuggcccgccgccg

SEQ ID NO: 2988149 - RNA, 18 nt, Mycobacterium avium subsp. paratuberculosis
ccagggacaugccgagca

SEQ ID NO: 2988150 - RNA, 22 nt, Mycobacterium avium subsp. paratuberculosis
ccagggacaugccgagcagcac

SEQ ID NO: 2988151 - RNA, 16 nt, Mycobacterium avium subsp. paratuberculosis
ccagggacuccgggga

SEQ ID NO: 2988152 - RNA, 16 nt, Mycobacterium avium subsp. paratuberculosis
ccagggcagccagccc

SEQ ID NO: 2988153 - RNA, 17 nt, Mycobacterium avium subsp. paratuberculosis
ccagggcagccagcccg

SEQ ID NO: 2988154 - RNA, 19 nt, Mycobacterium avium subsp. paratuberculosis
ccagggcagccagcccgcg

SEQ ID NO: 2988155 - RNA, 14 nt, Mycobacterium avium subsp. paratuberculosis
ccagggcagcgccu

SEQ ID NO: 2988156 - RNA, 19 nt, Mycobacterium avium subsp. paratuberculosis
ccagggcagcgccucggcg

SEQ ID NO: 2988157 - RNA, 13 nt, Mycobacterium avium subsp. paratuberculosis
ccagggcagcgcg

SEQ ID NO: 2988158 - RNA, 14 nt, Mycobacterium avium subsp. paratuberculosis
ccagggcagcgcga

SEQ ID NO: 2988159 - RNA, 19 nt, Mycobacterium avium subsp. paratuberculosis
ccagggcagcgcgaccagc

SEQ ID NO: 2988160 - RNA, 22 nt, Mycobacterium avium subsp. paratuberculosis
ccagggcagcgcgaccagcccg

SEQ ID NO: 2988161 - RNA, 13 nt, Mycobacterium avium subsp. paratuberculosis
ccagggccgccgc

SEQ ID NO: 2988162 - RNA, 16 nt, Mycobacterium avium subsp. paratuberculosis
ccagggccgcgagcgc

SEQ ID NO: 2988163 - RNA, 17 nt, Mycobacterium avium subsp. paratuberculosis
ccagggccgcgagcgcu

SEQ ID NO: 2988164 - RNA, 12 nt, Mycobacterium avium subsp. paratuberculosis
ccagggccgggc

SEQ ID NO: 2988165 - RNA, 19 nt, Mycobacterium avium subsp. paratuberculosis
ccagggccgggcgugcccg

SEQ ID NO: 2988166 - RNA, 18 nt, Mycobacterium avium subsp. paratuberculosis
ccagggccugcagcacca

SEQ ID NO: 2988167 - RNA, 14 nt, Mycobacterium avium subsp. paratuberculosis
ccagggcgaccgcc

SEQ ID NO: 2988168 - RNA, 15 nt, Mycobacterium avium subsp. paratuberculosis
ccagggcgaccgccg

SEQ ID NO: 2988169 - RNA, 18 nt, Mycobacterium avium subsp. paratuberculosis
ccagggcgaccgccgcgu

SEQ ID NO: 2988170 - RNA, 17 nt, Mycobacterium avium subsp. paratuberculosis
ccagggcgacgccgcgg

SEQ ID NO: 2988171 - RNA, 21 nt, Mycobacterium avium subsp. paratuberculosis
ccagggcgaggaacccgaccg

SEQ ID NO: 2988172 - RNA, 16 nt, Mycobacterium avium subsp. paratuberculosis
ccagggcgaucaccgc

SEQ ID NO: 2988173 - RNA, 17 nt, Mycobacterium avium subsp. paratuberculosis
ccagggcgaucaccgcg

SEQ ID NO: 2988174 - RNA, 23 nt, Mycobacterium avium subsp. paratuberculosis
ccagggcgaucaccgcggccacc

SEQ ID NO: 2988175 - RNA, 20 nt, Mycobacterium avium subsp. paratuberculosis
ccagggcgcguccacuccaa

SEQ ID NO: 2988176 - RNA, 14 nt, Mycobacterium avium subsp. paratuberculosis
ccagggcggcgccg

SEQ ID NO: 2988177 - RNA, 15 nt, Mycobacterium avium subsp. paratuberculosis
ccagggcggcgccgg

SEQ ID NO: 2988178 - RNA, 12 nt, Mycobacterium avium subsp. paratuberculosis
ccagggcggugg

SEQ ID NO: 2988179 - RNA, 13 nt, Mycobacterium avium subsp. paratuberculosis
ccagggcgugcgc

SEQ ID NO: 2988180 - RNA, 18 nt, Mycobacterium avium subsp. paratuberculosis
ccagggcgugcgcggccg

SEQ ID NO: 2988181 - RNA, 21 nt, Mycobacterium avium subsp. paratuberculosis
ccagggcguggaacgcgucgc

SEQ ID NO: 2988182 - RNA, 16 nt, Mycobacterium avium subsp. paratuberculosis
ccagggcucgugcagc

SEQ ID NO: 2988183 - RNA, 21 nt, Mycobacterium avium subsp. paratuberculosis
ccagggcucgugcagccggcg

SEQ ID NO: 2988184 - RNA, 14 nt, Mycobacterium avium subsp. paratuberculosis
ccaggggagcggcg

SEQ ID NO: 2988185 - RNA, 14 nt, Mycobacterium avium subsp. paratuberculosis
ccaggggcagcuga

SEQ ID NO: 2988186 - RNA, 19 nt, Mycobacterium avium subsp. paratuberculosis
ccagggggaguagucggcg

SEQ ID NO: 2988187 - RNA, 15 nt, Mycobacterium avium subsp. paratuberculosis
ccaggguagaggcgg

SEQ ID NO: 2988188 - RNA, 17 nt, Mycobacterium avium subsp. paratuberculosis
ccaggguagaggcggcg

SEQ ID NO: 2988189 - RNA, 18 nt, Mycobacterium avium subsp. paratuberculosis
ccaggguagaggcggcga

SEQ ID NO: 2988190 - RNA, 17 nt, Mycobacterium avium subsp. paratuberculosis
ccagggucucgcgcagc

SEQ ID NO: 2988191 - RNA, 18 nt, Mycobacterium avium subsp. paratuberculosis
ccagggucucgcgcagca

SEQ ID NO: 2988192 - RNA, 20 nt, Mycobacterium avium subsp. paratuberculosis
ccagggucucgcgcagcacg

SEQ ID NO: 2988193 - RNA, 21 nt, Mycobacterium avium subsp. paratuberculosis
ccagggucucgcgcagcacga

SEQ ID NO: 2988194 - RNA, 16 nt, Mycobacterium avium subsp. paratuberculosis
ccagggucucgggcag

SEQ ID NO: 2988195 - RNA, 22 nt, Mycobacterium avium subsp. paratuberculosis
ccagggucucgggcagcagcac

SEQ ID NO: 2988196 - RNA, 16 nt, Mycobacterium avium subsp. paratuberculosis
ccagggucuggcccgg

SEQ ID NO: 2988197 - RNA, 12 nt, Mycobacterium avium subsp. paratuberculosis
ccagggugccga

SEQ ID NO: 2988198 - RNA, 14 nt, Mycobacterium avium subsp. paratuberculosis
ccagggugccgccg

SEQ ID NO: 2988199 - RNA, 17 nt, Mycobacterium avium subsp. paratuberculosis
ccagggugccgcugccc

SEQ ID NO: 2988200 - RNA, 21 nt, Mycobacterium avium subsp. paratuberculosis
ccagggugccgcugcccgccg

SEQ ID NO: 2988201 - RNA, 23 nt, Mycobacterium avium subsp. paratuberculosis
ccagggugccgcugcccgccgcg

SEQ ID NO: 2988202 - RNA, 15 nt, Mycobacterium avium subsp. paratuberculosis
ccagggugcgccgcu

SEQ ID NO: 2988203 - RNA, 16 nt, Mycobacterium avium subsp. paratuberculosis
ccagggugcgccgcuc

SEQ ID NO: 2988204 - RNA, 17 nt, Mycobacterium avium subsp. paratuberculosis
ccaggguggccagcacg

SEQ ID NO: 2988205 - RNA, 15 nt, Mycobacterium avium subsp. paratuberculosis
ccaggguggccccag

SEQ ID NO: 2988206 - RNA, 20 nt, Mycobacterium avium subsp. paratuberculosis
ccaggguggccccagcccgg

SEQ ID NO: 2988207 - RNA, 15 nt, Mycobacterium avium subsp. paratuberculosis
ccaggguggucagcg

SEQ ID NO: 2988208 - RNA, 14 nt, Mycobacterium avium subsp. paratuberculosis
ccagggugguggug

SEQ ID NO: 2988209 - RNA, 15 nt, Mycobacterium avium subsp. paratuberculosis
ccagggugucgauga

SEQ ID NO: 2988210 - RNA, 12 nt, Mycobacterium avium subsp. paratuberculosis
ccagggugucgu

SEQ ID NO: 2988211 - RNA, 17 nt, Mycobacterium avium subsp. paratuberculosis
ccagggugucgucgcgc

SEQ ID NO: 2988212 - RNA, 23 nt, Mycobacterium avium subsp. paratuberculosis
ccagggugucgucgcgcacccag

SEQ ID NO: 2988213 - RNA, 16 nt, Mycobacterium avium subsp. paratuberculosis
ccagggugucgucguc

SEQ ID NO: 2988214 - RNA, 19 nt, Mycobacterium avium subsp. paratuberculosis
ccagggugucgucgucggu

SEQ ID NO: 2988215 - RNA, 20 nt, Mycobacterium avium subsp. paratuberculosis
ccaggguucucgcggcggcc

SEQ ID NO: 2988216 - RNA, 20 nt, Mycobacterium avium subsp. paratuberculosis
ccaggguuggucggagccgu

SEQ ID NO: 2988217 - RNA, 18 nt, Mycobacterium avium subsp. paratuberculosis
ccagguacacguagcggu

SEQ ID NO: 2988218 - RNA, 17 nt, Mycobacterium avium subsp. paratuberculosis
ccagguaccggcgggcg

SEQ ID NO: 2988219 - RNA, 17 nt, Mycobacterium avium subsp. paratuberculosis
ccagguacugggcgugg

SEQ ID NO: 2988220 - RNA, 18 nt, Mycobacterium avium subsp. paratuberculosis
ccagguacugggcguggu

SEQ ID NO: 2988221 - RNA, 21 nt, Mycobacterium avium subsp. paratuberculosis
ccagguagacgaugcccagcc

SEQ ID NO: 2988222 - RNA, 17 nt, Mycobacterium avium subsp. paratuberculosis
ccagguagauggugauc

SEQ ID NO: 2988223 - RNA, 20 nt, Mycobacterium avium subsp. paratuberculosis
ccagguaggcgcccugcgag

SEQ ID NO: 2988224 - RNA, 14 nt, Mycobacterium avium subsp. paratuberculosis
ccagguaguagcgc

SEQ ID NO: 2988225 - RNA, 16 nt, Mycobacterium avium subsp. paratuberculosis
ccagguauucaucgcg

SEQ ID NO: 2988226 - RNA, 21 nt, Mycobacterium avium subsp. paratuberculosis
ccagguauucaucgcggccgc

SEQ ID NO: 2988227 - RNA, 23 nt, Mycobacterium avium subsp. paratuberculosis
ccagguauucgcgggaggacagc

SEQ ID NO: 2988228 - RNA, 21 nt, Mycobacterium avium subsp. paratuberculosis
ccagguauucguugcccugcc

SEQ ID NO: 2988229 - RNA, 20 nt, Mycobacterium avium subsp. paratuberculosis
ccaggucaugguggcggcgc

SEQ ID NO: 2988230 - RNA, 22 nt, Mycobacterium avium subsp. paratuberculosis
ccaggucaugguggcggcgccg

SEQ ID NO: 2988231 - RNA, 22 nt, Mycobacterium avium subsp. paratuberculosis
ccagguccaccaggugaccggc

SEQ ID NO: 2988232 - RNA, 23 nt, Mycobacterium avium subsp. paratuberculosis
ccagguccaccguugucucggcg

SEQ ID NO: 2988233 - RNA, 14 nt, Mycobacterium avium subsp. paratuberculosis
ccaggucccaggcg

SEQ ID NO: 2988234 - RNA, 17 nt, Mycobacterium avium subsp. paratuberculosis
ccaggucccaggcgugg

SEQ ID NO: 2988235 - RNA, 22 nt, Mycobacterium avium subsp. paratuberculosis
ccaggucccaggcguggucggc

SEQ ID NO: 2988236 - RNA, 18 nt, Mycobacterium avium subsp. paratuberculosis
ccagguccgggaacagcg

SEQ ID NO: 2988237 - RNA, 19 nt, Mycobacterium avium subsp. paratuberculosis
ccagguccgguucgaccgg

SEQ ID NO: 2988238 - RNA, 20 nt, Mycobacterium avium subsp. paratuberculosis
ccagguccgguucgaccggc

SEQ ID NO: 2988239 - RNA, 19 nt, Mycobacterium avium subsp. paratuberculosis
ccagguccucgcuggcgau

SEQ ID NO: 2988240 - RNA, 23 nt, Mycobacterium avium subsp. paratuberculosis
ccagguccucgcuggcgaucacc

SEQ ID NO: 2988241 - RNA, 13 nt, Mycobacterium avium subsp. paratuberculosis
ccagguccuugag

SEQ ID NO: 2988242 - RNA, 21 nt, Mycobacterium avium subsp. paratuberculosis
ccaggucgaagcgcagcaccu

SEQ ID NO: 2988243 - RNA, 16 nt, Mycobacterium avium subsp. paratuberculosis
ccaggucgacgggguc

SEQ ID NO: 2988244 - RNA, 23 nt, Mycobacterium avium subsp. paratuberculosis
ccaggucgacggggucggacaga

SEQ ID NO: 2988245 - RNA, 12 nt, Mycobacterium avium subsp. paratuberculosis
ccaggucgaggu

SEQ ID NO: 2988246 - RNA, 20 nt, Mycobacterium avium subsp. paratuberculosis
ccaggucgagguccucggcg

SEQ ID NO: 2988247 - RNA, 22 nt, Mycobacterium avium subsp. paratuberculosis
ccaggucgaguucaugaucucg

SEQ ID NO: 2988248 - RNA, 19 nt, Mycobacterium avium subsp. paratuberculosis
ccaggucgaucucggccag

SEQ ID NO: 2988249 - RNA, 20 nt, Mycobacterium avium subsp. paratuberculosis
ccaggucgaucucggccagc

SEQ ID NO: 2988250 - RNA, 22 nt, Mycobacterium avium subsp. paratuberculosis
ccaggucgaucucggccagcgg

SEQ ID NO: 2988251 - RNA, 14 nt, Mycobacterium avium subsp. paratuberculosis
ccaggucgcacacc

SEQ ID NO: 2988252 - RNA, 17 nt, Mycobacterium avium subsp. paratuberculosis
ccaggucgcacaccagc

SEQ ID NO: 2988253 - RNA, 20 nt, Mycobacterium avium subsp. paratuberculosis
ccaggucgcacaccagcacg

SEQ ID NO: 2988254 - RNA, 14 nt, Mycobacterium avium subsp. paratuberculosis
ccaggucgcccucg

SEQ ID NO: 2988255 - RNA, 15 nt, Mycobacterium avium subsp. paratuberculosis
ccaggucgccgcgca

SEQ ID NO: 2988256 - RNA, 17 nt, Mycobacterium avium subsp. paratuberculosis
ccaggucgccgcgcagc

SEQ ID NO: 2988257 - RNA, 12 nt, Mycobacterium avium subsp. paratuberculosis
ccaggucgccgg

SEQ ID NO: 2988258 - RNA, 15 nt, Mycobacterium avium subsp. paratuberculosis
ccaggucgccggcgg

SEQ ID NO: 2988259 - RNA, 16 nt, Mycobacterium avium subsp. paratuberculosis
ccaggucgccggcggc

SEQ ID NO: 2988260 - RNA, 15 nt, Mycobacterium avium subsp. paratuberculosis
ccaggucgcggcgcu

SEQ ID NO: 2988261 - RNA, 16 nt, Mycobacterium avium subsp. paratuberculosis
ccaggucgcggcgcug

SEQ ID NO: 2988262 - RNA, 20 nt, Mycobacterium avium subsp. paratuberculosis
ccaggucgcggcgcugcgcc

SEQ ID NO: 2988263 - RNA, 22 nt, Mycobacterium avium subsp. paratuberculosis
ccaggucgcggcgcugcgccgu

SEQ ID NO: 2988264 - RNA, 23 nt, Mycobacterium avium subsp. paratuberculosis
ccaggucgcggcgcugcgccguu

SEQ ID NO: 2988265 - RNA, 20 nt, Mycobacterium avium subsp. paratuberculosis
ccaggucgcugacgaugauc

SEQ ID NO: 2988266 - RNA, 16 nt, Mycobacterium avium subsp. paratuberculosis
ccaggucggcgugauc

SEQ ID NO: 2988267 - RNA, 22 nt, Mycobacterium avium subsp. paratuberculosis
ccaggucggcgugaucccgauc

SEQ ID NO: 2988268 - RNA, 21 nt, Mycobacterium avium subsp. paratuberculosis
ccaggucgggacguccgcgcg

SEQ ID NO: 2988269 - RNA, 14 nt, Mycobacterium avium subsp. paratuberculosis
ccaggucggggccc

SEQ ID NO: 2988270 - RNA, 20 nt, Mycobacterium avium subsp. paratuberculosis
ccaggucgggguccaggccg

SEQ ID NO: 2988271 - RNA, 22 nt, Mycobacterium avium subsp. paratuberculosis
ccaggucgggguccaggccgcg

SEQ ID NO: 2988272 - RNA, 13 nt, Mycobacterium avium subsp. paratuberculosis
ccaggucggggug

SEQ ID NO: 2988273 - RNA, 14 nt, Mycobacterium avium subsp. paratuberculosis
ccaggucggugaca

SEQ ID NO: 2988274 - RNA, 21 nt, Mycobacterium avium subsp. paratuberculosis
ccaggucguucauucagcacc

SEQ ID NO: 2988275 - RNA, 22 nt, Mycobacterium avium subsp. paratuberculosis
ccaggucguucauucagcaccu

SEQ ID NO: 2988276 - RNA, 16 nt, Mycobacterium avium subsp. paratuberculosis
ccaggucguugccggu

SEQ ID NO: 2988277 - RNA, 20 nt, Mycobacterium avium subsp. paratuberculosis
ccaggucguugccggugccg

SEQ ID NO: 2988278 - RNA, 18 nt, Mycobacterium avium subsp. paratuberculosis
ccaggucuccgucggcgc

SEQ ID NO: 2988279 - RNA, 20 nt, Mycobacterium avium subsp. paratuberculosis
ccaggucuucucguccgcgc

SEQ ID NO: 2988280 - RNA, 23 nt, Mycobacterium avium subsp. paratuberculosis
ccaggucuucucguccgcgcugg

SEQ ID NO: 2988281 - RNA, 22 nt, Mycobacterium avium subsp. paratuberculosis
ccaggucuugaggaugacgggg

SEQ ID NO: 2988282 - RNA, 15 nt, Mycobacterium avium subsp. paratuberculosis
ccaggugaacagcag

SEQ ID NO: 2988283 - RNA, 19 nt, Mycobacterium avium subsp. paratuberculosis
ccaggugaacagcagccac

SEQ ID NO: 2988284 - RNA, 20 nt, Mycobacterium avium subsp. paratuberculosis
ccaggugaacagcagccacg

SEQ ID NO: 2988285 - RNA, 15 nt, Mycobacterium avium subsp. paratuberculosis
ccaggugaacagguc

SEQ ID NO: 2988286 - RNA, 18 nt, Mycobacterium avium subsp. paratuberculosis
ccaggugaaugcucagcg

SEQ ID NO: 2988287 - RNA, 13 nt, Mycobacterium avium subsp. paratuberculosis
ccaggugacgccg

SEQ ID NO: 2988288 - RNA, 14 nt, Mycobacterium avium subsp. paratuberculosis
ccaggugacgccgc

SEQ ID NO: 2988289 - RNA, 16 nt, Mycobacterium avium subsp. paratuberculosis
ccaggugacgccgcac

SEQ ID NO: 2988290 - RNA, 17 nt, Mycobacterium avium subsp. paratuberculosis
ccaggugacgccgcacg

SEQ ID NO: 2988291 - RNA, 17 nt, Mycobacterium avium subsp. paratuberculosis
ccaggugcacccgcggc

SEQ ID NO: 2988292 - RNA, 21 nt, Mycobacterium avium subsp. paratuberculosis
ccaggugcacccgcggcgcga

SEQ ID NO: 2988293 - RNA, 15 nt, Mycobacterium avium subsp. paratuberculosis
ccaggugcacgccga

SEQ ID NO: 2988294 - RNA, 18 nt, Mycobacterium avium subsp. paratuberculosis
ccaggugcacgccgagca

SEQ ID NO: 2988295 - RNA, 20 nt, Mycobacterium avium subsp. paratuberculosis
ccaggugcacgccgagcagc

SEQ ID NO: 2988296 - RNA, 21 nt, Mycobacterium avium subsp. paratuberculosis
ccaggugcacgccgagcagca

SEQ ID NO: 2988297 - RNA, 14 nt, Mycobacterium avium subsp. paratuberculosis
ccaggugcagaccg

SEQ ID NO: 2988298 - RNA, 21 nt, Mycobacterium avium subsp. paratuberculosis
ccaggugcagaccggacagcu

SEQ ID NO: 2988299 - RNA, 14 nt, Mycobacterium avium subsp. paratuberculosis
ccaggugcgccgcc

SEQ ID NO: 2988300 - RNA, 18 nt, Mycobacterium avium subsp. paratuberculosis
ccaggugcgccgccgcgu

SEQ ID NO: 2988301 - RNA, 22 nt, Mycobacterium avium subsp. paratuberculosis
ccaggugcgccgccgcgucgcc

SEQ ID NO: 2988302 - RNA, 13 nt, Mycobacterium avium subsp. paratuberculosis
ccaggugcugccc

SEQ ID NO: 2988303 - RNA, 21 nt, Mycobacterium avium subsp. paratuberculosis
ccaggugcugcccuugugguu

SEQ ID NO: 2988304 - RNA, 15 nt, Mycobacterium avium subsp. paratuberculosis
ccagguggcccgacc

SEQ ID NO: 2988305 - RNA, 17 nt, Mycobacterium avium subsp. paratuberculosis
ccagguggcgccuccgc

SEQ ID NO: 2988306 - RNA, 16 nt, Mycobacterium avium subsp. paratuberculosis
ccaggugggcgcgcag

SEQ ID NO: 2988307 - RNA, 15 nt, Mycobacterium avium subsp. paratuberculosis
ccaggugggcggcca

SEQ ID NO: 2988308 - RNA, 15 nt, Mycobacterium avium subsp. paratuberculosis
ccagguggggcacgg

SEQ ID NO: 2988309 - RNA, 17 nt, Mycobacterium avium subsp. paratuberculosis
ccagguggggcacgggc

SEQ ID NO: 2988310 - RNA, 15 nt, Mycobacterium avium subsp. paratuberculosis
ccaggugggguggug

SEQ ID NO: 2988311 - RNA, 21 nt, Mycobacterium avium subsp. paratuberculosis
ccagguguagaccacgaucug

SEQ ID NO: 2988312 - RNA, 21 nt, Mycobacterium avium subsp. paratuberculosis
ccagguguaggcguggcaggc

SEQ ID NO: 2988313 - RNA, 14 nt, Mycobacterium avium subsp. paratuberculosis
ccagguguccggcc

SEQ ID NO: 2988314 - RNA, 18 nt, Mycobacterium avium subsp. paratuberculosis
ccagguguccggcccgau

SEQ ID NO: 2988315 - RNA, 16 nt, Mycobacterium avium subsp. paratuberculosis
ccaggugugcccgccc

SEQ ID NO: 2988316 - RNA, 15 nt, Mycobacterium avium subsp. paratuberculosis
ccaggugugcggcac

SEQ ID NO: 2988317 - RNA, 14 nt, Mycobacterium avium subsp. paratuberculosis
ccagguucagcccg

SEQ ID NO: 2988318 - RNA, 23 nt, Mycobacterium avium subsp. paratuberculosis
ccagguucagcccggcgcugcgc

SEQ ID NO: 2988319 - RNA, 17 nt, Mycobacterium avium subsp. paratuberculosis
ccagguucaggcccgcg

SEQ ID NO: 2988320 - RNA, 18 nt, Mycobacterium avium subsp. paratuberculosis
ccagguucaggcccgcgc

SEQ ID NO: 2988321 - RNA, 13 nt, Mycobacterium avium subsp. paratuberculosis
ccagguucaggcu

SEQ ID NO: 2988322 - RNA, 15 nt, Mycobacterium avium subsp. paratuberculosis
ccagguucaggcuga

SEQ ID NO: 2988323 - RNA, 14 nt, Mycobacterium avium subsp. paratuberculosis
ccagguuccggugu

SEQ ID NO: 2988324 - RNA, 14 nt, Mycobacterium avium subsp. paratuberculosis
ccagguucgccgcc

SEQ ID NO: 2988325 - RNA, 15 nt, Mycobacterium avium subsp. paratuberculosis
ccagguucgcgcagc

SEQ ID NO: 2988326 - RNA, 14 nt, Mycobacterium avium subsp. paratuberculosis
ccagguucgcgccg

SEQ ID NO: 2988327 - RNA, 16 nt, Mycobacterium avium subsp. paratuberculosis
ccagguucgcgccgau

SEQ ID NO: 2988328 - RNA, 18 nt, Mycobacterium avium subsp. paratuberculosis
ccagguugaccaccagcg

SEQ ID NO: 2988329 - RNA, 21 nt, Mycobacterium avium subsp. paratuberculosis
ccagguugaccaccagcgugc

SEQ ID NO: 2988330 - RNA, 21 nt, Mycobacterium avium subsp. paratuberculosis
ccagguugccacgcggauagc

SEQ ID NO: 2988331 - RNA, 14 nt, Mycobacterium avium subsp. paratuberculosis
ccagguugcgccgu

SEQ ID NO: 2988332 - RNA, 17 nt, Mycobacterium avium subsp. paratuberculosis
ccagguugcgccguccg

SEQ ID NO: 2988333 - RNA, 19 nt, Mycobacterium avium subsp. paratuberculosis
ccagguugcgccguccggc

SEQ ID NO: 2988334 - RNA, 22 nt, Mycobacterium avium subsp. paratuberculosis
ccagguugcgccguccggccac

SEQ ID NO: 2988335 - RNA, 15 nt, Mycobacterium avium subsp. paratuberculosis
ccagguuggcggcgg

SEQ ID NO: 2988336 - RNA, 22 nt, Mycobacterium avium subsp. paratuberculosis
ccagguuggcggcggcccgcgc

SEQ ID NO: 2988337 - RNA, 14 nt, Mycobacterium avium subsp. paratuberculosis
ccagguuggucagc

SEQ ID NO: 2988338 - RNA, 16 nt, Mycobacterium avium subsp. paratuberculosis
ccagguuggucagcag

SEQ ID NO: 2988339 - RNA, 21 nt, Mycobacterium avium subsp. paratuberculosis
ccagguuggucagcagcagcg

SEQ ID NO: 2988340 - RNA, 22 nt, Mycobacterium avium subsp. paratuberculosis
ccagguuggucagcagcagcgc

SEQ ID NO: 2988341 - RNA, 19 nt, Mycobacterium avium subsp. paratuberculosis
ccagguuguaggugcccga

SEQ ID NO: 2988342 - RNA, 16 nt, Mycobacterium avium subsp. paratuberculosis
ccagguugucgccgcg

SEQ ID NO: 2988343 - RNA, 17 nt, Mycobacterium avium subsp. paratuberculosis
ccagguugucgccgcgc

SEQ ID NO: 2988344 - RNA, 18 nt, Mycobacterium avium subsp. paratuberculosis
ccagguugucgccgcgcc

SEQ ID NO: 2988345 - RNA, 20 nt, Mycobacterium avium subsp. paratuberculosis
ccagguugucgccgcgccag

SEQ ID NO: 2988346 - RNA, 21 nt, Mycobacterium avium subsp. paratuberculosis
ccagguugucgucgggcacca

SEQ ID NO: 2988347 - RNA, 20 nt, Mycobacterium avium subsp. paratuberculosis
ccagguuguggugcacgaac

SEQ ID NO: 2988348 - RNA, 17 nt, Mycobacterium avium subsp. paratuberculosis
ccagguuuugcagcgga

SEQ ID NO: 2988349 - RNA, 19 nt, Mycobacterium avium subsp. paratuberculosis
ccaguaccagcggccgucg

SEQ ID NO: 2988350 - RNA, 17 nt, Mycobacterium avium subsp. paratuberculosis
ccaguagaaguggccga

SEQ ID NO: 2988351 - RNA, 13 nt, Mycobacterium avium subsp. paratuberculosis
ccaguagccgccg

SEQ ID NO: 2988352 - RNA, 18 nt, Mycobacterium avium subsp. paratuberculosis
ccaguagccgccgggcgu

SEQ ID NO: 2988353 - RNA, 13 nt, Mycobacterium avium subsp. paratuberculosis
ccaguaggccagc

SEQ ID NO: 2988354 - RNA, 14 nt, Mycobacterium avium subsp. paratuberculosis
ccaguaggccagca

SEQ ID NO: 2988355 - RNA, 16 nt, Mycobacterium avium subsp. paratuberculosis
ccaguaggccagcauc

SEQ ID NO: 2988356 - RNA, 17 nt, Mycobacterium avium subsp. paratuberculosis
ccaguaguggaucagcc

SEQ ID NO: 2988357 - RNA, 17 nt, Mycobacterium avium subsp. paratuberculosis
ccagucaagcgcuuuga

SEQ ID NO: 2988358 - RNA, 15 nt, Mycobacterium avium subsp. paratuberculosis
ccaguccaggccgcc

SEQ ID NO: 2988359 - RNA, 14 nt, Mycobacterium avium subsp. paratuberculosis
ccagucccagcaca

SEQ ID NO: 2988360 - RNA, 15 nt, Mycobacterium avium subsp. paratuberculosis
ccagucccagcacag

SEQ ID NO: 2988361 - RNA, 14 nt, Mycobacterium avium subsp. paratuberculosis
ccaguccgccgccg

SEQ ID NO: 2988362 - RNA, 14 nt, Mycobacterium avium subsp. paratuberculosis
ccaguccggcagca

SEQ ID NO: 2988363 - RNA, 15 nt, Mycobacterium avium subsp. paratuberculosis
ccaguccggcagcag

SEQ ID NO: 2988364 - RNA, 13 nt, Mycobacterium avium subsp. paratuberculosis
ccaguccggccag

SEQ ID NO: 2988365 - RNA, 13 nt, Mycobacterium avium subsp. paratuberculosis
ccaguccggccgu

SEQ ID NO: 2988366 - RNA, 16 nt, Mycobacterium avium subsp. paratuberculosis
ccaguccggcgcccgg

SEQ ID NO: 2988367 - RNA, 14 nt, Mycobacterium avium subsp. paratuberculosis
ccaguccggcgccg

SEQ ID NO: 2988368 - RNA, 14 nt, Mycobacterium avium subsp. paratuberculosis
ccaguccugcagcu

SEQ ID NO: 2988369 - RNA, 13 nt, Mycobacterium avium subsp. paratuberculosis
ccaguccugggcc

SEQ ID NO: 2988370 - RNA, 16 nt, Mycobacterium avium subsp. paratuberculosis
ccaguccugggccaga

SEQ ID NO: 2988371 - RNA, 20 nt, Mycobacterium avium subsp. paratuberculosis
ccagucgaaguucggcaucu

SEQ ID NO: 2988372 - RNA, 20 nt, Mycobacterium avium subsp. paratuberculosis
ccagucgauaguggcgucca

SEQ ID NO: 2988373 - RNA, 20 nt, Mycobacterium avium subsp. paratuberculosis
ccagucgaugucgguggcgc

SEQ ID NO: 2988374 - RNA, 22 nt, Mycobacterium avium subsp. paratuberculosis
ccagucgaugucgguggcgcgc

SEQ ID NO: 2988375 - RNA, 24 nt, Mycobacterium avium subsp. paratuberculosis
ccagucgaugucgguggcgcgcag

SEQ ID NO: 2988376 - RNA, 17 nt, Mycobacterium avium subsp. paratuberculosis
ccagucgccgccgcgca

SEQ ID NO: 2988377 - RNA, 12 nt, Mycobacterium avium subsp. paratuberculosis
ccagucgccgcg

SEQ ID NO: 2988378 - RNA, 15 nt, Mycobacterium avium subsp. paratuberculosis
ccagucgccgcgcag

SEQ ID NO: 2988379 - RNA, 17 nt, Mycobacterium avium subsp. paratuberculosis
ccagucgccgcgcagau

SEQ ID NO: 2988380 - RNA, 13 nt, Mycobacterium avium subsp. paratuberculosis
ccagucgccggcc

SEQ ID NO: 2988381 - RNA, 19 nt, Mycobacterium avium subsp. paratuberculosis
ccagucgccggccaggccg

SEQ ID NO: 2988382 - RNA, 17 nt, Mycobacterium avium subsp. paratuberculosis
ccagucgcgcagcguca

SEQ ID NO: 2988383 - RNA, 18 nt, Mycobacterium avium subsp. paratuberculosis
ccagucgcgcagcgucau

SEQ ID NO: 2988384 - RNA, 20 nt, Mycobacterium avium subsp. paratuberculosis
ccagucgcggcgaaccagca

SEQ ID NO: 2988385 - RNA, 14 nt, Mycobacterium avium subsp. paratuberculosis
ccagucggcgccga

SEQ ID NO: 2988386 - RNA, 15 nt, Mycobacterium avium subsp. paratuberculosis
ccagucggcgccgau

SEQ ID NO: 2988387 - RNA, 16 nt, Mycobacterium avium subsp. paratuberculosis
ccagucggcgccgaug

SEQ ID NO: 2988388 - RNA, 19 nt, Mycobacterium avium subsp. paratuberculosis
ccagucggcgccgaugcag

SEQ ID NO: 2988389 - RNA, 20 nt, Mycobacterium avium subsp. paratuberculosis
ccagucggcgccgaugcagc

SEQ ID NO: 2988390 - RNA, 21 nt, Mycobacterium avium subsp. paratuberculosis
ccagucggcgccgaugcagca

SEQ ID NO: 2988391 - RNA, 13 nt, Mycobacterium avium subsp. paratuberculosis
ccagucggcgucu

SEQ ID NO: 2988392 - RNA, 21 nt, Mycobacterium avium subsp. paratuberculosis
ccagucguacucccaggccgc

SEQ ID NO: 2988393 - RNA, 24 nt, Mycobacterium avium subsp. paratuberculosis
ccagucguacucccaggccgcggc

SEQ ID NO: 2988394 - RNA, 17 nt, Mycobacterium avium subsp. paratuberculosis
ccagucguuggugcgca

SEQ ID NO: 2988395 - RNA, 19 nt, Mycobacterium avium subsp. paratuberculosis
ccagucguuggugcgcacc

SEQ ID NO: 2988396 - RNA, 17 nt, Mycobacterium avium subsp. paratuberculosis
ccagucugagcccgggc

SEQ ID NO: 2988397 - RNA, 14 nt, Mycobacterium avium subsp. paratuberculosis
ccagugacgccugc

SEQ ID NO: 2988398 - RNA, 20 nt, Mycobacterium avium subsp. paratuberculosis
ccagugcaagcucgccagga

SEQ ID NO: 2988399 - RNA, 17 nt, Mycobacterium avium subsp. paratuberculosis
ccagugcaccucgacga

SEQ ID NO: 2988400 - RNA, 19 nt, Mycobacterium avium subsp. paratuberculosis
ccagugcacgcucggcggg

SEQ ID NO: 2988401 - RNA, 21 nt, Mycobacterium avium subsp. paratuberculosis
ccagugcaggcugacgcgacc

SEQ ID NO: 2988402 - RNA, 19 nt, Mycobacterium avium subsp. paratuberculosis
ccagugcagguuccggauc

SEQ ID NO: 2988403 - RNA, 19 nt, Mycobacterium avium subsp. paratuberculosis
ccagugcaguucgaugccg

SEQ ID NO: 2988404 - RNA, 22 nt, Mycobacterium avium subsp. paratuberculosis
ccagugcaguucgaugccgaug

SEQ ID NO: 2988405 - RNA, 15 nt, Mycobacterium avium subsp. paratuberculosis
ccagugcaugccggc

SEQ ID NO: 2988406 - RNA, 16 nt, Mycobacterium avium subsp. paratuberculosis
ccagugcaugccggcc

SEQ ID NO: 2988407 - RNA, 17 nt, Mycobacterium avium subsp. paratuberculosis
ccagugcaugccggccu

SEQ ID NO: 2988408 - RNA, 17 nt, Mycobacterium avium subsp. paratuberculosis
ccagugccaguaccagc

SEQ ID NO: 2988409 - RNA, 20 nt, Mycobacterium avium subsp. paratuberculosis
ccagugccaguaccagcggc

SEQ ID NO: 2988410 - RNA, 14 nt, Mycobacterium avium subsp. paratuberculosis
ccagugcccgagca

SEQ ID NO: 2988411 - RNA, 18 nt, Mycobacterium avium subsp. paratuberculosis
ccagugcccgagcaccug

SEQ ID NO: 2988412 - RNA, 14 nt, Mycobacterium avium subsp. paratuberculosis
ccagugcccggcca

SEQ ID NO: 2988413 - RNA, 15 nt, Mycobacterium avium subsp. paratuberculosis
ccagugcccggccaa

SEQ ID NO: 2988414 - RNA, 15 nt, Mycobacterium avium subsp. paratuberculosis
ccagugcccggccau

SEQ ID NO: 2988415 - RNA, 21 nt, Mycobacterium avium subsp. paratuberculosis
ccagugccgcagguggugggc

SEQ ID NO: 2988416 - RNA, 20 nt, Mycobacterium avium subsp. paratuberculosis
ccagugccgcgcggacgcgg

SEQ ID NO: 2988417 - RNA, 13 nt, Mycobacterium avium subsp. paratuberculosis
ccagugccggcga

SEQ ID NO: 2988418 - RNA, 21 nt, Mycobacterium avium subsp. paratuberculosis
ccagugccgggccagcugcuc

SEQ ID NO: 2988419 - RNA, 12 nt, Mycobacterium avium subsp. paratuberculosis
ccaguggcuguc

SEQ ID NO: 2988420 - RNA, 14 nt, Mycobacterium avium subsp. paratuberculosis
ccaguggcugucgg

SEQ ID NO: 2988421 - RNA, 17 nt, Mycobacterium avium subsp. paratuberculosis
ccaguggcugucgggug

SEQ ID NO: 2988422 - RNA, 18 nt, Mycobacterium avium subsp. paratuberculosis
ccaguggcugucgggugc

SEQ ID NO: 2988423 - RNA, 14 nt, Mycobacterium avium subsp. paratuberculosis
ccagugguggccga

SEQ ID NO: 2988424 - RNA, 18 nt, Mycobacterium avium subsp. paratuberculosis
ccagugucagggcagcgg

SEQ ID NO: 2988425 - RNA, 19 nt, Mycobacterium avium subsp. paratuberculosis
ccagugucagggcagcggu

SEQ ID NO: 2988426 - RNA, 17 nt, Mycobacterium avium subsp. paratuberculosis
ccaguguccgggcgccc

SEQ ID NO: 2988427 - RNA, 13 nt, Mycobacterium avium subsp. paratuberculosis
ccaguguggccgc

SEQ ID NO: 2988428 - RNA, 15 nt, Mycobacterium avium subsp. paratuberculosis
ccaguguggccgcgg

SEQ ID NO: 2988429 - RNA, 13 nt, Mycobacterium avium subsp. paratuberculosis
ccaguucaccgcg

SEQ ID NO: 2988430 - RNA, 14 nt, Mycobacterium avium subsp. paratuberculosis
ccaguuccaccagu

SEQ ID NO: 2988431 - RNA, 16 nt, Mycobacterium avium subsp. paratuberculosis
ccaguucccggcgggc

SEQ ID NO: 2988432 - RNA, 17 nt, Mycobacterium avium subsp. paratuberculosis
ccaguuccugcaugccg

SEQ ID NO: 2988433 - RNA, 16 nt, Mycobacterium avium subsp. paratuberculosis
ccaguucgagcgccgc

SEQ ID NO: 2988434 - RNA, 20 nt, Mycobacterium avium subsp. paratuberculosis
ccaguucgagcgccgcggcc

SEQ ID NO: 2988435 - RNA, 22 nt, Mycobacterium avium subsp. paratuberculosis
ccaguucgagcgccgcggccac

SEQ ID NO: 2988436 - RNA, 14 nt, Mycobacterium avium subsp. paratuberculosis
ccaguucgccacca

SEQ ID NO: 2988437 - RNA, 19 nt, Mycobacterium avium subsp. paratuberculosis
ccaguucgcguacccgcgc

SEQ ID NO: 2988438 - RNA, 20 nt, Mycobacterium avium subsp. paratuberculosis
ccaguucgcguacccgcgcg

SEQ ID NO: 2988439 - RNA, 21 nt, Mycobacterium avium subsp. paratuberculosis
ccaguucgcguacccgcgcgg

SEQ ID NO: 2988440 - RNA, 16 nt, Mycobacterium avium subsp. paratuberculosis
ccaguucggccaccgc

SEQ ID NO: 2988441 - RNA, 13 nt, Mycobacterium avium subsp. paratuberculosis
ccaguucggccag

SEQ ID NO: 2988442 - RNA, 18 nt, Mycobacterium avium subsp. paratuberculosis
ccaguucggccagcgcgg

SEQ ID NO: 2988443 - RNA, 15 nt, Mycobacterium avium subsp. paratuberculosis
ccaguucgucgcgcg

SEQ ID NO: 2988444 - RNA, 19 nt, Mycobacterium avium subsp. paratuberculosis
ccaguucgucggccgucgg

SEQ ID NO: 2988445 - RNA, 19 nt, Mycobacterium avium subsp. paratuberculosis
ccaguucuucgaugacggc

SEQ ID NO: 2988446 - RNA, 14 nt, Mycobacterium avium subsp. paratuberculosis
ccaguugacggcgc

SEQ ID NO: 2988447 - RNA, 15 nt, Mycobacterium avium subsp. paratuberculosis
ccaguugacggcgca

SEQ ID NO: 2988448 - RNA, 16 nt, Mycobacterium avium subsp. paratuberculosis
ccaguugacggcgcaa

SEQ ID NO: 2988449 - RNA, 18 nt, Mycobacterium avium subsp. paratuberculosis
ccaguugacguugaucgc

SEQ ID NO: 2988450 - RNA, 19 nt, Mycobacterium avium subsp. paratuberculosis
ccaguugacguugaucgcg

SEQ ID NO: 2988451 - RNA, 23 nt, Mycobacterium avium subsp. paratuberculosis
ccaguugacguugaucgcgccga

SEQ ID NO: 2988452 - RNA, 17 nt, Mycobacterium avium subsp. paratuberculosis
ccaguugcaccggcacc

SEQ ID NO: 2988453 - RNA, 17 nt, Mycobacterium avium subsp. paratuberculosis
ccaguugcacgguguag

SEQ ID NO: 2988454 - RNA, 13 nt, Mycobacterium avium subsp. paratuberculosis
ccaguugcggcac

SEQ ID NO: 2988455 - RNA, 19 nt, Mycobacterium avium subsp. paratuberculosis
ccaguugcucgggugacgc

SEQ ID NO: 2988456 - RNA, 20 nt, Mycobacterium avium subsp. paratuberculosis
ccaguugggggccagcgccg

SEQ ID NO: 2988457 - RNA, 17 nt, Mycobacterium avium subsp. paratuberculosis
ccaguuguuggccgggc

SEQ ID NO: 2988458 - RNA, 19 nt, Mycobacterium avium subsp. paratuberculosis
ccaguuguuuccccagccc

SEQ ID NO: 2988459 - RNA, 21 nt, Mycobacterium avium subsp. paratuberculosis
ccaguuguuuccccagcccgg

SEQ ID NO: 2988460 - RNA, 22 nt, Mycobacterium avium subsp. paratuberculosis
ccaguuguuuccccagcccgga

SEQ ID NO: 2988461 - RNA, 18 nt, Mycobacterium avium subsp. paratuberculosis
ccaguuucacgucggcga

SEQ ID NO: 2988462 - RNA, 19 nt, Mycobacterium avium subsp. paratuberculosis
ccaguuucacgucggcgau

SEQ ID NO: 2988463 - RNA, 15 nt, Mycobacterium avium subsp. paratuberculosis
ccaguuucccgucgg

SEQ ID NO: 2988464 - RNA, 18 nt, Mycobacterium avium subsp. paratuberculosis
ccauacacgggccgucca

SEQ ID NO: 2988465 - RNA, 21 nt, Mycobacterium avium subsp. paratuberculosis
ccauaccccccacgcucggcg

SEQ ID NO: 2988466 - RNA, 21 nt, Mycobacterium avium subsp. paratuberculosis
ccauaucgagguaggccaccg

SEQ ID NO: 2988467 - RNA, 16 nt, Mycobacterium avium subsp. paratuberculosis
ccaucaacccgagcac

SEQ ID NO: 2988468 - RNA, 18 nt, Mycobacterium avium subsp. paratuberculosis
ccaucaacccgagcaccg

SEQ ID NO: 2988469 - RNA, 14 nt, Mycobacterium avium subsp. paratuberculosis
ccaucaccagcaga

SEQ ID NO: 2988470 - RNA, 13 nt, Mycobacterium avium subsp. paratuberculosis
ccaucaccccgaa

SEQ ID NO: 2988471 - RNA, 16 nt, Mycobacterium avium subsp. paratuberculosis
ccaucaccgcaccgac

SEQ ID NO: 2988472 - RNA, 23 nt, Mycobacterium avium subsp. paratuberculosis
ccaucaccgcgcuuuggaccagg

SEQ ID NO: 2988473 - RNA, 15 nt, Mycobacterium avium subsp. paratuberculosis
ccaucaccggaccgg

SEQ ID NO: 2988474 - RNA, 19 nt, Mycobacterium avium subsp. paratuberculosis
ccaucaccggaccggccag

SEQ ID NO: 2988475 - RNA, 21 nt, Mycobacterium avium subsp. paratuberculosis
ccaucaccggaccggccagca

SEQ ID NO: 2988476 - RNA, 14 nt, Mycobacterium avium subsp. paratuberculosis
ccaucacgaccucg

SEQ ID NO: 2988477 - RNA, 20 nt, Mycobacterium avium subsp. paratuberculosis
ccaucacgcagaacucgucg

SEQ ID NO: 2988478 - RNA, 17 nt, Mycobacterium avium subsp. paratuberculosis
ccaucacggugccgagu

SEQ ID NO: 2988479 - RNA, 21 nt, Mycobacterium avium subsp. paratuberculosis
ccaucagaacgcccgcaacuc

SEQ ID NO: 2988480 - RNA, 17 nt, Mycobacterium avium subsp. paratuberculosis
ccaucagcaccacguug

SEQ ID NO: 2988481 - RNA, 13 nt, Mycobacterium avium subsp. paratuberculosis
ccaucagcacgcc

SEQ ID NO: 2988482 - RNA, 17 nt, Mycobacterium avium subsp. paratuberculosis
ccaucagcacgcccucg

SEQ ID NO: 2988483 - RNA, 12 nt, Mycobacterium avium subsp. paratuberculosis
ccaucagcagcg

SEQ ID NO: 2988484 - RNA, 17 nt, Mycobacterium avium subsp. paratuberculosis
ccaucagcaggaccagg

SEQ ID NO: 2988485 - RNA, 14 nt, Mycobacterium avium subsp. paratuberculosis
ccaucagcccggcg

SEQ ID NO: 2988486 - RNA, 17 nt, Mycobacterium avium subsp. paratuberculosis
ccaucagcccggcgucc

SEQ ID NO: 2988487 - RNA, 13 nt, Mycobacterium avium subsp. paratuberculosis
ccaucagcccggu

SEQ ID NO: 2988488 - RNA, 15 nt, Mycobacterium avium subsp. paratuberculosis
ccaucagcccgguga

SEQ ID NO: 2988489 - RNA, 23 nt, Mycobacterium avium subsp. paratuberculosis
ccaucagcccggugacgaacauc

SEQ ID NO: 2988490 - RNA, 17 nt, Mycobacterium avium subsp. paratuberculosis
ccaucagccgccgucgc

SEQ ID NO: 2988491 - RNA, 18 nt, Mycobacterium avium subsp. paratuberculosis
ccaucagccgccgucgcg

SEQ ID NO: 2988492 - RNA, 19 nt, Mycobacterium avium subsp. paratuberculosis
ccaucagccgccgucgcgc

SEQ ID NO: 2988493 - RNA, 17 nt, Mycobacterium avium subsp. paratuberculosis
ccaucagccugcgguga

SEQ ID NO: 2988494 - RNA, 16 nt, Mycobacterium avium subsp. paratuberculosis
ccaucagcgcccgggu

SEQ ID NO: 2988495 - RNA, 14 nt, Mycobacterium avium subsp. paratuberculosis
ccaucagcggcucg

SEQ ID NO: 2988496 - RNA, 15 nt, Mycobacterium avium subsp. paratuberculosis
ccaucagcggcucgc

SEQ ID NO: 2988497 - RNA, 19 nt, Mycobacterium avium subsp. paratuberculosis
ccaucagcggcucgcgggu

SEQ ID NO: 2988498 - RNA, 15 nt, Mycobacterium avium subsp. paratuberculosis
ccaucagugcggccc

SEQ ID NO: 2988499 - RNA, 16 nt, Mycobacterium avium subsp. paratuberculosis
ccaucagugcggcccg

SEQ ID NO: 2988500 - RNA, 16 nt, Mycobacterium avium subsp. paratuberculosis
ccaucaugcccaccau

SEQ ID NO: 2988501 - RNA, 18 nt, Mycobacterium avium subsp. paratuberculosis
ccaucauggccuccccau

SEQ ID NO: 2988502 - RNA, 23 nt, Mycobacterium avium subsp. paratuberculosis
ccaucauggcgcugcgcgacacc

SEQ ID NO: 2988503 - RNA, 17 nt, Mycobacterium avium subsp. paratuberculosis
ccauccacucgggccag

SEQ ID NO: 2988504 - RNA, 12 nt, Mycobacterium avium subsp. paratuberculosis
ccauccagcgcc

SEQ ID NO: 2988505 - RNA, 14 nt, Mycobacterium avium subsp. paratuberculosis
ccauccagcgccgc

SEQ ID NO: 2988506 - RNA, 16 nt, Mycobacterium avium subsp. paratuberculosis
ccauccagcgccgcag

SEQ ID NO: 2988507 - RNA, 17 nt, Mycobacterium avium subsp. paratuberculosis
ccauccagcgccgcagc

SEQ ID NO: 2988508 - RNA, 15 nt, Mycobacterium avium subsp. paratuberculosis
ccauccccaggaugg

SEQ ID NO: 2988509 - RNA, 22 nt, Mycobacterium avium subsp. paratuberculosis
ccauccccaggauggccgcuuc

SEQ ID NO: 2988510 - RNA, 19 nt, Mycobacterium avium subsp. paratuberculosis
ccauccccgcguuggccag

SEQ ID NO: 2988511 - RNA, 21 nt, Mycobacterium avium subsp. paratuberculosis
ccauccccgcguuggccagcg

SEQ ID NO: 2988512 - RNA, 19 nt, Mycobacterium avium subsp. paratuberculosis
ccaucccgauccgcgccgc

SEQ ID NO: 2988513 - RNA, 14 nt, Mycobacterium avium subsp. paratuberculosis
ccaucccgccgccg

SEQ ID NO: 2988514 - RNA, 18 nt, Mycobacterium avium subsp. paratuberculosis
ccaucccgcugaagccga

SEQ ID NO: 2988515 - RNA, 12 nt, Mycobacterium avium subsp. paratuberculosis
ccaucccgggga

SEQ ID NO: 2988516 - RNA, 20 nt, Mycobacterium avium subsp. paratuberculosis
ccaucccggggacaccgggc

SEQ ID NO: 2988517 - RNA, 21 nt, Mycobacterium avium subsp. paratuberculosis
ccaucccgguggacgcgaugg

SEQ ID NO: 2988518 - RNA, 15 nt, Mycobacterium avium subsp. paratuberculosis
ccauccgccacccgc

SEQ ID NO: 2988519 - RNA, 24 nt, Mycobacterium avium subsp. paratuberculosis
ccauccgccagaucgccuggcagc

SEQ ID NO: 2988520 - RNA, 13 nt, Mycobacterium avium subsp. paratuberculosis
ccauccgccgucg

SEQ ID NO: 2988521 - RNA, 14 nt, Mycobacterium avium subsp. paratuberculosis
ccauccgccgucga

SEQ ID NO: 2988522 - RNA, 15 nt, Mycobacterium avium subsp. paratuberculosis
ccauccgccgucgac

SEQ ID NO: 2988523 - RNA, 17 nt, Mycobacterium avium subsp. paratuberculosis
ccauccgcgacgccagc

SEQ ID NO: 2988524 - RNA, 14 nt, Mycobacterium avium subsp. paratuberculosis
ccauccgcgccgaa

SEQ ID NO: 2988525 - RNA, 14 nt, Mycobacterium avium subsp. paratuberculosis
ccauccgcggccac

SEQ ID NO: 2988526 - RNA, 14 nt, Mycobacterium avium subsp. paratuberculosis
ccauccggccggcg

SEQ ID NO: 2988527 - RNA, 15 nt, Mycobacterium avium subsp. paratuberculosis
ccauccggccggcga

SEQ ID NO: 2988528 - RNA, 16 nt, Mycobacterium avium subsp. paratuberculosis
ccauccggccggcgag

SEQ ID NO: 2988529 - RNA, 12 nt, Mycobacterium avium subsp. paratuberculosis
ccauccggcgcc

SEQ ID NO: 2988530 - RNA, 13 nt, Mycobacterium avium subsp. paratuberculosis
ccauccggcgccg

SEQ ID NO: 2988531 - RNA, 16 nt, Mycobacterium avium subsp. paratuberculosis
ccauccgggcggcauc

SEQ ID NO: 2988532 - RNA, 24 nt, Mycobacterium avium subsp. paratuberculosis
ccauccgggcggcaucgcgcgcgg

SEQ ID NO: 2988533 - RNA, 14 nt, Mycobacterium avium subsp. paratuberculosis
ccauccgggcggcc

SEQ ID NO: 2988534 - RNA, 16 nt, Mycobacterium avium subsp. paratuberculosis
ccauccgggcggccag

SEQ ID NO: 2988535 - RNA, 17 nt, Mycobacterium avium subsp. paratuberculosis
ccauccgggcggccagc

SEQ ID NO: 2988536 - RNA, 19 nt, Mycobacterium avium subsp. paratuberculosis
ccauccgggcggccagccg

SEQ ID NO: 2988537 - RNA, 22 nt, Mycobacterium avium subsp. paratuberculosis
ccauccgggcggccagccgcgc

SEQ ID NO: 2988538 - RNA, 22 nt, Mycobacterium avium subsp. paratuberculosis
ccauccgguccagaucggcgcg

SEQ ID NO: 2988539 - RNA, 23 nt, Mycobacterium avium subsp. paratuberculosis
ccauccgguccagaucggcgcgc

SEQ ID NO: 2988540 - RNA, 13 nt, Mycobacterium avium subsp. paratuberculosis
ccauccguucggc

SEQ ID NO: 2988541 - RNA, 23 nt, Mycobacterium avium subsp. paratuberculosis
ccauccguucggcucugcagagc

SEQ ID NO: 2988542 - RNA, 13 nt, Mycobacterium avium subsp. paratuberculosis
ccaucgacgcuga

SEQ ID NO: 2988543 - RNA, 13 nt, Mycobacterium avium subsp. paratuberculosis
ccaucgacuccag

SEQ ID NO: 2988544 - RNA, 14 nt, Mycobacterium avium subsp. paratuberculosis
ccaucgacuccagc

SEQ ID NO: 2988545 - RNA, 16 nt, Mycobacterium avium subsp. paratuberculosis
ccaucgacuccagcac

SEQ ID NO: 2988546 - RNA, 18 nt, Mycobacterium avium subsp. paratuberculosis
ccaucgacuccagcaccg

SEQ ID NO: 2988547 - RNA, 19 nt, Mycobacterium avium subsp. paratuberculosis
ccaucgacuccagcaccgg

SEQ ID NO: 2988548 - RNA, 16 nt, Mycobacterium avium subsp. paratuberculosis
ccaucgaggcgaucau

SEQ ID NO: 2988549 - RNA, 19 nt, Mycobacterium avium subsp. paratuberculosis
ccaucgaggcgaucaucgc

SEQ ID NO: 2988550 - RNA, 17 nt, Mycobacterium avium subsp. paratuberculosis
ccaucgauggcggugug

SEQ ID NO: 2988551 - RNA, 18 nt, Mycobacterium avium subsp. paratuberculosis
ccaucgauggcggugugg

SEQ ID NO: 2988552 - RNA, 15 nt, Mycobacterium avium subsp. paratuberculosis
ccaucgcaccgcgag

SEQ ID NO: 2988553 - RNA, 14 nt, Mycobacterium avium subsp. paratuberculosis
ccaucgccacgccg

SEQ ID NO: 2988554 - RNA, 21 nt, Mycobacterium avium subsp. paratuberculosis
ccaucgccacgccguggcccg

SEQ ID NO: 2988555 - RNA, 15 nt, Mycobacterium avium subsp. paratuberculosis
ccaucgccaggaacc

SEQ ID NO: 2988556 - RNA, 23 nt, Mycobacterium avium subsp. paratuberculosis
ccaucgcccggugcgccagcgug

SEQ ID NO: 2988557 - RNA, 17 nt, Mycobacterium avium subsp. paratuberculosis
ccaucgccgccgccauc

SEQ ID NO: 2988558 - RNA, 22 nt, Mycobacterium avium subsp. paratuberculosis
ccaucgccgccgccaucuccuc

SEQ ID NO: 2988559 - RNA, 15 nt, Mycobacterium avium subsp. paratuberculosis
ccaucgccucggcca

SEQ ID NO: 2988560 - RNA, 12 nt, Mycobacterium avium subsp. paratuberculosis
ccaucgcggccc

SEQ ID NO: 2988561 - RNA, 13 nt, Mycobacterium avium subsp. paratuberculosis
ccaucgcggcccc

SEQ ID NO: 2988562 - RNA, 18 nt, Mycobacterium avium subsp. paratuberculosis
ccaucgcggcccccacgc

SEQ ID NO: 2988563 - RNA, 14 nt, Mycobacterium avium subsp. paratuberculosis
ccaucgcggccgcc

SEQ ID NO: 2988564 - RNA, 15 nt, Mycobacterium avium subsp. paratuberculosis
ccaucgcggccgccc

SEQ ID NO: 2988565 - RNA, 17 nt, Mycobacterium avium subsp. paratuberculosis
ccaucgcggccgcccgg

SEQ ID NO: 2988566 - RNA, 18 nt, Mycobacterium avium subsp. paratuberculosis
ccaucgcggccgcccggu

SEQ ID NO: 2988567 - RNA, 14 nt, Mycobacterium avium subsp. paratuberculosis
ccaucgcggcguug

SEQ ID NO: 2988568 - RNA, 19 nt, Mycobacterium avium subsp. paratuberculosis
ccaucgcggucagcgucug

SEQ ID NO: 2988569 - RNA, 20 nt, Mycobacterium avium subsp. paratuberculosis
ccaucggcagacccagcagc

SEQ ID NO: 2988570 - RNA, 21 nt, Mycobacterium avium subsp. paratuberculosis
ccaucggcagacccagcagcg

SEQ ID NO: 2988571 - RNA, 14 nt, Mycobacterium avium subsp. paratuberculosis
ccaucggcagcccg

SEQ ID NO: 2988572 - RNA, 12 nt, Mycobacterium avium subsp. paratuberculosis
ccaucggcaucg

SEQ ID NO: 2988573 - RNA, 15 nt, Mycobacterium avium subsp. paratuberculosis
ccaucggcaucgcgc

SEQ ID NO: 2988574 - RNA, 19 nt, Mycobacterium avium subsp. paratuberculosis
ccaucggcaucgcgcgcgg

SEQ ID NO: 2988575 - RNA, 14 nt, Mycobacterium avium subsp. paratuberculosis
ccaucgggaccgcg

SEQ ID NO: 2988576 - RNA, 17 nt, Mycobacterium avium subsp. paratuberculosis
ccaucgggcccagcagc

SEQ ID NO: 2988577 - RNA, 23 nt, Mycobacterium avium subsp. paratuberculosis
ccaucgggcccagcagccugccc

SEQ ID NO: 2988578 - RNA, 20 nt, Mycobacterium avium subsp. paratuberculosis
ccaucgggucgucggcgucg

SEQ ID NO: 2988579 - RNA, 15 nt, Mycobacterium avium subsp. paratuberculosis
ccaucgucacuucgc

SEQ ID NO: 2988580 - RNA, 13 nt, Mycobacterium avium subsp. paratuberculosis
ccaucguccucgc

SEQ ID NO: 2988581 - RNA, 16 nt, Mycobacterium avium subsp. paratuberculosis
ccaucguccucgcgcc

SEQ ID NO: 2988582 - RNA, 17 nt, Mycobacterium avium subsp. paratuberculosis
ccaucguccucgcgccg

SEQ ID NO: 2988583 - RNA, 19 nt, Mycobacterium avium subsp. paratuberculosis
ccaucguccucgcgccgug

SEQ ID NO: 2988584 - RNA, 23 nt, Mycobacterium avium subsp. paratuberculosis
ccaucguccucgcgccguggccc

SEQ ID NO: 2988585 - RNA, 16 nt, Mycobacterium avium subsp. paratuberculosis
ccaucgucuuccccgu

SEQ ID NO: 2988586 - RNA, 13 nt, Mycobacterium avium subsp. paratuberculosis
ccaucguggccgc

SEQ ID NO: 2988587 - RNA, 14 nt, Mycobacterium avium subsp. paratuberculosis
ccaucguggccgcg

SEQ ID NO: 2988588 - RNA, 15 nt, Mycobacterium avium subsp. paratuberculosis
ccaucuacgaccucg

SEQ ID NO: 2988589 - RNA, 17 nt, Mycobacterium avium subsp. paratuberculosis
ccaucuccugcacgcgc

SEQ ID NO: 2988590 - RNA, 19 nt, Mycobacterium avium subsp. paratuberculosis
ccaucucgggagugcggcc

SEQ ID NO: 2988591 - RNA, 21 nt, Mycobacterium avium subsp. paratuberculosis
ccaucucgggagugcggccca

SEQ ID NO: 2988592 - RNA, 15 nt, Mycobacterium avium subsp. paratuberculosis
ccaucucgugcccgg

SEQ ID NO: 2988593 - RNA, 20 nt, Mycobacterium avium subsp. paratuberculosis
ccaucugccggcgcuucugc

SEQ ID NO: 2988594 - RNA, 10 nt, Mycobacterium avium subsp. paratuberculosis
ccaucuggaa

SEQ ID NO: 2988595 - RNA, 11 nt, Mycobacterium avium subsp. paratuberculosis
ccaucuggccg

SEQ ID NO: 2988596 - RNA, 13 nt, Mycobacterium avium subsp. paratuberculosis
ccaucuggccgcg

SEQ ID NO: 2988597 - RNA, 14 nt, Mycobacterium avium subsp. paratuberculosis
ccaucuggccgcgg

SEQ ID NO: 2988598 - RNA, 13 nt, Mycobacterium avium subsp. paratuberculosis
ccaucugggcgcg

SEQ ID NO: 2988599 - RNA, 22 nt, Mycobacterium avium subsp. paratuberculosis
ccaucuucacgaagugcccggc

SEQ ID NO: 2988600 - RNA, 19 nt, Mycobacterium avium subsp. paratuberculosis
ccaucuucacgugcgcggc

SEQ ID NO: 2988601 - RNA, 18 nt, Mycobacterium avium subsp. paratuberculosis
ccaucuucaguucggccg

SEQ ID NO: 2988602 - RNA, 21 nt, Mycobacterium avium subsp. paratuberculosis
ccaugaacggcagcucgucga

SEQ ID NO: 2988603 - RNA, 20 nt, Mycobacterium avium subsp. paratuberculosis
ccaugaacuccgacuccagc

SEQ ID NO: 2988604 - RNA, 15 nt, Mycobacterium avium subsp. paratuberculosis
ccaugaacucgucca

SEQ ID NO: 2988605 - RNA, 16 nt, Mycobacterium avium subsp. paratuberculosis
ccaugaacucguccac

SEQ ID NO: 2988606 - RNA, 18 nt, Mycobacterium avium subsp. paratuberculosis
ccaugaacucguccaccg

SEQ ID NO: 2988607 - RNA, 20 nt, Mycobacterium avium subsp. paratuberculosis
ccaugaacucguccaccgac

SEQ ID NO: 2988608 - RNA, 22 nt, Mycobacterium avium subsp. paratuberculosis
ccaugaagccguugccgccgcg

SEQ ID NO: 2988609 - RNA, 18 nt, Mycobacterium avium subsp. paratuberculosis
ccaugaguugggucacau

SEQ ID NO: 2988610 - RNA, 19 nt, Mycobacterium avium subsp. paratuberculosis
ccaugaucagcgccguggc

SEQ ID NO: 2988611 - RNA, 13 nt, Mycobacterium avium subsp. paratuberculosis
ccaugaucgccag

SEQ ID NO: 2988612 - RNA, 20 nt, Mycobacterium avium subsp. paratuberculosis
ccaugaucgccaguccggcg

SEQ ID NO: 2988613 - RNA, 21 nt, Mycobacterium avium subsp. paratuberculosis
ccaugauguagcggcggucgg

SEQ ID NO: 2988614 - RNA, 16 nt, Mycobacterium avium subsp. paratuberculosis
ccaugcagaccagccc

SEQ ID NO: 2988615 - RNA, 13 nt, Mycobacterium avium subsp. paratuberculosis
ccaugcccagcag

SEQ ID NO: 2988616 - RNA, 23 nt, Mycobacterium avium subsp. paratuberculosis
ccaugcccagcaguccggcgguc

SEQ ID NO: 2988617 - RNA, 14 nt, Mycobacterium avium subsp. paratuberculosis
ccaugcccucgauc

SEQ ID NO: 2988618 - RNA, 17 nt, Mycobacterium avium subsp. paratuberculosis
ccaugccgaugcccauc

SEQ ID NO: 2988619 - RNA, 12 nt, Mycobacterium avium subsp. paratuberculosis
ccaugccgccau

SEQ ID NO: 2988620 - RNA, 18 nt, Mycobacterium avium subsp. paratuberculosis
ccaugccgccgaccgccg

SEQ ID NO: 2988621 - RNA, 20 nt, Mycobacterium avium subsp. paratuberculosis
ccaugccgccgaccgccgag

SEQ ID NO: 2988622 - RNA, 15 nt, Mycobacterium avium subsp. paratuberculosis
ccaugccgcgggcca

SEQ ID NO: 2988623 - RNA, 13 nt, Mycobacterium avium subsp. paratuberculosis
ccaugccggcguc

SEQ ID NO: 2988624 - RNA, 22 nt, Mycobacterium avium subsp. paratuberculosis
ccaugccggcguccaguucggc

SEQ ID NO: 2988625 - RNA, 19 nt, Mycobacterium avium subsp. paratuberculosis
ccaugccggguuucggccc

SEQ ID NO: 2988626 - RNA, 20 nt, Mycobacterium avium subsp. paratuberculosis
ccaugccggguuucggcccg

SEQ ID NO: 2988627 - RNA, 13 nt, Mycobacterium avium subsp. paratuberculosis
ccaugccggugga

SEQ ID NO: 2988628 - RNA, 18 nt, Mycobacterium avium subsp. paratuberculosis
ccaugccucuucggcgcg

SEQ ID NO: 2988629 - RNA, 19 nt, Mycobacterium avium subsp. paratuberculosis
ccaugcgaccacgaccggg

SEQ ID NO: 2988630 - RNA, 20 nt, Mycobacterium avium subsp. paratuberculosis
ccaugcgcgagucgagcacc

SEQ ID NO: 2988631 - RNA, 21 nt, Mycobacterium avium subsp. paratuberculosis
ccaugcgcgagucgagcaccg

SEQ ID NO: 2988632 - RNA, 23 nt, Mycobacterium avium subsp. paratuberculosis
ccaugcgcgagucgagcaccgcg

SEQ ID NO: 2988633 - RNA, 16 nt, Mycobacterium avium subsp. paratuberculosis
ccauggaaaccggcgg

SEQ ID NO: 2988634 - RNA, 17 nt, Mycobacterium avium subsp. paratuberculosis
ccauggaaaccggcggg

SEQ ID NO: 2988635 - RNA, 20 nt, Mycobacterium avium subsp. paratuberculosis
ccauggaguugucggugaag

SEQ ID NO: 2988636 - RNA, 21 nt, Mycobacterium avium subsp. paratuberculosis
ccauggccaggaacggcgcca

SEQ ID NO: 2988637 - RNA, 14 nt, Mycobacterium avium subsp. paratuberculosis
ccauggcccacgac

SEQ ID NO: 2988638 - RNA, 18 nt, Mycobacterium avium subsp. paratuberculosis
ccauggccuugacgucgg

SEQ ID NO: 2988639 - RNA, 13 nt, Mycobacterium avium subsp. paratuberculosis
ccauggcgcaccg

SEQ ID NO: 2988640 - RNA, 20 nt, Mycobacterium avium subsp. paratuberculosis
ccauggcgcaccgcggccuc

SEQ ID NO: 2988641 - RNA, 16 nt, Mycobacterium avium subsp. paratuberculosis
ccauggcgcggcggcc

SEQ ID NO: 2988642 - RNA, 13 nt, Mycobacterium avium subsp. paratuberculosis
ccauggcggcccg

SEQ ID NO: 2988643 - RNA, 15 nt, Mycobacterium avium subsp. paratuberculosis
ccauggcggcccgcg

SEQ ID NO: 2988644 - RNA, 21 nt, Mycobacterium avium subsp. paratuberculosis
ccauggcggcccgcgccggcg

SEQ ID NO: 2988645 - RNA, 21 nt, Mycobacterium avium subsp. paratuberculosis
ccaugggucucggcgaggcgc

SEQ ID NO: 2988646 - RNA, 21 nt, Mycobacterium avium subsp. paratuberculosis
ccauguacggauugcggacgc

SEQ ID NO: 2988647 - RNA, 14 nt, Mycobacterium avium subsp. paratuberculosis
ccauguccccgccg

SEQ ID NO: 2988648 - RNA, 23 nt, Mycobacterium avium subsp. paratuberculosis
ccauguccggcaggcucagcagc

SEQ ID NO: 2988649 - RNA, 17 nt, Mycobacterium avium subsp. paratuberculosis
ccauguccuuggugaug

SEQ ID NO: 2988650 - RNA, 21 nt, Mycobacterium avium subsp. paratuberculosis
ccaugucgacgcugagccgcu

SEQ ID NO: 2988651 - RNA, 17 nt, Mycobacterium avium subsp. paratuberculosis
ccaugucgaucggcucg

SEQ ID NO: 2988652 - RNA, 22 nt, Mycobacterium avium subsp. paratuberculosis
ccaugucgaucggcucggcgcc

SEQ ID NO: 2988653 - RNA, 20 nt, Mycobacterium avium subsp. paratuberculosis
ccaugucgaugucgacgccg

SEQ ID NO: 2988654 - RNA, 15 nt, Mycobacterium avium subsp. paratuberculosis
ccaugucgcaacggu

SEQ ID NO: 2988655 - RNA, 13 nt, Mycobacterium avium subsp. paratuberculosis
ccaugucgccggu

SEQ ID NO: 2988656 - RNA, 23 nt, Mycobacterium avium subsp. paratuberculosis
ccaugucggagcugcgcgccccg

SEQ ID NO: 2988657 - RNA, 15 nt, Mycobacterium avium subsp. paratuberculosis
ccaugucggccaggu

SEQ ID NO: 2988658 - RNA, 17 nt, Mycobacterium avium subsp. paratuberculosis
ccaugucggcgacccgc

SEQ ID NO: 2988659 - RNA, 14 nt, Mycobacterium avium subsp. paratuberculosis
ccaugucggcgucg

SEQ ID NO: 2988660 - RNA, 17 nt, Mycobacterium avium subsp. paratuberculosis
ccaugucggcgucgccg

SEQ ID NO: 2988661 - RNA, 12 nt, Mycobacterium avium subsp. paratuberculosis
ccaugucgucga

SEQ ID NO: 2988662 - RNA, 14 nt, Mycobacterium avium subsp. paratuberculosis
ccaugucgucgagc

SEQ ID NO: 2988663 - RNA, 21 nt, Mycobacterium avium subsp. paratuberculosis
ccaugugccggcgcucgucgu

SEQ ID NO: 2988664 - RNA, 15 nt, Mycobacterium avium subsp. paratuberculosis
ccauguuccagaacc

SEQ ID NO: 2988665 - RNA, 17 nt, Mycobacterium avium subsp. paratuberculosis
ccauucgggccagcgcc

SEQ ID NO: 2988666 - RNA, 16 nt, Mycobacterium avium subsp. paratuberculosis
ccauucgguuuccccu

SEQ ID NO: 2988667 - RNA, 21 nt, Mycobacterium avium subsp. paratuberculosis
ccauucgucugccaaggugcg

SEQ ID NO: 2988668 - RNA, 14 nt, Mycobacterium avium subsp. paratuberculosis
ccauugcaccgcaa

SEQ ID NO: 2988669 - RNA, 22 nt, Mycobacterium avium subsp. paratuberculosis
ccauugcgacuugcgcgccgug

SEQ ID NO: 2988670 - RNA, 20 nt, Mycobacterium avium subsp. paratuberculosis
ccauugcgggaagggcccgg

SEQ ID NO: 2988671 - RNA, 21 nt, Mycobacterium avium subsp. paratuberculosis
ccauuuccguugugccaccgc

SEQ ID NO: 2988672 - RNA, 14 nt, Mycobacterium avium subsp. paratuberculosis
ccauuucggcgaaa

SEQ ID NO: 2988673 - RNA, 15 nt, Mycobacterium avium subsp. paratuberculosis
cccaaaaacaucguc

SEQ ID NO: 2988674 - RNA, 13 nt, Mycobacterium avium subsp. paratuberculosis
cccaacacgcccu

SEQ ID NO: 2988675 - RNA, 18 nt, Mycobacterium avium subsp. paratuberculosis
cccaacacgcccugcagg

SEQ ID NO: 2988676 - RNA, 14 nt, Mycobacterium avium subsp. paratuberculosis
cccaaccccgggcg

SEQ ID NO: 2988677 - RNA, 16 nt, Mycobacterium avium subsp. paratuberculosis
cccaaccccgggcggc

SEQ ID NO: 2988678 - RNA, 15 nt, Mycobacterium avium subsp. paratuberculosis
cccaaccgcauucgg

SEQ ID NO: 2988679 - RNA, 14 nt, Mycobacterium avium subsp. paratuberculosis
cccaaccguuggug

SEQ ID NO: 2988680 - RNA, 13 nt, Mycobacterium avium subsp. paratuberculosis
cccaacgacgucg

SEQ ID NO: 2988681 - RNA, 14 nt, Mycobacterium avium subsp. paratuberculosis
cccaacgcagcgca

SEQ ID NO: 2988682 - RNA, 18 nt, Mycobacterium avium subsp. paratuberculosis
cccaacggcgugcagccg

SEQ ID NO: 2988683 - RNA, 22 nt, Mycobacterium avium subsp. paratuberculosis
cccaacucaugggcccggcccg

SEQ ID NO: 2988684 - RNA, 16 nt, Mycobacterium avium subsp. paratuberculosis
cccaagccggccaggc

SEQ ID NO: 2988685 - RNA, 18 nt, Mycobacterium avium subsp. paratuberculosis
cccaagccggccaggccc

SEQ ID NO: 2988686 - RNA, 20 nt, Mycobacterium avium subsp. paratuberculosis
cccaagccggccaggcccag

SEQ ID NO: 2988687 - RNA, 16 nt, Mycobacterium avium subsp. paratuberculosis
cccaaggcggacaacg

SEQ ID NO: 2988688 - RNA, 16 nt, Mycobacterium avium subsp. paratuberculosis
cccaauacgaucagca

SEQ ID NO: 2988689 - RNA, 18 nt, Mycobacterium avium subsp. paratuberculosis
cccaauccucgccgagca

SEQ ID NO: 2988690 - RNA, 19 nt, Mycobacterium avium subsp. paratuberculosis
cccaauccucgccgagcag

SEQ ID NO: 2988691 - RNA, 20 nt, Mycobacterium avium subsp. paratuberculosis
cccaauccucgccgagcaga

SEQ ID NO: 2988692 - RNA, 22 nt, Mycobacterium avium subsp. paratuberculosis
cccaaugaucugggccgccaac

SEQ ID NO: 2988693 - RNA, 17 nt, Mycobacterium avium subsp. paratuberculosis
cccaauugccgggccag

SEQ ID NO: 2988694 - RNA, 18 nt, Mycobacterium avium subsp. paratuberculosis
cccacaccaccaccgagc

SEQ ID NO: 2988695 - RNA, 22 nt, Mycobacterium avium subsp. paratuberculosis
cccacaccgacaccggccggga

SEQ ID NO: 2988696 - RNA, 14 nt, Mycobacterium avium subsp. paratuberculosis
cccacaccguccga

SEQ ID NO: 2988697 - RNA, 19 nt, Mycobacterium avium subsp. paratuberculosis
cccacaccuucgcggucgg

SEQ ID NO: 2988698 - RNA, 20 nt, Mycobacterium avium subsp. paratuberculosis
cccacaccuucgcggucggc

SEQ ID NO: 2988699 - RNA, 14 nt, Mycobacterium avium subsp. paratuberculosis
cccacacgcucggc

SEQ ID NO: 2988700 - RNA, 17 nt, Mycobacterium avium subsp. paratuberculosis
cccacacgcucggcgag

SEQ ID NO: 2988701 - RNA, 20 nt, Mycobacterium avium subsp. paratuberculosis
cccacagcgccagcacggcc

SEQ ID NO: 2988702 - RNA, 18 nt, Mycobacterium avium subsp. paratuberculosis
cccacagcggaucggccu

SEQ ID NO: 2988703 - RNA, 21 nt, Mycobacterium avium subsp. paratuberculosis
cccacagcugacgggccggcg

SEQ ID NO: 2988704 - RNA, 23 nt, Mycobacterium avium subsp. paratuberculosis
cccacagcugacgggccggcggg

SEQ ID NO: 2988705 - RNA, 15 nt, Mycobacterium avium subsp. paratuberculosis
cccacagcugccggc

SEQ ID NO: 2988706 - RNA, 17 nt, Mycobacterium avium subsp. paratuberculosis
cccacagcugccggccg

SEQ ID NO: 2988707 - RNA, 23 nt, Mycobacterium avium subsp. paratuberculosis
cccacaggacguugaggcggcgg

SEQ ID NO: 2988708 - RNA, 14 nt, Mycobacterium avium subsp. paratuberculosis
cccacaguccgccc

SEQ ID NO: 2988709 - RNA, 13 nt, Mycobacterium avium subsp. paratuberculosis
cccaccaccgaca

SEQ ID NO: 2988710 - RNA, 15 nt, Mycobacterium avium subsp. paratuberculosis
cccaccaccgacagc

SEQ ID NO: 2988711 - RNA, 13 nt, Mycobacterium avium subsp. paratuberculosis
cccaccaccgcca

SEQ ID NO: 2988712 - RNA, 16 nt, Mycobacterium avium subsp. paratuberculosis
cccaccaccgccggcc

SEQ ID NO: 2988713 - RNA, 23 nt, Mycobacterium avium subsp. paratuberculosis
cccaccaccgccggcccaggcag

SEQ ID NO: 2988714 - RNA, 13 nt, Mycobacterium avium subsp. paratuberculosis
cccaccaccgccu

SEQ ID NO: 2988715 - RNA, 18 nt, Mycobacterium avium subsp. paratuberculosis
cccaccacgaaccaggcg

SEQ ID NO: 2988716 - RNA, 19 nt, Mycobacterium avium subsp. paratuberculosis
cccaccacgaaccaggcgc

SEQ ID NO: 2988717 - RNA, 11 nt, Mycobacterium avium subsp. paratuberculosis
cccaccagcau

SEQ ID NO: 2988718 - RNA, 12 nt, Mycobacterium avium subsp. paratuberculosis
cccaccagccga

SEQ ID NO: 2988719 - RNA, 13 nt, Mycobacterium avium subsp. paratuberculosis
cccaccagccgag

SEQ ID NO: 2988720 - RNA, 23 nt, Mycobacterium avium subsp. paratuberculosis
cccaccagccgagaucgacccgc

SEQ ID NO: 2988721 - RNA, 14 nt, Mycobacterium avium subsp. paratuberculosis
cccaccagccggcc

SEQ ID NO: 2988722 - RNA, 13 nt, Mycobacterium avium subsp. paratuberculosis
cccaccagcgccu

SEQ ID NO: 2988723 - RNA, 13 nt, Mycobacterium avium subsp. paratuberculosis
cccaccaucccgc

SEQ ID NO: 2988724 - RNA, 17 nt, Mycobacterium avium subsp. paratuberculosis
cccaccaucccgccgcc

SEQ ID NO: 2988725 - RNA, 18 nt, Mycobacterium avium subsp. paratuberculosis
cccaccaucccgccgccg

SEQ ID NO: 2988726 - RNA, 22 nt, Mycobacterium avium subsp. paratuberculosis
cccacccagguguccggcccga

SEQ ID NO: 2988727 - RNA, 13 nt, Mycobacterium avium subsp. paratuberculosis
cccaccccggcgu

SEQ ID NO: 2988728 - RNA, 14 nt, Mycobacterium avium subsp. paratuberculosis
cccaccccggcguc

SEQ ID NO: 2988729 - RNA, 17 nt, Mycobacterium avium subsp. paratuberculosis
cccacccgaugaccggc

SEQ ID NO: 2988730 - RNA, 15 nt, Mycobacterium avium subsp. paratuberculosis
cccacccgcacgccc

SEQ ID NO: 2988731 - RNA, 16 nt, Mycobacterium avium subsp. paratuberculosis
cccacccgcacgcccg

SEQ ID NO: 2988732 - RNA, 13 nt, Mycobacterium avium subsp. paratuberculosis
cccacccgcgcga

SEQ ID NO: 2988733 - RNA, 14 nt, Mycobacterium avium subsp. paratuberculosis
cccacccgcucggc

SEQ ID NO: 2988734 - RNA, 17 nt, Mycobacterium avium subsp. paratuberculosis
cccacccgcucggcgau

SEQ ID NO: 2988735 - RNA, 17 nt, Mycobacterium avium subsp. paratuberculosis
cccacccggggccgucc

SEQ ID NO: 2988736 - RNA, 17 nt, Mycobacterium avium subsp. paratuberculosis
cccacccguuggcaggc

SEQ ID NO: 2988737 - RNA, 15 nt, Mycobacterium avium subsp. paratuberculosis
cccaccgacagccgg

SEQ ID NO: 2988738 - RNA, 16 nt, Mycobacterium avium subsp. paratuberculosis
cccaccgacagccgga

SEQ ID NO: 2988739 - RNA, 14 nt, Mycobacterium avium subsp. paratuberculosis
cccaccgagcagcu

SEQ ID NO: 2988740 - RNA, 20 nt, Mycobacterium avium subsp. paratuberculosis
cccaccgaucaggaucggcg

SEQ ID NO: 2988741 - RNA, 17 nt, Mycobacterium avium subsp. paratuberculosis
cccaccgcgacacgucg

SEQ ID NO: 2988742 - RNA, 12 nt, Mycobacterium avium subsp. paratuberculosis
cccaccgcgacc

SEQ ID NO: 2988743 - RNA, 13 nt, Mycobacterium avium subsp. paratuberculosis
cccaccgcgccca

SEQ ID NO: 2988744 - RNA, 15 nt, Mycobacterium avium subsp. paratuberculosis
cccaccgcgcccagc

SEQ ID NO: 2988745 - RNA, 13 nt, Mycobacterium avium subsp. paratuberculosis
cccaccgcgccgu

SEQ ID NO: 2988746 - RNA, 15 nt, Mycobacterium avium subsp. paratuberculosis
cccaccgcgccguga

SEQ ID NO: 2988747 - RNA, 13 nt, Mycobacterium avium subsp. paratuberculosis
cccaccgcggcgc

SEQ ID NO: 2988748 - RNA, 21 nt, Mycobacterium avium subsp. paratuberculosis
cccaccgcggugaccgcccgc

SEQ ID NO: 2988749 - RNA, 15 nt, Mycobacterium avium subsp. paratuberculosis
cccaccgcgucgcag

SEQ ID NO: 2988750 - RNA, 20 nt, Mycobacterium avium subsp. paratuberculosis
cccaccgcgucgcagugccg

SEQ ID NO: 2988751 - RNA, 14 nt, Mycobacterium avium subsp. paratuberculosis
cccaccggcccggc

SEQ ID NO: 2988752 - RNA, 14 nt, Mycobacterium avium subsp. paratuberculosis
cccaccggcgaugu

SEQ ID NO: 2988753 - RNA, 16 nt, Mycobacterium avium subsp. paratuberculosis
cccaccggcgaugugg

SEQ ID NO: 2988754 - RNA, 21 nt, Mycobacterium avium subsp. paratuberculosis
cccaccggcgcagcgcgucgc

SEQ ID NO: 2988755 - RNA, 12 nt, Mycobacterium avium subsp. paratuberculosis
cccaccgggcag

SEQ ID NO: 2988756 - RNA, 13 nt, Mycobacterium avium subsp. paratuberculosis
cccaccgggcagc

SEQ ID NO: 2988757 - RNA, 15 nt, Mycobacterium avium subsp. paratuberculosis
cccaccgggcagccg

SEQ ID NO: 2988758 - RNA, 13 nt, Mycobacterium avium subsp. paratuberculosis
cccaccgucgcca

SEQ ID NO: 2988759 - RNA, 23 nt, Mycobacterium avium subsp. paratuberculosis
cccaccgucuuggucucgccgau

SEQ ID NO: 2988760 - RNA, 16 nt, Mycobacterium avium subsp. paratuberculosis
cccaccucgagcacgc

SEQ ID NO: 2988761 - RNA, 20 nt, Mycobacterium avium subsp. paratuberculosis
cccaccugaucgcggcgagc

SEQ ID NO: 2988762 - RNA, 22 nt, Mycobacterium avium subsp. paratuberculosis
cccaccuggaggccaacgagcg

SEQ ID NO: 2988763 - RNA, 22 nt, Mycobacterium avium subsp. paratuberculosis
cccaccugguucucccgucgcg

SEQ ID NO: 2988764 - RNA, 22 nt, Mycobacterium avium subsp. paratuberculosis
cccaccugguuggcccgcacca

SEQ ID NO: 2988765 - RNA, 16 nt, Mycobacterium avium subsp. paratuberculosis
cccaccuuggcgucga

SEQ ID NO: 2988766 - RNA, 19 nt, Mycobacterium avium subsp. paratuberculosis
cccacgaacgucaggccgu

SEQ ID NO: 2988767 - RNA, 18 nt, Mycobacterium avium subsp. paratuberculosis
cccacgaagaugaucagc

SEQ ID NO: 2988768 - RNA, 23 nt, Mycobacterium avium subsp. paratuberculosis
cccacgaagaugaucagcgcgcc

SEQ ID NO: 2988769 - RNA, 22 nt, Mycobacterium avium subsp. paratuberculosis
cccacgacgacugggugcgcgg

SEQ ID NO: 2988770 - RNA, 22 nt, Mycobacterium avium subsp. paratuberculosis
cccacgacgucugggccgccga

SEQ ID NO: 2988771 - RNA, 19 nt, Mycobacterium avium subsp. paratuberculosis
cccacgaguaaccggugcg

SEQ ID NO: 2988772 - RNA, 12 nt, Mycobacterium avium subsp. paratuberculosis
cccacgcagccg

SEQ ID NO: 2988773 - RNA, 12 nt, Mycobacterium avium subsp. paratuberculosis
cccacgccagcc

SEQ ID NO: 2988774 - RNA, 19 nt, Mycobacterium avium subsp. paratuberculosis
cccacgcccuagcgggcca

SEQ ID NO: 2988775 - RNA, 22 nt, Mycobacterium avium subsp. paratuberculosis
cccacgcccuagcgggccagga

SEQ ID NO: 2988776 - RNA, 12 nt, Mycobacterium avium subsp. paratuberculosis
cccacgccgccc

SEQ ID NO: 2988777 - RNA, 22 nt, Mycobacterium avium subsp. paratuberculosis
cccacgccgucgacccguuccc

SEQ ID NO: 2988778 - RNA, 20 nt, Mycobacterium avium subsp. paratuberculosis
cccacgccuugcgguuggcc

SEQ ID NO: 2988779 - RNA, 18 nt, Mycobacterium avium subsp. paratuberculosis
cccacgcgcucagcgcgg

SEQ ID NO: 2988780 - RNA, 19 nt, Mycobacterium avium subsp. paratuberculosis
cccacgcgcucagcgcggc

SEQ ID NO: 2988781 - RNA, 20 nt, Mycobacterium avium subsp. paratuberculosis
cccacgcgcucagcgcggcc

SEQ ID NO: 2988782 - RNA, 12 nt, Mycobacterium avium subsp. paratuberculosis
cccacgcucggc

SEQ ID NO: 2988783 - RNA, 12 nt, Mycobacterium avium subsp. paratuberculosis
cccacggccaca

SEQ ID NO: 2988784 - RNA, 14 nt, Mycobacterium avium subsp. paratuberculosis
cccacggccaccac

SEQ ID NO: 2988785 - RNA, 14 nt, Mycobacterium avium subsp. paratuberculosis
cccacggcgcgugc

SEQ ID NO: 2988786 - RNA, 19 nt, Mycobacterium avium subsp. paratuberculosis
cccacgggaugcggcacgc

SEQ ID NO: 2988787 - RNA, 17 nt, Mycobacterium avium subsp. paratuberculosis
cccacgggccauguccc

SEQ ID NO: 2988788 - RNA, 19 nt, Mycobacterium avium subsp. paratuberculosis
cccacgggccauguccccg

SEQ ID NO: 2988789 - RNA, 22 nt, Mycobacterium avium subsp. paratuberculosis
cccacggucuuugccggccaug

SEQ ID NO: 2988790 - RNA, 23 nt, Mycobacterium avium subsp. paratuberculosis
cccacggugaggacaccacgauc

SEQ ID NO: 2988791 - RNA, 20 nt, Mycobacterium avium subsp. paratuberculosis
cccacggugauuccggcacc

SEQ ID NO: 2988792 - RNA, 21 nt, Mycobacterium avium subsp. paratuberculosis
cccacggugauuccggcaccc

SEQ ID NO: 2988793 - RNA, 23 nt, Mycobacterium avium subsp. paratuberculosis
cccacggugauuccggcacccgc

SEQ ID NO: 2988794 - RNA, 18 nt, Mycobacterium avium subsp. paratuberculosis
cccacguaggcgaugucg

SEQ ID NO: 2988795 - RNA, 19 nt, Mycobacterium avium subsp. paratuberculosis
cccacguaggcgaugucga

SEQ ID NO: 2988796 - RNA, 21 nt, Mycobacterium avium subsp. paratuberculosis
cccacguaggcgaugucgacg

SEQ ID NO: 2988797 - RNA, 17 nt, Mycobacterium avium subsp. paratuberculosis
cccacguaggggcccgg

SEQ ID NO: 2988798 - RNA, 21 nt, Mycobacterium avium subsp. paratuberculosis
cccacguaggggcccggguug

SEQ ID NO: 2988799 - RNA, 14 nt, Mycobacterium avium subsp. paratuberculosis
cccacgucgcgccg

SEQ ID NO: 2988800 - RNA, 15 nt, Mycobacterium avium subsp. paratuberculosis
cccacgugcggcgcc

SEQ ID NO: 2988801 - RNA, 14 nt, Mycobacterium avium subsp. paratuberculosis
cccacguugagcac

SEQ ID NO: 2988802 - RNA, 19 nt, Mycobacterium avium subsp. paratuberculosis
cccacguugagcacgcccg

SEQ ID NO: 2988803 - RNA, 16 nt, Mycobacterium avium subsp. paratuberculosis
cccacguugaucaugu

SEQ ID NO: 2988804 - RNA, 19 nt, Mycobacterium avium subsp. paratuberculosis
cccacguugaucaugucga

SEQ ID NO: 2988805 - RNA, 21 nt, Mycobacterium avium subsp. paratuberculosis
cccacguugaucaugucgaug

SEQ ID NO: 2988806 - RNA, 17 nt, Mycobacterium avium subsp. paratuberculosis
cccacucccagccgccg

SEQ ID NO: 2988807 - RNA, 18 nt, Mycobacterium avium subsp. paratuberculosis
cccacucccagccgccgg

SEQ ID NO: 2988808 - RNA, 21 nt, Mycobacterium avium subsp. paratuberculosis
cccacucgucgaucgacgccg

SEQ ID NO: 2988809 - RNA, 22 nt, Mycobacterium avium subsp. paratuberculosis
cccacugcccguagucggcggc

SEQ ID NO: 2988810 - RNA, 19 nt, Mycobacterium avium subsp. paratuberculosis
cccacugccugacccggcc

SEQ ID NO: 2988811 - RNA, 16 nt, Mycobacterium avium subsp. paratuberculosis
cccacuggcggccggc

SEQ ID NO: 2988812 - RNA, 17 nt, Mycobacterium avium subsp. paratuberculosis
cccacuggcggccggcc

SEQ ID NO: 2988813 - RNA, 21 nt, Mycobacterium avium subsp. paratuberculosis
cccacuggcggccggccgcgc

SEQ ID NO: 2988814 - RNA, 22 nt, Mycobacterium avium subsp. paratuberculosis
cccacuggcggccggccgcgcc

SEQ ID NO: 2988815 - RNA, 14 nt, Mycobacterium avium subsp. paratuberculosis
cccacuucgacggu

SEQ ID NO: 2988816 - RNA, 19 nt, Mycobacterium avium subsp. paratuberculosis
cccagaaccgcucggcggc

SEQ ID NO: 2988817 - RNA, 20 nt, Mycobacterium avium subsp. paratuberculosis
cccagaaccgcucggcggcg

SEQ ID NO: 2988818 - RNA, 20 nt, Mycobacterium avium subsp. paratuberculosis
cccagaacgacgcgcucagc

SEQ ID NO: 2988819 - RNA, 22 nt, Mycobacterium avium subsp. paratuberculosis
cccagaacgacgcgcucagccc

SEQ ID NO: 2988820 - RNA, 13 nt, Mycobacterium avium subsp. paratuberculosis
cccagaacugggc

SEQ ID NO: 2988821 - RNA, 18 nt, Mycobacterium avium subsp. paratuberculosis
cccagaacugggccgccg

SEQ ID NO: 2988822 - RNA, 22 nt, Mycobacterium avium subsp. paratuberculosis
cccagaacugggccgccgucgc

SEQ ID NO: 2988823 - RNA, 18 nt, Mycobacterium avium subsp. paratuberculosis
cccagaauucgccggggc

SEQ ID NO: 2988824 - RNA, 14 nt, Mycobacterium avium subsp. paratuberculosis
cccagacaggccgg

SEQ ID NO: 2988825 - RNA, 15 nt, Mycobacterium avium subsp. paratuberculosis
cccagacaggccggc

SEQ ID NO: 2988826 - RNA, 16 nt, Mycobacterium avium subsp. paratuberculosis
cccagacccagcaucg

SEQ ID NO: 2988827 - RNA, 18 nt, Mycobacterium avium subsp. paratuberculosis
cccagacccagcaucgcc

SEQ ID NO: 2988828 - RNA, 22 nt, Mycobacterium avium subsp. paratuberculosis
cccagacgaugucgucgccggu

SEQ ID NO: 2988829 - RNA, 23 nt, Mycobacterium avium subsp. paratuberculosis
cccagacgauuugggcgguccgc

SEQ ID NO: 2988830 - RNA, 12 nt, Mycobacterium avium subsp. paratuberculosis
cccagacgcggg

SEQ ID NO: 2988831 - RNA, 19 nt, Mycobacterium avium subsp. paratuberculosis
cccagacgcgggcgcccag

SEQ ID NO: 2988832 - RNA, 20 nt, Mycobacterium avium subsp. paratuberculosis
cccagacgcgggcgcccagc

SEQ ID NO: 2988833 - RNA, 19 nt, Mycobacterium avium subsp. paratuberculosis
cccagacuugggcagcagg

SEQ ID NO: 2988834 - RNA, 21 nt, Mycobacterium avium subsp. paratuberculosis
cccagacuugggcagcaggug

SEQ ID NO: 2988835 - RNA, 16 nt, Mycobacterium avium subsp. paratuberculosis
cccagauacgccgcga

SEQ ID NO: 2988836 - RNA, 12 nt, Mycobacterium avium subsp. paratuberculosis
cccagaucgacg

SEQ ID NO: 2988837 - RNA, 14 nt, Mycobacterium avium subsp. paratuberculosis
cccagaucgacgcc

SEQ ID NO: 2988838 - RNA, 21 nt, Mycobacterium avium subsp. paratuberculosis
cccagaucgacgccgaccgcg

SEQ ID NO: 2988839 - RNA, 18 nt, Mycobacterium avium subsp. paratuberculosis
cccagaucgcccgggcgg

SEQ ID NO: 2988840 - RNA, 14 nt, Mycobacterium avium subsp. paratuberculosis
cccagaucggccag

SEQ ID NO: 2988841 - RNA, 15 nt, Mycobacterium avium subsp. paratuberculosis
cccagaucggccagc

SEQ ID NO: 2988842 - RNA, 23 nt, Mycobacterium avium subsp. paratuberculosis
cccagaucguagggcucggcguc

SEQ ID NO: 2988843 - RNA, 17 nt, Mycobacterium avium subsp. paratuberculosis
cccagaugcccagcggc

SEQ ID NO: 2988844 - RNA, 17 nt, Mycobacterium avium subsp. paratuberculosis
cccagaugccgccgcca

SEQ ID NO: 2988845 - RNA, 19 nt, Mycobacterium avium subsp. paratuberculosis
cccagaugccgccgccagc

SEQ ID NO: 2988846 - RNA, 21 nt, Mycobacterium avium subsp. paratuberculosis
cccagaugcgcgacggccucg

SEQ ID NO: 2988847 - RNA, 22 nt, Mycobacterium avium subsp. paratuberculosis
cccagaugcgcgacggccucgc

SEQ ID NO: 2988848 - RNA, 18 nt, Mycobacterium avium subsp. paratuberculosis
cccagcaaaaccccgccg

SEQ ID NO: 2988849 - RNA, 17 nt, Mycobacterium avium subsp. paratuberculosis
cccagcaaacccagcac

SEQ ID NO: 2988850 - RNA, 19 nt, Mycobacterium avium subsp. paratuberculosis
cccagcaaacccagcacca

SEQ ID NO: 2988851 - RNA, 13 nt, Mycobacterium avium subsp. paratuberculosis
cccagcacagccg

SEQ ID NO: 2988852 - RNA, 15 nt, Mycobacterium avium subsp. paratuberculosis
cccagcacagcgagg

SEQ ID NO: 2988853 - RNA, 17 nt, Mycobacterium avium subsp. paratuberculosis
cccagcacagcgaggcg

SEQ ID NO: 2988854 - RNA, 13 nt, Mycobacterium avium subsp. paratuberculosis
cccagcaccaaca

SEQ ID NO: 2988855 - RNA, 21 nt, Mycobacterium avium subsp. paratuberculosis
cccagcaccaacagcggcccg

SEQ ID NO: 2988856 - RNA, 11 nt, Mycobacterium avium subsp. paratuberculosis
cccagcaccac

SEQ ID NO: 2988857 - RNA, 13 nt, Mycobacterium avium subsp. paratuberculosis
cccagcaccacca

SEQ ID NO: 2988858 - RNA, 13 nt, Mycobacterium avium subsp. paratuberculosis
cccagcaccaccu

SEQ ID NO: 2988859 - RNA, 16 nt, Mycobacterium avium subsp. paratuberculosis
cccagcaccaccuugu

SEQ ID NO: 2988860 - RNA, 23 nt, Mycobacterium avium subsp. paratuberculosis
cccagcaccacuuccagcaccgg

SEQ ID NO: 2988861 - RNA, 18 nt, Mycobacterium avium subsp. paratuberculosis
cccagcaccccgguccag

SEQ ID NO: 2988862 - RNA, 21 nt, Mycobacterium avium subsp. paratuberculosis
cccagcaccccgguccaggcg

SEQ ID NO: 2988863 - RNA, 14 nt, Mycobacterium avium subsp. paratuberculosis
cccagcacccgcuc

SEQ ID NO: 2988864 - RNA, 17 nt, Mycobacterium avium subsp. paratuberculosis
cccagcacccgcucgcc

SEQ ID NO: 2988865 - RNA, 13 nt, Mycobacterium avium subsp. paratuberculosis
cccagcaccgccg

SEQ ID NO: 2988866 - RNA, 15 nt, Mycobacterium avium subsp. paratuberculosis
cccagcaccgccggc

SEQ ID NO: 2988867 - RNA, 16 nt, Mycobacterium avium subsp. paratuberculosis
cccagcaccgccggcg

SEQ ID NO: 2988868 - RNA, 13 nt, Mycobacterium avium subsp. paratuberculosis
cccagcaccgcga

SEQ ID NO: 2988869 - RNA, 14 nt, Mycobacterium avium subsp. paratuberculosis
cccagcacgacgcc

SEQ ID NO: 2988870 - RNA, 17 nt, Mycobacterium avium subsp. paratuberculosis
cccagcacgacgccgcu

SEQ ID NO: 2988871 - RNA, 19 nt, Mycobacterium avium subsp. paratuberculosis
cccagcacgacgccgcugg

SEQ ID NO: 2988872 - RNA, 16 nt, Mycobacterium avium subsp. paratuberculosis
cccagcacgaucccgc

SEQ ID NO: 2988873 - RNA, 18 nt, Mycobacterium avium subsp. paratuberculosis
cccagcacgaucccgccg

SEQ ID NO: 2988874 - RNA, 23 nt, Mycobacterium avium subsp. paratuberculosis
cccagcacgaucccgccgcccgc

SEQ ID NO: 2988875 - RNA, 18 nt, Mycobacterium avium subsp. paratuberculosis
cccagcacgaugacgacc

SEQ ID NO: 2988876 - RNA, 14 nt, Mycobacterium avium subsp. paratuberculosis
cccagcagcaccgc

SEQ ID NO: 2988877 - RNA, 15 nt, Mycobacterium avium subsp. paratuberculosis
cccagcagcccggcc

SEQ ID NO: 2988878 - RNA, 18 nt, Mycobacterium avium subsp. paratuberculosis
cccagcagcccggccagc

SEQ ID NO: 2988879 - RNA, 21 nt, Mycobacterium avium subsp. paratuberculosis
cccagcagcccggccagccgg

SEQ ID NO: 2988880 - RNA, 18 nt, Mycobacterium avium subsp. paratuberculosis
cccagcagccugcccccc

SEQ ID NO: 2988881 - RNA, 12 nt, Mycobacterium avium subsp. paratuberculosis
cccagcagcgca

SEQ ID NO: 2988882 - RNA, 20 nt, Mycobacterium avium subsp. paratuberculosis
cccagcagcgcaccggcgau

SEQ ID NO: 2988883 - RNA, 13 nt, Mycobacterium avium subsp. paratuberculosis
cccagcagcggcc

SEQ ID NO: 2988884 - RNA, 16 nt, Mycobacterium avium subsp. paratuberculosis
cccagcagcggccggc

SEQ ID NO: 2988885 - RNA, 23 nt, Mycobacterium avium subsp. paratuberculosis
cccagcagcgggcccgggcugcc

SEQ ID NO: 2988886 - RNA, 22 nt, Mycobacterium avium subsp. paratuberculosis
cccagcagcgucacgucgacgg

SEQ ID NO: 2988887 - RNA, 15 nt, Mycobacterium avium subsp. paratuberculosis
cccagcagggcggcg

SEQ ID NO: 2988888 - RNA, 21 nt, Mycobacterium avium subsp. paratuberculosis
cccagcaguccggcggucagc

SEQ ID NO: 2988889 - RNA, 18 nt, Mycobacterium avium subsp. paratuberculosis
cccagcaguuuguccugc

SEQ ID NO: 2988890 - RNA, 14 nt, Mycobacterium avium subsp. paratuberculosis
cccagcaucgccgc

SEQ ID NO: 2988891 - RNA, 15 nt, Mycobacterium avium subsp. paratuberculosis
cccagcaucgccgcg

SEQ ID NO: 2988892 - RNA, 21 nt, Mycobacterium avium subsp. paratuberculosis
cccagccagccgguggcggcc

SEQ ID NO: 2988893 - RNA, 14 nt, Mycobacterium avium subsp. paratuberculosis
cccagccagcgaca

SEQ ID NO: 2988894 - RNA, 22 nt, Mycobacterium avium subsp. paratuberculosis
cccagccauaccuugucggcgu

SEQ ID NO: 2988895 - RNA, 14 nt, Mycobacterium avium subsp. paratuberculosis
cccagccaucugcu

SEQ ID NO: 2988896 - RNA, 14 nt, Mycobacterium avium subsp. paratuberculosis
cccagccccagcac

SEQ ID NO: 2988897 - RNA, 16 nt, Mycobacterium avium subsp. paratuberculosis
cccagccccucgccgg

SEQ ID NO: 2988898 - RNA, 20 nt, Mycobacterium avium subsp. paratuberculosis
cccagccccuuguagcccuc

SEQ ID NO: 2988899 - RNA, 21 nt, Mycobacterium avium subsp. paratuberculosis
cccagccccuuguagcccucc

SEQ ID NO: 2988900 - RNA, 14 nt, Mycobacterium avium subsp. paratuberculosis
cccagcccgagcac

SEQ ID NO: 2988901 - RNA, 12 nt, Mycobacterium avium subsp. paratuberculosis
cccagcccgccg

SEQ ID NO: 2988902 - RNA, 13 nt, Mycobacterium avium subsp. paratuberculosis
cccagcccgccgc

SEQ ID NO: 2988903 - RNA, 15 nt, Mycobacterium avium subsp. paratuberculosis
cccagcccgcgccga

SEQ ID NO: 2988904 - RNA, 16 nt, Mycobacterium avium subsp. paratuberculosis
cccagcccgcgcgagc

SEQ ID NO: 2988905 - RNA, 17 nt, Mycobacterium avium subsp. paratuberculosis
cccagcccgcgcgagcg

SEQ ID NO: 2988906 - RNA, 17 nt, Mycobacterium avium subsp. paratuberculosis
cccagcccggaucccag

SEQ ID NO: 2988907 - RNA, 12 nt, Mycobacterium avium subsp. paratuberculosis
cccagcccggcc

SEQ ID NO: 2988908 - RNA, 14 nt, Mycobacterium avium subsp. paratuberculosis
cccagcccggccag

SEQ ID NO: 2988909 - RNA, 15 nt, Mycobacterium avium subsp. paratuberculosis
cccagcccggccagc

SEQ ID NO: 2988910 - RNA, 22 nt, Mycobacterium avium subsp. paratuberculosis
cccagcccggccccaccgccgc

SEQ ID NO: 2988911 - RNA, 21 nt, Mycobacterium avium subsp. paratuberculosis
cccagcccggcuggcaggucg

SEQ ID NO: 2988912 - RNA, 17 nt, Mycobacterium avium subsp. paratuberculosis
cccagccgagccgggcc

SEQ ID NO: 2988913 - RNA, 23 nt, Mycobacterium avium subsp. paratuberculosis
cccagccgcaggugcagcuccuu

SEQ ID NO: 2988914 - RNA, 20 nt, Mycobacterium avium subsp. paratuberculosis
cccagccgcauucggugagc

SEQ ID NO: 2988915 - RNA, 13 nt, Mycobacterium avium subsp. paratuberculosis
cccagccgccagc

SEQ ID NO: 2988916 - RNA, 15 nt, Mycobacterium avium subsp. paratuberculosis
cccagccgccagccg

SEQ ID NO: 2988917 - RNA, 14 nt, Mycobacterium avium subsp. paratuberculosis
cccagccgcugaac

SEQ ID NO: 2988918 - RNA, 13 nt, Mycobacterium avium subsp. paratuberculosis
cccagccggccga

SEQ ID NO: 2988919 - RNA, 14 nt, Mycobacterium avium subsp. paratuberculosis
cccagccggccgag

SEQ ID NO: 2988920 - RNA, 14 nt, Mycobacterium avium subsp. paratuberculosis
cccagccggcggau

SEQ ID NO: 2988921 - RNA, 14 nt, Mycobacterium avium subsp. paratuberculosis
cccagccggcggug

SEQ ID NO: 2988922 - RNA, 18 nt, Mycobacterium avium subsp. paratuberculosis
cccagccggcggugcagg

SEQ ID NO: 2988923 - RNA, 16 nt, Mycobacterium avium subsp. paratuberculosis
cccagccggucgccgg

SEQ ID NO: 2988924 - RNA, 19 nt, Mycobacterium avium subsp. paratuberculosis
cccagccggucgccgggcc

SEQ ID NO: 2988925 - RNA, 20 nt, Mycobacterium avium subsp. paratuberculosis
cccagccggugcgagccgcu

SEQ ID NO: 2988926 - RNA, 12 nt, Mycobacterium avium subsp. paratuberculosis
cccagccgucgc

SEQ ID NO: 2988927 - RNA, 12 nt, Mycobacterium avium subsp. paratuberculosis
cccagccgugcc

SEQ ID NO: 2988928 - RNA, 14 nt, Mycobacterium avium subsp. paratuberculosis
cccagcgacucggc

SEQ ID NO: 2988929 - RNA, 17 nt, Mycobacterium avium subsp. paratuberculosis
cccagcgacucggccag

SEQ ID NO: 2988930 - RNA, 20 nt, Mycobacterium avium subsp. paratuberculosis
cccagcgagcaggucaccgg

SEQ ID NO: 2988931 - RNA, 14 nt, Mycobacterium avium subsp. paratuberculosis
cccagcgagccgau

SEQ ID NO: 2988932 - RNA, 23 nt, Mycobacterium avium subsp. paratuberculosis
cccagcgagcucaggccggccuu

SEQ ID NO: 2988933 - RNA, 13 nt, Mycobacterium avium subsp. paratuberculosis
cccagcgagcugc

SEQ ID NO: 2988934 - RNA, 17 nt, Mycobacterium avium subsp. paratuberculosis
cccagcgagcugccggc

SEQ ID NO: 2988935 - RNA, 20 nt, Mycobacterium avium subsp. paratuberculosis
cccagcgagcugccggcggc

SEQ ID NO: 2988936 - RNA, 19 nt, Mycobacterium avium subsp. paratuberculosis
cccagcgaggcggccagcg

SEQ ID NO: 2988937 - RNA, 20 nt, Mycobacterium avium subsp. paratuberculosis
cccagcgaggcggccagcgg

SEQ ID NO: 2988938 - RNA, 20 nt, Mycobacterium avium subsp. paratuberculosis
cccagcgaggugaagccguu

SEQ ID NO: 2988939 - RNA, 19 nt, Mycobacterium avium subsp. paratuberculosis
cccagcgcaacggcgucga

SEQ ID NO: 2988940 - RNA, 12 nt, Mycobacterium avium subsp. paratuberculosis
cccagcgcagcg

SEQ ID NO: 2988941 - RNA, 16 nt, Mycobacterium avium subsp. paratuberculosis
cccagcgcagcgccuc

SEQ ID NO: 2988942 - RNA, 19 nt, Mycobacterium avium subsp. paratuberculosis
cccagcgcagcgccucggc

SEQ ID NO: 2988943 - RNA, 22 nt, Mycobacterium avium subsp. paratuberculosis
cccagcgcauccaccagggcgg

SEQ ID NO: 2988944 - RNA, 18 nt, Mycobacterium avium subsp. paratuberculosis
cccagcgccacuggcugg

SEQ ID NO: 2988945 - RNA, 14 nt, Mycobacterium avium subsp. paratuberculosis
cccagcgccccgaa

SEQ ID NO: 2988946 - RNA, 12 nt, Mycobacterium avium subsp. paratuberculosis
cccagcgccgcg

SEQ ID NO: 2988947 - RNA, 14 nt, Mycobacterium avium subsp. paratuberculosis
cccagcgccgcggc

SEQ ID NO: 2988948 - RNA, 17 nt, Mycobacterium avium subsp. paratuberculosis
cccagcgccucgagcac

SEQ ID NO: 2988949 - RNA, 16 nt, Mycobacterium avium subsp. paratuberculosis
cccagcgcgaggucga

SEQ ID NO: 2988950 - RNA, 19 nt, Mycobacterium avium subsp. paratuberculosis
cccagcgcgcgaucgccgg

SEQ ID NO: 2988951 - RNA, 14 nt, Mycobacterium avium subsp. paratuberculosis
cccagcgcggcggc

SEQ ID NO: 2988952 - RNA, 14 nt, Mycobacterium avium subsp. paratuberculosis
cccagcgcgggggg

SEQ ID NO: 2988953 - RNA, 12 nt, Mycobacterium avium subsp. paratuberculosis
cccagcgcggua

SEQ ID NO: 2988954 - RNA, 13 nt, Mycobacterium avium subsp. paratuberculosis
cccagcgcggugu

SEQ ID NO: 2988955 - RNA, 22 nt, Mycobacterium avium subsp. paratuberculosis
cccagcgcgguguacagcgcgc

SEQ ID NO: 2988956 - RNA, 19 nt, Mycobacterium avium subsp. paratuberculosis
cccagcgcguugcggccgu

SEQ ID NO: 2988957 - RNA, 18 nt, Mycobacterium avium subsp. paratuberculosis
cccagcggaaccgggggc

SEQ ID NO: 2988958 - RNA, 20 nt, Mycobacterium avium subsp. paratuberculosis
cccagcggcacgggcaccga

SEQ ID NO: 2988959 - RNA, 12 nt, Mycobacterium avium subsp. paratuberculosis
cccagcggcccc

SEQ ID NO: 2988960 - RNA, 15 nt, Mycobacterium avium subsp. paratuberculosis
cccagcggccccggc

SEQ ID NO: 2988961 - RNA, 13 nt, Mycobacterium avium subsp. paratuberculosis
cccagcggccgag

SEQ ID NO: 2988962 - RNA, 22 nt, Mycobacterium avium subsp. paratuberculosis
cccagcggcuguagcacccggc

SEQ ID NO: 2988963 - RNA, 20 nt, Mycobacterium avium subsp. paratuberculosis
cccagcggcuugagccggau

SEQ ID NO: 2988964 - RNA, 20 nt, Mycobacterium avium subsp. paratuberculosis
cccagcgggacagcaccacc

SEQ ID NO: 2988965 - RNA, 13 nt, Mycobacterium avium subsp. paratuberculosis
cccagcggggcaa

SEQ ID NO: 2988966 - RNA, 19 nt, Mycobacterium avium subsp. paratuberculosis
cccagcggggcaagcagcg

SEQ ID NO: 2988967 - RNA, 21 nt, Mycobacterium avium subsp. paratuberculosis
cccagcggggcaagcagcggc

SEQ ID NO: 2988968 - RNA, 20 nt, Mycobacterium avium subsp. paratuberculosis
cccagcgucucggcggccga

SEQ ID NO: 2988969 - RNA, 23 nt, Mycobacterium avium subsp. paratuberculosis
cccagcgucucggcggccgagcg

SEQ ID NO: 2988970 - RNA, 19 nt, Mycobacterium avium subsp. paratuberculosis
cccagcguggucacccgca

SEQ ID NO: 2988971 - RNA, 23 nt, Mycobacterium avium subsp. paratuberculosis
cccagcguggucacccgcagccc

SEQ ID NO: 2988972 - RNA, 21 nt, Mycobacterium avium subsp. paratuberculosis
cccagcuccaaugcggccgac

SEQ ID NO: 2988973 - RNA, 17 nt, Mycobacterium avium subsp. paratuberculosis
cccagcuccucggccag

SEQ ID NO: 2988974 - RNA, 19 nt, Mycobacterium avium subsp. paratuberculosis
cccagcuccucggccagca

SEQ ID NO: 2988975 - RNA, 13 nt, Mycobacterium avium subsp. paratuberculosis
cccagcucgguga

SEQ ID NO: 2988976 - RNA, 22 nt, Mycobacterium avium subsp. paratuberculosis
cccagcucguugccggcggcca

SEQ ID NO: 2988977 - RNA, 24 nt, Mycobacterium avium subsp. paratuberculosis
cccagcugcacccaccggcccagc

SEQ ID NO: 2988978 - RNA, 14 nt, Mycobacterium avium subsp. paratuberculosis
cccagcugggccgc

SEQ ID NO: 2988979 - RNA, 19 nt, Mycobacterium avium subsp. paratuberculosis
cccagcuugaccacccggu

SEQ ID NO: 2988980 - RNA, 21 nt, Mycobacterium avium subsp. paratuberculosis
cccagcuuggcgcccuugccg

SEQ ID NO: 2988981 - RNA, 19 nt, Mycobacterium avium subsp. paratuberculosis
cccaggaaaaccagcgacg

SEQ ID NO: 2988982 - RNA, 20 nt, Mycobacterium avium subsp. paratuberculosis
cccaggaacgcgcccggcgg

SEQ ID NO: 2988983 - RNA, 21 nt, Mycobacterium avium subsp. paratuberculosis
cccaggaacgcgcccggcggg

SEQ ID NO: 2988984 - RNA, 15 nt, Mycobacterium avium subsp. paratuberculosis
cccaggaacgcgccg

SEQ ID NO: 2988985 - RNA, 17 nt, Mycobacterium avium subsp. paratuberculosis
cccaggaacgcgccggc

SEQ ID NO: 2988986 - RNA, 19 nt, Mycobacterium avium subsp. paratuberculosis
cccaggaacgcgccggcgc

SEQ ID NO: 2988987 - RNA, 20 nt, Mycobacterium avium subsp. paratuberculosis
cccaggaaguagccggccag

SEQ ID NO: 2988988 - RNA, 13 nt, Mycobacterium avium subsp. paratuberculosis
cccaggacgcggu

SEQ ID NO: 2988989 - RNA, 15 nt, Mycobacterium avium subsp. paratuberculosis
cccaggacggcgcgg

SEQ ID NO: 2988990 - RNA, 23 nt, Mycobacterium avium subsp. paratuberculosis
cccaggacgguuucugccggccg

SEQ ID NO: 2988991 - RNA, 20 nt, Mycobacterium avium subsp. paratuberculosis
cccaggaugaucuucuccag

SEQ ID NO: 2988992 - RNA, 21 nt, Mycobacterium avium subsp. paratuberculosis
cccaggaugaucuucuccagg

SEQ ID NO: 2988993 - RNA, 19 nt, Mycobacterium avium subsp. paratuberculosis
cccaggauucccgaccccg

SEQ ID NO: 2988994 - RNA, 23 nt, Mycobacterium avium subsp. paratuberculosis
cccaggauucccgaccccgccag

SEQ ID NO: 2988995 - RNA, 18 nt, Mycobacterium avium subsp. paratuberculosis
cccaggauuccgucggcg

SEQ ID NO: 2988996 - RNA, 20 nt, Mycobacterium avium subsp. paratuberculosis
cccaggauuccgucggcggc

SEQ ID NO: 2988997 - RNA, 23 nt, Mycobacterium avium subsp. paratuberculosis
cccaggauuccgucggcggccga

SEQ ID NO: 2988998 - RNA, 18 nt, Mycobacterium avium subsp. paratuberculosis
cccaggauucucagcagc

SEQ ID NO: 2988999 - RNA, 18 nt, Mycobacterium avium subsp. paratuberculosis
cccaggcacagcgaaagc

SEQ ID NO: 2989000 - RNA, 21 nt, Mycobacterium avium subsp. paratuberculosis
cccaggcagacccccagcagc

SEQ ID NO: 2989001 - RNA, 17 nt, Mycobacterium avium subsp. paratuberculosis
cccaggccaacagcagc

SEQ ID NO: 2989002 - RNA, 14 nt, Mycobacterium avium subsp. paratuberculosis
cccaggcccagcag

SEQ ID NO: 2989003 - RNA, 15 nt, Mycobacterium avium subsp. paratuberculosis
cccaggcccagcagc

SEQ ID NO: 2989004 - RNA, 13 nt, Mycobacterium avium subsp. paratuberculosis
cccaggccccggc

SEQ ID NO: 2989005 - RNA, 16 nt, Mycobacterium avium subsp. paratuberculosis
cccaggcccggcaccg

SEQ ID NO: 2989006 - RNA, 17 nt, Mycobacterium avium subsp. paratuberculosis
cccaggcccggcaccgg

SEQ ID NO: 2989007 - RNA, 12 nt, Mycobacterium avium subsp. paratuberculosis
cccaggccgacg

SEQ ID NO: 2989008 - RNA, 15 nt, Mycobacterium avium subsp. paratuberculosis
cccaggccgacgccg

SEQ ID NO: 2989009 - RNA, 14 nt, Mycobacterium avium subsp. paratuberculosis
cccaggccgagcgc

SEQ ID NO: 2989010 - RNA, 23 nt, Mycobacterium avium subsp. paratuberculosis
cccaggccgaguauccgcgcagc

SEQ ID NO: 2989011 - RNA, 12 nt, Mycobacterium avium subsp. paratuberculosis
cccaggccgccg

SEQ ID NO: 2989012 - RNA, 18 nt, Mycobacterium avium subsp. paratuberculosis
cccaggccgccgccaccg

SEQ ID NO: 2989013 - RNA, 13 nt, Mycobacterium avium subsp. paratuberculosis
cccaggccgcggc

SEQ ID NO: 2989014 - RNA, 13 nt, Mycobacterium avium subsp. paratuberculosis
cccaggccgcggu

SEQ ID NO: 2989015 - RNA, 19 nt, Mycobacterium avium subsp. paratuberculosis
cccaggcgggccagcucga

SEQ ID NO: 2989016 - RNA, 14 nt, Mycobacterium avium subsp. paratuberculosis
cccaggcgucgucg

SEQ ID NO: 2989017 - RNA, 19 nt, Mycobacterium avium subsp. paratuberculosis
cccaggcguggucggcgcg

SEQ ID NO: 2989018 - RNA, 23 nt, Mycobacterium avium subsp. paratuberculosis
cccaggcucaggaucagcagccg

SEQ ID NO: 2989019 - RNA, 15 nt, Mycobacterium avium subsp. paratuberculosis
cccagggcaacgaac

SEQ ID NO: 2989020 - RNA, 22 nt, Mycobacterium avium subsp. paratuberculosis
cccagggcaacgaacgcggcgc

SEQ ID NO: 2989021 - RNA, 14 nt, Mycobacterium avium subsp. paratuberculosis
cccagggccucggc

SEQ ID NO: 2989022 - RNA, 19 nt, Mycobacterium avium subsp. paratuberculosis
cccagggccucggcgaccg

SEQ ID NO: 2989023 - RNA, 16 nt, Mycobacterium avium subsp. paratuberculosis
cccagggcguuugcca

SEQ ID NO: 2989024 - RNA, 18 nt, Mycobacterium avium subsp. paratuberculosis
cccaggggagcggcggag

SEQ ID NO: 2989025 - RNA, 14 nt, Mycobacterium avium subsp. paratuberculosis
cccaggggucccag

SEQ ID NO: 2989026 - RNA, 15 nt, Mycobacterium avium subsp. paratuberculosis
cccagguacuccucg

SEQ ID NO: 2989027 - RNA, 17 nt, Mycobacterium avium subsp. paratuberculosis
cccagguacuccucggu

SEQ ID NO: 2989028 - RNA, 22 nt, Mycobacterium avium subsp. paratuberculosis
cccagguacuccucggugugcu

SEQ ID NO: 2989029 - RNA, 19 nt, Mycobacterium avium subsp. paratuberculosis
cccaggucaugguggcggc

SEQ ID NO: 2989030 - RNA, 20 nt, Mycobacterium avium subsp. paratuberculosis
cccaggucaugguggcggcg

SEQ ID NO: 2989031 - RNA, 21 nt, Mycobacterium avium subsp. paratuberculosis
cccaggucaugguggcggcgc

SEQ ID NO: 2989032 - RNA, 23 nt, Mycobacterium avium subsp. paratuberculosis
cccaggucaugguggcggcgccg

SEQ ID NO: 2989033 - RNA, 16 nt, Mycobacterium avium subsp. paratuberculosis
cccagguccaccaggu

SEQ ID NO: 2989034 - RNA, 19 nt, Mycobacterium avium subsp. paratuberculosis
cccagguccaccaggugac

SEQ ID NO: 2989035 - RNA, 14 nt, Mycobacterium avium subsp. paratuberculosis
cccaggucgcccag

SEQ ID NO: 2989036 - RNA, 14 nt, Mycobacterium avium subsp. paratuberculosis
cccaggucggcgug

SEQ ID NO: 2989037 - RNA, 15 nt, Mycobacterium avium subsp. paratuberculosis
cccaggucggcguga

SEQ ID NO: 2989038 - RNA, 21 nt, Mycobacterium avium subsp. paratuberculosis
cccaggucuucucguccgcgc

SEQ ID NO: 2989039 - RNA, 18 nt, Mycobacterium avium subsp. paratuberculosis
cccaggugacgccgcacg

SEQ ID NO: 2989040 - RNA, 22 nt, Mycobacterium avium subsp. paratuberculosis
cccaggugggcgcgcagcacca

SEQ ID NO: 2989041 - RNA, 18 nt, Mycobacterium avium subsp. paratuberculosis
cccagguuccggugucga

SEQ ID NO: 2989042 - RNA, 11 nt, Mycobacterium avium subsp. paratuberculosis
cccagguucuc

SEQ ID NO: 2989043 - RNA, 18 nt, Mycobacterium avium subsp. paratuberculosis
cccagguucuccggcccg

SEQ ID NO: 2989044 - RNA, 22 nt, Mycobacterium avium subsp. paratuberculosis
cccaguccagccguucgcgcac

SEQ ID NO: 2989045 - RNA, 18 nt, Mycobacterium avium subsp. paratuberculosis
cccaguccagucgcgccg

SEQ ID NO: 2989046 - RNA, 19 nt, Mycobacterium avium subsp. paratuberculosis
cccaguccagucgcgccga

SEQ ID NO: 2989047 - RNA, 14 nt, Mycobacterium avium subsp. paratuberculosis
cccagucccagcac

SEQ ID NO: 2989048 - RNA, 15 nt, Mycobacterium avium subsp. paratuberculosis
cccagucccagcaca

SEQ ID NO: 2989049 - RNA, 16 nt, Mycobacterium avium subsp. paratuberculosis
cccagucccagcacag

SEQ ID NO: 2989050 - RNA, 19 nt, Mycobacterium avium subsp. paratuberculosis
cccagucccagcacagccg

SEQ ID NO: 2989051 - RNA, 15 nt, Mycobacterium avium subsp. paratuberculosis
cccaguccccgguuc

SEQ ID NO: 2989052 - RNA, 23 nt, Mycobacterium avium subsp. paratuberculosis
cccaguccugcagcucgccggcg

SEQ ID NO: 2989053 - RNA, 12 nt, Mycobacterium avium subsp. paratuberculosis
cccagucgccgc

SEQ ID NO: 2989054 - RNA, 17 nt, Mycobacterium avium subsp. paratuberculosis
cccagucgccgccgcgc

SEQ ID NO: 2989055 - RNA, 21 nt, Mycobacterium avium subsp. paratuberculosis
cccagucguuggugcgcacca

SEQ ID NO: 2989056 - RNA, 17 nt, Mycobacterium avium subsp. paratuberculosis
cccagugccgcaggugg

SEQ ID NO: 2989057 - RNA, 14 nt, Mycobacterium avium subsp. paratuberculosis
cccagugcgcgccg

SEQ ID NO: 2989058 - RNA, 13 nt, Mycobacterium avium subsp. paratuberculosis
cccagugcucgac

SEQ ID NO: 2989059 - RNA, 17 nt, Mycobacterium avium subsp. paratuberculosis
cccaguggaucggcccg

SEQ ID NO: 2989060 - RNA, 18 nt, Mycobacterium avium subsp. paratuberculosis
cccaguggaucggcccga

SEQ ID NO: 2989061 - RNA, 16 nt, Mycobacterium avium subsp. paratuberculosis
cccaguucccggcggg

SEQ ID NO: 2989062 - RNA, 21 nt, Mycobacterium avium subsp. paratuberculosis
cccaguucccggcgggcaggu

SEQ ID NO: 2989063 - RNA, 23 nt, Mycobacterium avium subsp. paratuberculosis
cccaguucgaucagcagcucggu

SEQ ID NO: 2989064 - RNA, 15 nt, Mycobacterium avium subsp. paratuberculosis
cccaguugcacggug

SEQ ID NO: 2989065 - RNA, 19 nt, Mycobacterium avium subsp. paratuberculosis
cccaguugcacgguguaga

SEQ ID NO: 2989066 - RNA, 14 nt, Mycobacterium avium subsp. paratuberculosis
cccaguuggcgucg

SEQ ID NO: 2989067 - RNA, 22 nt, Mycobacterium avium subsp. paratuberculosis
cccaguuggcgucgucggcggc

SEQ ID NO: 2989068 - RNA, 23 nt, Mycobacterium avium subsp. paratuberculosis
cccaguuggcgucgucggcggcg

SEQ ID NO: 2989069 - RNA, 20 nt, Mycobacterium avium subsp. paratuberculosis
cccaguuguuuccccagccc

SEQ ID NO: 2989070 - RNA, 21 nt, Mycobacterium avium subsp. paratuberculosis
cccaguuguuuccccagcccg

SEQ ID NO: 2989071 - RNA, 22 nt, Mycobacterium avium subsp. paratuberculosis
cccaguuguuuccccagcccgg

SEQ ID NO: 2989072 - RNA, 15 nt, Mycobacterium avium subsp. paratuberculosis
cccaucaccagcggc

SEQ ID NO: 2989073 - RNA, 15 nt, Mycobacterium avium subsp. paratuberculosis
cccaucaccccgaag

SEQ ID NO: 2989074 - RNA, 13 nt, Mycobacterium avium subsp. paratuberculosis
cccaucaccgcac

SEQ ID NO: 2989075 - RNA, 15 nt, Mycobacterium avium subsp. paratuberculosis
cccaucaccggaccg

SEQ ID NO: 2989076 - RNA, 18 nt, Mycobacterium avium subsp. paratuberculosis
cccaucaccggaccggcc

SEQ ID NO: 2989077 - RNA, 20 nt, Mycobacterium avium subsp. paratuberculosis
cccaucaccggaccggccag

SEQ ID NO: 2989078 - RNA, 12 nt, Mycobacterium avium subsp. paratuberculosis
cccaucagcacg

SEQ ID NO: 2989079 - RNA, 19 nt, Mycobacterium avium subsp. paratuberculosis
cccaucagcaggaccaggc

SEQ ID NO: 2989080 - RNA, 21 nt, Mycobacterium avium subsp. paratuberculosis
cccaucaggaugcccgggccg

SEQ ID NO: 2989081 - RNA, 14 nt, Mycobacterium avium subsp. paratuberculosis
cccaucagugcggc

SEQ ID NO: 2989082 - RNA, 20 nt, Mycobacterium avium subsp. paratuberculosis
cccaucagugcggcccgccg

SEQ ID NO: 2989083 - RNA, 16 nt, Mycobacterium avium subsp. paratuberculosis
cccauccaggccagca

SEQ ID NO: 2989084 - RNA, 13 nt, Mycobacterium avium subsp. paratuberculosis
cccauccccagga

SEQ ID NO: 2989085 - RNA, 15 nt, Mycobacterium avium subsp. paratuberculosis
cccauccgcggccac

SEQ ID NO: 2989086 - RNA, 14 nt, Mycobacterium avium subsp. paratuberculosis
cccauccggcgccg

SEQ ID NO: 2989087 - RNA, 20 nt, Mycobacterium avium subsp. paratuberculosis
cccaucgaccggaugaugcc

SEQ ID NO: 2989088 - RNA, 13 nt, Mycobacterium avium subsp. paratuberculosis
cccaucgccacgc

SEQ ID NO: 2989089 - RNA, 13 nt, Mycobacterium avium subsp. paratuberculosis
cccaucgcggccg

SEQ ID NO: 2989090 - RNA, 18 nt, Mycobacterium avium subsp. paratuberculosis
cccaucgcggccgcccgg

SEQ ID NO: 2989091 - RNA, 20 nt, Mycobacterium avium subsp. paratuberculosis
cccaucgcggccgcccgguc

SEQ ID NO: 2989092 - RNA, 14 nt, Mycobacterium avium subsp. paratuberculosis
cccaucgcggucag

SEQ ID NO: 2989093 - RNA, 20 nt, Mycobacterium avium subsp. paratuberculosis
cccaucggcagcccggaggc

SEQ ID NO: 2989094 - RNA, 20 nt, Mycobacterium avium subsp. paratuberculosis
cccaucugcacagcuucggc

SEQ ID NO: 2989095 - RNA, 18 nt, Mycobacterium avium subsp. paratuberculosis
cccaucuugaccaggguu

SEQ ID NO: 2989096 - RNA, 18 nt, Mycobacterium avium subsp. paratuberculosis
cccaugaacgcgucgccg

SEQ ID NO: 2989097 - RNA, 19 nt, Mycobacterium avium subsp. paratuberculosis
cccaugaacgcgucgccgu

SEQ ID NO: 2989098 - RNA, 23 nt, Mycobacterium avium subsp. paratuberculosis
cccaugaucgccaguccggcgcc

SEQ ID NO: 2989099 - RNA, 16 nt, Mycobacterium avium subsp. paratuberculosis
cccaugccccagguga

SEQ ID NO: 2989100 - RNA, 12 nt, Mycobacterium avium subsp. paratuberculosis
cccaugccgaug

SEQ ID NO: 2989101 - RNA, 15 nt, Mycobacterium avium subsp. paratuberculosis
cccauggcgaacagg

SEQ ID NO: 2989102 - RNA, 19 nt, Mycobacterium avium subsp. paratuberculosis
cccauggcgaacaggaugc

SEQ ID NO: 2989103 - RNA, 13 nt, Mycobacterium avium subsp. paratuberculosis
cccaugucgaucg

SEQ ID NO: 2989104 - RNA, 16 nt, Mycobacterium avium subsp. paratuberculosis
cccaugucgaucggcu

SEQ ID NO: 2989105 - RNA, 22 nt, Mycobacterium avium subsp. paratuberculosis
cccaugucgaucggcucggcgc

SEQ ID NO: 2989106 - RNA, 17 nt, Mycobacterium avium subsp. paratuberculosis
cccauucacgcagcugg

SEQ ID NO: 2989107 - RNA, 16 nt, Mycobacterium avium subsp. paratuberculosis
cccauucgucggcggu

SEQ ID NO: 2989108 - RNA, 12 nt, Mycobacterium avium subsp. paratuberculosis
cccauugccgcg

SEQ ID NO: 2989109 - RNA, 15 nt, Mycobacterium avium subsp. paratuberculosis
cccauugccgcgccg

SEQ ID NO: 2989110 - RNA, 14 nt, Mycobacterium avium subsp. paratuberculosis
ccccaaaacccggc

SEQ ID NO: 2989111 - RNA, 15 nt, Mycobacterium avium subsp. paratuberculosis
ccccaaaacgggcga

SEQ ID NO: 2989112 - RNA, 13 nt, Mycobacterium avium subsp. paratuberculosis
ccccaaccuggac

SEQ ID NO: 2989113 - RNA, 17 nt, Mycobacterium avium subsp. paratuberculosis
ccccaauucuucggcgu

SEQ ID NO: 2989114 - RNA, 21 nt, Mycobacterium avium subsp. paratuberculosis
ccccaauugccgggccagaua

SEQ ID NO: 2989115 - RNA, 16 nt, Mycobacterium avium subsp. paratuberculosis
ccccacaccguccgac

SEQ ID NO: 2989116 - RNA, 19 nt, Mycobacterium avium subsp. paratuberculosis
ccccaccacauucccgccg

SEQ ID NO: 2989117 - RNA, 21 nt, Mycobacterium avium subsp. paratuberculosis
ccccaccaccgacagcacccg

SEQ ID NO: 2989118 - RNA, 19 nt, Mycobacterium avium subsp. paratuberculosis
ccccaccacgaagcuggcg

SEQ ID NO: 2989119 - RNA, 12 nt, Mycobacterium avium subsp. paratuberculosis
ccccaccaggcg

SEQ ID NO: 2989120 - RNA, 14 nt, Mycobacterium avium subsp. paratuberculosis
ccccaccaggcgcg

SEQ ID NO: 2989121 - RNA, 14 nt, Mycobacterium avium subsp. paratuberculosis
ccccacccaggugu

SEQ ID NO: 2989122 - RNA, 11 nt, Mycobacterium avium subsp. paratuberculosis
ccccaccccgg

SEQ ID NO: 2989123 - RNA, 12 nt, Mycobacterium avium subsp. paratuberculosis
ccccaccccgga

SEQ ID NO: 2989124 - RNA, 16 nt, Mycobacterium avium subsp. paratuberculosis
ccccaccccggacggc

SEQ ID NO: 2989125 - RNA, 17 nt, Mycobacterium avium subsp. paratuberculosis
ccccaccccggacggcc

SEQ ID NO: 2989126 - RNA, 17 nt, Mycobacterium avium subsp. paratuberculosis
ccccaccgagcagcugc

SEQ ID NO: 2989127 - RNA, 22 nt, Mycobacterium avium subsp. paratuberculosis
ccccaccgaucaggaucggcgg

SEQ ID NO: 2989128 - RNA, 17 nt, Mycobacterium avium subsp. paratuberculosis
ccccaccgcgacacguc

SEQ ID NO: 2989129 - RNA, 11 nt, Mycobacterium avium subsp. paratuberculosis
ccccacgccau

SEQ ID NO: 2989130 - RNA, 17 nt, Mycobacterium avium subsp. paratuberculosis
ccccacgccaugugccg

SEQ ID NO: 2989131 - RNA, 21 nt, Mycobacterium avium subsp. paratuberculosis
ccccacgccuggcggaaggcc

SEQ ID NO: 2989132 - RNA, 20 nt, Mycobacterium avium subsp. paratuberculosis
ccccacgcgcucagcgcggc

SEQ ID NO: 2989133 - RNA, 13 nt, Mycobacterium avium subsp. paratuberculosis
ccccacggccgca

SEQ ID NO: 2989134 - RNA, 21 nt, Mycobacterium avium subsp. paratuberculosis
ccccacggccgcaacggcggu

SEQ ID NO: 2989135 - RNA, 13 nt, Mycobacterium avium subsp. paratuberculosis
ccccacggcgcgu

SEQ ID NO: 2989136 - RNA, 22 nt, Mycobacterium avium subsp. paratuberculosis
ccccacgggccauguccccgac

SEQ ID NO: 2989137 - RNA, 19 nt, Mycobacterium avium subsp. paratuberculosis
ccccagacgauuugggcgg

SEQ ID NO: 2989138 - RNA, 22 nt, Mycobacterium avium subsp. paratuberculosis
ccccagcacgaucccgccgccc

SEQ ID NO: 2989139 - RNA, 16 nt, Mycobacterium avium subsp. paratuberculosis
ccccagcagcggggug

SEQ ID NO: 2989140 - RNA, 20 nt, Mycobacterium avium subsp. paratuberculosis
ccccagccaccguggcccca

SEQ ID NO: 2989141 - RNA, 17 nt, Mycobacterium avium subsp. paratuberculosis
ccccagccccucgccgg

SEQ ID NO: 2989142 - RNA, 12 nt, Mycobacterium avium subsp. paratuberculosis
ccccagcccgcc

SEQ ID NO: 2989143 - RNA, 15 nt, Mycobacterium avium subsp. paratuberculosis
ccccagcccgccggg

SEQ ID NO: 2989144 - RNA, 11 nt, Mycobacterium avium subsp. paratuberculosis
ccccagcccgg

SEQ ID NO: 2989145 - RNA, 12 nt, Mycobacterium avium subsp. paratuberculosis
ccccagcccggg

SEQ ID NO: 2989146 - RNA, 21 nt, Mycobacterium avium subsp. paratuberculosis
ccccagcccggggguggcggu

SEQ ID NO: 2989147 - RNA, 13 nt, Mycobacterium avium subsp. paratuberculosis
ccccagccgacca

SEQ ID NO: 2989148 - RNA, 16 nt, Mycobacterium avium subsp. paratuberculosis
ccccagccgccgcgac

SEQ ID NO: 2989149 - RNA, 17 nt, Mycobacterium avium subsp. paratuberculosis
ccccagccgccgcgaca

SEQ ID NO: 2989150 - RNA, 11 nt, Mycobacterium avium subsp. paratuberculosis
ccccagccggc

SEQ ID NO: 2989151 - RNA, 14 nt, Mycobacterium avium subsp. paratuberculosis
ccccagccggccga

SEQ ID NO: 2989152 - RNA, 16 nt, Mycobacterium avium subsp. paratuberculosis
ccccagccggccgagc

SEQ ID NO: 2989153 - RNA, 22 nt, Mycobacterium avium subsp. paratuberculosis
ccccagcgagcaggucaccgga

SEQ ID NO: 2989154 - RNA, 13 nt, Mycobacterium avium subsp. paratuberculosis
ccccagcggcacg

SEQ ID NO: 2989155 - RNA, 23 nt, Mycobacterium avium subsp. paratuberculosis
ccccagcggggcaagcagcggca

SEQ ID NO: 2989156 - RNA, 13 nt, Mycobacterium avium subsp. paratuberculosis
ccccagcgugacg

SEQ ID NO: 2989157 - RNA, 14 nt, Mycobacterium avium subsp. paratuberculosis
ccccagcgugacgu

SEQ ID NO: 2989158 - RNA, 17 nt, Mycobacterium avium subsp. paratuberculosis
ccccagcgugacgucga

SEQ ID NO: 2989159 - RNA, 13 nt, Mycobacterium avium subsp. paratuberculosis
ccccagcuccucg

SEQ ID NO: 2989160 - RNA, 11 nt, Mycobacterium avium subsp. paratuberculosis
ccccagcucga

SEQ ID NO: 2989161 - RNA, 21 nt, Mycobacterium avium subsp. paratuberculosis
ccccagcucgacgacuucggc

SEQ ID NO: 2989162 - RNA, 14 nt, Mycobacterium avium subsp. paratuberculosis
ccccagcugggccg

SEQ ID NO: 2989163 - RNA, 18 nt, Mycobacterium avium subsp. paratuberculosis
ccccagcugggccgccag

SEQ ID NO: 2989164 - RNA, 19 nt, Mycobacterium avium subsp. paratuberculosis
ccccagcugggccgccagc

SEQ ID NO: 2989165 - RNA, 21 nt, Mycobacterium avium subsp. paratuberculosis
ccccagcugggccgccagccg

SEQ ID NO: 2989166 - RNA, 17 nt, Mycobacterium avium subsp. paratuberculosis
ccccagcugucgggugg

SEQ ID NO: 2989167 - RNA, 22 nt, Mycobacterium avium subsp. paratuberculosis
ccccagcugucggguggcagga

SEQ ID NO: 2989168 - RNA, 17 nt, Mycobacterium avium subsp. paratuberculosis
ccccaggauggccgcuu

SEQ ID NO: 2989169 - RNA, 22 nt, Mycobacterium avium subsp. paratuberculosis
ccccaggcccgguugagugcgc

SEQ ID NO: 2989170 - RNA, 19 nt, Mycobacterium avium subsp. paratuberculosis
ccccaggcgaugccgccga

SEQ ID NO: 2989171 - RNA, 21 nt, Mycobacterium avium subsp. paratuberculosis
ccccaggcgaugccgccgacg

SEQ ID NO: 2989172 - RNA, 18 nt, Mycobacterium avium subsp. paratuberculosis
ccccagggccucggcgac

SEQ ID NO: 2989173 - RNA, 15 nt, Mycobacterium avium subsp. paratuberculosis
ccccagggugcgccg

SEQ ID NO: 2989174 - RNA, 13 nt, Mycobacterium avium subsp. paratuberculosis
ccccaggucgggg

SEQ ID NO: 2989175 - RNA, 16 nt, Mycobacterium avium subsp. paratuberculosis
ccccaggucggggugg

SEQ ID NO: 2989176 - RNA, 15 nt, Mycobacterium avium subsp. paratuberculosis
ccccaggugacgccg

SEQ ID NO: 2989177 - RNA, 13 nt, Mycobacterium avium subsp. paratuberculosis
ccccagugcaggc

SEQ ID NO: 2989178 - RNA, 22 nt, Mycobacterium avium subsp. paratuberculosis
ccccagugcaggcugacgcgac

SEQ ID NO: 2989179 - RNA, 22 nt, Mycobacterium avium subsp. paratuberculosis
ccccaguuggcgucgucggcgg

SEQ ID NO: 2989180 - RNA, 22 nt, Mycobacterium avium subsp. paratuberculosis
ccccaguuucccgucggggugg

SEQ ID NO: 2989181 - RNA, 14 nt, Mycobacterium avium subsp. paratuberculosis
ccccauccgcggcc

SEQ ID NO: 2989182 - RNA, 15 nt, Mycobacterium avium subsp. paratuberculosis
ccccauccgcggcca

SEQ ID NO: 2989183 - RNA, 17 nt, Mycobacterium avium subsp. paratuberculosis
ccccauccgcggccacc

SEQ ID NO: 2989184 - RNA, 20 nt, Mycobacterium avium subsp. paratuberculosis
ccccauccgcggccaccggg

SEQ ID NO: 2989185 - RNA, 19 nt, Mycobacterium avium subsp. paratuberculosis
ccccaucggccaggaacca

SEQ ID NO: 2989186 - RNA, 18 nt, Mycobacterium avium subsp. paratuberculosis
ccccaucuugaccagggu

SEQ ID NO: 2989187 - RNA, 16 nt, Mycobacterium avium subsp. paratuberculosis
ccccauugccgcgccg

SEQ ID NO: 2989188 - RNA, 18 nt, Mycobacterium avium subsp. paratuberculosis
ccccauugccgcgccggg

SEQ ID NO: 2989189 - RNA, 20 nt, Mycobacterium avium subsp. paratuberculosis
cccccaaugucacggcgggu

SEQ ID NO: 2989190 - RNA, 22 nt, Mycobacterium avium subsp. paratuberculosis
cccccacgcagcggugcagccc

SEQ ID NO: 2989191 - RNA, 13 nt, Mycobacterium avium subsp. paratuberculosis
cccccagcagcgg

SEQ ID NO: 2989192 - RNA, 15 nt, Mycobacterium avium subsp. paratuberculosis
cccccagcccgccgg

SEQ ID NO: 2989193 - RNA, 17 nt, Mycobacterium avium subsp. paratuberculosis
cccccgacaccgccagc

SEQ ID NO: 2989194 - RNA, 14 nt, Mycobacterium avium subsp. paratuberculosis
cccccgacccgaag

SEQ ID NO: 2989195 - RNA, 15 nt, Mycobacterium avium subsp. paratuberculosis
cccccgagcgggccu

SEQ ID NO: 2989196 - RNA, 20 nt, Mycobacterium avium subsp. paratuberculosis
cccccgaggagacgucggcc

SEQ ID NO: 2989197 - RNA, 15 nt, Mycobacterium avium subsp. paratuberculosis
cccccgauagccccg

SEQ ID NO: 2989198 - RNA, 15 nt, Mycobacterium avium subsp. paratuberculosis
cccccgcacgccagc

SEQ ID NO: 2989199 - RNA, 22 nt, Mycobacterium avium subsp. paratuberculosis
cccccgccgcgucggucagcgc

SEQ ID NO: 2989200 - RNA, 12 nt, Mycobacterium avium subsp. paratuberculosis
cccccgcgccgc

SEQ ID NO: 2989201 - RNA, 15 nt, Mycobacterium avium subsp. paratuberculosis
cccccgcgccgcccg

SEQ ID NO: 2989202 - RNA, 14 nt, Mycobacterium avium subsp. paratuberculosis
cccccgcggcggcc

SEQ ID NO: 2989203 - RNA, 13 nt, Mycobacterium avium subsp. paratuberculosis
cccccgcggcguc

SEQ ID NO: 2989204 - RNA, 14 nt, Mycobacterium avium subsp. paratuberculosis
cccccgcggcgucc

SEQ ID NO: 2989205 - RNA, 21 nt, Mycobacterium avium subsp. paratuberculosis
cccccgcgggucgucgacguc

SEQ ID NO: 2989206 - RNA, 13 nt, Mycobacterium avium subsp. paratuberculosis
cccccgcggugag

SEQ ID NO: 2989207 - RNA, 21 nt, Mycobacterium avium subsp. paratuberculosis
cccccgcggugaguucaucga

SEQ ID NO: 2989208 - RNA, 20 nt, Mycobacterium avium subsp. paratuberculosis
cccccggaccacguccccgg

SEQ ID NO: 2989209 - RNA, 14 nt, Mycobacterium avium subsp. paratuberculosis
cccccggcgcgacg

SEQ ID NO: 2989210 - RNA, 15 nt, Mycobacterium avium subsp. paratuberculosis
cccccggcgugagcg

SEQ ID NO: 2989211 - RNA, 13 nt, Mycobacterium avium subsp. paratuberculosis
cccccgggcacca

SEQ ID NO: 2989212 - RNA, 14 nt, Mycobacterium avium subsp. paratuberculosis
cccccgggcccgaa

SEQ ID NO: 2989213 - RNA, 17 nt, Mycobacterium avium subsp. paratuberculosis
cccccggggccuccagc

SEQ ID NO: 2989214 - RNA, 20 nt, Mycobacterium avium subsp. paratuberculosis
cccccggugucugaccucgc

SEQ ID NO: 2989215 - RNA, 16 nt, Mycobacterium avium subsp. paratuberculosis
cccccgucgggccguc

SEQ ID NO: 2989216 - RNA, 19 nt, Mycobacterium avium subsp. paratuberculosis
cccccgucgggccguccgc

SEQ ID NO: 2989217 - RNA, 18 nt, Mycobacterium avium subsp. paratuberculosis
cccccguuuccucgcgca

SEQ ID NO: 2989218 - RNA, 12 nt, Mycobacterium avium subsp. paratuberculosis
cccccucgucga

SEQ ID NO: 2989219 - RNA, 19 nt, Mycobacterium avium subsp. paratuberculosis
cccccuugagccgguccga

SEQ ID NO: 2989220 - RNA, 21 nt, Mycobacterium avium subsp. paratuberculosis
ccccgaaaccauugcaccgca

SEQ ID NO: 2989221 - RNA, 15 nt, Mycobacterium avium subsp. paratuberculosis
ccccgaacagcgcca

SEQ ID NO: 2989222 - RNA, 20 nt, Mycobacterium avium subsp. paratuberculosis
ccccgaacagcgccagggug

SEQ ID NO: 2989223 - RNA, 15 nt, Mycobacterium avium subsp. paratuberculosis
ccccgaaccgcccgc

SEQ ID NO: 2989224 - RNA, 20 nt, Mycobacterium avium subsp. paratuberculosis
ccccgaaccgcccgcccggc

SEQ ID NO: 2989225 - RNA, 20 nt, Mycobacterium avium subsp. paratuberculosis
ccccgaagcucaucaccggc

SEQ ID NO: 2989226 - RNA, 23 nt, Mycobacterium avium subsp. paratuberculosis
ccccgaagcucaucaccggcgcg

SEQ ID NO: 2989227 - RNA, 14 nt, Mycobacterium avium subsp. paratuberculosis
ccccgacaccgcca

SEQ ID NO: 2989228 - RNA, 15 nt, Mycobacterium avium subsp. paratuberculosis
ccccgacaccgccag

SEQ ID NO: 2989229 - RNA, 22 nt, Mycobacterium avium subsp. paratuberculosis
ccccgacaccgccagcagcgcc

SEQ ID NO: 2989230 - RNA, 21 nt, Mycobacterium avium subsp. paratuberculosis
ccccgacaccgugguggcggc

SEQ ID NO: 2989231 - RNA, 15 nt, Mycobacterium avium subsp. paratuberculosis
ccccgacaggcccac

SEQ ID NO: 2989232 - RNA, 17 nt, Mycobacterium avium subsp. paratuberculosis
ccccgacaucgccauca

SEQ ID NO: 2989233 - RNA, 18 nt, Mycobacterium avium subsp. paratuberculosis
ccccgaccacaccggcgc

SEQ ID NO: 2989234 - RNA, 12 nt, Mycobacterium avium subsp. paratuberculosis
ccccgacccgaa

SEQ ID NO: 2989235 - RNA, 13 nt, Mycobacterium avium subsp. paratuberculosis
ccccgaccgacgc

SEQ ID NO: 2989236 - RNA, 15 nt, Mycobacterium avium subsp. paratuberculosis
ccccgaccgacgcgg

SEQ ID NO: 2989237 - RNA, 19 nt, Mycobacterium avium subsp. paratuberculosis
ccccgacgaucgcgccggc

SEQ ID NO: 2989238 - RNA, 14 nt, Mycobacterium avium subsp. paratuberculosis
ccccgacggcgccg

SEQ ID NO: 2989239 - RNA, 16 nt, Mycobacterium avium subsp. paratuberculosis
ccccgacgugcagcgc

SEQ ID NO: 2989240 - RNA, 14 nt, Mycobacterium avium subsp. paratuberculosis
ccccgagaucgcgg

SEQ ID NO: 2989241 - RNA, 17 nt, Mycobacterium avium subsp. paratuberculosis
ccccgagaucgcgggcu

SEQ ID NO: 2989242 - RNA, 15 nt, Mycobacterium avium subsp. paratuberculosis
ccccgagcacgucga

SEQ ID NO: 2989243 - RNA, 22 nt, Mycobacterium avium subsp. paratuberculosis
ccccgagcaggcggaucggccc

SEQ ID NO: 2989244 - RNA, 13 nt, Mycobacterium avium subsp. paratuberculosis
ccccgagcgucac

SEQ ID NO: 2989245 - RNA, 14 nt, Mycobacterium avium subsp. paratuberculosis
ccccgagcucgggc

SEQ ID NO: 2989246 - RNA, 21 nt, Mycobacterium avium subsp. paratuberculosis
ccccgaggagacgucggccgg

SEQ ID NO: 2989247 - RNA, 20 nt, Mycobacterium avium subsp. paratuberculosis
ccccgaguuccagcuccguc

SEQ ID NO: 2989248 - RNA, 13 nt, Mycobacterium avium subsp. paratuberculosis
ccccgaguucggc

SEQ ID NO: 2989249 - RNA, 18 nt, Mycobacterium avium subsp. paratuberculosis
ccccgaguucggccagau

SEQ ID NO: 2989250 - RNA, 16 nt, Mycobacterium avium subsp. paratuberculosis
ccccgauagccccgcc

SEQ ID NO: 2989251 - RNA, 18 nt, Mycobacterium avium subsp. paratuberculosis
ccccgauagccccgccag

SEQ ID NO: 2989252 - RNA, 15 nt, Mycobacterium avium subsp. paratuberculosis
ccccgaucaacaccg

SEQ ID NO: 2989253 - RNA, 20 nt, Mycobacterium avium subsp. paratuberculosis
ccccgaucaacaccgccagc

SEQ ID NO: 2989254 - RNA, 13 nt, Mycobacterium avium subsp. paratuberculosis
ccccgauccgccg

SEQ ID NO: 2989255 - RNA, 21 nt, Mycobacterium avium subsp. paratuberculosis
ccccgaucggauccgccugcc

SEQ ID NO: 2989256 - RNA, 14 nt, Mycobacterium avium subsp. paratuberculosis
ccccgaucggggcc

SEQ ID NO: 2989257 - RNA, 23 nt, Mycobacterium avium subsp. paratuberculosis
ccccgaugccgaacuccgccgaa

SEQ ID NO: 2989258 - RNA, 18 nt, Mycobacterium avium subsp. paratuberculosis
ccccgaugcgcucgccga

SEQ ID NO: 2989259 - RNA, 21 nt, Mycobacterium avium subsp. paratuberculosis
ccccgaugcggugccgggcca

SEQ ID NO: 2989260 - RNA, 17 nt, Mycobacterium avium subsp. paratuberculosis
ccccgauuucgcggccg

SEQ ID NO: 2989261 - RNA, 16 nt, Mycobacterium avium subsp. paratuberculosis
ccccgcacaccggcca

SEQ ID NO: 2989262 - RNA, 12 nt, Mycobacterium avium subsp. paratuberculosis
ccccgcagaaca

SEQ ID NO: 2989263 - RNA, 19 nt, Mycobacterium avium subsp. paratuberculosis
ccccgcagaacaccagcgc

SEQ ID NO: 2989264 - RNA, 11 nt, Mycobacterium avium subsp. paratuberculosis
ccccgcagcuc

SEQ ID NO: 2989265 - RNA, 13 nt, Mycobacterium avium subsp. paratuberculosis
ccccgcagcuccc

SEQ ID NO: 2989266 - RNA, 20 nt, Mycobacterium avium subsp. paratuberculosis
ccccgcagcuucugcagcuc

SEQ ID NO: 2989267 - RNA, 21 nt, Mycobacterium avium subsp. paratuberculosis
ccccgcagcuucugcagcucg

SEQ ID NO: 2989268 - RNA, 19 nt, Mycobacterium avium subsp. paratuberculosis
ccccgccaaucaccgcggu

SEQ ID NO: 2989269 - RNA, 23 nt, Mycobacterium avium subsp. paratuberculosis
ccccgccaaucaccgcgguguug

SEQ ID NO: 2989270 - RNA, 13 nt, Mycobacterium avium subsp. paratuberculosis
ccccgccagcacc

SEQ ID NO: 2989271 - RNA, 19 nt, Mycobacterium avium subsp. paratuberculosis
ccccgccaggcggcgacga

SEQ ID NO: 2989272 - RNA, 21 nt, Mycobacterium avium subsp. paratuberculosis
ccccgccaggcggcgacgaac

SEQ ID NO: 2989273 - RNA, 15 nt, Mycobacterium avium subsp. paratuberculosis
ccccgcccacgaaga

SEQ ID NO: 2989274 - RNA, 13 nt, Mycobacterium avium subsp. paratuberculosis
ccccgcccggauc

SEQ ID NO: 2989275 - RNA, 16 nt, Mycobacterium avium subsp. paratuberculosis
ccccgcccggcaacac

SEQ ID NO: 2989276 - RNA, 13 nt, Mycobacterium avium subsp. paratuberculosis
ccccgcccggccg

SEQ ID NO: 2989277 - RNA, 13 nt, Mycobacterium avium subsp. paratuberculosis
ccccgcccggcgc

SEQ ID NO: 2989278 - RNA, 14 nt, Mycobacterium avium subsp. paratuberculosis
ccccgcccggggcg

SEQ ID NO: 2989279 - RNA, 12 nt, Mycobacterium avium subsp. paratuberculosis
ccccgccgaccg

SEQ ID NO: 2989280 - RNA, 14 nt, Mycobacterium avium subsp. paratuberculosis
ccccgccgcgccgg

SEQ ID NO: 2989281 - RNA, 20 nt, Mycobacterium avium subsp. paratuberculosis
ccccgccgcgccgggcgccc

SEQ ID NO: 2989282 - RNA, 14 nt, Mycobacterium avium subsp. paratuberculosis
ccccgccgcggcca

SEQ ID NO: 2989283 - RNA, 23 nt, Mycobacterium avium subsp. paratuberculosis
ccccgccgcgucggucagcgcca

SEQ ID NO: 2989284 - RNA, 13 nt, Mycobacterium avium subsp. paratuberculosis
ccccgccggcccg

SEQ ID NO: 2989285 - RNA, 14 nt, Mycobacterium avium subsp. paratuberculosis
ccccgccggcccgg

SEQ ID NO: 2989286 - RNA, 19 nt, Mycobacterium avium subsp. paratuberculosis
ccccgccggcccggucgac

SEQ ID NO: 2989287 - RNA, 19 nt, Mycobacterium avium subsp. paratuberculosis
ccccgccgggaucggcggg

SEQ ID NO: 2989288 - RNA, 22 nt, Mycobacterium avium subsp. paratuberculosis
ccccgccgggguccgcaacgcc

SEQ ID NO: 2989289 - RNA, 15 nt, Mycobacterium avium subsp. paratuberculosis
ccccgccgguggcgg

SEQ ID NO: 2989290 - RNA, 16 nt, Mycobacterium avium subsp. paratuberculosis
ccccgccgguggcggc

SEQ ID NO: 2989291 - RNA, 12 nt, Mycobacterium avium subsp. paratuberculosis
ccccgccggugu

SEQ ID NO: 2989292 - RNA, 14 nt, Mycobacterium avium subsp. paratuberculosis
ccccgccggugucg

SEQ ID NO: 2989293 - RNA, 16 nt, Mycobacterium avium subsp. paratuberculosis
ccccgccggugucggc

SEQ ID NO: 2989294 - RNA, 18 nt, Mycobacterium avium subsp. paratuberculosis
ccccgccggugucggcga

SEQ ID NO: 2989295 - RNA, 12 nt, Mycobacterium avium subsp. paratuberculosis
ccccgccgucga

SEQ ID NO: 2989296 - RNA, 17 nt, Mycobacterium avium subsp. paratuberculosis
ccccgcgacacgccgcg

SEQ ID NO: 2989297 - RNA, 13 nt, Mycobacterium avium subsp. paratuberculosis
ccccgcgccgccc

SEQ ID NO: 2989298 - RNA, 16 nt, Mycobacterium avium subsp. paratuberculosis
ccccgcgccgcccgga

SEQ ID NO: 2989299 - RNA, 13 nt, Mycobacterium avium subsp. paratuberculosis
ccccgcgccgggc

SEQ ID NO: 2989300 - RNA, 22 nt, Mycobacterium avium subsp. paratuberculosis
ccccgcgccgggcguugcccgc

SEQ ID NO: 2989301 - RNA, 22 nt, Mycobacterium avium subsp. paratuberculosis
ccccgcgcgaucaggccggcca

SEQ ID NO: 2989302 - RNA, 15 nt, Mycobacterium avium subsp. paratuberculosis
ccccgcgcgcgggcc

SEQ ID NO: 2989303 - RNA, 18 nt, Mycobacterium avium subsp. paratuberculosis
ccccgcgcgcgggccagc

SEQ ID NO: 2989304 - RNA, 19 nt, Mycobacterium avium subsp. paratuberculosis
ccccgcgcgcgggccagcg

SEQ ID NO: 2989305 - RNA, 13 nt, Mycobacterium avium subsp. paratuberculosis
ccccgcgcggcuc

SEQ ID NO: 2989306 - RNA, 15 nt, Mycobacterium avium subsp. paratuberculosis
ccccgcgcggcucgc

SEQ ID NO: 2989307 - RNA, 21 nt, Mycobacterium avium subsp. paratuberculosis
ccccgcgcggcucgcgggcga

SEQ ID NO: 2989308 - RNA, 19 nt, Mycobacterium avium subsp. paratuberculosis
ccccgcgcugcccagcgcg

SEQ ID NO: 2989309 - RNA, 21 nt, Mycobacterium avium subsp. paratuberculosis
ccccgcgcugggcuggccguc

SEQ ID NO: 2989310 - RNA, 11 nt, Mycobacterium avium subsp. paratuberculosis
ccccgcggcca

SEQ ID NO: 2989311 - RNA, 13 nt, Mycobacterium avium subsp. paratuberculosis
ccccgcggccacc

SEQ ID NO: 2989312 - RNA, 20 nt, Mycobacterium avium subsp. paratuberculosis
ccccgcgggucgucgacguc

SEQ ID NO: 2989313 - RNA, 19 nt, Mycobacterium avium subsp. paratuberculosis
ccccgcggucggcggcgua

SEQ ID NO: 2989314 - RNA, 13 nt, Mycobacterium avium subsp. paratuberculosis
ccccgcggugccg

SEQ ID NO: 2989315 - RNA, 15 nt, Mycobacterium avium subsp. paratuberculosis
ccccgcggugccgca

SEQ ID NO: 2989316 - RNA, 17 nt, Mycobacterium avium subsp. paratuberculosis
ccccgcggugccgcagc

SEQ ID NO: 2989317 - RNA, 17 nt, Mycobacterium avium subsp. paratuberculosis
ccccgcgugacggccgc

SEQ ID NO: 2989318 - RNA, 18 nt, Mycobacterium avium subsp. paratuberculosis
ccccgcgugacggccgcg

SEQ ID NO: 2989319 - RNA, 19 nt, Mycobacterium avium subsp. paratuberculosis
ccccgcuagccucaacgac

SEQ ID NO: 2989320 - RNA, 15 nt, Mycobacterium avium subsp. paratuberculosis
ccccgcucccauccg

SEQ ID NO: 2989321 - RNA, 15 nt, Mycobacterium avium subsp. paratuberculosis
ccccgcuccuccucg

SEQ ID NO: 2989322 - RNA, 15 nt, Mycobacterium avium subsp. paratuberculosis
ccccgcucggccagc

SEQ ID NO: 2989323 - RNA, 22 nt, Mycobacterium avium subsp. paratuberculosis
ccccgcucggccagcgcgccgc

SEQ ID NO: 2989324 - RNA, 19 nt, Mycobacterium avium subsp. paratuberculosis
ccccgcugccguccggcgg

SEQ ID NO: 2989325 - RNA, 21 nt, Mycobacterium avium subsp. paratuberculosis
ccccgcugcucuuguccgcgu

SEQ ID NO: 2989326 - RNA, 19 nt, Mycobacterium avium subsp. paratuberculosis
ccccgcuggaucccgguga

SEQ ID NO: 2989327 - RNA, 14 nt, Mycobacterium avium subsp. paratuberculosis
ccccgcuggcgccg

SEQ ID NO: 2989328 - RNA, 15 nt, Mycobacterium avium subsp. paratuberculosis
ccccgcuggcgccgg

SEQ ID NO: 2989329 - RNA, 19 nt, Mycobacterium avium subsp. paratuberculosis
ccccgcuggcgccggcguc

SEQ ID NO: 2989330 - RNA, 20 nt, Mycobacterium avium subsp. paratuberculosis
ccccgcuggcgccggcgucc

SEQ ID NO: 2989331 - RNA, 15 nt, Mycobacterium avium subsp. paratuberculosis
ccccgcuucggcucg

SEQ ID NO: 2989332 - RNA, 18 nt, Mycobacterium avium subsp. paratuberculosis
ccccggacaacggaucga

SEQ ID NO: 2989333 - RNA, 18 nt, Mycobacterium avium subsp. paratuberculosis
ccccggaccugccggcga

SEQ ID NO: 2989334 - RNA, 15 nt, Mycobacterium avium subsp. paratuberculosis
ccccggagagccggu

SEQ ID NO: 2989335 - RNA, 17 nt, Mycobacterium avium subsp. paratuberculosis
ccccggagauccggccg

SEQ ID NO: 2989336 - RNA, 18 nt, Mycobacterium avium subsp. paratuberculosis
ccccggagauccggccgc

SEQ ID NO: 2989337 - RNA, 23 nt, Mycobacterium avium subsp. paratuberculosis
ccccggagucgucgaacucgaug

SEQ ID NO: 2989338 - RNA, 20 nt, Mycobacterium avium subsp. paratuberculosis
ccccggauccgucgccccgc

SEQ ID NO: 2989339 - RNA, 19 nt, Mycobacterium avium subsp. paratuberculosis
ccccggaugaccagggugg

SEQ ID NO: 2989340 - RNA, 23 nt, Mycobacterium avium subsp. paratuberculosis
ccccggaugaccaggguggucag

SEQ ID NO: 2989341 - RNA, 12 nt, Mycobacterium avium subsp. paratuberculosis
ccccggcaucga

SEQ ID NO: 2989342 - RNA, 12 nt, Mycobacterium avium subsp. paratuberculosis
ccccggccagca

SEQ ID NO: 2989343 - RNA, 13 nt, Mycobacterium avium subsp. paratuberculosis
ccccggccagcac

SEQ ID NO: 2989344 - RNA, 12 nt, Mycobacterium avium subsp. paratuberculosis
ccccggccagga

SEQ ID NO: 2989345 - RNA, 20 nt, Mycobacterium avium subsp. paratuberculosis
ccccggccagggugccgacg

SEQ ID NO: 2989346 - RNA, 22 nt, Mycobacterium avium subsp. paratuberculosis
ccccggccagggugccgacgac

SEQ ID NO: 2989347 - RNA, 14 nt, Mycobacterium avium subsp. paratuberculosis
ccccggcccggcga

SEQ ID NO: 2989348 - RNA, 12 nt, Mycobacterium avium subsp. paratuberculosis
ccccggcccguc

SEQ ID NO: 2989349 - RNA, 15 nt, Mycobacterium avium subsp. paratuberculosis
ccccggcccguccag

SEQ ID NO: 2989350 - RNA, 15 nt, Mycobacterium avium subsp. paratuberculosis
ccccggccgagccgg

SEQ ID NO: 2989351 - RNA, 15 nt, Mycobacterium avium subsp. paratuberculosis
ccccggccgcgguga

SEQ ID NO: 2989352 - RNA, 19 nt, Mycobacterium avium subsp. paratuberculosis
ccccggccggcccgcccgg

SEQ ID NO: 2989353 - RNA, 22 nt, Mycobacterium avium subsp. paratuberculosis
ccccggccggcccgcccggcgg

SEQ ID NO: 2989354 - RNA, 13 nt, Mycobacterium avium subsp. paratuberculosis
ccccggccggcgg

SEQ ID NO: 2989355 - RNA, 14 nt, Mycobacterium avium subsp. paratuberculosis
ccccggccgggcga

SEQ ID NO: 2989356 - RNA, 16 nt, Mycobacterium avium subsp. paratuberculosis
ccccggccgggcgacu

SEQ ID NO: 2989357 - RNA, 18 nt, Mycobacterium avium subsp. paratuberculosis
ccccggccguucuugcgg

SEQ ID NO: 2989358 - RNA, 22 nt, Mycobacterium avium subsp. paratuberculosis
ccccggccguucuugcggguga

SEQ ID NO: 2989359 - RNA, 21 nt, Mycobacterium avium subsp. paratuberculosis
ccccggcgaccacccucacca

SEQ ID NO: 2989360 - RNA, 22 nt, Mycobacterium avium subsp. paratuberculosis
ccccggcgaccacccucaccac

SEQ ID NO: 2989361 - RNA, 15 nt, Mycobacterium avium subsp. paratuberculosis
ccccggcgacggcgg

SEQ ID NO: 2989362 - RNA, 21 nt, Mycobacterium avium subsp. paratuberculosis
ccccggcgacggcggugggcu

SEQ ID NO: 2989363 - RNA, 20 nt, Mycobacterium avium subsp. paratuberculosis
ccccggcgacgucgccggcc

SEQ ID NO: 2989364 - RNA, 23 nt, Mycobacterium avium subsp. paratuberculosis
ccccggcgacgucgccggccugc

SEQ ID NO: 2989365 - RNA, 14 nt, Mycobacterium avium subsp. paratuberculosis
ccccggcgaugacc

SEQ ID NO: 2989366 - RNA, 15 nt, Mycobacterium avium subsp. paratuberculosis
ccccggcgccgucgu

SEQ ID NO: 2989367 - RNA, 14 nt, Mycobacterium avium subsp. paratuberculosis
ccccggcgcgacgg

SEQ ID NO: 2989368 - RNA, 20 nt, Mycobacterium avium subsp. paratuberculosis
ccccggcgcggaacgcgccg

SEQ ID NO: 2989369 - RNA, 22 nt, Mycobacterium avium subsp. paratuberculosis
ccccggcgcggaacgcgccggg

SEQ ID NO: 2989370 - RNA, 21 nt, Mycobacterium avium subsp. paratuberculosis
ccccggcgcugaagugcagcg

SEQ ID NO: 2989371 - RNA, 13 nt, Mycobacterium avium subsp. paratuberculosis
ccccggcggcacc

SEQ ID NO: 2989372 - RNA, 15 nt, Mycobacterium avium subsp. paratuberculosis
ccccggcggcaccgc

SEQ ID NO: 2989373 - RNA, 15 nt, Mycobacterium avium subsp. paratuberculosis
ccccggcggccacgc

SEQ ID NO: 2989374 - RNA, 16 nt, Mycobacterium avium subsp. paratuberculosis
ccccggcggccgcguc

SEQ ID NO: 2989375 - RNA, 13 nt, Mycobacterium avium subsp. paratuberculosis
ccccggcggccgg

SEQ ID NO: 2989376 - RNA, 17 nt, Mycobacterium avium subsp. paratuberculosis
ccccggcgggcggccga

SEQ ID NO: 2989377 - RNA, 19 nt, Mycobacterium avium subsp. paratuberculosis
ccccggcgggcggccgauc

SEQ ID NO: 2989378 - RNA, 18 nt, Mycobacterium avium subsp. paratuberculosis
ccccggcgggcucgccgg

SEQ ID NO: 2989379 - RNA, 12 nt, Mycobacterium avium subsp. paratuberculosis
ccccggcggguc

SEQ ID NO: 2989380 - RNA, 22 nt, Mycobacterium avium subsp. paratuberculosis
ccccggcggucggaucgagcuc

SEQ ID NO: 2989381 - RNA, 23 nt, Mycobacterium avium subsp. paratuberculosis
ccccggcguccaguagccgccgg

SEQ ID NO: 2989382 - RNA, 12 nt, Mycobacterium avium subsp. paratuberculosis
ccccggcgucga

SEQ ID NO: 2989383 - RNA, 17 nt, Mycobacterium avium subsp. paratuberculosis
ccccggcgugggugucg

SEQ ID NO: 2989384 - RNA, 17 nt, Mycobacterium avium subsp. paratuberculosis
ccccggcucgaucgcgg

SEQ ID NO: 2989385 - RNA, 17 nt, Mycobacterium avium subsp. paratuberculosis
ccccggcugcugcacga

SEQ ID NO: 2989386 - RNA, 16 nt, Mycobacterium avium subsp. paratuberculosis
ccccgggaaaugcugc

SEQ ID NO: 2989387 - RNA, 18 nt, Mycobacterium avium subsp. paratuberculosis
ccccgggaacgacggugc

SEQ ID NO: 2989388 - RNA, 19 nt, Mycobacterium avium subsp. paratuberculosis
ccccgggauccgaggcguc

SEQ ID NO: 2989389 - RNA, 19 nt, Mycobacterium avium subsp. paratuberculosis
ccccgggaugccugcccgc

SEQ ID NO: 2989390 - RNA, 15 nt, Mycobacterium avium subsp. paratuberculosis
ccccgggcaccagcg

SEQ ID NO: 2989391 - RNA, 12 nt, Mycobacterium avium subsp. paratuberculosis
ccccgggcccag

SEQ ID NO: 2989392 - RNA, 21 nt, Mycobacterium avium subsp. paratuberculosis
ccccgggcccagcaccaccac

SEQ ID NO: 2989393 - RNA, 18 nt, Mycobacterium avium subsp. paratuberculosis
ccccgggccgcagggugg

SEQ ID NO: 2989394 - RNA, 19 nt, Mycobacterium avium subsp. paratuberculosis
ccccgggccgcaggguggc

SEQ ID NO: 2989395 - RNA, 12 nt, Mycobacterium avium subsp. paratuberculosis
ccccgggcgagc

SEQ ID NO: 2989396 - RNA, 15 nt, Mycobacterium avium subsp. paratuberculosis
ccccgggcgagcguc

SEQ ID NO: 2989397 - RNA, 20 nt, Mycobacterium avium subsp. paratuberculosis
ccccgggcgagcgucgccgc

SEQ ID NO: 2989398 - RNA, 15 nt, Mycobacterium avium subsp. paratuberculosis
ccccgggcgugccgg

SEQ ID NO: 2989399 - RNA, 17 nt, Mycobacterium avium subsp. paratuberculosis
ccccggggccuccagcc

SEQ ID NO: 2989400 - RNA, 17 nt, Mycobacterium avium subsp. paratuberculosis
ccccgggggaccagcgc

SEQ ID NO: 2989401 - RNA, 14 nt, Mycobacterium avium subsp. paratuberculosis
ccccgggugggugc

SEQ ID NO: 2989402 - RNA, 19 nt, Mycobacterium avium subsp. paratuberculosis
ccccgguagccagcaccgc

SEQ ID NO: 2989403 - RNA, 18 nt, Mycobacterium avium subsp. paratuberculosis
ccccggucccgccgguga

SEQ ID NO: 2989404 - RNA, 12 nt, Mycobacterium avium subsp. paratuberculosis
ccccggucccgg

SEQ ID NO: 2989405 - RNA, 15 nt, Mycobacterium avium subsp. paratuberculosis
ccccggucccggggc

SEQ ID NO: 2989406 - RNA, 18 nt, Mycobacterium avium subsp. paratuberculosis
ccccggucccggggcucg

SEQ ID NO: 2989407 - RNA, 21 nt, Mycobacterium avium subsp. paratuberculosis
ccccggugacgauccggucga

SEQ ID NO: 2989408 - RNA, 22 nt, Mycobacterium avium subsp. paratuberculosis
ccccggugccgcagugccggcg

SEQ ID NO: 2989409 - RNA, 23 nt, Mycobacterium avium subsp. paratuberculosis
ccccggugccgcagugccggcgc

SEQ ID NO: 2989410 - RNA, 18 nt, Mycobacterium avium subsp. paratuberculosis
ccccgguggaugggcucg

SEQ ID NO: 2989411 - RNA, 12 nt, Mycobacterium avium subsp. paratuberculosis
ccccggugucug

SEQ ID NO: 2989412 - RNA, 15 nt, Mycobacterium avium subsp. paratuberculosis
ccccguaggugcaca

SEQ ID NO: 2989413 - RNA, 19 nt, Mycobacterium avium subsp. paratuberculosis
ccccguagucacccggccc

SEQ ID NO: 2989414 - RNA, 20 nt, Mycobacterium avium subsp. paratuberculosis
ccccguagucacccggcccc

SEQ ID NO: 2989415 - RNA, 21 nt, Mycobacterium avium subsp. paratuberculosis
ccccguagucacccggccccc

SEQ ID NO: 2989416 - RNA, 16 nt, Mycobacterium avium subsp. paratuberculosis
ccccguauugccgucg

SEQ ID NO: 2989417 - RNA, 17 nt, Mycobacterium avium subsp. paratuberculosis
ccccguauugccgucgg

SEQ ID NO: 2989418 - RNA, 22 nt, Mycobacterium avium subsp. paratuberculosis
ccccguauugccgucggcgucg

SEQ ID NO: 2989419 - RNA, 13 nt, Mycobacterium avium subsp. paratuberculosis
ccccguccagccc

SEQ ID NO: 2989420 - RNA, 17 nt, Mycobacterium avium subsp. paratuberculosis
ccccguccagcccagcg

SEQ ID NO: 2989421 - RNA, 20 nt, Mycobacterium avium subsp. paratuberculosis
ccccguccagcccagcgccc

SEQ ID NO: 2989422 - RNA, 14 nt, Mycobacterium avium subsp. paratuberculosis
ccccguccggcgcc

SEQ ID NO: 2989423 - RNA, 15 nt, Mycobacterium avium subsp. paratuberculosis
ccccgucgggccguc

SEQ ID NO: 2989424 - RNA, 13 nt, Mycobacterium avium subsp. paratuberculosis
ccccgugcagccg

SEQ ID NO: 2989425 - RNA, 17 nt, Mycobacterium avium subsp. paratuberculosis
ccccgugcagccgggcc

SEQ ID NO: 2989426 - RNA, 13 nt, Mycobacterium avium subsp. paratuberculosis
ccccgugcggggc

SEQ ID NO: 2989427 - RNA, 14 nt, Mycobacterium avium subsp. paratuberculosis
ccccgugcggggcc

SEQ ID NO: 2989428 - RNA, 22 nt, Mycobacterium avium subsp. paratuberculosis
ccccguggaucaucccgaccag

SEQ ID NO: 2989429 - RNA, 22 nt, Mycobacterium avium subsp. paratuberculosis
ccccguguuguggucugacccc

SEQ ID NO: 2989430 - RNA, 21 nt, Mycobacterium avium subsp. paratuberculosis
ccccguucgccgacagcagcu

SEQ ID NO: 2989431 - RNA, 22 nt, Mycobacterium avium subsp. paratuberculosis
ccccguugaucuugaccgucgc

SEQ ID NO: 2989432 - RNA, 13 nt, Mycobacterium avium subsp. paratuberculosis
ccccguugccgcc

SEQ ID NO: 2989433 - RNA, 19 nt, Mycobacterium avium subsp. paratuberculosis
ccccguugccgccggcgcc

SEQ ID NO: 2989434 - RNA, 14 nt, Mycobacterium avium subsp. paratuberculosis
ccccguuggugcgg

SEQ ID NO: 2989435 - RNA, 14 nt, Mycobacterium avium subsp. paratuberculosis
ccccuacgccgugg

SEQ ID NO: 2989436 - RNA, 14 nt, Mycobacterium avium subsp. paratuberculosis
ccccuacgggcgca

SEQ ID NO: 2989437 - RNA, 21 nt, Mycobacterium avium subsp. paratuberculosis
ccccuacgggcgcaccgcgcg

SEQ ID NO: 2989438 - RNA, 22 nt, Mycobacterium avium subsp. paratuberculosis
ccccuacgggcgcaccgcgcgc

SEQ ID NO: 2989439 - RNA, 22 nt, Mycobacterium avium subsp. paratuberculosis
ccccucacuccagcggcggccc

SEQ ID NO: 2989440 - RNA, 11 nt, Mycobacterium avium subsp. paratuberculosis
ccccuccagcc

SEQ ID NO: 2989441 - RNA, 12 nt, Mycobacterium avium subsp. paratuberculosis
ccccuccagccg

SEQ ID NO: 2989442 - RNA, 14 nt, Mycobacterium avium subsp. paratuberculosis
ccccuccagccgcc

SEQ ID NO: 2989443 - RNA, 13 nt, Mycobacterium avium subsp. paratuberculosis
ccccucccaccac

SEQ ID NO: 2989444 - RNA, 20 nt, Mycobacterium avium subsp. paratuberculosis
ccccucgaccaccucuucgc

SEQ ID NO: 2989445 - RNA, 14 nt, Mycobacterium avium subsp. paratuberculosis
ccccucgacccgaa

SEQ ID NO: 2989446 - RNA, 14 nt, Mycobacterium avium subsp. paratuberculosis
ccccucgccgggcg

SEQ ID NO: 2989447 - RNA, 14 nt, Mycobacterium avium subsp. paratuberculosis
ccccucggcggccg

SEQ ID NO: 2989448 - RNA, 15 nt, Mycobacterium avium subsp. paratuberculosis
ccccucggcggccgu

SEQ ID NO: 2989449 - RNA, 17 nt, Mycobacterium avium subsp. paratuberculosis
ccccucggcggccgucg

SEQ ID NO: 2989450 - RNA, 15 nt, Mycobacterium avium subsp. paratuberculosis
ccccugcacuacccc

SEQ ID NO: 2989451 - RNA, 12 nt, Mycobacterium avium subsp. paratuberculosis
ccccugccgcca

SEQ ID NO: 2989452 - RNA, 14 nt, Mycobacterium avium subsp. paratuberculosis
ccccugcggggugu

SEQ ID NO: 2989453 - RNA, 16 nt, Mycobacterium avium subsp. paratuberculosis
ccccugcucagcggcc

SEQ ID NO: 2989454 - RNA, 14 nt, Mycobacterium avium subsp. paratuberculosis
ccccugcucgcugu

SEQ ID NO: 2989455 - RNA, 17 nt, Mycobacterium avium subsp. paratuberculosis
ccccuucuccacgcucg

SEQ ID NO: 2989456 - RNA, 19 nt, Mycobacterium avium subsp. paratuberculosis
ccccuuggugcggucgaug

SEQ ID NO: 2989457 - RNA, 22 nt, Mycobacterium avium subsp. paratuberculosis
cccgaaaaauaggugaccucga

SEQ ID NO: 2989458 - RNA, 21 nt, Mycobacterium avium subsp. paratuberculosis
cccgaaaagguauucgcgcaa

SEQ ID NO: 2989459 - RNA, 23 nt, Mycobacterium avium subsp. paratuberculosis
cccgaaaagguauucgcgcaaca

SEQ ID NO: 2989460 - RNA, 16 nt, Mycobacterium avium subsp. paratuberculosis
cccgaaaccgucgacc

SEQ ID NO: 2989461 - RNA, 18 nt, Mycobacterium avium subsp. paratuberculosis
cccgaaacgucgcagccc

SEQ ID NO: 2989462 - RNA, 21 nt, Mycobacterium avium subsp. paratuberculosis
cccgaaagcccccagcucuuc

SEQ ID NO: 2989463 - RNA, 14 nt, Mycobacterium avium subsp. paratuberculosis
cccgaaaguccccg

SEQ ID NO: 2989464 - RNA, 22 nt, Mycobacterium avium subsp. paratuberculosis
cccgaacacgggcggcagggcc

SEQ ID NO: 2989465 - RNA, 18 nt, Mycobacterium avium subsp. paratuberculosis
cccgaacagccgggccag

SEQ ID NO: 2989466 - RNA, 16 nt, Mycobacterium avium subsp. paratuberculosis
cccgaacagccgggcg

SEQ ID NO: 2989467 - RNA, 18 nt, Mycobacterium avium subsp. paratuberculosis
cccgaacagccgggcggc

SEQ ID NO: 2989468 - RNA, 19 nt, Mycobacterium avium subsp. paratuberculosis
cccgaacagccgggcggcc

SEQ ID NO: 2989469 - RNA, 20 nt, Mycobacterium avium subsp. paratuberculosis
cccgaacagccgggcggccg

SEQ ID NO: 2989470 - RNA, 20 nt, Mycobacterium avium subsp. paratuberculosis
cccgaacagggcgacggcgg

SEQ ID NO: 2989471 - RNA, 21 nt, Mycobacterium avium subsp. paratuberculosis
cccgaacagggcgacggcggc

SEQ ID NO: 2989472 - RNA, 20 nt, Mycobacterium avium subsp. paratuberculosis
cccgaacaucgccucggccg

SEQ ID NO: 2989473 - RNA, 21 nt, Mycobacterium avium subsp. paratuberculosis
cccgaacaucgccucggccgc

SEQ ID NO: 2989474 - RNA, 19 nt, Mycobacterium avium subsp. paratuberculosis
cccgaaccaguucgccacc

SEQ ID NO: 2989475 - RNA, 22 nt, Mycobacterium avium subsp. paratuberculosis
cccgaaccaguucgccaccacg

SEQ ID NO: 2989476 - RNA, 13 nt, Mycobacterium avium subsp. paratuberculosis
cccgaacccggcc

SEQ ID NO: 2989477 - RNA, 16 nt, Mycobacterium avium subsp. paratuberculosis
cccgaaccgcccgccc

SEQ ID NO: 2989478 - RNA, 14 nt, Mycobacterium avium subsp. paratuberculosis
cccgaacggaccgg

SEQ ID NO: 2989479 - RNA, 23 nt, Mycobacterium avium subsp. paratuberculosis
cccgaagcucaucaccggcgcgc

SEQ ID NO: 2989480 - RNA, 24 nt, Mycobacterium avium subsp. paratuberculosis
cccgaagcucaucaccggcgcgcc

SEQ ID NO: 2989481 - RNA, 22 nt, Mycobacterium avium subsp. paratuberculosis
cccgaaggcguuggagccgacc

SEQ ID NO: 2989482 - RNA, 15 nt, Mycobacterium avium subsp. paratuberculosis
cccgaaggugguggc

SEQ ID NO: 2989483 - RNA, 16 nt, Mycobacterium avium subsp. paratuberculosis
cccgaaggugguggcg

SEQ ID NO: 2989484 - RNA, 14 nt, Mycobacterium avium subsp. paratuberculosis
cccgacaccgccag

SEQ ID NO: 2989485 - RNA, 17 nt, Mycobacterium avium subsp. paratuberculosis
cccgacaccgccagcag

SEQ ID NO: 2989486 - RNA, 21 nt, Mycobacterium avium subsp. paratuberculosis
cccgacaccgccagcagcgcc

SEQ ID NO: 2989487 - RNA, 22 nt, Mycobacterium avium subsp. paratuberculosis
cccgacaccgccagcagcgccg

SEQ ID NO: 2989488 - RNA, 15 nt, Mycobacterium avium subsp. paratuberculosis
cccgacaccgccccg

SEQ ID NO: 2989489 - RNA, 17 nt, Mycobacterium avium subsp. paratuberculosis
cccgacaccgccccgcc

SEQ ID NO: 2989490 - RNA, 19 nt, Mycobacterium avium subsp. paratuberculosis
cccgacaccgugguggcgg

SEQ ID NO: 2989491 - RNA, 15 nt, Mycobacterium avium subsp. paratuberculosis
cccgacagcaacgcc

SEQ ID NO: 2989492 - RNA, 18 nt, Mycobacterium avium subsp. paratuberculosis
cccgacauccaggaccgc

SEQ ID NO: 2989493 - RNA, 20 nt, Mycobacterium avium subsp. paratuberculosis
cccgacauccaggaccgcgc

SEQ ID NO: 2989494 - RNA, 22 nt, Mycobacterium avium subsp. paratuberculosis
cccgacaucgccaucagcagcg

SEQ ID NO: 2989495 - RNA, 23 nt, Mycobacterium avium subsp. paratuberculosis
cccgacaucugccgggcggcgac

SEQ ID NO: 2989496 - RNA, 15 nt, Mycobacterium avium subsp. paratuberculosis
cccgaccacaccggc

SEQ ID NO: 2989497 - RNA, 18 nt, Mycobacterium avium subsp. paratuberculosis
cccgaccacaccggcgcu

SEQ ID NO: 2989498 - RNA, 22 nt, Mycobacterium avium subsp. paratuberculosis
cccgaccacaccggcgcugccc

SEQ ID NO: 2989499 - RNA, 23 nt, Mycobacterium avium subsp. paratuberculosis
cccgaccaccuccccgcggugcc

SEQ ID NO: 2989500 - RNA, 14 nt, Mycobacterium avium subsp. paratuberculosis
cccgaccagcaccg

SEQ ID NO: 2989501 - RNA, 15 nt, Mycobacterium avium subsp. paratuberculosis
cccgaccagcaccgc

SEQ ID NO: 2989502 - RNA, 12 nt, Mycobacterium avium subsp. paratuberculosis
cccgaccagcgg

SEQ ID NO: 2989503 - RNA, 16 nt, Mycobacterium avium subsp. paratuberculosis
cccgaccagcgggccg

SEQ ID NO: 2989504 - RNA, 12 nt, Mycobacterium avium subsp. paratuberculosis
cccgaccagcug

SEQ ID NO: 2989505 - RNA, 12 nt, Mycobacterium avium subsp. paratuberculosis
cccgaccccgcc

SEQ ID NO: 2989506 - RNA, 14 nt, Mycobacterium avium subsp. paratuberculosis
cccgaccccgccag

SEQ ID NO: 2989507 - RNA, 16 nt, Mycobacterium avium subsp. paratuberculosis
cccgaccccgccagca

SEQ ID NO: 2989508 - RNA, 15 nt, Mycobacterium avium subsp. paratuberculosis
cccgaccccggcgag

SEQ ID NO: 2989509 - RNA, 16 nt, Mycobacterium avium subsp. paratuberculosis
cccgaccccggcgagc

SEQ ID NO: 2989510 - RNA, 19 nt, Mycobacterium avium subsp. paratuberculosis
cccgaccccggcgagcgcg

SEQ ID NO: 2989511 - RNA, 12 nt, Mycobacterium avium subsp. paratuberculosis
cccgacccgaag

SEQ ID NO: 2989512 - RNA, 15 nt, Mycobacterium avium subsp. paratuberculosis
cccgacccgaagccc

SEQ ID NO: 2989513 - RNA, 16 nt, Mycobacterium avium subsp. paratuberculosis
cccgacccgcaccacc

SEQ ID NO: 2989514 - RNA, 19 nt, Mycobacterium avium subsp. paratuberculosis
cccgacccgcaccaccgcc

SEQ ID NO: 2989515 - RNA, 13 nt, Mycobacterium avium subsp. paratuberculosis
cccgaccgacgcc

SEQ ID NO: 2989516 - RNA, 14 nt, Mycobacterium avium subsp. paratuberculosis
cccgaccgacgccc

SEQ ID NO: 2989517 - RNA, 22 nt, Mycobacterium avium subsp. paratuberculosis
cccgaccgacgcggucaccggc

SEQ ID NO: 2989518 - RNA, 20 nt, Mycobacterium avium subsp. paratuberculosis
cccgaccgcgaugcagaaca

SEQ ID NO: 2989519 - RNA, 15 nt, Mycobacterium avium subsp. paratuberculosis
cccgaccgcgccgaa

SEQ ID NO: 2989520 - RNA, 14 nt, Mycobacterium avium subsp. paratuberculosis
cccgaccggagccg

SEQ ID NO: 2989521 - RNA, 16 nt, Mycobacterium avium subsp. paratuberculosis
cccgaccuucugcugc

SEQ ID NO: 2989522 - RNA, 20 nt, Mycobacterium avium subsp. paratuberculosis
cccgaccuuuugcccggcga

SEQ ID NO: 2989523 - RNA, 16 nt, Mycobacterium avium subsp. paratuberculosis
cccgacgacgacgucg

SEQ ID NO: 2989524 - RNA, 21 nt, Mycobacterium avium subsp. paratuberculosis
cccgacgacgacgucgacgac

SEQ ID NO: 2989525 - RNA, 12 nt, Mycobacterium avium subsp. paratuberculosis
cccgacgacgcc

SEQ ID NO: 2989526 - RNA, 16 nt, Mycobacterium avium subsp. paratuberculosis
cccgacgaucgcgccg

SEQ ID NO: 2989527 - RNA, 19 nt, Mycobacterium avium subsp. paratuberculosis
cccgacgaucgcgccggcc

SEQ ID NO: 2989528 - RNA, 21 nt, Mycobacterium avium subsp. paratuberculosis
cccgacgaucgcgccggccgc

SEQ ID NO: 2989529 - RNA, 12 nt, Mycobacterium avium subsp. paratuberculosis
cccgacgccgac

SEQ ID NO: 2989530 - RNA, 14 nt, Mycobacterium avium subsp. paratuberculosis
cccgacgccgacac

SEQ ID NO: 2989531 - RNA, 14 nt, Mycobacterium avium subsp. paratuberculosis
cccgacgccgacgg

SEQ ID NO: 2989532 - RNA, 14 nt, Mycobacterium avium subsp. paratuberculosis
cccgacgccggacc

SEQ ID NO: 2989533 - RNA, 17 nt, Mycobacterium avium subsp. paratuberculosis
cccgacgccggacccca

SEQ ID NO: 2989534 - RNA, 12 nt, Mycobacterium avium subsp. paratuberculosis
cccgacgcggcg

SEQ ID NO: 2989535 - RNA, 15 nt, Mycobacterium avium subsp. paratuberculosis
cccgacgcggcgcga

SEQ ID NO: 2989536 - RNA, 23 nt, Mycobacterium avium subsp. paratuberculosis
cccgacgcggcgcgacaccgcgg

SEQ ID NO: 2989537 - RNA, 22 nt, Mycobacterium avium subsp. paratuberculosis
cccgacgcugacgaugcggccg

SEQ ID NO: 2989538 - RNA, 13 nt, Mycobacterium avium subsp. paratuberculosis
cccgacggcagca

SEQ ID NO: 2989539 - RNA, 15 nt, Mycobacterium avium subsp. paratuberculosis
cccgacggcagcacc

SEQ ID NO: 2989540 - RNA, 17 nt, Mycobacterium avium subsp. paratuberculosis
cccgacggcagcaccgc

SEQ ID NO: 2989541 - RNA, 18 nt, Mycobacterium avium subsp. paratuberculosis
cccgacggcagcaccgcc

SEQ ID NO: 2989542 - RNA, 19 nt, Mycobacterium avium subsp. paratuberculosis
cccgacggcagcaccgccg

SEQ ID NO: 2989543 - RNA, 21 nt, Mycobacterium avium subsp. paratuberculosis
cccgacggcagcaccgccgac

SEQ ID NO: 2989544 - RNA, 17 nt, Mycobacterium avium subsp. paratuberculosis
cccgacggcgccgcggc

SEQ ID NO: 2989545 - RNA, 19 nt, Mycobacterium avium subsp. paratuberculosis
cccgacggcgccgcggccg

SEQ ID NO: 2989546 - RNA, 13 nt, Mycobacterium avium subsp. paratuberculosis
cccgacggcgcgc

SEQ ID NO: 2989547 - RNA, 14 nt, Mycobacterium avium subsp. paratuberculosis
cccgacggcgcgcc

SEQ ID NO: 2989548 - RNA, 15 nt, Mycobacterium avium subsp. paratuberculosis
cccgacggcgcgccc

SEQ ID NO: 2989549 - RNA, 13 nt, Mycobacterium avium subsp. paratuberculosis
cccgacggcgucu

SEQ ID NO: 2989550 - RNA, 20 nt, Mycobacterium avium subsp. paratuberculosis
cccgacgggaacucggccag

SEQ ID NO: 2989551 - RNA, 21 nt, Mycobacterium avium subsp. paratuberculosis
cccgacgggcgugccggcggc

SEQ ID NO: 2989552 - RNA, 21 nt, Mycobacterium avium subsp. paratuberculosis
cccgacggguucgcgcagcca

SEQ ID NO: 2989553 - RNA, 13 nt, Mycobacterium avium subsp. paratuberculosis
cccgacggucgcc

SEQ ID NO: 2989554 - RNA, 15 nt, Mycobacterium avium subsp. paratuberculosis
cccgacggucgccac

SEQ ID NO: 2989555 - RNA, 17 nt, Mycobacterium avium subsp. paratuberculosis
cccgacggucgccacca

SEQ ID NO: 2989556 - RNA, 17 nt, Mycobacterium avium subsp. paratuberculosis
cccgacgugcagcgcca

SEQ ID NO: 2989557 - RNA, 20 nt, Mycobacterium avium subsp. paratuberculosis
cccgacgugcagcgccagca

SEQ ID NO: 2989558 - RNA, 17 nt, Mycobacterium avium subsp. paratuberculosis
cccgacguugccgcugg

SEQ ID NO: 2989559 - RNA, 18 nt, Mycobacterium avium subsp. paratuberculosis
cccgacguugccgcuggu

SEQ ID NO: 2989560 - RNA, 14 nt, Mycobacterium avium subsp. paratuberculosis
cccgacuccucaca

SEQ ID NO: 2989561 - RNA, 18 nt, Mycobacterium avium subsp. paratuberculosis
cccgacuccucacaccuc

SEQ ID NO: 2989562 - RNA, 19 nt, Mycobacterium avium subsp. paratuberculosis
cccgacuccucacaccucg

SEQ ID NO: 2989563 - RNA, 20 nt, Mycobacterium avium subsp. paratuberculosis
cccgacuccucacaccucgc

SEQ ID NO: 2989564 - RNA, 12 nt, Mycobacterium avium subsp. paratuberculosis
cccgacuucggc

SEQ ID NO: 2989565 - RNA, 16 nt, Mycobacterium avium subsp. paratuberculosis
cccgacuucggcucgg

SEQ ID NO: 2989566 - RNA, 20 nt, Mycobacterium avium subsp. paratuberculosis
cccgacuucggcucggcgac

SEQ ID NO: 2989567 - RNA, 21 nt, Mycobacterium avium subsp. paratuberculosis
cccgacuucggcucggcgaca

SEQ ID NO: 2989568 - RNA, 18 nt, Mycobacterium avium subsp. paratuberculosis
cccgagaguccgccgccg

SEQ ID NO: 2989569 - RNA, 14 nt, Mycobacterium avium subsp. paratuberculosis
cccgagaucaccgg

SEQ ID NO: 2989570 - RNA, 16 nt, Mycobacterium avium subsp. paratuberculosis
cccgagaucccagcgg

SEQ ID NO: 2989571 - RNA, 17 nt, Mycobacterium avium subsp. paratuberculosis
cccgagaucgcgggcug

SEQ ID NO: 2989572 - RNA, 17 nt, Mycobacterium avium subsp. paratuberculosis
cccgagcaacuggguga

SEQ ID NO: 2989573 - RNA, 12 nt, Mycobacterium avium subsp. paratuberculosis
cccgagcaccag

SEQ ID NO: 2989574 - RNA, 14 nt, Mycobacterium avium subsp. paratuberculosis
cccgagcaccagcg

SEQ ID NO: 2989575 - RNA, 19 nt, Mycobacterium avium subsp. paratuberculosis
cccgagcaccccggcggcc

SEQ ID NO: 2989576 - RNA, 11 nt, Mycobacterium avium subsp. paratuberculosis
cccgagcaccg

SEQ ID NO: 2989577 - RNA, 17 nt, Mycobacterium avium subsp. paratuberculosis
cccgagcaccgggccga

SEQ ID NO: 2989578 - RNA, 18 nt, Mycobacterium avium subsp. paratuberculosis
cccgagcaccgggccgaa

SEQ ID NO: 2989579 - RNA, 19 nt, Mycobacterium avium subsp. paratuberculosis
cccgagcaccugaacggcc

SEQ ID NO: 2989580 - RNA, 21 nt, Mycobacterium avium subsp. paratuberculosis
cccgagcaccugaacggccgc

SEQ ID NO: 2989581 - RNA, 23 nt, Mycobacterium avium subsp. paratuberculosis
cccgagcaccugaacggccgcgc

SEQ ID NO: 2989582 - RNA, 23 nt, Mycobacterium avium subsp. paratuberculosis
cccgagcacgucgagcaccgcgu

SEQ ID NO: 2989583 - RNA, 15 nt, Mycobacterium avium subsp. paratuberculosis
cccgagcagaucggg

SEQ ID NO: 2989584 - RNA, 16 nt, Mycobacterium avium subsp. paratuberculosis
cccgagcagcgggucg

SEQ ID NO: 2989585 - RNA, 12 nt, Mycobacterium avium subsp. paratuberculosis
cccgagcaggcg

SEQ ID NO: 2989586 - RNA, 13 nt, Mycobacterium avium subsp. paratuberculosis
cccgagcaggcgg

SEQ ID NO: 2989587 - RNA, 22 nt, Mycobacterium avium subsp. paratuberculosis
cccgagcaggcggaucggcccg

SEQ ID NO: 2989588 - RNA, 23 nt, Mycobacterium avium subsp. paratuberculosis
cccgagcaggcggaucggcccga

SEQ ID NO: 2989589 - RNA, 14 nt, Mycobacterium avium subsp. paratuberculosis
cccgagcaucgccg

SEQ ID NO: 2989590 - RNA, 16 nt, Mycobacterium avium subsp. paratuberculosis
cccgagcaucgccgag

SEQ ID NO: 2989591 - RNA, 19 nt, Mycobacterium avium subsp. paratuberculosis
cccgagcaucgccgagcgc

SEQ ID NO: 2989592 - RNA, 17 nt, Mycobacterium avium subsp. paratuberculosis
cccgagcccgacggcag

SEQ ID NO: 2989593 - RNA, 20 nt, Mycobacterium avium subsp. paratuberculosis
cccgagcccgacggcagcac

SEQ ID NO: 2989594 - RNA, 19 nt, Mycobacterium avium subsp. paratuberculosis
cccgagcccugcgccagca

SEQ ID NO: 2989595 - RNA, 13 nt, Mycobacterium avium subsp. paratuberculosis
cccgagccgacga

SEQ ID NO: 2989596 - RNA, 13 nt, Mycobacterium avium subsp. paratuberculosis
cccgagccgcgga

SEQ ID NO: 2989597 - RNA, 22 nt, Mycobacterium avium subsp. paratuberculosis
cccgagccgcggauggccucgg

SEQ ID NO: 2989598 - RNA, 13 nt, Mycobacterium avium subsp. paratuberculosis
cccgagcggcauc

SEQ ID NO: 2989599 - RNA, 16 nt, Mycobacterium avium subsp. paratuberculosis
cccgagcggcgacucc

SEQ ID NO: 2989600 - RNA, 18 nt, Mycobacterium avium subsp. paratuberculosis
cccgagcgggccuucacg

SEQ ID NO: 2989601 - RNA, 16 nt, Mycobacterium avium subsp. paratuberculosis
cccgagcgucacgcca

SEQ ID NO: 2989602 - RNA, 12 nt, Mycobacterium avium subsp. paratuberculosis
cccgagcgucau

SEQ ID NO: 2989603 - RNA, 23 nt, Mycobacterium avium subsp. paratuberculosis
cccgagcgucauuccgccgcgcc

SEQ ID NO: 2989604 - RNA, 20 nt, Mycobacterium avium subsp. paratuberculosis
cccgagcugaucgcggccgg

SEQ ID NO: 2989605 - RNA, 21 nt, Mycobacterium avium subsp. paratuberculosis
cccgagcugaucgcggccggc

SEQ ID NO: 2989606 - RNA, 17 nt, Mycobacterium avium subsp. paratuberculosis
cccgaggagacgucggc

SEQ ID NO: 2989607 - RNA, 21 nt, Mycobacterium avium subsp. paratuberculosis
cccgaggagacgucggccggg

SEQ ID NO: 2989608 - RNA, 22 nt, Mycobacterium avium subsp. paratuberculosis
cccgaggagacgucggccgggu

SEQ ID NO: 2989609 - RNA, 15 nt, Mycobacterium avium subsp. paratuberculosis
cccgaggaugccgcc

SEQ ID NO: 2989610 - RNA, 21 nt, Mycobacterium avium subsp. paratuberculosis
cccgaggaugccgcccaccac

SEQ ID NO: 2989611 - RNA, 21 nt, Mycobacterium avium subsp. paratuberculosis
cccgaggucauaucgacggcc

SEQ ID NO: 2989612 - RNA, 22 nt, Mycobacterium avium subsp. paratuberculosis
cccgaggugaauaccacugcgc

SEQ ID NO: 2989613 - RNA, 23 nt, Mycobacterium avium subsp. paratuberculosis
cccgaggugaauaccacugcgcg

SEQ ID NO: 2989614 - RNA, 17 nt, Mycobacterium avium subsp. paratuberculosis
cccgagucacccggcug

SEQ ID NO: 2989615 - RNA, 18 nt, Mycobacterium avium subsp. paratuberculosis
cccgagucacccggcugg

SEQ ID NO: 2989616 - RNA, 17 nt, Mycobacterium avium subsp. paratuberculosis
cccgaguccacgacguc

SEQ ID NO: 2989617 - RNA, 19 nt, Mycobacterium avium subsp. paratuberculosis
cccgagucggagacccgcc

SEQ ID NO: 2989618 - RNA, 15 nt, Mycobacterium avium subsp. paratuberculosis
cccgaguggcgccgu

SEQ ID NO: 2989619 - RNA, 16 nt, Mycobacterium avium subsp. paratuberculosis
cccgaguggcgccguc

SEQ ID NO: 2989620 - RNA, 17 nt, Mycobacterium avium subsp. paratuberculosis
cccgaguggcgccgucg

SEQ ID NO: 2989621 - RNA, 20 nt, Mycobacterium avium subsp. paratuberculosis
cccgagugggaccgucggca

SEQ ID NO: 2989622 - RNA, 15 nt, Mycobacterium avium subsp. paratuberculosis
cccgauagccccgcc

SEQ ID NO: 2989623 - RNA, 18 nt, Mycobacterium avium subsp. paratuberculosis
cccgauagccccgccagg

SEQ ID NO: 2989624 - RNA, 14 nt, Mycobacterium avium subsp. paratuberculosis
cccgauaggccgac

SEQ ID NO: 2989625 - RNA, 16 nt, Mycobacterium avium subsp. paratuberculosis
cccgaucaacaccgcc

SEQ ID NO: 2989626 - RNA, 18 nt, Mycobacterium avium subsp. paratuberculosis
cccgaucaacaccgccag

SEQ ID NO: 2989627 - RNA, 20 nt, Mycobacterium avium subsp. paratuberculosis
cccgaucaacaccgccagca

SEQ ID NO: 2989628 - RNA, 22 nt, Mycobacterium avium subsp. paratuberculosis
cccgaucaacaccgccagcacc

SEQ ID NO: 2989629 - RNA, 13 nt, Mycobacterium avium subsp. paratuberculosis
cccgaucaccagg

SEQ ID NO: 2989630 - RNA, 16 nt, Mycobacterium avium subsp. paratuberculosis
cccgaucaccuugccc

SEQ ID NO: 2989631 - RNA, 20 nt, Mycobacterium avium subsp. paratuberculosis
cccgaucaggguccagggcg

SEQ ID NO: 2989632 - RNA, 22 nt, Mycobacterium avium subsp. paratuberculosis
cccgaucaucucaccgacgacc

SEQ ID NO: 2989633 - RNA, 16 nt, Mycobacterium avium subsp. paratuberculosis
cccgauccacggcgac

SEQ ID NO: 2989634 - RNA, 17 nt, Mycobacterium avium subsp. paratuberculosis
cccgauccacggcgacc

SEQ ID NO: 2989635 - RNA, 15 nt, Mycobacterium avium subsp. paratuberculosis
cccgaucccgggccg

SEQ ID NO: 2989636 - RNA, 23 nt, Mycobacterium avium subsp. paratuberculosis
cccgauccgccguugcggcccac

SEQ ID NO: 2989637 - RNA, 21 nt, Mycobacterium avium subsp. paratuberculosis
cccgauccgcgccgccgccag

SEQ ID NO: 2989638 - RNA, 14 nt, Mycobacterium avium subsp. paratuberculosis
cccgauccggcuga

SEQ ID NO: 2989639 - RNA, 13 nt, Mycobacterium avium subsp. paratuberculosis
cccgaucgaggac

SEQ ID NO: 2989640 - RNA, 22 nt, Mycobacterium avium subsp. paratuberculosis
cccgaucgaucaucgccucggu

SEQ ID NO: 2989641 - RNA, 16 nt, Mycobacterium avium subsp. paratuberculosis
cccgaucgccagcgcc

SEQ ID NO: 2989642 - RNA, 19 nt, Mycobacterium avium subsp. paratuberculosis
cccgaucgccagcgcccga

SEQ ID NO: 2989643 - RNA, 23 nt, Mycobacterium avium subsp. paratuberculosis
cccgaucgccgagucgaucgcca

SEQ ID NO: 2989644 - RNA, 12 nt, Mycobacterium avium subsp. paratuberculosis
cccgaucgcgau

SEQ ID NO: 2989645 - RNA, 20 nt, Mycobacterium avium subsp. paratuberculosis
cccgaucgcgaucaccgcgg

SEQ ID NO: 2989646 - RNA, 21 nt, Mycobacterium avium subsp. paratuberculosis
cccgaucgcgaucaccgcggc

SEQ ID NO: 2989647 - RNA, 22 nt, Mycobacterium avium subsp. paratuberculosis
cccgaucgcgaucaccgcggcc

SEQ ID NO: 2989648 - RNA, 18 nt, Mycobacterium avium subsp. paratuberculosis
cccgaucgcgucgacgau

SEQ ID NO: 2989649 - RNA, 14 nt, Mycobacterium avium subsp. paratuberculosis
cccgaucggcaccc

SEQ ID NO: 2989650 - RNA, 21 nt, Mycobacterium avium subsp. paratuberculosis
cccgaucggggccaggaugcc

SEQ ID NO: 2989651 - RNA, 16 nt, Mycobacterium avium subsp. paratuberculosis
cccgaucgugcgccca

SEQ ID NO: 2989652 - RNA, 17 nt, Mycobacterium avium subsp. paratuberculosis
cccgaucgugcgcccau

SEQ ID NO: 2989653 - RNA, 16 nt, Mycobacterium avium subsp. paratuberculosis
cccgaucucgcggucg

SEQ ID NO: 2989654 - RNA, 14 nt, Mycobacterium avium subsp. paratuberculosis
cccgaucucgucgg

SEQ ID NO: 2989655 - RNA, 20 nt, Mycobacterium avium subsp. paratuberculosis
cccgaucugggaucggugcg

SEQ ID NO: 2989656 - RNA, 17 nt, Mycobacterium avium subsp. paratuberculosis
cccgaugaccggcccgg

SEQ ID NO: 2989657 - RNA, 20 nt, Mycobacterium avium subsp. paratuberculosis
cccgaugccgaacuccgccg

SEQ ID NO: 2989658 - RNA, 21 nt, Mycobacterium avium subsp. paratuberculosis
cccgaugccgaacuccgccga

SEQ ID NO: 2989659 - RNA, 23 nt, Mycobacterium avium subsp. paratuberculosis
cccgaugccgaacuccgccgaac

SEQ ID NO: 2989660 - RNA, 14 nt, Mycobacterium avium subsp. paratuberculosis
cccgaugccgccga

SEQ ID NO: 2989661 - RNA, 19 nt, Mycobacterium avium subsp. paratuberculosis
cccgaugccgcgcaggccg

SEQ ID NO: 2989662 - RNA, 21 nt, Mycobacterium avium subsp. paratuberculosis
cccgaugccgcgcaggccguc

SEQ ID NO: 2989663 - RNA, 16 nt, Mycobacterium avium subsp. paratuberculosis
cccgaugcgcucaccc

SEQ ID NO: 2989664 - RNA, 18 nt, Mycobacterium avium subsp. paratuberculosis
cccgaugcggugccgggc

SEQ ID NO: 2989665 - RNA, 21 nt, Mycobacterium avium subsp. paratuberculosis
cccgaugcggugccgggccag

SEQ ID NO: 2989666 - RNA, 15 nt, Mycobacterium avium subsp. paratuberculosis
cccgaugcucccggu

SEQ ID NO: 2989667 - RNA, 17 nt, Mycobacterium avium subsp. paratuberculosis
cccgaugcucccggucg

SEQ ID NO: 2989668 - RNA, 20 nt, Mycobacterium avium subsp. paratuberculosis
cccgaugcuggccaucgccg

SEQ ID NO: 2989669 - RNA, 18 nt, Mycobacterium avium subsp. paratuberculosis
cccgauggaggugccgcg

SEQ ID NO: 2989670 - RNA, 15 nt, Mycobacterium avium subsp. paratuberculosis
cccgaugucggcgaa

SEQ ID NO: 2989671 - RNA, 17 nt, Mycobacterium avium subsp. paratuberculosis
cccgauucagccggcgg

SEQ ID NO: 2989672 - RNA, 20 nt, Mycobacterium avium subsp. paratuberculosis
cccgauucagccggcgggcg

SEQ ID NO: 2989673 - RNA, 15 nt, Mycobacterium avium subsp. paratuberculosis
cccgauucgcggcca

SEQ ID NO: 2989674 - RNA, 19 nt, Mycobacterium avium subsp. paratuberculosis
cccgauucgcggccaccac

SEQ ID NO: 2989675 - RNA, 17 nt, Mycobacterium avium subsp. paratuberculosis
cccgcaaacacgagcag

SEQ ID NO: 2989676 - RNA, 19 nt, Mycobacterium avium subsp. paratuberculosis
cccgcaaaucagccgagcc

SEQ ID NO: 2989677 - RNA, 20 nt, Mycobacterium avium subsp. paratuberculosis
cccgcaaaucagccgagccg

SEQ ID NO: 2989678 - RNA, 18 nt, Mycobacterium avium subsp. paratuberculosis
cccgcaacgcgcgcgacg

SEQ ID NO: 2989679 - RNA, 18 nt, Mycobacterium avium subsp. paratuberculosis
cccgcaacgcugaccgca

SEQ ID NO: 2989680 - RNA, 19 nt, Mycobacterium avium subsp. paratuberculosis
cccgcaacgcugaccgcag

SEQ ID NO: 2989681 - RNA, 19 nt, Mycobacterium avium subsp. paratuberculosis
cccgcaacuguucgcggcu

SEQ ID NO: 2989682 - RNA, 22 nt, Mycobacterium avium subsp. paratuberculosis
cccgcaaggccgccagccgcgu

SEQ ID NO: 2989683 - RNA, 16 nt, Mycobacterium avium subsp. paratuberculosis
cccgcaauugcgccag

SEQ ID NO: 2989684 - RNA, 18 nt, Mycobacterium avium subsp. paratuberculosis
cccgcaauugcgccagca

SEQ ID NO: 2989685 - RNA, 21 nt, Mycobacterium avium subsp. paratuberculosis
cccgcaauugcgccagcagca

SEQ ID NO: 2989686 - RNA, 13 nt, Mycobacterium avium subsp. paratuberculosis
cccgcaccaccca

SEQ ID NO: 2989687 - RNA, 16 nt, Mycobacterium avium subsp. paratuberculosis
cccgcaccacccagcc

SEQ ID NO: 2989688 - RNA, 14 nt, Mycobacterium avium subsp. paratuberculosis
cccgcaccaccgcc

SEQ ID NO: 2989689 - RNA, 13 nt, Mycobacterium avium subsp. paratuberculosis
cccgcaccagcag

SEQ ID NO: 2989690 - RNA, 12 nt, Mycobacterium avium subsp. paratuberculosis
cccgcacccgcc

SEQ ID NO: 2989691 - RNA, 14 nt, Mycobacterium avium subsp. paratuberculosis
cccgcacccgccgc

SEQ ID NO: 2989692 - RNA, 15 nt, Mycobacterium avium subsp. paratuberculosis
cccgcacccguucgg

SEQ ID NO: 2989693 - RNA, 22 nt, Mycobacterium avium subsp. paratuberculosis
cccgcacccuugacuaccgcgc

SEQ ID NO: 2989694 - RNA, 18 nt, Mycobacterium avium subsp. paratuberculosis
cccgcaccgccaggcugg

SEQ ID NO: 2989695 - RNA, 13 nt, Mycobacterium avium subsp. paratuberculosis
cccgcaccgcccc

SEQ ID NO: 2989696 - RNA, 20 nt, Mycobacterium avium subsp. paratuberculosis
cccgcaccgccccgcaaccg

SEQ ID NO: 2989697 - RNA, 17 nt, Mycobacterium avium subsp. paratuberculosis
cccgcaccucgcccggc

SEQ ID NO: 2989698 - RNA, 14 nt, Mycobacterium avium subsp. paratuberculosis
cccgcaccugcgcg

SEQ ID NO: 2989699 - RNA, 19 nt, Mycobacterium avium subsp. paratuberculosis
cccgcacgaaaugcgggcg

SEQ ID NO: 2989700 - RNA, 14 nt, Mycobacterium avium subsp. paratuberculosis
cccgcacgccagca

SEQ ID NO: 2989701 - RNA, 15 nt, Mycobacterium avium subsp. paratuberculosis
cccgcacgccagcau

SEQ ID NO: 2989702 - RNA, 20 nt, Mycobacterium avium subsp. paratuberculosis
cccgcacggccgccaggguc

SEQ ID NO: 2989703 - RNA, 17 nt, Mycobacterium avium subsp. paratuberculosis
cccgcacgugcgcgccg

SEQ ID NO: 2989704 - RNA, 16 nt, Mycobacterium avium subsp. paratuberculosis
cccgcagaacaccagc

SEQ ID NO: 2989705 - RNA, 19 nt, Mycobacterium avium subsp. paratuberculosis
cccgcagaacaccagcgca

SEQ ID NO: 2989706 - RNA, 12 nt, Mycobacterium avium subsp. paratuberculosis
cccgcagcacgc

SEQ ID NO: 2989707 - RNA, 13 nt, Mycobacterium avium subsp. paratuberculosis
cccgcagcacgcc

SEQ ID NO: 2989708 - RNA, 20 nt, Mycobacterium avium subsp. paratuberculosis
cccgcagcacgcccguagcg

SEQ ID NO: 2989709 - RNA, 15 nt, Mycobacterium avium subsp. paratuberculosis
cccgcagccagcgca

SEQ ID NO: 2989710 - RNA, 15 nt, Mycobacterium avium subsp. paratuberculosis
cccgcagccgcgagu

SEQ ID NO: 2989711 - RNA, 12 nt, Mycobacterium avium subsp. paratuberculosis
cccgcagccgcu

SEQ ID NO: 2989712 - RNA, 14 nt, Mycobacterium avium subsp. paratuberculosis
cccgcagccgcugg

SEQ ID NO: 2989713 - RNA, 17 nt, Mycobacterium avium subsp. paratuberculosis
cccgcagccgcuggccg

SEQ ID NO: 2989714 - RNA, 20 nt, Mycobacterium avium subsp. paratuberculosis
cccgcagccgcuggccgcgc

SEQ ID NO: 2989715 - RNA, 21 nt, Mycobacterium avium subsp. paratuberculosis
cccgcagccgcuggccgcgcc

SEQ ID NO: 2989716 - RNA, 17 nt, Mycobacterium avium subsp. paratuberculosis
cccgcagcgaacgcggc

SEQ ID NO: 2989717 - RNA, 15 nt, Mycobacterium avium subsp. paratuberculosis
cccgcagcgaccgcg

SEQ ID NO: 2989718 - RNA, 13 nt, Mycobacterium avium subsp. paratuberculosis
cccgcagcgccag

SEQ ID NO: 2989719 - RNA, 14 nt, Mycobacterium avium subsp. paratuberculosis
cccgcagcgccagc

SEQ ID NO: 2989720 - RNA, 12 nt, Mycobacterium avium subsp. paratuberculosis
cccgcagcgcgg

SEQ ID NO: 2989721 - RNA, 17 nt, Mycobacterium avium subsp. paratuberculosis
cccgcagcgcggcggag

SEQ ID NO: 2989722 - RNA, 16 nt, Mycobacterium avium subsp. paratuberculosis
cccgcagcggcgguug

SEQ ID NO: 2989723 - RNA, 17 nt, Mycobacterium avium subsp. paratuberculosis
cccgcagcucccccggc

SEQ ID NO: 2989724 - RNA, 22 nt, Mycobacterium avium subsp. paratuberculosis
cccgcagcucccccggcgugag

SEQ ID NO: 2989725 - RNA, 15 nt, Mycobacterium avium subsp. paratuberculosis
cccgcagcucgccga

SEQ ID NO: 2989726 - RNA, 17 nt, Mycobacterium avium subsp. paratuberculosis
cccgcaggaucgagccg

SEQ ID NO: 2989727 - RNA, 21 nt, Mycobacterium avium subsp. paratuberculosis
cccgcaggaucgagccggccg

SEQ ID NO: 2989728 - RNA, 15 nt, Mycobacterium avium subsp. paratuberculosis
cccgcaggccgcgag

SEQ ID NO: 2989729 - RNA, 20 nt, Mycobacterium avium subsp. paratuberculosis
cccgcagugcgucagaaccg

SEQ ID NO: 2989730 - RNA, 16 nt, Mycobacterium avium subsp. paratuberculosis
cccgcaguucggccgc

SEQ ID NO: 2989731 - RNA, 17 nt, Mycobacterium avium subsp. paratuberculosis
cccgcaucaacugcacc

SEQ ID NO: 2989732 - RNA, 18 nt, Mycobacterium avium subsp. paratuberculosis
cccgcaucaacugcacca

SEQ ID NO: 2989733 - RNA, 19 nt, Mycobacterium avium subsp. paratuberculosis
cccgcaucaacugcaccag

SEQ ID NO: 2989734 - RNA, 21 nt, Mycobacterium avium subsp. paratuberculosis
cccgcaucaacugcaccagcg

SEQ ID NO: 2989735 - RNA, 13 nt, Mycobacterium avium subsp. paratuberculosis
cccgcauccgccg

SEQ ID NO: 2989736 - RNA, 14 nt, Mycobacterium avium subsp. paratuberculosis
cccgcauccgccgg

SEQ ID NO: 2989737 - RNA, 17 nt, Mycobacterium avium subsp. paratuberculosis
cccgcauccgccgggcg

SEQ ID NO: 2989738 - RNA, 18 nt, Mycobacterium avium subsp. paratuberculosis
cccgcauccgccgggcgg

SEQ ID NO: 2989739 - RNA, 21 nt, Mycobacterium avium subsp. paratuberculosis
cccgcauccgccgggcggcgu

SEQ ID NO: 2989740 - RNA, 12 nt, Mycobacterium avium subsp. paratuberculosis
cccgcaucgcac

SEQ ID NO: 2989741 - RNA, 14 nt, Mycobacterium avium subsp. paratuberculosis
cccgcaucgcacag

SEQ ID NO: 2989742 - RNA, 15 nt, Mycobacterium avium subsp. paratuberculosis
cccgcaucgccgaac

SEQ ID NO: 2989743 - RNA, 14 nt, Mycobacterium avium subsp. paratuberculosis
cccgcaucgcggcg

SEQ ID NO: 2989744 - RNA, 17 nt, Mycobacterium avium subsp. paratuberculosis
cccgcaucgcggcgaug

SEQ ID NO: 2989745 - RNA, 23 nt, Mycobacterium avium subsp. paratuberculosis
cccgcauguucucgagcccgauc

SEQ ID NO: 2989746 - RNA, 15 nt, Mycobacterium avium subsp. paratuberculosis
cccgccaaucaccgc

SEQ ID NO: 2989747 - RNA, 15 nt, Mycobacterium avium subsp. paratuberculosis
cccgccacggccagc

SEQ ID NO: 2989748 - RNA, 16 nt, Mycobacterium avium subsp. paratuberculosis
cccgccacggccagca

SEQ ID NO: 2989749 - RNA, 19 nt, Mycobacterium avium subsp. paratuberculosis
cccgccacggccagcaccg

SEQ ID NO: 2989750 - RNA, 15 nt, Mycobacterium avium subsp. paratuberculosis
cccgccacgugcggc

SEQ ID NO: 2989751 - RNA, 18 nt, Mycobacterium avium subsp. paratuberculosis
cccgccacgugcggcugc

SEQ ID NO: 2989752 - RNA, 20 nt, Mycobacterium avium subsp. paratuberculosis
cccgccagauagggcagcgu

SEQ ID NO: 2989753 - RNA, 12 nt, Mycobacterium avium subsp. paratuberculosis
cccgccagaucg

SEQ ID NO: 2989754 - RNA, 15 nt, Mycobacterium avium subsp. paratuberculosis
cccgccagcaccgac

SEQ ID NO: 2989755 - RNA, 16 nt, Mycobacterium avium subsp. paratuberculosis
cccgccagcagaugcc

SEQ ID NO: 2989756 - RNA, 20 nt, Mycobacterium avium subsp. paratuberculosis
cccgccagcagaugccgccc

SEQ ID NO: 2989757 - RNA, 15 nt, Mycobacterium avium subsp. paratuberculosis
cccgccagcccgcgu

SEQ ID NO: 2989758 - RNA, 16 nt, Mycobacterium avium subsp. paratuberculosis
cccgccagcccgcguc

SEQ ID NO: 2989759 - RNA, 15 nt, Mycobacterium avium subsp. paratuberculosis
cccgccaggcggcga

SEQ ID NO: 2989760 - RNA, 19 nt, Mycobacterium avium subsp. paratuberculosis
cccgccagggcgacgccgc

SEQ ID NO: 2989761 - RNA, 22 nt, Mycobacterium avium subsp. paratuberculosis
cccgccagggcgacgccgcgga

SEQ ID NO: 2989762 - RNA, 20 nt, Mycobacterium avium subsp. paratuberculosis
cccgccaguucccggccagc

SEQ ID NO: 2989763 - RNA, 13 nt, Mycobacterium avium subsp. paratuberculosis
cccgccaucgccc

SEQ ID NO: 2989764 - RNA, 16 nt, Mycobacterium avium subsp. paratuberculosis
cccgccaucgcccggu

SEQ ID NO: 2989765 - RNA, 13 nt, Mycobacterium avium subsp. paratuberculosis
cccgccaucugga

SEQ ID NO: 2989766 - RNA, 16 nt, Mycobacterium avium subsp. paratuberculosis
cccgccauggcggcau

SEQ ID NO: 2989767 - RNA, 17 nt, Mycobacterium avium subsp. paratuberculosis
cccgccauggcggcauc

SEQ ID NO: 2989768 - RNA, 22 nt, Mycobacterium avium subsp. paratuberculosis
cccgcccaccacgaacgcgccg

SEQ ID NO: 2989769 - RNA, 20 nt, Mycobacterium avium subsp. paratuberculosis
cccgcccacgggucgccgau

SEQ ID NO: 2989770 - RNA, 14 nt, Mycobacterium avium subsp. paratuberculosis
cccgcccagcacca

SEQ ID NO: 2989771 - RNA, 16 nt, Mycobacterium avium subsp. paratuberculosis
cccgcccagcgcagca

SEQ ID NO: 2989772 - RNA, 23 nt, Mycobacterium avium subsp. paratuberculosis
cccgcccagcugcacccaccggc

SEQ ID NO: 2989773 - RNA, 13 nt, Mycobacterium avium subsp. paratuberculosis
cccgcccaggccg

SEQ ID NO: 2989774 - RNA, 14 nt, Mycobacterium avium subsp. paratuberculosis
cccgcccaggccgc

SEQ ID NO: 2989775 - RNA, 14 nt, Mycobacterium avium subsp. paratuberculosis
cccgccccagcccg

SEQ ID NO: 2989776 - RNA, 14 nt, Mycobacterium avium subsp. paratuberculosis
cccgccccgacagc

SEQ ID NO: 2989777 - RNA, 13 nt, Mycobacterium avium subsp. paratuberculosis
cccgccccgccgc

SEQ ID NO: 2989778 - RNA, 19 nt, Mycobacterium avium subsp. paratuberculosis
cccgcccgagcgucauucc

SEQ ID NO: 2989779 - RNA, 15 nt, Mycobacterium avium subsp. paratuberculosis
cccgcccgccgggca

SEQ ID NO: 2989780 - RNA, 14 nt, Mycobacterium avium subsp. paratuberculosis
cccgcccggacgcg

SEQ ID NO: 2989781 - RNA, 15 nt, Mycobacterium avium subsp. paratuberculosis
cccgcccggacgcgc

SEQ ID NO: 2989782 - RNA, 12 nt, Mycobacterium avium subsp. paratuberculosis
cccgcccggcac

SEQ ID NO: 2989783 - RNA, 13 nt, Mycobacterium avium subsp. paratuberculosis
cccgcccggcacg

SEQ ID NO: 2989784 - RNA, 11 nt, Mycobacterium avium subsp. paratuberculosis
cccgcccggcc

SEQ ID NO: 2989785 - RNA, 12 nt, Mycobacterium avium subsp. paratuberculosis
cccgcccggccc

SEQ ID NO: 2989786 - RNA, 14 nt, Mycobacterium avium subsp. paratuberculosis
cccgcccggcccgg

SEQ ID NO: 2989787 - RNA, 15 nt, Mycobacterium avium subsp. paratuberculosis
cccgcccggcccggc

SEQ ID NO: 2989788 - RNA, 13 nt, Mycobacterium avium subsp. paratuberculosis
cccgcccggcgcc

SEQ ID NO: 2989789 - RNA, 15 nt, Mycobacterium avium subsp. paratuberculosis
cccgcccggcgccgg

SEQ ID NO: 2989790 - RNA, 16 nt, Mycobacterium avium subsp. paratuberculosis
cccgcccggcgccggc

SEQ ID NO: 2989791 - RNA, 18 nt, Mycobacterium avium subsp. paratuberculosis
cccgcccggcgccggccg

SEQ ID NO: 2989792 - RNA, 12 nt, Mycobacterium avium subsp. paratuberculosis
cccgcccggcgg

SEQ ID NO: 2989793 - RNA, 12 nt, Mycobacterium avium subsp. paratuberculosis
cccgcccggggc

SEQ ID NO: 2989794 - RNA, 14 nt, Mycobacterium avium subsp. paratuberculosis
cccgcccgggucgu

SEQ ID NO: 2989795 - RNA, 13 nt, Mycobacterium avium subsp. paratuberculosis
cccgcccucgccc

SEQ ID NO: 2989796 - RNA, 15 nt, Mycobacterium avium subsp. paratuberculosis
cccgcccucgccccg

SEQ ID NO: 2989797 - RNA, 17 nt, Mycobacterium avium subsp. paratuberculosis
cccgcccucgccccgga

SEQ ID NO: 2989798 - RNA, 24 nt, Mycobacterium avium subsp. paratuberculosis
cccgcccuggcuguagcggucgug

SEQ ID NO: 2989799 - RNA, 14 nt, Mycobacterium avium subsp. paratuberculosis
cccgcccuugaacg

SEQ ID NO: 2989800 - RNA, 20 nt, Mycobacterium avium subsp. paratuberculosis
cccgcccuugaacggcacca

SEQ ID NO: 2989801 - RNA, 21 nt, Mycobacterium avium subsp. paratuberculosis
cccgcccuugaacggcaccag

SEQ ID NO: 2989802 - RNA, 19 nt, Mycobacterium avium subsp. paratuberculosis
cccgccgaacaccggcagc

SEQ ID NO: 2989803 - RNA, 19 nt, Mycobacterium avium subsp. paratuberculosis
cccgccgaacccgcccucg

SEQ ID NO: 2989804 - RNA, 19 nt, Mycobacterium avium subsp. paratuberculosis
cccgccgaacgccuccgcc

SEQ ID NO: 2989805 - RNA, 23 nt, Mycobacterium avium subsp. paratuberculosis
cccgccgaacgccuccgccgccc

SEQ ID NO: 2989806 - RNA, 14 nt, Mycobacterium avium subsp. paratuberculosis
cccgccgaccaccu

SEQ ID NO: 2989807 - RNA, 23 nt, Mycobacterium avium subsp. paratuberculosis
cccgccgaccaccuugcgcagca

SEQ ID NO: 2989808 - RNA, 21 nt, Mycobacterium avium subsp. paratuberculosis
cccgccgaccgguccgccgcc

SEQ ID NO: 2989809 - RNA, 22 nt, Mycobacterium avium subsp. paratuberculosis
cccgccgaccgguccgccgccg

SEQ ID NO: 2989810 - RNA, 14 nt, Mycobacterium avium subsp. paratuberculosis
cccgccgacgccug

SEQ ID NO: 2989811 - RNA, 15 nt, Mycobacterium avium subsp. paratuberculosis
cccgccgacgccugc

SEQ ID NO: 2989812 - RNA, 19 nt, Mycobacterium avium subsp. paratuberculosis
cccgccgacgccugcgcga

SEQ ID NO: 2989813 - RNA, 11 nt, Mycobacterium avium subsp. paratuberculosis
cccgccgacgg

SEQ ID NO: 2989814 - RNA, 21 nt, Mycobacterium avium subsp. paratuberculosis
cccgccgacggagacgaccag

SEQ ID NO: 2989815 - RNA, 18 nt, Mycobacterium avium subsp. paratuberculosis
cccgccgagauccaccgc

SEQ ID NO: 2989816 - RNA, 19 nt, Mycobacterium avium subsp. paratuberculosis
cccgccgagauccaccgcg

SEQ ID NO: 2989817 - RNA, 17 nt, Mycobacterium avium subsp. paratuberculosis
cccgccgaucgaucagc

SEQ ID NO: 2989818 - RNA, 22 nt, Mycobacterium avium subsp. paratuberculosis
cccgccgaucgaucagccgcga

SEQ ID NO: 2989819 - RNA, 16 nt, Mycobacterium avium subsp. paratuberculosis
cccgccgauggacacg

SEQ ID NO: 2989820 - RNA, 19 nt, Mycobacterium avium subsp. paratuberculosis
cccgccgauggacacgcug

SEQ ID NO: 2989821 - RNA, 18 nt, Mycobacterium avium subsp. paratuberculosis
cccgccgcaacagccggc

SEQ ID NO: 2989822 - RNA, 21 nt, Mycobacterium avium subsp. paratuberculosis
cccgccgcaacagccggcccg

SEQ ID NO: 2989823 - RNA, 20 nt, Mycobacterium avium subsp. paratuberculosis
cccgccgcaccucgccggcc

SEQ ID NO: 2989824 - RNA, 13 nt, Mycobacterium avium subsp. paratuberculosis
cccgccgcagccc

SEQ ID NO: 2989825 - RNA, 14 nt, Mycobacterium avium subsp. paratuberculosis
cccgccgccaccac

SEQ ID NO: 2989826 - RNA, 13 nt, Mycobacterium avium subsp. paratuberculosis
cccgccgccgaug

SEQ ID NO: 2989827 - RNA, 13 nt, Mycobacterium avium subsp. paratuberculosis
cccgccgccgcgg

SEQ ID NO: 2989828 - RNA, 16 nt, Mycobacterium avium subsp. paratuberculosis
cccgccgccgcgggug

SEQ ID NO: 2989829 - RNA, 15 nt, Mycobacterium avium subsp. paratuberculosis
cccgccgccggcgcu

SEQ ID NO: 2989830 - RNA, 13 nt, Mycobacterium avium subsp. paratuberculosis
cccgccgccgucg

SEQ ID NO: 2989831 - RNA, 15 nt, Mycobacterium avium subsp. paratuberculosis
cccgccgccgugcau

SEQ ID NO: 2989832 - RNA, 12 nt, Mycobacterium avium subsp. paratuberculosis
cccgccgcgacc

SEQ ID NO: 2989833 - RNA, 15 nt, Mycobacterium avium subsp. paratuberculosis
cccgccgcgaccgcg

SEQ ID NO: 2989834 - RNA, 13 nt, Mycobacterium avium subsp. paratuberculosis
cccgccgcgagca

SEQ ID NO: 2989835 - RNA, 14 nt, Mycobacterium avium subsp. paratuberculosis
cccgccgcgagccg

SEQ ID NO: 2989836 - RNA, 17 nt, Mycobacterium avium subsp. paratuberculosis
cccgccgcgagccgccc

SEQ ID NO: 2989837 - RNA, 12 nt, Mycobacterium avium subsp. paratuberculosis
cccgccgcgccc

SEQ ID NO: 2989838 - RNA, 14 nt, Mycobacterium avium subsp. paratuberculosis
cccgccgcgcccgg

SEQ ID NO: 2989839 - RNA, 16 nt, Mycobacterium avium subsp. paratuberculosis
cccgccgcgcccggcu

SEQ ID NO: 2989840 - RNA, 17 nt, Mycobacterium avium subsp. paratuberculosis
cccgccgcgcccggcuu

SEQ ID NO: 2989841 - RNA, 11 nt, Mycobacterium avium subsp. paratuberculosis
cccgccgcggc

SEQ ID NO: 2989842 - RNA, 12 nt, Mycobacterium avium subsp. paratuberculosis
cccgccgcggca

SEQ ID NO: 2989843 - RNA, 13 nt, Mycobacterium avium subsp. paratuberculosis
cccgccgcggcaa

SEQ ID NO: 2989844 - RNA, 17 nt, Mycobacterium avium subsp. paratuberculosis
cccgccgcggcaacgcc

SEQ ID NO: 2989845 - RNA, 13 nt, Mycobacterium avium subsp. paratuberculosis
cccgccgcggcca

SEQ ID NO: 2989846 - RNA, 16 nt, Mycobacterium avium subsp. paratuberculosis
cccgccgcggccgcug

SEQ ID NO: 2989847 - RNA, 12 nt, Mycobacterium avium subsp. paratuberculosis
cccgccgcggcg

SEQ ID NO: 2989848 - RNA, 15 nt, Mycobacterium avium subsp. paratuberculosis
cccgccgcggcgagc

SEQ ID NO: 2989849 - RNA, 20 nt, Mycobacterium avium subsp. paratuberculosis
cccgccgcguacaccggcug

SEQ ID NO: 2989850 - RNA, 14 nt, Mycobacterium avium subsp. paratuberculosis
cccgccgcgucagc

SEQ ID NO: 2989851 - RNA, 16 nt, Mycobacterium avium subsp. paratuberculosis
cccgccgcgucgguca

SEQ ID NO: 2989852 - RNA, 22 nt, Mycobacterium avium subsp. paratuberculosis
cccgccgcgucggucagcgcca

SEQ ID NO: 2989853 - RNA, 16 nt, Mycobacterium avium subsp. paratuberculosis
cccgccgcucaccgcc

SEQ ID NO: 2989854 - RNA, 18 nt, Mycobacterium avium subsp. paratuberculosis
cccgccgcucaccgccga

SEQ ID NO: 2989855 - RNA, 16 nt, Mycobacterium avium subsp. paratuberculosis
cccgccgcugacgcgg

SEQ ID NO: 2989856 - RNA, 17 nt, Mycobacterium avium subsp. paratuberculosis
cccgccgcugacgcggc

SEQ ID NO: 2989857 - RNA, 14 nt, Mycobacterium avium subsp. paratuberculosis
cccgccgcugcagc

SEQ ID NO: 2989858 - RNA, 15 nt, Mycobacterium avium subsp. paratuberculosis
cccgccggaacucgg

SEQ ID NO: 2989859 - RNA, 17 nt, Mycobacterium avium subsp. paratuberculosis
cccgccggaacucggcc

SEQ ID NO: 2989860 - RNA, 19 nt, Mycobacterium avium subsp. paratuberculosis
cccgccggaacucggccgg

SEQ ID NO: 2989861 - RNA, 20 nt, Mycobacterium avium subsp. paratuberculosis
cccgccggaacucggccggc

SEQ ID NO: 2989862 - RNA, 21 nt, Mycobacterium avium subsp. paratuberculosis
cccgccggaacucggccggca

SEQ ID NO: 2989863 - RNA, 22 nt, Mycobacterium avium subsp. paratuberculosis
cccgccggaacucggccggcac

SEQ ID NO: 2989864 - RNA, 13 nt, Mycobacterium avium subsp. paratuberculosis
cccgccggagaug

SEQ ID NO: 2989865 - RNA, 14 nt, Mycobacterium avium subsp. paratuberculosis
cccgccggagccga

SEQ ID NO: 2989866 - RNA, 13 nt, Mycobacterium avium subsp. paratuberculosis
cccgccggcccgg

SEQ ID NO: 2989867 - RNA, 20 nt, Mycobacterium avium subsp. paratuberculosis
cccgccggcgaacgacgucg

SEQ ID NO: 2989868 - RNA, 14 nt, Mycobacterium avium subsp. paratuberculosis
cccgccggcggcca

SEQ ID NO: 2989869 - RNA, 12 nt, Mycobacterium avium subsp. paratuberculosis
cccgccggcggg

SEQ ID NO: 2989870 - RNA, 13 nt, Mycobacterium avium subsp. paratuberculosis
cccgccggcgggu

SEQ ID NO: 2989871 - RNA, 20 nt, Mycobacterium avium subsp. paratuberculosis
cccgccgggaucggcggggc

SEQ ID NO: 2989872 - RNA, 21 nt, Mycobacterium avium subsp. paratuberculosis
cccgccgggaucggcggggcg

SEQ ID NO: 2989873 - RNA, 12 nt, Mycobacterium avium subsp. paratuberculosis
cccgccgggaug

SEQ ID NO: 2989874 - RNA, 20 nt, Mycobacterium avium subsp. paratuberculosis
cccgccgggcacccgggugg

SEQ ID NO: 2989875 - RNA, 15 nt, Mycobacterium avium subsp. paratuberculosis
cccgccgggccggau

SEQ ID NO: 2989876 - RNA, 16 nt, Mycobacterium avium subsp. paratuberculosis
cccgccgggccggauc

SEQ ID NO: 2989877 - RNA, 22 nt, Mycobacterium avium subsp. paratuberculosis
cccgccgggccggaucgcgcag

SEQ ID NO: 2989878 - RNA, 14 nt, Mycobacterium avium subsp. paratuberculosis
cccgccgggcgcca

SEQ ID NO: 2989879 - RNA, 23 nt, Mycobacterium avium subsp. paratuberculosis
cccgccgggcugaccgucgacca

SEQ ID NO: 2989880 - RNA, 18 nt, Mycobacterium avium subsp. paratuberculosis
cccgccggggccggcgau

SEQ ID NO: 2989881 - RNA, 16 nt, Mycobacterium avium subsp. paratuberculosis
cccgccgggguccgca

SEQ ID NO: 2989882 - RNA, 19 nt, Mycobacterium avium subsp. paratuberculosis
cccgccggguggccgccac

SEQ ID NO: 2989883 - RNA, 18 nt, Mycobacterium avium subsp. paratuberculosis
cgcgagcugcuucgucgc

SEQ ID NO: 2989884 - RNA, 19 nt, Mycobacterium avium subsp. paratuberculosis
cgcgagcugcuucgucgcc

SEQ ID NO: 2989885 - RNA, 21 nt, Mycobacterium avium subsp. paratuberculosis
cgcgagcugcuucgucgccgg

SEQ ID NO: 2989886 - RNA, 17 nt, Mycobacterium avium subsp. paratuberculosis
cgcgaggaaucgcggca

SEQ ID NO: 2989887 - RNA, 18 nt, Mycobacterium avium subsp. paratuberculosis
cgcgaggacgauggacga

SEQ ID NO: 2989888 - RNA, 13 nt, Mycobacterium avium subsp. paratuberculosis
cgcgaggccgcca

SEQ ID NO: 2989889 - RNA, 15 nt, Mycobacterium avium subsp. paratuberculosis
cgcgaggcgcaguag

SEQ ID NO: 2989890 - RNA, 14 nt, Mycobacterium avium subsp. paratuberculosis
cgcgaggcgcgaaa

SEQ ID NO: 2989891 - RNA, 12 nt, Mycobacterium avium subsp. paratuberculosis
cgcgaggcgcgg

SEQ ID NO: 2989892 - RNA, 18 nt, Mycobacterium avium subsp. paratuberculosis
cgcgaggcgcggggcgcg

SEQ ID NO: 2989893 - RNA, 23 nt, Mycobacterium avium subsp. paratuberculosis
cgcgaggcgcggggcgcgaggcg

SEQ ID NO: 2989894 - RNA, 18 nt, Mycobacterium avium subsp. paratuberculosis
cgcgagggccguugcggc

SEQ ID NO: 2989895 - RNA, 15 nt, Mycobacterium avium subsp. paratuberculosis
cgcgagggcgggcca

SEQ ID NO: 2989896 - RNA, 17 nt, Mycobacterium avium subsp. paratuberculosis
cgcgagguccuugcgga

SEQ ID NO: 2989897 - RNA, 19 nt, Mycobacterium avium subsp. paratuberculosis
cgcggccagcggcgccgaa

SEQ ID NO: 2989898 - RNA, 13 nt, Mycobacterium avium subsp. paratuberculosis
cgcggccagcgug

SEQ ID NO: 2989899 - RNA, 14 nt, Mycobacterium avium subsp. paratuberculosis
cgcggccagcguga

SEQ ID NO: 2989900 - RNA, 19 nt, Mycobacterium avium subsp. paratuberculosis
cgcggccagcgugaacacc

SEQ ID NO: 2989901 - RNA, 17 nt, Mycobacterium avium subsp. paratuberculosis
cgcggccagcuccgggu

SEQ ID NO: 2989902 - RNA, 22 nt, Mycobacterium avium subsp. paratuberculosis
cgcggccagcuccgggucgacc

SEQ ID NO: 2989903 - RNA, 13 nt, Mycobacterium avium subsp. paratuberculosis
cgcggccagcucg

SEQ ID NO: 2989904 - RNA, 14 nt, Mycobacterium avium subsp. paratuberculosis
cgcggccagcucgg

SEQ ID NO: 2989905 - RNA, 23 nt, Mycobacterium avium subsp. paratuberculosis
cgcggccagcugcgacagcacgg

SEQ ID NO: 2989906 - RNA, 11 nt, Mycobacterium avium subsp. paratuberculosis
cgcggccaggg

SEQ ID NO: 2989907 - RNA, 11 nt, Mycobacterium avium subsp. paratuberculosis
cgcggccaggu

SEQ ID NO: 2989908 - RNA, 17 nt, Mycobacterium avium subsp. paratuberculosis
cgcggccaggucgaggu

SEQ ID NO: 2989909 - RNA, 15 nt, Mycobacterium avium subsp. paratuberculosis
cgcggcccaccgcgu

SEQ ID NO: 2989910 - RNA, 13 nt, Mycobacterium avium subsp. paratuberculosis
cgcggcccagcac

SEQ ID NO: 2989911 - RNA, 14 nt, Mycobacterium avium subsp. paratuberculosis
cgcggcccagcacc

SEQ ID NO: 2989912 - RNA, 16 nt, Mycobacterium avium subsp. paratuberculosis
cgcggcccagcaccac

SEQ ID NO: 2989913 - RNA, 18 nt, Mycobacterium avium subsp. paratuberculosis
cgcggcccagcaccaccu

SEQ ID NO: 2989914 - RNA, 12 nt, Mycobacterium avium subsp. paratuberculosis
cgcggcccaggg

SEQ ID NO: 2989915 - RNA, 13 nt, Mycobacterium avium subsp. paratuberculosis
cgcggcccauggg

SEQ ID NO: 2989916 - RNA, 16 nt, Mycobacterium avium subsp. paratuberculosis
cgcggcccauggggga

SEQ ID NO: 2989917 - RNA, 18 nt, Mycobacterium avium subsp. paratuberculosis
cgcggcccccacgcagcg

SEQ ID NO: 2989918 - RNA, 17 nt, Mycobacterium avium subsp. paratuberculosis
cgcggcccccugaucgg

SEQ ID NO: 2989919 - RNA, 19 nt, Mycobacterium avium subsp. paratuberculosis
cgcggcccccugaucggcc

SEQ ID NO: 2989920 - RNA, 21 nt, Mycobacterium avium subsp. paratuberculosis
cgcggcccccugaucggccgc

SEQ ID NO: 2989921 - RNA, 22 nt, Mycobacterium avium subsp. paratuberculosis
cgcggcccccugaucggccgca

SEQ ID NO: 2989922 - RNA, 22 nt, Mycobacterium avium subsp. paratuberculosis
cgcggcccgccgaacgccuccg

SEQ ID NO: 2989923 - RNA, 16 nt, Mycobacterium avium subsp. paratuberculosis
cgcggcccgccgcuca

SEQ ID NO: 2989924 - RNA, 18 nt, Mycobacterium avium subsp. paratuberculosis
cgcggcccgccgcucacc

SEQ ID NO: 2989925 - RNA, 20 nt, Mycobacterium avium subsp. paratuberculosis
cgcggcccgccgcucaccgc

SEQ ID NO: 2989926 - RNA, 11 nt, Mycobacterium avium subsp. paratuberculosis
cgcggcccgcg

SEQ ID NO: 2989927 - RNA, 16 nt, Mycobacterium avium subsp. paratuberculosis
cgcggcccgcgacguc

SEQ ID NO: 2989928 - RNA, 12 nt, Mycobacterium avium subsp. paratuberculosis
cgcggcccgcgg

SEQ ID NO: 2989929 - RNA, 17 nt, Mycobacterium avium subsp. paratuberculosis
cgcggcccgcggcguca

SEQ ID NO: 2989930 - RNA, 14 nt, Mycobacterium avium subsp. paratuberculosis
cgcggcccgcgggg

SEQ ID NO: 2989931 - RNA, 14 nt, Mycobacterium avium subsp. paratuberculosis
cgcggcccggccac

SEQ ID NO: 2989932 - RNA, 15 nt, Mycobacterium avium subsp. paratuberculosis
cgcggcccggccacc

SEQ ID NO: 2989933 - RNA, 16 nt, Mycobacterium avium subsp. paratuberculosis
cgcggcccggccacca

SEQ ID NO: 2989934 - RNA, 18 nt, Mycobacterium avium subsp. paratuberculosis
cgcggcccggccaccagg

SEQ ID NO: 2989935 - RNA, 19 nt, Mycobacterium avium subsp. paratuberculosis
cgcggcccggcccgcuggc

SEQ ID NO: 2989936 - RNA, 22 nt, Mycobacterium avium subsp. paratuberculosis
cgcggcccggcccgcuggccgc

SEQ ID NO: 2989937 - RNA, 18 nt, Mycobacterium avium subsp. paratuberculosis
cgcggcccguacucgggu

SEQ ID NO: 2989938 - RNA, 19 nt, Mycobacterium avium subsp. paratuberculosis
cgcggcccguacucgggug

SEQ ID NO: 2989939 - RNA, 19 nt, Mycobacterium avium subsp. paratuberculosis
cgcggcccguugagcaccg

SEQ ID NO: 2989940 - RNA, 21 nt, Mycobacterium avium subsp. paratuberculosis
cgcggcccguugagcaccgcg

SEQ ID NO: 2989941 - RNA, 14 nt, Mycobacterium avium subsp. paratuberculosis
cgcggcccugcagc

SEQ ID NO: 2989942 - RNA, 17 nt, Mycobacterium avium subsp. paratuberculosis
cgcggcccuggauguca

SEQ ID NO: 2989943 - RNA, 19 nt, Mycobacterium avium subsp. paratuberculosis
cgcggccgaaaucaacgcg

SEQ ID NO: 2989944 - RNA, 23 nt, Mycobacterium avium subsp. paratuberculosis
cgcggccgaaaucaacgcgccga

SEQ ID NO: 2989945 - RNA, 13 nt, Mycobacterium avium subsp. paratuberculosis
cgcggccgaaccg

SEQ ID NO: 2989946 - RNA, 14 nt, Mycobacterium avium subsp. paratuberculosis
cgcggccgaaccgc

SEQ ID NO: 2989947 - RNA, 23 nt, Mycobacterium avium subsp. paratuberculosis
cgcggccgagccgaggccgaugg

SEQ ID NO: 2989948 - RNA, 17 nt, Mycobacterium avium subsp. paratuberculosis
cgcggccgauucggcgc

SEQ ID NO: 2989949 - RNA, 20 nt, Mycobacterium avium subsp. paratuberculosis
cgcggccgauucggcgccgc

SEQ ID NO: 2989950 - RNA, 12 nt, Mycobacterium avium subsp. paratuberculosis
cgcggccgcaug

SEQ ID NO: 2989951 - RNA, 12 nt, Mycobacterium avium subsp. paratuberculosis
cgcggccgccag

SEQ ID NO: 2989952 - RNA, 13 nt, Mycobacterium avium subsp. paratuberculosis
cgcggccgccagc

SEQ ID NO: 2989953 - RNA, 16 nt, Mycobacterium avium subsp. paratuberculosis
cgcggccgccagcgca

SEQ ID NO: 2989954 - RNA, 19 nt, Mycobacterium avium subsp. paratuberculosis
cgcggccgccagcgcaccg

SEQ ID NO: 2989955 - RNA, 21 nt, Mycobacterium avium subsp. paratuberculosis
cgcggccgccagcgcaccgag

SEQ ID NO: 2989956 - RNA, 14 nt, Mycobacterium avium subsp. paratuberculosis
cgcggccgccaggu

SEQ ID NO: 2989957 - RNA, 16 nt, Mycobacterium avium subsp. paratuberculosis
cgcggccgccaggucg

SEQ ID NO: 2989958 - RNA, 22 nt, Mycobacterium avium subsp. paratuberculosis
cgcggccgccaggucggggccc

SEQ ID NO: 2989959 - RNA, 22 nt, Mycobacterium avium subsp. paratuberculosis
cgcggccgccaucgaucgggcg

SEQ ID NO: 2989960 - RNA, 12 nt, Mycobacterium avium subsp. paratuberculosis
cgcggccgccca

SEQ ID NO: 2989961 - RNA, 14 nt, Mycobacterium avium subsp. paratuberculosis
cgcggccgcccagc

SEQ ID NO: 2989962 - RNA, 15 nt, Mycobacterium avium subsp. paratuberculosis
cgcggccgcccagcc

SEQ ID NO: 2989963 - RNA, 19 nt, Mycobacterium avium subsp. paratuberculosis
cgcggccgcccagcccgcg

SEQ ID NO: 2989964 - RNA, 14 nt, Mycobacterium avium subsp. paratuberculosis
cgcggccgcccggu

SEQ ID NO: 2989965 - RNA, 17 nt, Mycobacterium avium subsp. paratuberculosis
cgcggccgcccgguccg

SEQ ID NO: 2989966 - RNA, 21 nt, Mycobacterium avium subsp. paratuberculosis
cgcggccgcccgucggggccc

SEQ ID NO: 2989967 - RNA, 14 nt, Mycobacterium avium subsp. paratuberculosis
cgcggccgccgccg

SEQ ID NO: 2989968 - RNA, 17 nt, Mycobacterium avium subsp. paratuberculosis
cgcggccgccgccgcgg

SEQ ID NO: 2989969 - RNA, 18 nt, Mycobacterium avium subsp. paratuberculosis
cgcggccgccgccgcggc

SEQ ID NO: 2989970 - RNA, 23 nt, Mycobacterium avium subsp. paratuberculosis
cgcggccgccgccgcggccgcgg

SEQ ID NO: 2989971 - RNA, 16 nt, Mycobacterium avium subsp. paratuberculosis
cgcggccgccgcgacg

SEQ ID NO: 2989972 - RNA, 21 nt, Mycobacterium avium subsp. paratuberculosis
cgcggccgccgcgacggccgc

SEQ ID NO: 2989973 - RNA, 22 nt, Mycobacterium avium subsp. paratuberculosis
cgcggccgccgcgacggccgcc

SEQ ID NO: 2989974 - RNA, 13 nt, Mycobacterium avium subsp. paratuberculosis
cgcggccgccggg

SEQ ID NO: 2989975 - RNA, 14 nt, Mycobacterium avium subsp. paratuberculosis
cgcggccgccgggg

SEQ ID NO: 2989976 - RNA, 13 nt, Mycobacterium avium subsp. paratuberculosis
cgcggccgccucc

SEQ ID NO: 2989977 - RNA, 20 nt, Mycobacterium avium subsp. paratuberculosis
cgcggccgccucccgcagcg

SEQ ID NO: 2989978 - RNA, 23 nt, Mycobacterium avium subsp. paratuberculosis
cgcggccgccucccgcagcgcca

SEQ ID NO: 2989979 - RNA, 16 nt, Mycobacterium avium subsp. paratuberculosis
cgcggccgccuucacg

SEQ ID NO: 2989980 - RNA, 24 nt, Mycobacterium avium subsp. paratuberculosis
cgcggccgccuucacgaccggcag

SEQ ID NO: 2989981 - RNA, 15 nt, Mycobacterium avium subsp. paratuberculosis
cgcggccgcgccggc

SEQ ID NO: 2989982 - RNA, 13 nt, Mycobacterium avium subsp. paratuberculosis
cgccggcacaccg

SEQ ID NO: 2989983 - RNA, 14 nt, Mycobacterium avium subsp. paratuberculosis
cgccggcacaccga

SEQ ID NO: 2989984 - RNA, 15 nt, Mycobacterium avium subsp. paratuberculosis
cgccggcacaccgag

SEQ ID NO: 2989985 - RNA, 16 nt, Mycobacterium avium subsp. paratuberculosis
cgccggcacaccgagc

SEQ ID NO: 2989986 - RNA, 15 nt, Mycobacterium avium subsp. paratuberculosis
cgccggcaccagcag

SEQ ID NO: 2989987 - RNA, 15 nt, Mycobacterium avium subsp. paratuberculosis
cgccggcaccguccg

SEQ ID NO: 2989988 - RNA, 15 nt, Mycobacterium avium subsp. paratuberculosis
cgccggcacucgucg

SEQ ID NO: 2989989 - RNA, 16 nt, Mycobacterium avium subsp. paratuberculosis
cgccggcacucgucgu

SEQ ID NO: 2989990 - RNA, 13 nt, Mycobacterium avium subsp. paratuberculosis
cgccggcacugcu

SEQ ID NO: 2989991 - RNA, 15 nt, Mycobacterium avium subsp. paratuberculosis
cgccggcacugcugc

SEQ ID NO: 2989992 - RNA, 20 nt, Mycobacterium avium subsp. paratuberculosis
cgccggcacugcugcccgcg

SEQ ID NO: 2989993 - RNA, 14 nt, Mycobacterium avium subsp. paratuberculosis
cgccggcagcaacc

SEQ ID NO: 2989994 - RNA, 19 nt, Mycobacterium avium subsp. paratuberculosis
cgccggcagcaaccggcgg

SEQ ID NO: 2989995 - RNA, 21 nt, Mycobacterium avium subsp. paratuberculosis
cgccggcagcaaccggcggcu

SEQ ID NO: 2989996 - RNA, 12 nt, Mycobacterium avium subsp. paratuberculosis
cgccggcagccg

SEQ ID NO: 2989997 - RNA, 16 nt, Mycobacterium avium subsp. paratuberculosis
cgccggcagccgcucg

SEQ ID NO: 2989998 - RNA, 13 nt, Mycobacterium avium subsp. paratuberculosis
cgccggcagcggc

SEQ ID NO: 2989999 - RNA, 14 nt, Mycobacterium avium subsp. paratuberculosis
cgccggcagcggcc

SEQ ID NO: 2990000 - RNA, 15 nt, Mycobacterium avium subsp. paratuberculosis
cgccggcagcggccg

SEQ ID NO: 2990001 - RNA, 17 nt, Mycobacterium avium subsp. paratuberculosis
cgccggcagcggccgca

SEQ ID NO: 2990002 - RNA, 20 nt, Mycobacterium avium subsp. paratuberculosis
cgccggcagcggccgcaauc

SEQ ID NO: 2990003 - RNA, 16 nt, Mycobacterium avium subsp. paratuberculosis
cgccggcagcggcugc

SEQ ID NO: 2990004 - RNA, 13 nt, Mycobacterium avium subsp. paratuberculosis
cgccggcaguccg

SEQ ID NO: 2990005 - RNA, 15 nt, Mycobacterium avium subsp. paratuberculosis
cgccggcaguccgga

SEQ ID NO: 2990006 - RNA, 21 nt, Mycobacterium avium subsp. paratuberculosis
cgccggcaguccggacacggc

SEQ ID NO: 2990007 - RNA, 15 nt, Mycobacterium avium subsp. paratuberculosis
cgccggcauccagca

SEQ ID NO: 2990008 - RNA, 17 nt, Mycobacterium avium subsp. paratuberculosis
cgccggcauccagcacg

SEQ ID NO: 2990009 - RNA, 18 nt, Mycobacterium avium subsp. paratuberculosis
cgccggcauccagcacgg

SEQ ID NO: 2990010 - RNA, 19 nt, Mycobacterium avium subsp. paratuberculosis
cgccggcauccagcacggc

SEQ ID NO: 2990011 - RNA, 13 nt, Mycobacterium avium subsp. paratuberculosis
cgccggcaucgac

SEQ ID NO: 2990012 - RNA, 17 nt, Mycobacterium avium subsp. paratuberculosis
cgccggcaucgaccgcc

SEQ ID NO: 2990013 - RNA, 21 nt, Mycobacterium avium subsp. paratuberculosis
cgccggcaucgaccgcccgcu

SEQ ID NO: 2990014 - RNA, 12 nt, Mycobacterium avium subsp. paratuberculosis
cgccggccacca

SEQ ID NO: 2990015 - RNA, 14 nt, Mycobacterium avium subsp. paratuberculosis
cgccggccaccaac

SEQ ID NO: 2990016 - RNA, 20 nt, Mycobacterium avium subsp. paratuberculosis
cgccggccaccaacaggucg

SEQ ID NO: 2990017 - RNA, 14 nt, Mycobacterium avium subsp. paratuberculosis
cgccggccaccagg

SEQ ID NO: 2990018 - RNA, 18 nt, Mycobacterium avium subsp. paratuberculosis
cgccggccaccagggucu

SEQ ID NO: 2990019 - RNA, 22 nt, Mycobacterium avium subsp. paratuberculosis
cgccggccaccagggucucgcg

SEQ ID NO: 2990020 - RNA, 12 nt, Mycobacterium avium subsp. paratuberculosis
cgccggccagca

SEQ ID NO: 2990021 - RNA, 13 nt, Mycobacterium avium subsp. paratuberculosis
cgccggccagcac

SEQ ID NO: 2990022 - RNA, 15 nt, Mycobacterium avium subsp. paratuberculosis
cgccggccagcacca

SEQ ID NO: 2990023 - RNA, 17 nt, Mycobacterium avium subsp. paratuberculosis
cgccggccagcaccacg

SEQ ID NO: 2990024 - RNA, 16 nt, Mycobacterium avium subsp. paratuberculosis
cgccggccagcacgcc

SEQ ID NO: 2990025 - RNA, 17 nt, Mycobacterium avium subsp. paratuberculosis
cgccggccagcacgccg

SEQ ID NO: 2990026 - RNA, 18 nt, Mycobacterium avium subsp. paratuberculosis
cgccggccagcacgccgu

SEQ ID NO: 2990027 - RNA, 20 nt, Mycobacterium avium subsp. paratuberculosis
cgccggccagcacgccgucc

SEQ ID NO: 2990028 - RNA, 15 nt, Mycobacterium avium subsp. paratuberculosis
cgccggccagcacgg

SEQ ID NO: 2990029 - RNA, 20 nt, Mycobacterium avium subsp. paratuberculosis
cgccggccagcacggcggcg

SEQ ID NO: 2990030 - RNA, 12 nt, Mycobacterium avium subsp. paratuberculosis
cgccggccagcc

SEQ ID NO: 2990031 - RNA, 14 nt, Mycobacterium avium subsp. paratuberculosis
cgccggccagccgg

SEQ ID NO: 2990032 - RNA, 13 nt, Mycobacterium avium subsp. paratuberculosis
cgccggccagcgg

SEQ ID NO: 2990033 - RNA, 14 nt, Mycobacterium avium subsp. paratuberculosis
cgccggccagcggc

SEQ ID NO: 2990034 - RNA, 15 nt, Mycobacterium avium subsp. paratuberculosis
cgccggccagcuccg

SEQ ID NO: 2990035 - RNA, 21 nt, Mycobacterium avium subsp. paratuberculosis
cgccggccagcuccgccaccc

SEQ ID NO: 2990036 - RNA, 22 nt, Mycobacterium avium subsp. paratuberculosis
cgccggccagcuccgccacccu

SEQ ID NO: 2990037 - RNA, 21 nt, Mycobacterium avium subsp. paratuberculosis
cgccggccaggauggagcuga

SEQ ID NO: 2990038 - RNA, 15 nt, Mycobacterium avium subsp. paratuberculosis
cgccggccaggccgg

SEQ ID NO: 2990039 - RNA, 20 nt, Mycobacterium avium subsp. paratuberculosis
cgccggccaggccggccugc

SEQ ID NO: 2990040 - RNA, 13 nt, Mycobacterium avium subsp. paratuberculosis
cgccggccaggcg

SEQ ID NO: 2990041 - RNA, 14 nt, Mycobacterium avium subsp. paratuberculosis
cgccggccaggcga

SEQ ID NO: 2990042 - RNA, 13 nt, Mycobacterium avium subsp. paratuberculosis
cgccggcccagac

SEQ ID NO: 2990043 - RNA, 23 nt, Mycobacterium avium subsp. paratuberculosis
cgccggcccagacgguuccaccg

SEQ ID NO: 2990044 - RNA, 13 nt, Mycobacterium avium subsp. paratuberculosis
cgccggcccagcu

SEQ ID NO: 2990045 - RNA, 15 nt, Mycobacterium avium subsp. paratuberculosis
cgccggcccagcucc

SEQ ID NO: 2990046 - RNA, 19 nt, Mycobacterium avium subsp. paratuberculosis
cgccggcccagcuccacgc

SEQ ID NO: 2990047 - RNA, 21 nt, Mycobacterium avium subsp. paratuberculosis
cgccggcccagcuccacgcgu

SEQ ID NO: 2990048 - RNA, 13 nt, Mycobacterium avium subsp. paratuberculosis
cgccggccccggc

SEQ ID NO: 2990049 - RNA, 15 nt, Mycobacterium avium subsp. paratuberculosis
cgccggccccggcga

SEQ ID NO: 2990050 - RNA, 20 nt, Mycobacterium avium subsp. paratuberculosis
cgccggcccgaccggagccg

SEQ ID NO: 2990051 - RNA, 23 nt, Mycobacterium avium subsp. paratuberculosis
cgccggcccgaccggagccgucu

SEQ ID NO: 2990052 - RNA, 20 nt, Mycobacterium avium subsp. paratuberculosis
cgccggcccgauaggccgac

SEQ ID NO: 2990053 - RNA, 15 nt, Mycobacterium avium subsp. paratuberculosis
cgccggcccgcggcg

SEQ ID NO: 2990054 - RNA, 16 nt, Mycobacterium avium subsp. paratuberculosis
cgccggcccgcggcgg

SEQ ID NO: 2990055 - RNA, 16 nt, Mycobacterium avium subsp. paratuberculosis
cgccggcccggcguua

SEQ ID NO: 2990056 - RNA, 15 nt, Mycobacterium avium subsp. paratuberculosis
cgccggcccggucga

SEQ ID NO: 2990057 - RNA, 12 nt, Mycobacterium avium subsp. paratuberculosis
cgccggccgaca

SEQ ID NO: 2990058 - RNA, 15 nt, Mycobacterium avium subsp. paratuberculosis
cgccggccgccagcg

SEQ ID NO: 2990059 - RNA, 17 nt, Mycobacterium avium subsp. paratuberculosis
cgccggccgccagcgcc

SEQ ID NO: 2990060 - RNA, 18 nt, Mycobacterium avium subsp. paratuberculosis
cgccggccgccagcgccc

SEQ ID NO: 2990061 - RNA, 20 nt, Mycobacterium avium subsp. paratuberculosis
cgccggccgccagcgcccgc

SEQ ID NO: 2990062 - RNA, 15 nt, Mycobacterium avium subsp. paratuberculosis
cgccggccgccgcga

SEQ ID NO: 2990063 - RNA, 13 nt, Mycobacterium avium subsp. paratuberculosis
cgccggccgccgg

SEQ ID NO: 2990064 - RNA, 17 nt, Mycobacterium avium subsp. paratuberculosis
cgccggccgccggaucg

SEQ ID NO: 2990065 - RNA, 14 nt, Mycobacterium avium subsp. paratuberculosis
cgccggccgccgug

SEQ ID NO: 2990066 - RNA, 16 nt, Mycobacterium avium subsp. paratuberculosis
cgccggccgccguggc

SEQ ID NO: 2990067 - RNA, 14 nt, Mycobacterium avium subsp. paratuberculosis
cgccggccgcgcag

SEQ ID NO: 2990068 - RNA, 15 nt, Mycobacterium avium subsp. paratuberculosis
cgccggccgcgcaga

SEQ ID NO: 2990069 - RNA, 14 nt, Mycobacterium avium subsp. paratuberculosis
cgccggccgcgcgu

SEQ ID NO: 2990070 - RNA, 15 nt, Mycobacterium avium subsp. paratuberculosis
cgccggccgcgcgug

SEQ ID NO: 2990071 - RNA, 13 nt, Mycobacterium avium subsp. paratuberculosis
cgccggccgcggc

SEQ ID NO: 2990072 - RNA, 15 nt, Mycobacterium avium subsp. paratuberculosis
cgccggccgcggcgu

SEQ ID NO: 2990073 - RNA, 16 nt, Mycobacterium avium subsp. paratuberculosis
cgccggccgcgggcga

SEQ ID NO: 2990074 - RNA, 17 nt, Mycobacterium avium subsp. paratuberculosis
cgccggccgcgggcgau

SEQ ID NO: 2990075 - RNA, 13 nt, Mycobacterium avium subsp. paratuberculosis
cgccggccgcggu

SEQ ID NO: 2990076 - RNA, 16 nt, Mycobacterium avium subsp. paratuberculosis
cgccggccgcggugug

SEQ ID NO: 2990077 - RNA, 23 nt, Mycobacterium avium subsp. paratuberculosis
cgccggccgcggugugcccggcg

SEQ ID NO: 2990078 - RNA, 12 nt, Mycobacterium avium subsp. paratuberculosis
cgccggccgcuc

SEQ ID NO: 2990079 - RNA, 14 nt, Mycobacterium avium subsp. paratuberculosis
cgccggccgcucgc

SEQ ID NO: 2990080 - RNA, 16 nt, Mycobacterium avium subsp. paratuberculosis
cgccggccggagcgga

SEQ ID NO: 2990081 - RNA, 13 nt, Mycobacterium avium subsp. paratuberculosis
cgccggccggcac

SEQ ID NO: 2990082 - RNA, 20 nt, Mycobacterium avium subsp. paratuberculosis
cgccggccggcacgauggcg

SEQ ID NO: 2990083 - RNA, 14 nt, Mycobacterium avium subsp. paratuberculosis
cgccggccggcgcg

SEQ ID NO: 2990084 - RNA, 16 nt, Mycobacterium avium subsp. paratuberculosis
cgccggccggcgcgug

SEQ ID NO: 2990085 - RNA, 22 nt, Mycobacterium avium subsp. paratuberculosis
cgccggccggcgcgugcgcgac

SEQ ID NO: 2990086 - RNA, 23 nt, Mycobacterium avium subsp. paratuberculosis
cgccggccggcgcgugcgcgacg

SEQ ID NO: 2990087 - RNA, 16 nt, Mycobacterium avium subsp. paratuberculosis
cgccggccggcgguca

SEQ ID NO: 2990088 - RNA, 17 nt, Mycobacterium avium subsp. paratuberculosis
cgccggccggcggucag

SEQ ID NO: 2990089 - RNA, 13 nt, Mycobacterium avium subsp. paratuberculosis
cgccggccggcgu

SEQ ID NO: 2990090 - RNA, 14 nt, Mycobacterium avium subsp. paratuberculosis
cgccggccggcgug

SEQ ID NO: 2990091 - RNA, 13 nt, Mycobacterium avium subsp. paratuberculosis
cgccggccgggcg

SEQ ID NO: 2990092 - RNA, 23 nt, Mycobacterium avium subsp. paratuberculosis
cgccggccgggcugcgcagcacc

SEQ ID NO: 2990093 - RNA, 12 nt, Mycobacterium avium subsp. paratuberculosis
cgccggccguca

SEQ ID NO: 2990094 - RNA, 20 nt, Mycobacterium avium subsp. paratuberculosis
cgccggccgucacgcuggcg

SEQ ID NO: 2990095 - RNA, 22 nt, Mycobacterium avium subsp. paratuberculosis
cgccggccguucgccggccagc

SEQ ID NO: 2990096 - RNA, 17 nt, Mycobacterium avium subsp. paratuberculosis
cgccggccuccagcugu

SEQ ID NO: 2990097 - RNA, 11 nt, Mycobacterium avium subsp. paratuberculosis
cgccggccucu

SEQ ID NO: 2990098 - RNA, 13 nt, Mycobacterium avium subsp. paratuberculosis
cgccggccucucg

SEQ ID NO: 2990099 - RNA, 17 nt, Mycobacterium avium subsp. paratuberculosis
cgccggccucucgucga

SEQ ID NO: 2990100 - RNA, 19 nt, Mycobacterium avium subsp. paratuberculosis
cgccggccucucgucgacg

SEQ ID NO: 2990101 - RNA, 17 nt, Mycobacterium avium subsp. paratuberculosis
cgccggccugcccgccg

SEQ ID NO: 2990102 - RNA, 20 nt, Mycobacterium avium subsp. paratuberculosis
cgccggccugcccgccgcgg

SEQ ID NO: 2990103 - RNA, 21 nt, Mycobacterium avium subsp. paratuberculosis
cgccggccugcccgccgcggc

SEQ ID NO: 2990104 - RNA, 17 nt, Mycobacterium avium subsp. paratuberculosis
cgccggccuuggcccgc

SEQ ID NO: 2990105 - RNA, 18 nt, Mycobacterium avium subsp. paratuberculosis
cgccggccuuggcccgcg

SEQ ID NO: 2990106 - RNA, 20 nt, Mycobacterium avium subsp. paratuberculosis
cgccggccuuggcccgcgcc

SEQ ID NO: 2990107 - RNA, 21 nt, Mycobacterium avium subsp. paratuberculosis
cgccggccuuggcccgcgccc

SEQ ID NO: 2990108 - RNA, 24 nt, Mycobacterium avium subsp. paratuberculosis
cgccggccuuggcccgcgcccgcu

SEQ ID NO: 2990109 - RNA, 17 nt, Mycobacterium avium subsp. paratuberculosis
cgccggcgaacgacguc

SEQ ID NO: 2990110 - RNA, 21 nt, Mycobacterium avium subsp. paratuberculosis
cgccggcgaacgacgucgagg

SEQ ID NO: 2990111 - RNA, 12 nt, Mycobacterium avium subsp. paratuberculosis
cgccggcgaccg

SEQ ID NO: 2990112 - RNA, 14 nt, Mycobacterium avium subsp. paratuberculosis
cgccggcgaccgcc

SEQ ID NO: 2990113 - RNA, 15 nt, Mycobacterium avium subsp. paratuberculosis
cgccggcgaccgcca

SEQ ID NO: 2990114 - RNA, 15 nt, Mycobacterium avium subsp. paratuberculosis
cgccggcgaccgccu

SEQ ID NO: 2990115 - RNA, 20 nt, Mycobacterium avium subsp. paratuberculosis
cgccggcgaccgccuugucg

SEQ ID NO: 2990116 - RNA, 23 nt, Mycobacterium avium subsp. paratuberculosis
cgccggcgaccgugcccaccagc

SEQ ID NO: 2990117 - RNA, 14 nt, Mycobacterium avium subsp. paratuberculosis
cgccggcgacggcc

SEQ ID NO: 2990118 - RNA, 15 nt, Mycobacterium avium subsp. paratuberculosis
cgccggcgacggcca

SEQ ID NO: 2990119 - RNA, 16 nt, Mycobacterium avium subsp. paratuberculosis
cgccggcgacggccag

SEQ ID NO: 2990120 - RNA, 17 nt, Mycobacterium avium subsp. paratuberculosis
cgccggcgacggccagc

SEQ ID NO: 2990121 - RNA, 13 nt, Mycobacterium avium subsp. paratuberculosis
cgccggcgaggcg

SEQ ID NO: 2990122 - RNA, 21 nt, Mycobacterium avium subsp. paratuberculosis
cgccggcgaggcggucggcgg

SEQ ID NO: 2990123 - RNA, 20 nt, Mycobacterium avium subsp. paratuberculosis
cgccggcgauaggcggccag

SEQ ID NO: 2990124 - RNA, 21 nt, Mycobacterium avium subsp. paratuberculosis
cgccggcgauaggcggccagc

SEQ ID NO: 2990125 - RNA, 22 nt, Mycobacterium avium subsp. paratuberculosis
cgccggcgauaggcggccagcu

SEQ ID NO: 2990126 - RNA, 12 nt, Mycobacterium avium subsp. paratuberculosis
cgccggcgaucu

SEQ ID NO: 2990127 - RNA, 17 nt, Mycobacterium avium subsp. paratuberculosis
cgccggcgaucuccacc

SEQ ID NO: 2990128 - RNA, 14 nt, Mycobacterium avium subsp. paratuberculosis
cgccggcgaucucg

SEQ ID NO: 2990129 - RNA, 23 nt, Mycobacterium avium subsp. paratuberculosis
cgccggcgaucucgucgcgcagc

SEQ ID NO: 2990130 - RNA, 13 nt, Mycobacterium avium subsp. paratuberculosis
cgccggcgaugcg

SEQ ID NO: 2990131 - RNA, 23 nt, Mycobacterium avium subsp. paratuberculosis
cgccggcgcacaucguggcgacg

SEQ ID NO: 2990132 - RNA, 15 nt, Mycobacterium avium subsp. paratuberculosis
cgccggcgcagcggc

SEQ ID NO: 2990133 - RNA, 18 nt, Mycobacterium avium subsp. paratuberculosis
cgccggcgcaucaucucg

SEQ ID NO: 2990134 - RNA, 21 nt, Mycobacterium avium subsp. paratuberculosis
cgccggcgcaucaucucggcg

SEQ ID NO: 2990135 - RNA, 15 nt, Mycobacterium avium subsp. paratuberculosis
cgccgcugacugcga

SEQ ID NO: 2990136 - RNA, 20 nt, Mycobacterium avium subsp. paratuberculosis
cgccgcugacugcgaucgcc

SEQ ID NO: 2990137 - RNA, 23 nt, Mycobacterium avium subsp. paratuberculosis
cgccgcugacugcgaucgccgac

SEQ ID NO: 2990138 - RNA, 24 nt, Mycobacterium avium subsp. paratuberculosis
cgccgcugacugcgaucgccgacg

SEQ ID NO: 2990139 - RNA, 13 nt, Mycobacterium avium subsp. paratuberculosis
cgccgcugccggg

SEQ ID NO: 2990140 - RNA, 14 nt, Mycobacterium avium subsp. paratuberculosis
cgccgcugccgggg

SEQ ID NO: 2990141 - RNA, 16 nt, Mycobacterium avium subsp. paratuberculosis
cgccgcugccggggug

SEQ ID NO: 2990142 - RNA, 23 nt, Mycobacterium avium subsp. paratuberculosis
cgccgcugccggggugcagcacc

SEQ ID NO: 2990143 - RNA, 21 nt, Mycobacterium avium subsp. paratuberculosis
cgccgcugcgcgcgcgaucgg

SEQ ID NO: 2990144 - RNA, 24 nt, Mycobacterium avium subsp. paratuberculosis
cgccgcugcgcgcgcgaucggugu

SEQ ID NO: 2990145 - RNA, 17 nt, Mycobacterium avium subsp. paratuberculosis
cgccgcugcgggccauc

SEQ ID NO: 2990146 - RNA, 19 nt, Mycobacterium avium subsp. paratuberculosis
cgccgcugcgggccaucga

SEQ ID NO: 2990147 - RNA, 23 nt, Mycobacterium avium subsp. paratuberculosis
cgccgcugcgggccaucgacucc

SEQ ID NO: 2990148 - RNA, 14 nt, Mycobacterium avium subsp. paratuberculosis
cgccgcuggauccc

SEQ ID NO: 2990149 - RNA, 12 nt, Mycobacterium avium subsp. paratuberculosis
cgccgcugggac

SEQ ID NO: 2990150 - RNA, 15 nt, Mycobacterium avium subsp. paratuberculosis
cgccgcugggcgugg

SEQ ID NO: 2990151 - RNA, 17 nt, Mycobacterium avium subsp. paratuberculosis
cgccgcugggcguggug

SEQ ID NO: 2990152 - RNA, 12 nt, Mycobacterium avium subsp. paratuberculosis
cgccgcugguga

SEQ ID NO: 2990153 - RNA, 14 nt, Mycobacterium avium subsp. paratuberculosis
cgccgcuggugaac

SEQ ID NO: 2990154 - RNA, 17 nt, Mycobacterium avium subsp. paratuberculosis
cgccgcuguccucgucg

SEQ ID NO: 2990155 - RNA, 15 nt, Mycobacterium avium subsp. paratuberculosis
cgccgcugucgucga

SEQ ID NO: 2990156 - RNA, 13 nt, Mycobacterium avium subsp. paratuberculosis
cgccgcuucgucg

SEQ ID NO: 2990157 - RNA, 14 nt, Mycobacterium avium subsp. paratuberculosis
cgccgcuucgucgc

SEQ ID NO: 2990158 - RNA, 17 nt, Mycobacterium avium subsp. paratuberculosis
cgccgcuucgucgccgg

SEQ ID NO: 2990159 - RNA, 20 nt, Mycobacterium avium subsp. paratuberculosis
cgccgcuucgucgccggccg

SEQ ID NO: 2990160 - RNA, 21 nt, Mycobacterium avium subsp. paratuberculosis
cgccgcuucgucgccggccgc

SEQ ID NO: 2990161 - RNA, 22 nt, Mycobacterium avium subsp. paratuberculosis
cgccgcuugcagcuuggcggug

SEQ ID NO: 2990162 - RNA, 12 nt, Mycobacterium avium subsp. paratuberculosis
cgccggaacggg

SEQ ID NO: 2990163 - RNA, 20 nt, Mycobacterium avium subsp. paratuberculosis
cgccggaaggucuuucgucg

SEQ ID NO: 2990164 - RNA, 21 nt, Mycobacterium avium subsp. paratuberculosis
cgccggaaggucuuucgucgc

SEQ ID NO: 2990165 - RNA, 17 nt, Mycobacterium avium subsp. paratuberculosis
cgccggacaccaccgcg

SEQ ID NO: 2990166 - RNA, 21 nt, Mycobacterium avium subsp. paratuberculosis
cgccggacaccaccgcggugg

SEQ ID NO: 2990167 - RNA, 15 nt, Mycobacterium avium subsp. paratuberculosis
cgccggacaccuugg

SEQ ID NO: 2990168 - RNA, 13 nt, Mycobacterium avium subsp. paratuberculosis
cgccggacagccg

SEQ ID NO: 2990169 - RNA, 14 nt, Mycobacterium avium subsp. paratuberculosis
cgccggacagccgg

SEQ ID NO: 2990170 - RNA, 18 nt, Mycobacterium avium subsp. paratuberculosis
cgccggacagccggggca

SEQ ID NO: 2990171 - RNA, 23 nt, Mycobacterium avium subsp. paratuberculosis
cgccggacagccggggcagcugc

SEQ ID NO: 2990172 - RNA, 12 nt, Mycobacterium avium subsp. paratuberculosis
cgccggacagcg

SEQ ID NO: 2990173 - RNA, 17 nt, Mycobacterium avium subsp. paratuberculosis
cgccggacagcgggccg

SEQ ID NO: 2990174 - RNA, 18 nt, Mycobacterium avium subsp. paratuberculosis
cgccggacagcgggccga

SEQ ID NO: 2990175 - RNA, 19 nt, Mycobacterium avium subsp. paratuberculosis
cgccggacagcgggccgac

SEQ ID NO: 2990176 - RNA, 21 nt, Mycobacterium avium subsp. paratuberculosis
cgccggacagcgggccgaccc

SEQ ID NO: 2990177 - RNA, 15 nt, Mycobacterium avium subsp. paratuberculosis
cgccggacagcuggc

SEQ ID NO: 2990178 - RNA, 18 nt, Mycobacterium avium subsp. paratuberculosis
cgccggacagcuggcggu

SEQ ID NO: 2990179 - RNA, 20 nt, Mycobacterium avium subsp. paratuberculosis
cgccggacagcuggcggucg

SEQ ID NO: 2990180 - RNA, 13 nt, Mycobacterium avium subsp. paratuberculosis
cgccggaccccac

SEQ ID NO: 2990181 - RNA, 18 nt, Mycobacterium avium subsp. paratuberculosis
cgccggaccccacagcgc

SEQ ID NO: 2990182 - RNA, 20 nt, Mycobacterium avium subsp. paratuberculosis
cgccggaccccacagcgcgc

SEQ ID NO: 2990183 - RNA, 15 nt, Mycobacterium avium subsp. paratuberculosis
cgccggaccgauccg

SEQ ID NO: 2990184 - RNA, 20 nt, Mycobacterium avium subsp. paratuberculosis
cgccggaccgauccggcgcc

SEQ ID NO: 2990185 - RNA, 15 nt, Mycobacterium avium subsp. paratuberculosis
cgccggacggcccgc

SEQ ID NO: 2990186 - RNA, 18 nt, Mycobacterium avium subsp. paratuberculosis
cgccggacgugguccggu

SEQ ID NO: 2990187 - RNA, 17 nt, Mycobacterium avium subsp. paratuberculosis
cgccggacucgaucgcc

SEQ ID NO: 2990188 - RNA, 20 nt, Mycobacterium avium subsp. paratuberculosis
cgccggacucgaucgccacc

SEQ ID NO: 2990189 - RNA, 21 nt, Mycobacterium avium subsp. paratuberculosis
cgccggacucgaucgccaccg

SEQ ID NO: 2990190 - RNA, 22 nt, Mycobacterium avium subsp. paratuberculosis
cgccggacucgaucgccaccga

SEQ ID NO: 2990191 - RNA, 15 nt, Mycobacterium avium subsp. paratuberculosis
cgccggagaccagca

SEQ ID NO: 2990192 - RNA, 13 nt, Mycobacterium avium subsp. paratuberculosis
cgccggagagccc

SEQ ID NO: 2990193 - RNA, 22 nt, Mycobacterium avium subsp. paratuberculosis
cgccggagaugaucaugucguc

SEQ ID NO: 2990194 - RNA, 14 nt, Mycobacterium avium subsp. paratuberculosis
cgccggagccgauc

SEQ ID NO: 2990195 - RNA, 15 nt, Mycobacterium avium subsp. paratuberculosis
cgccggagccgaucg

SEQ ID NO: 2990196 - RNA, 13 nt, Mycobacterium avium subsp. paratuberculosis
cgccggagcgccc

SEQ ID NO: 2990197 - RNA, 14 nt, Mycobacterium avium subsp. paratuberculosis
cgccggagcgcccc

SEQ ID NO: 2990198 - RNA, 15 nt, Mycobacterium avium subsp. paratuberculosis
cgccggagcgcccca

SEQ ID NO: 2990199 - RNA, 19 nt, Mycobacterium avium subsp. paratuberculosis
cgccggagcgccccagggc

SEQ ID NO: 2990200 - RNA, 23 nt, Mycobacterium avium subsp. paratuberculosis
cgccggagcgccccagggccucg

SEQ ID NO: 2990201 - RNA, 15 nt, Mycobacterium avium subsp. paratuberculosis
cgccggaggccagcu

SEQ ID NO: 2990202 - RNA, 18 nt, Mycobacterium avium subsp. paratuberculosis
cgccggaggccagcucga

SEQ ID NO: 2990203 - RNA, 23 nt, Mycobacterium avium subsp. paratuberculosis
cgccggaggccagcucgaccgcg

SEQ ID NO: 2990204 - RNA, 12 nt, Mycobacterium avium subsp. paratuberculosis
cgccggaggcga

SEQ ID NO: 2990205 - RNA, 15 nt, Mycobacterium avium subsp. paratuberculosis
cgccggaggcgauca

SEQ ID NO: 2990206 - RNA, 21 nt, Mycobacterium avium subsp. paratuberculosis
cgccggaggcgaucagguggg

SEQ ID NO: 2990207 - RNA, 16 nt, Mycobacterium avium subsp. paratuberculosis
cgccggaggggcgacg

SEQ ID NO: 2990208 - RNA, 17 nt, Mycobacterium avium subsp. paratuberculosis
cgccggaggggcgacgg

SEQ ID NO: 2990209 - RNA, 22 nt, Mycobacterium avium subsp. paratuberculosis
cgccggaggggcgacgggccga

SEQ ID NO: 2990210 - RNA, 20 nt, Mycobacterium avium subsp. paratuberculosis
cgccggaguucagccugaug

SEQ ID NO: 2990211 - RNA, 21 nt, Mycobacterium avium subsp. paratuberculosis
cgccggaguugccgauggcgg

SEQ ID NO: 2990212 - RNA, 22 nt, Mycobacterium avium subsp. paratuberculosis
cgccggaguugccgauggcggu

SEQ ID NO: 2990213 - RNA, 17 nt, Mycobacterium avium subsp. paratuberculosis
cgccggaucaugucguu

SEQ ID NO: 2990214 - RNA, 15 nt, Mycobacterium avium subsp. paratuberculosis
cgccggaucgagcac

SEQ ID NO: 2990215 - RNA, 15 nt, Mycobacterium avium subsp. paratuberculosis
cgccggaucgccgag

SEQ ID NO: 2990216 - RNA, 16 nt, Mycobacterium avium subsp. paratuberculosis
cgccggaucgccgagg

SEQ ID NO: 2990217 - RNA, 16 nt, Mycobacterium avium subsp. paratuberculosis
cgccggaucggcagcg

SEQ ID NO: 2990218 - RNA, 22 nt, Mycobacterium avium subsp. paratuberculosis
cgccggaucggcccccgggccc

SEQ ID NO: 2990219 - RNA, 21 nt, Mycobacterium avium subsp. paratuberculosis
cgccggaucgugucccggcgc

SEQ ID NO: 2990220 - RNA, 14 nt, Mycobacterium avium subsp. paratuberculosis
cgcggccgcgcgcc

SEQ ID NO: 2990221 - RNA, 15 nt, Mycobacterium avium subsp. paratuberculosis
cgcggccgcgcgccc

SEQ ID NO: 2990222 - RNA, 15 nt, Mycobacterium avium subsp. paratuberculosis
cgcggccgcggcgcg

SEQ ID NO: 2990223 - RNA, 17 nt, Mycobacterium avium subsp. paratuberculosis
cgcggccgcggcgcgca

SEQ ID NO: 2990224 - RNA, 14 nt, Mycobacterium avium subsp. paratuberculosis
cgcggccgcggcgg

SEQ ID NO: 2990225 - RNA, 14 nt, Mycobacterium avium subsp. paratuberculosis
cgcggccgcgucgg

SEQ ID NO: 2990226 - RNA, 15 nt, Mycobacterium avium subsp. paratuberculosis
cgcggccgcguuguc

SEQ ID NO: 2990227 - RNA, 20 nt, Mycobacterium avium subsp. paratuberculosis
cgcggccgcguugucgacca

SEQ ID NO: 2990228 - RNA, 12 nt, Mycobacterium avium subsp. paratuberculosis
cgcggccgcugc

SEQ ID NO: 2990229 - RNA, 15 nt, Mycobacterium avium subsp. paratuberculosis
cgcggccgcugcgcc

SEQ ID NO: 2990230 - RNA, 16 nt, Mycobacterium avium subsp. paratuberculosis
cgcggccgcugcgccc

SEQ ID NO: 2990231 - RNA, 21 nt, Mycobacterium avium subsp. paratuberculosis
cgcggccgcugcgcccagcgc

SEQ ID NO: 2990232 - RNA, 22 nt, Mycobacterium avium subsp. paratuberculosis
cgcggccgcugcgcccagcgcg

SEQ ID NO: 2990233 - RNA, 14 nt, Mycobacterium avium subsp. paratuberculosis
cgcggccgcuggcg

SEQ ID NO: 2990234 - RNA, 14 nt, Mycobacterium avium subsp. paratuberculosis
cgcggccggaucga

SEQ ID NO: 2990235 - RNA, 16 nt, Mycobacterium avium subsp. paratuberculosis
cgcggccggccacgcu

SEQ ID NO: 2990236 - RNA, 13 nt, Mycobacterium avium subsp. paratuberculosis
cgcggccggccca

SEQ ID NO: 2990237 - RNA, 15 nt, Mycobacterium avium subsp. paratuberculosis
cgcggccggcccagc

SEQ ID NO: 2990238 - RNA, 18 nt, Mycobacterium avium subsp. paratuberculosis
cgcggccggcccagcgcg

SEQ ID NO: 2990239 - RNA, 19 nt, Mycobacterium avium subsp. paratuberculosis
cgcggccggcccagcgcgc

SEQ ID NO: 2990240 - RNA, 23 nt, Mycobacterium avium subsp. paratuberculosis
cgcggccggcccagcgcgcggcg

SEQ ID NO: 2990241 - RNA, 13 nt, Mycobacterium avium subsp. paratuberculosis
cgcggccggccga

SEQ ID NO: 2990242 - RNA, 14 nt, Mycobacterium avium subsp. paratuberculosis
cgcggccggccgac

SEQ ID NO: 2990243 - RNA, 18 nt, Mycobacterium avium subsp. paratuberculosis
cgcggccggccggccugg

SEQ ID NO: 2990244 - RNA, 17 nt, Mycobacterium avium subsp. paratuberculosis
cgcggccggcgagucgc

SEQ ID NO: 2990245 - RNA, 13 nt, Mycobacterium avium subsp. paratuberculosis
cgcggccggcgug

SEQ ID NO: 2990246 - RNA, 14 nt, Mycobacterium avium subsp. paratuberculosis
cgcggccggcgugu

SEQ ID NO: 2990247 - RNA, 15 nt, Mycobacterium avium subsp. paratuberculosis
cgcggccgggcgccc

SEQ ID NO: 2990248 - RNA, 16 nt, Mycobacterium avium subsp. paratuberculosis
cgcggccgggcgcccc

SEQ ID NO: 2990249 - RNA, 18 nt, Mycobacterium avium subsp. paratuberculosis
cgcggccggugccacggu

SEQ ID NO: 2990250 - RNA, 14 nt, Mycobacterium avium subsp. paratuberculosis
cgcggccggugcgc

SEQ ID NO: 2990251 - RNA, 18 nt, Mycobacterium avium subsp. paratuberculosis
cgcggccggugcgcguca

SEQ ID NO: 2990252 - RNA, 22 nt, Mycobacterium avium subsp. paratuberculosis
cgcggccggugcgcgucagccg

SEQ ID NO: 2990253 - RNA, 18 nt, Mycobacterium avium subsp. paratuberculosis
cgcggccguagccggacc

SEQ ID NO: 2990254 - RNA, 19 nt, Mycobacterium avium subsp. paratuberculosis
cgcggccguagccggaccg

SEQ ID NO: 2990255 - RNA, 20 nt, Mycobacterium avium subsp. paratuberculosis
cgcggccguagccggaccgc

SEQ ID NO: 2990256 - RNA, 16 nt, Mycobacterium avium subsp. paratuberculosis
cgcggccgucgcggcg

SEQ ID NO: 2990257 - RNA, 20 nt, Mycobacterium avium subsp. paratuberculosis
cgcggccgucgcggcgaucg

SEQ ID NO: 2990258 - RNA, 21 nt, Mycobacterium avium subsp. paratuberculosis
cgcggccgucgucgugcacca

SEQ ID NO: 2990259 - RNA, 22 nt, Mycobacterium avium subsp. paratuberculosis
cgcggccgucgucgugcaccac

SEQ ID NO: 2990260 - RNA, 21 nt, Mycobacterium avium subsp. paratuberculosis
cgcggccguugcucucggccu

SEQ ID NO: 2990261 - RNA, 12 nt, Mycobacterium avium subsp. paratuberculosis
cgcggccucacc

SEQ ID NO: 2990262 - RNA, 15 nt, Mycobacterium avium subsp. paratuberculosis
cgcggccucaccgcg

SEQ ID NO: 2990263 - RNA, 16 nt, Mycobacterium avium subsp. paratuberculosis
cgcggccucaccgcgg

SEQ ID NO: 2990264 - RNA, 20 nt, Mycobacterium avium subsp. paratuberculosis
cgcggccucaccgcgggcca

SEQ ID NO: 2990265 - RNA, 23 nt, Mycobacterium avium subsp. paratuberculosis
cgcggccucaccgcgggccaggc

SEQ ID NO: 2990266 - RNA, 13 nt, Mycobacterium avium subsp. paratuberculosis
cgcggccuccagc

SEQ ID NO: 2990267 - RNA, 21 nt, Mycobacterium avium subsp. paratuberculosis
cgcggccuccagccgcgcggc

SEQ ID NO: 2990268 - RNA, 24 nt, Mycobacterium avium subsp. paratuberculosis
cgcggccuccagccgcgcggccgc

SEQ ID NO: 2990269 - RNA, 20 nt, Mycobacterium avium subsp. paratuberculosis
cgcggccuccagccgcuccg

SEQ ID NO: 2990270 - RNA, 22 nt, Mycobacterium avium subsp. paratuberculosis
cgcggccuccagccgcuccgcg

SEQ ID NO: 2990271 - RNA, 17 nt, Mycobacterium avium subsp. paratuberculosis
cgcggccuccgagcggc

SEQ ID NO: 2990272 - RNA, 18 nt, Mycobacterium avium subsp. paratuberculosis
cgcggccuccgagcggcg

SEQ ID NO: 2990273 - RNA, 13 nt, Mycobacterium avium subsp. paratuberculosis
cgcggccucggcg

SEQ ID NO: 2990274 - RNA, 16 nt, Mycobacterium avium subsp. paratuberculosis
cgcggccucggcgucg

SEQ ID NO: 2990275 - RNA, 17 nt, Mycobacterium avium subsp. paratuberculosis
cgcggccucggcgucga

SEQ ID NO: 2990276 - RNA, 14 nt, Mycobacterium avium subsp. paratuberculosis
cgcggccucgucga

SEQ ID NO: 2990277 - RNA, 20 nt, Mycobacterium avium subsp. paratuberculosis
cgcggccucucagcgcuguc

SEQ ID NO: 2990278 - RNA, 13 nt, Mycobacterium avium subsp. paratuberculosis
cgcggccugcagc

SEQ ID NO: 2990279 - RNA, 14 nt, Mycobacterium avium subsp. paratuberculosis
cgcggccugcagca

SEQ ID NO: 2990280 - RNA, 16 nt, Mycobacterium avium subsp. paratuberculosis
cgcggccugcagcacc

SEQ ID NO: 2990281 - RNA, 19 nt, Mycobacterium avium subsp. paratuberculosis
cgcggccugcagcaccgaa

SEQ ID NO: 2990282 - RNA, 22 nt, Mycobacterium avium subsp. paratuberculosis
cgcggccugcagcaccgaaccg

SEQ ID NO: 2990283 - RNA, 23 nt, Mycobacterium avium subsp. paratuberculosis
cgcggccugcagcaccgaaccgg

SEQ ID NO: 2990284 - RNA, 13 nt, Mycobacterium avium subsp. paratuberculosis
cgcggccugcggg

SEQ ID NO: 2990285 - RNA, 14 nt, Mycobacterium avium subsp. paratuberculosis
cgcggccugcgggc

SEQ ID NO: 2990286 - RNA, 22 nt, Mycobacterium avium subsp. paratuberculosis
cgcggccugggugaccgagucg

SEQ ID NO: 2990287 - RNA, 11 nt, Mycobacterium avium subsp. paratuberculosis
cgcggccuucu

SEQ ID NO: 2990288 - RNA, 19 nt, Mycobacterium avium subsp. paratuberculosis
cgcggccuucuuggccgga

SEQ ID NO: 2990289 - RNA, 20 nt, Mycobacterium avium subsp. paratuberculosis
cgcggccuucuuggccggag

SEQ ID NO: 2990290 - RNA, 23 nt, Mycobacterium avium subsp. paratuberculosis
cgcggccuucuuggccggagccu

SEQ ID NO: 2990291 - RNA, 12 nt, Mycobacterium avium subsp. paratuberculosis
cgcggccuugcg

SEQ ID NO: 2990292 - RNA, 16 nt, Mycobacterium avium subsp. paratuberculosis
cgcggccuugcgagcc

SEQ ID NO: 2990293 - RNA, 18 nt, Mycobacterium avium subsp. paratuberculosis
cgcggccuugcgagccgg

SEQ ID NO: 2990294 - RNA, 21 nt, Mycobacterium avium subsp. paratuberculosis
cgcggccuugcgagccggagc

SEQ ID NO: 2990295 - RNA, 17 nt, Mycobacterium avium subsp. paratuberculosis
cgcggccuugcgcaccg

SEQ ID NO: 2990296 - RNA, 19 nt, Mycobacterium avium subsp. paratuberculosis
cgcggccuugcgggccgga

SEQ ID NO: 2990297 - RNA, 20 nt, Mycobacterium avium subsp. paratuberculosis
cgcggccuugcgggccggag

SEQ ID NO: 2990298 - RNA, 21 nt, Mycobacterium avium subsp. paratuberculosis
cgcggccuugcgggccggagc

SEQ ID NO: 2990299 - RNA, 17 nt, Mycobacterium avium subsp. paratuberculosis
cgcggcgaacaccucgg

SEQ ID NO: 2990300 - RNA, 14 nt, Mycobacterium avium subsp. paratuberculosis
cgcggcgaagcagg

SEQ ID NO: 2990301 - RNA, 16 nt, Mycobacterium avium subsp. paratuberculosis
cgcggcgaagcaggcc

SEQ ID NO: 2990302 - RNA, 17 nt, Mycobacterium avium subsp. paratuberculosis
cgcggcgaagcaggcca

SEQ ID NO: 2990303 - RNA, 14 nt, Mycobacterium avium subsp. paratuberculosis
cgcggcgaaggcca

SEQ ID NO: 2990304 - RNA, 18 nt, Mycobacterium avium subsp. paratuberculosis
cgcggcgaaggccagcga

SEQ ID NO: 2990305 - RNA, 17 nt, Mycobacterium avium subsp. paratuberculosis
cgcggcgaauccgagca

SEQ ID NO: 2990306 - RNA, 20 nt, Mycobacterium avium subsp. paratuberculosis
cgcggcgaauccgagcaucg

SEQ ID NO: 2990307 - RNA, 14 nt, Mycobacterium avium subsp. paratuberculosis
cgcggcgaaucggu

SEQ ID NO: 2990308 - RNA, 21 nt, Mycobacterium avium subsp. paratuberculosis
cgcggcgaaucgguccggcga

SEQ ID NO: 2990309 - RNA, 22 nt, Mycobacterium avium subsp. paratuberculosis
cgcggcgaaucgguccggcgaa

SEQ ID NO: 2990310 - RNA, 17 nt, Mycobacterium avium subsp. paratuberculosis
cgcggcgacacccagcg

SEQ ID NO: 2990311 - RNA, 22 nt, Mycobacterium avium subsp. paratuberculosis
cgcggcgacauuggccgcgcgc

SEQ ID NO: 2990312 - RNA, 23 nt, Mycobacterium avium subsp. paratuberculosis
cgcggcgacauuggccgcgcgca

SEQ ID NO: 2990313 - RNA, 16 nt, Mycobacterium avium subsp. paratuberculosis
cgcggcgaccaccacc

SEQ ID NO: 2990314 - RNA, 17 nt, Mycobacterium avium subsp. paratuberculosis
cgcggcgaccaccaccg

SEQ ID NO: 2990315 - RNA, 18 nt, Mycobacterium avium subsp. paratuberculosis
cgcggcgaccaccucggc

SEQ ID NO: 2990316 - RNA, 22 nt, Mycobacterium avium subsp. paratuberculosis
cgcggcgaccaccucggcgacg

SEQ ID NO: 2990317 - RNA, 13 nt, Mycobacterium avium subsp. paratuberculosis
cgcggcgacccgc

SEQ ID NO: 2990318 - RNA, 14 nt, Mycobacterium avium subsp. paratuberculosis
cgcggcgacccgcu

SEQ ID NO: 2990319 - RNA, 15 nt, Mycobacterium avium subsp. paratuberculosis
cgcggcgacccgcuu

SEQ ID NO: 2990320 - RNA, 15 nt, Mycobacterium avium subsp. paratuberculosis
cgcggcgaccggggc

SEQ ID NO: 2990321 - RNA, 13 nt, Mycobacterium avium subsp. paratuberculosis
cgcggcgacggcg

SEQ ID NO: 2990322 - RNA, 14 nt, Mycobacterium avium subsp. paratuberculosis
cgcggcgacggcga

SEQ ID NO: 2990323 - RNA, 13 nt, Mycobacterium avium subsp. paratuberculosis
cgcggcgacggug

SEQ ID NO: 2990324 - RNA, 22 nt, Mycobacterium avium subsp. paratuberculosis
cgcggcgacgucgugcacgccg

SEQ ID NO: 2990325 - RNA, 23 nt, Mycobacterium avium subsp. paratuberculosis
cgcggcgacgucgugcacgccgu

SEQ ID NO: 2990326 - RNA, 16 nt, Mycobacterium avium subsp. paratuberculosis
cgcggcgacgugaugg

SEQ ID NO: 2990327 - RNA, 13 nt, Mycobacterium avium subsp. paratuberculosis
cgcggcgagcagc

SEQ ID NO: 2990328 - RNA, 15 nt, Mycobacterium avium subsp. paratuberculosis
cgcggcgagcagcgc

SEQ ID NO: 2990329 - RNA, 23 nt, Mycobacterium avium subsp. paratuberculosis
cgcggcgagcagcgcgaugccgg

SEQ ID NO: 2990330 - RNA, 13 nt, Mycobacterium avium subsp. paratuberculosis
cgcggcgagcgcg

SEQ ID NO: 2990331 - RNA, 15 nt, Mycobacterium avium subsp. paratuberculosis
cgcggcgaucagcag

SEQ ID NO: 2990332 - RNA, 19 nt, Mycobacterium avium subsp. paratuberculosis
cgcggcgaucagcagcacc

SEQ ID NO: 2990333 - RNA, 20 nt, Mycobacterium avium subsp. paratuberculosis
cgcggcgaucagcagcaccc

SEQ ID NO: 2990334 - RNA, 22 nt, Mycobacterium avium subsp. paratuberculosis
cgcggcgaucagcagcacccgg

SEQ ID NO: 2990335 - RNA, 17 nt, Mycobacterium avium subsp. paratuberculosis
cgcggcgaucagcccgg

SEQ ID NO: 2990336 - RNA, 19 nt, Mycobacterium avium subsp. paratuberculosis
cgcggcgaucagcccggcc

SEQ ID NO: 2990337 - RNA, 22 nt, Mycobacterium avium subsp. paratuberculosis
cgcggcgaucagcccggcccgc

SEQ ID NO: 2990338 - RNA, 13 nt, Mycobacterium avium subsp. paratuberculosis
cgcggcgaucgcc

SEQ ID NO: 2990339 - RNA, 16 nt, Mycobacterium avium subsp. paratuberculosis
cgcggcgaucgccgug

SEQ ID NO: 2990340 - RNA, 14 nt, Mycobacterium avium subsp. paratuberculosis
cgcggcgaucgcga

SEQ ID NO: 2990341 - RNA, 13 nt, Mycobacterium avium subsp. paratuberculosis
cgcggcgaucggc

SEQ ID NO: 2990342 - RNA, 14 nt, Mycobacterium avium subsp. paratuberculosis
cgcggcgaucggcg

SEQ ID NO: 2990343 - RNA, 17 nt, Mycobacterium avium subsp. paratuberculosis
cgcggcgaucggcgguc

SEQ ID NO: 2990344 - RNA, 20 nt, Mycobacterium avium subsp. paratuberculosis
cgcggcgaucucgaucgugg

SEQ ID NO: 2990345 - RNA, 21 nt, Mycobacterium avium subsp. paratuberculosis
cgcggcgaucucggcggccgc

SEQ ID NO: 2990346 - RNA, 19 nt, Mycobacterium avium subsp. paratuberculosis
cgcggcgaucuugucccgc

SEQ ID NO: 2990347 - RNA, 23 nt, Mycobacterium avium subsp. paratuberculosis
cgcggcgaucuuugcggccgugg

SEQ ID NO: 2990348 - RNA, 16 nt, Mycobacterium avium subsp. paratuberculosis
cgcggcgaugaccgga

SEQ ID NO: 2990349 - RNA, 16 nt, Mycobacterium avium subsp. paratuberculosis
cgcggcgaugaucacg

SEQ ID NO: 2990350 - RNA, 17 nt, Mycobacterium avium subsp. paratuberculosis
cgcggcgaugaucacga

SEQ ID NO: 2990351 - RNA, 23 nt, Mycobacterium avium subsp. paratuberculosis
cgcggcgaugauccgcggcgccg

SEQ ID NO: 2990352 - RNA, 11 nt, Mycobacterium avium subsp. paratuberculosis
cgcggcgaugc

SEQ ID NO: 2990353 - RNA, 12 nt, Mycobacterium avium subsp. paratuberculosis
cgcggcgaugcg

SEQ ID NO: 2990354 - RNA, 13 nt, Mycobacterium avium subsp. paratuberculosis
cgcggcgaugcgc

SEQ ID NO: 2990355 - RNA, 19 nt, Mycobacterium avium subsp. paratuberculosis
cgcggcgaugcgcuccagc

SEQ ID NO: 2990356 - RNA, 20 nt, Mycobacterium avium subsp. paratuberculosis
cgcggcgaugcgcuccagca

SEQ ID NO: 2990357 - RNA, 21 nt, Mycobacterium avium subsp. paratuberculosis
cgcggcgauggacguccagcg

SEQ ID NO: 2990358 - RNA, 23 nt, Mycobacterium avium subsp. paratuberculosis
cgcggcgauggacguccagcggc

SEQ ID NO: 2990359 - RNA, 16 nt, Mycobacterium avium subsp. paratuberculosis
cgcggcgauggcccgc

SEQ ID NO: 2990360 - RNA, 21 nt, Mycobacterium avium subsp. paratuberculosis
cgcggcgauggcccgcugcgc

SEQ ID NO: 2990361 - RNA, 16 nt, Mycobacterium avium subsp. paratuberculosis
cgcggcgauggccgac

SEQ ID NO: 2990362 - RNA, 17 nt, Mycobacterium avium subsp. paratuberculosis
cgcggcgauggccgaca

SEQ ID NO: 2990363 - RNA, 23 nt, Mycobacterium avium subsp. paratuberculosis
cgcggcgauggugggcagccggc

SEQ ID NO: 2990364 - RNA, 15 nt, Mycobacterium avium subsp. paratuberculosis
cgcggcgcaccccga

SEQ ID NO: 2990365 - RNA, 15 nt, Mycobacterium avium subsp. paratuberculosis
cgcggcgcacccggg

SEQ ID NO: 2990366 - RNA, 13 nt, Mycobacterium avium subsp. paratuberculosis
cgcggcgcaccga

SEQ ID NO: 2990367 - RNA, 13 nt, Mycobacterium avium subsp. paratuberculosis
cgcggcgcaccgc

SEQ ID NO: 2990368 - RNA, 14 nt, Mycobacterium avium subsp. paratuberculosis
cgcggcgcaccgcc

SEQ ID NO: 2990369 - RNA, 18 nt, Mycobacterium avium subsp. paratuberculosis
cgcggcgcaccgcccgcg

SEQ ID NO: 2990370 - RNA, 20 nt, Mycobacterium avium subsp. paratuberculosis
cgcggcgcaccgcccgcggu

SEQ ID NO: 2990371 - RNA, 14 nt, Mycobacterium avium subsp. paratuberculosis
cgcggcgcacggug

SEQ ID NO: 2990372 - RNA, 16 nt, Mycobacterium avium subsp. paratuberculosis
cgcggcgcacggugcc

SEQ ID NO: 2990373 - RNA, 12 nt, Mycobacterium avium subsp. paratuberculosis
cgcggcgcacgu

SEQ ID NO: 2990374 - RNA, 14 nt, Mycobacterium avium subsp. paratuberculosis
cgcggcgcagcacg

SEQ ID NO: 2990375 - RNA, 18 nt, Mycobacterium avium subsp. paratuberculosis
cgcggcgcagcacggcca

SEQ ID NO: 2990376 - RNA, 13 nt, Mycobacterium avium subsp. paratuberculosis
cgcggcgcagcuc

SEQ ID NO: 2990377 - RNA, 14 nt, Mycobacterium avium subsp. paratuberculosis
cgcggcgcagcucg

SEQ ID NO: 2990378 - RNA, 16 nt, Mycobacterium avium subsp. paratuberculosis
cgcggcgcagcucgcg

SEQ ID NO: 2990379 - RNA, 17 nt, Mycobacterium avium subsp. paratuberculosis
cgcggcgcagcucgcgc

SEQ ID NO: 2990380 - RNA, 19 nt, Mycobacterium avium subsp. paratuberculosis
cgcggcgcagcucgcgcag

SEQ ID NO: 2990381 - RNA, 18 nt, Mycobacterium avium subsp. paratuberculosis
cgcggcgcagguccggca

SEQ ID NO: 2990382 - RNA, 21 nt, Mycobacterium avium subsp. paratuberculosis
cgcggcgcagguccggcagcg

SEQ ID NO: 2990383 - RNA, 14 nt, Mycobacterium avium subsp. paratuberculosis
cgcggcgccagcgg

SEQ ID NO: 2990384 - RNA, 22 nt, Mycobacterium avium subsp. paratuberculosis
cgcggcgccagcggccgaucau

SEQ ID NO: 2990385 - RNA, 15 nt, Mycobacterium avium subsp. paratuberculosis
cgcggcgcccagggg

SEQ ID NO: 2990386 - RNA, 20 nt, Mycobacterium avium subsp. paratuberculosis
cgcggcgcccccgcgacguc

SEQ ID NO: 2990387 - RNA, 12 nt, Mycobacterium avium subsp. paratuberculosis
cgcggcgcccgg

SEQ ID NO: 2990388 - RNA, 15 nt, Mycobacterium avium subsp. paratuberculosis
cgcggcgcccggcgc

SEQ ID NO: 2990389 - RNA, 19 nt, Mycobacterium avium subsp. paratuberculosis
cgcggcgcccucgccggcg

SEQ ID NO: 2990390 - RNA, 23 nt, Mycobacterium avium subsp. paratuberculosis
cgcggcgcccucgccggcggcgc

SEQ ID NO: 2990391 - RNA, 14 nt, Mycobacterium avium subsp. paratuberculosis
cgcggcgccgacgu

SEQ ID NO: 2990392 - RNA, 16 nt, Mycobacterium avium subsp. paratuberculosis
cgcggcgccgacgucc

SEQ ID NO: 2990393 - RNA, 13 nt, Mycobacterium avium subsp. paratuberculosis
cgcggcgccgaug

SEQ ID NO: 2990394 - RNA, 14 nt, Mycobacterium avium subsp. paratuberculosis
cgcggcgccgaugg

SEQ ID NO: 2990395 - RNA, 13 nt, Mycobacterium avium subsp. paratuberculosis
cgcggcgccgcca

SEQ ID NO: 2990396 - RNA, 21 nt, Mycobacterium avium subsp. paratuberculosis
cgcggcgccgccacggcacgu

SEQ ID NO: 2990397 - RNA, 13 nt, Mycobacterium avium subsp. paratuberculosis
cgcggcgccgcgg

SEQ ID NO: 2990398 - RNA, 18 nt, Mycobacterium avium subsp. paratuberculosis
cgcggcgccgcggcggca

SEQ ID NO: 2990399 - RNA, 12 nt, Mycobacterium avium subsp. paratuberculosis
cgcggcgccgga

SEQ ID NO: 2990400 - RNA, 14 nt, Mycobacterium avium subsp. paratuberculosis
cgcggcgccggaug

SEQ ID NO: 2990401 - RNA, 24 nt, Mycobacterium avium subsp. paratuberculosis
cgcggcgccggaugggcgcacgau

SEQ ID NO: 2990402 - RNA, 14 nt, Mycobacterium avium subsp. paratuberculosis
cgcggcgccgggcg

SEQ ID NO: 2990403 - RNA, 16 nt, Mycobacterium avium subsp. paratuberculosis
cgcggcgccgggcggc

SEQ ID NO: 2990404 - RNA, 20 nt, Mycobacterium avium subsp. paratuberculosis
cgcggcgccgggcggcccgc

SEQ ID NO: 2990405 - RNA, 13 nt, Mycobacterium avium subsp. paratuberculosis
cgcggcgccggug

SEQ ID NO: 2990406 - RNA, 11 nt, Mycobacterium avium subsp. paratuberculosis
cgcggcgccgu

SEQ ID NO: 2990407 - RNA, 13 nt, Mycobacterium avium subsp. paratuberculosis
cgcggcgccguag

SEQ ID NO: 2990408 - RNA, 15 nt, Mycobacterium avium subsp. paratuberculosis
cgcggcgccguaggu

SEQ ID NO: 2990409 - RNA, 17 nt, Mycobacterium avium subsp. paratuberculosis
cgcggcgccgucgaaca

SEQ ID NO: 2990410 - RNA, 22 nt, Mycobacterium avium subsp. paratuberculosis
cgcggcgccguugaccggccgg

SEQ ID NO: 2990411 - RNA, 19 nt, Mycobacterium avium subsp. paratuberculosis
cgcggcgccguuucggacg

SEQ ID NO: 2990412 - RNA, 23 nt, Mycobacterium avium subsp. paratuberculosis
cgcggcgccguuucggacgagcc

SEQ ID NO: 2990413 - RNA, 18 nt, Mycobacterium avium subsp. paratuberculosis
cgcggcgccugcacgcag

SEQ ID NO: 2990414 - RNA, 17 nt, Mycobacterium avium subsp. paratuberculosis
cgcggcgcgaagcccuc

SEQ ID NO: 2990415 - RNA, 15 nt, Mycobacterium avium subsp. paratuberculosis
cgcggcgcgacaccg

SEQ ID NO: 2990416 - RNA, 19 nt, Mycobacterium avium subsp. paratuberculosis
cgcggcgcgaggcgcgggg

SEQ ID NO: 2990417 - RNA, 14 nt, Mycobacterium avium subsp. paratuberculosis
cgcggcgcgaugau

SEQ ID NO: 2990418 - RNA, 15 nt, Mycobacterium avium subsp. paratuberculosis
cgcggcgcgaugauc

SEQ ID NO: 2990419 - RNA, 20 nt, Mycobacterium avium subsp. paratuberculosis
cgcggcgcgaugaucgccgg

SEQ ID NO: 2990420 - RNA, 21 nt, Mycobacterium avium subsp. paratuberculosis
cgcggcgcgaugaucgccggc

SEQ ID NO: 2990421 - RNA, 22 nt, Mycobacterium avium subsp. paratuberculosis
cgcggcgcgaugaucgccggcg

SEQ ID NO: 2990422 - RNA, 23 nt, Mycobacterium avium subsp. paratuberculosis
cgcggcgcgaugaucgccggcgc

SEQ ID NO: 2990423 - RNA, 13 nt, Mycobacterium avium subsp. paratuberculosis
cgcggcgcgcauc

SEQ ID NO: 2990424 - RNA, 17 nt, Mycobacterium avium subsp. paratuberculosis
cgcggcgcgcaucccga

SEQ ID NO: 2990425 - RNA, 17 nt, Mycobacterium avium subsp. paratuberculosis
cgcggcgcgcaucgccg

SEQ ID NO: 2990426 - RNA, 20 nt, Mycobacterium avium subsp. paratuberculosis
cgcggcgcgcaucgccgucc

SEQ ID NO: 2990427 - RNA, 21 nt, Mycobacterium avium subsp. paratuberculosis
cgcggcgcgcaucgccgucca

SEQ ID NO: 2990428 - RNA, 17 nt, Mycobacterium avium subsp. paratuberculosis
cgcggcgcgcaucgucg

SEQ ID NO: 2990429 - RNA, 22 nt, Mycobacterium avium subsp. paratuberculosis
cgcggcgcgcaucgucgcggcg

SEQ ID NO: 2990430 - RNA, 12 nt, Mycobacterium avium subsp. paratuberculosis
cgcggcgcgcga

SEQ ID NO: 2990431 - RNA, 14 nt, Mycobacterium avium subsp. paratuberculosis
cgcggcgcgcgaaa

SEQ ID NO: 2990432 - RNA, 14 nt, Mycobacterium avium subsp. paratuberculosis
cgcggcgcgcgaug

SEQ ID NO: 2990433 - RNA, 15 nt, Mycobacterium avium subsp. paratuberculosis
cgcggcgcgcgaugg

SEQ ID NO: 2990434 - RNA, 23 nt, Mycobacterium avium subsp. paratuberculosis
cgcggcgcgcgauggacagcagc

SEQ ID NO: 2990435 - RNA, 12 nt, Mycobacterium avium subsp. paratuberculosis
cgcggcgcgcgg

SEQ ID NO: 2990436 - RNA, 16 nt, Mycobacterium avium subsp. paratuberculosis
cgcggcgcgcggccgc

SEQ ID NO: 2990437 - RNA, 16 nt, Mycobacterium avium subsp. paratuberculosis
cgcggcgcggacccca

SEQ ID NO: 2990438 - RNA, 16 nt, Mycobacterium avium subsp. paratuberculosis
cgcggcgcggagccgg

SEQ ID NO: 2990439 - RNA, 21 nt, Mycobacterium avium subsp. paratuberculosis
cgcggcgcggagccggccgcc

SEQ ID NO: 2990440 - RNA, 16 nt, Mycobacterium avium subsp. paratuberculosis
cgcggcgcggcccggc

SEQ ID NO: 2990441 - RNA, 17 nt, Mycobacterium avium subsp. paratuberculosis
cgcggcgcggcccggcc

SEQ ID NO: 2990442 - RNA, 15 nt, Mycobacterium avium subsp. paratuberculosis
cgcggcgcgggucgc

SEQ ID NO: 2990443 - RNA, 17 nt, Mycobacterium avium subsp. paratuberculosis
cgcggcgcgggucgcug

SEQ ID NO: 2990444 - RNA, 13 nt, Mycobacterium avium subsp. paratuberculosis
cgcggcgcugccg

SEQ ID NO: 2990445 - RNA, 16 nt, Mycobacterium avium subsp. paratuberculosis
cgcggcgcugccgccg

SEQ ID NO: 2990446 - RNA, 14 nt, Mycobacterium avium subsp. paratuberculosis
cgcggcgcugccgg

SEQ ID NO: 2990447 - RNA, 17 nt, Mycobacterium avium subsp. paratuberculosis
cgcggcgcugccggugc

SEQ ID NO: 2990448 - RNA, 15 nt, Mycobacterium avium subsp. paratuberculosis
cgcggcgcugcgccg

SEQ ID NO: 2990449 - RNA, 17 nt, Mycobacterium avium subsp. paratuberculosis
cgcggcgcugcgccguu

SEQ ID NO: 2990450 - RNA, 16 nt, Mycobacterium avium subsp. paratuberculosis
cgcggcggacagcacg

SEQ ID NO: 2990451 - RNA, 14 nt, Mycobacterium avium subsp. paratuberculosis
cgcggcggacgaug

SEQ ID NO: 2990452 - RNA, 15 nt, Mycobacterium avium subsp. paratuberculosis
cgcggcggacgaugu

SEQ ID NO: 2990453 - RNA, 21 nt, Mycobacterium avium subsp. paratuberculosis
cgcggcggacgauguccgccg

SEQ ID NO: 2990454 - RNA, 23 nt, Mycobacterium avium subsp. paratuberculosis
cgcggcggaggccugcgcggccg

SEQ ID NO: 2990455 - RNA, 12 nt, Mycobacterium avium subsp. paratuberculosis
cgcggcggaggg

SEQ ID NO: 2990456 - RNA, 22 nt, Mycobacterium avium subsp. paratuberculosis
cgcggcggagggguacucggcu

SEQ ID NO: 2990457 - RNA, 19 nt, Mycobacterium avium subsp. paratuberculosis
cgcggcggaggucagcggc

SEQ ID NO: 2990458 - RNA, 20 nt, Mycobacterium avium subsp. paratuberculosis
cgcggcggaggucagcggcc

SEQ ID NO: 2990459 - RNA, 19 nt, Mycobacterium avium subsp. paratuberculosis
cgcggcggauccagcaccg

SEQ ID NO: 2990460 - RNA, 21 nt, Mycobacterium avium subsp. paratuberculosis
cgcggcggauccagcaccgcc

SEQ ID NO: 2990461 - RNA, 22 nt, Mycobacterium avium subsp. paratuberculosis
cgcggcggauccagcaccgcca

SEQ ID NO: 2990462 - RNA, 15 nt, Mycobacterium avium subsp. paratuberculosis
cgcggcggcaaccag

SEQ ID NO: 2990463 - RNA, 19 nt, Mycobacterium avium subsp. paratuberculosis
cgcggcggcaaccagcucc

SEQ ID NO: 2990464 - RNA, 23 nt, Mycobacterium avium subsp. paratuberculosis
cgcggcggcaaccagcuccggca

SEQ ID NO: 2990465 - RNA, 18 nt, Mycobacterium avium subsp. paratuberculosis
cgcggcggcaaguccggg

SEQ ID NO: 2990466 - RNA, 14 nt, Mycobacterium avium subsp. paratuberculosis
cgcggcggcaccca

SEQ ID NO: 2990467 - RNA, 15 nt, Mycobacterium avium subsp. paratuberculosis
cgcggcggcacccag

SEQ ID NO: 2990468 - RNA, 16 nt, Mycobacterium avium subsp. paratuberculosis
cgcggcggcagcaccc

SEQ ID NO: 2990469 - RNA, 18 nt, Mycobacterium avium subsp. paratuberculosis
cgcggcggcagcacccgc

SEQ ID NO: 2990470 - RNA, 19 nt, Mycobacterium avium subsp. paratuberculosis
cgcggcggcagcacccgca

SEQ ID NO: 2990471 - RNA, 17 nt, Mycobacterium avium subsp. paratuberculosis
cgcggcggcagcagccc

SEQ ID NO: 2990472 - RNA, 11 nt, Mycobacterium avium subsp. paratuberculosis
cgcggcggcca

SEQ ID NO: 2990473 - RNA, 14 nt, Mycobacterium avium subsp. paratuberculosis
cgcggcggccaccg

SEQ ID NO: 2990474 - RNA, 15 nt, Mycobacterium avium subsp. paratuberculosis
cgcggcggccaccgc

SEQ ID NO: 2990475 - RNA, 19 nt, Mycobacterium avium subsp. paratuberculosis
cgcggcggccaccgcgccg

SEQ ID NO: 2990476 - RNA, 21 nt, Mycobacterium avium subsp. paratuberculosis
cgcggcggccaccgcgccgug

SEQ ID NO: 2990477 - RNA, 13 nt, Mycobacterium avium subsp. paratuberculosis
cgcggcggccagc

SEQ ID NO: 2990478 - RNA, 20 nt, Mycobacterium avium subsp. paratuberculosis
cgcggcggccagcucggccc

SEQ ID NO: 2990479 - RNA, 12 nt, Mycobacterium avium subsp. paratuberculosis
cgcggcggccau

SEQ ID NO: 2990480 - RNA, 21 nt, Mycobacterium avium subsp. paratuberculosis
cgcggcggccaucucgugccc

SEQ ID NO: 2990481 - RNA, 14 nt, Mycobacterium avium subsp. paratuberculosis
cgcggcggcccggc

SEQ ID NO: 2990482 - RNA, 22 nt, Mycobacterium avium subsp. paratuberculosis
cgcggcggccgacagcgcgucg

SEQ ID NO: 2990483 - RNA, 22 nt, Mycobacterium avium subsp. paratuberculosis
cgcggcggccgacgcgccgucg

SEQ ID NO: 2990484 - RNA, 12 nt, Mycobacterium avium subsp. paratuberculosis
cgcggcggccgg

SEQ ID NO: 2990485 - RNA, 22 nt, Mycobacterium avium subsp. paratuberculosis
cgcggcggccggccagcgcgcg

SEQ ID NO: 2990486 - RNA, 14 nt, Mycobacterium avium subsp. paratuberculosis
cgcggcggccggcg

SEQ ID NO: 2990487 - RNA, 15 nt, Mycobacterium avium subsp. paratuberculosis
cgcggcggccggcga

SEQ ID NO: 2990488 - RNA, 15 nt, Mycobacterium avium subsp. paratuberculosis
cgcggcggccggcgc

SEQ ID NO: 2990489 - RNA, 16 nt, Mycobacterium avium subsp. paratuberculosis
cgcggcggccggcgcc

SEQ ID NO: 2990490 - RNA, 18 nt, Mycobacterium avium subsp. paratuberculosis
cgcggcggccugcgcguc

SEQ ID NO: 2990491 - RNA, 23 nt, Mycobacterium avium subsp. paratuberculosis
cgcggcggccuggccgucgcggc

SEQ ID NO: 2990492 - RNA, 16 nt, Mycobacterium avium subsp. paratuberculosis
cgcggcggcgacgucg

SEQ ID NO: 2990493 - RNA, 18 nt, Mycobacterium avium subsp. paratuberculosis
cgcggcggcgacgucgac

SEQ ID NO: 2990494 - RNA, 15 nt, Mycobacterium avium subsp. paratuberculosis
cgcggcggcgccgac

SEQ ID NO: 2990495 - RNA, 19 nt, Mycobacterium avium subsp. paratuberculosis
cgcggcggcgccgacgggc

SEQ ID NO: 2990496 - RNA, 22 nt, Mycobacterium avium subsp. paratuberculosis
cgcggcggcgccgacgggcccg

SEQ ID NO: 2990497 - RNA, 15 nt, Mycobacterium avium subsp. paratuberculosis
cgcggcggcgccgca

SEQ ID NO: 2990498 - RNA, 16 nt, Mycobacterium avium subsp. paratuberculosis
cgcggcggcgccgcag

SEQ ID NO: 2990499 - RNA, 20 nt, Mycobacterium avium subsp. paratuberculosis
cgcggcggcgccgcagcacg

SEQ ID NO: 2990500 - RNA, 15 nt, Mycobacterium avium subsp. paratuberculosis
cgcggcggcgccguc

SEQ ID NO: 2990501 - RNA, 16 nt, Mycobacterium avium subsp. paratuberculosis
cgcggcggcgccgucg

SEQ ID NO: 2990502 - RNA, 20 nt, Mycobacterium avium subsp. paratuberculosis
cgcggcggcgccgucgccga

SEQ ID NO: 2990503 - RNA, 13 nt, Mycobacterium avium subsp. paratuberculosis
cgcggcggcggcc

SEQ ID NO: 2990504 - RNA, 19 nt, Mycobacterium avium subsp. paratuberculosis
cgcggcggcggcccguccg

SEQ ID NO: 2990505 - RNA, 23 nt, Mycobacterium avium subsp. paratuberculosis
cgcggcggcggcccguccgcccc

SEQ ID NO: 2990506 - RNA, 16 nt, Mycobacterium avium subsp. paratuberculosis
cgcggcggcggcgcgg

SEQ ID NO: 2990507 - RNA, 12 nt, Mycobacterium avium subsp. paratuberculosis
cgcggcggcgua

SEQ ID NO: 2990508 - RNA, 16 nt, Mycobacterium avium subsp. paratuberculosis
cgcggcggcguacgcg

SEQ ID NO: 2990509 - RNA, 14 nt, Mycobacterium avium subsp. paratuberculosis
cgcggcggcguccg

SEQ ID NO: 2990510 - RNA, 16 nt, Mycobacterium avium subsp. paratuberculosis
cgcggcggcgucgacc

SEQ ID NO: 2990511 - RNA, 15 nt, Mycobacterium avium subsp. paratuberculosis
cgcggcggcgucggc

SEQ ID NO: 2990512 - RNA, 16 nt, Mycobacterium avium subsp. paratuberculosis
cgcggcggcgucggcg

SEQ ID NO: 2990513 - RNA, 18 nt, Mycobacterium avium subsp. paratuberculosis
cgcggcggcgugccgccc

SEQ ID NO: 2990514 - RNA, 13 nt, Mycobacterium avium subsp. paratuberculosis
cgcggcggcucgg

SEQ ID NO: 2990515 - RNA, 15 nt, Mycobacterium avium subsp. paratuberculosis
cgcggcggcucggcg

SEQ ID NO: 2990516 - RNA, 16 nt, Mycobacterium avium subsp. paratuberculosis
cgcggcggcucggcgg

SEQ ID NO: 2990517 - RNA, 18 nt, Mycobacterium avium subsp. paratuberculosis
cgcggcggcucggcggcg

SEQ ID NO: 2990518 - RNA, 22 nt, Mycobacterium avium subsp. paratuberculosis
cgcggcgggaaaccaccugccg

SEQ ID NO: 2990519 - RNA, 14 nt, Mycobacterium avium subsp. paratuberculosis
cgcggcgggcaggu

SEQ ID NO: 2990520 - RNA, 13 nt, Mycobacterium avium subsp. paratuberculosis
cgcggcgggccag

SEQ ID NO: 2990521 - RNA, 18 nt, Mycobacterium avium subsp. paratuberculosis
cgcggcgggccagucgcc

SEQ ID NO: 2990522 - RNA, 20 nt, Mycobacterium avium subsp. paratuberculosis
cgcggcgggccagucgccgc

SEQ ID NO: 2990523 - RNA, 13 nt, Mycobacterium avium subsp. paratuberculosis
cgcggcgggcccg

SEQ ID NO: 2990524 - RNA, 15 nt, Mycobacterium avium subsp. paratuberculosis
cgcggcgggcccgca

SEQ ID NO: 2990525 - RNA, 20 nt, Mycobacterium avium subsp. paratuberculosis
cgcggcgggcccgcagcucg

SEQ ID NO: 2990526 - RNA, 21 nt, Mycobacterium avium subsp. paratuberculosis
cgcggcgggccuugagcaccg

SEQ ID NO: 2990527 - RNA, 22 nt, Mycobacterium avium subsp. paratuberculosis
cgcggcgggccuugagcaccgc

SEQ ID NO: 2990528 - RNA, 15 nt, Mycobacterium avium subsp. paratuberculosis
cgcggcgggcgagcc

SEQ ID NO: 2990529 - RNA, 19 nt, Mycobacterium avium subsp. paratuberculosis
cgcggcgggcgcgucgagg

SEQ ID NO: 2990530 - RNA, 20 nt, Mycobacterium avium subsp. paratuberculosis
cgcggcgggcgcgucgaggu

SEQ ID NO: 2990531 - RNA, 16 nt, Mycobacterium avium subsp. paratuberculosis
cgcggcgggcgugcga

SEQ ID NO: 2990532 - RNA, 12 nt, Mycobacterium avium subsp. paratuberculosis
cgcggcggggca

SEQ ID NO: 2990533 - RNA, 22 nt, Mycobacterium avium subsp. paratuberculosis
cgcggcggggcauggugucagg

SEQ ID NO: 2990534 - RNA, 19 nt, Mycobacterium avium subsp. paratuberculosis
cgcggcgggggucggagca

SEQ ID NO: 2990535 - RNA, 21 nt, Mycobacterium avium subsp. paratuberculosis
cgcggcgggguccacgcagug

SEQ ID NO: 2990536 - RNA, 18 nt, Mycobacterium avium subsp. paratuberculosis
cgcggcgggucagcaccc

SEQ ID NO: 2990537 - RNA, 12 nt, Mycobacterium avium subsp. paratuberculosis
cgcggcggucag

SEQ ID NO: 2990538 - RNA, 17 nt, Mycobacterium avium subsp. paratuberculosis
cgcggcggucagguucg

SEQ ID NO: 2990539 - RNA, 15 nt, Mycobacterium avium subsp. paratuberculosis
cgcggcgguccagcg

SEQ ID NO: 2990540 - RNA, 12 nt, Mycobacterium avium subsp. paratuberculosis
cgcggcggucgc

SEQ ID NO: 2990541 - RNA, 14 nt, Mycobacterium avium subsp. paratuberculosis
cgcggcggucgcca

SEQ ID NO: 2990542 - RNA, 21 nt, Mycobacterium avium subsp. paratuberculosis
cgcggcggucgcgcgccggcg

SEQ ID NO: 2990543 - RNA, 22 nt, Mycobacterium avium subsp. paratuberculosis
cgcggcggucgcgcgccggcgc

SEQ ID NO: 2990544 - RNA, 19 nt, Mycobacterium avium subsp. paratuberculosis
cgcggcggugaccggaucg

SEQ ID NO: 2990545 - RNA, 14 nt, Mycobacterium avium subsp. paratuberculosis
cgcggcggugacga

SEQ ID NO: 2990546 - RNA, 16 nt, Mycobacterium avium subsp. paratuberculosis
cgcggcggugagccgc

SEQ ID NO: 2990547 - RNA, 13 nt, Mycobacterium avium subsp. paratuberculosis
cgcggcggugccg

SEQ ID NO: 2990548 - RNA, 16 nt, Mycobacterium avium subsp. paratuberculosis
cgcggcggugccggug

SEQ ID NO: 2990549 - RNA, 16 nt, Mycobacterium avium subsp. paratuberculosis
cgcggcggugcgcagc

SEQ ID NO: 2990550 - RNA, 17 nt, Mycobacterium avium subsp. paratuberculosis
cgcggcggugcgcagcc

SEQ ID NO: 2990551 - RNA, 18 nt, Mycobacterium avium subsp. paratuberculosis
cgcggcggugcgcagccg

SEQ ID NO: 2990552 - RNA, 19 nt, Mycobacterium avium subsp. paratuberculosis
cgcggcggugcgcagccgc

SEQ ID NO: 2990553 - RNA, 22 nt, Mycobacterium avium subsp. paratuberculosis
cgcggcggugcgcagccgcugc

SEQ ID NO: 2990554 - RNA, 17 nt, Mycobacterium avium subsp. paratuberculosis
cgcggcggugcucgcgc

SEQ ID NO: 2990555 - RNA, 19 nt, Mycobacterium avium subsp. paratuberculosis
cgcggcggugcucgcgccg

SEQ ID NO: 2990556 - RNA, 21 nt, Mycobacterium avium subsp. paratuberculosis
cgcggcggugcucgcgccggg

SEQ ID NO: 2990557 - RNA, 22 nt, Mycobacterium avium subsp. paratuberculosis
cgcggcggugcucgcgccgggc

SEQ ID NO: 2990558 - RNA, 15 nt, Mycobacterium avium subsp. paratuberculosis
cgcggcgguggccug

SEQ ID NO: 2990559 - RNA, 17 nt, Mycobacterium avium subsp. paratuberculosis
cgcggcgguggccugcc

SEQ ID NO: 2990560 - RNA, 19 nt, Mycobacterium avium subsp. paratuberculosis
cgcggcgguggccugcccg

SEQ ID NO: 2990561 - RNA, 22 nt, Mycobacterium avium subsp. paratuberculosis
cgcggcgguggccugcccggcg

SEQ ID NO: 2990562 - RNA, 14 nt, Mycobacterium avium subsp. paratuberculosis
cgcggcggugucgg

SEQ ID NO: 2990563 - RNA, 19 nt, Mycobacterium avium subsp. paratuberculosis
cgcggcggugucggugccc

SEQ ID NO: 2990564 - RNA, 14 nt, Mycobacterium avium subsp. paratuberculosis
cgcggcguagccgc

SEQ ID NO: 2990565 - RNA, 15 nt, Mycobacterium avium subsp. paratuberculosis
cgcggcguagccgcc

SEQ ID NO: 2990566 - RNA, 21 nt, Mycobacterium avium subsp. paratuberculosis
cgcggcguaggugggcagcgc

SEQ ID NO: 2990567 - RNA, 17 nt, Mycobacterium avium subsp. paratuberculosis
cgcggcgucacccugga

SEQ ID NO: 2990568 - RNA, 20 nt, Mycobacterium avium subsp. paratuberculosis
cgcggcgucaggggugccag

SEQ ID NO: 2990569 - RNA, 16 nt, Mycobacterium avium subsp. paratuberculosis
cgcggcgucauccccc

SEQ ID NO: 2990570 - RNA, 23 nt, Mycobacterium avium subsp. paratuberculosis
cgcggcgucaucccccgcagcuu

SEQ ID NO: 2990571 - RNA, 12 nt, Mycobacterium avium subsp. paratuberculosis
cgcggcguccac

SEQ ID NO: 2990572 - RNA, 16 nt, Mycobacterium avium subsp. paratuberculosis
cgcggcguccaccagc

SEQ ID NO: 2990573 - RNA, 19 nt, Mycobacterium avium subsp. paratuberculosis
cgcggcguccaccagcacg

SEQ ID NO: 2990574 - RNA, 22 nt, Mycobacterium avium subsp. paratuberculosis
cgcggcguccaccagcacgccg

SEQ ID NO: 2990575 - RNA, 12 nt, Mycobacterium avium subsp. paratuberculosis
cgcggcgucggc

SEQ ID NO: 2990576 - RNA, 14 nt, Mycobacterium avium subsp. paratuberculosis
cgcggcgucggccg

SEQ ID NO: 2990577 - RNA, 20 nt, Mycobacterium avium subsp. paratuberculosis
cgcggcgucggccgggcugc

SEQ ID NO: 2990578 - RNA, 17 nt, Mycobacterium avium subsp. paratuberculosis
cgcggcgucggccugcc

SEQ ID NO: 2990579 - RNA, 20 nt, Mycobacterium avium subsp. paratuberculosis
cgcggcgucgggauggucga

SEQ ID NO: 2990580 - RNA, 15 nt, Mycobacterium avium subsp. paratuberculosis
cgcggcgucgggcgg

SEQ ID NO: 2990581 - RNA, 19 nt, Mycobacterium avium subsp. paratuberculosis
cgcggcgucgggcgggugg

SEQ ID NO: 2990582 - RNA, 14 nt, Mycobacterium avium subsp. paratuberculosis
cgcggcgugcgcca

SEQ ID NO: 2990583 - RNA, 14 nt, Mycobacterium avium subsp. paratuberculosis
cgcggcgugguagc

SEQ ID NO: 2990584 - RNA, 16 nt, Mycobacterium avium subsp. paratuberculosis
cgcggcguucuccagc

SEQ ID NO: 2990585 - RNA, 16 nt, Mycobacterium avium subsp. paratuberculosis
cgcggcguugcccgcu

SEQ ID NO: 2990586 - RNA, 22 nt, Mycobacterium avium subsp. paratuberculosis
cgcggcguugcccgcugcggca

SEQ ID NO: 2990587 - RNA, 23 nt, Mycobacterium avium subsp. paratuberculosis
cgcggcguugcccgcugcggcaa

SEQ ID NO: 2990588 - RNA, 16 nt, Mycobacterium avium subsp. paratuberculosis
cgcggcguugcccggg

SEQ ID NO: 2990589 - RNA, 17 nt, Mycobacterium avium subsp. paratuberculosis
cgcggcguugcccgggu

SEQ ID NO: 2990590 - RNA, 19 nt, Mycobacterium avium subsp. paratuberculosis
cgcggcguugcccgggucc

SEQ ID NO: 2990591 - RNA, 13 nt, Mycobacterium avium subsp. paratuberculosis
cgcggcguugccg

SEQ ID NO: 2990592 - RNA, 20 nt, Mycobacterium avium subsp. paratuberculosis
cgcggcguugccgccggcgc

SEQ ID NO: 2990593 - RNA, 21 nt, Mycobacterium avium subsp. paratuberculosis
cgcggcguugccgccggcgcg

SEQ ID NO: 2990594 - RNA, 20 nt, Mycobacterium avium subsp. paratuberculosis
cgcggcuaguuggccggcuu

SEQ ID NO: 2990595 - RNA, 22 nt, Mycobacterium avium subsp. paratuberculosis
cgcggcucacagcgcggcggug

SEQ ID NO: 2990596 - RNA, 23 nt, Mycobacterium avium subsp. paratuberculosis
cgcggcucacagcgcggcgguga

SEQ ID NO: 2990597 - RNA, 23 nt, Mycobacterium avium subsp. paratuberculosis
cgcggcucacgacuccuggccga

SEQ ID NO: 2990598 - RNA, 14 nt, Mycobacterium avium subsp. paratuberculosis
cgcggcuccagcag

SEQ ID NO: 2990599 - RNA, 14 nt, Mycobacterium avium subsp. paratuberculosis
cgcggcuccggccg

SEQ ID NO: 2990600 - RNA, 16 nt, Mycobacterium avium subsp. paratuberculosis
cgcggcuccggccgcg

SEQ ID NO: 2990601 - RNA, 17 nt, Mycobacterium avium subsp. paratuberculosis
cgcggcuccggccgcgc

SEQ ID NO: 2990602 - RNA, 23 nt, Mycobacterium avium subsp. paratuberculosis
cgcggcuccggccgcgccggccu

SEQ ID NO: 2990603 - RNA, 14 nt, Mycobacterium avium subsp. paratuberculosis
cgcggcucgcgacg

SEQ ID NO: 2990604 - RNA, 14 nt, Mycobacterium avium subsp. paratuberculosis
cgcggcucgcgcgg

SEQ ID NO: 2990605 - RNA, 15 nt, Mycobacterium avium subsp. paratuberculosis
cgcggcucgcgcggu

SEQ ID NO: 2990606 - RNA, 16 nt, Mycobacterium avium subsp. paratuberculosis
cgcggcucgcgcggug

SEQ ID NO: 2990607 - RNA, 18 nt, Mycobacterium avium subsp. paratuberculosis
cgcggcucggucgcgaag

SEQ ID NO: 2990608 - RNA, 17 nt, Mycobacterium avium subsp. paratuberculosis
cgcggcugaucagccgg

SEQ ID NO: 2990609 - RNA, 13 nt, Mycobacterium avium subsp. paratuberculosis
cgcggcugccggu

SEQ ID NO: 2990610 - RNA, 14 nt, Mycobacterium avium subsp. paratuberculosis
cgcggcugccggug

SEQ ID NO: 2990611 - RNA, 15 nt, Mycobacterium avium subsp. paratuberculosis
cgcggcugccggugc

SEQ ID NO: 2990612 - RNA, 16 nt, Mycobacterium avium subsp. paratuberculosis
cgcggcugccggugcu

SEQ ID NO: 2990613 - RNA, 17 nt, Mycobacterium avium subsp. paratuberculosis
cgcggcugcucgaaccg

SEQ ID NO: 2990614 - RNA, 14 nt, Mycobacterium avium subsp. paratuberculosis
cgcggcuggcccgg

SEQ ID NO: 2990615 - RNA, 20 nt, Mycobacterium avium subsp. paratuberculosis
cgcggcuggcccggcgcggc

SEQ ID NO: 2990616 - RNA, 21 nt, Mycobacterium avium subsp. paratuberculosis
cgcggcuggcccggcgcggcg

SEQ ID NO: 2990617 - RNA, 15 nt, Mycobacterium avium subsp. paratuberculosis
cgcggcuggccgcgg

SEQ ID NO: 2990618 - RNA, 23 nt, Mycobacterium avium subsp. paratuberculosis
cgcggcuggccgcggcgaucggc

SEQ ID NO: 2990619 - RNA, 13 nt, Mycobacterium avium subsp. paratuberculosis
cgcggcuggccgu

SEQ ID NO: 2990620 - RNA, 14 nt, Mycobacterium avium subsp. paratuberculosis
cgcggcuggccguc

SEQ ID NO: 2990621 - RNA, 17 nt, Mycobacterium avium subsp. paratuberculosis
cgcggcuggugccgccg

SEQ ID NO: 2990622 - RNA, 18 nt, Mycobacterium avium subsp. paratuberculosis
cgcggcuggugccgccgg

SEQ ID NO: 2990623 - RNA, 20 nt, Mycobacterium avium subsp. paratuberculosis
cgcggcuggugccgccggcg

SEQ ID NO: 2990624 - RNA, 21 nt, Mycobacterium avium subsp. paratuberculosis
cgcggcuggugccgccggcga

SEQ ID NO: 2990625 - RNA, 20 nt, Mycobacterium avium subsp. paratuberculosis
cgcggcuucauaugacgccg

SEQ ID NO: 2990626 - RNA, 21 nt, Mycobacterium avium subsp. paratuberculosis
cgcggcuucauaugacgccgg

SEQ ID NO: 2990627 - RNA, 22 nt, Mycobacterium avium subsp. paratuberculosis
cgcggcuucauaugacgccggc

SEQ ID NO: 2990628 - RNA, 19 nt, Mycobacterium avium subsp. paratuberculosis
cgcggcuugcugcgguagg

SEQ ID NO: 2990629 - RNA, 15 nt, Mycobacterium avium subsp. paratuberculosis
cgcggcuuggccacc

SEQ ID NO: 2990630 - RNA, 18 nt, Mycobacterium avium subsp. paratuberculosis
cgcggcuuggccaccacc

SEQ ID NO: 2990631 - RNA, 23 nt, Mycobacterium avium subsp. paratuberculosis
cgcggcuuggccaccaccacgga

SEQ ID NO: 2990632 - RNA, 18 nt, Mycobacterium avium subsp. paratuberculosis
cgcggcuuuuggcgucgu

SEQ ID NO: 2990633 - RNA, 15 nt, Mycobacterium avium subsp. paratuberculosis
cgcgggaacgaucgg

SEQ ID NO: 2990634 - RNA, 22 nt, Mycobacterium avium subsp. paratuberculosis
cgcgggaacgaucggcuccagc

SEQ ID NO: 2990635 - RNA, 14 nt, Mycobacterium avium subsp. paratuberculosis
cgcgggaagccgcc

SEQ ID NO: 2990636 - RNA, 15 nt, Mycobacterium avium subsp. paratuberculosis
cgcgggaagccgccg

SEQ ID NO: 2990637 - RNA, 18 nt, Mycobacterium avium subsp. paratuberculosis
cgcgggaagccgccgccc

SEQ ID NO: 2990638 - RNA, 16 nt, Mycobacterium avium subsp. paratuberculosis
cgcgggaaucccaccc

SEQ ID NO: 2990639 - RNA, 19 nt, Mycobacterium avium subsp. paratuberculosis
cgcgggaauggccgcgccg

SEQ ID NO: 2990640 - RNA, 19 nt, Mycobacterium avium subsp. paratuberculosis
cgcgggaauuggcaccgga

SEQ ID NO: 2990641 - RNA, 22 nt, Mycobacterium avium subsp. paratuberculosis
cgcgggaauuggcaccggaccg

SEQ ID NO: 2990642 - RNA, 23 nt, Mycobacterium avium subsp. paratuberculosis
cgcgggaauuggcaccggaccgc

SEQ ID NO: 2990643 - RNA, 18 nt, Mycobacterium avium subsp. paratuberculosis
cgcgggacacggcggcgc

SEQ ID NO: 2990644 - RNA, 16 nt, Mycobacterium avium subsp. paratuberculosis
cgcgggaccgggcccg

SEQ ID NO: 2990645 - RNA, 19 nt, Mycobacterium avium subsp. paratuberculosis
cgcgggaccgggcccggcg

SEQ ID NO: 2990646 - RNA, 22 nt, Mycobacterium avium subsp. paratuberculosis
cgcgggaccgggcccggcgcca

SEQ ID NO: 2990647 - RNA, 12 nt, Mycobacterium avium subsp. paratuberculosis
cgcgggacggcg

SEQ ID NO: 2990648 - RNA, 13 nt, Mycobacterium avium subsp. paratuberculosis
cgcgggacggcgg

SEQ ID NO: 2990649 - RNA, 15 nt, Mycobacterium avium subsp. paratuberculosis
cgcgggacggcggcg

SEQ ID NO: 2990650 - RNA, 13 nt, Mycobacterium avium subsp. paratuberculosis
cgcgggagcgcug

SEQ ID NO: 2990651 - RNA, 18 nt, Mycobacterium avium subsp. paratuberculosis
cgcgggagcgcuggucgg

SEQ ID NO: 2990652 - RNA, 23 nt, Mycobacterium avium subsp. paratuberculosis
cgcgggagcgcuggucggcgaac

SEQ ID NO: 2990653 - RNA, 15 nt, Mycobacterium avium subsp. paratuberculosis
cgcgggaggacagcg

SEQ ID NO: 2990654 - RNA, 19 nt, Mycobacterium avium subsp. paratuberculosis
cgcgggaguccacgccgug

SEQ ID NO: 2990655 - RNA, 19 nt, Mycobacterium avium subsp. paratuberculosis
cgcgggaguggccggcguc

SEQ ID NO: 2990656 - RNA, 20 nt, Mycobacterium avium subsp. paratuberculosis
cgcgggaguggccggcgucc

SEQ ID NO: 2990657 - RNA, 23 nt, Mycobacterium avium subsp. paratuberculosis
cgcgggaguggccggcguccagg

SEQ ID NO: 2990658 - RNA, 12 nt, Mycobacterium avium subsp. paratuberculosis
cgcgggaucagc

SEQ ID NO: 2990659 - RNA, 14 nt, Mycobacterium avium subsp. paratuberculosis
cgcgggaucggccg

SEQ ID NO: 2990660 - RNA, 15 nt, Mycobacterium avium subsp. paratuberculosis
cgcgggaucggccgg

SEQ ID NO: 2990661 - RNA, 17 nt, Mycobacterium avium subsp. paratuberculosis
cgcgggaucggccggcg

SEQ ID NO: 2990662 - RNA, 15 nt, Mycobacterium avium subsp. paratuberculosis
cgcgggaucggugcc

SEQ ID NO: 2990663 - RNA, 16 nt, Mycobacterium avium subsp. paratuberculosis
cgcgggaucggugccg

SEQ ID NO: 2990664 - RNA, 22 nt, Mycobacterium avium subsp. paratuberculosis
cgcgggaucggugccgacggug

SEQ ID NO: 2990665 - RNA, 16 nt, Mycobacterium avium subsp. paratuberculosis
cgcgggauugccgagc

SEQ ID NO: 2990666 - RNA, 17 nt, Mycobacterium avium subsp. paratuberculosis
cgcgggauugccgagca

SEQ ID NO: 2990667 - RNA, 20 nt, Mycobacterium avium subsp. paratuberculosis
cgcgggauugccgagcaccc

SEQ ID NO: 2990668 - RNA, 16 nt, Mycobacterium avium subsp. paratuberculosis
cgcgggcaaucgcugc

SEQ ID NO: 2990669 - RNA, 18 nt, Mycobacterium avium subsp. paratuberculosis
cgcgggcaaucgcugcgc

SEQ ID NO: 2990670 - RNA, 21 nt, Mycobacterium avium subsp. paratuberculosis
cgcgggcaaucgcugcgcccg

SEQ ID NO: 2990671 - RNA, 12 nt, Mycobacterium avium subsp. paratuberculosis
cgcgggcaccgu

SEQ ID NO: 2990672 - RNA, 14 nt, Mycobacterium avium subsp. paratuberculosis
cgcgggcaccgucg

SEQ ID NO: 2990673 - RNA, 15 nt, Mycobacterium avium subsp. paratuberculosis
cgcgggcaccgucgu

SEQ ID NO: 2990674 - RNA, 17 nt, Mycobacterium avium subsp. paratuberculosis
cgcgggcacggcgaugu

SEQ ID NO: 2990675 - RNA, 19 nt, Mycobacterium avium subsp. paratuberculosis
cgcgggcagcagcuuggcg

SEQ ID NO: 2990676 - RNA, 19 nt, Mycobacterium avium subsp. paratuberculosis
cgcgggcagccggcgcccg

SEQ ID NO: 2990677 - RNA, 20 nt, Mycobacterium avium subsp. paratuberculosis
cgcgggcagccggcgcccgc

SEQ ID NO: 2990678 - RNA, 12 nt, Mycobacterium avium subsp. paratuberculosis
cgcgggcaucgc

SEQ ID NO: 2990679 - RNA, 23 nt, Mycobacterium avium subsp. paratuberculosis
cgcgggccacagcggcgacagcg

SEQ ID NO: 2990680 - RNA, 20 nt, Mycobacterium avium subsp. paratuberculosis
cgcgggccaccgcggcguug

SEQ ID NO: 2990681 - RNA, 23 nt, Mycobacterium avium subsp. paratuberculosis
cgcgggccaccgcggcguugccc

SEQ ID NO: 2990682 - RNA, 18 nt, Mycobacterium avium subsp. paratuberculosis
cgcgggccaccggcgcca

SEQ ID NO: 2990683 - RNA, 21 nt, Mycobacterium avium subsp. paratuberculosis
cgcgggccagacugcgcaccg

SEQ ID NO: 2990684 - RNA, 22 nt, Mycobacterium avium subsp. paratuberculosis
cgcgggccagacugcgcaccgc

SEQ ID NO: 2990685 - RNA, 13 nt, Mycobacterium avium subsp. paratuberculosis
cgcgggccagcag

SEQ ID NO: 2990686 - RNA, 14 nt, Mycobacterium avium subsp. paratuberculosis
cgcgggccagcagc

SEQ ID NO: 2990687 - RNA, 15 nt, Mycobacterium avium subsp. paratuberculosis
cgcgggccagcagca

SEQ ID NO: 2990688 - RNA, 17 nt, Mycobacterium avium subsp. paratuberculosis
cgcgggccagcagcagc

SEQ ID NO: 2990689 - RNA, 15 nt, Mycobacterium avium subsp. paratuberculosis
cgcgggccagcagcc

SEQ ID NO: 2990690 - RNA, 16 nt, Mycobacterium avium subsp. paratuberculosis
cgcgggccagcagccg

SEQ ID NO: 2990691 - RNA, 19 nt, Mycobacterium avium subsp. paratuberculosis
cgcgggccagcagccgggu

SEQ ID NO: 2990692 - RNA, 21 nt, Mycobacterium avium subsp. paratuberculosis
cgcgggccagcagccggguca

SEQ ID NO: 2990693 - RNA, 14 nt, Mycobacterium avium subsp. paratuberculosis
cgcgggccagcgcc

SEQ ID NO: 2990694 - RNA, 13 nt, Mycobacterium avium subsp. paratuberculosis
cgcgggccagcgu

SEQ ID NO: 2990695 - RNA, 23 nt, Mycobacterium avium subsp. paratuberculosis
cgcgggccagcguuuccagcgcc

SEQ ID NO: 2990696 - RNA, 12 nt, Mycobacterium avium subsp. paratuberculosis
cgcgggccaggc

SEQ ID NO: 2990697 - RNA, 14 nt, Mycobacterium avium subsp. paratuberculosis
cgcgggccaggccc

SEQ ID NO: 2990698 - RNA, 14 nt, Mycobacterium avium subsp. paratuberculosis
cgcgggcccaccgc

SEQ ID NO: 2990699 - RNA, 20 nt, Mycobacterium avium subsp. paratuberculosis
cgcgggcccaccgccaccag

SEQ ID NO: 2990700 - RNA, 13 nt, Mycobacterium avium subsp. paratuberculosis
cgcgggcccgccg

SEQ ID NO: 2990701 - RNA, 15 nt, Mycobacterium avium subsp. paratuberculosis
cgcgggcccgcgccg

SEQ ID NO: 2990702 - RNA, 16 nt, Mycobacterium avium subsp. paratuberculosis
cgcgggcccgcgccgc

SEQ ID NO: 2990703 - RNA, 18 nt, Mycobacterium avium subsp. paratuberculosis
cgcgggcccgcgccgcgu

SEQ ID NO: 2990704 - RNA, 17 nt, Mycobacterium avium subsp. paratuberculosis
cgcgggcccgcgcggcg

SEQ ID NO: 2990705 - RNA, 20 nt, Mycobacterium avium subsp. paratuberculosis
cgcgggcccgggccacccgc

SEQ ID NO: 2990706 - RNA, 21 nt, Mycobacterium avium subsp. paratuberculosis
cgcgggcccgggccacccgcg

SEQ ID NO: 2990707 - RNA, 21 nt, Mycobacterium avium subsp. paratuberculosis
cgcgggccgcagcgcgcgggu

SEQ ID NO: 2990708 - RNA, 12 nt, Mycobacterium avium subsp. paratuberculosis
cgcgggccgcgu

SEQ ID NO: 2990709 - RNA, 15 nt, Mycobacterium avium subsp. paratuberculosis
cgcgggccgcgucgg

SEQ ID NO: 2990710 - RNA, 16 nt, Mycobacterium avium subsp. paratuberculosis
cgcgggccgcgucggc

SEQ ID NO: 2990711 - RNA, 22 nt, Mycobacterium avium subsp. paratuberculosis
cgcgggccggcacuucgaucau

SEQ ID NO: 2990712 - RNA, 15 nt, Mycobacterium avium subsp. paratuberculosis
cgcgggccugcucgu

SEQ ID NO: 2990713 - RNA, 17 nt, Mycobacterium avium subsp. paratuberculosis
cgcgggcgacccgcugg

SEQ ID NO: 2990714 - RNA, 20 nt, Mycobacterium avium subsp. paratuberculosis
cgcgggcgaccugcgggccc

SEQ ID NO: 2990715 - RNA, 13 nt, Mycobacterium avium subsp. paratuberculosis
cgcgggcgagcag

SEQ ID NO: 2990716 - RNA, 20 nt, Mycobacterium avium subsp. paratuberculosis
cgcgggcgagcagcgcccgg

SEQ ID NO: 2990717 - RNA, 21 nt, Mycobacterium avium subsp. paratuberculosis
cgcgggcgagcagcgcccggg

SEQ ID NO: 2990718 - RNA, 22 nt, Mycobacterium avium subsp. paratuberculosis
cgcgggcgagcagcgcccgggu

SEQ ID NO: 2990719 - RNA, 13 nt, Mycobacterium avium subsp. paratuberculosis
cgcgggcgagccg

SEQ ID NO: 2990720 - RNA, 18 nt, Mycobacterium avium subsp. paratuberculosis
cgcgggcgaucuccagcg

SEQ ID NO: 2990721 - RNA, 19 nt, Mycobacterium avium subsp. paratuberculosis
cgcgggcgaucuccagcgg

SEQ ID NO: 2990722 - RNA, 16 nt, Mycobacterium avium subsp. paratuberculosis
cgcgggcgaugcggcc

SEQ ID NO: 2990723 - RNA, 19 nt, Mycobacterium avium subsp. paratuberculosis
cgcgggcgaugcggcccgg

SEQ ID NO: 2990724 - RNA, 16 nt, Mycobacterium avium subsp. paratuberculosis
cgcgggcgauucccgg

SEQ ID NO: 2990725 - RNA, 23 nt, Mycobacterium avium subsp. paratuberculosis
cgcgggcgauucccggaugcugc

SEQ ID NO: 2990726 - RNA, 18 nt, Mycobacterium avium subsp. paratuberculosis
cgcgggcgcauaccagcg

SEQ ID NO: 2990727 - RNA, 20 nt, Mycobacterium avium subsp. paratuberculosis
cgcgggcgcauaccagcgcu

SEQ ID NO: 2990728 - RNA, 21 nt, Mycobacterium avium subsp. paratuberculosis
cgcgggcgcauaccagcgcug

SEQ ID NO: 2990729 - RNA, 16 nt, Mycobacterium avium subsp. paratuberculosis
cgcgggcgcccguaga

SEQ ID NO: 2990730 - RNA, 13 nt, Mycobacterium avium subsp. paratuberculosis
cgcgggcgccgag

SEQ ID NO: 2990731 - RNA, 13 nt, Mycobacterium avium subsp. paratuberculosis
cgcgggcgcgccg

SEQ ID NO: 2990732 - RNA, 22 nt, Mycobacterium avium subsp. paratuberculosis
cgcgggcgcgccgucccagccg

SEQ ID NO: 2990733 - RNA, 12 nt, Mycobacterium avium subsp. paratuberculosis
cgcgggcgcgcg

SEQ ID NO: 2990734 - RNA, 13 nt, Mycobacterium avium subsp. paratuberculosis
cgcgggcgcgcgc

SEQ ID NO: 2990735 - RNA, 17 nt, Mycobacterium avium subsp. paratuberculosis
cgcgggcgcgcgccgcc

SEQ ID NO: 2990736 - RNA, 18 nt, Mycobacterium avium subsp. paratuberculosis
cgcgggcgcgcgccgccc

SEQ ID NO: 2990737 - RNA, 13 nt, Mycobacterium avium subsp. paratuberculosis
cgcgggcgcggac

SEQ ID NO: 2990738 - RNA, 13 nt, Mycobacterium avium subsp. paratuberculosis
cgcgggcgcggcc

SEQ ID NO: 2990739 - RNA, 14 nt, Mycobacterium avium subsp. paratuberculosis
cgcgggcgcggcca

SEQ ID NO: 2990740 - RNA, 21 nt, Mycobacterium avium subsp. paratuberculosis
cgcgggcggcaggucggcggg

SEQ ID NO: 2990741 - RNA, 22 nt, Mycobacterium avium subsp. paratuberculosis
cgcgggcggcaggucggcggga

SEQ ID NO: 2990742 - RNA, 14 nt, Mycobacterium avium subsp. paratuberculosis
cgcgggcggcgcag

SEQ ID NO: 2990743 - RNA, 18 nt, Mycobacterium avium subsp. paratuberculosis
cgcgggcggcgucggcga

SEQ ID NO: 2990744 - RNA, 15 nt, Mycobacterium avium subsp. paratuberculosis
cgcgggcggcgucgu

SEQ ID NO: 2990745 - RNA, 13 nt, Mycobacterium avium subsp. paratuberculosis
cgcgggcgggccg

SEQ ID NO: 2990746 - RNA, 14 nt, Mycobacterium avium subsp. paratuberculosis
cgcgggcgggccga

SEQ ID NO: 2990747 - RNA, 14 nt, Mycobacterium avium subsp. paratuberculosis
cgcgggcggggcgc

SEQ ID NO: 2990748 - RNA, 15 nt, Mycobacterium avium subsp. paratuberculosis
cgcgggcggucgcgc

SEQ ID NO: 2990749 - RNA, 16 nt, Mycobacterium avium subsp. paratuberculosis
cgcgggcggucgcgca

SEQ ID NO: 2990750 - RNA, 12 nt, Mycobacterium avium subsp. paratuberculosis
cgcgggcgucca

SEQ ID NO: 2990751 - RNA, 19 nt, Mycobacterium avium subsp. paratuberculosis
cgcgggcguccucgucggc

SEQ ID NO: 2990752 - RNA, 21 nt, Mycobacterium avium subsp. paratuberculosis
cgcgggcguccucgucggcga

SEQ ID NO: 2990753 - RNA, 15 nt, Mycobacterium avium subsp. paratuberculosis
cgcgggcgucgggca

SEQ ID NO: 2990754 - RNA, 16 nt, Mycobacterium avium subsp. paratuberculosis
cgcgggcgucgggcag

SEQ ID NO: 2990755 - RNA, 17 nt, Mycobacterium avium subsp. paratuberculosis
cgcgggcgucgggcagc

SEQ ID NO: 2990756 - RNA, 19 nt, Mycobacterium avium subsp. paratuberculosis
cgcgggcgucgggcagcag

SEQ ID NO: 2990757 - RNA, 17 nt, Mycobacterium avium subsp. paratuberculosis
cgcgggcguggcggucg

SEQ ID NO: 2990758 - RNA, 23 nt, Mycobacterium avium subsp. paratuberculosis
cgcgggcuaaugcaucgaugccg

SEQ ID NO: 2990759 - RNA, 17 nt, Mycobacterium avium subsp. paratuberculosis
cgcgggcucccgcucgc

SEQ ID NO: 2990760 - RNA, 20 nt, Mycobacterium avium subsp. paratuberculosis
cgcgggcucgaacaacccgg

SEQ ID NO: 2990761 - RNA, 22 nt, Mycobacterium avium subsp. paratuberculosis
cgcgggcucgaacaacccggcc

SEQ ID NO: 2990762 - RNA, 20 nt, Mycobacterium avium subsp. paratuberculosis
cgcgggcugcagggccgggu

SEQ ID NO: 2990763 - RNA, 23 nt, Mycobacterium avium subsp. paratuberculosis
cgcgggcugcagggccgggucga

SEQ ID NO: 2990764 - RNA, 17 nt, Mycobacterium avium subsp. paratuberculosis
cgcgggcugcggcgagu

SEQ ID NO: 2990765 - RNA, 19 nt, Mycobacterium avium subsp. paratuberculosis
cgcggggccaccaggcgcc

SEQ ID NO: 2990766 - RNA, 14 nt, Mycobacterium avium subsp. paratuberculosis
cgcggggccggcgc

SEQ ID NO: 2990767 - RNA, 18 nt, Mycobacterium avium subsp. paratuberculosis
cgcggggcgcgaggcgcg

SEQ ID NO: 2990768 - RNA, 19 nt, Mycobacterium avium subsp. paratuberculosis
cgcggggcgcgaggcgcga

SEQ ID NO: 2990769 - RNA, 13 nt, Mycobacterium avium subsp. paratuberculosis
cgcggggcggccg

SEQ ID NO: 2990770 - RNA, 14 nt, Mycobacterium avium subsp. paratuberculosis
cgcggggcggccgc

SEQ ID NO: 2990771 - RNA, 18 nt, Mycobacterium avium subsp. paratuberculosis
cgcggggcggccgccggg

SEQ ID NO: 2990772 - RNA, 19 nt, Mycobacterium avium subsp. paratuberculosis
cgcggggcggccgccgggc

SEQ ID NO: 2990773 - RNA, 13 nt, Mycobacterium avium subsp. paratuberculosis
cgcggggcggcgg

SEQ ID NO: 2990774 - RNA, 18 nt, Mycobacterium avium subsp. paratuberculosis
cgcggggcggcggcgccg

SEQ ID NO: 2990775 - RNA, 19 nt, Mycobacterium avium subsp. paratuberculosis
cgcggggcguacgcgcugc

SEQ ID NO: 2990776 - RNA, 14 nt, Mycobacterium avium subsp. paratuberculosis
cgcggggcugggcg

SEQ ID NO: 2990777 - RNA, 14 nt, Mycobacterium avium subsp. paratuberculosis
cgcgggggccgccg

SEQ ID NO: 2990778 - RNA, 13 nt, Mycobacterium avium subsp. paratuberculosis
cgcgggggccgcg

SEQ ID NO: 2990779 - RNA, 15 nt, Mycobacterium avium subsp. paratuberculosis
cgcgggggccgcgau

SEQ ID NO: 2990780 - RNA, 14 nt, Mycobacterium avium subsp. paratuberculosis
cgcgggggcggccg

SEQ ID NO: 2990781 - RNA, 15 nt, Mycobacterium avium subsp. paratuberculosis
cgcgggggcggccgg

SEQ ID NO: 2990782 - RNA, 16 nt, Mycobacterium avium subsp. paratuberculosis
cgcgggggcggccggg

SEQ ID NO: 2990783 - RNA, 20 nt, Mycobacterium avium subsp. paratuberculosis
cgcgggggcggccgggccgc

SEQ ID NO: 2990784 - RNA, 22 nt, Mycobacterium avium subsp. paratuberculosis
cgcgggggcggccgggccgcgg

SEQ ID NO: 2990785 - RNA, 23 nt, Mycobacterium avium subsp. paratuberculosis
cgcgggggcggccgggccgcggc

SEQ ID NO: 2990786 - RNA, 14 nt, Mycobacterium avium subsp. paratuberculosis
cgcggggggagggu

SEQ ID NO: 2990787 - RNA, 17 nt, Mycobacterium avium subsp. paratuberculosis
cgcggggggagggucgg

SEQ ID NO: 2990788 - RNA, 20 nt, Mycobacterium avium subsp. paratuberculosis
cgcggggggagggucggugg

SEQ ID NO: 2990789 - RNA, 22 nt, Mycobacterium avium subsp. paratuberculosis
cgcggggucggccagucguacu

SEQ ID NO: 2990790 - RNA, 15 nt, Mycobacterium avium subsp. paratuberculosis
cgcggggucgggccg

SEQ ID NO: 2990791 - RNA, 16 nt, Mycobacterium avium subsp. paratuberculosis
cgcggggucgggccgg

SEQ ID NO: 2990792 - RNA, 20 nt, Mycobacterium avium subsp. paratuberculosis
cgcgggguggcgccggccag

SEQ ID NO: 2990793 - RNA, 13 nt, Mycobacterium avium subsp. paratuberculosis
cgcggguacggcg

SEQ ID NO: 2990794 - RNA, 21 nt, Mycobacterium avium subsp. paratuberculosis
cgcggguacggcggccgcgga

SEQ ID NO: 2990795 - RNA, 13 nt, Mycobacterium avium subsp. paratuberculosis
cgcggguagacgu

SEQ ID NO: 2990796 - RNA, 18 nt, Mycobacterium avium subsp. paratuberculosis
cgcggguagacguucucc

SEQ ID NO: 2990797 - RNA, 20 nt, Mycobacterium avium subsp. paratuberculosis
cgcggguagcccgucgacgg

SEQ ID NO: 2990798 - RNA, 23 nt, Mycobacterium avium subsp. paratuberculosis
cgcggguagcccgucgacgggcc

SEQ ID NO: 2990799 - RNA, 14 nt, Mycobacterium avium subsp. paratuberculosis
cgcgggucgagcag

SEQ ID NO: 2990800 - RNA, 18 nt, Mycobacterium avium subsp. paratuberculosis
cgcgggucgagcagcagc

SEQ ID NO: 2990801 - RNA, 20 nt, Mycobacterium avium subsp. paratuberculosis
cgcgggucgagcagcagccg

SEQ ID NO: 2990802 - RNA, 21 nt, Mycobacterium avium subsp. paratuberculosis
cgcgggucgagcagcagccgc

SEQ ID NO: 2990803 - RNA, 15 nt, Mycobacterium avium subsp. paratuberculosis
cgcgggucgccgggc

SEQ ID NO: 2990804 - RNA, 16 nt, Mycobacterium avium subsp. paratuberculosis
cgcgggucgccgggca

SEQ ID NO: 2990805 - RNA, 17 nt, Mycobacterium avium subsp. paratuberculosis
cgcgggucgccgggcag

SEQ ID NO: 2990806 - RNA, 19 nt, Mycobacterium avium subsp. paratuberculosis
cgcgggucgccgggcaggu

SEQ ID NO: 2990807 - RNA, 15 nt, Mycobacterium avium subsp. paratuberculosis
cgcgggucgcggccc

SEQ ID NO: 2990808 - RNA, 17 nt, Mycobacterium avium subsp. paratuberculosis
cgcgggucgcggcccac

SEQ ID NO: 2990809 - RNA, 20 nt, Mycobacterium avium subsp. paratuberculosis
cgcgggucgcggcccaccgc

SEQ ID NO: 2990810 - RNA, 13 nt, Mycobacterium avium subsp. paratuberculosis
cgcgggucgcugg

SEQ ID NO: 2990811 - RNA, 22 nt, Mycobacterium avium subsp. paratuberculosis
cgcgggucggcgacggcgcuca

SEQ ID NO: 2990812 - RNA, 16 nt, Mycobacterium avium subsp. paratuberculosis
cgcgggucggcgccgg

SEQ ID NO: 2990813 - RNA, 19 nt, Mycobacterium avium subsp. paratuberculosis
cgcgggucggcgccggcca

SEQ ID NO: 2990814 - RNA, 15 nt, Mycobacterium avium subsp. paratuberculosis
cgcgggucgucgacg

SEQ ID NO: 2990815 - RNA, 16 nt, Mycobacterium avium subsp. paratuberculosis
cgcgggucgucgacgu

SEQ ID NO: 2990816 - RNA, 19 nt, Mycobacterium avium subsp. paratuberculosis
cgcgggucgucgacgucgg

SEQ ID NO: 2990817 - RNA, 15 nt, Mycobacterium avium subsp. paratuberculosis
cgcgggucuggcucg

SEQ ID NO: 2990818 - RNA, 17 nt, Mycobacterium avium subsp. paratuberculosis
cgcgggucuggcucggc

SEQ ID NO: 2990819 - RNA, 18 nt, Mycobacterium avium subsp. paratuberculosis
cgcgggucuggcucggca

SEQ ID NO: 2990820 - RNA, 23 nt, Mycobacterium avium subsp. paratuberculosis
cgcgggucuggcucggcaccaga

SEQ ID NO: 2990821 - RNA, 18 nt, Mycobacterium avium subsp. paratuberculosis
cgcgggugaccggcgccg

SEQ ID NO: 2990822 - RNA, 20 nt, Mycobacterium avium subsp. paratuberculosis
cgcgggugaccggcgccggg

SEQ ID NO: 2990823 - RNA, 22 nt, Mycobacterium avium subsp. paratuberculosis
cgcgggugacgaucaccgcugc

SEQ ID NO: 2990824 - RNA, 13 nt, Mycobacterium avium subsp. paratuberculosis
cgcgggugacgcu

SEQ ID NO: 2990825 - RNA, 23 nt, Mycobacterium avium subsp. paratuberculosis
cgcgggugaggggcgcgcgccgg

SEQ ID NO: 2990826 - RNA, 17 nt, Mycobacterium avium subsp. paratuberculosis
cgcgggugauccggugc

SEQ ID NO: 2990827 - RNA, 19 nt, Mycobacterium avium subsp. paratuberculosis
cgcgggugaucugcgccgu

SEQ ID NO: 2990828 - RNA, 20 nt, Mycobacterium avium subsp. paratuberculosis
cgcgggugaucugcgccgug

SEQ ID NO: 2990829 - RNA, 14 nt, Mycobacterium avium subsp. paratuberculosis
cgcgggugcagccg

SEQ ID NO: 2990830 - RNA, 16 nt, Mycobacterium avium subsp. paratuberculosis
cgcgggugcgcucgac

SEQ ID NO: 2990831 - RNA, 16 nt, Mycobacterium avium subsp. paratuberculosis
cgcgggugcgcugcag

SEQ ID NO: 2990832 - RNA, 17 nt, Mycobacterium avium subsp. paratuberculosis
cgcgggugcgcugcagc

SEQ ID NO: 2990833 - RNA, 21 nt, Mycobacterium avium subsp. paratuberculosis
cgcgggugcgcugcagcgaga

SEQ ID NO: 2990834 - RNA, 19 nt, Mycobacterium avium subsp. paratuberculosis
cgcgggugcggcacggcau

SEQ ID NO: 2990835 - RNA, 20 nt, Mycobacterium avium subsp. paratuberculosis
cgcgggugcggcacggcaug

SEQ ID NO: 2990836 - RNA, 15 nt, Mycobacterium avium subsp. paratuberculosis
cgcgggugcggcgcu

SEQ ID NO: 2990837 - RNA, 21 nt, Mycobacterium avium subsp. paratuberculosis
cgcgggugcggcgcugccggc

SEQ ID NO: 2990838 - RNA, 14 nt, Mycobacterium avium subsp. paratuberculosis
cgcgggugcugggc

SEQ ID NO: 2990839 - RNA, 14 nt, Mycobacterium avium subsp. paratuberculosis
cgcggguggcgcca

SEQ ID NO: 2990840 - RNA, 15 nt, Mycobacterium avium subsp. paratuberculosis
cgcgggugucgagcc

SEQ ID NO: 2990841 - RNA, 19 nt, Mycobacterium avium subsp. paratuberculosis
cgcgggugucgagccacca

SEQ ID NO: 2990842 - RNA, 21 nt, Mycobacterium avium subsp. paratuberculosis
cgcgggugucgagccaccacu

SEQ ID NO: 2990843 - RNA, 14 nt, Mycobacterium avium subsp. paratuberculosis
cgcgggugucgccc

SEQ ID NO: 2990844 - RNA, 19 nt, Mycobacterium avium subsp. paratuberculosis
cgcggguguugccggaggg

SEQ ID NO: 2990845 - RNA, 19 nt, Mycobacterium avium subsp. paratuberculosis
cgcggguucacccuggcga

SEQ ID NO: 2990846 - RNA, 22 nt, Mycobacterium avium subsp. paratuberculosis
cgcgguaaagucuucggcgaug

SEQ ID NO: 2990847 - RNA, 23 nt, Mycobacterium avium subsp. paratuberculosis
cgcgguaaagucuucggcgaugc

SEQ ID NO: 2990848 - RNA, 15 nt, Mycobacterium avium subsp. paratuberculosis
cgcgguaacagagcg

SEQ ID NO: 2990849 - RNA, 15 nt, Mycobacterium avium subsp. paratuberculosis
cgcgguaccgaugac

SEQ ID NO: 2990850 - RNA, 19 nt, Mycobacterium avium subsp. paratuberculosis
cgcgguaccgaugaccacc

SEQ ID NO: 2990851 - RNA, 23 nt, Mycobacterium avium subsp. paratuberculosis
cgcgguagaaccaacgcggcgcc

SEQ ID NO: 2990852 - RNA, 17 nt, Mycobacterium avium subsp. paratuberculosis
cgcgguagaucgacagg

SEQ ID NO: 2990853 - RNA, 15 nt, Mycobacterium avium subsp. paratuberculosis
cgcgguagcgcucgg

SEQ ID NO: 2990854 - RNA, 16 nt, Mycobacterium avium subsp. paratuberculosis
cgcgguagcgcucggu

SEQ ID NO: 2990855 - RNA, 13 nt, Mycobacterium avium subsp. paratuberculosis
cgcgguagcggac

SEQ ID NO: 2990856 - RNA, 13 nt, Mycobacterium avium subsp. paratuberculosis
cgcggucaacacc

SEQ ID NO: 2990857 - RNA, 12 nt, Mycobacterium avium subsp. paratuberculosis
cgcggucaccgg

SEQ ID NO: 2990858 - RNA, 14 nt, Mycobacterium avium subsp. paratuberculosis
cgcggucaccggcu

SEQ ID NO: 2990859 - RNA, 16 nt, Mycobacterium avium subsp. paratuberculosis
cgcggucagacgaugg

SEQ ID NO: 2990860 - RNA, 21 nt, Mycobacterium avium subsp. paratuberculosis
cgcggucagacgaugggccgc

SEQ ID NO: 2990861 - RNA, 22 nt, Mycobacterium avium subsp. paratuberculosis
cgcggucagacgaugggccgcc

SEQ ID NO: 2990862 - RNA, 13 nt, Mycobacterium avium subsp. paratuberculosis
cgcggucagccgg

SEQ ID NO: 2990863 - RNA, 17 nt, Mycobacterium avium subsp. paratuberculosis
cgcggucagccggcucg

SEQ ID NO: 2990864 - RNA, 13 nt, Mycobacterium avium subsp. paratuberculosis
cgcggucagcgcg

SEQ ID NO: 2990865 - RNA, 14 nt, Mycobacterium avium subsp. paratuberculosis
cgcggucagcgcgu

SEQ ID NO: 2990866 - RNA, 15 nt, Mycobacterium avium subsp. paratuberculosis
cgcggucagcgcguc

SEQ ID NO: 2990867 - RNA, 16 nt, Mycobacterium avium subsp. paratuberculosis
cgcggucagcgcgucc

SEQ ID NO: 2990868 - RNA, 19 nt, Mycobacterium avium subsp. paratuberculosis
cgcggucagcgcguccagg

SEQ ID NO: 2990869 - RNA, 23 nt, Mycobacterium avium subsp. paratuberculosis
cgcggucagcgcguccaggugcg

SEQ ID NO: 2990870 - RNA, 20 nt, Mycobacterium avium subsp. paratuberculosis
cgcggucagcgucuggcggg

SEQ ID NO: 2990871 - RNA, 21 nt, Mycobacterium avium subsp. paratuberculosis
cgcggucagcucgaucgccgc

SEQ ID NO: 2990872 - RNA, 17 nt, Mycobacterium avium subsp. paratuberculosis
cgcggucaucgagccgg

SEQ ID NO: 2990873 - RNA, 18 nt, Mycobacterium avium subsp. paratuberculosis
cgcggucaugcgcgggca

SEQ ID NO: 2990874 - RNA, 19 nt, Mycobacterium avium subsp. paratuberculosis
cgcggucaugcgcgggcaa

SEQ ID NO: 2990875 - RNA, 16 nt, Mycobacterium avium subsp. paratuberculosis
cgcgguccaccagaag

SEQ ID NO: 2990876 - RNA, 15 nt, Mycobacterium avium subsp. paratuberculosis
cgcgguccacgccgg

SEQ ID NO: 2990877 - RNA, 16 nt, Mycobacterium avium subsp. paratuberculosis
cgcgguccacggucag

SEQ ID NO: 2990878 - RNA, 18 nt, Mycobacterium avium subsp. paratuberculosis
cgcgguccacggucagcg

SEQ ID NO: 2990879 - RNA, 21 nt, Mycobacterium avium subsp. paratuberculosis
cgcgguccacggucagcgcgu

SEQ ID NO: 2990880 - RNA, 21 nt, Mycobacterium avium subsp. paratuberculosis
cgcgguccacgguggcgccga

SEQ ID NO: 2990881 - RNA, 21 nt, Mycobacterium avium subsp. paratuberculosis
cgcgguccagcuugucguagc

SEQ ID NO: 2990882 - RNA, 21 nt, Mycobacterium avium subsp. paratuberculosis
cgcgguccaggaucugcagca

SEQ ID NO: 2990883 - RNA, 22 nt, Mycobacterium avium subsp. paratuberculosis
cgcgguccaggaucugcagcac

SEQ ID NO: 2990884 - RNA, 13 nt, Mycobacterium avium subsp. paratuberculosis
cgcgguccaucuc

SEQ ID NO: 2990885 - RNA, 18 nt, Mycobacterium avium subsp. paratuberculosis
cgcgguccaucuccagcu

SEQ ID NO: 2990886 - RNA, 20 nt, Mycobacterium avium subsp. paratuberculosis
cgcgguccaucuccagcucc

SEQ ID NO: 2990887 - RNA, 23 nt, Mycobacterium avium subsp. paratuberculosis
cgcgguccaucuccagcuccgcg

SEQ ID NO: 2990888 - RNA, 20 nt, Mycobacterium avium subsp. paratuberculosis
cgcggucccaggugcugggc

SEQ ID NO: 2990889 - RNA, 14 nt, Mycobacterium avium subsp. paratuberculosis
cgcggucgaagggu

SEQ ID NO: 2990890 - RNA, 13 nt, Mycobacterium avium subsp. paratuberculosis
cgcggucgacgga

SEQ ID NO: 2990891 - RNA, 18 nt, Mycobacterium avium subsp. paratuberculosis
cgcggucgacggaagccg

SEQ ID NO: 2990892 - RNA, 23 nt, Mycobacterium avium subsp. paratuberculosis
cgcggucgacggaagccgagcgg

SEQ ID NO: 2990893 - RNA, 13 nt, Mycobacterium avium subsp. paratuberculosis
cgcggucgcaggc

SEQ ID NO: 2990894 - RNA, 15 nt, Mycobacterium avium subsp. paratuberculosis
cgcggucgcaggccg

SEQ ID NO: 2990895 - RNA, 16 nt, Mycobacterium avium subsp. paratuberculosis
cgcggucgcaggccgc

SEQ ID NO: 2990896 - RNA, 19 nt, Mycobacterium avium subsp. paratuberculosis
cgcggucgcaggccgcccg

SEQ ID NO: 2990897 - RNA, 17 nt, Mycobacterium avium subsp. paratuberculosis
cgcggucgcaggcgagc

SEQ ID NO: 2990898 - RNA, 20 nt, Mycobacterium avium subsp. paratuberculosis
cgcggucgccaccaccagcg

SEQ ID NO: 2990899 - RNA, 15 nt, Mycobacterium avium subsp. paratuberculosis
cgcggucgccccggc

SEQ ID NO: 2990900 - RNA, 22 nt, Mycobacterium avium subsp. paratuberculosis
cgcggucgccccggccgcggug

SEQ ID NO: 2990901 - RNA, 22 nt, Mycobacterium avium subsp. paratuberculosis
cgcggucgccgcccacgccgug

SEQ ID NO: 2990902 - RNA, 13 nt, Mycobacterium avium subsp. paratuberculosis
cgcggucgcggcg

SEQ ID NO: 2990903 - RNA, 14 nt, Mycobacterium avium subsp. paratuberculosis
cgcggucgcggcgc

SEQ ID NO: 2990904 - RNA, 18 nt, Mycobacterium avium subsp. paratuberculosis
cgcggucgcggcgccggu

SEQ ID NO: 2990905 - RNA, 14 nt, Mycobacterium avium subsp. paratuberculosis
cgcggucgcugacc

SEQ ID NO: 2990906 - RNA, 18 nt, Mycobacterium avium subsp. paratuberculosis
cgcggucgcugacccgcc

SEQ ID NO: 2990907 - RNA, 19 nt, Mycobacterium avium subsp. paratuberculosis
cgcggucgcugacccgccg

SEQ ID NO: 2990908 - RNA, 17 nt, Mycobacterium avium subsp. paratuberculosis
cgcggucggcaacccga

SEQ ID NO: 2990909 - RNA, 19 nt, Mycobacterium avium subsp. paratuberculosis
cgcggucggcaacccgacc

SEQ ID NO: 2990910 - RNA, 20 nt, Mycobacterium avium subsp. paratuberculosis
cgcggucggcaacccgaccu

SEQ ID NO: 2990911 - RNA, 11 nt, Mycobacterium avium subsp. paratuberculosis
cgcggucggcg

SEQ ID NO: 2990912 - RNA, 12 nt, Mycobacterium avium subsp. paratuberculosis
cgcggucggcgc

SEQ ID NO: 2990913 - RNA, 15 nt, Mycobacterium avium subsp. paratuberculosis
cgcggucggcgcccg

SEQ ID NO: 2990914 - RNA, 22 nt, Mycobacterium avium subsp. paratuberculosis
cgcggucggcgcccggcccagc

SEQ ID NO: 2990915 - RNA, 16 nt, Mycobacterium avium subsp. paratuberculosis
cgcggucggcggcgua

SEQ ID NO: 2990916 - RNA, 12 nt, Mycobacterium avium subsp. paratuberculosis
cgcggucggcgu

SEQ ID NO: 2990917 - RNA, 14 nt, Mycobacterium avium subsp. paratuberculosis
cgcggucggcgucg

SEQ ID NO: 2990918 - RNA, 21 nt, Mycobacterium avium subsp. paratuberculosis
cgcggucggggaauuccggcg

SEQ ID NO: 2990919 - RNA, 23 nt, Mycobacterium avium subsp. paratuberculosis
cgcggucggggaauuccggcgcg

SEQ ID NO: 2990920 - RNA, 11 nt, Mycobacterium avium subsp. paratuberculosis
cgcggucgggu

SEQ ID NO: 2990921 - RNA, 21 nt, Mycobacterium avium subsp. paratuberculosis
cgcggucgggucccggcaaca

SEQ ID NO: 2990922 - RNA, 13 nt, Mycobacterium avium subsp. paratuberculosis
cgcggucgguggc

SEQ ID NO: 2990923 - RNA, 16 nt, Mycobacterium avium subsp. paratuberculosis
cgcggucgguggcggu

SEQ ID NO: 2990924 - RNA, 17 nt, Mycobacterium avium subsp. paratuberculosis
cgcggucgguggcggug

SEQ ID NO: 2990925 - RNA, 18 nt, Mycobacterium avium subsp. paratuberculosis
cgcggucgguggcggugc

SEQ ID NO: 2990926 - RNA, 14 nt, Mycobacterium avium subsp. paratuberculosis
cgcggucgucgccc

SEQ ID NO: 2990927 - RNA, 22 nt, Mycobacterium avium subsp. paratuberculosis
cgcggucgucgcccgucucggc

SEQ ID NO: 2990928 - RNA, 20 nt, Mycobacterium avium subsp. paratuberculosis
cgcggucgucgucgucggug

SEQ ID NO: 2990929 - RNA, 21 nt, Mycobacterium avium subsp. paratuberculosis
cgcggucgucuucuuggccgc

SEQ ID NO: 2990930 - RNA, 21 nt, Mycobacterium avium subsp. paratuberculosis
cgcggucucgaccgacugcga

SEQ ID NO: 2990931 - RNA, 22 nt, Mycobacterium avium subsp. paratuberculosis
cgcggucucgaucugcaccagc

SEQ ID NO: 2990932 - RNA, 23 nt, Mycobacterium avium subsp. paratuberculosis
cgcggucucgaucugcaccagcg

SEQ ID NO: 2990933 - RNA, 17 nt, Mycobacterium avium subsp. paratuberculosis
cgcggucugcgccagcu

SEQ ID NO: 2990934 - RNA, 19 nt, Mycobacterium avium subsp. paratuberculosis
cgcggucugcggugcgccc

SEQ ID NO: 2990935 - RNA, 20 nt, Mycobacterium avium subsp. paratuberculosis
cgcggucugcggugcgccca

SEQ ID NO: 2990936 - RNA, 22 nt, Mycobacterium avium subsp. paratuberculosis
cgcggucugcggugcgcccagg

SEQ ID NO: 2990937 - RNA, 15 nt, Mycobacterium avium subsp. paratuberculosis
cgcggucuuuggcgu

SEQ ID NO: 2990938 - RNA, 16 nt, Mycobacterium avium subsp. paratuberculosis
cgcggucuuuggcgua

SEQ ID NO: 2990939 - RNA, 15 nt, Mycobacterium avium subsp. paratuberculosis
cgcggugaagucggu

SEQ ID NO: 2990940 - RNA, 18 nt, Mycobacterium avium subsp. paratuberculosis
cgcggugaagucggugcc

SEQ ID NO: 2990941 - RNA, 20 nt, Mycobacterium avium subsp. paratuberculosis
cgcggugaagucggugccca

SEQ ID NO: 2990942 - RNA, 19 nt, Mycobacterium avium subsp. paratuberculosis
cgcggugacaugcccgggc

SEQ ID NO: 2990943 - RNA, 13 nt, Mycobacterium avium subsp. paratuberculosis
cgcggugaccgcc

SEQ ID NO: 2990944 - RNA, 17 nt, Mycobacterium avium subsp. paratuberculosis
cgcggugaccgcccgcu

SEQ ID NO: 2990945 - RNA, 15 nt, Mycobacterium avium subsp. paratuberculosis
cgcggugaccgccgc

SEQ ID NO: 2990946 - RNA, 17 nt, Mycobacterium avium subsp. paratuberculosis
cgcggugaccgccgcca

SEQ ID NO: 2990947 - RNA, 16 nt, Mycobacterium avium subsp. paratuberculosis
cgcggugaccgcgccg

SEQ ID NO: 2990948 - RNA, 17 nt, Mycobacterium avium subsp. paratuberculosis
cgcggugaccgcgccgc

SEQ ID NO: 2990949 - RNA, 19 nt, Mycobacterium avium subsp. paratuberculosis
cgcggugaccgcgccgcgg

SEQ ID NO: 2990950 - RNA, 19 nt, Mycobacterium avium subsp. paratuberculosis
cgcggugaccgcggccucg

SEQ ID NO: 2990951 - RNA, 20 nt, Mycobacterium avium subsp. paratuberculosis
cgcggugaccgcggccucgu

SEQ ID NO: 2990952 - RNA, 12 nt, Mycobacterium avium subsp. paratuberculosis
cgcggugacgcg

SEQ ID NO: 2990953 - RNA, 13 nt, Mycobacterium avium subsp. paratuberculosis
cgcggugacgcgc

SEQ ID NO: 2990954 - RNA, 14 nt, Mycobacterium avium subsp. paratuberculosis
cgcggugacgcgcc

SEQ ID NO: 2990955 - RNA, 19 nt, Mycobacterium avium subsp. paratuberculosis
cgcggugacgcgccggccc

SEQ ID NO: 2990956 - RNA, 20 nt, Mycobacterium avium subsp. paratuberculosis
cgcggugacgcgccggccca

SEQ ID NO: 2990957 - RNA, 13 nt, Mycobacterium avium subsp. paratuberculosis
cgcggugagcagc

SEQ ID NO: 2990958 - RNA, 19 nt, Mycobacterium avium subsp. paratuberculosis
cgcggugagcagcaugccg

SEQ ID NO: 2990959 - RNA, 16 nt, Mycobacterium avium subsp. paratuberculosis
cgcggugagcgcgccg

SEQ ID NO: 2990960 - RNA, 17 nt, Mycobacterium avium subsp. paratuberculosis
cgcggugagcgcgccgg

SEQ ID NO: 2990961 - RNA, 15 nt, Mycobacterium avium subsp. paratuberculosis
cgcggugagcggccg

SEQ ID NO: 2990962 - RNA, 23 nt, Mycobacterium avium subsp. paratuberculosis
cgcggugagcgugccgaucgaga

SEQ ID NO: 2990963 - RNA, 19 nt, Mycobacterium avium subsp. paratuberculosis
cgcggugaguucaucgacg

SEQ ID NO: 2990964 - RNA, 20 nt, Mycobacterium avium subsp. paratuberculosis
cgcggugaguucaucgacgu

SEQ ID NO: 2990965 - RNA, 22 nt, Mycobacterium avium subsp. paratuberculosis
cgcggugaucaggcccucgucg

SEQ ID NO: 2990966 - RNA, 23 nt, Mycobacterium avium subsp. paratuberculosis
cgcggugaucaggcccucgucgg

SEQ ID NO: 2990967 - RNA, 13 nt, Mycobacterium avium subsp. paratuberculosis
cgcggugaugccg

SEQ ID NO: 2990968 - RNA, 15 nt, Mycobacterium avium subsp. paratuberculosis
cgcggugcaccagga

SEQ ID NO: 2990969 - RNA, 20 nt, Mycobacterium avium subsp. paratuberculosis
cgcggugcaccaggacgcga

SEQ ID NO: 2990970 - RNA, 20 nt, Mycobacterium avium subsp. paratuberculosis
cgcggugcacggucagcucg

SEQ ID NO: 2990971 - RNA, 23 nt, Mycobacterium avium subsp. paratuberculosis
cgcggugcacggucagcucgcgc

SEQ ID NO: 2990972 - RNA, 14 nt, Mycobacterium avium subsp. paratuberculosis
cgcggugcagacgu

SEQ ID NO: 2990973 - RNA, 19 nt, Mycobacterium avium subsp. paratuberculosis
cgcggugcagacgugacgu

SEQ ID NO: 2990974 - RNA, 17 nt, Mycobacterium avium subsp. paratuberculosis
cgcggugcagcaggaac

SEQ ID NO: 2990975 - RNA, 14 nt, Mycobacterium avium subsp. paratuberculosis
cgcggugcagucgg

SEQ ID NO: 2990976 - RNA, 17 nt, Mycobacterium avium subsp. paratuberculosis
cgcggugcccagccagg

SEQ ID NO: 2990977 - RNA, 19 nt, Mycobacterium avium subsp. paratuberculosis
cgcggugcccagccaggcc

SEQ ID NO: 2990978 - RNA, 20 nt, Mycobacterium avium subsp. paratuberculosis
cgcggugcccagccaggccg

SEQ ID NO: 2990979 - RNA, 21 nt, Mycobacterium avium subsp. paratuberculosis
cgcggugcccagccaggccgc

SEQ ID NO: 2990980 - RNA, 19 nt, Mycobacterium avium subsp. paratuberculosis
cgcggugcccggaacggcg

SEQ ID NO: 2990981 - RNA, 23 nt, Mycobacterium avium subsp. paratuberculosis
cgcggugccgaccugggcggcca

SEQ ID NO: 2990982 - RNA, 13 nt, Mycobacterium avium subsp. paratuberculosis
cgcggugccgcag

SEQ ID NO: 2990983 - RNA, 20 nt, Mycobacterium avium subsp. paratuberculosis
cgcggugccgcagcucgauc

SEQ ID NO: 2990984 - RNA, 13 nt, Mycobacterium avium subsp. paratuberculosis
cgcggugcgccac

SEQ ID NO: 2990985 - RNA, 18 nt, Mycobacterium avium subsp. paratuberculosis
cgcggugcgccagcgccg

SEQ ID NO: 2990986 - RNA, 21 nt, Mycobacterium avium subsp. paratuberculosis
cgcggugcgccagcgccgggu

SEQ ID NO: 2990987 - RNA, 13 nt, Mycobacterium avium subsp. paratuberculosis
cgcggugcgccga

SEQ ID NO: 2990988 - RNA, 17 nt, Mycobacterium avium subsp. paratuberculosis
cgcggugcgccgacagc

SEQ ID NO: 2990989 - RNA, 20 nt, Mycobacterium avium subsp. paratuberculosis
cgcggugcgcgcgcgcucgg

SEQ ID NO: 2990990 - RNA, 15 nt, Mycobacterium avium subsp. paratuberculosis
cgcggugcggcccgc

SEQ ID NO: 2990991 - RNA, 16 nt, Mycobacterium avium subsp. paratuberculosis
cgcggugcggcccgcg

SEQ ID NO: 2990992 - RNA, 19 nt, Mycobacterium avium subsp. paratuberculosis
cgcggugcggcccgcggca

SEQ ID NO: 2990993 - RNA, 20 nt, Mycobacterium avium subsp. paratuberculosis
cgcggugcggcccgcggcau

SEQ ID NO: 2990994 - RNA, 22 nt, Mycobacterium avium subsp. paratuberculosis
cgcggugcggcccgcggcaucg

SEQ ID NO: 2990995 - RNA, 17 nt, Mycobacterium avium subsp. paratuberculosis
cgcggugcggggccgcg

SEQ ID NO: 2990996 - RNA, 23 nt, Mycobacterium avium subsp. paratuberculosis
cgcggugcggggccgcggccggc

SEQ ID NO: 2990997 - RNA, 14 nt, Mycobacterium avium subsp. paratuberculosis
cgcggugcucgccc

SEQ ID NO: 2990998 - RNA, 17 nt, Mycobacterium avium subsp. paratuberculosis
cgcggugcucgcccugg

SEQ ID NO: 2990999 - RNA, 14 nt, Mycobacterium avium subsp. paratuberculosis
cgcggugcucggcg

SEQ ID NO: 2991000 - RNA, 15 nt, Mycobacterium avium subsp. paratuberculosis
cgcggugcucggcgc

SEQ ID NO: 2991001 - RNA, 16 nt, Mycobacterium avium subsp. paratuberculosis
cgcggugcucggcgcg

SEQ ID NO: 2991002 - RNA, 18 nt, Mycobacterium avium subsp. paratuberculosis
cgcggugcucggcgcgcg

SEQ ID NO: 2991003 - RNA, 22 nt, Mycobacterium avium subsp. paratuberculosis
cgcggugcugcagauccgcucg

SEQ ID NO: 2991004 - RNA, 18 nt, Mycobacterium avium subsp. paratuberculosis
cgcggugcugcagcgcga

SEQ ID NO: 2991005 - RNA, 20 nt, Mycobacterium avium subsp. paratuberculosis
cgcgguggaacccagcaccc

SEQ ID NO: 2991006 - RNA, 15 nt, Mycobacterium avium subsp. paratuberculosis
cgcgguggagcacag

SEQ ID NO: 2991007 - RNA, 19 nt, Mycobacterium avium subsp. paratuberculosis
cgcgguggccgggaugcca

SEQ ID NO: 2991008 - RNA, 13 nt, Mycobacterium avium subsp. paratuberculosis
cgcgguggcgccg

SEQ ID NO: 2991009 - RNA, 16 nt, Mycobacterium avium subsp. paratuberculosis
cgcgguggcggugcgg

SEQ ID NO: 2991010 - RNA, 23 nt, Mycobacterium avium subsp. paratuberculosis
cgcgguggcggugcggucgcgca

SEQ ID NO: 2991011 - RNA, 15 nt, Mycobacterium avium subsp. paratuberculosis
cgcggugggcaccag

SEQ ID NO: 2991012 - RNA, 19 nt, Mycobacterium avium subsp. paratuberculosis
cgcggugggcaccagcagc

SEQ ID NO: 2991013 - RNA, 21 nt, Mycobacterium avium subsp. paratuberculosis
cgcggugggcaccagcagcgc

SEQ ID NO: 2991014 - RNA, 20 nt, Mycobacterium avium subsp. paratuberculosis
cgcggugggcgcgggccgcg

SEQ ID NO: 2991015 - RNA, 13 nt, Mycobacterium avium subsp. paratuberculosis
cgcggugggcucg

SEQ ID NO: 2991016 - RNA, 16 nt, Mycobacterium avium subsp. paratuberculosis
cgcggugggcucggcg

SEQ ID NO: 2991017 - RNA, 19 nt, Mycobacterium avium subsp. paratuberculosis
cgcggugggcucggcgccg

SEQ ID NO: 2991018 - RNA, 16 nt, Mycobacterium avium subsp. paratuberculosis
cgcgguggguccgccg

SEQ ID NO: 2991019 - RNA, 23 nt, Mycobacterium avium subsp. paratuberculosis
cgcgguggguccgccgggcgcga

SEQ ID NO: 2991020 - RNA, 13 nt, Mycobacterium avium subsp. paratuberculosis
cgcgguggucagc

SEQ ID NO: 2991021 - RNA, 17 nt, Mycobacterium avium subsp. paratuberculosis
cgcgguggucagcaccg

SEQ ID NO: 2991022 - RNA, 22 nt, Mycobacterium avium subsp. paratuberculosis
cgcgguggucagcaccggcgug

SEQ ID NO: 2991023 - RNA, 18 nt, Mycobacterium avium subsp. paratuberculosis
cgcgguggucagcggcgc

SEQ ID NO: 2991024 - RNA, 20 nt, Mycobacterium avium subsp. paratuberculosis
cgcgguggucagcggcgcca

SEQ ID NO: 2991025 - RNA, 23 nt, Mycobacterium avium subsp. paratuberculosis
cgcgguggucagcggcgccaccg

SEQ ID NO: 2991026 - RNA, 19 nt, Mycobacterium avium subsp. paratuberculosis
cgcgguggugcucgccccg

SEQ ID NO: 2991027 - RNA, 21 nt, Mycobacterium avium subsp. paratuberculosis
cgcgguggugggcgcgguggu

SEQ ID NO: 2991028 - RNA, 19 nt, Mycobacterium avium subsp. paratuberculosis
cgcggugguguugcggugg

SEQ ID NO: 2991029 - RNA, 14 nt, Mycobacterium avium subsp. paratuberculosis
cgcgguguacagcg

SEQ ID NO: 2991030 - RNA, 15 nt, Mycobacterium avium subsp. paratuberculosis
cgcgguguacagcgc

SEQ ID NO: 2991031 - RNA, 20 nt, Mycobacterium avium subsp. paratuberculosis
cgcgguguacagcgcgccgc

SEQ ID NO: 2991032 - RNA, 22 nt, Mycobacterium avium subsp. paratuberculosis
cgcgguguacagcgcgccgcgg

SEQ ID NO: 2991033 - RNA, 18 nt, Mycobacterium avium subsp. paratuberculosis
cgcgguguagucgcugac

SEQ ID NO: 2991034 - RNA, 17 nt, Mycobacterium avium subsp. paratuberculosis
cgcggugucgacgucgg

SEQ ID NO: 2991035 - RNA, 15 nt, Mycobacterium avium subsp. paratuberculosis
cgcggugucggcguc

SEQ ID NO: 2991036 - RNA, 17 nt, Mycobacterium avium subsp. paratuberculosis
cgcggugugcccggcgu

SEQ ID NO: 2991037 - RNA, 13 nt, Mycobacterium avium subsp. paratuberculosis
cgcggugugcggc

SEQ ID NO: 2991038 - RNA, 16 nt, Mycobacterium avium subsp. paratuberculosis
cgcggugugcggcagc

SEQ ID NO: 2991039 - RNA, 17 nt, Mycobacterium avium subsp. paratuberculosis
cgcggugugcggcagcu

SEQ ID NO: 2991040 - RNA, 20 nt, Mycobacterium avium subsp. paratuberculosis
cgcggugugcggcagcucgg

SEQ ID NO: 2991041 - RNA, 21 nt, Mycobacterium avium subsp. paratuberculosis
cgcggugugcggcagcucggc

SEQ ID NO: 2991042 - RNA, 17 nt, Mycobacterium avium subsp. paratuberculosis
cgcggugugcggcggcu

SEQ ID NO: 2991043 - RNA, 22 nt, Mycobacterium avium subsp. paratuberculosis
cgcggugugcuggccagcacca

SEQ ID NO: 2991044 - RNA, 16 nt, Mycobacterium avium subsp. paratuberculosis
cgcggugugggcgaug

SEQ ID NO: 2991045 - RNA, 18 nt, Mycobacterium avium subsp. paratuberculosis
cgcggugugggcgauggc

SEQ ID NO: 2991046 - RNA, 23 nt, Mycobacterium avium subsp. paratuberculosis
cgcggugugggcgauggcggcgu

SEQ ID NO: 2991047 - RNA, 17 nt, Mycobacterium avium subsp. paratuberculosis
cgcgguguugagcgcgu

SEQ ID NO: 2991048 - RNA, 15 nt, Mycobacterium avium subsp. paratuberculosis
cgcgguguuggcggc

SEQ ID NO: 2991049 - RNA, 16 nt, Mycobacterium avium subsp. paratuberculosis
cgcgguguuggcggcg

SEQ ID NO: 2991050 - RNA, 19 nt, Mycobacterium avium subsp. paratuberculosis
cgcgguguuggcggcgucg

SEQ ID NO: 2991051 - RNA, 21 nt, Mycobacterium avium subsp. paratuberculosis
cgcgguguuuggccgcgcagc

SEQ ID NO: 2991052 - RNA, 22 nt, Mycobacterium avium subsp. paratuberculosis
cgcgguguuuggccgcgcagcu

SEQ ID NO: 2991053 - RNA, 13 nt, Mycobacterium avium subsp. paratuberculosis
cgcgguuccggcg

SEQ ID NO: 2991054 - RNA, 18 nt, Mycobacterium avium subsp. paratuberculosis
cgcgguuccggcgugcag

SEQ ID NO: 2991055 - RNA, 19 nt, Mycobacterium avium subsp. paratuberculosis
cgcgguuccggcgugcagc

SEQ ID NO: 2991056 - RNA, 15 nt, Mycobacterium avium subsp. paratuberculosis
cgcgguucgaggugc

SEQ ID NO: 2991057 - RNA, 19 nt, Mycobacterium avium subsp. paratuberculosis
cgcgguucgaucuccucgg

SEQ ID NO: 2991058 - RNA, 20 nt, Mycobacterium avium subsp. paratuberculosis
cgcgguucgaucuccucggc

SEQ ID NO: 2991059 - RNA, 19 nt, Mycobacterium avium subsp. paratuberculosis
cgcgguucggcgucggucc

SEQ ID NO: 2991060 - RNA, 23 nt, Mycobacterium avium subsp. paratuberculosis
cgcgguucuuggcguaguggugc

SEQ ID NO: 2991061 - RNA, 13 nt, Mycobacterium avium subsp. paratuberculosis
cgcgguugaacag

SEQ ID NO: 2991062 - RNA, 17 nt, Mycobacterium avium subsp. paratuberculosis
cgcgguugaacaggcug

SEQ ID NO: 2991063 - RNA, 15 nt, Mycobacterium avium subsp. paratuberculosis
cgcgguugaccgccg

SEQ ID NO: 2991064 - RNA, 16 nt, Mycobacterium avium subsp. paratuberculosis
cgcgguugaccgccga

SEQ ID NO: 2991065 - RNA, 19 nt, Mycobacterium avium subsp. paratuberculosis
cgcgguugaccgccgacac

SEQ ID NO: 2991066 - RNA, 20 nt, Mycobacterium avium subsp. paratuberculosis
cgcgguugaccgccgacacc

SEQ ID NO: 2991067 - RNA, 22 nt, Mycobacterium avium subsp. paratuberculosis
cgcgguugaccgccgacaccac

SEQ ID NO: 2991068 - RNA, 17 nt, Mycobacterium avium subsp. paratuberculosis
cggacgcggccgagccg

SEQ ID NO: 2991069 - RNA, 12 nt, Mycobacterium avium subsp. paratuberculosis
cggacgcggcgg

SEQ ID NO: 2991070 - RNA, 15 nt, Mycobacterium avium subsp. paratuberculosis
cggacgcggcggacg

SEQ ID NO: 2991071 - RNA, 16 nt, Mycobacterium avium subsp. paratuberculosis
cggacgcggcggacga

SEQ ID NO: 2991072 - RNA, 17 nt, Mycobacterium avium subsp. paratuberculosis
cggacgcggcggacgau

SEQ ID NO: 2991073 - RNA, 12 nt, Mycobacterium avium subsp. paratuberculosis
cggacgcgggga

SEQ ID NO: 2991074 - RNA, 14 nt, Mycobacterium avium subsp. paratuberculosis
cggacggcaccgac

SEQ ID NO: 2991075 - RNA, 13 nt, Mycobacterium avium subsp. paratuberculosis
cggacggccaccu

SEQ ID NO: 2991076 - RNA, 12 nt, Mycobacterium avium subsp. paratuberculosis
cggacggcccac

SEQ ID NO: 2991077 - RNA, 14 nt, Mycobacterium avium subsp. paratuberculosis
cggacggcccgcaa

SEQ ID NO: 2991078 - RNA, 21 nt, Mycobacterium avium subsp. paratuberculosis
cggacggccgaaacgcccggc

SEQ ID NO: 2991079 - RNA, 13 nt, Mycobacterium avium subsp. paratuberculosis
cggacggcgaacu

SEQ ID NO: 2991080 - RNA, 12 nt, Mycobacterium avium subsp. paratuberculosis
cggacggcgacc

SEQ ID NO: 2991081 - RNA, 13 nt, Mycobacterium avium subsp. paratuberculosis
cggacggcgacgg

SEQ ID NO: 2991082 - RNA, 18 nt, Mycobacterium avium subsp. paratuberculosis
cggacggcgacggcagcg

SEQ ID NO: 2991083 - RNA, 16 nt, Mycobacterium avium subsp. paratuberculosis
cggacgggaucggcgc

SEQ ID NO: 2991084 - RNA, 17 nt, Mycobacterium avium subsp. paratuberculosis
cggacgggaucggcgcg

SEQ ID NO: 2991085 - RNA, 19 nt, Mycobacterium avium subsp. paratuberculosis
cggacgggaucggcgcguc

SEQ ID NO: 2991086 - RNA, 20 nt, Mycobacterium avium subsp. paratuberculosis
cggacgggaucggcgcgucg

SEQ ID NO: 2991087 - RNA, 21 nt, Mycobacterium avium subsp. paratuberculosis
cggacgggaucggcgcgucgg

SEQ ID NO: 2991088 - RNA, 22 nt, Mycobacterium avium subsp. paratuberculosis
cggacgggaucggcgcgucggc

SEQ ID NO: 2991089 - RNA, 22 nt, Mycobacterium avium subsp. paratuberculosis
cggacgggccgcauccgcgagc

SEQ ID NO: 2991090 - RNA, 14 nt, Mycobacterium avium subsp. paratuberculosis
cggacgggucgacc

SEQ ID NO: 2991091 - RNA, 15 nt, Mycobacterium avium subsp. paratuberculosis
cggacgggucgaccg

SEQ ID NO: 2991092 - RNA, 22 nt, Mycobacterium avium subsp. paratuberculosis
cggacgggucgaccgccgcguc

SEQ ID NO: 2991093 - RNA, 16 nt, Mycobacterium avium subsp. paratuberculosis
cggacgggucguagga

SEQ ID NO: 2991094 - RNA, 21 nt, Mycobacterium avium subsp. paratuberculosis
cggacggguugggcgccagca

SEQ ID NO: 2991095 - RNA, 14 nt, Mycobacterium avium subsp. paratuberculosis
cggacggucgccga

SEQ ID NO: 2991096 - RNA, 16 nt, Mycobacterium avium subsp. paratuberculosis
cggacggucgccgacg

SEQ ID NO: 2991097 - RNA, 14 nt, Mycobacterium avium subsp. paratuberculosis
cggacggugacgcc

SEQ ID NO: 2991098 - RNA, 19 nt, Mycobacterium avium subsp. paratuberculosis
cggacgugauaucgggagu

SEQ ID NO: 2991099 - RNA, 15 nt, Mycobacterium avium subsp. paratuberculosis
cggacgugaucgcgg

SEQ ID NO: 2991100 - RNA, 21 nt, Mycobacterium avium subsp. paratuberculosis
cggacuauacacgccuggaca

SEQ ID NO: 2991101 - RNA, 22 nt, Mycobacterium avium subsp. paratuberculosis
cggacuauacacgccuggacag

SEQ ID NO: 2991102 - RNA, 16 nt, Mycobacterium avium subsp. paratuberculosis
cggacuccucgguggc

SEQ ID NO: 2991103 - RNA, 18 nt, Mycobacterium avium subsp. paratuberculosis
cggacucgaucgccaccg

SEQ ID NO: 2991104 - RNA, 19 nt, Mycobacterium avium subsp. paratuberculosis
cggacucgaucgccaccga

SEQ ID NO: 2991105 - RNA, 22 nt, Mycobacterium avium subsp. paratuberculosis
cggacucguuggggccaccaga

SEQ ID NO: 2991106 - RNA, 13 nt, Mycobacterium avium subsp. paratuberculosis
cggacugcccgac

SEQ ID NO: 2991107 - RNA, 19 nt, Mycobacterium avium subsp. paratuberculosis
cggacugcccgaccgcgcc

SEQ ID NO: 2991108 - RNA, 20 nt, Mycobacterium avium subsp. paratuberculosis
cggacugcccgaccgcgccg

SEQ ID NO: 2991109 - RNA, 21 nt, Mycobacterium avium subsp. paratuberculosis
cggacugcccgaccgcgccga

SEQ ID NO: 2991110 - RNA, 15 nt, Mycobacterium avium subsp. paratuberculosis
cggacugcuugggcg

SEQ ID NO: 2991111 - RNA, 20 nt, Mycobacterium avium subsp. paratuberculosis
cggacugcuugggcgccucg

SEQ ID NO: 2991112 - RNA, 17 nt, Mycobacterium avium subsp. paratuberculosis
cggacuggugggcgucg

SEQ ID NO: 2991113 - RNA, 20 nt, Mycobacterium avium subsp. paratuberculosis
cggacuggugggcgucgugg

SEQ ID NO: 2991114 - RNA, 15 nt, Mycobacterium avium subsp. paratuberculosis
cggacuugaugcugc

SEQ ID NO: 2991115 - RNA, 20 nt, Mycobacterium avium subsp. paratuberculosis
cggacuugaugcugcccggc

SEQ ID NO: 2991116 - RNA, 23 nt, Mycobacterium avium subsp. paratuberculosis
cggacuugaugcugcccggcgcc

SEQ ID NO: 2991117 - RNA, 13 nt, Mycobacterium avium subsp. paratuberculosis
cggacuugggcgu

SEQ ID NO: 2991118 - RNA, 15 nt, Mycobacterium avium subsp. paratuberculosis
cggacuugggcgucu

SEQ ID NO: 2991119 - RNA, 17 nt, Mycobacterium avium subsp. paratuberculosis
cggacuugucgccguug

SEQ ID NO: 2991120 - RNA, 17 nt, Mycobacterium avium subsp. paratuberculosis
cggagaaaccgucggcc

SEQ ID NO: 2991121 - RNA, 19 nt, Mycobacterium avium subsp. paratuberculosis
cggagaaaccgucggcccg

SEQ ID NO: 2991122 - RNA, 22 nt, Mycobacterium avium subsp. paratuberculosis
cggagaaaccgucggcccgcca

SEQ ID NO: 2991123 - RNA, 17 nt, Mycobacterium avium subsp. paratuberculosis
cggagaaggcgaacggg

SEQ ID NO: 2991124 - RNA, 16 nt, Mycobacterium avium subsp. paratuberculosis
cggagaaggugucgca

SEQ ID NO: 2991125 - RNA, 13 nt, Mycobacterium avium subsp. paratuberculosis
cggagaccagcag

SEQ ID NO: 2991126 - RNA, 20 nt, Mycobacterium avium subsp. paratuberculosis
cggagaccaggucggccuuc

SEQ ID NO: 2991127 - RNA, 21 nt, Mycobacterium avium subsp. paratuberculosis
cggagaccaggucggccuuca

SEQ ID NO: 2991128 - RNA, 15 nt, Mycobacterium avium subsp. paratuberculosis
cggagacccgcccgg

SEQ ID NO: 2991129 - RNA, 16 nt, Mycobacterium avium subsp. paratuberculosis
cggagacccgcccgga

SEQ ID NO: 2991130 - RNA, 16 nt, Mycobacterium avium subsp. paratuberculosis
cggagaccgccguggc

SEQ ID NO: 2991131 - RNA, 17 nt, Mycobacterium avium subsp. paratuberculosis
cggagaccgccguggcg

SEQ ID NO: 2991132 - RNA, 23 nt, Mycobacterium avium subsp. paratuberculosis
cggagacgacucuuccaggacaa

SEQ ID NO: 2991133 - RNA, 13 nt, Mycobacterium avium subsp. paratuberculosis
cggagacguggcg

SEQ ID NO: 2991134 - RNA, 17 nt, Mycobacterium avium subsp. paratuberculosis
cggagacguggcggcgg

SEQ ID NO: 2991135 - RNA, 18 nt, Mycobacterium avium subsp. paratuberculosis
cggagacguggcggcggu

SEQ ID NO: 2991136 - RNA, 14 nt, Mycobacterium avium subsp. paratuberculosis
cggagacguugccg

SEQ ID NO: 2991137 - RNA, 15 nt, Mycobacterium avium subsp. paratuberculosis
cggagagcaacaccu

SEQ ID NO: 2991138 - RNA, 17 nt, Mycobacterium avium subsp. paratuberculosis
cggagagcccgucgucg

SEQ ID NO: 2991139 - RNA, 18 nt, Mycobacterium avium subsp. paratuberculosis
cggagagcccgucgucgg

SEQ ID NO: 2991140 - RNA, 19 nt, Mycobacterium avium subsp. paratuberculosis
cggagaucaccccuggcgg

SEQ ID NO: 2991141 - RNA, 15 nt, Mycobacterium avium subsp. paratuberculosis
cggagaucaccggca

SEQ ID NO: 2991142 - RNA, 16 nt, Mycobacterium avium subsp. paratuberculosis
cggagaucaccggcac

SEQ ID NO: 2991143 - RNA, 18 nt, Mycobacterium avium subsp. paratuberculosis
cggagaucaccggcaccc

SEQ ID NO: 2991144 - RNA, 20 nt, Mycobacterium avium subsp. paratuberculosis
cggagaucagggugcucagc

SEQ ID NO: 2991145 - RNA, 13 nt, Mycobacterium avium subsp. paratuberculosis
cggagaucccgua

SEQ ID NO: 2991146 - RNA, 22 nt, Mycobacterium avium subsp. paratuberculosis
cggagaucccguaggucgccuc

SEQ ID NO: 2991147 - RNA, 23 nt, Mycobacterium avium subsp. paratuberculosis
cggagaucccguaggucgccucc

SEQ ID NO: 2991148 - RNA, 15 nt, Mycobacterium avium subsp. paratuberculosis
cggagauccggccgc

SEQ ID NO: 2991149 - RNA, 17 nt, Mycobacterium avium subsp. paratuberculosis
cggagauccggccgcug

SEQ ID NO: 2991150 - RNA, 20 nt, Mycobacterium avium subsp. paratuberculosis
cggagauccggccgcuggug

SEQ ID NO: 2991151 - RNA, 13 nt, Mycobacterium avium subsp. paratuberculosis
cggagaucgcccc

SEQ ID NO: 2991152 - RNA, 18 nt, Mycobacterium avium subsp. paratuberculosis
cggagaucgccccggggg

SEQ ID NO: 2991153 - RNA, 19 nt, Mycobacterium avium subsp. paratuberculosis
cggagaugaauucggcgau

SEQ ID NO: 2991154 - RNA, 17 nt, Mycobacterium avium subsp. paratuberculosis
cggagaugacguggauc

SEQ ID NO: 2991155 - RNA, 20 nt, Mycobacterium avium subsp. paratuberculosis
cggagaugauggccgcgccg

SEQ ID NO: 2991156 - RNA, 17 nt, Mycobacterium avium subsp. paratuberculosis
cggagaugcgggccacc

SEQ ID NO: 2991157 - RNA, 19 nt, Mycobacterium avium subsp. paratuberculosis
cggagaugcgggccaccgu

SEQ ID NO: 2991158 - RNA, 17 nt, Mycobacterium avium subsp. paratuberculosis
cggagaugcuggugacg

SEQ ID NO: 2991159 - RNA, 19 nt, Mycobacterium avium subsp. paratuberculosis
cggagaugcuggugacgcc

SEQ ID NO: 2991160 - RNA, 17 nt, Mycobacterium avium subsp. paratuberculosis
cggagaugguggucacc

SEQ ID NO: 2991161 - RNA, 21 nt, Mycobacterium avium subsp. paratuberculosis
cggagaugguggucaccacca

SEQ ID NO: 2991162 - RNA, 18 nt, Mycobacterium avium subsp. paratuberculosis
cggagcaaauccggcagc

SEQ ID NO: 2991163 - RNA, 19 nt, Mycobacterium avium subsp. paratuberculosis
cggagcaaauccggcagcg

SEQ ID NO: 2991164 - RNA, 20 nt, Mycobacterium avium subsp. paratuberculosis
cggagcaaauccggcagcgc

SEQ ID NO: 2991165 - RNA, 22 nt, Mycobacterium avium subsp. paratuberculosis
cggagcaaauccggcagcgcuc

SEQ ID NO: 2991166 - RNA, 15 nt, Mycobacterium avium subsp. paratuberculosis
cggagcccagcguga

SEQ ID NO: 2991167 - RNA, 20 nt, Mycobacterium avium subsp. paratuberculosis
cggagcccagcuuggcgccc

SEQ ID NO: 2991168 - RNA, 15 nt, Mycobacterium avium subsp. paratuberculosis
cggagccgaccucgg

SEQ ID NO: 2991169 - RNA, 14 nt, Mycobacterium avium subsp. paratuberculosis
cggagccgagcacc

SEQ ID NO: 2991170 - RNA, 16 nt, Mycobacterium avium subsp. paratuberculosis
cggagccgagcaccag

SEQ ID NO: 2991171 - RNA, 17 nt, Mycobacterium avium subsp. paratuberculosis
cggagccgagcaccagg

SEQ ID NO: 2991172 - RNA, 18 nt, Mycobacterium avium subsp. paratuberculosis
cggagccgagcaccaggc

SEQ ID NO: 2991173 - RNA, 14 nt, Mycobacterium avium subsp. paratuberculosis
cggagccgaucgcc

SEQ ID NO: 2991174 - RNA, 17 nt, Mycobacterium avium subsp. paratuberculosis
cggagccgaucgccucc

SEQ ID NO: 2991175 - RNA, 17 nt, Mycobacterium avium subsp. paratuberculosis
cggagccggccucgccg

SEQ ID NO: 2991176 - RNA, 11 nt, Mycobacterium avium subsp. paratuberculosis
cggagccgucg

SEQ ID NO: 2991177 - RNA, 22 nt, Mycobacterium avium subsp. paratuberculosis
cggagccgucucggagcggugu

SEQ ID NO: 2991178 - RNA, 16 nt, Mycobacterium avium subsp. paratuberculosis
cggagccgugcccgag

SEQ ID NO: 2991179 - RNA, 19 nt, Mycobacterium avium subsp. paratuberculosis
cggagccuucuugaccgca

SEQ ID NO: 2991180 - RNA, 18 nt, Mycobacterium avium subsp. paratuberculosis
cggagccuugcuggcggc

SEQ ID NO: 2991181 - RNA, 19 nt, Mycobacterium avium subsp. paratuberculosis
cggagccuugcuggcggcc

SEQ ID NO: 2991182 - RNA, 20 nt, Mycobacterium avium subsp. paratuberculosis
cggagccuugcuggcggccu

SEQ ID NO: 2991183 - RNA, 21 nt, Mycobacterium avium subsp. paratuberculosis
cggagccuugcuggcggccuu

SEQ ID NO: 2991184 - RNA, 17 nt, Mycobacterium avium subsp. paratuberculosis
cggagccuuggucgcgg

SEQ ID NO: 2991185 - RNA, 21 nt, Mycobacterium avium subsp. paratuberculosis
cggagccuuggucgcggccuu

SEQ ID NO: 2991186 - RNA, 23 nt, Mycobacterium avium subsp. paratuberculosis
cggagccuuggucgcggccuugc

SEQ ID NO: 2991187 - RNA, 17 nt, Mycobacterium avium subsp. paratuberculosis
cggagcgaaggugccgc

SEQ ID NO: 2991188 - RNA, 13 nt, Mycobacterium avium subsp. paratuberculosis
cggagcgccccag

SEQ ID NO: 2991189 - RNA, 15 nt, Mycobacterium avium subsp. paratuberculosis
cggagcgccccaggg

SEQ ID NO: 2991190 - RNA, 21 nt, Mycobacterium avium subsp. paratuberculosis
cggagcgccccagggccucgg

SEQ ID NO: 2991191 - RNA, 23 nt, Mycobacterium avium subsp. paratuberculosis
cggagcgccccagggccucggcg

SEQ ID NO: 2991192 - RNA, 12 nt, Mycobacterium avium subsp. paratuberculosis
cggagcgcccgg

SEQ ID NO: 2991193 - RNA, 17 nt, Mycobacterium avium subsp. paratuberculosis
cggagcgcccggccagc

SEQ ID NO: 2991194 - RNA, 19 nt, Mycobacterium avium subsp. paratuberculosis
cggagcgcccggccagccg

SEQ ID NO: 2991195 - RNA, 15 nt, Mycobacterium avium subsp. paratuberculosis
cggagcgcuccacca

SEQ ID NO: 2991196 - RNA, 17 nt, Mycobacterium avium subsp. paratuberculosis
cggagcgcuccaccacc

SEQ ID NO: 2991197 - RNA, 18 nt, Mycobacterium avium subsp. paratuberculosis
cggagcgcuccaccaccg

SEQ ID NO: 2991198 - RNA, 17 nt, Mycobacterium avium subsp. paratuberculosis
cggagcggauggcgccg

SEQ ID NO: 2991199 - RNA, 21 nt, Mycobacterium avium subsp. paratuberculosis
cggagcggauggcgccgucga

SEQ ID NO: 2991200 - RNA, 13 nt, Mycobacterium avium subsp. paratuberculosis
cggagcggcgguc

SEQ ID NO: 2991201 - RNA, 19 nt, Mycobacterium avium subsp. paratuberculosis
cggagcgggucagcgugcu

SEQ ID NO: 2991202 - RNA, 16 nt, Mycobacterium avium subsp. paratuberculosis
cggagcgucgcgauga

SEQ ID NO: 2991203 - RNA, 15 nt, Mycobacterium avium subsp. paratuberculosis
cggagcguucuccac

SEQ ID NO: 2991204 - RNA, 17 nt, Mycobacterium avium subsp. paratuberculosis
cggagcguucuccaccc

SEQ ID NO: 2991205 - RNA, 20 nt, Mycobacterium avium subsp. paratuberculosis
cggagcguucuccacccgcc

SEQ ID NO: 2991206 - RNA, 14 nt, Mycobacterium avium subsp. paratuberculosis
cggagcugcgcgcc

SEQ ID NO: 2991207 - RNA, 15 nt, Mycobacterium avium subsp. paratuberculosis
cggagcugcgcgccc

SEQ ID NO: 2991208 - RNA, 18 nt, Mycobacterium avium subsp. paratuberculosis
cggagcugcgcgccccgg

SEQ ID NO: 2991209 - RNA, 20 nt, Mycobacterium avium subsp. paratuberculosis
cggagcugcgcgccccggcc

SEQ ID NO: 2991210 - RNA, 17 nt, Mycobacterium avium subsp. paratuberculosis
cggaggaauucgccgac

SEQ ID NO: 2991211 - RNA, 22 nt, Mycobacterium avium subsp. paratuberculosis
cggaggacaacgcgucgaacag

SEQ ID NO: 2991212 - RNA, 23 nt, Mycobacterium avium subsp. paratuberculosis
cggaggacaacgcgucgaacagc

SEQ ID NO: 2991213 - RNA, 21 nt, Mycobacterium avium subsp. paratuberculosis
cggaggaguuuuucggggugg

SEQ ID NO: 2991214 - RNA, 19 nt, Mycobacterium avium subsp. paratuberculosis
cggaggaugccggccagcu

SEQ ID NO: 2991215 - RNA, 15 nt, Mycobacterium avium subsp. paratuberculosis
cggaggccaccgcgc

SEQ ID NO: 2991216 - RNA, 20 nt, Mycobacterium avium subsp. paratuberculosis
cggaggccaccgcgccgucu

SEQ ID NO: 2991217 - RNA, 19 nt, Mycobacterium avium subsp. paratuberculosis
cggaggccagcucgaccgc

SEQ ID NO: 2991218 - RNA, 22 nt, Mycobacterium avium subsp. paratuberculosis
cggaggccagcucgaccgcggc

SEQ ID NO: 2991219 - RNA, 13 nt, Mycobacterium avium subsp. paratuberculosis
cggaggccgcggg

SEQ ID NO: 2991220 - RNA, 16 nt, Mycobacterium avium subsp. paratuberculosis
cggaggccugcgcggc

SEQ ID NO: 2991221 - RNA, 17 nt, Mycobacterium avium subsp. paratuberculosis
cggaggcgaaugcggcc

SEQ ID NO: 2991222 - RNA, 18 nt, Mycobacterium avium subsp. paratuberculosis
cggaggcgaaugcggcca

SEQ ID NO: 2991223 - RNA, 13 nt, Mycobacterium avium subsp. paratuberculosis
cggaggcgagcag

SEQ ID NO: 2991224 - RNA, 15 nt, Mycobacterium avium subsp. paratuberculosis
cggaggcgagcagcc

SEQ ID NO: 2991225 - RNA, 15 nt, Mycobacterium avium subsp. paratuberculosis
cggaggcgaucaggu

SEQ ID NO: 2991226 - RNA, 20 nt, Mycobacterium avium subsp. paratuberculosis
cggaggcggcgggggcgggc

SEQ ID NO: 2991227 - RNA, 12 nt, Mycobacterium avium subsp. paratuberculosis
cggaggcggcgu

SEQ ID NO: 2991228 - RNA, 15 nt, Mycobacterium avium subsp. paratuberculosis
cggaggcgucgacgc

SEQ ID NO: 2991229 - RNA, 20 nt, Mycobacterium avium subsp. paratuberculosis
cggaggcgucgacgcgcugc

SEQ ID NO: 2991230 - RNA, 23 nt, Mycobacterium avium subsp. paratuberculosis
cggagggguacucggcuucgucg

SEQ ID NO: 2991231 - RNA, 23 nt, Mycobacterium avium subsp. paratuberculosis
cggagguacucgaguggcgaacg

SEQ ID NO: 2991232 - RNA, 18 nt, Mycobacterium avium subsp. paratuberculosis
cggaggucagcggcccga

SEQ ID NO: 2991233 - RNA, 21 nt, Mycobacterium avium subsp. paratuberculosis
cggaggucagcggcccgauca

SEQ ID NO: 2991234 - RNA, 22 nt, Mycobacterium avium subsp. paratuberculosis
cggaggucagcggcccgaucac

SEQ ID NO: 2991235 - RNA, 13 nt, Mycobacterium avium subsp. paratuberculosis
cggaggucauggc

SEQ ID NO: 2991236 - RNA, 19 nt, Mycobacterium avium subsp. paratuberculosis
cggaggucauggcgaccgc

SEQ ID NO: 2991237 - RNA, 13 nt, Mycobacterium avium subsp. paratuberculosis
cggaauucgcggg

SEQ ID NO: 2991238 - RNA, 20 nt, Mycobacterium avium subsp. paratuberculosis
cggaauucgggugcggcgug

SEQ ID NO: 2991239 - RNA, 21 nt, Mycobacterium avium subsp. paratuberculosis
cggaauugaagaagcgggcca

SEQ ID NO: 2991240 - RNA, 17 nt, Mycobacterium avium subsp. paratuberculosis
cggacaccaccgcggug

SEQ ID NO: 2991241 - RNA, 13 nt, Mycobacterium avium subsp. paratuberculosis
cggacaccagcau

SEQ ID NO: 2991242 - RNA, 13 nt, Mycobacterium avium subsp. paratuberculosis
cggacaccagguu

SEQ ID NO: 2991243 - RNA, 14 nt, Mycobacterium avium subsp. paratuberculosis
cggacaccagguug

SEQ ID NO: 2991244 - RNA, 21 nt, Mycobacterium avium subsp. paratuberculosis
cggacaccagguuggucucga

SEQ ID NO: 2991245 - RNA, 17 nt, Mycobacterium avium subsp. paratuberculosis
cggacaccagucgcaca

SEQ ID NO: 2991246 - RNA, 14 nt, Mycobacterium avium subsp. paratuberculosis
cggacaccccguag

SEQ ID NO: 2991247 - RNA, 15 nt, Mycobacterium avium subsp. paratuberculosis
cggacaccccguagg

SEQ ID NO: 2991248 - RNA, 21 nt, Mycobacterium avium subsp. paratuberculosis
cggacaccccguaggugcaca

SEQ ID NO: 2991249 - RNA, 12 nt, Mycobacterium avium subsp. paratuberculosis
cggacacccgcg

SEQ ID NO: 2991250 - RNA, 20 nt, Mycobacterium avium subsp. paratuberculosis
cggacaccgaaccgccccgc

SEQ ID NO: 2991251 - RNA, 23 nt, Mycobacterium avium subsp. paratuberculosis
cggacaccgaaccgccccgcgcg

SEQ ID NO: 2991252 - RNA, 13 nt, Mycobacterium avium subsp. paratuberculosis
cggacaccggcac

SEQ ID NO: 2991253 - RNA, 20 nt, Mycobacterium avium subsp. paratuberculosis
cggacaccggcacgucggcc

SEQ ID NO: 2991254 - RNA, 21 nt, Mycobacterium avium subsp. paratuberculosis
cggacaccucggccagcgccg

SEQ ID NO: 2991255 - RNA, 22 nt, Mycobacterium avium subsp. paratuberculosis
cggacaccuggagucguaccga

SEQ ID NO: 2991256 - RNA, 19 nt, Mycobacterium avium subsp. paratuberculosis
cggacacgaacgacgcggc

SEQ ID NO: 2991257 - RNA, 13 nt, Mycobacterium avium subsp. paratuberculosis
cggacacggccag

SEQ ID NO: 2991258 - RNA, 18 nt, Mycobacterium avium subsp. paratuberculosis
cggacacggccagcgccg

SEQ ID NO: 2991259 - RNA, 20 nt, Mycobacterium avium subsp. paratuberculosis
cggacacggccagcgccguc

SEQ ID NO: 2991260 - RNA, 13 nt, Mycobacterium avium subsp. paratuberculosis
cggacacggcgcc

SEQ ID NO: 2991261 - RNA, 14 nt, Mycobacterium avium subsp. paratuberculosis
cggacacggcgccg

SEQ ID NO: 2991262 - RNA, 16 nt, Mycobacterium avium subsp. paratuberculosis
cggacacggcgccgug

SEQ ID NO: 2991263 - RNA, 17 nt, Mycobacterium avium subsp. paratuberculosis
cggacacggcgccgugc

SEQ ID NO: 2991264 - RNA, 13 nt, Mycobacterium avium subsp. paratuberculosis
cggacagagucga

SEQ ID NO: 2991265 - RNA, 14 nt, Mycobacterium avium subsp. paratuberculosis
cggacagcagcacc

SEQ ID NO: 2991266 - RNA, 15 nt, Mycobacterium avium subsp. paratuberculosis
cggacagcagcaccg

SEQ ID NO: 2991267 - RNA, 17 nt, Mycobacterium avium subsp. paratuberculosis
cggacagcagcaccggc

SEQ ID NO: 2991268 - RNA, 20 nt, Mycobacterium avium subsp. paratuberculosis
cggacagcagcaccggcacc

SEQ ID NO: 2991269 - RNA, 13 nt, Mycobacterium avium subsp. paratuberculosis
cggacagccgggg

SEQ ID NO: 2991270 - RNA, 21 nt, Mycobacterium avium subsp. paratuberculosis
cggacagcgcgacgcacgccg

SEQ ID NO: 2991271 - RNA, 17 nt, Mycobacterium avium subsp. paratuberculosis
cggacagcggccccccg

SEQ ID NO: 2991272 - RNA, 15 nt, Mycobacterium avium subsp. paratuberculosis
cggacagcgggccga

SEQ ID NO: 2991273 - RNA, 16 nt, Mycobacterium avium subsp. paratuberculosis
cggacagcucaccggg

SEQ ID NO: 2991274 - RNA, 15 nt, Mycobacterium avium subsp. paratuberculosis
cggacagcucgccgg

SEQ ID NO: 2991275 - RNA, 16 nt, Mycobacterium avium subsp. paratuberculosis
cggacagcucgccggc

SEQ ID NO: 2991276 - RNA, 18 nt, Mycobacterium avium subsp. paratuberculosis
cggacagcucgccggccg

SEQ ID NO: 2991277 - RNA, 20 nt, Mycobacterium avium subsp. paratuberculosis
cggacagcucgccggccgcg

SEQ ID NO: 2991278 - RNA, 21 nt, Mycobacterium avium subsp. paratuberculosis
cggacagcucgccggccgcgg

SEQ ID NO: 2991279 - RNA, 24 nt, Mycobacterium avium subsp. paratuberculosis
cggacagcucgccggccgcgggcg

SEQ ID NO: 2991280 - RNA, 17 nt, Mycobacterium avium subsp. paratuberculosis
cggacagcugcgcgggc

SEQ ID NO: 2991281 - RNA, 17 nt, Mycobacterium avium subsp. paratuberculosis
cggacagcuggcggucg

SEQ ID NO: 2991282 - RNA, 14 nt, Mycobacterium avium subsp. paratuberculosis
cggacagggcggcg

SEQ ID NO: 2991283 - RNA, 18 nt, Mycobacterium avium subsp. paratuberculosis
cggacagggcggcgaccu

SEQ ID NO: 2991284 - RNA, 14 nt, Mycobacterium avium subsp. paratuberculosis
cggacagguguggg

SEQ ID NO: 2991285 - RNA, 21 nt, Mycobacterium avium subsp. paratuberculosis
cggacaggugugggcguacgg

SEQ ID NO: 2991286 - RNA, 15 nt, Mycobacterium avium subsp. paratuberculosis
cggacauaggcgucg

SEQ ID NO: 2991287 - RNA, 19 nt, Mycobacterium avium subsp. paratuberculosis
cggacauccauugggccgc

SEQ ID NO: 2991288 - RNA, 20 nt, Mycobacterium avium subsp. paratuberculosis
cggacauccauugggccgcg

SEQ ID NO: 2991289 - RNA, 22 nt, Mycobacterium avium subsp. paratuberculosis
cggacauccauugggccgcggc

SEQ ID NO: 2991290 - RNA, 23 nt, Mycobacterium avium subsp. paratuberculosis
cggacauccauugggccgcggcg

SEQ ID NO: 2991291 - RNA, 17 nt, Mycobacterium avium subsp. paratuberculosis
cggacaucgccucggcg

SEQ ID NO: 2991292 - RNA, 15 nt, Mycobacterium avium subsp. paratuberculosis
cggacaucggcagca

SEQ ID NO: 2991293 - RNA, 16 nt, Mycobacterium avium subsp. paratuberculosis
cggacaucggcagcag

SEQ ID NO: 2991294 - RNA, 22 nt, Mycobacterium avium subsp. paratuberculosis
cggacaucucccgcacccguuc

SEQ ID NO: 2991295 - RNA, 17 nt, Mycobacterium avium subsp. paratuberculosis
cggacauucggacggcc

SEQ ID NO: 2991296 - RNA, 21 nt, Mycobacterium avium subsp. paratuberculosis
cggaccaccgcgugcgagccg

SEQ ID NO: 2991297 - RNA, 22 nt, Mycobacterium avium subsp. paratuberculosis
cggaccaccgcgugcgagccga

SEQ ID NO: 2991298 - RNA, 14 nt, Mycobacterium avium subsp. paratuberculosis
cggaccacgucccc

SEQ ID NO: 2991299 - RNA, 19 nt, Mycobacterium avium subsp. paratuberculosis
cggaccacguccccgggcg

SEQ ID NO: 2991300 - RNA, 20 nt, Mycobacterium avium subsp. paratuberculosis
cggaccaggguggccccagc

SEQ ID NO: 2991301 - RNA, 22 nt, Mycobacterium avium subsp. paratuberculosis
cggaccaggguggccccagccc

SEQ ID NO: 2991302 - RNA, 23 nt, Mycobacterium avium subsp. paratuberculosis
cggaccaggguggccccagcccg

SEQ ID NO: 2991303 - RNA, 22 nt, Mycobacterium avium subsp. paratuberculosis
cggaccagguauucaucgcggc

SEQ ID NO: 2991304 - RNA, 19 nt, Mycobacterium avium subsp. paratuberculosis
cggaccagugcagguuccg

SEQ ID NO: 2991305 - RNA, 12 nt, Mycobacterium avium subsp. paratuberculosis
cggacccagccc

SEQ ID NO: 2991306 - RNA, 13 nt, Mycobacterium avium subsp. paratuberculosis
cggacccagcccg

SEQ ID NO: 2991307 - RNA, 14 nt, Mycobacterium avium subsp. paratuberculosis
cggacccagcccga

SEQ ID NO: 2991308 - RNA, 17 nt, Mycobacterium avium subsp. paratuberculosis
cggacccagcccggcga

SEQ ID NO: 2991309 - RNA, 18 nt, Mycobacterium avium subsp. paratuberculosis
cggacccagcuccucggc

SEQ ID NO: 2991310 - RNA, 21 nt, Mycobacterium avium subsp. paratuberculosis
cggacccagcuccucggccag

SEQ ID NO: 2991311 - RNA, 14 nt, Mycobacterium avium subsp. paratuberculosis
cggacccaggcagc

SEQ ID NO: 2991312 - RNA, 19 nt, Mycobacterium avium subsp. paratuberculosis
cggacccauucgucggcgg

SEQ ID NO: 2991313 - RNA, 23 nt, Mycobacterium avium subsp. paratuberculosis
cggaccccagcgugacgucgacg

SEQ ID NO: 2991314 - RNA, 20 nt, Mycobacterium avium subsp. paratuberculosis
cggacccccucggggcucac

SEQ ID NO: 2991315 - RNA, 17 nt, Mycobacterium avium subsp. paratuberculosis
cggaccccgaugcgcuc

SEQ ID NO: 2991316 - RNA, 20 nt, Mycobacterium avium subsp. paratuberculosis
cggacccgacggucgggccc

SEQ ID NO: 2991317 - RNA, 15 nt, Mycobacterium avium subsp. paratuberculosis
cggacccgcucgccg

SEQ ID NO: 2991318 - RNA, 18 nt, Mycobacterium avium subsp. paratuberculosis
cggacccggucggccgcg

SEQ ID NO: 2991319 - RNA, 19 nt, Mycobacterium avium subsp. paratuberculosis
cggacccuggccagcaccg

SEQ ID NO: 2991320 - RNA, 21 nt, Mycobacterium avium subsp. paratuberculosis
cggacccuucagccagaucga

SEQ ID NO: 2991321 - RNA, 12 nt, Mycobacterium avium subsp. paratuberculosis
cggaccgauccg

SEQ ID NO: 2991322 - RNA, 14 nt, Mycobacterium avium subsp. paratuberculosis
cggaccgauccggc

SEQ ID NO: 2991323 - RNA, 13 nt, Mycobacterium avium subsp. paratuberculosis
cggaccgcaccac

SEQ ID NO: 2991324 - RNA, 16 nt, Mycobacterium avium subsp. paratuberculosis
cggaccgcaccaccac

SEQ ID NO: 2991325 - RNA, 23 nt, Mycobacterium avium subsp. paratuberculosis
cgcgguugaucacaccgucggcg

SEQ ID NO: 2991326 - RNA, 18 nt, Mycobacterium avium subsp. paratuberculosis
cgcgguugaugaucuugg

SEQ ID NO: 2991327 - RNA, 22 nt, Mycobacterium avium subsp. paratuberculosis
cgcgguugaugaucuuggugaa

SEQ ID NO: 2991328 - RNA, 16 nt, Mycobacterium avium subsp. paratuberculosis
cgcgguugcccgcacc

SEQ ID NO: 2991329 - RNA, 16 nt, Mycobacterium avium subsp. paratuberculosis
cgcgguugcccucggu

SEQ ID NO: 2991330 - RNA, 22 nt, Mycobacterium avium subsp. paratuberculosis
cgcgguugcggguggcggccgg

SEQ ID NO: 2991331 - RNA, 22 nt, Mycobacterium avium subsp. paratuberculosis
cgcgguugcgguugucggucag

SEQ ID NO: 2991332 - RNA, 14 nt, Mycobacterium avium subsp. paratuberculosis
cgcgguugggccgc

SEQ ID NO: 2991333 - RNA, 17 nt, Mycobacterium avium subsp. paratuberculosis
cgcgguugggccgccgg

SEQ ID NO: 2991334 - RNA, 20 nt, Mycobacterium avium subsp. paratuberculosis
cgcgguugggccgccggccg

SEQ ID NO: 2991335 - RNA, 20 nt, Mycobacterium avium subsp. paratuberculosis
cgcgguugggccggcgcccg

SEQ ID NO: 2991336 - RNA, 21 nt, Mycobacterium avium subsp. paratuberculosis
cgcgguugggccggcgcccgu

SEQ ID NO: 2991337 - RNA, 23 nt, Mycobacterium avium subsp. paratuberculosis
cgcgguuucaccgugcgcgcgca

SEQ ID NO: 2991338 - RNA, 14 nt, Mycobacterium avium subsp. paratuberculosis
cgcgguuuccggcg

SEQ ID NO: 2991339 - RNA, 16 nt, Mycobacterium avium subsp. paratuberculosis
cgcgguuuccggcgau

SEQ ID NO: 2991340 - RNA, 17 nt, Mycobacterium avium subsp. paratuberculosis
cgcgguuuccggcgauu

SEQ ID NO: 2991341 - RNA, 15 nt, Mycobacterium avium subsp. paratuberculosis
cgcgguuucggcguc

SEQ ID NO: 2991342 - RNA, 18 nt, Mycobacterium avium subsp. paratuberculosis
cgcgguuucggcgucgcc

SEQ ID NO: 2991343 - RNA, 19 nt, Mycobacterium avium subsp. paratuberculosis
cgcgguuucggcgucgccu

SEQ ID NO: 2991344 - RNA, 20 nt, Mycobacterium avium subsp. paratuberculosis
cgcgguuucggcgucgccuu

SEQ ID NO: 2991345 - RNA, 16 nt, Mycobacterium avium subsp. paratuberculosis
cgcgguuuggucagcg

SEQ ID NO: 2991346 - RNA, 20 nt, Mycobacterium avium subsp. paratuberculosis
cgcgguuuggucagcgcccc

SEQ ID NO: 2991347 - RNA, 22 nt, Mycobacterium avium subsp. paratuberculosis
cgcgguuuggucagcgcccccg

SEQ ID NO: 2991348 - RNA, 23 nt, Mycobacterium avium subsp. paratuberculosis
cgcgguuuggucagcgcccccga

SEQ ID NO: 2991349 - RNA, 17 nt, Mycobacterium avium subsp. paratuberculosis
cgcgguuuugaugccgc

SEQ ID NO: 2991350 - RNA, 20 nt, Mycobacterium avium subsp. paratuberculosis
cgcgguuuugaugccgccgg

SEQ ID NO: 2991351 - RNA, 21 nt, Mycobacterium avium subsp. paratuberculosis
cgcgguuuugaugccgccggg

SEQ ID NO: 2991352 - RNA, 15 nt, Mycobacterium avium subsp. paratuberculosis
cgcguaaccggcggc

SEQ ID NO: 2991353 - RNA, 16 nt, Mycobacterium avium subsp. paratuberculosis
cgcguaaccggcggcg

SEQ ID NO: 2991354 - RNA, 17 nt, Mycobacterium avium subsp. paratuberculosis
cgcguaaccggcggcgg

SEQ ID NO: 2991355 - RNA, 21 nt, Mycobacterium avium subsp. paratuberculosis
cgcguaaccggcggcggugag

SEQ ID NO: 2991356 - RNA, 13 nt, Mycobacterium avium subsp. paratuberculosis
cgcguacaccggc

SEQ ID NO: 2991357 - RNA, 17 nt, Mycobacterium avium subsp. paratuberculosis
cgcguacaccggcugac

SEQ ID NO: 2991358 - RNA, 22 nt, Mycobacterium avium subsp. paratuberculosis
cgcguacaccggcugaccggcg

SEQ ID NO: 2991359 - RNA, 14 nt, Mycobacterium avium subsp. paratuberculosis
cgcguacagccagc

SEQ ID NO: 2991360 - RNA, 13 nt, Mycobacterium avium subsp. paratuberculosis
cgcguacagcgcc

SEQ ID NO: 2991361 - RNA, 18 nt, Mycobacterium avium subsp. paratuberculosis
cgcguacagcgcccggau

SEQ ID NO: 2991362 - RNA, 15 nt, Mycobacterium avium subsp. paratuberculosis
cgcguacagcggguc

SEQ ID NO: 2991363 - RNA, 17 nt, Mycobacterium avium subsp. paratuberculosis
cgcguacagcgggucgu

SEQ ID NO: 2991364 - RNA, 18 nt, Mycobacterium avium subsp. paratuberculosis
cgcguacagggcgucgga

SEQ ID NO: 2991365 - RNA, 21 nt, Mycobacterium avium subsp. paratuberculosis
cgcguacaggucgcacaggau

SEQ ID NO: 2991366 - RNA, 15 nt, Mycobacterium avium subsp. paratuberculosis
cgcguaccagcgcca

SEQ ID NO: 2991367 - RNA, 17 nt, Mycobacterium avium subsp. paratuberculosis
cgcguaccagcgccacg

SEQ ID NO: 2991368 - RNA, 18 nt, Mycobacterium avium subsp. paratuberculosis
cgcguacccgcgcggcgu

SEQ ID NO: 2991369 - RNA, 20 nt, Mycobacterium avium subsp. paratuberculosis
cgcguacgaccguagccggu

SEQ ID NO: 2991370 - RNA, 22 nt, Mycobacterium avium subsp. paratuberculosis
cgcguacgccgccuugacgccg

SEQ ID NO: 2991371 - RNA, 13 nt, Mycobacterium avium subsp. paratuberculosis
cgcguacgggaug

SEQ ID NO: 2991372 - RNA, 21 nt, Mycobacterium avium subsp. paratuberculosis
cgcguacggguugggcggggc

SEQ ID NO: 2991373 - RNA, 16 nt, Mycobacterium avium subsp. paratuberculosis
cgcguagagcaucagg

SEQ ID NO: 2991374 - RNA, 16 nt, Mycobacterium avium subsp. paratuberculosis
cgcguagcgcagcucc

SEQ ID NO: 2991375 - RNA, 13 nt, Mycobacterium avium subsp. paratuberculosis
cgcguagcgccgc

SEQ ID NO: 2991376 - RNA, 19 nt, Mycobacterium avium subsp. paratuberculosis
cgcguagcucagugguaga

SEQ ID NO: 2991377 - RNA, 15 nt, Mycobacterium avium subsp. paratuberculosis
cgcguagcucgccgc

SEQ ID NO: 2991378 - RNA, 17 nt, Mycobacterium avium subsp. paratuberculosis
cgcguagcucgccgcgg

SEQ ID NO: 2991379 - RNA, 20 nt, Mycobacterium avium subsp. paratuberculosis
cgcguagcucgccgcggcca

SEQ ID NO: 2991380 - RNA, 17 nt, Mycobacterium avium subsp. paratuberculosis
cgcguagggcagggucg

SEQ ID NO: 2991381 - RNA, 19 nt, Mycobacterium avium subsp. paratuberculosis
cgcguaggguucgccgaug

SEQ ID NO: 2991382 - RNA, 14 nt, Mycobacterium avium subsp. paratuberculosis
cgcguaggugcggu

SEQ ID NO: 2991383 - RNA, 16 nt, Mycobacterium avium subsp. paratuberculosis
cgcguaguccagcacg

SEQ ID NO: 2991384 - RNA, 20 nt, Mycobacterium avium subsp. paratuberculosis
cgcguaguccagcacggcga

SEQ ID NO: 2991385 - RNA, 22 nt, Mycobacterium avium subsp. paratuberculosis
cgcguaguccagcacggcgaag

SEQ ID NO: 2991386 - RNA, 20 nt, Mycobacterium avium subsp. paratuberculosis
cgcguagucggcgucggcca

SEQ ID NO: 2991387 - RNA, 16 nt, Mycobacterium avium subsp. paratuberculosis
cgcguauuccagcgcc

SEQ ID NO: 2991388 - RNA, 19 nt, Mycobacterium avium subsp. paratuberculosis
cgcguauuccagcgccagc

SEQ ID NO: 2991389 - RNA, 17 nt, Mycobacterium avium subsp. paratuberculosis
cgcguauugcacggcgg

SEQ ID NO: 2991390 - RNA, 20 nt, Mycobacterium avium subsp. paratuberculosis
cgcguauugcacggcggcga

SEQ ID NO: 2991391 - RNA, 15 nt, Mycobacterium avium subsp. paratuberculosis
cgcgucaaccaccgg

SEQ ID NO: 2991392 - RNA, 16 nt, Mycobacterium avium subsp. paratuberculosis
cgcgucaaccaccggc

SEQ ID NO: 2991393 - RNA, 13 nt, Mycobacterium avium subsp. paratuberculosis
cgcgucacauccg

SEQ ID NO: 2991394 - RNA, 13 nt, Mycobacterium avium subsp. paratuberculosis
cgcgucacgcugg

SEQ ID NO: 2991395 - RNA, 15 nt, Mycobacterium avium subsp. paratuberculosis
cgcgucacgcuggcg

SEQ ID NO: 2991396 - RNA, 18 nt, Mycobacterium avium subsp. paratuberculosis
cgcgucacgcuggcguga

SEQ ID NO: 2991397 - RNA, 20 nt, Mycobacterium avium subsp. paratuberculosis
cgcgucacgcuggcgugacg

SEQ ID NO: 2991398 - RNA, 13 nt, Mycobacterium avium subsp. paratuberculosis
cgcgucacgucgg

SEQ ID NO: 2991399 - RNA, 17 nt, Mycobacterium avium subsp. paratuberculosis
cgcgucagcagcgcgac

SEQ ID NO: 2991400 - RNA, 19 nt, Mycobacterium avium subsp. paratuberculosis
cgcgucagcagcgcgacgc

SEQ ID NO: 2991401 - RNA, 15 nt, Mycobacterium avium subsp. paratuberculosis
cgcgucagccgucgu

SEQ ID NO: 2991402 - RNA, 17 nt, Mycobacterium avium subsp. paratuberculosis
cgcgucagccgucgucg

SEQ ID NO: 2991403 - RNA, 23 nt, Mycobacterium avium subsp. paratuberculosis
cgcgucagccgucgucguccgca

SEQ ID NO: 2991404 - RNA, 14 nt, Mycobacterium avium subsp. paratuberculosis
cgcgucaggcgucg

SEQ ID NO: 2991405 - RNA, 16 nt, Mycobacterium avium subsp. paratuberculosis
cgcgucaggcgucgua

SEQ ID NO: 2991406 - RNA, 17 nt, Mycobacterium avium subsp. paratuberculosis
cgcgucaucgggcccga

SEQ ID NO: 2991407 - RNA, 18 nt, Mycobacterium avium subsp. paratuberculosis
cgcgucaucgggcccgac

SEQ ID NO: 2991408 - RNA, 17 nt, Mycobacterium avium subsp. paratuberculosis
cgcgucauggccgucgg

SEQ ID NO: 2991409 - RNA, 15 nt, Mycobacterium avium subsp. paratuberculosis
cgcguccaaccgcgg

SEQ ID NO: 2991410 - RNA, 18 nt, Mycobacterium avium subsp. paratuberculosis
cgcguccaaccgcggacu

SEQ ID NO: 2991411 - RNA, 13 nt, Mycobacterium avium subsp. paratuberculosis
cgcguccagcagc

SEQ ID NO: 2991412 - RNA, 15 nt, Mycobacterium avium subsp. paratuberculosis
cgcguccagcaugcc

SEQ ID NO: 2991413 - RNA, 22 nt, Mycobacterium avium subsp. paratuberculosis
cgcguccagcaugcccacgccg

SEQ ID NO: 2991414 - RNA, 17 nt, Mycobacterium avium subsp. paratuberculosis
cgcgucggucagcgcca

SEQ ID NO: 2991415 - RNA, 18 nt, Mycobacterium avium subsp. paratuberculosis
cgcgucggucagcgccac

SEQ ID NO: 2991416 - RNA, 19 nt, Mycobacterium avium subsp. paratuberculosis
cgcgucggucagcggcguc

SEQ ID NO: 2991417 - RNA, 20 nt, Mycobacterium avium subsp. paratuberculosis
cgcgucggucagcggcguca

SEQ ID NO: 2991418 - RNA, 21 nt, Mycobacterium avium subsp. paratuberculosis
cgcgucggucagcggcgucag

SEQ ID NO: 2991419 - RNA, 18 nt, Mycobacterium avium subsp. paratuberculosis
cgcgucguagccggcacg

SEQ ID NO: 2991420 - RNA, 20 nt, Mycobacterium avium subsp. paratuberculosis
cgcgucguagucgcucggcg

SEQ ID NO: 2991421 - RNA, 22 nt, Mycobacterium avium subsp. paratuberculosis
cgcgucguagucgcucggcggc

SEQ ID NO: 2991422 - RNA, 13 nt, Mycobacterium avium subsp. paratuberculosis
cgcgucguccgac

SEQ ID NO: 2991423 - RNA, 15 nt, Mycobacterium avium subsp. paratuberculosis
cgcgucguccgacac

SEQ ID NO: 2991424 - RNA, 19 nt, Mycobacterium avium subsp. paratuberculosis
cgcgucguccgacaccacc

SEQ ID NO: 2991425 - RNA, 20 nt, Mycobacterium avium subsp. paratuberculosis
cgcgucguccgacaccaccu

SEQ ID NO: 2991426 - RNA, 16 nt, Mycobacterium avium subsp. paratuberculosis
cgcgucguccucuucg

SEQ ID NO: 2991427 - RNA, 13 nt, Mycobacterium avium subsp. paratuberculosis
cgcgucgucgaug

SEQ ID NO: 2991428 - RNA, 20 nt, Mycobacterium avium subsp. paratuberculosis
cgcgucgucgauggccacca

SEQ ID NO: 2991429 - RNA, 15 nt, Mycobacterium avium subsp. paratuberculosis
cgcgucgucgcccga

SEQ ID NO: 2991430 - RNA, 13 nt, Mycobacterium avium subsp. paratuberculosis
cgcgucgucggcg

SEQ ID NO: 2991431 - RNA, 14 nt, Mycobacterium avium subsp. paratuberculosis
cgcgucgucggcgg

SEQ ID NO: 2991432 - RNA, 16 nt, Mycobacterium avium subsp. paratuberculosis
cgcgucgucggcgggc

SEQ ID NO: 2991433 - RNA, 15 nt, Mycobacterium avium subsp. paratuberculosis
cgcgucgucggucag

SEQ ID NO: 2991434 - RNA, 13 nt, Mycobacterium avium subsp. paratuberculosis
cgcgucgucgucg

SEQ ID NO: 2991435 - RNA, 14 nt, Mycobacterium avium subsp. paratuberculosis
cgcgucgucgucga

SEQ ID NO: 2991436 - RNA, 15 nt, Mycobacterium avium subsp. paratuberculosis
cgcgucgucgucgac

SEQ ID NO: 2991437 - RNA, 19 nt, Mycobacterium avium subsp. paratuberculosis
cgcgucgucgucgaccguc

SEQ ID NO: 2991438 - RNA, 15 nt, Mycobacterium avium subsp. paratuberculosis
cgcgucgugccgagc

SEQ ID NO: 2991439 - RNA, 13 nt, Mycobacterium avium subsp. paratuberculosis
cgcgucgugcggc

SEQ ID NO: 2991440 - RNA, 14 nt, Mycobacterium avium subsp. paratuberculosis
cgcgucgugcggcc

SEQ ID NO: 2991441 - RNA, 19 nt, Mycobacterium avium subsp. paratuberculosis
cgcgucgugcggccggcgc

SEQ ID NO: 2991442 - RNA, 23 nt, Mycobacterium avium subsp. paratuberculosis
cgcgucguggcccugcucgucgu

SEQ ID NO: 2991443 - RNA, 18 nt, Mycobacterium avium subsp. paratuberculosis
cgcgucguguccgggccc

SEQ ID NO: 2991444 - RNA, 21 nt, Mycobacterium avium subsp. paratuberculosis
cgcgucguguccgggcccgaa

SEQ ID NO: 2991445 - RNA, 22 nt, Mycobacterium avium subsp. paratuberculosis
cgcgucguugagugcgcugugg

SEQ ID NO: 2991446 - RNA, 22 nt, Mycobacterium avium subsp. paratuberculosis
cgcgucguugucgucgccggcc

SEQ ID NO: 2991447 - RNA, 14 nt, Mycobacterium avium subsp. paratuberculosis
cgcgucucccccga

SEQ ID NO: 2991448 - RNA, 19 nt, Mycobacterium avium subsp. paratuberculosis
cgcgucucccccgaucagc

SEQ ID NO: 2991449 - RNA, 15 nt, Mycobacterium avium subsp. paratuberculosis
cgcgucugcucgccg

SEQ ID NO: 2991450 - RNA, 16 nt, Mycobacterium avium subsp. paratuberculosis
cgcgucugcucgccgg

SEQ ID NO: 2991451 - RNA, 17 nt, Mycobacterium avium subsp. paratuberculosis
cgcgucugcucgccggc

SEQ ID NO: 2991452 - RNA, 18 nt, Mycobacterium avium subsp. paratuberculosis
cgcgucugcucgccggcu

SEQ ID NO: 2991453 - RNA, 18 nt, Mycobacterium avium subsp. paratuberculosis
cgcgucugcucgcgguuc

SEQ ID NO: 2991454 - RNA, 16 nt, Mycobacterium avium subsp. paratuberculosis
cgcgucuuggacgccc

SEQ ID NO: 2991455 - RNA, 22 nt, Mycobacterium avium subsp. paratuberculosis
cgcgucuuggacgcccgcgacc

SEQ ID NO: 2991456 - RNA, 12 nt, Mycobacterium avium subsp. paratuberculosis
cgcgucuuguug

SEQ ID NO: 2991457 - RNA, 19 nt, Mycobacterium avium subsp. paratuberculosis
cgcgugaaugcccagcggg

SEQ ID NO: 2991458 - RNA, 17 nt, Mycobacterium avium subsp. paratuberculosis
cgcgugacaagccggcg

SEQ ID NO: 2991459 - RNA, 20 nt, Mycobacterium avium subsp. paratuberculosis
cgcgugacaagccggcgucg

SEQ ID NO: 2991460 - RNA, 18 nt, Mycobacterium avium subsp. paratuberculosis
cgcgugacaggggcagca

SEQ ID NO: 2991461 - RNA, 13 nt, Mycobacterium avium subsp. paratuberculosis
cgcgugaccccgg

SEQ ID NO: 2991462 - RNA, 15 nt, Mycobacterium avium subsp. paratuberculosis
cgcgugaccccggcg

SEQ ID NO: 2991463 - RNA, 18 nt, Mycobacterium avium subsp. paratuberculosis
cgcgugaccccggcgacc

SEQ ID NO: 2991464 - RNA, 21 nt, Mycobacterium avium subsp. paratuberculosis
cgcgugaccccggcgaccagc

SEQ ID NO: 2991465 - RNA, 18 nt, Mycobacterium avium subsp. paratuberculosis
cgcgugaccggcggugcg

SEQ ID NO: 2991466 - RNA, 13 nt, Mycobacterium avium subsp. paratuberculosis
cgcgugacggccg

SEQ ID NO: 2991467 - RNA, 17 nt, Mycobacterium avium subsp. paratuberculosis
cgcgugacggccgcggc

SEQ ID NO: 2991468 - RNA, 19 nt, Mycobacterium avium subsp. paratuberculosis
cgcgugacggccgcggcgc

SEQ ID NO: 2991469 - RNA, 15 nt, Mycobacterium avium subsp. paratuberculosis
cgcgugacggcgggg

SEQ ID NO: 2991470 - RNA, 12 nt, Mycobacterium avium subsp. paratuberculosis
cgcgugaucggu

SEQ ID NO: 2991471 - RNA, 22 nt, Mycobacterium avium subsp. paratuberculosis
cgcgugaugggugggcagcucg

SEQ ID NO: 2991472 - RNA, 22 nt, Mycobacterium avium subsp. paratuberculosis
cgcgugcaacacaugguccugc

SEQ ID NO: 2991473 - RNA, 16 nt, Mycobacterium avium subsp. paratuberculosis
cgcgugcacaccggcc

SEQ ID NO: 2991474 - RNA, 15 nt, Mycobacterium avium subsp. paratuberculosis
cgcgugcacgaacgc

SEQ ID NO: 2991475 - RNA, 16 nt, Mycobacterium avium subsp. paratuberculosis
cgcgugcacgaacgcg

SEQ ID NO: 2991476 - RNA, 15 nt, Mycobacterium avium subsp. paratuberculosis
cgcgugcagccgggc

SEQ ID NO: 2991477 - RNA, 20 nt, Mycobacterium avium subsp. paratuberculosis
cgcgugcagccgggcggcgc

SEQ ID NO: 2991478 - RNA, 21 nt, Mycobacterium avium subsp. paratuberculosis
cgcgugcagccgggcggcgcc

SEQ ID NO: 2991479 - RNA, 22 nt, Mycobacterium avium subsp. paratuberculosis
cgcgugcagccgggcggcgccg

SEQ ID NO: 2991480 - RNA, 23 nt, Mycobacterium avium subsp. paratuberculosis
cgcgugcagccgggcggcgccga

SEQ ID NO: 2991481 - RNA, 21 nt, Mycobacterium avium subsp. paratuberculosis
cgcgugcgagccgagcacgca

SEQ ID NO: 2991482 - RNA, 15 nt, Mycobacterium avium subsp. paratuberculosis
cgcgugcgccgcggc

SEQ ID NO: 2991483 - RNA, 14 nt, Mycobacterium avium subsp. paratuberculosis
cgcgugcgcgacga

SEQ ID NO: 2991484 - RNA, 20 nt, Mycobacterium avium subsp. paratuberculosis
cgcgugcggggugugcaggc

SEQ ID NO: 2991485 - RNA, 17 nt, Mycobacterium avium subsp. paratuberculosis
cgcgugcgucacgcugg

SEQ ID NO: 2991486 - RNA, 21 nt, Mycobacterium avium subsp. paratuberculosis
cgcgugcuggggguggcgucg

SEQ ID NO: 2991487 - RNA, 19 nt, Mycobacterium avium subsp. paratuberculosis
cgcgugcuguugcaggugc

SEQ ID NO: 2991488 - RNA, 22 nt, Mycobacterium avium subsp. paratuberculosis
cgcgugcuugccgaugucggcg

SEQ ID NO: 2991489 - RNA, 21 nt, Mycobacterium avium subsp. paratuberculosis
cgcguggcaauucgaccgucu

SEQ ID NO: 2991490 - RNA, 19 nt, Mycobacterium avium subsp. paratuberculosis
cgcguggccgaggaugggg

SEQ ID NO: 2991491 - RNA, 12 nt, Mycobacterium avium subsp. paratuberculosis
cgcguggccugg

SEQ ID NO: 2991492 - RNA, 14 nt, Mycobacterium avium subsp. paratuberculosis
cgcgugggagagcg

SEQ ID NO: 2991493 - RNA, 19 nt, Mycobacterium avium subsp. paratuberculosis
cgcgugggagagcgggacc

SEQ ID NO: 2991494 - RNA, 14 nt, Mycobacterium avium subsp. paratuberculosis
cgcgugggccaacg

SEQ ID NO: 2991495 - RNA, 16 nt, Mycobacterium avium subsp. paratuberculosis
cgcgugggccaacgcg

SEQ ID NO: 2991496 - RNA, 18 nt, Mycobacterium avium subsp. paratuberculosis
cgcguggggcgucgccgc

SEQ ID NO: 2991497 - RNA, 21 nt, Mycobacterium avium subsp. paratuberculosis
cgcguggggcgucgccgcccc

SEQ ID NO: 2991498 - RNA, 23 nt, Mycobacterium avium subsp. paratuberculosis
cgcguggguguccuugcgcacca

SEQ ID NO: 2991499 - RNA, 21 nt, Mycobacterium avium subsp. paratuberculosis
cgcguggucccacaccaccac

SEQ ID NO: 2991500 - RNA, 23 nt, Mycobacterium avium subsp. paratuberculosis
cgcguggucccacaccaccaccg

SEQ ID NO: 2991501 - RNA, 19 nt, Mycobacterium avium subsp. paratuberculosis
cgcgugguucaggcguccg

SEQ ID NO: 2991502 - RNA, 14 nt, Mycobacterium avium subsp. paratuberculosis
cgcgugucggcaca

SEQ ID NO: 2991503 - RNA, 21 nt, Mycobacterium avium subsp. paratuberculosis
cgcgugugcccagcacgacgc

SEQ ID NO: 2991504 - RNA, 19 nt, Mycobacterium avium subsp. paratuberculosis
cgcguucaagccgccgauc

SEQ ID NO: 2991505 - RNA, 18 nt, Mycobacterium avium subsp. paratuberculosis
cgcguucagggugcaggc

SEQ ID NO: 2991506 - RNA, 16 nt, Mycobacterium avium subsp. paratuberculosis
cgcguuccagcacgcc

SEQ ID NO: 2991507 - RNA, 20 nt, Mycobacterium avium subsp. paratuberculosis
cgcguuccaucagcgcccgc

SEQ ID NO: 2991508 - RNA, 12 nt, Mycobacterium avium subsp. paratuberculosis
cgcguuccccgg

SEQ ID NO: 2991509 - RNA, 17 nt, Mycobacterium avium subsp. paratuberculosis
cgcguuccccggcgugg

SEQ ID NO: 2991510 - RNA, 18 nt, Mycobacterium avium subsp. paratuberculosis
cgcguucccgggcccgcu

SEQ ID NO: 2991511 - RNA, 17 nt, Mycobacterium avium subsp. paratuberculosis
cgcguucgacccacacc

SEQ ID NO: 2991512 - RNA, 12 nt, Mycobacterium avium subsp. paratuberculosis
cgcguucgaccu

SEQ ID NO: 2991513 - RNA, 20 nt, Mycobacterium avium subsp. paratuberculosis
cgcguucgcuuucgccgggc

SEQ ID NO: 2991514 - RNA, 22 nt, Mycobacterium avium subsp. paratuberculosis
cgcguucgcuuucgcguucgcu

SEQ ID NO: 2991515 - RNA, 21 nt, Mycobacterium avium subsp. paratuberculosis
cgcguucggacaccucggcca

SEQ ID NO: 2991516 - RNA, 23 nt, Mycobacterium avium subsp. paratuberculosis
cgcguucggacaccucggccagc

SEQ ID NO: 2991517 - RNA, 22 nt, Mycobacterium avium subsp. paratuberculosis
cgcguucggaggcuucgcucau

SEQ ID NO: 2991518 - RNA, 24 nt, Mycobacterium avium subsp. paratuberculosis
cgcguucggcggcgcgcugcaggc

SEQ ID NO: 2991519 - RNA, 13 nt, Mycobacterium avium subsp. paratuberculosis
cgcguucgggcag

SEQ ID NO: 2991520 - RNA, 15 nt, Mycobacterium avium subsp. paratuberculosis
cgcguucgggcccgg

SEQ ID NO: 2991521 - RNA, 19 nt, Mycobacterium avium subsp. paratuberculosis
cgcguucgggcccggccgc

SEQ ID NO: 2991522 - RNA, 21 nt, Mycobacterium avium subsp. paratuberculosis
cgcguucgggcccggccgcca

SEQ ID NO: 2991523 - RNA, 24 nt, Mycobacterium avium subsp. paratuberculosis
cgcguucgggcccggccgccagca

SEQ ID NO: 2991524 - RNA, 15 nt, Mycobacterium avium subsp. paratuberculosis
cgcguucgucggcgc

SEQ ID NO: 2991525 - RNA, 22 nt, Mycobacterium avium subsp. paratuberculosis
cgcguucuccucgaacaccgca

SEQ ID NO: 2991526 - RNA, 23 nt, Mycobacterium avium subsp. paratuberculosis
cgcguucuccucgaacaccgcac

SEQ ID NO: 2991527 - RNA, 18 nt, Mycobacterium avium subsp. paratuberculosis
cgcguucugcaccagcuc

SEQ ID NO: 2991528 - RNA, 16 nt, Mycobacterium avium subsp. paratuberculosis
cgcguugaaagccgcg

SEQ ID NO: 2991529 - RNA, 20 nt, Mycobacterium avium subsp. paratuberculosis
cgcguugaagaacgggcuga

SEQ ID NO: 2991530 - RNA, 14 nt, Mycobacterium avium subsp. paratuberculosis
cgcguugaccagac

SEQ ID NO: 2991531 - RNA, 16 nt, Mycobacterium avium subsp. paratuberculosis
cgcguugaccagaccg

SEQ ID NO: 2991532 - RNA, 16 nt, Mycobacterium avium subsp. paratuberculosis
cgcguugagcgucgcc

SEQ ID NO: 2991533 - RNA, 17 nt, Mycobacterium avium subsp. paratuberculosis
cgcguugagcgucgcca

SEQ ID NO: 2991534 - RNA, 19 nt, Mycobacterium avium subsp. paratuberculosis
cgcguugaucagcgccagg

SEQ ID NO: 2991535 - RNA, 22 nt, Mycobacterium avium subsp. paratuberculosis
cgcguugaucagcgccaggugg

SEQ ID NO: 2991536 - RNA, 14 nt, Mycobacterium avium subsp. paratuberculosis
cgcguugaugacgg

SEQ ID NO: 2991537 - RNA, 17 nt, Mycobacterium avium subsp. paratuberculosis
cgcguugcgcggaccgg

SEQ ID NO: 2991538 - RNA, 20 nt, Mycobacterium avium subsp. paratuberculosis
cgcguugcgcggaccggcga

SEQ ID NO: 2991539 - RNA, 22 nt, Mycobacterium avium subsp. paratuberculosis
cgcguugcgcggaccggcgauu

SEQ ID NO: 2991540 - RNA, 17 nt, Mycobacterium avium subsp. paratuberculosis
cgcguugcggccgucca

SEQ ID NO: 2991541 - RNA, 14 nt, Mycobacterium avium subsp. paratuberculosis
cgcguugcggcgca

SEQ ID NO: 2991542 - RNA, 15 nt, Mycobacterium avium subsp. paratuberculosis
cgcguugcggcgcag

SEQ ID NO: 2991543 - RNA, 22 nt, Mycobacterium avium subsp. paratuberculosis
cgcguuggccagcgccuccagc

SEQ ID NO: 2991544 - RNA, 21 nt, Mycobacterium avium subsp. paratuberculosis
cgcguuggccagguugcgccg

SEQ ID NO: 2991545 - RNA, 17 nt, Mycobacterium avium subsp. paratuberculosis
cgcguuggcccgugucg

SEQ ID NO: 2991546 - RNA, 14 nt, Mycobacterium avium subsp. paratuberculosis
cgcguuggccgcca

SEQ ID NO: 2991547 - RNA, 15 nt, Mycobacterium avium subsp. paratuberculosis
cgcguuggccggcug

SEQ ID NO: 2991548 - RNA, 16 nt, Mycobacterium avium subsp. paratuberculosis
cgcguuggccggcugg

SEQ ID NO: 2991549 - RNA, 14 nt, Mycobacterium avium subsp. paratuberculosis
cgcguuggcgccga

SEQ ID NO: 2991550 - RNA, 16 nt, Mycobacterium avium subsp. paratuberculosis
cgcguuggcgccgacg

SEQ ID NO: 2991551 - RNA, 19 nt, Mycobacterium avium subsp. paratuberculosis
cgcguuggcgccgacguca

SEQ ID NO: 2991552 - RNA, 13 nt, Mycobacterium avium subsp. paratuberculosis
cgcguuggucauc

SEQ ID NO: 2991553 - RNA, 16 nt, Mycobacterium avium subsp. paratuberculosis
cgcguuggucaucacc

SEQ ID NO: 2991554 - RNA, 19 nt, Mycobacterium avium subsp. paratuberculosis
cgcguuguccagcagcgcc

SEQ ID NO: 2991555 - RNA, 14 nt, Mycobacterium avium subsp. paratuberculosis
cgcguugucgacca

SEQ ID NO: 2991556 - RNA, 19 nt, Mycobacterium avium subsp. paratuberculosis
cgcguugucgaccaccagg

SEQ ID NO: 2991557 - RNA, 13 nt, Mycobacterium avium subsp. paratuberculosis
cgcguugucggcg

SEQ ID NO: 2991558 - RNA, 14 nt, Mycobacterium avium subsp. paratuberculosis
cgcguugucggcga

SEQ ID NO: 2991559 - RNA, 16 nt, Mycobacterium avium subsp. paratuberculosis
cgcguuguugcucggc

SEQ ID NO: 2991560 - RNA, 18 nt, Mycobacterium avium subsp. paratuberculosis
cgcguuguugcucggcgg

SEQ ID NO: 2991561 - RNA, 21 nt, Mycobacterium avium subsp. paratuberculosis
cgcguuguugcucggcggccc

SEQ ID NO: 2991562 - RNA, 23 nt, Mycobacterium avium subsp. paratuberculosis
cgcguuucccgaguggcgccguc

SEQ ID NO: 2991563 - RNA, 16 nt, Mycobacterium avium subsp. paratuberculosis
cgcuaaagccaccagc

SEQ ID NO: 2991564 - RNA, 15 nt, Mycobacterium avium subsp. paratuberculosis
cgcuaaagccgaccg

SEQ ID NO: 2991565 - RNA, 16 nt, Mycobacterium avium subsp. paratuberculosis
cgcuaaagccgaccgc

SEQ ID NO: 2991566 - RNA, 14 nt, Mycobacterium avium subsp. paratuberculosis
cgcuaaucgccgcg

SEQ ID NO: 2991567 - RNA, 17 nt, Mycobacterium avium subsp. paratuberculosis
cgcuaccucaccacgug

SEQ ID NO: 2991568 - RNA, 16 nt, Mycobacterium avium subsp. paratuberculosis
cgcuacgccgaggcgc

SEQ ID NO: 2991569 - RNA, 16 nt, Mycobacterium avium subsp. paratuberculosis
cgcuacgccggcucgg

SEQ ID NO: 2991570 - RNA, 18 nt, Mycobacterium avium subsp. paratuberculosis
cgcuacgcgagcugcuuc

SEQ ID NO: 2991571 - RNA, 21 nt, Mycobacterium avium subsp. paratuberculosis
cgcuacggcagaggcguuuuc

SEQ ID NO: 2991572 - RNA, 14 nt, Mycobacterium avium subsp. paratuberculosis
cgcuacucgcgcau

SEQ ID NO: 2991573 - RNA, 20 nt, Mycobacterium avium subsp. paratuberculosis
cgcuagaccgauggcggcgg

SEQ ID NO: 2991574 - RNA, 21 nt, Mycobacterium avium subsp. paratuberculosis
cgcuagaccgauggcggcggc

SEQ ID NO: 2991575 - RNA, 19 nt, Mycobacterium avium subsp. paratuberculosis
cgcuagcgugacgcucgcg

SEQ ID NO: 2991576 - RNA, 15 nt, Mycobacterium avium subsp. paratuberculosis
cgcuagcugcgccgg

SEQ ID NO: 2991577 - RNA, 16 nt, Mycobacterium avium subsp. paratuberculosis
cgcuagcugcgccggc

SEQ ID NO: 2991578 - RNA, 17 nt, Mycobacterium avium subsp. paratuberculosis
cgcuagcugcgccggcu

SEQ ID NO: 2991579 - RNA, 17 nt, Mycobacterium avium subsp. paratuberculosis
cgcuaggacgcgggccu

SEQ ID NO: 2991580 - RNA, 19 nt, Mycobacterium avium subsp. paratuberculosis
cgcuagguuuggccagcac

SEQ ID NO: 2991581 - RNA, 20 nt, Mycobacterium avium subsp. paratuberculosis
cgcuagguuuggccagcacc

SEQ ID NO: 2991582 - RNA, 22 nt, Mycobacterium avium subsp. paratuberculosis
cgcuagguuuggccagcaccgc

SEQ ID NO: 2991583 - RNA, 20 nt, Mycobacterium avium subsp. paratuberculosis
cgcucccgguagagcggcac

SEQ ID NO: 2991584 - RNA, 13 nt, Mycobacterium avium subsp. paratuberculosis
cgcuccgacgcgg

SEQ ID NO: 2991585 - RNA, 16 nt, Mycobacterium avium subsp. paratuberculosis
cgcuccgacgcggugg

SEQ ID NO: 2991586 - RNA, 13 nt, Mycobacterium avium subsp. paratuberculosis
cgcuccgcggcgg

SEQ ID NO: 2991587 - RNA, 14 nt, Mycobacterium avium subsp. paratuberculosis
cgcuccgcggcggg

SEQ ID NO: 2991588 - RNA, 15 nt, Mycobacterium avium subsp. paratuberculosis
cgcuccgcgggcagc

SEQ ID NO: 2991589 - RNA, 23 nt, Mycobacterium avium subsp. paratuberculosis
cgcuccgcgggcagcgagcacag

SEQ ID NO: 2991590 - RNA, 15 nt, Mycobacterium avium subsp. paratuberculosis
cgcuccgcggugcug

SEQ ID NO: 2991591 - RNA, 18 nt, Mycobacterium avium subsp. paratuberculosis
cgcuccggcccgagcacc

SEQ ID NO: 2991592 - RNA, 22 nt, Mycobacterium avium subsp. paratuberculosis
cgcuccggcccgagcaccacca

SEQ ID NO: 2991593 - RNA, 12 nt, Mycobacterium avium subsp. paratuberculosis
cgcuccggcgga

SEQ ID NO: 2991594 - RNA, 14 nt, Mycobacterium avium subsp. paratuberculosis
cgcuccggucgcgu

SEQ ID NO: 2991595 - RNA, 23 nt, Mycobacterium avium subsp. paratuberculosis
cgcuccggucgcgucgugcggcc

SEQ ID NO: 2991596 - RNA, 22 nt, Mycobacterium avium subsp. paratuberculosis
cgcuccguugggucucaucccg

SEQ ID NO: 2991597 - RNA, 12 nt, Mycobacterium avium subsp. paratuberculosis
cgcuccuccucg

SEQ ID NO: 2991598 - RNA, 18 nt, Mycobacterium avium subsp. paratuberculosis
cgcuccuccucgcgccgc

SEQ ID NO: 2991599 - RNA, 22 nt, Mycobacterium avium subsp. paratuberculosis
cgcuccucgaucaucgcgucgg

SEQ ID NO: 2991600 - RNA, 15 nt, Mycobacterium avium subsp. paratuberculosis
cgcuccugaaucggu

SEQ ID NO: 2991601 - RNA, 13 nt, Mycobacterium avium subsp. paratuberculosis
cgcuccugcagcg

SEQ ID NO: 2991602 - RNA, 14 nt, Mycobacterium avium subsp. paratuberculosis
cgcuccugcagcgc

SEQ ID NO: 2991603 - RNA, 16 nt, Mycobacterium avium subsp. paratuberculosis
cgcuccugcagcgcgg

SEQ ID NO: 2991604 - RNA, 21 nt, Mycobacterium avium subsp. paratuberculosis
cgcuccugcagcgcggcgauc

SEQ ID NO: 2991605 - RNA, 13 nt, Mycobacterium avium subsp. paratuberculosis
cgcuccugcaggc

SEQ ID NO: 2991606 - RNA, 16 nt, Mycobacterium avium subsp. paratuberculosis
cgcuccuggccggacg

SEQ ID NO: 2991607 - RNA, 16 nt, Mycobacterium avium subsp. paratuberculosis
cgcucgaacacccggc

SEQ ID NO: 2991608 - RNA, 17 nt, Mycobacterium avium subsp. paratuberculosis
cgcucgaacacccggcu

SEQ ID NO: 2991609 - RNA, 20 nt, Mycobacterium avium subsp. paratuberculosis
cgcucgaacacccggcuucg

SEQ ID NO: 2991610 - RNA, 18 nt, Mycobacterium avium subsp. paratuberculosis
cgcucgaacucaccggug

SEQ ID NO: 2991611 - RNA, 23 nt, Mycobacterium avium subsp. paratuberculosis
cgcucgaacucaccgguggccgc

SEQ ID NO: 2991612 - RNA, 14 nt, Mycobacterium avium subsp. paratuberculosis
cgcucgaccccucg

SEQ ID NO: 2991613 - RNA, 18 nt, Mycobacterium avium subsp. paratuberculosis
cgcucgaccucggcggcc

SEQ ID NO: 2991614 - RNA, 15 nt, Mycobacterium avium subsp. paratuberculosis
cgcucgacgaguucc

SEQ ID NO: 2991615 - RNA, 22 nt, Mycobacterium avium subsp. paratuberculosis
cgcucgacgaguuccucgugcg

SEQ ID NO: 2991616 - RNA, 21 nt, Mycobacterium avium subsp. paratuberculosis
cgcucgacgaugucgacgccc

SEQ ID NO: 2991617 - RNA, 23 nt, Mycobacterium avium subsp. paratuberculosis
cgcucgacgcgcacccgggaccg

SEQ ID NO: 2991618 - RNA, 13 nt, Mycobacterium avium subsp. paratuberculosis
cgcucgacgcguc

SEQ ID NO: 2991619 - RNA, 15 nt, Mycobacterium avium subsp. paratuberculosis
cgcucgacgcgucga

SEQ ID NO: 2991620 - RNA, 17 nt, Mycobacterium avium subsp. paratuberculosis
cgcucgacgcgucgaca

SEQ ID NO: 2991621 - RNA, 11 nt, Mycobacterium avium subsp. paratuberculosis
cgcucgacggc

SEQ ID NO: 2991622 - RNA, 14 nt, Mycobacterium avium subsp. paratuberculosis
cgcucgacggccgg

SEQ ID NO: 2991623 - RNA, 17 nt, Mycobacterium avium subsp. paratuberculosis
cgcucgacggccggcgu

SEQ ID NO: 2991624 - RNA, 16 nt, Mycobacterium avium subsp. paratuberculosis
cgcucgacggccggug

SEQ ID NO: 2991625 - RNA, 17 nt, Mycobacterium avium subsp. paratuberculosis
cgcucgacggccgguga

SEQ ID NO: 2991626 - RNA, 16 nt, Mycobacterium avium subsp. paratuberculosis
cgcucgacggccugca

SEQ ID NO: 2991627 - RNA, 18 nt, Mycobacterium avium subsp. paratuberculosis
cgcucgaggggcuuggcg

SEQ ID NO: 2991628 - RNA, 23 nt, Mycobacterium avium subsp. paratuberculosis
cgcucgaucuggcggacccgcuc

SEQ ID NO: 2991629 - RNA, 21 nt, Mycobacterium avium subsp. paratuberculosis
cgcucgauggaauucgucggc

SEQ ID NO: 2991630 - RNA, 22 nt, Mycobacterium avium subsp. paratuberculosis
cgcucgauggaauucgucggcg

SEQ ID NO: 2991631 - RNA, 23 nt, Mycobacterium avium subsp. paratuberculosis
cgcucgauggaauucgucggcgg

SEQ ID NO: 2991632 - RNA, 19 nt, Mycobacterium avium subsp. paratuberculosis
cgcucgauggguguggcgu

SEQ ID NO: 2991633 - RNA, 20 nt, Mycobacterium avium subsp. paratuberculosis
cgcucgauggguguggcguc

SEQ ID NO: 2991634 - RNA, 21 nt, Mycobacterium avium subsp. paratuberculosis
cgcucgauggguguggcgucg

SEQ ID NO: 2991635 - RNA, 23 nt, Mycobacterium avium subsp. paratuberculosis
cgcucgauggguguggcgucgau

SEQ ID NO: 2991636 - RNA, 17 nt, Mycobacterium avium subsp. paratuberculosis
cgcucgcacaacccgcc

SEQ ID NO: 2991637 - RNA, 19 nt, Mycobacterium avium subsp. paratuberculosis
cgcucgcacaacccgcccg

SEQ ID NO: 2991638 - RNA, 14 nt, Mycobacterium avium subsp. paratuberculosis
cgcucgcaccagcg

SEQ ID NO: 2991639 - RNA, 15 nt, Mycobacterium avium subsp. paratuberculosis
cgcucgcaccagcgc

SEQ ID NO: 2991640 - RNA, 19 nt, Mycobacterium avium subsp. paratuberculosis
cgcucgccaccccgcgcca

SEQ ID NO: 2991641 - RNA, 13 nt, Mycobacterium avium subsp. paratuberculosis
cgcucgccagacc

SEQ ID NO: 2991642 - RNA, 15 nt, Mycobacterium avium subsp. paratuberculosis
cgcucgccagaccgg

SEQ ID NO: 2991643 - RNA, 19 nt, Mycobacterium avium subsp. paratuberculosis
cgcucgccaugcgaccacg

SEQ ID NO: 2991644 - RNA, 16 nt, Mycobacterium avium subsp. paratuberculosis
cgcucgcccagcgcgg

SEQ ID NO: 2991645 - RNA, 18 nt, Mycobacterium avium subsp. paratuberculosis
cgcucgcccagcgcggcg

SEQ ID NO: 2991646 - RNA, 19 nt, Mycobacterium avium subsp. paratuberculosis
cgcucgcccagcgcggcgg

SEQ ID NO: 2991647 - RNA, 20 nt, Mycobacterium avium subsp. paratuberculosis
cgcucgcccagcgcggcggc

SEQ ID NO: 2991648 - RNA, 17 nt, Mycobacterium avium subsp. paratuberculosis
cgcucgccgaucuggcg

SEQ ID NO: 2991649 - RNA, 15 nt, Mycobacterium avium subsp. paratuberculosis
cgcucgccgaugacg

SEQ ID NO: 2991650 - RNA, 17 nt, Mycobacterium avium subsp. paratuberculosis
cgcucgccgcgcggccc

SEQ ID NO: 2991651 - RNA, 22 nt, Mycobacterium avium subsp. paratuberculosis
cgcucgccgcgggugucgcccu

SEQ ID NO: 2991652 - RNA, 15 nt, Mycobacterium avium subsp. paratuberculosis
cgcucgccggcggcc

SEQ ID NO: 2991653 - RNA, 16 nt, Mycobacterium avium subsp. paratuberculosis
cgcucgccggcggccg

SEQ ID NO: 2991654 - RNA, 17 nt, Mycobacterium avium subsp. paratuberculosis
cgcucgccggcggccgc

SEQ ID NO: 2991655 - RNA, 22 nt, Mycobacterium avium subsp. paratuberculosis
cgcucgccggcggccgccacgc

SEQ ID NO: 2991656 - RNA, 23 nt, Mycobacterium avium subsp. paratuberculosis
cgcucgccggcggccgccacgcu

SEQ ID NO: 2991657 - RNA, 13 nt, Mycobacterium avium subsp. paratuberculosis
cgcucgccgucgg

SEQ ID NO: 2991658 - RNA, 14 nt, Mycobacterium avium subsp. paratuberculosis
cgcucgccgucggc

SEQ ID NO: 2991659 - RNA, 17 nt, Mycobacterium avium subsp. paratuberculosis
cgcucgccgucggccag

SEQ ID NO: 2991660 - RNA, 21 nt, Mycobacterium avium subsp. paratuberculosis
cgcucgccgucggccagcagc

SEQ ID NO: 2991661 - RNA, 15 nt, Mycobacterium avium subsp. paratuberculosis
cgcucgccgucggug

SEQ ID NO: 2991662 - RNA, 17 nt, Mycobacterium avium subsp. paratuberculosis
cgcucgccgucggugau

SEQ ID NO: 2991663 - RNA, 12 nt, Mycobacterium avium subsp. paratuberculosis
cgcucgcgcacc

SEQ ID NO: 2991664 - RNA, 14 nt, Mycobacterium avium subsp. paratuberculosis
cgcucgcgggccac

SEQ ID NO: 2991665 - RNA, 17 nt, Mycobacterium avium subsp. paratuberculosis
cgcucgcgggccacagc

SEQ ID NO: 2991666 - RNA, 15 nt, Mycobacterium avium subsp. paratuberculosis
cgcucgcgggcccgc

SEQ ID NO: 2991667 - RNA, 17 nt, Mycobacterium avium subsp. paratuberculosis
cgcucgcgggcccgcgc

SEQ ID NO: 2991668 - RNA, 18 nt, Mycobacterium avium subsp. paratuberculosis
cgcucgugaccggcggug

SEQ ID NO: 2991669 - RNA, 22 nt, Mycobacterium avium subsp. paratuberculosis
cgcucuaacuccgcucgggccc

SEQ ID NO: 2991670 - RNA, 16 nt, Mycobacterium avium subsp. paratuberculosis
cgcucucgccggucag

SEQ ID NO: 2991671 - RNA, 17 nt, Mycobacterium avium subsp. paratuberculosis
cgcucucgccggucagc

SEQ ID NO: 2991672 - RNA, 19 nt, Mycobacterium avium subsp. paratuberculosis
cgcucucgccggucagcac

SEQ ID NO: 2991673 - RNA, 14 nt, Mycobacterium avium subsp. paratuberculosis
cgcucugccgggcc

SEQ ID NO: 2991674 - RNA, 16 nt, Mycobacterium avium subsp. paratuberculosis
cgcucugccgggccgc

SEQ ID NO: 2991675 - RNA, 14 nt, Mycobacterium avium subsp. paratuberculosis
cgcucuugcgggag

SEQ ID NO: 2991676 - RNA, 22 nt, Mycobacterium avium subsp. paratuberculosis
cgcugaaagcucgcgucgacgu

SEQ ID NO: 2991677 - RNA, 15 nt, Mycobacterium avium subsp. paratuberculosis
cgcugaacagcagca

SEQ ID NO: 2991678 - RNA, 17 nt, Mycobacterium avium subsp. paratuberculosis
cgcugaacagcagcagc

SEQ ID NO: 2991679 - RNA, 22 nt, Mycobacterium avium subsp. paratuberculosis
cgcugaacagcagcagcagcgg

SEQ ID NO: 2991680 - RNA, 23 nt, Mycobacterium avium subsp. paratuberculosis
cgcugaacagcagcagcagcggc

SEQ ID NO: 2991681 - RNA, 18 nt, Mycobacterium avium subsp. paratuberculosis
cgcugaacagcccgagca

SEQ ID NO: 2991682 - RNA, 21 nt, Mycobacterium avium subsp. paratuberculosis
cgcugaaccgguagucgucga

SEQ ID NO: 2991683 - RNA, 14 nt, Mycobacterium avium subsp. paratuberculosis
cgcugaacgcgauc

SEQ ID NO: 2991684 - RNA, 13 nt, Mycobacterium avium subsp. paratuberculosis
cgcugaacgcggu

SEQ ID NO: 2991685 - RNA, 14 nt, Mycobacterium avium subsp. paratuberculosis
cgcugaacgcggug

SEQ ID NO: 2991686 - RNA, 15 nt, Mycobacterium avium subsp. paratuberculosis
cgcugaacgcggugg

SEQ ID NO: 2991687 - RNA, 14 nt, Mycobacterium avium subsp. paratuberculosis
cgcugaacgcgucg

SEQ ID NO: 2991688 - RNA, 15 nt, Mycobacterium avium subsp. paratuberculosis
cgcugaacgggcagc

SEQ ID NO: 2991689 - RNA, 17 nt, Mycobacterium avium subsp. paratuberculosis
cgcugaacgggcagcca

SEQ ID NO: 2991690 - RNA, 20 nt, Mycobacterium avium subsp. paratuberculosis
cgcugaacgggcagccacgc

SEQ ID NO: 2991691 - RNA, 20 nt, Mycobacterium avium subsp. paratuberculosis
cgcugaacggugccgucacg

SEQ ID NO: 2991692 - RNA, 17 nt, Mycobacterium avium subsp. paratuberculosis
cgcugaacugcucgacc

SEQ ID NO: 2991693 - RNA, 18 nt, Mycobacterium avium subsp. paratuberculosis
cgcugaacugcucgacca

SEQ ID NO: 2991694 - RNA, 21 nt, Mycobacterium avium subsp. paratuberculosis
cgcugaagaagaugggcgccg

SEQ ID NO: 2991695 - RNA, 23 nt, Mycobacterium avium subsp. paratuberculosis
cgcugaagaucgaaaugaccgcg

SEQ ID NO: 2991696 - RNA, 14 nt, Mycobacterium avium subsp. paratuberculosis
cgcugaagcccacc

SEQ ID NO: 2991697 - RNA, 19 nt, Mycobacterium avium subsp. paratuberculosis
cgcugaagcccaccgccgu

SEQ ID NO: 2991698 - RNA, 20 nt, Mycobacterium avium subsp. paratuberculosis
cgcugaagccgaacgcgcug

SEQ ID NO: 2991699 - RNA, 15 nt, Mycobacterium avium subsp. paratuberculosis
cgcugaagccgcugg

SEQ ID NO: 2991700 - RNA, 15 nt, Mycobacterium avium subsp. paratuberculosis
cgcugaagcgcgacc

SEQ ID NO: 2991701 - RNA, 17 nt, Mycobacterium avium subsp. paratuberculosis
cgcugaagugcagcgca

SEQ ID NO: 2991702 - RNA, 18 nt, Mycobacterium avium subsp. paratuberculosis
cgcugaagugcagcgcau

SEQ ID NO: 2991703 - RNA, 21 nt, Mycobacterium avium subsp. paratuberculosis
cgcugaauucuguugucggcu

SEQ ID NO: 2991704 - RNA, 23 nt, Mycobacterium avium subsp. paratuberculosis
cgcugaauucuguugucggcucg

SEQ ID NO: 2991705 - RNA, 14 nt, Mycobacterium avium subsp. paratuberculosis
cgcugaccaccgag

SEQ ID NO: 2991706 - RNA, 23 nt, Mycobacterium avium subsp. paratuberculosis
cgcugaccagcgugaccucgacg

SEQ ID NO: 2991707 - RNA, 14 nt, Mycobacterium avium subsp. paratuberculosis
cgcugaccaggccg

SEQ ID NO: 2991708 - RNA, 18 nt, Mycobacterium avium subsp. paratuberculosis
cgcugaccaggccgauga

SEQ ID NO: 2991709 - RNA, 22 nt, Mycobacterium avium subsp. paratuberculosis
cgcugacccccguuuccucgcg

SEQ ID NO: 2991710 - RNA, 14 nt, Mycobacterium avium subsp. paratuberculosis
cgcugaccccgcuc

SEQ ID NO: 2991711 - RNA, 17 nt, Mycobacterium avium subsp. paratuberculosis
cgcugaccccgcucggc

SEQ ID NO: 2991712 - RNA, 19 nt, Mycobacterium avium subsp. paratuberculosis
cgcugaccccgcucggcgu

SEQ ID NO: 2991713 - RNA, 14 nt, Mycobacterium avium subsp. paratuberculosis
cgcugacccgccgc

SEQ ID NO: 2991714 - RNA, 15 nt, Mycobacterium avium subsp. paratuberculosis
cgcugacccgccgca

SEQ ID NO: 2991715 - RNA, 20 nt, Mycobacterium avium subsp. paratuberculosis
cgcugacccgccgcaacagc

SEQ ID NO: 2991716 - RNA, 15 nt, Mycobacterium avium subsp. paratuberculosis
cgcugacccgggcgg

SEQ ID NO: 2991717 - RNA, 14 nt, Mycobacterium avium subsp. paratuberculosis
cgcugaccgcagga

SEQ ID NO: 2991718 - RNA, 15 nt, Mycobacterium avium subsp. paratuberculosis
cgcugaccgcaggaa

SEQ ID NO: 2991719 - RNA, 19 nt, Mycobacterium avium subsp. paratuberculosis
cgcugaccgccgcgcucgg

SEQ ID NO: 2991720 - RNA, 15 nt, Mycobacterium avium subsp. paratuberculosis
cgcugaccguggugu

SEQ ID NO: 2991721 - RNA, 18 nt, Mycobacterium avium subsp. paratuberculosis
cgcugaccguggugucgg

SEQ ID NO: 2991722 - RNA, 19 nt, Mycobacterium avium subsp. paratuberculosis
cgcugaccugugcgcccca

SEQ ID NO: 2991723 - RNA, 20 nt, Mycobacterium avium subsp. paratuberculosis
cgcugaccuucuuggucagc

SEQ ID NO: 2991724 - RNA, 21 nt, Mycobacterium avium subsp. paratuberculosis
cgcugacgaugauccuggccu

SEQ ID NO: 2991725 - RNA, 15 nt, Mycobacterium avium subsp. paratuberculosis
cgcugacgaugcggc

SEQ ID NO: 2991726 - RNA, 18 nt, Mycobacterium avium subsp. paratuberculosis
cgcugacgaugcggccgg

SEQ ID NO: 2991727 - RNA, 21 nt, Mycobacterium avium subsp. paratuberculosis
cgcugacgaugcggccggcgg

SEQ ID NO: 2991728 - RNA, 22 nt, Mycobacterium avium subsp. paratuberculosis
cgcugacgaugcggccggcggg

SEQ ID NO: 2991729 - RNA, 14 nt, Mycobacterium avium subsp. paratuberculosis
cgcugacgccguug

SEQ ID NO: 2991730 - RNA, 14 nt, Mycobacterium avium subsp. paratuberculosis
cgcugacgcggcgg

SEQ ID NO: 2991731 - RNA, 15 nt, Mycobacterium avium subsp. paratuberculosis
cgcugacgcggcggg

SEQ ID NO: 2991732 - RNA, 15 nt, Mycobacterium avium subsp. paratuberculosis
cgcugacggucgccg

SEQ ID NO: 2991733 - RNA, 17 nt, Mycobacterium avium subsp. paratuberculosis
cgcugacggucgccgac

SEQ ID NO: 2991734 - RNA, 23 nt, Mycobacterium avium subsp. paratuberculosis
cgcugacgucgaugccggccagc

SEQ ID NO: 2991735 - RNA, 22 nt, Mycobacterium avium subsp. paratuberculosis
cgcugacuccaucccgugcgga

SEQ ID NO: 2991736 - RNA, 16 nt, Mycobacterium avium subsp. paratuberculosis
cgcugacugcgaucgc

SEQ ID NO: 2991737 - RNA, 15 nt, Mycobacterium avium subsp. paratuberculosis
cgcugagcaaccgcc

SEQ ID NO: 2991738 - RNA, 16 nt, Mycobacterium avium subsp. paratuberculosis
cgcugagcaaccgccg

SEQ ID NO: 2991739 - RNA, 23 nt, Mycobacterium avium subsp. paratuberculosis
cgcugagcaauucggugacggcg

SEQ ID NO: 2991740 - RNA, 12 nt, Mycobacterium avium subsp. paratuberculosis
cgcugagcaccc

SEQ ID NO: 2991741 - RNA, 15 nt, Mycobacterium avium subsp. paratuberculosis
cgcugagcacccgcc

SEQ ID NO: 2991742 - RNA, 22 nt, Mycobacterium avium subsp. paratuberculosis
cgcugagcacccgcccggacgc

SEQ ID NO: 2991743 - RNA, 21 nt, Mycobacterium avium subsp. paratuberculosis
cgcugagcacggugggcgccg

SEQ ID NO: 2991744 - RNA, 20 nt, Mycobacterium avium subsp. paratuberculosis
cgcugagcagguccucgauc

SEQ ID NO: 2991745 - RNA, 17 nt, Mycobacterium avium subsp. paratuberculosis
cgcugagccgcucgucg

SEQ ID NO: 2991746 - RNA, 18 nt, Mycobacterium avium subsp. paratuberculosis
cgcugagccgcucgucga

SEQ ID NO: 2991747 - RNA, 21 nt, Mycobacterium avium subsp. paratuberculosis
cgcugagccgcucgucgaguc

SEQ ID NO: 2991748 - RNA, 19 nt, Mycobacterium avium subsp. paratuberculosis
cgcugagcgacauggucgg

SEQ ID NO: 2991749 - RNA, 15 nt, Mycobacterium avium subsp. paratuberculosis
cgcugagcgccaggc

SEQ ID NO: 2991750 - RNA, 17 nt, Mycobacterium avium subsp. paratuberculosis
cgcugagcgccaggcca

SEQ ID NO: 2991751 - RNA, 23 nt, Mycobacterium avium subsp. paratuberculosis
cgcugagcgccaggccauggcgc

SEQ ID NO: 2991752 - RNA, 15 nt, Mycobacterium avium subsp. paratuberculosis
cgcugcccgcgaucg

SEQ ID NO: 2991753 - RNA, 22 nt, Mycobacterium avium subsp. paratuberculosis
cgcugcccgcgaucgccagcgc

SEQ ID NO: 2991754 - RNA, 14 nt, Mycobacterium avium subsp. paratuberculosis
cgcugcccggcgcu

SEQ ID NO: 2991755 - RNA, 15 nt, Mycobacterium avium subsp. paratuberculosis
cgcugcccggcgugu

SEQ ID NO: 2991756 - RNA, 14 nt, Mycobacterium avium subsp. paratuberculosis
cgcugcccgucgac

SEQ ID NO: 2991757 - RNA, 15 nt, Mycobacterium avium subsp. paratuberculosis
cgcugcccgugccgc

SEQ ID NO: 2991758 - RNA, 18 nt, Mycobacterium avium subsp. paratuberculosis
cgcugcccgugccgcacc

SEQ ID NO: 2991759 - RNA, 15 nt, Mycobacterium avium subsp. paratuberculosis
cgcugcccucggucg

SEQ ID NO: 2991760 - RNA, 14 nt, Mycobacterium avium subsp. paratuberculosis
cgcugccgagcacc

SEQ ID NO: 2991761 - RNA, 15 nt, Mycobacterium avium subsp. paratuberculosis
cgcugccgagcaccu

SEQ ID NO: 2991762 - RNA, 12 nt, Mycobacterium avium subsp. paratuberculosis
cgcugccgcacc

SEQ ID NO: 2991763 - RNA, 12 nt, Mycobacterium avium subsp. paratuberculosis
cgcugccgcccc

SEQ ID NO: 2991764 - RNA, 19 nt, Mycobacterium avium subsp. paratuberculosis
cgcugccgcccccgcuggc

SEQ ID NO: 2991765 - RNA, 15 nt, Mycobacterium avium subsp. paratuberculosis
cgcugccgccgccgc

SEQ ID NO: 2991766 - RNA, 16 nt, Mycobacterium avium subsp. paratuberculosis
cgcugccgccgccgcu

SEQ ID NO: 2991767 - RNA, 17 nt, Mycobacterium avium subsp. paratuberculosis
cgcugccgccgccgcug

SEQ ID NO: 2991768 - RNA, 17 nt, Mycobacterium avium subsp. paratuberculosis
cgcugccgccgccggcg

SEQ ID NO: 2991769 - RNA, 18 nt, Mycobacterium avium subsp. paratuberculosis
cgcugccgccgccggcgg

SEQ ID NO: 2991770 - RNA, 19 nt, Mycobacterium avium subsp. paratuberculosis
cgcugccgccgccggcggu

SEQ ID NO: 2991771 - RNA, 20 nt, Mycobacterium avium subsp. paratuberculosis
cgcugccgccgccggcggug

SEQ ID NO: 2991772 - RNA, 18 nt, Mycobacterium avium subsp. paratuberculosis
cgcugccgccggccucgg

SEQ ID NO: 2991773 - RNA, 16 nt, Mycobacterium avium subsp. paratuberculosis
cgcugccgcgccgcca

SEQ ID NO: 2991774 - RNA, 15 nt, Mycobacterium avium subsp. paratuberculosis
cgcugccgcgcgccg

SEQ ID NO: 2991775 - RNA, 17 nt, Mycobacterium avium subsp. paratuberculosis
cgcugccgcgcgccgac

SEQ ID NO: 2991776 - RNA, 18 nt, Mycobacterium avium subsp. paratuberculosis
cgcugccgcgcgccgaca

SEQ ID NO: 2991777 - RNA, 13 nt, Mycobacterium avium subsp. paratuberculosis
cgcugccgcuggc

SEQ ID NO: 2991778 - RNA, 16 nt, Mycobacterium avium subsp. paratuberculosis
cgcugccgcuggcguc

SEQ ID NO: 2991779 - RNA, 20 nt, Mycobacterium avium subsp. paratuberculosis
cgcugccgcuggcgucgauc

SEQ ID NO: 2991780 - RNA, 13 nt, Mycobacterium avium subsp. paratuberculosis
cgcugccggcccg

SEQ ID NO: 2991781 - RNA, 12 nt, Mycobacterium avium subsp. paratuberculosis
cgcugccggcgc

SEQ ID NO: 2991782 - RNA, 16 nt, Mycobacterium avium subsp. paratuberculosis
cgcugccggcgcaccc

SEQ ID NO: 2991783 - RNA, 19 nt, Mycobacterium avium subsp. paratuberculosis
cgcugccggcgcacccgca

SEQ ID NO: 2991784 - RNA, 20 nt, Mycobacterium avium subsp. paratuberculosis
cgcugccggcgcacccgcac

SEQ ID NO: 2991785 - RNA, 14 nt, Mycobacterium avium subsp. paratuberculosis
cgcugccggggugc

SEQ ID NO: 2991786 - RNA, 20 nt, Mycobacterium avium subsp. paratuberculosis
cgcugccggggugcagcacc

SEQ ID NO: 2991787 - RNA, 18 nt, Mycobacterium avium subsp. paratuberculosis
cgcugccggugcugcucg

SEQ ID NO: 2991788 - RNA, 12 nt, Mycobacterium avium subsp. paratuberculosis
cgcugccgucca

SEQ ID NO: 2991789 - RNA, 15 nt, Mycobacterium avium subsp. paratuberculosis
cgcugccguccaccc

SEQ ID NO: 2991790 - RNA, 16 nt, Mycobacterium avium subsp. paratuberculosis
cgcugccguccacccg

SEQ ID NO: 2991791 - RNA, 18 nt, Mycobacterium avium subsp. paratuberculosis
cgcugccguccacccggc

SEQ ID NO: 2991792 - RNA, 19 nt, Mycobacterium avium subsp. paratuberculosis
cgcugccguccacccggcc

SEQ ID NO: 2991793 - RNA, 12 nt, Mycobacterium avium subsp. paratuberculosis
cgcugccguccg

SEQ ID NO: 2991794 - RNA, 15 nt, Mycobacterium avium subsp. paratuberculosis
cgcugccguccggcg

SEQ ID NO: 2991795 - RNA, 16 nt, Mycobacterium avium subsp. paratuberculosis
cgcugccguccggcgg

SEQ ID NO: 2991796 - RNA, 18 nt, Mycobacterium avium subsp. paratuberculosis
cgcugccguccggcggca

SEQ ID NO: 2991797 - RNA, 12 nt, Mycobacterium avium subsp. paratuberculosis
cgcugccguccu

SEQ ID NO: 2991798 - RNA, 23 nt, Mycobacterium avium subsp. paratuberculosis
cgcugccguucgccgguaccgcc

SEQ ID NO: 2991799 - RNA, 13 nt, Mycobacterium avium subsp. paratuberculosis
cgcugcgacaggu

SEQ ID NO: 2991800 - RNA, 18 nt, Mycobacterium avium subsp. paratuberculosis
cgcugcgacaggucggcg

SEQ ID NO: 2991801 - RNA, 15 nt, Mycobacterium avium subsp. paratuberculosis
cgcugcgagcccggc

SEQ ID NO: 2991802 - RNA, 18 nt, Mycobacterium avium subsp. paratuberculosis
cgcugcgagcccggccag

SEQ ID NO: 2991803 - RNA, 15 nt, Mycobacterium avium subsp. paratuberculosis
cgcugcgaggcgggc

SEQ ID NO: 2991804 - RNA, 19 nt, Mycobacterium avium subsp. paratuberculosis
cgcugcgauugguggcccg

SEQ ID NO: 2991805 - RNA, 12 nt, Mycobacterium avium subsp. paratuberculosis
cgcugcgcaccc

SEQ ID NO: 2991806 - RNA, 14 nt, Mycobacterium avium subsp. paratuberculosis
cgcugcgcacccgg

SEQ ID NO: 2991807 - RNA, 21 nt, Mycobacterium avium subsp. paratuberculosis
cgcugcgccagccgucgccgc

SEQ ID NO: 2991808 - RNA, 13 nt, Mycobacterium avium subsp. paratuberculosis
cgcugcgcccagc

SEQ ID NO: 2991809 - RNA, 12 nt, Mycobacterium avium subsp. paratuberculosis
cgcugcgcccgc

SEQ ID NO: 2991810 - RNA, 16 nt, Mycobacterium avium subsp. paratuberculosis
cgcugcgcccgccgcc

SEQ ID NO: 2991811 - RNA, 21 nt, Mycobacterium avium subsp. paratuberculosis
cgcugcgcccgccgccaccac

SEQ ID NO: 2991812 - RNA, 23 nt, Mycobacterium avium subsp. paratuberculosis
cgcugcgcccgccgccaccacgg

SEQ ID NO: 2991813 - RNA, 13 nt, Mycobacterium avium subsp. paratuberculosis
cgcugcgcccggu

SEQ ID NO: 2991814 - RNA, 16 nt, Mycobacterium avium subsp. paratuberculosis
cgcugcgcccggucag

SEQ ID NO: 2991815 - RNA, 23 nt, Mycobacterium avium subsp. paratuberculosis
cgcugcgccgaacgugcacucag

SEQ ID NO: 2991816 - RNA, 23 nt, Mycobacterium avium subsp. paratuberculosis
cgcugcgccgacuugaucgcggc

SEQ ID NO: 2991817 - RNA, 12 nt, Mycobacterium avium subsp. paratuberculosis
cgcugcgccggc

SEQ ID NO: 2991818 - RNA, 13 nt, Mycobacterium avium subsp. paratuberculosis
cgcugcgccggcg

SEQ ID NO: 2991819 - RNA, 14 nt, Mycobacterium avium subsp. paratuberculosis
cgcugcgccggcgc

SEQ ID NO: 2991820 - RNA, 15 nt, Mycobacterium avium subsp. paratuberculosis
cgcugcgccggcgcg

SEQ ID NO: 2991821 - RNA, 17 nt, Mycobacterium avium subsp. paratuberculosis
cgcugcgccggcgcggc

SEQ ID NO: 2991822 - RNA, 15 nt, Mycobacterium avium subsp. paratuberculosis
cgcugcgccggcggu

SEQ ID NO: 2991823 - RNA, 13 nt, Mycobacterium avium subsp. paratuberculosis
cgcugcgccguug

SEQ ID NO: 2991824 - RNA, 15 nt, Mycobacterium avium subsp. paratuberculosis
cgcugcgcgacaccu

SEQ ID NO: 2991825 - RNA, 18 nt, Mycobacterium avium subsp. paratuberculosis
cgcugcgcgacaccugcu

SEQ ID NO: 2991826 - RNA, 15 nt, Mycobacterium avium subsp. paratuberculosis
cgcugcgcgccgauc

SEQ ID NO: 2991827 - RNA, 15 nt, Mycobacterium avium subsp. paratuberculosis
cgcugcgcgccgccc

SEQ ID NO: 2991828 - RNA, 12 nt, Mycobacterium avium subsp. paratuberculosis
cgcugcgcgcgu

SEQ ID NO: 2991829 - RNA, 13 nt, Mycobacterium avium subsp. paratuberculosis
cgcugcgcggccg

SEQ ID NO: 2991830 - RNA, 14 nt, Mycobacterium avium subsp. paratuberculosis
cgcugcgcgggucg

SEQ ID NO: 2991831 - RNA, 15 nt, Mycobacterium avium subsp. paratuberculosis
cgcugcgcgggucgg

SEQ ID NO: 2991832 - RNA, 12 nt, Mycobacterium avium subsp. paratuberculosis
cgcugcgcggug

SEQ ID NO: 2991833 - RNA, 14 nt, Mycobacterium avium subsp. paratuberculosis
cgcugcgcucgccg

SEQ ID NO: 2991834 - RNA, 15 nt, Mycobacterium avium subsp. paratuberculosis
cgcugcggaugucgg

SEQ ID NO: 2991835 - RNA, 20 nt, Mycobacterium avium subsp. paratuberculosis
cgcugcggcaaugccguugg

SEQ ID NO: 2991836 - RNA, 17 nt, Mycobacterium avium subsp. paratuberculosis
cgcugcggcacaccagc

SEQ ID NO: 2991837 - RNA, 20 nt, Mycobacterium avium subsp. paratuberculosis
cgcugcggcacaccagcguu

SEQ ID NO: 2991838 - RNA, 20 nt, Mycobacterium avium subsp. paratuberculosis
cgcuggcguagaucugcacg

SEQ ID NO: 2991839 - RNA, 14 nt, Mycobacterium avium subsp. paratuberculosis
cgcuggcgucgauc

SEQ ID NO: 2991840 - RNA, 19 nt, Mycobacterium avium subsp. paratuberculosis
cgcuggcgugacagucgag

SEQ ID NO: 2991841 - RNA, 14 nt, Mycobacterium avium subsp. paratuberculosis
cgcuggcgugacgc

SEQ ID NO: 2991842 - RNA, 21 nt, Mycobacterium avium subsp. paratuberculosis
cgcuggcgugacgcucgccgg

SEQ ID NO: 2991843 - RNA, 23 nt, Mycobacterium avium subsp. paratuberculosis
cgcuggcgugacgcucgccggcg

SEQ ID NO: 2991844 - RNA, 18 nt, Mycobacterium avium subsp. paratuberculosis
cgcuggcgugacgcucgg

SEQ ID NO: 2991845 - RNA, 21 nt, Mycobacterium avium subsp. paratuberculosis
cgcuggcgugacgcucggccg

SEQ ID NO: 2991846 - RNA, 23 nt, Mycobacterium avium subsp. paratuberculosis
cgcuggcgugacgcucggccgug

SEQ ID NO: 2991847 - RNA, 20 nt, Mycobacterium avium subsp. paratuberculosis
cgcuggcgugacgcucggcg

SEQ ID NO: 2991848 - RNA, 24 nt, Mycobacterium avium subsp. paratuberculosis
cgcuggcgugacgcucggcgccgg

SEQ ID NO: 2991849 - RNA, 21 nt, Mycobacterium avium subsp. paratuberculosis
cgcuggcgugacgcucggggc

SEQ ID NO: 2991850 - RNA, 18 nt, Mycobacterium avium subsp. paratuberculosis
cgcuggcgugacggucga

SEQ ID NO: 2991851 - RNA, 20 nt, Mycobacterium avium subsp. paratuberculosis
cgcuggcgugacguucguca

SEQ ID NO: 2991852 - RNA, 15 nt, Mycobacterium avium subsp. paratuberculosis
cgcuggcguggcacc

SEQ ID NO: 2991853 - RNA, 20 nt, Mycobacterium avium subsp. paratuberculosis
cgcuggcguggcacccgggc

SEQ ID NO: 2991854 - RNA, 16 nt, Mycobacterium avium subsp. paratuberculosis
cgcuggcguggcgccg

SEQ ID NO: 2991855 - RNA, 19 nt, Mycobacterium avium subsp. paratuberculosis
cgcuggcguggcgccggcg

SEQ ID NO: 2991856 - RNA, 14 nt, Mycobacterium avium subsp. paratuberculosis
cgcuggcguggcuc

SEQ ID NO: 2991857 - RNA, 16 nt, Mycobacterium avium subsp. paratuberculosis
cgcuggcguggcucgg

SEQ ID NO: 2991858 - RNA, 18 nt, Mycobacterium avium subsp. paratuberculosis
cgcuggcguggcucggcc

SEQ ID NO: 2991859 - RNA, 19 nt, Mycobacterium avium subsp. paratuberculosis
cgcuggcguugagcacgcg

SEQ ID NO: 2991860 - RNA, 23 nt, Mycobacterium avium subsp. paratuberculosis
cgcuggcguugagcacgcggacc

SEQ ID NO: 2991861 - RNA, 17 nt, Mycobacterium avium subsp. paratuberculosis
cgcugggacugaaguag

SEQ ID NO: 2991862 - RNA, 17 nt, Mycobacterium avium subsp. paratuberculosis
cgcugggagcgggccac

SEQ ID NO: 2991863 - RNA, 14 nt, Mycobacterium avium subsp. paratuberculosis
cgcugggcagccgu

SEQ ID NO: 2991864 - RNA, 13 nt, Mycobacterium avium subsp. paratuberculosis
cgcugggcggcga

SEQ ID NO: 2991865 - RNA, 21 nt, Mycobacterium avium subsp. paratuberculosis
cgcugggcggcgacaucgccg

SEQ ID NO: 2991866 - RNA, 23 nt, Mycobacterium avium subsp. paratuberculosis
cgcugggcggcgacaucgccgag

SEQ ID NO: 2991867 - RNA, 15 nt, Mycobacterium avium subsp. paratuberculosis
cgcugggcguggugc

SEQ ID NO: 2991868 - RNA, 20 nt, Mycobacterium avium subsp. paratuberculosis
cgcugggcguggugcggugc

SEQ ID NO: 2991869 - RNA, 22 nt, Mycobacterium avium subsp. paratuberculosis
cgcugggcucgagugccggcag

SEQ ID NO: 2991870 - RNA, 23 nt, Mycobacterium avium subsp. paratuberculosis
cgcugggcucgagugccggcagc

SEQ ID NO: 2991871 - RNA, 15 nt, Mycobacterium avium subsp. paratuberculosis
cgcugggcuggccgu

SEQ ID NO: 2991872 - RNA, 18 nt, Mycobacterium avium subsp. paratuberculosis
cgcugggcuggccguccg

SEQ ID NO: 2991873 - RNA, 15 nt, Mycobacterium avium subsp. paratuberculosis
cgcuggggcccagcu

SEQ ID NO: 2991874 - RNA, 17 nt, Mycobacterium avium subsp. paratuberculosis
cgcuggggcccagcucc

SEQ ID NO: 2991875 - RNA, 14 nt, Mycobacterium avium subsp. paratuberculosis
cgcuggggcgcacc

SEQ ID NO: 2991876 - RNA, 15 nt, Mycobacterium avium subsp. paratuberculosis
cgcuggggcgcaccg

SEQ ID NO: 2991877 - RNA, 16 nt, Mycobacterium avium subsp. paratuberculosis
cgcuggggcgcaccgc

SEQ ID NO: 2991878 - RNA, 18 nt, Mycobacterium avium subsp. paratuberculosis
cgcuggggcgcaccgccu

SEQ ID NO: 2991879 - RNA, 19 nt, Mycobacterium avium subsp. paratuberculosis
cgcuggggcgcaccgccug

SEQ ID NO: 2991880 - RNA, 17 nt, Mycobacterium avium subsp. paratuberculosis
cgcuggggugcucgauc

SEQ ID NO: 2991881 - RNA, 20 nt, Mycobacterium avium subsp. paratuberculosis
cgcugggugaacaccccgcg

SEQ ID NO: 2991882 - RNA, 14 nt, Mycobacterium avium subsp. paratuberculosis
cgcugggugcgggc

SEQ ID NO: 2991883 - RNA, 21 nt, Mycobacterium avium subsp. paratuberculosis
cgcuggguguuccccgggcga

SEQ ID NO: 2991884 - RNA, 16 nt, Mycobacterium avium subsp. paratuberculosis
cgcugguaggcggcgc

SEQ ID NO: 2991885 - RNA, 20 nt, Mycobacterium avium subsp. paratuberculosis
cgcugguaguggcgugcggc

SEQ ID NO: 2991886 - RNA, 14 nt, Mycobacterium avium subsp. paratuberculosis
cgcuggucaggccg

SEQ ID NO: 2991887 - RNA, 21 nt, Mycobacterium avium subsp. paratuberculosis
cgcuggucgaaccgcgagcgc

SEQ ID NO: 2991888 - RNA, 13 nt, Mycobacterium avium subsp. paratuberculosis
cgcuggucgaacg

SEQ ID NO: 2991889 - RNA, 12 nt, Mycobacterium avium subsp. paratuberculosis
cgcuggucggcg

SEQ ID NO: 2991890 - RNA, 18 nt, Mycobacterium avium subsp. paratuberculosis
cgcuggucggcgaaccgu

SEQ ID NO: 2991891 - RNA, 14 nt, Mycobacterium avium subsp. paratuberculosis
cgcuggucggcggg

SEQ ID NO: 2991892 - RNA, 15 nt, Mycobacterium avium subsp. paratuberculosis
cgcuggucggcgggc

SEQ ID NO: 2991893 - RNA, 17 nt, Mycobacterium avium subsp. paratuberculosis
cgcuggucggcgggcag

SEQ ID NO: 2991894 - RNA, 20 nt, Mycobacterium avium subsp. paratuberculosis
cgcuggucggcgggcagcga

SEQ ID NO: 2991895 - RNA, 13 nt, Mycobacterium avium subsp. paratuberculosis
cgcuggugcagca

SEQ ID NO: 2991896 - RNA, 21 nt, Mycobacterium avium subsp. paratuberculosis
cgcuggugcagcagggcgcgc

SEQ ID NO: 2991897 - RNA, 18 nt, Mycobacterium avium subsp. paratuberculosis
cgcuggugcgcgccggcg

SEQ ID NO: 2991898 - RNA, 22 nt, Mycobacterium avium subsp. paratuberculosis
cgcuggugcgcgccggcgucgg

SEQ ID NO: 2991899 - RNA, 12 nt, Mycobacterium avium subsp. paratuberculosis
cgcuggugcggg

SEQ ID NO: 2991900 - RNA, 19 nt, Mycobacterium avium subsp. paratuberculosis
cgcuggugcgggccagcac

SEQ ID NO: 2991901 - RNA, 20 nt, Mycobacterium avium subsp. paratuberculosis
cgcuggugcgggccagcacg

SEQ ID NO: 2991902 - RNA, 13 nt, Mycobacterium avium subsp. paratuberculosis
cgcuggugcugcc

SEQ ID NO: 2991903 - RNA, 15 nt, Mycobacterium avium subsp. paratuberculosis
cgcuggugcugcugc

SEQ ID NO: 2991904 - RNA, 11 nt, Mycobacterium avium subsp. paratuberculosis
cgcugguggcc

SEQ ID NO: 2991905 - RNA, 15 nt, Mycobacterium avium subsp. paratuberculosis
cgcugguggccgacg

SEQ ID NO: 2991906 - RNA, 15 nt, Mycobacterium avium subsp. paratuberculosis
cgcugguggugagaa

SEQ ID NO: 2991907 - RNA, 18 nt, Mycobacterium avium subsp. paratuberculosis
cgcugguggugaucaccc

SEQ ID NO: 2991908 - RNA, 20 nt, Mycobacterium avium subsp. paratuberculosis
cgcugguggugaucacccag

SEQ ID NO: 2991909 - RNA, 19 nt, Mycobacterium avium subsp. paratuberculosis
cgcuggugugacgcucgcg

SEQ ID NO: 2991910 - RNA, 16 nt, Mycobacterium avium subsp. paratuberculosis
cgcugguugucgacgc

SEQ ID NO: 2991911 - RNA, 19 nt, Mycobacterium avium subsp. paratuberculosis
cgcugguugucgacgcugc

SEQ ID NO: 2991912 - RNA, 20 nt, Mycobacterium avium subsp. paratuberculosis
cgcugguugucgacgcugca

SEQ ID NO: 2991913 - RNA, 23 nt, Mycobacterium avium subsp. paratuberculosis
cgcugguugucgacgcugcaggu

SEQ ID NO: 2991914 - RNA, 15 nt, Mycobacterium avium subsp. paratuberculosis
cgcuguaggccagcc

SEQ ID NO: 2991915 - RNA, 17 nt, Mycobacterium avium subsp. paratuberculosis
cgcuguaggccagcccg

SEQ ID NO: 2991916 - RNA, 18 nt, Mycobacterium avium subsp. paratuberculosis
cgcuguaggccagcccgg

SEQ ID NO: 2991917 - RNA, 20 nt, Mycobacterium avium subsp. paratuberculosis
cgcuguaggccagcccggcg

SEQ ID NO: 2991918 - RNA, 23 nt, Mycobacterium avium subsp. paratuberculosis
cgcuguaggccagcccggcgugc

SEQ ID NO: 2991919 - RNA, 24 nt, Mycobacterium avium subsp. paratuberculosis
cgcuguaggccagcccggcgugca

SEQ ID NO: 2991920 - RNA, 16 nt, Mycobacterium avium subsp. paratuberculosis
cgcuguaggccagccg

SEQ ID NO: 2991921 - RNA, 16 nt, Mycobacterium avium subsp. paratuberculosis
cgcuguaggcggcgug

SEQ ID NO: 2991922 - RNA, 16 nt, Mycobacterium avium subsp. paratuberculosis
cgcuuuccaccucgag

SEQ ID NO: 2991923 - RNA, 17 nt, Mycobacterium avium subsp. paratuberculosis
cgggaucggaccgcacc

SEQ ID NO: 2991924 - RNA, 22 nt, Mycobacterium avium subsp. paratuberculosis
cgggaucggaccgcaccaccac

SEQ ID NO: 2991925 - RNA, 17 nt, Mycobacterium avium subsp. paratuberculosis
cgggaucggcagcgcgc

SEQ ID NO: 2991926 - RNA, 19 nt, Mycobacterium avium subsp. paratuberculosis
cgggaucggcagcgcgccc

SEQ ID NO: 2991927 - RNA, 13 nt, Mycobacterium avium subsp. paratuberculosis
cgggaucggccgg

SEQ ID NO: 2991928 - RNA, 16 nt, Mycobacterium avium subsp. paratuberculosis
cgggaucggccggcga

SEQ ID NO: 2991929 - RNA, 14 nt, Mycobacterium avium subsp. paratuberculosis
cgggaucggcgccc

SEQ ID NO: 2991930 - RNA, 15 nt, Mycobacterium avium subsp. paratuberculosis
cgggaucggcgccca

SEQ ID NO: 2991931 - RNA, 19 nt, Mycobacterium avium subsp. paratuberculosis
cgggaucggcgcccaccgc

SEQ ID NO: 2991932 - RNA, 21 nt, Mycobacterium avium subsp. paratuberculosis
cgggaucggcgcccaccgcgg

SEQ ID NO: 2991933 - RNA, 22 nt, Mycobacterium avium subsp. paratuberculosis
cgggaucggcgcccaccgcggc

SEQ ID NO: 2991934 - RNA, 23 nt, Mycobacterium avium subsp. paratuberculosis
cgggaucggcgcccaccgcggcg

SEQ ID NO: 2991935 - RNA, 16 nt, Mycobacterium avium subsp. paratuberculosis
cgggaucggcgcgucg

SEQ ID NO: 2991936 - RNA, 17 nt, Mycobacterium avium subsp. paratuberculosis
cgggaucggcgcgucgg

SEQ ID NO: 2991937 - RNA, 19 nt, Mycobacterium avium subsp. paratuberculosis
cgggaucggcgcgucggcg

SEQ ID NO: 2991938 - RNA, 14 nt, Mycobacterium avium subsp. paratuberculosis
cgggaucggcggcg

SEQ ID NO: 2991939 - RNA, 18 nt, Mycobacterium avium subsp. paratuberculosis
cgggaucggcggcggggu

SEQ ID NO: 2991940 - RNA, 15 nt, Mycobacterium avium subsp. paratuberculosis
cgggaucggcggggc

SEQ ID NO: 2991941 - RNA, 18 nt, Mycobacterium avium subsp. paratuberculosis
cgggaucggcggggcgcg

SEQ ID NO: 2991942 - RNA, 14 nt, Mycobacterium avium subsp. paratuberculosis
cgggaucggggugc

SEQ ID NO: 2991943 - RNA, 14 nt, Mycobacterium avium subsp. paratuberculosis
cgggaucggugccg

SEQ ID NO: 2991944 - RNA, 15 nt, Mycobacterium avium subsp. paratuberculosis
cgggaucggugccga

SEQ ID NO: 2991945 - RNA, 21 nt, Mycobacterium avium subsp. paratuberculosis
cgggaucggugccgacggugc

SEQ ID NO: 2991946 - RNA, 13 nt, Mycobacterium avium subsp. paratuberculosis
cgggaucgucgcc

SEQ ID NO: 2991947 - RNA, 14 nt, Mycobacterium avium subsp. paratuberculosis
cgggaucgucgccg

SEQ ID NO: 2991948 - RNA, 15 nt, Mycobacterium avium subsp. paratuberculosis
cgggaucgucgccgg

SEQ ID NO: 2991949 - RNA, 17 nt, Mycobacterium avium subsp. paratuberculosis
cgggaucgucgccgggc

SEQ ID NO: 2991950 - RNA, 17 nt, Mycobacterium avium subsp. paratuberculosis
cgggaucguguggccgc

SEQ ID NO: 2991951 - RNA, 15 nt, Mycobacterium avium subsp. paratuberculosis
cgggaucugcgccgc

SEQ ID NO: 2991952 - RNA, 17 nt, Mycobacterium avium subsp. paratuberculosis
cgggaucugcgccgccu

SEQ ID NO: 2991953 - RNA, 18 nt, Mycobacterium avium subsp. paratuberculosis
cgggaucugcgccgccuc

SEQ ID NO: 2991954 - RNA, 14 nt, Mycobacterium avium subsp. paratuberculosis
cgggaucuggccgg

SEQ ID NO: 2991955 - RNA, 19 nt, Mycobacterium avium subsp. paratuberculosis
cgggaugaacucgugcggc

SEQ ID NO: 2991956 - RNA, 22 nt, Mycobacterium avium subsp. paratuberculosis
cgggaugaacucgugcggcgcc

SEQ ID NO: 2991957 - RNA, 19 nt, Mycobacterium avium subsp. paratuberculosis
cgggaugacaccgcggacc

SEQ ID NO: 2991958 - RNA, 15 nt, Mycobacterium avium subsp. paratuberculosis
cgggaugaucggcgc

SEQ ID NO: 2991959 - RNA, 22 nt, Mycobacterium avium subsp. paratuberculosis
cgggaugccgagcagcucggcg

SEQ ID NO: 2991960 - RNA, 12 nt, Mycobacterium avium subsp. paratuberculosis
cgggaugccgcc

SEQ ID NO: 2991961 - RNA, 16 nt, Mycobacterium avium subsp. paratuberculosis
cgggaugccgccgguc

SEQ ID NO: 2991962 - RNA, 22 nt, Mycobacterium avium subsp. paratuberculosis
cgggaugccgccggucacggcg

SEQ ID NO: 2991963 - RNA, 20 nt, Mycobacterium avium subsp. paratuberculosis
cgggaugccugcccgcgcag

SEQ ID NO: 2991964 - RNA, 14 nt, Mycobacterium avium subsp. paratuberculosis
cgggaugcggucga

SEQ ID NO: 2991965 - RNA, 20 nt, Mycobacterium avium subsp. paratuberculosis
cgggaugcuuggucgcggcg

SEQ ID NO: 2991966 - RNA, 22 nt, Mycobacterium avium subsp. paratuberculosis
cgggaugcuuggucgcggcguu

SEQ ID NO: 2991967 - RNA, 15 nt, Mycobacterium avium subsp. paratuberculosis
cgggauggacgacgu

SEQ ID NO: 2991968 - RNA, 16 nt, Mycobacterium avium subsp. paratuberculosis
cgggauggagccgccc

SEQ ID NO: 2991969 - RNA, 17 nt, Mycobacterium avium subsp. paratuberculosis
cgggauggagccgccca

SEQ ID NO: 2991970 - RNA, 21 nt, Mycobacterium avium subsp. paratuberculosis
cgggauggagccgcccaugcc

SEQ ID NO: 2991971 - RNA, 14 nt, Mycobacterium avium subsp. paratuberculosis
cgggauggcggcgu

SEQ ID NO: 2991972 - RNA, 19 nt, Mycobacterium avium subsp. paratuberculosis
cgggauggcucagcgcacc

SEQ ID NO: 2991973 - RNA, 15 nt, Mycobacterium avium subsp. paratuberculosis
cgggauggucgaucc

SEQ ID NO: 2991974 - RNA, 14 nt, Mycobacterium avium subsp. paratuberculosis
cgggauggugacca

SEQ ID NO: 2991975 - RNA, 20 nt, Mycobacterium avium subsp. paratuberculosis
cgggauggugaccagcgccc

SEQ ID NO: 2991976 - RNA, 14 nt, Mycobacterium avium subsp. paratuberculosis
cgggauggugagcc

SEQ ID NO: 2991977 - RNA, 21 nt, Mycobacterium avium subsp. paratuberculosis
cgggauguacuugaugacgca

SEQ ID NO: 2991978 - RNA, 21 nt, Mycobacterium avium subsp. paratuberculosis
cgggaugucgugggcgugccg

SEQ ID NO: 2991979 - RNA, 22 nt, Mycobacterium avium subsp. paratuberculosis
cgggaugucgugggcgugccgg

SEQ ID NO: 2991980 - RNA, 21 nt, Mycobacterium avium subsp. paratuberculosis
cgggauguggcaucaccgccu

SEQ ID NO: 2991981 - RNA, 16 nt, Mycobacterium avium subsp. paratuberculosis
cgggauugccgagcac

SEQ ID NO: 2991982 - RNA, 16 nt, Mycobacterium avium subsp. paratuberculosis
cgggauuggacagcgg

SEQ ID NO: 2991983 - RNA, 14 nt, Mycobacterium avium subsp. paratuberculosis
cgggauuggcgcca

SEQ ID NO: 2991984 - RNA, 21 nt, Mycobacterium avium subsp. paratuberculosis
cgggauuggcgccacugccgc

SEQ ID NO: 2991985 - RNA, 22 nt, Mycobacterium avium subsp. paratuberculosis
cgggauuggcgccacugccgcc

SEQ ID NO: 2991986 - RNA, 17 nt, Mycobacterium avium subsp. paratuberculosis
cgggauuggcggccaac

SEQ ID NO: 2991987 - RNA, 20 nt, Mycobacterium avium subsp. paratuberculosis
cgggauuuggcuagcgggcg

SEQ ID NO: 2991988 - RNA, 17 nt, Mycobacterium avium subsp. paratuberculosis
cgggcaacagcgcgccg

SEQ ID NO: 2991989 - RNA, 19 nt, Mycobacterium avium subsp. paratuberculosis
cgggcaaccacagcggcgc

SEQ ID NO: 2991990 - RNA, 19 nt, Mycobacterium avium subsp. paratuberculosis
cgggcaacgcgccggcggu

SEQ ID NO: 2991991 - RNA, 21 nt, Mycobacterium avium subsp. paratuberculosis
cgggcaagggcaaagacgacg

SEQ ID NO: 2991992 - RNA, 23 nt, Mycobacterium avium subsp. paratuberculosis
cgggcaagggcaaagacgacggc

SEQ ID NO: 2991993 - RNA, 14 nt, Mycobacterium avium subsp. paratuberculosis
cgggcaaucgcugc

SEQ ID NO: 2991994 - RNA, 22 nt, Mycobacterium avium subsp. paratuberculosis
cgggcaaucgcugcgcccgccg

SEQ ID NO: 2991995 - RNA, 15 nt, Mycobacterium avium subsp. paratuberculosis
cgggcaaucggaccc

SEQ ID NO: 2991996 - RNA, 20 nt, Mycobacterium avium subsp. paratuberculosis
cgggcaaucggacccagccc

SEQ ID NO: 2991997 - RNA, 19 nt, Mycobacterium avium subsp. paratuberculosis
cgggcaaugaugucggcgg

SEQ ID NO: 2991998 - RNA, 23 nt, Mycobacterium avium subsp. paratuberculosis
cgggcacaccgucguccacgccc

SEQ ID NO: 2991999 - RNA, 12 nt, Mycobacterium avium subsp. paratuberculosis
cgggcacacgcg

SEQ ID NO: 2992000 - RNA, 17 nt, Mycobacterium avium subsp. paratuberculosis
cgggcacacgcggucca

SEQ ID NO: 2992001 - RNA, 17 nt, Mycobacterium avium subsp. paratuberculosis
cgggcacagccagcgcc

SEQ ID NO: 2992002 - RNA, 14 nt, Mycobacterium avium subsp. paratuberculosis
cgggcaccaccacc

SEQ ID NO: 2992003 - RNA, 15 nt, Mycobacterium avium subsp. paratuberculosis
cgggcaccaccaccg

SEQ ID NO: 2992004 - RNA, 16 nt, Mycobacterium avium subsp. paratuberculosis
cgggcaccaccaccga

SEQ ID NO: 2992005 - RNA, 23 nt, Mycobacterium avium subsp. paratuberculosis
cgggcaccaccaccgacaccccg

SEQ ID NO: 2992006 - RNA, 13 nt, Mycobacterium avium subsp. paratuberculosis
cgggcaccacgcc

SEQ ID NO: 2992007 - RNA, 14 nt, Mycobacterium avium subsp. paratuberculosis
cgggcaccacgccg

SEQ ID NO: 2992008 - RNA, 17 nt, Mycobacterium avium subsp. paratuberculosis
cgggcaccacgccgacg

SEQ ID NO: 2992009 - RNA, 19 nt, Mycobacterium avium subsp. paratuberculosis
cgggcaccacgccgacgug

SEQ ID NO: 2992010 - RNA, 13 nt, Mycobacterium avium subsp. paratuberculosis
cgggcaccacggc

SEQ ID NO: 2992011 - RNA, 16 nt, Mycobacterium avium subsp. paratuberculosis
cgggcaccacggcggc

SEQ ID NO: 2992012 - RNA, 18 nt, Mycobacterium avium subsp. paratuberculosis
cgggcaccacggcggcau

SEQ ID NO: 2992013 - RNA, 19 nt, Mycobacterium avium subsp. paratuberculosis
cgggcaccacggcggcaug

SEQ ID NO: 2992014 - RNA, 11 nt, Mycobacterium avium subsp. paratuberculosis
cgggcaccagc

SEQ ID NO: 2992015 - RNA, 14 nt, Mycobacterium avium subsp. paratuberculosis
cgggcaccagcacc

SEQ ID NO: 2992016 - RNA, 15 nt, Mycobacterium avium subsp. paratuberculosis
cgggcaccagcaccg

SEQ ID NO: 2992017 - RNA, 18 nt, Mycobacterium avium subsp. paratuberculosis
cgggcaccagcaccgaga

SEQ ID NO: 2992018 - RNA, 20 nt, Mycobacterium avium subsp. paratuberculosis
cgggcaccagcgacagcacc

SEQ ID NO: 2992019 - RNA, 14 nt, Mycobacterium avium subsp. paratuberculosis
cgggcaccagcgcg

SEQ ID NO: 2992020 - RNA, 17 nt, Mycobacterium avium subsp. paratuberculosis
cgggcaccagcgcgacg

SEQ ID NO: 2992021 - RNA, 21 nt, Mycobacterium avium subsp. paratuberculosis
cgggcaccaguaggucacccg

SEQ ID NO: 2992022 - RNA, 16 nt, Mycobacterium avium subsp. paratuberculosis
cgggcaccccggucac

SEQ ID NO: 2992023 - RNA, 19 nt, Mycobacterium avium subsp. paratuberculosis
cgggcaccccggucaccgg

SEQ ID NO: 2992024 - RNA, 14 nt, Mycobacterium avium subsp. paratuberculosis
cgggcaccccugcc

SEQ ID NO: 2992025 - RNA, 18 nt, Mycobacterium avium subsp. paratuberculosis
cgggcaccccugccgcca

SEQ ID NO: 2992026 - RNA, 22 nt, Mycobacterium avium subsp. paratuberculosis
cgggcaccccugccgccaccgc

SEQ ID NO: 2992027 - RNA, 22 nt, Mycobacterium avium subsp. paratuberculosis
cgggcacccgacgucgacgcgg

SEQ ID NO: 2992028 - RNA, 13 nt, Mycobacterium avium subsp. paratuberculosis
cgggcacccgcgc

SEQ ID NO: 2992029 - RNA, 14 nt, Mycobacterium avium subsp. paratuberculosis
cgggcacccgcgcg

SEQ ID NO: 2992030 - RNA, 17 nt, Mycobacterium avium subsp. paratuberculosis
cgggcacccgcgcgucg

SEQ ID NO: 2992031 - RNA, 14 nt, Mycobacterium avium subsp. paratuberculosis
cgggcacccggcgc

SEQ ID NO: 2992032 - RNA, 15 nt, Mycobacterium avium subsp. paratuberculosis
cgggcacccggcgcg

SEQ ID NO: 2992033 - RNA, 16 nt, Mycobacterium avium subsp. paratuberculosis
cgggcacccggcgcgg

SEQ ID NO: 2992034 - RNA, 17 nt, Mycobacterium avium subsp. paratuberculosis
cgggcacccggcgcggc

SEQ ID NO: 2992035 - RNA, 23 nt, Mycobacterium avium subsp. paratuberculosis
cgggcacccggcgcggccgccca

SEQ ID NO: 2992036 - RNA, 12 nt, Mycobacterium avium subsp. paratuberculosis
cgggcacccggg

SEQ ID NO: 2992037 - RNA, 16 nt, Mycobacterium avium subsp. paratuberculosis
cgggcacccgggcgac

SEQ ID NO: 2992038 - RNA, 22 nt, Mycobacterium avium subsp. paratuberculosis
cgggcacccggguggacaccgc

SEQ ID NO: 2992039 - RNA, 15 nt, Mycobacterium avium subsp. paratuberculosis
cgggcaccgacauca

SEQ ID NO: 2992040 - RNA, 16 nt, Mycobacterium avium subsp. paratuberculosis
cgggcaccgacaucag

SEQ ID NO: 2992041 - RNA, 14 nt, Mycobacterium avium subsp. paratuberculosis
cgggcaccgacgag

SEQ ID NO: 2992042 - RNA, 15 nt, Mycobacterium avium subsp. paratuberculosis
cgggcaccgacgagg

SEQ ID NO: 2992043 - RNA, 13 nt, Mycobacterium avium subsp. paratuberculosis
cgggcaccgcgcc

SEQ ID NO: 2992044 - RNA, 18 nt, Mycobacterium avium subsp. paratuberculosis
cgggcaccgcgcccgccc

SEQ ID NO: 2992045 - RNA, 15 nt, Mycobacterium avium subsp. paratuberculosis
cgggcaccgucgucg

SEQ ID NO: 2992046 - RNA, 16 nt, Mycobacterium avium subsp. paratuberculosis
cgggcaccgucgucgc

SEQ ID NO: 2992047 - RNA, 17 nt, Mycobacterium avium subsp. paratuberculosis
cgggcaccgucgucgca

SEQ ID NO: 2992048 - RNA, 21 nt, Mycobacterium avium subsp. paratuberculosis
cgggcaccgucgucgcaccgg

SEQ ID NO: 2992049 - RNA, 22 nt, Mycobacterium avium subsp. paratuberculosis
cgggcaccgucgucgcaccggc

SEQ ID NO: 2992050 - RNA, 15 nt, Mycobacterium avium subsp. paratuberculosis
cgggcaccucggcca

SEQ ID NO: 2992051 - RNA, 17 nt, Mycobacterium avium subsp. paratuberculosis
cgggcaccucggccagg

SEQ ID NO: 2992052 - RNA, 14 nt, Mycobacterium avium subsp. paratuberculosis
cgggcaccucggcg

SEQ ID NO: 2992053 - RNA, 17 nt, Mycobacterium avium subsp. paratuberculosis
cgggcaccucggcgucg

SEQ ID NO: 2992054 - RNA, 21 nt, Mycobacterium avium subsp. paratuberculosis
cgggcaccucggcgucggcgc

SEQ ID NO: 2992055 - RNA, 15 nt, Mycobacterium avium subsp. paratuberculosis
cgggcaccugauagg

SEQ ID NO: 2992056 - RNA, 18 nt, Mycobacterium avium subsp. paratuberculosis
cgggcacgaauucggugg

SEQ ID NO: 2992057 - RNA, 16 nt, Mycobacterium avium subsp. paratuberculosis
cgggcacgacggucag

SEQ ID NO: 2992058 - RNA, 19 nt, Mycobacterium avium subsp. paratuberculosis
cgggcacgacggucagcac

SEQ ID NO: 2992059 - RNA, 14 nt, Mycobacterium avium subsp. paratuberculosis
cgggcacgcgagac

SEQ ID NO: 2992060 - RNA, 21 nt, Mycobacterium avium subsp. paratuberculosis
cgggcacgcgagacgagccgc

SEQ ID NO: 2992061 - RNA, 15 nt, Mycobacterium avium subsp. paratuberculosis
cgggcacggcgaugu

SEQ ID NO: 2992062 - RNA, 13 nt, Mycobacterium avium subsp. paratuberculosis
cgggcacggucag

SEQ ID NO: 2992063 - RNA, 14 nt, Mycobacterium avium subsp. paratuberculosis
cgggcacggucagg

SEQ ID NO: 2992064 - RNA, 14 nt, Mycobacterium avium subsp. paratuberculosis
cgggcacgucgacg

SEQ ID NO: 2992065 - RNA, 14 nt, Mycobacterium avium subsp. paratuberculosis
cgggcacgucgcgc

SEQ ID NO: 2992066 - RNA, 16 nt, Mycobacterium avium subsp. paratuberculosis
cgggcacgucgcgcgg

SEQ ID NO: 2992067 - RNA, 21 nt, Mycobacterium avium subsp. paratuberculosis
cgggcacgucgcgcggggucg

SEQ ID NO: 2992068 - RNA, 19 nt, Mycobacterium avium subsp. paratuberculosis
cgggcacucgagcguccgg

SEQ ID NO: 2992069 - RNA, 21 nt, Mycobacterium avium subsp. paratuberculosis
cgggcacucgagcguccggag

SEQ ID NO: 2992070 - RNA, 21 nt, Mycobacterium avium subsp. paratuberculosis
cgggcacuuaacaccucgccu

SEQ ID NO: 2992071 - RNA, 18 nt, Mycobacterium avium subsp. paratuberculosis
cgggcagauggucgccga

SEQ ID NO: 2992072 - RNA, 19 nt, Mycobacterium avium subsp. paratuberculosis
cgggcagauggucgccgac

SEQ ID NO: 2992073 - RNA, 14 nt, Mycobacterium avium subsp. paratuberculosis
cgggcagcaccagc

SEQ ID NO: 2992074 - RNA, 15 nt, Mycobacterium avium subsp. paratuberculosis
cgggcagcaccagcg

SEQ ID NO: 2992075 - RNA, 18 nt, Mycobacterium avium subsp. paratuberculosis
cgggcagcaccagcggca

SEQ ID NO: 2992076 - RNA, 20 nt, Mycobacterium avium subsp. paratuberculosis
cgggcagcaccagcggcacc

SEQ ID NO: 2992077 - RNA, 12 nt, Mycobacterium avium subsp. paratuberculosis
cgggcagcagca

SEQ ID NO: 2992078 - RNA, 15 nt, Mycobacterium avium subsp. paratuberculosis
cgggcagcagcacca

SEQ ID NO: 2992079 - RNA, 16 nt, Mycobacterium avium subsp. paratuberculosis
cgggcagcagcaccag

SEQ ID NO: 2992080 - RNA, 18 nt, Mycobacterium avium subsp. paratuberculosis
cgggcagcagcaccagcg

SEQ ID NO: 2992081 - RNA, 20 nt, Mycobacterium avium subsp. paratuberculosis
cgggcagcagcaccagcgcc

SEQ ID NO: 2992082 - RNA, 21 nt, Mycobacterium avium subsp. paratuberculosis
cgggcagcagcaccagcgccg

SEQ ID NO: 2992083 - RNA, 14 nt, Mycobacterium avium subsp. paratuberculosis
cgggcagcccgccg

SEQ ID NO: 2992084 - RNA, 16 nt, Mycobacterium avium subsp. paratuberculosis
cgggcagcccgccgac

SEQ ID NO: 2992085 - RNA, 18 nt, Mycobacterium avium subsp. paratuberculosis
cgggcagcccgccgacca

SEQ ID NO: 2992086 - RNA, 20 nt, Mycobacterium avium subsp. paratuberculosis
cgggcagcccgccgaccacc

SEQ ID NO: 2992087 - RNA, 21 nt, Mycobacterium avium subsp. paratuberculosis
cgggcagcccgccgaccaccu

SEQ ID NO: 2992088 - RNA, 15 nt, Mycobacterium avium subsp. paratuberculosis
cgggcagcccgccgc

SEQ ID NO: 2992089 - RNA, 18 nt, Mycobacterium avium subsp. paratuberculosis
cgggcagcccgccgcgga

SEQ ID NO: 2992090 - RNA, 21 nt, Mycobacterium avium subsp. paratuberculosis
cgggcagcccgccgcggaucg

SEQ ID NO: 2992091 - RNA, 21 nt, Mycobacterium avium subsp. paratuberculosis
cgggcagccgcacaccgcggc

SEQ ID NO: 2992092 - RNA, 13 nt, Mycobacterium avium subsp. paratuberculosis
cgggcagccggcg

SEQ ID NO: 2992093 - RNA, 16 nt, Mycobacterium avium subsp. paratuberculosis
cggcguacgcgauggc

SEQ ID NO: 2992094 - RNA, 17 nt, Mycobacterium avium subsp. paratuberculosis
cggcguacgcgauggcg

SEQ ID NO: 2992095 - RNA, 16 nt, Mycobacterium avium subsp. paratuberculosis
cggcguacucgcacag

SEQ ID NO: 2992096 - RNA, 17 nt, Mycobacterium avium subsp. paratuberculosis
cggcguacugcgcgacc

SEQ ID NO: 2992097 - RNA, 19 nt, Mycobacterium avium subsp. paratuberculosis
cggcguacugcgcgaccaa

SEQ ID NO: 2992098 - RNA, 19 nt, Mycobacterium avium subsp. paratuberculosis
cggcguacugcgcgagcuc

SEQ ID NO: 2992099 - RNA, 21 nt, Mycobacterium avium subsp. paratuberculosis
cggcguacugcgcgagcucgu

SEQ ID NO: 2992100 - RNA, 17 nt, Mycobacterium avium subsp. paratuberculosis
cggcguagaacaccgaa

SEQ ID NO: 2992101 - RNA, 20 nt, Mycobacterium avium subsp. paratuberculosis
cggcguagaggugcagcggg

SEQ ID NO: 2992102 - RNA, 21 nt, Mycobacterium avium subsp. paratuberculosis
cggcguagaggugcagcgggc

SEQ ID NO: 2992103 - RNA, 18 nt, Mycobacterium avium subsp. paratuberculosis
cggcguagcagucggccu

SEQ ID NO: 2992104 - RNA, 23 nt, Mycobacterium avium subsp. paratuberculosis
cggcguagcagucggccugcagc

SEQ ID NO: 2992105 - RNA, 13 nt, Mycobacterium avium subsp. paratuberculosis
cggcguagccgcc

SEQ ID NO: 2992106 - RNA, 15 nt, Mycobacterium avium subsp. paratuberculosis
cggcguagccgccgg

SEQ ID NO: 2992107 - RNA, 17 nt, Mycobacterium avium subsp. paratuberculosis
cggcguagccgccgguu

SEQ ID NO: 2992108 - RNA, 16 nt, Mycobacterium avium subsp. paratuberculosis
cggcguagggcagccc

SEQ ID NO: 2992109 - RNA, 19 nt, Mycobacterium avium subsp. paratuberculosis
cggcguaggugggcagcgc

SEQ ID NO: 2992110 - RNA, 22 nt, Mycobacterium avium subsp. paratuberculosis
cggcguaggugggcagcgcggc

SEQ ID NO: 2992111 - RNA, 15 nt, Mycobacterium avium subsp. paratuberculosis
cggcguagucgccgg

SEQ ID NO: 2992112 - RNA, 19 nt, Mycobacterium avium subsp. paratuberculosis
cggcguagucgccggugua

SEQ ID NO: 2992113 - RNA, 18 nt, Mycobacterium avium subsp. paratuberculosis
cggcguagucggcgcagc

SEQ ID NO: 2992114 - RNA, 13 nt, Mycobacterium avium subsp. paratuberculosis
cggcguaguucgu

SEQ ID NO: 2992115 - RNA, 14 nt, Mycobacterium avium subsp. paratuberculosis
cggcguaguucguc

SEQ ID NO: 2992116 - RNA, 20 nt, Mycobacterium avium subsp. paratuberculosis
cggcguaguucgucgaacag

SEQ ID NO: 2992117 - RNA, 21 nt, Mycobacterium avium subsp. paratuberculosis
cggcguaucaacugagcgccc

SEQ ID NO: 2992118 - RNA, 19 nt, Mycobacterium avium subsp. paratuberculosis
cggcguaucuccaccgucg

SEQ ID NO: 2992119 - RNA, 20 nt, Mycobacterium avium subsp. paratuberculosis
cggcguaucuccaccgucga

SEQ ID NO: 2992120 - RNA, 22 nt, Mycobacterium avium subsp. paratuberculosis
cggcguaucuccaccgucgaug

SEQ ID NO: 2992121 - RNA, 21 nt, Mycobacterium avium subsp. paratuberculosis
cggcgucacauacgccucacc

SEQ ID NO: 2992122 - RNA, 13 nt, Mycobacterium avium subsp. paratuberculosis
cggcgucaccagg

SEQ ID NO: 2992123 - RNA, 16 nt, Mycobacterium avium subsp. paratuberculosis
cggcgucaccaggcug

SEQ ID NO: 2992124 - RNA, 12 nt, Mycobacterium avium subsp. paratuberculosis
cggcgucacccc

SEQ ID NO: 2992125 - RNA, 18 nt, Mycobacterium avium subsp. paratuberculosis
cggcgucacccuggaacu

SEQ ID NO: 2992126 - RNA, 17 nt, Mycobacterium avium subsp. paratuberculosis
cggcgucaccgcgggug

SEQ ID NO: 2992127 - RNA, 19 nt, Mycobacterium avium subsp. paratuberculosis
cggcgucacgcccucuucu

SEQ ID NO: 2992128 - RNA, 21 nt, Mycobacterium avium subsp. paratuberculosis
cggcgucacgcuggcgugacg

SEQ ID NO: 2992129 - RNA, 21 nt, Mycobacterium avium subsp. paratuberculosis
cggcgucacucuggcgugacg

SEQ ID NO: 2992130 - RNA, 24 nt, Mycobacterium avium subsp. paratuberculosis
cggcgucacucuggcgugacgcuc

SEQ ID NO: 2992131 - RNA, 14 nt, Mycobacterium avium subsp. paratuberculosis
cggcgucacugccc

SEQ ID NO: 2992132 - RNA, 14 nt, Mycobacterium avium subsp. paratuberculosis
cggcgucaggaugg

SEQ ID NO: 2992133 - RNA, 16 nt, Mycobacterium avium subsp. paratuberculosis
cggcgucaggggugcc

SEQ ID NO: 2992134 - RNA, 13 nt, Mycobacterium avium subsp. paratuberculosis
cggcgucaggucc

SEQ ID NO: 2992135 - RNA, 16 nt, Mycobacterium avium subsp. paratuberculosis
cggcgucaucccccgc

SEQ ID NO: 2992136 - RNA, 19 nt, Mycobacterium avium subsp. paratuberculosis
cggcgucaucccccgcagc

SEQ ID NO: 2992137 - RNA, 21 nt, Mycobacterium avium subsp. paratuberculosis
cggcgucaucgacuugccgcc

SEQ ID NO: 2992138 - RNA, 22 nt, Mycobacterium avium subsp. paratuberculosis
cggcgucaucgacuugccgccg

SEQ ID NO: 2992139 - RNA, 18 nt, Mycobacterium avium subsp. paratuberculosis
cggcgucauggugcgcgg

SEQ ID NO: 2992140 - RNA, 21 nt, Mycobacterium avium subsp. paratuberculosis
cggcgucauggugcgcggguu

SEQ ID NO: 2992141 - RNA, 14 nt, Mycobacterium avium subsp. paratuberculosis
cggcguccaccagc

SEQ ID NO: 2992142 - RNA, 21 nt, Mycobacterium avium subsp. paratuberculosis
cggcguccaccagcacgccgu

SEQ ID NO: 2992143 - RNA, 16 nt, Mycobacterium avium subsp. paratuberculosis
cggcguccaccggucg

SEQ ID NO: 2992144 - RNA, 19 nt, Mycobacterium avium subsp. paratuberculosis
cggcguccaccggucgacg

SEQ ID NO: 2992145 - RNA, 13 nt, Mycobacterium avium subsp. paratuberculosis
cggcguccacgcc

SEQ ID NO: 2992146 - RNA, 17 nt, Mycobacterium avium subsp. paratuberculosis
cggcguccacgccgugu

SEQ ID NO: 2992147 - RNA, 22 nt, Mycobacterium avium subsp. paratuberculosis
cggcguccagcgccgccacggc

SEQ ID NO: 2992148 - RNA, 14 nt, Mycobacterium avium subsp. paratuberculosis
cggcguccagcugc

SEQ ID NO: 2992149 - RNA, 19 nt, Mycobacterium avium subsp. paratuberculosis
cggcguccagcugcgcgcc

SEQ ID NO: 2992150 - RNA, 18 nt, Mycobacterium avium subsp. paratuberculosis
cggcguccaggcgcaccg

SEQ ID NO: 2992151 - RNA, 23 nt, Mycobacterium avium subsp. paratuberculosis
cggcguccaggcgcaccgccacc

SEQ ID NO: 2992152 - RNA, 18 nt, Mycobacterium avium subsp. paratuberculosis
cggcguccaguagccgcc

SEQ ID NO: 2992153 - RNA, 19 nt, Mycobacterium avium subsp. paratuberculosis
cggcguccaguagccgccg

SEQ ID NO: 2992154 - RNA, 20 nt, Mycobacterium avium subsp. paratuberculosis
cggcguccaguagccgccgg

SEQ ID NO: 2992155 - RNA, 22 nt, Mycobacterium avium subsp. paratuberculosis
cggcguccaguagccgccgggc

SEQ ID NO: 2992156 - RNA, 23 nt, Mycobacterium avium subsp. paratuberculosis
cggcguccaguagccgccgggcg

SEQ ID NO: 2992157 - RNA, 15 nt, Mycobacterium avium subsp. paratuberculosis
cggcguccagugcau

SEQ ID NO: 2992158 - RNA, 18 nt, Mycobacterium avium subsp. paratuberculosis
cggcguccaguucggcca

SEQ ID NO: 2992159 - RNA, 22 nt, Mycobacterium avium subsp. paratuberculosis
cggcguccaguucggccagcgc

SEQ ID NO: 2992160 - RNA, 20 nt, Mycobacterium avium subsp. paratuberculosis
cggcguccaguugcggcacg

SEQ ID NO: 2992161 - RNA, 23 nt, Mycobacterium avium subsp. paratuberculosis
cggcguccaguugcggcacgccg

SEQ ID NO: 2992162 - RNA, 23 nt, Mycobacterium avium subsp. paratuberculosis
cggcgucccacguggugaucagc

SEQ ID NO: 2992163 - RNA, 17 nt, Mycobacterium avium subsp. paratuberculosis
cggcgucccagugcucg

SEQ ID NO: 2992164 - RNA, 14 nt, Mycobacterium avium subsp. paratuberculosis
cggcguccccggcg

SEQ ID NO: 2992165 - RNA, 17 nt, Mycobacterium avium subsp. paratuberculosis
cggcguccccggcgguu

SEQ ID NO: 2992166 - RNA, 14 nt, Mycobacterium avium subsp. paratuberculosis
cggcgucccgcgcc

SEQ ID NO: 2992167 - RNA, 13 nt, Mycobacterium avium subsp. paratuberculosis
cggcgucccggcg

SEQ ID NO: 2992168 - RNA, 13 nt, Mycobacterium avium subsp. paratuberculosis
cggcguccgcggc

SEQ ID NO: 2992169 - RNA, 14 nt, Mycobacterium avium subsp. paratuberculosis
cggcguccgcggcc

SEQ ID NO: 2992170 - RNA, 16 nt, Mycobacterium avium subsp. paratuberculosis
cggcguccgcggccgc

SEQ ID NO: 2992171 - RNA, 17 nt, Mycobacterium avium subsp. paratuberculosis
cggcguccgcggccgcg

SEQ ID NO: 2992172 - RNA, 19 nt, Mycobacterium avium subsp. paratuberculosis
cggcguccgcggccgcggc

SEQ ID NO: 2992173 - RNA, 23 nt, Mycobacterium avium subsp. paratuberculosis
cggcguccgcggccgcggcgcgc

SEQ ID NO: 2992174 - RNA, 15 nt, Mycobacterium avium subsp. paratuberculosis
cggcguccgcggcgg

SEQ ID NO: 2992175 - RNA, 16 nt, Mycobacterium avium subsp. paratuberculosis
cggcguccgcggcgga

SEQ ID NO: 2992176 - RNA, 16 nt, Mycobacterium avium subsp. paratuberculosis
cggcguccgggcgcug

SEQ ID NO: 2992177 - RNA, 22 nt, Mycobacterium avium subsp. paratuberculosis
cggcuaccuaggcgucgucggc

SEQ ID NO: 2992178 - RNA, 23 nt, Mycobacterium avium subsp. paratuberculosis
cggcuaccuaggcgucgucggcc

SEQ ID NO: 2992179 - RNA, 19 nt, Mycobacterium avium subsp. paratuberculosis
cggcuaccugaccagcggc

SEQ ID NO: 2992180 - RNA, 20 nt, Mycobacterium avium subsp. paratuberculosis
cggcuaccugaccagcggcg

SEQ ID NO: 2992181 - RNA, 22 nt, Mycobacterium avium subsp. paratuberculosis
cggcuaccugaccagcggcgcg

SEQ ID NO: 2992182 - RNA, 23 nt, Mycobacterium avium subsp. paratuberculosis
cggcuaccugaccagcggcgcgc

SEQ ID NO: 2992183 - RNA, 20 nt, Mycobacterium avium subsp. paratuberculosis
cggcuacucggacgccggca

SEQ ID NO: 2992184 - RNA, 23 nt, Mycobacterium avium subsp. paratuberculosis
cggcuacucggacgccggcagcc

SEQ ID NO: 2992185 - RNA, 22 nt, Mycobacterium avium subsp. paratuberculosis
cggcuagcagcuccggucggcg

SEQ ID NO: 2992186 - RNA, 24 nt, Mycobacterium avium subsp. paratuberculosis
cggcuagcagcuccggucggcgcu

SEQ ID NO: 2992187 - RNA, 20 nt, Mycobacterium avium subsp. paratuberculosis
cggcuagcggcugacccgcc

SEQ ID NO: 2992188 - RNA, 20 nt, Mycobacterium avium subsp. paratuberculosis
cggcuauucgggccugacca

SEQ ID NO: 2992189 - RNA, 18 nt, Mycobacterium avium subsp. paratuberculosis
cggcucaaaccguugacc

SEQ ID NO: 2992190 - RNA, 15 nt, Mycobacterium avium subsp. paratuberculosis
cggcucaacggccgg

SEQ ID NO: 2992191 - RNA, 17 nt, Mycobacterium avium subsp. paratuberculosis
cggcucaacggccggcg

SEQ ID NO: 2992192 - RNA, 23 nt, Mycobacterium avium subsp. paratuberculosis
cggcucaacggccggcgccgccg

SEQ ID NO: 2992193 - RNA, 15 nt, Mycobacterium avium subsp. paratuberculosis
cggcucacagcgcgg

SEQ ID NO: 2992194 - RNA, 18 nt, Mycobacterium avium subsp. paratuberculosis
cggcucacagcgcggcgg

SEQ ID NO: 2992195 - RNA, 19 nt, Mycobacterium avium subsp. paratuberculosis
cggcucacagcgcggcggu

SEQ ID NO: 2992196 - RNA, 21 nt, Mycobacterium avium subsp. paratuberculosis
cggcucacagcgcggcgguga

SEQ ID NO: 2992197 - RNA, 19 nt, Mycobacterium avium subsp. paratuberculosis
cggcucacaugggcgcguu

SEQ ID NO: 2992198 - RNA, 15 nt, Mycobacterium avium subsp. paratuberculosis
cggcucaccaggucc

SEQ ID NO: 2992199 - RNA, 16 nt, Mycobacterium avium subsp. paratuberculosis
cggcucaccgaacgcg

SEQ ID NO: 2992200 - RNA, 21 nt, Mycobacterium avium subsp. paratuberculosis
cggcucacgacuccuggccga

SEQ ID NO: 2992201 - RNA, 21 nt, Mycobacterium avium subsp. paratuberculosis
cggcucgccggcgucuugauc

SEQ ID NO: 2992202 - RNA, 14 nt, Mycobacterium avium subsp. paratuberculosis
cggcucgccgggcu

SEQ ID NO: 2992203 - RNA, 15 nt, Mycobacterium avium subsp. paratuberculosis
cggcucgccgggcug

SEQ ID NO: 2992204 - RNA, 21 nt, Mycobacterium avium subsp. paratuberculosis
cggcucgccgggcugcacgcu

SEQ ID NO: 2992205 - RNA, 15 nt, Mycobacterium avium subsp. paratuberculosis
cggcucgccguugcg

SEQ ID NO: 2992206 - RNA, 23 nt, Mycobacterium avium subsp. paratuberculosis
cggcucgccguugcgggucggcg

SEQ ID NO: 2992207 - RNA, 12 nt, Mycobacterium avium subsp. paratuberculosis
cggcucgccugc

SEQ ID NO: 2992208 - RNA, 14 nt, Mycobacterium avium subsp. paratuberculosis
cggcucgccugcga

SEQ ID NO: 2992209 - RNA, 17 nt, Mycobacterium avium subsp. paratuberculosis
cggcucgccugcgagcg

SEQ ID NO: 2992210 - RNA, 20 nt, Mycobacterium avium subsp. paratuberculosis
cggcucgccugcgagcguga

SEQ ID NO: 2992211 - RNA, 14 nt, Mycobacterium avium subsp. paratuberculosis
cggcucgcgacgcg

SEQ ID NO: 2992212 - RNA, 12 nt, Mycobacterium avium subsp. paratuberculosis
cggcucgcgcgg

SEQ ID NO: 2992213 - RNA, 18 nt, Mycobacterium avium subsp. paratuberculosis
cggcucgcgggcgaugcg

SEQ ID NO: 2992214 - RNA, 22 nt, Mycobacterium avium subsp. paratuberculosis
cggcucgcgggcgaugcggccc

SEQ ID NO: 2992215 - RNA, 15 nt, Mycobacterium avium subsp. paratuberculosis
cggcucgcggggugu

SEQ ID NO: 2992216 - RNA, 17 nt, Mycobacterium avium subsp. paratuberculosis
cggcucgcggggugucg

SEQ ID NO: 2992217 - RNA, 21 nt, Mycobacterium avium subsp. paratuberculosis
cggcucgcggggugucgugca

SEQ ID NO: 2992218 - RNA, 18 nt, Mycobacterium avium subsp. paratuberculosis
cggcucgcgggugcggcg

SEQ ID NO: 2992219 - RNA, 13 nt, Mycobacterium avium subsp. paratuberculosis
cggcucggaaccg

SEQ ID NO: 2992220 - RNA, 11 nt, Mycobacterium avium subsp. paratuberculosis
cggcucggccc

SEQ ID NO: 2992221 - RNA, 13 nt, Mycobacterium avium subsp. paratuberculosis
cggcucggcccgg

SEQ ID NO: 2992222 - RNA, 15 nt, Mycobacterium avium subsp. paratuberculosis
cggcucggcccggaa

SEQ ID NO: 2992223 - RNA, 13 nt, Mycobacterium avium subsp. paratuberculosis
cggcucggccggc

SEQ ID NO: 2992224 - RNA, 12 nt, Mycobacterium avium subsp. paratuberculosis
cggcucggcgac

SEQ ID NO: 2992225 - RNA, 13 nt, Mycobacterium avium subsp. paratuberculosis
cggcucggcgaca

SEQ ID NO: 2992226 - RNA, 16 nt, Mycobacterium avium subsp. paratuberculosis
cggcucggcgacaaca

SEQ ID NO: 2992227 - RNA, 19 nt, Mycobacterium avium subsp. paratuberculosis
cggcucggcgacaacagcg

SEQ ID NO: 2992228 - RNA, 21 nt, Mycobacterium avium subsp. paratuberculosis
cggcucggcgacaacagcgcc

SEQ ID NO: 2992229 - RNA, 12 nt, Mycobacterium avium subsp. paratuberculosis
cggcucggcgcc

SEQ ID NO: 2992230 - RNA, 13 nt, Mycobacterium avium subsp. paratuberculosis
cggcucggcgccc

SEQ ID NO: 2992231 - RNA, 19 nt, Mycobacterium avium subsp. paratuberculosis
cggcucggcgccccacgcc

SEQ ID NO: 2992232 - RNA, 22 nt, Mycobacterium avium subsp. paratuberculosis
cggcucggcgccccacgccugg

SEQ ID NO: 2992233 - RNA, 16 nt, Mycobacterium avium subsp. paratuberculosis
cggcucggcggcgucg

SEQ ID NO: 2992234 - RNA, 17 nt, Mycobacterium avium subsp. paratuberculosis
cggcucggcggcgucgu

SEQ ID NO: 2992235 - RNA, 15 nt, Mycobacterium avium subsp. paratuberculosis
cggcucggcggcuca

SEQ ID NO: 2992236 - RNA, 17 nt, Mycobacterium avium subsp. paratuberculosis
cggcucggcucggccgg

SEQ ID NO: 2992237 - RNA, 18 nt, Mycobacterium avium subsp. paratuberculosis
cggcucgggaacggucag

SEQ ID NO: 2992238 - RNA, 12 nt, Mycobacterium avium subsp. paratuberculosis
cggcucgggcgg

SEQ ID NO: 2992239 - RNA, 21 nt, Mycobacterium avium subsp. paratuberculosis
cggcucgggcgguggcgccgg

SEQ ID NO: 2992240 - RNA, 12 nt, Mycobacterium avium subsp. paratuberculosis
cggcucgggggc

SEQ ID NO: 2992241 - RNA, 16 nt, Mycobacterium avium subsp. paratuberculosis
cggcucgggggccgcu

SEQ ID NO: 2992242 - RNA, 19 nt, Mycobacterium avium subsp. paratuberculosis
cggcucgggggccgcucca

SEQ ID NO: 2992243 - RNA, 16 nt, Mycobacterium avium subsp. paratuberculosis
cggcucgggggugucg

SEQ ID NO: 2992244 - RNA, 14 nt, Mycobacterium avium subsp. paratuberculosis
cggcucggggucgg

SEQ ID NO: 2992245 - RNA, 17 nt, Mycobacterium avium subsp. paratuberculosis
cggcucggggucggccg

SEQ ID NO: 2992246 - RNA, 17 nt, Mycobacterium avium subsp. paratuberculosis
cggcucggucaagccgg

SEQ ID NO: 2992247 - RNA, 22 nt, Mycobacterium avium subsp. paratuberculosis
cggcucggucaagccggccagc

SEQ ID NO: 2992248 - RNA, 23 nt, Mycobacterium avium subsp. paratuberculosis
cggcucggucaagccggccagca

SEQ ID NO: 2992249 - RNA, 14 nt, Mycobacterium avium subsp. paratuberculosis
cggcucggucgcga

SEQ ID NO: 2992250 - RNA, 13 nt, Mycobacterium avium subsp. paratuberculosis
cggcucggugccg

SEQ ID NO: 2992251 - RNA, 16 nt, Mycobacterium avium subsp. paratuberculosis
cggcucggugccgcgg

SEQ ID NO: 2992252 - RNA, 15 nt, Mycobacterium avium subsp. paratuberculosis
cggcucguagcgggc

SEQ ID NO: 2992253 - RNA, 19 nt, Mycobacterium avium subsp. paratuberculosis
cggcucguagcgggcgaac

SEQ ID NO: 2992254 - RNA, 24 nt, Mycobacterium avium subsp. paratuberculosis
cggcucguagcuggugcgcagccc

SEQ ID NO: 2992255 - RNA, 16 nt, Mycobacterium avium subsp. paratuberculosis
cggcucguccagcccg

SEQ ID NO: 2992256 - RNA, 17 nt, Mycobacterium avium subsp. paratuberculosis
cggcucguccagcccgg

SEQ ID NO: 2992257 - RNA, 19 nt, Mycobacterium avium subsp. paratuberculosis
cggcucguccaucagcagc

SEQ ID NO: 2992258 - RNA, 13 nt, Mycobacterium avium subsp. paratuberculosis
cggcucgucggcg

SEQ ID NO: 2992259 - RNA, 14 nt, Mycobacterium avium subsp. paratuberculosis
cggcucgucggcga

SEQ ID NO: 2992260 - RNA, 17 nt, Mycobacterium avium subsp. paratuberculosis
cggcucgucggcgaaca

SEQ ID NO: 2992261 - RNA, 14 nt, Mycobacterium avium subsp. paratuberculosis
cggcucguggaacg

SEQ ID NO: 2992262 - RNA, 19 nt, Mycobacterium avium subsp. paratuberculosis
cggcucguggaacgacgcc

SEQ ID NO: 2992263 - RNA, 13 nt, Mycobacterium avium subsp. paratuberculosis
cggcucgugggug

SEQ ID NO: 2992264 - RNA, 18 nt, Mycobacterium avium subsp. paratuberculosis
cggcucguggguggucug

SEQ ID NO: 2992265 - RNA, 19 nt, Mycobacterium avium subsp. paratuberculosis
cggcucguguccgaugacg

SEQ ID NO: 2992266 - RNA, 21 nt, Mycobacterium avium subsp. paratuberculosis
cggcucguguccgaugacgag

SEQ ID NO: 2992267 - RNA, 18 nt, Mycobacterium avium subsp. paratuberculosis
cggcucguugagcacaca

SEQ ID NO: 2992268 - RNA, 15 nt, Mycobacterium avium subsp. paratuberculosis
cggcucugccugcag

SEQ ID NO: 2992269 - RNA, 15 nt, Mycobacterium avium subsp. paratuberculosis
cggcucuucggcgcc

SEQ ID NO: 2992270 - RNA, 16 nt, Mycobacterium avium subsp. paratuberculosis
cggcucuucggcgccg

SEQ ID NO: 2992271 - RNA, 18 nt, Mycobacterium avium subsp. paratuberculosis
cggcucuucggcgccgag

SEQ ID NO: 2992272 - RNA, 16 nt, Mycobacterium avium subsp. paratuberculosis
cggcugaaccaccgcg

SEQ ID NO: 2992273 - RNA, 17 nt, Mycobacterium avium subsp. paratuberculosis
cggcugaaccaccgcgc

SEQ ID NO: 2992274 - RNA, 19 nt, Mycobacterium avium subsp. paratuberculosis
cggcugaaccaccgcgccc

SEQ ID NO: 2992275 - RNA, 20 nt, Mycobacterium avium subsp. paratuberculosis
cggcugaaccaccgcgccca

SEQ ID NO: 2992276 - RNA, 17 nt, Mycobacterium avium subsp. paratuberculosis
cggcugaacgccagcag

SEQ ID NO: 2992277 - RNA, 19 nt, Mycobacterium avium subsp. paratuberculosis
cggcugaacgccagcagcc

SEQ ID NO: 2992278 - RNA, 17 nt, Mycobacterium avium subsp. paratuberculosis
cggcugaagcgcuggga

SEQ ID NO: 2992279 - RNA, 18 nt, Mycobacterium avium subsp. paratuberculosis
cggcugaagcgcugggac

SEQ ID NO: 2992280 - RNA, 14 nt, Mycobacterium avium subsp. paratuberculosis
cggcugaccgagcg

SEQ ID NO: 2992281 - RNA, 21 nt, Mycobacterium avium subsp. paratuberculosis
cggcugaccgagcggcgcugc

SEQ ID NO: 2992282 - RNA, 22 nt, Mycobacterium avium subsp. paratuberculosis
cggcugaccgagcggcgcugca

SEQ ID NO: 2992283 - RNA, 16 nt, Mycobacterium avium subsp. paratuberculosis
cggcugaccggcggug

SEQ ID NO: 2992284 - RNA, 17 nt, Mycobacterium avium subsp. paratuberculosis
cggcugaccggcggugc

SEQ ID NO: 2992285 - RNA, 19 nt, Mycobacterium avium subsp. paratuberculosis
cggcugaccggcggugccg

SEQ ID NO: 2992286 - RNA, 13 nt, Mycobacterium avium subsp. paratuberculosis
cggcuggucggcc

SEQ ID NO: 2992287 - RNA, 14 nt, Mycobacterium avium subsp. paratuberculosis
cggcuggucggccu

SEQ ID NO: 2992288 - RNA, 14 nt, Mycobacterium avium subsp. paratuberculosis
cggcuggucggcgg

SEQ ID NO: 2992289 - RNA, 15 nt, Mycobacterium avium subsp. paratuberculosis
cggcuggucggcggc

SEQ ID NO: 2992290 - RNA, 15 nt, Mycobacterium avium subsp. paratuberculosis
cggcuggugccgccg

SEQ ID NO: 2992291 - RNA, 16 nt, Mycobacterium avium subsp. paratuberculosis
cggcuggugccgccgg

SEQ ID NO: 2992292 - RNA, 17 nt, Mycobacterium avium subsp. paratuberculosis
cggcuggugccgccggc

SEQ ID NO: 2992293 - RNA, 21 nt, Mycobacterium avium subsp. paratuberculosis
cggcuggugccgccggcgauc

SEQ ID NO: 2992294 - RNA, 16 nt, Mycobacterium avium subsp. paratuberculosis
cggcuguagcacccgg

SEQ ID NO: 2992295 - RNA, 18 nt, Mycobacterium avium subsp. paratuberculosis
cggcuguagcacccggcc

SEQ ID NO: 2992296 - RNA, 20 nt, Mycobacterium avium subsp. paratuberculosis
cggcuguagcacccggccgg

SEQ ID NO: 2992297 - RNA, 23 nt, Mycobacterium avium subsp. paratuberculosis
cggcuguagcacccggccggcga

SEQ ID NO: 2992298 - RNA, 15 nt, Mycobacterium avium subsp. paratuberculosis
cggcugucgacagga

SEQ ID NO: 2992299 - RNA, 21 nt, Mycobacterium avium subsp. paratuberculosis
cggcugucguagcggcccagg

SEQ ID NO: 2992300 - RNA, 22 nt, Mycobacterium avium subsp. paratuberculosis
cggcuguggcgcacagaucguc

SEQ ID NO: 2992301 - RNA, 14 nt, Mycobacterium avium subsp. paratuberculosis
cggcuuaaucgccc

SEQ ID NO: 2992302 - RNA, 22 nt, Mycobacterium avium subsp. paratuberculosis
cggcuuaccgaccucgaggccg

SEQ ID NO: 2992303 - RNA, 20 nt, Mycobacterium avium subsp. paratuberculosis
cggcuuaccggcgggcggcg

SEQ ID NO: 2992304 - RNA, 16 nt, Mycobacterium avium subsp. paratuberculosis
cggcuucagucccgcg

SEQ ID NO: 2992305 - RNA, 20 nt, Mycobacterium avium subsp. paratuberculosis
cggcuucauaugacgccggc

SEQ ID NO: 2992306 - RNA, 21 nt, Mycobacterium avium subsp. paratuberculosis
cggcuucauaugacgccggcc

SEQ ID NO: 2992307 - RNA, 22 nt, Mycobacterium avium subsp. paratuberculosis
cggcuucauaugacgccggccu

SEQ ID NO: 2992308 - RNA, 15 nt, Mycobacterium avium subsp. paratuberculosis
cggcuuccgagacgu

SEQ ID NO: 2992309 - RNA, 17 nt, Mycobacterium avium subsp. paratuberculosis
cggcuuccgagccggug

SEQ ID NO: 2992310 - RNA, 20 nt, Mycobacterium avium subsp. paratuberculosis
cggcuuccgagccggugaug

SEQ ID NO: 2992311 - RNA, 13 nt, Mycobacterium avium subsp. paratuberculosis
cggcuuccgcgga

SEQ ID NO: 2992312 - RNA, 15 nt, Mycobacterium avium subsp. paratuberculosis
cggcuuccgcggacg

SEQ ID NO: 2992313 - RNA, 19 nt, Mycobacterium avium subsp. paratuberculosis
cggcuuccgcggacggguu

SEQ ID NO: 2992314 - RNA, 16 nt, Mycobacterium avium subsp. paratuberculosis
cggcuuccuccucggc

SEQ ID NO: 2992315 - RNA, 17 nt, Mycobacterium avium subsp. paratuberculosis
cggcuuccuccucggcg

SEQ ID NO: 2992316 - RNA, 18 nt, Mycobacterium avium subsp. paratuberculosis
cggcuuccuccucggcgc

SEQ ID NO: 2992317 - RNA, 21 nt, Mycobacterium avium subsp. paratuberculosis
cggcuuccuccucggcgcgga

SEQ ID NO: 2992318 - RNA, 18 nt, Mycobacterium avium subsp. paratuberculosis
cggcuuccucgcggaacc

SEQ ID NO: 2992319 - RNA, 13 nt, Mycobacterium avium subsp. paratuberculosis
cggcuucgccgcc

SEQ ID NO: 2992320 - RNA, 14 nt, Mycobacterium avium subsp. paratuberculosis
cggcuucgccgccg

SEQ ID NO: 2992321 - RNA, 15 nt, Mycobacterium avium subsp. paratuberculosis
cggcuucgccgccgc

SEQ ID NO: 2992322 - RNA, 18 nt, Mycobacterium avium subsp. paratuberculosis
cggcuucgccgccgcacc

SEQ ID NO: 2992323 - RNA, 22 nt, Mycobacterium avium subsp. paratuberculosis
cggcuucgccgccgcaccggcc

SEQ ID NO: 2992324 - RNA, 15 nt, Mycobacterium avium subsp. paratuberculosis
cggcuucgccgcgcu

SEQ ID NO: 2992325 - RNA, 23 nt, Mycobacterium avium subsp. paratuberculosis
cggcuucgccgcgcuugcgaccg

SEQ ID NO: 2992326 - RNA, 16 nt, Mycobacterium avium subsp. paratuberculosis
cggcuucgcugcgccg

SEQ ID NO: 2992327 - RNA, 23 nt, Mycobacterium avium subsp. paratuberculosis
cggcuucgcugcgccggcgguau

SEQ ID NO: 2992328 - RNA, 17 nt, Mycobacterium avium subsp. paratuberculosis
cggcuucggccaagggg

SEQ ID NO: 2992329 - RNA, 15 nt, Mycobacterium avium subsp. paratuberculosis
cggcuucgucggguu

SEQ ID NO: 2992330 - RNA, 14 nt, Mycobacterium avium subsp. paratuberculosis
cggcuucucggcgu

SEQ ID NO: 2992331 - RNA, 15 nt, Mycobacterium avium subsp. paratuberculosis
cggcuucucggcgug

SEQ ID NO: 2992332 - RNA, 22 nt, Mycobacterium avium subsp. paratuberculosis
cggcuucucggcgugcccgccg

SEQ ID NO: 2992333 - RNA, 15 nt, Mycobacterium avium subsp. paratuberculosis
cggcuugaccggcuc

SEQ ID NO: 2992334 - RNA, 15 nt, Mycobacterium avium subsp. paratuberculosis
cggcuugagccggau

SEQ ID NO: 2992335 - RNA, 14 nt, Mycobacterium avium subsp. paratuberculosis
cggcuugagcgcca

SEQ ID NO: 2992336 - RNA, 17 nt, Mycobacterium avium subsp. paratuberculosis
cggcuugagcgccagcg

SEQ ID NO: 2992337 - RNA, 20 nt, Mycobacterium avium subsp. paratuberculosis
cggcuugagcgccagcgcgg

SEQ ID NO: 2992338 - RNA, 22 nt, Mycobacterium avium subsp. paratuberculosis
cggcuugaugaugcugucggug

SEQ ID NO: 2992339 - RNA, 14 nt, Mycobacterium avium subsp. paratuberculosis
cggcuugccccggu

SEQ ID NO: 2992340 - RNA, 15 nt, Mycobacterium avium subsp. paratuberculosis
cggcuugccccgguc

SEQ ID NO: 2992341 - RNA, 22 nt, Mycobacterium avium subsp. paratuberculosis
cggcuugccccggucccggggc

SEQ ID NO: 2992342 - RNA, 20 nt, Mycobacterium avium subsp. paratuberculosis
cggcuugccgaucgccgcgg

SEQ ID NO: 2992343 - RNA, 21 nt, Mycobacterium avium subsp. paratuberculosis
cggcuugccgaucgccgcggc

SEQ ID NO: 2992344 - RNA, 13 nt, Mycobacterium avium subsp. paratuberculosis
cggcuugccgccg

SEQ ID NO: 2992345 - RNA, 15 nt, Mycobacterium avium subsp. paratuberculosis
cggcuugccgccgca

SEQ ID NO: 2992346 - RNA, 17 nt, Mycobacterium avium subsp. paratuberculosis
cggcuugccgccgcagc

SEQ ID NO: 2992347 - RNA, 18 nt, Mycobacterium avium subsp. paratuberculosis
cggcuugcgcucggccgg

SEQ ID NO: 2992348 - RNA, 16 nt, Mycobacterium avium subsp. paratuberculosis
cggcuugcgucgcugu

SEQ ID NO: 2992349 - RNA, 19 nt, Mycobacterium avium subsp. paratuberculosis
cggcuugcgucgcugucgg

SEQ ID NO: 2992350 - RNA, 13 nt, Mycobacterium avium subsp. paratuberculosis
cggcuuggccacc

SEQ ID NO: 2992351 - RNA, 14 nt, Mycobacterium avium subsp. paratuberculosis
cggcuuggccacga

SEQ ID NO: 2992352 - RNA, 17 nt, Mycobacterium avium subsp. paratuberculosis
cggcuuggccacgauga

SEQ ID NO: 2992353 - RNA, 15 nt, Mycobacterium avium subsp. paratuberculosis
cggcuuggccgugca

SEQ ID NO: 2992354 - RNA, 16 nt, Mycobacterium avium subsp. paratuberculosis
cggcuuggccgugcag

SEQ ID NO: 2992355 - RNA, 16 nt, Mycobacterium avium subsp. paratuberculosis
cggcuuggcggugaug

SEQ ID NO: 2992356 - RNA, 21 nt, Mycobacterium avium subsp. paratuberculosis
cggcuugggcgaaucugucga

SEQ ID NO: 2992357 - RNA, 20 nt, Mycobacterium avium subsp. paratuberculosis
cggcuuggggaagccggcca

SEQ ID NO: 2992358 - RNA, 21 nt, Mycobacterium avium subsp. paratuberculosis
cggcuuggggaagccggccag

SEQ ID NO: 2992359 - RNA, 19 nt, Mycobacterium avium subsp. paratuberculosis
cggcuuggucaccagcucg

SEQ ID NO: 2992360 - RNA, 20 nt, Mycobacterium avium subsp. paratuberculosis
cggcuuggucaccagcucgc

SEQ ID NO: 2992361 - RNA, 17 nt, Mycobacterium avium subsp. paratuberculosis
cggcuuggugggcgccg

SEQ ID NO: 2992362 - RNA, 21 nt, Mycobacterium avium subsp. paratuberculosis
cggcuuucgaagagccggcgu

SEQ ID NO: 2992363 - RNA, 20 nt, Mycobacterium avium subsp. paratuberculosis
cggcuuuggugacgccgacg

SEQ ID NO: 2992364 - RNA, 20 nt, Mycobacterium avium subsp. paratuberculosis
cgggaaacccucgacgccgg

SEQ ID NO: 2992365 - RNA, 21 nt, Mycobacterium avium subsp. paratuberculosis
cgggaaaccggaugaugcccu

SEQ ID NO: 2992366 - RNA, 15 nt, Mycobacterium avium subsp. paratuberculosis
cgggaaacgcgucgc

SEQ ID NO: 2992367 - RNA, 21 nt, Mycobacterium avium subsp. paratuberculosis
cgggaaaguuguagcgcagca

SEQ ID NO: 2992368 - RNA, 15 nt, Mycobacterium avium subsp. paratuberculosis
cgggaaaucggaccc

SEQ ID NO: 2992369 - RNA, 19 nt, Mycobacterium avium subsp. paratuberculosis
cgggaaaucggacccagcc

SEQ ID NO: 2992370 - RNA, 18 nt, Mycobacterium avium subsp. paratuberculosis
cgggacgaggggcagcag

SEQ ID NO: 2992371 - RNA, 19 nt, Mycobacterium avium subsp. paratuberculosis
cgggacgaggggcagcagc

SEQ ID NO: 2992372 - RNA, 23 nt, Mycobacterium avium subsp. paratuberculosis
cgggacgaggggcagcagcgccc

SEQ ID NO: 2992373 - RNA, 20 nt, Mycobacterium avium subsp. paratuberculosis
cgggacgaucugcgucaugg

SEQ ID NO: 2992374 - RNA, 21 nt, Mycobacterium avium subsp. paratuberculosis
cgggacgaucugcgucaugga

SEQ ID NO: 2992375 - RNA, 13 nt, Mycobacterium avium subsp. paratuberculosis
cgggacgccacgg

SEQ ID NO: 2992376 - RNA, 15 nt, Mycobacterium avium subsp. paratuberculosis
cgggacgccacggcg

SEQ ID NO: 2992377 - RNA, 11 nt, Mycobacterium avium subsp. paratuberculosis
cgggacgccgu

SEQ ID NO: 2992378 - RNA, 14 nt, Mycobacterium avium subsp. paratuberculosis
cgggacgccugccg

SEQ ID NO: 2992379 - RNA, 16 nt, Mycobacterium avium subsp. paratuberculosis
cgggacgccugccgcc

SEQ ID NO: 2992380 - RNA, 19 nt, Mycobacterium avium subsp. paratuberculosis
cgggacgccugccgccuug

SEQ ID NO: 2992381 - RNA, 13 nt, Mycobacterium avium subsp. paratuberculosis
cgggacgcgcaga

SEQ ID NO: 2992382 - RNA, 20 nt, Mycobacterium avium subsp. paratuberculosis
cgggacgcgcagaucgucga

SEQ ID NO: 2992383 - RNA, 21 nt, Mycobacterium avium subsp. paratuberculosis
cgggacgcgcagaucgucgaa

SEQ ID NO: 2992384 - RNA, 18 nt, Mycobacterium avium subsp. paratuberculosis
cgggacgcggcaggcgcc

SEQ ID NO: 2992385 - RNA, 13 nt, Mycobacterium avium subsp. paratuberculosis
cgggacgcggucc

SEQ ID NO: 2992386 - RNA, 16 nt, Mycobacterium avium subsp. paratuberculosis
cgggacgcgguccagc

SEQ ID NO: 2992387 - RNA, 12 nt, Mycobacterium avium subsp. paratuberculosis
cgggacggccag

SEQ ID NO: 2992388 - RNA, 16 nt, Mycobacterium avium subsp. paratuberculosis
cgggacggccagcagg

SEQ ID NO: 2992389 - RNA, 15 nt, Mycobacterium avium subsp. paratuberculosis
cgggacgggggugcc

SEQ ID NO: 2992390 - RNA, 18 nt, Mycobacterium avium subsp. paratuberculosis
cgggacgggggugccgac

SEQ ID NO: 2992391 - RNA, 20 nt, Mycobacterium avium subsp. paratuberculosis
cgggacgggggugccgaccg

SEQ ID NO: 2992392 - RNA, 19 nt, Mycobacterium avium subsp. paratuberculosis
cgggacggguugcaggcca

SEQ ID NO: 2992393 - RNA, 21 nt, Mycobacterium avium subsp. paratuberculosis
cgggacggguugcaggccacg

SEQ ID NO: 2992394 - RNA, 15 nt, Mycobacterium avium subsp. paratuberculosis
cgggacguccgcgcg

SEQ ID NO: 2992395 - RNA, 15 nt, Mycobacterium avium subsp. paratuberculosis
cgggacgucggcgcg

SEQ ID NO: 2992396 - RNA, 16 nt, Mycobacterium avium subsp. paratuberculosis
cgggacgucggcgcgc

SEQ ID NO: 2992397 - RNA, 17 nt, Mycobacterium avium subsp. paratuberculosis
cgggacgucggcgcgcu

SEQ ID NO: 2992398 - RNA, 18 nt, Mycobacterium avium subsp. paratuberculosis
cgggacgucggcgcgcuc

SEQ ID NO: 2992399 - RNA, 19 nt, Mycobacterium avium subsp. paratuberculosis
cgggacgucggcgcgcucg

SEQ ID NO: 2992400 - RNA, 16 nt, Mycobacterium avium subsp. paratuberculosis
cgggacguggcucagc

SEQ ID NO: 2992401 - RNA, 20 nt, Mycobacterium avium subsp. paratuberculosis
cgggacguggcucagcggca

SEQ ID NO: 2992402 - RNA, 22 nt, Mycobacterium avium subsp. paratuberculosis
cgggacguggcucagcggcagg

SEQ ID NO: 2992403 - RNA, 12 nt, Mycobacterium avium subsp. paratuberculosis
cgggacguuguc

SEQ ID NO: 2992404 - RNA, 20 nt, Mycobacterium avium subsp. paratuberculosis
cgggacugggcgauugcguu

SEQ ID NO: 2992405 - RNA, 19 nt, Mycobacterium avium subsp. paratuberculosis
cgggagaaccucaacguga

SEQ ID NO: 2992406 - RNA, 19 nt, Mycobacterium avium subsp. paratuberculosis
cgggagaacucgacgaucu

SEQ ID NO: 2992407 - RNA, 13 nt, Mycobacterium avium subsp. paratuberculosis
cgggagacgcugu

SEQ ID NO: 2992408 - RNA, 15 nt, Mycobacterium avium subsp. paratuberculosis
cgggagacgcugugc

SEQ ID NO: 2992409 - RNA, 16 nt, Mycobacterium avium subsp. paratuberculosis
cgggagagcgcgggca

SEQ ID NO: 2992410 - RNA, 18 nt, Mycobacterium avium subsp. paratuberculosis
cgggagagcgcgggcacc

SEQ ID NO: 2992411 - RNA, 21 nt, Mycobacterium avium subsp. paratuberculosis
cgggagagcgcgggcaccguc

SEQ ID NO: 2992412 - RNA, 21 nt, Mycobacterium avium subsp. paratuberculosis
cgggagauacggucgcaccgc

SEQ ID NO: 2992413 - RNA, 22 nt, Mycobacterium avium subsp. paratuberculosis
cgggagauacggucgcaccgcg

SEQ ID NO: 2992414 - RNA, 14 nt, Mycobacterium avium subsp. paratuberculosis
cgggagcaaggucg

SEQ ID NO: 2992415 - RNA, 19 nt, Mycobacterium avium subsp. paratuberculosis
cgggagcaaggucgucgcg

SEQ ID NO: 2992416 - RNA, 21 nt, Mycobacterium avium subsp. paratuberculosis
cgggagcaaggucgucgcggc

SEQ ID NO: 2992417 - RNA, 12 nt, Mycobacterium avium subsp. paratuberculosis
cgggagcaucgg

SEQ ID NO: 2992418 - RNA, 14 nt, Mycobacterium avium subsp. paratuberculosis
cgggagccggccag

SEQ ID NO: 2992419 - RNA, 15 nt, Mycobacterium avium subsp. paratuberculosis
cgggagccggccagg

SEQ ID NO: 2992420 - RNA, 18 nt, Mycobacterium avium subsp. paratuberculosis
cgggagccggccagguug

SEQ ID NO: 2992421 - RNA, 18 nt, Mycobacterium avium subsp. paratuberculosis
cgggagccggcggcggug

SEQ ID NO: 2992422 - RNA, 19 nt, Mycobacterium avium subsp. paratuberculosis
cgggagccggcggcggugc

SEQ ID NO: 2992423 - RNA, 17 nt, Mycobacterium avium subsp. paratuberculosis
cgggagcuaggcggccg

SEQ ID NO: 2992424 - RNA, 18 nt, Mycobacterium avium subsp. paratuberculosis
cgggagcuaggcggccgg

SEQ ID NO: 2992425 - RNA, 14 nt, Mycobacterium avium subsp. paratuberculosis
cgggaggcagcgcg

SEQ ID NO: 2992426 - RNA, 15 nt, Mycobacterium avium subsp. paratuberculosis
cgggaggcagcgcgg

SEQ ID NO: 2992427 - RNA, 16 nt, Mycobacterium avium subsp. paratuberculosis
cgggaggccagcaccu

SEQ ID NO: 2992428 - RNA, 13 nt, Mycobacterium avium subsp. paratuberculosis
cgggaggcccagu

SEQ ID NO: 2992429 - RNA, 17 nt, Mycobacterium avium subsp. paratuberculosis
cgggaggcccaguagcg

SEQ ID NO: 2992430 - RNA, 15 nt, Mycobacterium avium subsp. paratuberculosis
cgggaguccacgccg

SEQ ID NO: 2992431 - RNA, 18 nt, Mycobacterium avium subsp. paratuberculosis
cgggagucgggcccgccc

SEQ ID NO: 2992432 - RNA, 15 nt, Mycobacterium avium subsp. paratuberculosis
cgggagugcggccca

SEQ ID NO: 2992433 - RNA, 18 nt, Mycobacterium avium subsp. paratuberculosis
cgggagugcggcccaccc

SEQ ID NO: 2992434 - RNA, 20 nt, Mycobacterium avium subsp. paratuberculosis
cgggagugcggcccacccgg

SEQ ID NO: 2992435 - RNA, 19 nt, Mycobacterium avium subsp. paratuberculosis
cgggagugcuggacggccc

SEQ ID NO: 2992436 - RNA, 22 nt, Mycobacterium avium subsp. paratuberculosis
cgggagugcuggacggcccgac

SEQ ID NO: 2992437 - RNA, 15 nt, Mycobacterium avium subsp. paratuberculosis
cgggaguggccggcg

SEQ ID NO: 2992438 - RNA, 19 nt, Mycobacterium avium subsp. paratuberculosis
cgggaguggccggcgucca

SEQ ID NO: 2992439 - RNA, 18 nt, Mycobacterium avium subsp. paratuberculosis
cgggauaacccagcacca

SEQ ID NO: 2992440 - RNA, 16 nt, Mycobacterium avium subsp. paratuberculosis
cgggauacccaugauc

SEQ ID NO: 2992441 - RNA, 15 nt, Mycobacterium avium subsp. paratuberculosis
cgggauaccgcgacc

SEQ ID NO: 2992442 - RNA, 14 nt, Mycobacterium avium subsp. paratuberculosis
cgggauagagcacc

SEQ ID NO: 2992443 - RNA, 18 nt, Mycobacterium avium subsp. paratuberculosis
cgggauagagcaccgcgc

SEQ ID NO: 2992444 - RNA, 19 nt, Mycobacterium avium subsp. paratuberculosis
cgggauagagcaccgcgcu

SEQ ID NO: 2992445 - RNA, 16 nt, Mycobacterium avium subsp. paratuberculosis
cgggauagccgagcgg

SEQ ID NO: 2992446 - RNA, 17 nt, Mycobacterium avium subsp. paratuberculosis
cgggauagccgagcggc

SEQ ID NO: 2992447 - RNA, 20 nt, Mycobacterium avium subsp. paratuberculosis
cgggauagccgagcggcgcc

SEQ ID NO: 2992448 - RNA, 21 nt, Mycobacterium avium subsp. paratuberculosis
cgggauagccgagcggcgcca

SEQ ID NO: 2992449 - RNA, 17 nt, Mycobacterium avium subsp. paratuberculosis
cgggauagggcgcgucg

SEQ ID NO: 2992450 - RNA, 18 nt, Mycobacterium avium subsp. paratuberculosis
cgggauagggcgcgucga

SEQ ID NO: 2992451 - RNA, 16 nt, Mycobacterium avium subsp. paratuberculosis
cgggauaguucgccgc

SEQ ID NO: 2992452 - RNA, 17 nt, Mycobacterium avium subsp. paratuberculosis
cgggauaguucgccgcc

SEQ ID NO: 2992453 - RNA, 18 nt, Mycobacterium avium subsp. paratuberculosis
cgggauaguucgccgccg

SEQ ID NO: 2992454 - RNA, 23 nt, Mycobacterium avium subsp. paratuberculosis
cgggauaguucgccgccgccagc

SEQ ID NO: 2992455 - RNA, 21 nt, Mycobacterium avium subsp. paratuberculosis
cggcggccuugaacgcguccg

SEQ ID NO: 2992456 - RNA, 23 nt, Mycobacterium avium subsp. paratuberculosis
cggcggccuugaacgcguccgac

SEQ ID NO: 2992457 - RNA, 23 nt, Mycobacterium avium subsp. paratuberculosis
cggcggccuuuuucugcgcccga

SEQ ID NO: 2992458 - RNA, 20 nt, Mycobacterium avium subsp. paratuberculosis
cggcggcgaacaggcccugc

SEQ ID NO: 2992459 - RNA, 14 nt, Mycobacterium avium subsp. paratuberculosis
cggcggcgaacgcc

SEQ ID NO: 2992460 - RNA, 14 nt, Mycobacterium avium subsp. paratuberculosis
cggcggcgaagacg

SEQ ID NO: 2992461 - RNA, 14 nt, Mycobacterium avium subsp. paratuberculosis
cggcggcgaagccg

SEQ ID NO: 2992462 - RNA, 19 nt, Mycobacterium avium subsp. paratuberculosis
cggcggcgaagccggcccc

SEQ ID NO: 2992463 - RNA, 16 nt, Mycobacterium avium subsp. paratuberculosis
cggcggcgacgaugcg

SEQ ID NO: 2992464 - RNA, 12 nt, Mycobacterium avium subsp. paratuberculosis
cggcggcgacgg

SEQ ID NO: 2992465 - RNA, 15 nt, Mycobacterium avium subsp. paratuberculosis
cggcggcgacggcga

SEQ ID NO: 2992466 - RNA, 16 nt, Mycobacterium avium subsp. paratuberculosis
cggcggcgacggcgac

SEQ ID NO: 2992467 - RNA, 15 nt, Mycobacterium avium subsp. paratuberculosis
cggcggcgacgucga

SEQ ID NO: 2992468 - RNA, 18 nt, Mycobacterium avium subsp. paratuberculosis
cggcggcgacgucgacgg

SEQ ID NO: 2992469 - RNA, 13 nt, Mycobacterium avium subsp. paratuberculosis
cggcggcgacgug

SEQ ID NO: 2992470 - RNA, 14 nt, Mycobacterium avium subsp. paratuberculosis
cggcggcgacguga

SEQ ID NO: 2992471 - RNA, 20 nt, Mycobacterium avium subsp. paratuberculosis
cggcggcgacgugaucggcg

SEQ ID NO: 2992472 - RNA, 14 nt, Mycobacterium avium subsp. paratuberculosis
cggcggcgaggacg

SEQ ID NO: 2992473 - RNA, 23 nt, Mycobacterium avium subsp. paratuberculosis
cggcggcgaggacgucgucgacg

SEQ ID NO: 2992474 - RNA, 13 nt, Mycobacterium avium subsp. paratuberculosis
cggcggcgauccg

SEQ ID NO: 2992475 - RNA, 15 nt, Mycobacterium avium subsp. paratuberculosis
cggcggcgaucggcg

SEQ ID NO: 2992476 - RNA, 12 nt, Mycobacterium avium subsp. paratuberculosis
cggcggcgauga

SEQ ID NO: 2992477 - RNA, 14 nt, Mycobacterium avium subsp. paratuberculosis
cggcggcgaugauc

SEQ ID NO: 2992478 - RNA, 13 nt, Mycobacterium avium subsp. paratuberculosis
cggcggcgcaggc

SEQ ID NO: 2992479 - RNA, 13 nt, Mycobacterium avium subsp. paratuberculosis
cggcggcgccaug

SEQ ID NO: 2992480 - RNA, 22 nt, Mycobacterium avium subsp. paratuberculosis
cggcggcgccaugaacggcggg

SEQ ID NO: 2992481 - RNA, 15 nt, Mycobacterium avium subsp. paratuberculosis
cggcggcgcccgcgg

SEQ ID NO: 2992482 - RNA, 12 nt, Mycobacterium avium subsp. paratuberculosis
cggcggcgcccu

SEQ ID NO: 2992483 - RNA, 14 nt, Mycobacterium avium subsp. paratuberculosis
cggcggcgcccugc

SEQ ID NO: 2992484 - RNA, 16 nt, Mycobacterium avium subsp. paratuberculosis
cggcggcgccgacggg

SEQ ID NO: 2992485 - RNA, 14 nt, Mycobacterium avium subsp. paratuberculosis
cggcggcgccgcag

SEQ ID NO: 2992486 - RNA, 15 nt, Mycobacterium avium subsp. paratuberculosis
cggcggcgccgcagc

SEQ ID NO: 2992487 - RNA, 18 nt, Mycobacterium avium subsp. paratuberculosis
cggcggcgccgcagcacg

SEQ ID NO: 2992488 - RNA, 19 nt, Mycobacterium avium subsp. paratuberculosis
cggcggcgccgcagcacgc

SEQ ID NO: 2992489 - RNA, 15 nt, Mycobacterium avium subsp. paratuberculosis
cggcggcgccggggc

SEQ ID NO: 2992490 - RNA, 17 nt, Mycobacterium avium subsp. paratuberculosis
cggcggcgccgucgccg

SEQ ID NO: 2992491 - RNA, 17 nt, Mycobacterium avium subsp. paratuberculosis
cggcggcgccgucgucg

SEQ ID NO: 2992492 - RNA, 18 nt, Mycobacterium avium subsp. paratuberculosis
cggcggcgccuugccggu

SEQ ID NO: 2992493 - RNA, 19 nt, Mycobacterium avium subsp. paratuberculosis
cggcggcgccuugccgguc

SEQ ID NO: 2992494 - RNA, 14 nt, Mycobacterium avium subsp. paratuberculosis
cggcggcgcgcacg

SEQ ID NO: 2992495 - RNA, 22 nt, Mycobacterium avium subsp. paratuberculosis
cggcggcgcgcacgucaccgcg

SEQ ID NO: 2992496 - RNA, 13 nt, Mycobacterium avium subsp. paratuberculosis
cggcggcgcgcag

SEQ ID NO: 2992497 - RNA, 15 nt, Mycobacterium avium subsp. paratuberculosis
cggcggcgcgcaggc

SEQ ID NO: 2992498 - RNA, 13 nt, Mycobacterium avium subsp. paratuberculosis
cggcggcgcgccg

SEQ ID NO: 2992499 - RNA, 15 nt, Mycobacterium avium subsp. paratuberculosis
cggcggcgcgccggc

SEQ ID NO: 2992500 - RNA, 21 nt, Mycobacterium avium subsp. paratuberculosis
cggcggcgcgccggccggagc

SEQ ID NO: 2992501 - RNA, 13 nt, Mycobacterium avium subsp. paratuberculosis
cggcggcgcgcug

SEQ ID NO: 2992502 - RNA, 14 nt, Mycobacterium avium subsp. paratuberculosis
cggcggcgcgcugc

SEQ ID NO: 2992503 - RNA, 16 nt, Mycobacterium avium subsp. paratuberculosis
cggcggcgcgcugcag

SEQ ID NO: 2992504 - RNA, 12 nt, Mycobacterium avium subsp. paratuberculosis
cggcggcgcggc

SEQ ID NO: 2992505 - RNA, 13 nt, Mycobacterium avium subsp. paratuberculosis
cggcggcgcggca

SEQ ID NO: 2992506 - RNA, 14 nt, Mycobacterium avium subsp. paratuberculosis
cggcggcgcggcag

SEQ ID NO: 2992507 - RNA, 17 nt, Mycobacterium avium subsp. paratuberculosis
cggcggcgcggcccagg

SEQ ID NO: 2992508 - RNA, 15 nt, Mycobacterium avium subsp. paratuberculosis
cggcggcgcgggcgc

SEQ ID NO: 2992509 - RNA, 16 nt, Mycobacterium avium subsp. paratuberculosis
cggcggcgcgggcggc

SEQ ID NO: 2992510 - RNA, 13 nt, Mycobacterium avium subsp. paratuberculosis
cggcggcgcgugc

SEQ ID NO: 2992511 - RNA, 14 nt, Mycobacterium avium subsp. paratuberculosis
cggcggcgcgugcg

SEQ ID NO: 2992512 - RNA, 20 nt, Mycobacterium avium subsp. paratuberculosis
cggcggcgcgugcgccgcgg

SEQ ID NO: 2992513 - RNA, 17 nt, Mycobacterium avium subsp. paratuberculosis
cggcggcgcucagcgcg

SEQ ID NO: 2992514 - RNA, 18 nt, Mycobacterium avium subsp. paratuberculosis
cggcggcgcucagcgcgg

SEQ ID NO: 2992515 - RNA, 21 nt, Mycobacterium avium subsp. paratuberculosis
cggcggcgcucagcgcggcgg

SEQ ID NO: 2992516 - RNA, 15 nt, Mycobacterium avium subsp. paratuberculosis
cggcggcgcugaugc

SEQ ID NO: 2992517 - RNA, 17 nt, Mycobacterium avium subsp. paratuberculosis
cggcggcgcugaugccg

SEQ ID NO: 2992518 - RNA, 19 nt, Mycobacterium avium subsp. paratuberculosis
cggcggcgcugaugccguc

SEQ ID NO: 2992519 - RNA, 13 nt, Mycobacterium avium subsp. paratuberculosis
cggcggcgcugcc

SEQ ID NO: 2992520 - RNA, 13 nt, Mycobacterium avium subsp. paratuberculosis
cggcggcgcuggu

SEQ ID NO: 2992521 - RNA, 16 nt, Mycobacterium avium subsp. paratuberculosis
cggcggcgcuggucgg

SEQ ID NO: 2992522 - RNA, 20 nt, Mycobacterium avium subsp. paratuberculosis
cggcgggcaccucggccagg

SEQ ID NO: 2992523 - RNA, 21 nt, Mycobacterium avium subsp. paratuberculosis
cggcgggcaccucggccaggu

SEQ ID NO: 2992524 - RNA, 14 nt, Mycobacterium avium subsp. paratuberculosis
cggcgggcaggccg

SEQ ID NO: 2992525 - RNA, 15 nt, Mycobacterium avium subsp. paratuberculosis
cggcgggcauacugc

SEQ ID NO: 2992526 - RNA, 16 nt, Mycobacterium avium subsp. paratuberculosis
cggcgggcaucaucgc

SEQ ID NO: 2992527 - RNA, 13 nt, Mycobacterium avium subsp. paratuberculosis
cggcgggccagau

SEQ ID NO: 2992528 - RNA, 19 nt, Mycobacterium avium subsp. paratuberculosis
cggcgggccagcucgucga

SEQ ID NO: 2992529 - RNA, 21 nt, Mycobacterium avium subsp. paratuberculosis
cggcgggccagcucgucgagc

SEQ ID NO: 2992530 - RNA, 21 nt, Mycobacterium avium subsp. paratuberculosis
cggcgggccagggcgaggacg

SEQ ID NO: 2992531 - RNA, 22 nt, Mycobacterium avium subsp. paratuberculosis
cggcgggccagggcgaggacgg

SEQ ID NO: 2992532 - RNA, 18 nt, Mycobacterium avium subsp. paratuberculosis
cggcgggccagucgccgc

SEQ ID NO: 2992533 - RNA, 15 nt, Mycobacterium avium subsp. paratuberculosis
cggcgggcccagcag

SEQ ID NO: 2992534 - RNA, 14 nt, Mycobacterium avium subsp. paratuberculosis
cggcgggcccgcag

SEQ ID NO: 2992535 - RNA, 23 nt, Mycobacterium avium subsp. paratuberculosis
cggcgggcccgcagcucggagua

SEQ ID NO: 2992536 - RNA, 13 nt, Mycobacterium avium subsp. paratuberculosis
cggcgggcccggc

SEQ ID NO: 2992537 - RNA, 18 nt, Mycobacterium avium subsp. paratuberculosis
cggcgggcccggcgaugc

SEQ ID NO: 2992538 - RNA, 19 nt, Mycobacterium avium subsp. paratuberculosis
cggcgggcccggcgaugcg

SEQ ID NO: 2992539 - RNA, 17 nt, Mycobacterium avium subsp. paratuberculosis
cggcgggcccgucgccg

SEQ ID NO: 2992540 - RNA, 18 nt, Mycobacterium avium subsp. paratuberculosis
cggcgggcccgucgccgg

SEQ ID NO: 2992541 - RNA, 18 nt, Mycobacterium avium subsp. paratuberculosis
cggccggccccuaccgcc

SEQ ID NO: 2992542 - RNA, 19 nt, Mycobacterium avium subsp. paratuberculosis
cggccggccccuaccgccg

SEQ ID NO: 2992543 - RNA, 22 nt, Mycobacterium avium subsp. paratuberculosis
cggccggccccuaccgccgagc

SEQ ID NO: 2992544 - RNA, 23 nt, Mycobacterium avium subsp. paratuberculosis
cggccggccccuaccgccgagcg

SEQ ID NO: 2992545 - RNA, 14 nt, Mycobacterium avium subsp. paratuberculosis
cggccggcccgccc

SEQ ID NO: 2992546 - RNA, 15 nt, Mycobacterium avium subsp. paratuberculosis
cggccggcccgcccg

SEQ ID NO: 2992547 - RNA, 16 nt, Mycobacterium avium subsp. paratuberculosis
cggccggcccgcccgg

SEQ ID NO: 2992548 - RNA, 21 nt, Mycobacterium avium subsp. paratuberculosis
cggccggcccgcccggcggcg

SEQ ID NO: 2992549 - RNA, 15 nt, Mycobacterium avium subsp. paratuberculosis
cggccggcccggccc

SEQ ID NO: 2992550 - RNA, 18 nt, Mycobacterium avium subsp. paratuberculosis
cggccggcccugcacgca

SEQ ID NO: 2992551 - RNA, 13 nt, Mycobacterium avium subsp. paratuberculosis
cggccggccgaac

SEQ ID NO: 2992552 - RNA, 14 nt, Mycobacterium avium subsp. paratuberculosis
cggccggccgaaca

SEQ ID NO: 2992553 - RNA, 19 nt, Mycobacterium avium subsp. paratuberculosis
cggccggccgacaccccga

SEQ ID NO: 2992554 - RNA, 13 nt, Mycobacterium avium subsp. paratuberculosis
cggccggccgccg

SEQ ID NO: 2992555 - RNA, 16 nt, Mycobacterium avium subsp. paratuberculosis
cggccggccgccggcg

SEQ ID NO: 2992556 - RNA, 22 nt, Mycobacterium avium subsp. paratuberculosis
cggccggccgccuggacgacgu

SEQ ID NO: 2992557 - RNA, 14 nt, Mycobacterium avium subsp. paratuberculosis
cggccggccgcgcc

SEQ ID NO: 2992558 - RNA, 15 nt, Mycobacterium avium subsp. paratuberculosis
cggccggccgcgccc

SEQ ID NO: 2992559 - RNA, 21 nt, Mycobacterium avium subsp. paratuberculosis
cggccggccgcgcccaucgcg

SEQ ID NO: 2992560 - RNA, 17 nt, Mycobacterium avium subsp. paratuberculosis
cggccggccgcgcgcgg

SEQ ID NO: 2992561 - RNA, 15 nt, Mycobacterium avium subsp. paratuberculosis
cggccggccggccgu

SEQ ID NO: 2992562 - RNA, 15 nt, Mycobacterium avium subsp. paratuberculosis
cggccggccggccug

SEQ ID NO: 2992563 - RNA, 17 nt, Mycobacterium avium subsp. paratuberculosis
cggccggccggccuggu

SEQ ID NO: 2992564 - RNA, 15 nt, Mycobacterium avium subsp. paratuberculosis
cggccggccgugccg

SEQ ID NO: 2992565 - RNA, 15 nt, Mycobacterium avium subsp. paratuberculosis
cggccggccuggugc

SEQ ID NO: 2992566 - RNA, 11 nt, Mycobacterium avium subsp. paratuberculosis
cggccggcgaa

SEQ ID NO: 2992567 - RNA, 21 nt, Mycobacterium avium subsp. paratuberculosis
cggccggcgaaacacagcagc

SEQ ID NO: 2992568 - RNA, 13 nt, Mycobacterium avium subsp. paratuberculosis
cggccggcgaagc

SEQ ID NO: 2992569 - RNA, 18 nt, Mycobacterium avium subsp. paratuberculosis
cggccggcgacgccgcgc

SEQ ID NO: 2992570 - RNA, 21 nt, Mycobacterium avium subsp. paratuberculosis
cggccggcgacgccgcgcugg

SEQ ID NO: 2992571 - RNA, 12 nt, Mycobacterium avium subsp. paratuberculosis
cggccggcgagg

SEQ ID NO: 2992572 - RNA, 14 nt, Mycobacterium avium subsp. paratuberculosis
cggccggcgaggaa

SEQ ID NO: 2992573 - RNA, 16 nt, Mycobacterium avium subsp. paratuberculosis
cggccggcgagucgcg

SEQ ID NO: 2992574 - RNA, 21 nt, Mycobacterium avium subsp. paratuberculosis
cggccggcgagucgcggauca

SEQ ID NO: 2992575 - RNA, 13 nt, Mycobacterium avium subsp. paratuberculosis
cggccggcgcagc

SEQ ID NO: 2992576 - RNA, 15 nt, Mycobacterium avium subsp. paratuberculosis
cggccggcgcagccg

SEQ ID NO: 2992577 - RNA, 19 nt, Mycobacterium avium subsp. paratuberculosis
cggccggcgcagccggcca

SEQ ID NO: 2992578 - RNA, 16 nt, Mycobacterium avium subsp. paratuberculosis
cggccggcgccgaccg

SEQ ID NO: 2992579 - RNA, 17 nt, Mycobacterium avium subsp. paratuberculosis
cggccggcgccgaccga

SEQ ID NO: 2992580 - RNA, 14 nt, Mycobacterium avium subsp. paratuberculosis
cggccggcgccgcc

SEQ ID NO: 2992581 - RNA, 15 nt, Mycobacterium avium subsp. paratuberculosis
cggccggcgccgccg

SEQ ID NO: 2992582 - RNA, 16 nt, Mycobacterium avium subsp. paratuberculosis
cggccggcgccgccgg

SEQ ID NO: 2992583 - RNA, 17 nt, Mycobacterium avium subsp. paratuberculosis
cggccggcgccgccggg

SEQ ID NO: 2992584 - RNA, 16 nt, Mycobacterium avium subsp. paratuberculosis
cggccggcgccggcgg

SEQ ID NO: 2992585 - RNA, 15 nt, Mycobacterium avium subsp. paratuberculosis
cggccggcgcgacca

SEQ ID NO: 2992586 - RNA, 18 nt, Mycobacterium avium subsp. paratuberculosis
cggccggcgcgaccagcg

SEQ ID NO: 2992587 - RNA, 20 nt, Mycobacterium avium subsp. paratuberculosis
cggccggcgcgaccagcggc

SEQ ID NO: 2992588 - RNA, 13 nt, Mycobacterium avium subsp. paratuberculosis
cggccggcgcgca

SEQ ID NO: 2992589 - RNA, 14 nt, Mycobacterium avium subsp. paratuberculosis
cggccggcgcgcac

SEQ ID NO: 2992590 - RNA, 20 nt, Mycobacterium avium subsp. paratuberculosis
cggccggcgcgcacggcagc

SEQ ID NO: 2992591 - RNA, 12 nt, Mycobacterium avium subsp. paratuberculosis
cggccggcgcgg

SEQ ID NO: 2992592 - RNA, 22 nt, Mycobacterium avium subsp. paratuberculosis
cggccggcggacgcggccagcg

SEQ ID NO: 2992593 - RNA, 14 nt, Mycobacterium avium subsp. paratuberculosis
cggccggcggcagu

SEQ ID NO: 2992594 - RNA, 21 nt, Mycobacterium avium subsp. paratuberculosis
cggccggcggcaguccggcga

SEQ ID NO: 2992595 - RNA, 22 nt, Mycobacterium avium subsp. paratuberculosis
cggccggcggcaguccggcgag

SEQ ID NO: 2992596 - RNA, 22 nt, Mycobacterium avium subsp. paratuberculosis
cggccggcggcagugcgccguc

SEQ ID NO: 2992597 - RNA, 12 nt, Mycobacterium avium subsp. paratuberculosis
cggccggcggcg

SEQ ID NO: 2992598 - RNA, 13 nt, Mycobacterium avium subsp. paratuberculosis
cggccggcggcgg

SEQ ID NO: 2992599 - RNA, 15 nt, Mycobacterium avium subsp. paratuberculosis
cggccggcggcgguu

SEQ ID NO: 2992600 - RNA, 14 nt, Mycobacterium avium subsp. paratuberculosis
cggccggcggcguc

SEQ ID NO: 2992601 - RNA, 20 nt, Mycobacterium avium subsp. paratuberculosis
cggccggcggcgucgugacc

SEQ ID NO: 2992602 - RNA, 11 nt, Mycobacterium avium subsp. paratuberculosis
cggccggcggg

SEQ ID NO: 2992603 - RNA, 13 nt, Mycobacterium avium subsp. paratuberculosis
cggccggcgggca

SEQ ID NO: 2992604 - RNA, 16 nt, Mycobacterium avium subsp. paratuberculosis
cggccggcgggcagca

SEQ ID NO: 2992605 - RNA, 13 nt, Mycobacterium avium subsp. paratuberculosis
cggccggcggggc

SEQ ID NO: 2992606 - RNA, 12 nt, Mycobacterium avium subsp. paratuberculosis
cggccggcgggu

SEQ ID NO: 2992607 - RNA, 13 nt, Mycobacterium avium subsp. paratuberculosis
cggccggcggguu

SEQ ID NO: 2992608 - RNA, 15 nt, Mycobacterium avium subsp. paratuberculosis
cggccggcggugucg

SEQ ID NO: 2992609 - RNA, 14 nt, Mycobacterium avium subsp. paratuberculosis
cggccggcgucacu

SEQ ID NO: 2992610 - RNA, 17 nt, Mycobacterium avium subsp. paratuberculosis
cggccggcgucacucug

SEQ ID NO: 2992611 - RNA, 19 nt, Mycobacterium avium subsp. paratuberculosis
cggccggcgucacucuggc

SEQ ID NO: 2992612 - RNA, 12 nt, Mycobacterium avium subsp. paratuberculosis
cggccggcgugg

SEQ ID NO: 2992613 - RNA, 15 nt, Mycobacterium avium subsp. paratuberculosis
cggccggcugcagcc

SEQ ID NO: 2992614 - RNA, 16 nt, Mycobacterium avium subsp. paratuberculosis
cggccggcugcagccg

SEQ ID NO: 2992615 - RNA, 21 nt, Mycobacterium avium subsp. paratuberculosis
cggccgcguacuucgcgcccu

SEQ ID NO: 2992616 - RNA, 22 nt, Mycobacterium avium subsp. paratuberculosis
cggccgcguacuucgcgcccug

SEQ ID NO: 2992617 - RNA, 23 nt, Mycobacterium avium subsp. paratuberculosis
cggccgcguacuucgcgcccugg

SEQ ID NO: 2992618 - RNA, 15 nt, Mycobacterium avium subsp. paratuberculosis
cggccgcguccucgc

SEQ ID NO: 2992619 - RNA, 17 nt, Mycobacterium avium subsp. paratuberculosis
cggccgcguccucgccg

SEQ ID NO: 2992620 - RNA, 14 nt, Mycobacterium avium subsp. paratuberculosis
cggccgcgucgccg

SEQ ID NO: 2992621 - RNA, 17 nt, Mycobacterium avium subsp. paratuberculosis
cggccgcgucgccgacc

SEQ ID NO: 2992622 - RNA, 18 nt, Mycobacterium avium subsp. paratuberculosis
cggccgcgucgccgacca

SEQ ID NO: 2992623 - RNA, 19 nt, Mycobacterium avium subsp. paratuberculosis
cggccgcgucgccgaccag

SEQ ID NO: 2992624 - RNA, 20 nt, Mycobacterium avium subsp. paratuberculosis
cggccgcgucgccgaccagc

SEQ ID NO: 2992625 - RNA, 22 nt, Mycobacterium avium subsp. paratuberculosis
cggccgcgucgccgaccagcag

SEQ ID NO: 2992626 - RNA, 23 nt, Mycobacterium avium subsp. paratuberculosis
cggccgcgucgccgaccagcagg

SEQ ID NO: 2992627 - RNA, 13 nt, Mycobacterium avium subsp. paratuberculosis
cggccgcgucggc

SEQ ID NO: 2992628 - RNA, 17 nt, Mycobacterium avium subsp. paratuberculosis
cggccgcgucggcggcg

SEQ ID NO: 2992629 - RNA, 16 nt, Mycobacterium avium subsp. paratuberculosis
cggccgcgucggcggu

SEQ ID NO: 2992630 - RNA, 15 nt, Mycobacterium avium subsp. paratuberculosis
cggccgcgucgggca

SEQ ID NO: 2992631 - RNA, 16 nt, Mycobacterium avium subsp. paratuberculosis
cggccgcgucgggcag

SEQ ID NO: 2992632 - RNA, 14 nt, Mycobacterium avium subsp. paratuberculosis
cggccgcgugcacc

SEQ ID NO: 2992633 - RNA, 19 nt, Mycobacterium avium subsp. paratuberculosis
cggccgcguugucgaccac

SEQ ID NO: 2992634 - RNA, 21 nt, Mycobacterium avium subsp. paratuberculosis
cggccgcguugucgaccacca

SEQ ID NO: 2992635 - RNA, 15 nt, Mycobacterium avium subsp. paratuberculosis
cggccgcuacccggc

SEQ ID NO: 2992636 - RNA, 19 nt, Mycobacterium avium subsp. paratuberculosis
cggccgcuacccggcgaac

SEQ ID NO: 2992637 - RNA, 14 nt, Mycobacterium avium subsp. paratuberculosis
cggccgcucagcgg

SEQ ID NO: 2992638 - RNA, 16 nt, Mycobacterium avium subsp. paratuberculosis
cggccgcucagcgggc

SEQ ID NO: 2992639 - RNA, 22 nt, Mycobacterium avium subsp. paratuberculosis
cggccgcucagcgggcggccag

SEQ ID NO: 2992640 - RNA, 23 nt, Mycobacterium avium subsp. paratuberculosis
cggccgcucagcgggcggccagc

SEQ ID NO: 2992641 - RNA, 14 nt, Mycobacterium avium subsp. paratuberculosis
cggccgcucgcggg

SEQ ID NO: 2992642 - RNA, 15 nt, Mycobacterium avium subsp. paratuberculosis
cggccgcucgcgggc

SEQ ID NO: 2992643 - RNA, 20 nt, Mycobacterium avium subsp. paratuberculosis
cggccgcucgcgggccacag

SEQ ID NO: 2992644 - RNA, 21 nt, Mycobacterium avium subsp. paratuberculosis
cggccgcucgggugucgccga

SEQ ID NO: 2992645 - RNA, 23 nt, Mycobacterium avium subsp. paratuberculosis
cggccgcucgggugucgccgagc

SEQ ID NO: 2992646 - RNA, 16 nt, Mycobacterium avium subsp. paratuberculosis
cggccgcugcccgggc

SEQ ID NO: 2992647 - RNA, 18 nt, Mycobacterium avium subsp. paratuberculosis
cggccgcugcccgggcau

SEQ ID NO: 2992648 - RNA, 20 nt, Mycobacterium avium subsp. paratuberculosis
cggccgcugcgcccagcgcg

SEQ ID NO: 2992649 - RNA, 16 nt, Mycobacterium avium subsp. paratuberculosis
cggccgcugcgggcgg

SEQ ID NO: 2992650 - RNA, 17 nt, Mycobacterium avium subsp. paratuberculosis
cggccgcugcgggcggg

SEQ ID NO: 2992651 - RNA, 18 nt, Mycobacterium avium subsp. paratuberculosis
cggccgcugcgggcgggc

SEQ ID NO: 2992652 - RNA, 16 nt, Mycobacterium avium subsp. paratuberculosis
cggccgcuggcguuga

SEQ ID NO: 2992653 - RNA, 18 nt, Mycobacterium avium subsp. paratuberculosis
cggccgcuggcguugagc

SEQ ID NO: 2992654 - RNA, 21 nt, Mycobacterium avium subsp. paratuberculosis
cggccgcuggcguugagcacg

SEQ ID NO: 2992655 - RNA, 16 nt, Mycobacterium avium subsp. paratuberculosis
cggccgcuggugguga

SEQ ID NO: 2992656 - RNA, 19 nt, Mycobacterium avium subsp. paratuberculosis
cggccgcugguggugauca

SEQ ID NO: 2992657 - RNA, 16 nt, Mycobacterium avium subsp. paratuberculosis
cggccgcuucccaccc

SEQ ID NO: 2992658 - RNA, 19 nt, Mycobacterium avium subsp. paratuberculosis
cggccgcuucccacccggu

SEQ ID NO: 2992659 - RNA, 15 nt, Mycobacterium avium subsp. paratuberculosis
cggccggaacagcug

SEQ ID NO: 2992660 - RNA, 17 nt, Mycobacterium avium subsp. paratuberculosis
cggccggaacagcuggu

SEQ ID NO: 2992661 - RNA, 22 nt, Mycobacterium avium subsp. paratuberculosis
cggccggaacagcuggucccac

SEQ ID NO: 2992662 - RNA, 20 nt, Mycobacterium avium subsp. paratuberculosis
cggccggaagaccguugacg

SEQ ID NO: 2992663 - RNA, 20 nt, Mycobacterium avium subsp. paratuberculosis
cggccggaaucucgugguac

SEQ ID NO: 2992664 - RNA, 13 nt, Mycobacterium avium subsp. paratuberculosis
cggccggacaccg

SEQ ID NO: 2992665 - RNA, 14 nt, Mycobacterium avium subsp. paratuberculosis
cggccggacaccga

SEQ ID NO: 2992666 - RNA, 16 nt, Mycobacterium avium subsp. paratuberculosis
cggccggacagaucgc

SEQ ID NO: 2992667 - RNA, 22 nt, Mycobacterium avium subsp. paratuberculosis
cggccggacagaucgcccauca

SEQ ID NO: 2992668 - RNA, 14 nt, Mycobacterium avium subsp. paratuberculosis
cggccggaccaccc

SEQ ID NO: 2992669 - RNA, 13 nt, Mycobacterium avium subsp. paratuberculosis
cggccggagccga

SEQ ID NO: 2992670 - RNA, 21 nt, Mycobacterium avium subsp. paratuberculosis
cggccggagccgaccucggcg

SEQ ID NO: 2992671 - RNA, 22 nt, Mycobacterium avium subsp. paratuberculosis
cggccggagcggauggcgccgu

SEQ ID NO: 2992672 - RNA, 21 nt, Mycobacterium avium subsp. paratuberculosis
cggccggaucgaauccggcgg

SEQ ID NO: 2992673 - RNA, 22 nt, Mycobacterium avium subsp. paratuberculosis
cggccggaucgaauccggcggc

SEQ ID NO: 2992674 - RNA, 15 nt, Mycobacterium avium subsp. paratuberculosis
cggccggauggccag

SEQ ID NO: 2992675 - RNA, 16 nt, Mycobacterium avium subsp. paratuberculosis
cggccggauggccagc

SEQ ID NO: 2992676 - RNA, 17 nt, Mycobacterium avium subsp. paratuberculosis
cggccggauggccagca

SEQ ID NO: 2992677 - RNA, 18 nt, Mycobacterium avium subsp. paratuberculosis
cggccggauggccagcag

SEQ ID NO: 2992678 - RNA, 20 nt, Mycobacterium avium subsp. paratuberculosis
cggccggauggccagcaggu

SEQ ID NO: 2992679 - RNA, 18 nt, Mycobacterium avium subsp. paratuberculosis
cggccggauucucgcccg

SEQ ID NO: 2992680 - RNA, 19 nt, Mycobacterium avium subsp. paratuberculosis
cggccggauucucgcccgg

SEQ ID NO: 2992681 - RNA, 22 nt, Mycobacterium avium subsp. paratuberculosis
cggccggauucucgcccggcuc

SEQ ID NO: 2992682 - RNA, 22 nt, Mycobacterium avium subsp. paratuberculosis
cggccggcaacgacccgucggg

SEQ ID NO: 2992683 - RNA, 17 nt, Mycobacterium avium subsp. paratuberculosis
cggccggcacgauggcg

SEQ ID NO: 2992684 - RNA, 20 nt, Mycobacterium avium subsp. paratuberculosis
cggccggcacuaccgccucg

SEQ ID NO: 2992685 - RNA, 23 nt, Mycobacterium avium subsp. paratuberculosis
cggccggcacuaccgccucgcca

SEQ ID NO: 2992686 - RNA, 21 nt, Mycobacterium avium subsp. paratuberculosis
cggccggcagcaucgggacgc

SEQ ID NO: 2992687 - RNA, 19 nt, Mycobacterium avium subsp. paratuberculosis
cggccggcagcggugccgc

SEQ ID NO: 2992688 - RNA, 19 nt, Mycobacterium avium subsp. paratuberculosis
cggccggcagcugcccguc

SEQ ID NO: 2992689 - RNA, 17 nt, Mycobacterium avium subsp. paratuberculosis
cggccggcaggccgccc

SEQ ID NO: 2992690 - RNA, 19 nt, Mycobacterium avium subsp. paratuberculosis
cggccggcaggccgcccga

SEQ ID NO: 2992691 - RNA, 15 nt, Mycobacterium avium subsp. paratuberculosis
cggccggcaggucga

SEQ ID NO: 2992692 - RNA, 19 nt, Mycobacterium avium subsp. paratuberculosis
cggccggcaguuccucgcc

SEQ ID NO: 2992693 - RNA, 21 nt, Mycobacterium avium subsp. paratuberculosis
cggccggcaguuccucgccgg

SEQ ID NO: 2992694 - RNA, 20 nt, Mycobacterium avium subsp. paratuberculosis
cggccggcaguugcggccgc

SEQ ID NO: 2992695 - RNA, 16 nt, Mycobacterium avium subsp. paratuberculosis
cggccggccacgcucg

SEQ ID NO: 2992696 - RNA, 22 nt, Mycobacterium avium subsp. paratuberculosis
cggccggccacgcucggcggcg

SEQ ID NO: 2992697 - RNA, 11 nt, Mycobacterium avium subsp. paratuberculosis
cggccggccag

SEQ ID NO: 2992698 - RNA, 15 nt, Mycobacterium avium subsp. paratuberculosis
cggccggccagcagc

SEQ ID NO: 2992699 - RNA, 16 nt, Mycobacterium avium subsp. paratuberculosis
cggcccggcgggcauc

SEQ ID NO: 2992700 - RNA, 19 nt, Mycobacterium avium subsp. paratuberculosis
cggcccggcgggucagcac

SEQ ID NO: 2992701 - RNA, 21 nt, Mycobacterium avium subsp. paratuberculosis
cggcccggcgggucagcaccg

SEQ ID NO: 2992702 - RNA, 13 nt, Mycobacterium avium subsp. paratuberculosis
cggcccggcguca

SEQ ID NO: 2992703 - RNA, 15 nt, Mycobacterium avium subsp. paratuberculosis
cggcccggcgucacg

SEQ ID NO: 2992704 - RNA, 13 nt, Mycobacterium avium subsp. paratuberculosis
cggcccggcgucc

SEQ ID NO: 2992705 - RNA, 20 nt, Mycobacterium avium subsp. paratuberculosis
cggcccggcguuacccgaac

SEQ ID NO: 2992706 - RNA, 12 nt, Mycobacterium avium subsp. paratuberculosis
cggcccggcuca

SEQ ID NO: 2992707 - RNA, 17 nt, Mycobacterium avium subsp. paratuberculosis
cggcccggcucaaugcc

SEQ ID NO: 2992708 - RNA, 18 nt, Mycobacterium avium subsp. paratuberculosis
cggcccgggaagccgcag

SEQ ID NO: 2992709 - RNA, 19 nt, Mycobacterium avium subsp. paratuberculosis
cggcccgggaagccgcagc

SEQ ID NO: 2992710 - RNA, 20 nt, Mycobacterium avium subsp. paratuberculosis
cggcccgggaagccgcagca

SEQ ID NO: 2992711 - RNA, 23 nt, Mycobacterium avium subsp. paratuberculosis
cggcccgggcgauucgucgucgu

SEQ ID NO: 2992712 - RNA, 13 nt, Mycobacterium avium subsp. paratuberculosis
cggcccggggugu

SEQ ID NO: 2992713 - RNA, 14 nt, Mycobacterium avium subsp. paratuberculosis
cggcccggggugug

SEQ ID NO: 2992714 - RNA, 19 nt, Mycobacterium avium subsp. paratuberculosis
cggcccggguggacgcccg

SEQ ID NO: 2992715 - RNA, 21 nt, Mycobacterium avium subsp. paratuberculosis
cggcccggguggacgcccgcg

SEQ ID NO: 2992716 - RNA, 21 nt, Mycobacterium avium subsp. paratuberculosis
cggcccgguacaucgacgcga

SEQ ID NO: 2992717 - RNA, 15 nt, Mycobacterium avium subsp. paratuberculosis
cggcccggucgacuu

SEQ ID NO: 2992718 - RNA, 16 nt, Mycobacterium avium subsp. paratuberculosis
cggcccggucgacuug

SEQ ID NO: 2992719 - RNA, 18 nt, Mycobacterium avium subsp. paratuberculosis
cggcccgucaggccucga

SEQ ID NO: 2992720 - RNA, 21 nt, Mycobacterium avium subsp. paratuberculosis
cggcccguccagaucggccag

SEQ ID NO: 2992721 - RNA, 14 nt, Mycobacterium avium subsp. paratuberculosis
cggcccgucgagcg

SEQ ID NO: 2992722 - RNA, 17 nt, Mycobacterium avium subsp. paratuberculosis
cggcccgucgagcggcu

SEQ ID NO: 2992723 - RNA, 18 nt, Mycobacterium avium subsp. paratuberculosis
cggcccgucgagcggcuu

SEQ ID NO: 2992724 - RNA, 20 nt, Mycobacterium avium subsp. paratuberculosis
cggcccgucgagcggcuugc

SEQ ID NO: 2992725 - RNA, 16 nt, Mycobacterium avium subsp. paratuberculosis
cggcccgucgccacca

SEQ ID NO: 2992726 - RNA, 16 nt, Mycobacterium avium subsp. paratuberculosis
cggcccgucgccgauc

SEQ ID NO: 2992727 - RNA, 17 nt, Mycobacterium avium subsp. paratuberculosis
cggcccgucgccgauca

SEQ ID NO: 2992728 - RNA, 23 nt, Mycobacterium avium subsp. paratuberculosis
cggcccgucgccgaucagcacca

SEQ ID NO: 2992729 - RNA, 17 nt, Mycobacterium avium subsp. paratuberculosis
cggcccguugagcaccg

SEQ ID NO: 2992730 - RNA, 18 nt, Mycobacterium avium subsp. paratuberculosis
cggcccguugagcaccgc

SEQ ID NO: 2992731 - RNA, 19 nt, Mycobacterium avium subsp. paratuberculosis
cggcccguugagcaccgcg

SEQ ID NO: 2992732 - RNA, 20 nt, Mycobacterium avium subsp. paratuberculosis
cggcccguugagcaccgcga

SEQ ID NO: 2992733 - RNA, 14 nt, Mycobacterium avium subsp. paratuberculosis
cggcccuccagcac

SEQ ID NO: 2992734 - RNA, 20 nt, Mycobacterium avium subsp. paratuberculosis
cggcccugcgcggccugcag

SEQ ID NO: 2992735 - RNA, 15 nt, Mycobacterium avium subsp. paratuberculosis
cggcccugcggccag

SEQ ID NO: 2992736 - RNA, 24 nt, Mycobacterium avium subsp. paratuberculosis
cggcccuggcgggcggcccgcacg

SEQ ID NO: 2992737 - RNA, 15 nt, Mycobacterium avium subsp. paratuberculosis
cggcccuggucggcc

SEQ ID NO: 2992738 - RNA, 22 nt, Mycobacterium avium subsp. paratuberculosis
cggcccuggucggccagggcgu

SEQ ID NO: 2992739 - RNA, 18 nt, Mycobacterium avium subsp. paratuberculosis
cggcccugguugagcacc

SEQ ID NO: 2992740 - RNA, 19 nt, Mycobacterium avium subsp. paratuberculosis
cggcccugguugagcaccg

SEQ ID NO: 2992741 - RNA, 21 nt, Mycobacterium avium subsp. paratuberculosis
cggcccugguugagcaccgcg

SEQ ID NO: 2992742 - RNA, 18 nt, Mycobacterium avium subsp. paratuberculosis
cggcccuguucgccgucg

SEQ ID NO: 2992743 - RNA, 19 nt, Mycobacterium avium subsp. paratuberculosis
cggcccuucucggacgccc

SEQ ID NO: 2992744 - RNA, 23 nt, Mycobacterium avium subsp. paratuberculosis
cggcccuucucggacgcccgucg

SEQ ID NO: 2992745 - RNA, 15 nt, Mycobacterium avium subsp. paratuberculosis
cggcccuugcggccg

SEQ ID NO: 2992746 - RNA, 16 nt, Mycobacterium avium subsp. paratuberculosis
cggcccuugcggccga

SEQ ID NO: 2992747 - RNA, 19 nt, Mycobacterium avium subsp. paratuberculosis
cggcccuugcggccgauca

SEQ ID NO: 2992748 - RNA, 20 nt, Mycobacterium avium subsp. paratuberculosis
cggcccuugcggccgaucac

SEQ ID NO: 2992749 - RNA, 21 nt, Mycobacterium avium subsp. paratuberculosis
cggcccuugcggccgaucacc

SEQ ID NO: 2992750 - RNA, 16 nt, Mycobacterium avium subsp. paratuberculosis
cggccgaaacgcccgg

SEQ ID NO: 2992751 - RNA, 19 nt, Mycobacterium avium subsp. paratuberculosis
cggccgaaacgcccggcuc

SEQ ID NO: 2992752 - RNA, 16 nt, Mycobacterium avium subsp. paratuberculosis
cggccgaaaucaacgc

SEQ ID NO: 2992753 - RNA, 20 nt, Mycobacterium avium subsp. paratuberculosis
cggccgaaaucaacgcgccg

SEQ ID NO: 2992754 - RNA, 21 nt, Mycobacterium avium subsp. paratuberculosis
cggccgaaaucaacgcgccga

SEQ ID NO: 2992755 - RNA, 17 nt, Mycobacterium avium subsp. paratuberculosis
cggccgaacacggccgc

SEQ ID NO: 2992756 - RNA, 21 nt, Mycobacterium avium subsp. paratuberculosis
cggccgaacacggccgccucc

SEQ ID NO: 2992757 - RNA, 22 nt, Mycobacterium avium subsp. paratuberculosis
cggccgaacacggccgccucca

SEQ ID NO: 2992758 - RNA, 14 nt, Mycobacterium avium subsp. paratuberculosis
cggccgaacucucc

SEQ ID NO: 2992759 - RNA, 17 nt, Mycobacterium avium subsp. paratuberculosis
cggccgaagaccgccga

SEQ ID NO: 2992760 - RNA, 18 nt, Mycobacterium avium subsp. paratuberculosis
cggccgaagaccgccgaa

SEQ ID NO: 2992761 - RNA, 23 nt, Mycobacterium avium subsp. paratuberculosis
cggccgaagcguuccgccguccu

SEQ ID NO: 2992762 - RNA, 17 nt, Mycobacterium avium subsp. paratuberculosis
cggccgaauccggccgg

SEQ ID NO: 2992763 - RNA, 17 nt, Mycobacterium avium subsp. paratuberculosis
cggccgacaacgacagc

SEQ ID NO: 2992764 - RNA, 18 nt, Mycobacterium avium subsp. paratuberculosis
cggccgacaacgacagca

SEQ ID NO: 2992765 - RNA, 14 nt, Mycobacterium avium subsp. paratuberculosis
cggccgacaccccg

SEQ ID NO: 2992766 - RNA, 19 nt, Mycobacterium avium subsp. paratuberculosis
cggccgacaccccgaugcc

SEQ ID NO: 2992767 - RNA, 19 nt, Mycobacterium avium subsp. paratuberculosis
cggccgacauggacgcggc

SEQ ID NO: 2992768 - RNA, 22 nt, Mycobacterium avium subsp. paratuberculosis
cggccgacauggacgcggccuc

SEQ ID NO: 2992769 - RNA, 20 nt, Mycobacterium avium subsp. paratuberculosis
cggccgacccugcguccggc

SEQ ID NO: 2992770 - RNA, 23 nt, Mycobacterium avium subsp. paratuberculosis
cggccgacccugcguccggcccg

SEQ ID NO: 2992771 - RNA, 21 nt, Mycobacterium avium subsp. paratuberculosis
cggccgaccggucucgaccgc

SEQ ID NO: 2992772 - RNA, 19 nt, Mycobacterium avium subsp. paratuberculosis
cggccgacgaacaagggcg

SEQ ID NO: 2992773 - RNA, 14 nt, Mycobacterium avium subsp. paratuberculosis
cggccgacgcccag

SEQ ID NO: 2992774 - RNA, 14 nt, Mycobacterium avium subsp. paratuberculosis
cggccgccacgcug

SEQ ID NO: 2992775 - RNA, 14 nt, Mycobacterium avium subsp. paratuberculosis
cggccgccagcagc

SEQ ID NO: 2992776 - RNA, 15 nt, Mycobacterium avium subsp. paratuberculosis
cggccgccagcagca

SEQ ID NO: 2992777 - RNA, 14 nt, Mycobacterium avium subsp. paratuberculosis
cggccgccagcagu

SEQ ID NO: 2992778 - RNA, 17 nt, Mycobacterium avium subsp. paratuberculosis
cggccgccagcgcaccg

SEQ ID NO: 2992779 - RNA, 16 nt, Mycobacterium avium subsp. paratuberculosis
cggccgccagcgcccg

SEQ ID NO: 2992780 - RNA, 19 nt, Mycobacterium avium subsp. paratuberculosis
cggccgccagcgcccgcgc

SEQ ID NO: 2992781 - RNA, 15 nt, Mycobacterium avium subsp. paratuberculosis
cggccgccagcgcgg

SEQ ID NO: 2992782 - RNA, 18 nt, Mycobacterium avium subsp. paratuberculosis
cggccgccagcgcggcga

SEQ ID NO: 2992783 - RNA, 15 nt, Mycobacterium avium subsp. paratuberculosis
cgcgucgagcaccug

SEQ ID NO: 2992784 - RNA, 16 nt, Mycobacterium avium subsp. paratuberculosis
cgcgucgagcaccugg

SEQ ID NO: 2992785 - RNA, 22 nt, Mycobacterium avium subsp. paratuberculosis
cggaggugcgggucucgaaccg

SEQ ID NO: 2992786 - RNA, 20 nt, Mycobacterium avium subsp. paratuberculosis
cggagguucgccggaauggc

SEQ ID NO: 2992787 - RNA, 21 nt, Mycobacterium avium subsp. paratuberculosis
cggaguagaccuuguccggcg

SEQ ID NO: 2992788 - RNA, 23 nt, Mycobacterium avium subsp. paratuberculosis
cggaguagaccuuguccggcguc

SEQ ID NO: 2992789 - RNA, 14 nt, Mycobacterium avium subsp. paratuberculosis
cggaguaggcgccg

SEQ ID NO: 2992790 - RNA, 22 nt, Mycobacterium avium subsp. paratuberculosis
cggaguaggcgccgccgcgcag

SEQ ID NO: 2992791 - RNA, 16 nt, Mycobacterium avium subsp. paratuberculosis
cggaguaguccagcac

SEQ ID NO: 2992792 - RNA, 19 nt, Mycobacterium avium subsp. paratuberculosis
cggaguaguuccggcgguc

SEQ ID NO: 2992793 - RNA, 15 nt, Mycobacterium avium subsp. paratuberculosis
cggaguccaccggcg

SEQ ID NO: 2992794 - RNA, 14 nt, Mycobacterium avium subsp. paratuberculosis
cggaguccagcacg

SEQ ID NO: 2992795 - RNA, 18 nt, Mycobacterium avium subsp. paratuberculosis
cggaguccggcucggugc

SEQ ID NO: 2992796 - RNA, 20 nt, Mycobacterium avium subsp. paratuberculosis
cggaguccggcucggugccg

SEQ ID NO: 2992797 - RNA, 15 nt, Mycobacterium avium subsp. paratuberculosis
cggagucguagucga

SEQ ID NO: 2992798 - RNA, 18 nt, Mycobacterium avium subsp. paratuberculosis
cggagucguagucgaugc

SEQ ID NO: 2992799 - RNA, 12 nt, Mycobacterium avium subsp. paratuberculosis
cggagucgucgg

SEQ ID NO: 2992800 - RNA, 14 nt, Mycobacterium avium subsp. paratuberculosis
cggagucgucggcg

SEQ ID NO: 2992801 - RNA, 15 nt, Mycobacterium avium subsp. paratuberculosis
cggagucgucggcgc

SEQ ID NO: 2992802 - RNA, 18 nt, Mycobacterium avium subsp. paratuberculosis
cggagucgucggcgcggu

SEQ ID NO: 2992803 - RNA, 16 nt, Mycobacterium avium subsp. paratuberculosis
cggagugaccgccagc

SEQ ID NO: 2992804 - RNA, 17 nt, Mycobacterium avium subsp. paratuberculosis
cggagugaccgccagca

SEQ ID NO: 2992805 - RNA, 18 nt, Mycobacterium avium subsp. paratuberculosis
cggagugaccgccagcac

SEQ ID NO: 2992806 - RNA, 19 nt, Mycobacterium avium subsp. paratuberculosis
cggagugaccgccagcacc

SEQ ID NO: 2992807 - RNA, 22 nt, Mycobacterium avium subsp. paratuberculosis
cggagugaccgccagcaccgcg

SEQ ID NO: 2992808 - RNA, 23 nt, Mycobacterium avium subsp. paratuberculosis
cggagugaccgccagcaccgcgg

SEQ ID NO: 2992809 - RNA, 16 nt, Mycobacterium avium subsp. paratuberculosis
cggagugacgucgcgc

SEQ ID NO: 2992810 - RNA, 18 nt, Mycobacterium avium subsp. paratuberculosis
cggagugacgucgcgcgg

SEQ ID NO: 2992811 - RNA, 22 nt, Mycobacterium avium subsp. paratuberculosis
cggagugcggauuaccgugacg

SEQ ID NO: 2992812 - RNA, 17 nt, Mycobacterium avium subsp. paratuberculosis
cggaguggaacagccgg

SEQ ID NO: 2992813 - RNA, 19 nt, Mycobacterium avium subsp. paratuberculosis
cggaguucgcccgcagcac

SEQ ID NO: 2992814 - RNA, 21 nt, Mycobacterium avium subsp. paratuberculosis
cggaguugaugaaaaccaccu

SEQ ID NO: 2992815 - RNA, 22 nt, Mycobacterium avium subsp. paratuberculosis
cggaguugaugaaaaccaccug

SEQ ID NO: 2992816 - RNA, 17 nt, Mycobacterium avium subsp. paratuberculosis
cggaguugccgauggcg

SEQ ID NO: 2992817 - RNA, 22 nt, Mycobacterium avium subsp. paratuberculosis
cggaguugccgauggcggucca

SEQ ID NO: 2992818 - RNA, 16 nt, Mycobacterium avium subsp. paratuberculosis
cggaguugcgcagccg

SEQ ID NO: 2992819 - RNA, 20 nt, Mycobacterium avium subsp. paratuberculosis
cggaguugcgcagccgggcg

SEQ ID NO: 2992820 - RNA, 21 nt, Mycobacterium avium subsp. paratuberculosis
cggaguugcgcagccgggcgg

SEQ ID NO: 2992821 - RNA, 19 nt, Mycobacterium avium subsp. paratuberculosis
cggaguuuggacaucacgu

SEQ ID NO: 2992822 - RNA, 23 nt, Mycobacterium avium subsp. paratuberculosis
cggauaacgcaaaacggugcggc

SEQ ID NO: 2992823 - RNA, 16 nt, Mycobacterium avium subsp. paratuberculosis
cggauacccgcggccu

SEQ ID NO: 2992824 - RNA, 19 nt, Mycobacterium avium subsp. paratuberculosis
cggauacgcccggccaccu

SEQ ID NO: 2992825 - RNA, 15 nt, Mycobacterium avium subsp. paratuberculosis
cggauagaggcggcg

SEQ ID NO: 2992826 - RNA, 16 nt, Mycobacterium avium subsp. paratuberculosis
cggauagaggcggcgc

SEQ ID NO: 2992827 - RNA, 17 nt, Mycobacterium avium subsp. paratuberculosis
cggauagcccagcgugg

SEQ ID NO: 2992828 - RNA, 19 nt, Mycobacterium avium subsp. paratuberculosis
cggauaucccgcgggucgc

SEQ ID NO: 2992829 - RNA, 15 nt, Mycobacterium avium subsp. paratuberculosis
cggaucaaccacacc

SEQ ID NO: 2992830 - RNA, 20 nt, Mycobacterium avium subsp. paratuberculosis
cggaucaaccacaccagcau

SEQ ID NO: 2992831 - RNA, 21 nt, Mycobacterium avium subsp. paratuberculosis
cggaucaaccacaccagcaug

SEQ ID NO: 2992832 - RNA, 16 nt, Mycobacterium avium subsp. paratuberculosis
cggaucagcaccgacg

SEQ ID NO: 2992833 - RNA, 19 nt, Mycobacterium avium subsp. paratuberculosis
cggaucagcaggaccggga

SEQ ID NO: 2992834 - RNA, 18 nt, Mycobacterium avium subsp. paratuberculosis
cggaucagcugaccggcg

SEQ ID NO: 2992835 - RNA, 16 nt, Mycobacterium avium subsp. paratuberculosis
cggaucaguaccggcg

SEQ ID NO: 2992836 - RNA, 19 nt, Mycobacterium avium subsp. paratuberculosis
cggaucaguaccggcgaug

SEQ ID NO: 2992837 - RNA, 20 nt, Mycobacterium avium subsp. paratuberculosis
cggaucaguaccggcgaugc

SEQ ID NO: 2992838 - RNA, 22 nt, Mycobacterium avium subsp. paratuberculosis
cggaucaguaccggcgaugcca

SEQ ID NO: 2992839 - RNA, 14 nt, Mycobacterium avium subsp. paratuberculosis
cggauccagcaccg

SEQ ID NO: 2992840 - RNA, 16 nt, Mycobacterium avium subsp. paratuberculosis
cggauccagcaccgcc

SEQ ID NO: 2992841 - RNA, 18 nt, Mycobacterium avium subsp. paratuberculosis
cggauccagcaccgccac

SEQ ID NO: 2992842 - RNA, 22 nt, Mycobacterium avium subsp. paratuberculosis
cggauccagguggggcacgggc

SEQ ID NO: 2992843 - RNA, 23 nt, Mycobacterium avium subsp. paratuberculosis
cggauccagguggggcacgggcg

SEQ ID NO: 2992844 - RNA, 18 nt, Mycobacterium avium subsp. paratuberculosis
cggaucccggggcgcgcu

SEQ ID NO: 2992845 - RNA, 21 nt, Mycobacterium avium subsp. paratuberculosis
cggaucccggggcgcgcuggg

SEQ ID NO: 2992846 - RNA, 23 nt, Mycobacterium avium subsp. paratuberculosis
cggauccgacgaaccgugcacga

SEQ ID NO: 2992847 - RNA, 14 nt, Mycobacterium avium subsp. paratuberculosis
cggauccgggccgc

SEQ ID NO: 2992848 - RNA, 19 nt, Mycobacterium avium subsp. paratuberculosis
cggauccgggccgccuucu

SEQ ID NO: 2992849 - RNA, 16 nt, Mycobacterium avium subsp. paratuberculosis
cggauccgggccggcg

SEQ ID NO: 2992850 - RNA, 15 nt, Mycobacterium avium subsp. paratuberculosis
cggauccgggcgccg

SEQ ID NO: 2992851 - RNA, 13 nt, Mycobacterium avium subsp. paratuberculosis
cggauccgucgcc

SEQ ID NO: 2992852 - RNA, 15 nt, Mycobacterium avium subsp. paratuberculosis
cggauccgucgcccc

SEQ ID NO: 2992853 - RNA, 20 nt, Mycobacterium avium subsp. paratuberculosis
cggauccgucgccccgcacc

SEQ ID NO: 2992854 - RNA, 23 nt, Mycobacterium avium subsp. paratuberculosis
cggauccgucgccccgcaccgag

SEQ ID NO: 2992855 - RNA, 20 nt, Mycobacterium avium subsp. paratuberculosis
cggaucgaaaaggucgaaca

SEQ ID NO: 2992856 - RNA, 14 nt, Mycobacterium avium subsp. paratuberculosis
cggaucgaacaggg

SEQ ID NO: 2992857 - RNA, 20 nt, Mycobacterium avium subsp. paratuberculosis
cggaucgaaggcgugcucga

SEQ ID NO: 2992858 - RNA, 18 nt, Mycobacterium avium subsp. paratuberculosis
cggaucgaauccggcggc

SEQ ID NO: 2992859 - RNA, 19 nt, Mycobacterium avium subsp. paratuberculosis
cggaucgaauccggcggcg

SEQ ID NO: 2992860 - RNA, 23 nt, Mycobacterium avium subsp. paratuberculosis
cggaucgaauccggcggcgcuca

SEQ ID NO: 2992861 - RNA, 14 nt, Mycobacterium avium subsp. paratuberculosis
cggaucgagcaccc

SEQ ID NO: 2992862 - RNA, 20 nt, Mycobacterium avium subsp. paratuberculosis
cggcccgcacggccgccagg

SEQ ID NO: 2992863 - RNA, 13 nt, Mycobacterium avium subsp. paratuberculosis
cggcccgcagcca

SEQ ID NO: 2992864 - RNA, 15 nt, Mycobacterium avium subsp. paratuberculosis
cggcccgcagccagc

SEQ ID NO: 2992865 - RNA, 16 nt, Mycobacterium avium subsp. paratuberculosis
cggcccgcagccagcg

SEQ ID NO: 2992866 - RNA, 17 nt, Mycobacterium avium subsp. paratuberculosis
cggcccgcagccagcgc

SEQ ID NO: 2992867 - RNA, 20 nt, Mycobacterium avium subsp. paratuberculosis
cggcccgcagccagcgcagc

SEQ ID NO: 2992868 - RNA, 23 nt, Mycobacterium avium subsp. paratuberculosis
cggcccgcagccagcgcagcacu

SEQ ID NO: 2992869 - RNA, 12 nt, Mycobacterium avium subsp. paratuberculosis
cggcccgcagcg

SEQ ID NO: 2992870 - RNA, 17 nt, Mycobacterium avium subsp. paratuberculosis
cggcccgcagcgccucg

SEQ ID NO: 2992871 - RNA, 18 nt, Mycobacterium avium subsp. paratuberculosis
cggcccgcagcgccucgg

SEQ ID NO: 2992872 - RNA, 20 nt, Mycobacterium avium subsp. paratuberculosis
cggcccgcagcgccucggcg

SEQ ID NO: 2992873 - RNA, 17 nt, Mycobacterium avium subsp. paratuberculosis
cggcccgcaucgcggcg

SEQ ID NO: 2992874 - RNA, 18 nt, Mycobacterium avium subsp. paratuberculosis
cggcccgcaucgcggcga

SEQ ID NO: 2992875 - RNA, 14 nt, Mycobacterium avium subsp. paratuberculosis
cggcccgcaugcac

SEQ ID NO: 2992876 - RNA, 17 nt, Mycobacterium avium subsp. paratuberculosis
cggcccgcaugcaccgg

SEQ ID NO: 2992877 - RNA, 19 nt, Mycobacterium avium subsp. paratuberculosis
cggcccgcaugcaccggug

SEQ ID NO: 2992878 - RNA, 18 nt, Mycobacterium avium subsp. paratuberculosis
cggcccgccacccgaggc

SEQ ID NO: 2992879 - RNA, 20 nt, Mycobacterium avium subsp. paratuberculosis
cggcccgccacccgaggccg

SEQ ID NO: 2992880 - RNA, 13 nt, Mycobacterium avium subsp. paratuberculosis
cggcccgcccggc

SEQ ID NO: 2992881 - RNA, 12 nt, Mycobacterium avium subsp. paratuberculosis
cggcccgccgaa

SEQ ID NO: 2992882 - RNA, 20 nt, Mycobacterium avium subsp. paratuberculosis
cggcccgccgaacgccuccg

SEQ ID NO: 2992883 - RNA, 21 nt, Mycobacterium avium subsp. paratuberculosis
cggcccgccgaacgccuccgc

SEQ ID NO: 2992884 - RNA, 15 nt, Mycobacterium avium subsp. paratuberculosis
cggcccgccgccggc

SEQ ID NO: 2992885 - RNA, 17 nt, Mycobacterium avium subsp. paratuberculosis
cggcccgccgccggcgg

SEQ ID NO: 2992886 - RNA, 18 nt, Mycobacterium avium subsp. paratuberculosis
cggcccgccgccggcggc

SEQ ID NO: 2992887 - RNA, 19 nt, Mycobacterium avium subsp. paratuberculosis
cggcccgccgccggcggcg

SEQ ID NO: 2992888 - RNA, 20 nt, Mycobacterium avium subsp. paratuberculosis
cggcccgccgccggcggcgu

SEQ ID NO: 2992889 - RNA, 13 nt, Mycobacterium avium subsp. paratuberculosis
cggcccgccgcgc

SEQ ID NO: 2992890 - RNA, 13 nt, Mycobacterium avium subsp. paratuberculosis
cggcccgccgcuc

SEQ ID NO: 2992891 - RNA, 21 nt, Mycobacterium avium subsp. paratuberculosis
cggcccgccgcucaccgccga

SEQ ID NO: 2992892 - RNA, 22 nt, Mycobacterium avium subsp. paratuberculosis
cggcccgccggaacucggccgg

SEQ ID NO: 2992893 - RNA, 14 nt, Mycobacterium avium subsp. paratuberculosis
cggcccgccggagc

SEQ ID NO: 2992894 - RNA, 16 nt, Mycobacterium avium subsp. paratuberculosis
cggcccgccggagccg

SEQ ID NO: 2992895 - RNA, 17 nt, Mycobacterium avium subsp. paratuberculosis
cggcccgccggagccga

SEQ ID NO: 2992896 - RNA, 19 nt, Mycobacterium avium subsp. paratuberculosis
cggcccgccggagccgauc

SEQ ID NO: 2992897 - RNA, 14 nt, Mycobacterium avium subsp. paratuberculosis
cggcccgccgggcc

SEQ ID NO: 2992898 - RNA, 16 nt, Mycobacterium avium subsp. paratuberculosis
cggcccgccgggccgg

SEQ ID NO: 2992899 - RNA, 19 nt, Mycobacterium avium subsp. paratuberculosis
cggcccgccgggccggauc

SEQ ID NO: 2992900 - RNA, 19 nt, Mycobacterium avium subsp. paratuberculosis
cggcccgccgggcgucgcg

SEQ ID NO: 2992901 - RNA, 21 nt, Mycobacterium avium subsp. paratuberculosis
cggcccgccgggcgucgcgcu

SEQ ID NO: 2992902 - RNA, 15 nt, Mycobacterium avium subsp. paratuberculosis
cggcccgccucggcg

SEQ ID NO: 2992903 - RNA, 16 nt, Mycobacterium avium subsp. paratuberculosis
cggcccgccucggcgg

SEQ ID NO: 2992904 - RNA, 19 nt, Mycobacterium avium subsp. paratuberculosis
cggcccgccucggcggccg

SEQ ID NO: 2992905 - RNA, 16 nt, Mycobacterium avium subsp. paratuberculosis
cggcccgccuucuccg

SEQ ID NO: 2992906 - RNA, 12 nt, Mycobacterium avium subsp. paratuberculosis
cggcccgcgacg

SEQ ID NO: 2992907 - RNA, 15 nt, Mycobacterium avium subsp. paratuberculosis
cggcccgcgacgucg

SEQ ID NO: 2992908 - RNA, 18 nt, Mycobacterium avium subsp. paratuberculosis
cggcccgcgacgucggag

SEQ ID NO: 2992909 - RNA, 18 nt, Mycobacterium avium subsp. paratuberculosis
cggcccgcgccccggcgg

SEQ ID NO: 2992910 - RNA, 21 nt, Mycobacterium avium subsp. paratuberculosis
cggcccgcgccccggcggcca

SEQ ID NO: 2992911 - RNA, 13 nt, Mycobacterium avium subsp. paratuberculosis
cggcccgcgccgg

SEQ ID NO: 2992912 - RNA, 15 nt, Mycobacterium avium subsp. paratuberculosis
cggcccgcgccggcg

SEQ ID NO: 2992913 - RNA, 16 nt, Mycobacterium avium subsp. paratuberculosis
cggcccgcgccggcgu

SEQ ID NO: 2992914 - RNA, 18 nt, Mycobacterium avium subsp. paratuberculosis
cggcccgcgccggcgugu

SEQ ID NO: 2992915 - RNA, 12 nt, Mycobacterium avium subsp. paratuberculosis
cggcccgcgcgg

SEQ ID NO: 2992916 - RNA, 14 nt, Mycobacterium avium subsp. paratuberculosis
cggcccgcgcgggg

SEQ ID NO: 2992917 - RNA, 15 nt, Mycobacterium avium subsp. paratuberculosis
cggcccgcgcggggu

SEQ ID NO: 2992918 - RNA, 12 nt, Mycobacterium avium subsp. paratuberculosis
cggcccgcggca

SEQ ID NO: 2992919 - RNA, 22 nt, Mycobacterium avium subsp. paratuberculosis
cggcccgcggcacgcugcgcca

SEQ ID NO: 2992920 - RNA, 19 nt, Mycobacterium avium subsp. paratuberculosis
cggcccgcggcaucgucgg

SEQ ID NO: 2992921 - RNA, 12 nt, Mycobacterium avium subsp. paratuberculosis
cggcccgcgggg

SEQ ID NO: 2992922 - RNA, 14 nt, Mycobacterium avium subsp. paratuberculosis
cggcccgcucggcg

SEQ ID NO: 2992923 - RNA, 14 nt, Mycobacterium avium subsp. paratuberculosis
cggcccgcucgggc

SEQ ID NO: 2992924 - RNA, 18 nt, Mycobacterium avium subsp. paratuberculosis
cggcccgcugcgcggccg

SEQ ID NO: 2992925 - RNA, 19 nt, Mycobacterium avium subsp. paratuberculosis
cggcccgcugcgcggccga

SEQ ID NO: 2992926 - RNA, 21 nt, Mycobacterium avium subsp. paratuberculosis
cggcccgcugcgcggccgaac

SEQ ID NO: 2992927 - RNA, 16 nt, Mycobacterium avium subsp. paratuberculosis
cggcccgcugcggcug

SEQ ID NO: 2992928 - RNA, 18 nt, Mycobacterium avium subsp. paratuberculosis
cggcccgcugcggcuggg

SEQ ID NO: 2992929 - RNA, 16 nt, Mycobacterium avium subsp. paratuberculosis
cggcccgcuggccgcc

SEQ ID NO: 2992930 - RNA, 17 nt, Mycobacterium avium subsp. paratuberculosis
cggcccgcuggccgccg

SEQ ID NO: 2992931 - RNA, 12 nt, Mycobacterium avium subsp. paratuberculosis
cggcccgcugug

SEQ ID NO: 2992932 - RNA, 23 nt, Mycobacterium avium subsp. paratuberculosis
cggcccgcugugguccucgucac

SEQ ID NO: 2992933 - RNA, 21 nt, Mycobacterium avium subsp. paratuberculosis
cggcccgcuucaggcagcgca

SEQ ID NO: 2992934 - RNA, 18 nt, Mycobacterium avium subsp. paratuberculosis
cggcccgcuugccgacgu

SEQ ID NO: 2992935 - RNA, 19 nt, Mycobacterium avium subsp. paratuberculosis
cggcccgcuugccgacgug

SEQ ID NO: 2992936 - RNA, 20 nt, Mycobacterium avium subsp. paratuberculosis
cggcccgcuugccgacguga

SEQ ID NO: 2992937 - RNA, 21 nt, Mycobacterium avium subsp. paratuberculosis
cggcccgcuugccgacgugau

SEQ ID NO: 2992938 - RNA, 17 nt, Mycobacterium avium subsp. paratuberculosis
cggcccggaacgcgucg

SEQ ID NO: 2992939 - RNA, 17 nt, Mycobacterium avium subsp. paratuberculosis
cggcccggacggagccg

SEQ ID NO: 2992940 - RNA, 12 nt, Mycobacterium avium subsp. paratuberculosis
cggcccggcacu

SEQ ID NO: 2992941 - RNA, 13 nt, Mycobacterium avium subsp. paratuberculosis
cggcccggccaac

SEQ ID NO: 2992942 - RNA, 17 nt, Mycobacterium avium subsp. paratuberculosis
cggcccggccaccaggg

SEQ ID NO: 2992943 - RNA, 18 nt, Mycobacterium avium subsp. paratuberculosis
cggcccggccaccaggga

SEQ ID NO: 2992944 - RNA, 13 nt, Mycobacterium avium subsp. paratuberculosis
cggcccggccacu

SEQ ID NO: 2992945 - RNA, 16 nt, Mycobacterium avium subsp. paratuberculosis
cggcccggccacucgc

SEQ ID NO: 2992946 - RNA, 18 nt, Mycobacterium avium subsp. paratuberculosis
cggcccggccacucgccg

SEQ ID NO: 2992947 - RNA, 22 nt, Mycobacterium avium subsp. paratuberculosis
cggcgagucccggcgcaccagg

SEQ ID NO: 2992948 - RNA, 17 nt, Mycobacterium avium subsp. paratuberculosis
cggcgaguccgcggagg

SEQ ID NO: 2992949 - RNA, 18 nt, Mycobacterium avium subsp. paratuberculosis
cggcgaguccgcggaggc

SEQ ID NO: 2992950 - RNA, 20 nt, Mycobacterium avium subsp. paratuberculosis
cggcgaguccggccaggucg

SEQ ID NO: 2992951 - RNA, 17 nt, Mycobacterium avium subsp. paratuberculosis
cggcgagugaggccgag

SEQ ID NO: 2992952 - RNA, 19 nt, Mycobacterium avium subsp. paratuberculosis
cggcgagugaggccgaggc

SEQ ID NO: 2992953 - RNA, 20 nt, Mycobacterium avium subsp. paratuberculosis
cggcgagugaggccgaggcg

SEQ ID NO: 2992954 - RNA, 15 nt, Mycobacterium avium subsp. paratuberculosis
cggcgagugcaccuu

SEQ ID NO: 2992955 - RNA, 14 nt, Mycobacterium avium subsp. paratuberculosis
cggcgagugcgaaa

SEQ ID NO: 2992956 - RNA, 20 nt, Mycobacterium avium subsp. paratuberculosis
cggcgaguggaagucagcgc

SEQ ID NO: 2992957 - RNA, 23 nt, Mycobacterium avium subsp. paratuberculosis
cggcgaguggaagucagcgcgug

SEQ ID NO: 2992958 - RNA, 22 nt, Mycobacterium avium subsp. paratuberculosis
cggcgaguucgaccuccacccg

SEQ ID NO: 2992959 - RNA, 14 nt, Mycobacterium avium subsp. paratuberculosis
cggcgaguucggcg

SEQ ID NO: 2992960 - RNA, 16 nt, Mycobacterium avium subsp. paratuberculosis
cggcgaguucggcggc

SEQ ID NO: 2992961 - RNA, 20 nt, Mycobacterium avium subsp. paratuberculosis
cggcgaguucggcggcccgc

SEQ ID NO: 2992962 - RNA, 18 nt, Mycobacterium avium subsp. paratuberculosis
cggcgauacccgggagca

SEQ ID NO: 2992963 - RNA, 16 nt, Mycobacterium avium subsp. paratuberculosis
cggcgauaggcggcca

SEQ ID NO: 2992964 - RNA, 17 nt, Mycobacterium avium subsp. paratuberculosis
cggcgauaggcggccag

SEQ ID NO: 2992965 - RNA, 18 nt, Mycobacterium avium subsp. paratuberculosis
cggcgauaggcggccagc

SEQ ID NO: 2992966 - RNA, 19 nt, Mycobacterium avium subsp. paratuberculosis
cggcgauaggcggccagcu

SEQ ID NO: 2992967 - RNA, 21 nt, Mycobacterium avium subsp. paratuberculosis
cggcgauaggcggccagcucc

SEQ ID NO: 2992968 - RNA, 14 nt, Mycobacterium avium subsp. paratuberculosis
cggcgaucaccgcc

SEQ ID NO: 2992969 - RNA, 20 nt, Mycobacterium avium subsp. paratuberculosis
cggcgaucaccgccgcggcg

SEQ ID NO: 2992970 - RNA, 23 nt, Mycobacterium avium subsp. paratuberculosis
cggcgaucaccgccgcggcgacc

SEQ ID NO: 2992971 - RNA, 13 nt, Mycobacterium avium subsp. paratuberculosis
cggcgaucaccgg

SEQ ID NO: 2992972 - RNA, 21 nt, Mycobacterium avium subsp. paratuberculosis
cggcgaucaccgggacaccgc

SEQ ID NO: 2992973 - RNA, 15 nt, Mycobacterium avium subsp. paratuberculosis
cggcgaucagcagca

SEQ ID NO: 2992974 - RNA, 19 nt, Mycobacterium avium subsp. paratuberculosis
cggcgaucagcagcacccg

SEQ ID NO: 2992975 - RNA, 14 nt, Mycobacterium avium subsp. paratuberculosis
cggcgaucagcccg

SEQ ID NO: 2992976 - RNA, 19 nt, Mycobacterium avium subsp. paratuberculosis
cggcgaucagcccggcccg

SEQ ID NO: 2992977 - RNA, 15 nt, Mycobacterium avium subsp. paratuberculosis
cggcgaucagcuccu

SEQ ID NO: 2992978 - RNA, 14 nt, Mycobacterium avium subsp. paratuberculosis
cggcgaucagcugc

SEQ ID NO: 2992979 - RNA, 16 nt, Mycobacterium avium subsp. paratuberculosis
cggcgaucagcugccc

SEQ ID NO: 2992980 - RNA, 19 nt, Mycobacterium avium subsp. paratuberculosis
cggcgaucagcugcccgga

SEQ ID NO: 2992981 - RNA, 24 nt, Mycobacterium avium subsp. paratuberculosis
cggcgaucagcugcccggaguccg

SEQ ID NO: 2992982 - RNA, 18 nt, Mycobacterium avium subsp. paratuberculosis
cggcgaucagcugcucgu

SEQ ID NO: 2992983 - RNA, 14 nt, Mycobacterium avium subsp. paratuberculosis
cggcgauccacgcc

SEQ ID NO: 2992984 - RNA, 15 nt, Mycobacterium avium subsp. paratuberculosis
cggcgauccacgccu

SEQ ID NO: 2992985 - RNA, 18 nt, Mycobacterium avium subsp. paratuberculosis
cggcgauccacgccuccg

SEQ ID NO: 2992986 - RNA, 20 nt, Mycobacterium avium subsp. paratuberculosis
cggcgauccacgccuccggc

SEQ ID NO: 2992987 - RNA, 13 nt, Mycobacterium avium subsp. paratuberculosis
cggcgauccggcc

SEQ ID NO: 2992988 - RNA, 14 nt, Mycobacterium avium subsp. paratuberculosis
cggcgauccggccg

SEQ ID NO: 2992989 - RNA, 17 nt, Mycobacterium avium subsp. paratuberculosis
cggcgauccggccggcg

SEQ ID NO: 2992990 - RNA, 18 nt, Mycobacterium avium subsp. paratuberculosis
cggcgauccggccggcgg

SEQ ID NO: 2992991 - RNA, 19 nt, Mycobacterium avium subsp. paratuberculosis
cggcgauccggccggcggc

SEQ ID NO: 2992992 - RNA, 20 nt, Mycobacterium avium subsp. paratuberculosis
cggcgauccggccggcggcg

SEQ ID NO: 2992993 - RNA, 21 nt, Mycobacterium avium subsp. paratuberculosis
cggcgauccggccggcggcgg

SEQ ID NO: 2992994 - RNA, 14 nt, Mycobacterium avium subsp. paratuberculosis
cggcgauccgggca

SEQ ID NO: 2992995 - RNA, 23 nt, Mycobacterium avium subsp. paratuberculosis
cggcgauccgggcacgcagcggc

SEQ ID NO: 2992996 - RNA, 22 nt, Mycobacterium avium subsp. paratuberculosis
cggcgaucgacgucaccaccgg

SEQ ID NO: 2992997 - RNA, 14 nt, Mycobacterium avium subsp. paratuberculosis
cggcgaucgagggg

SEQ ID NO: 2992998 - RNA, 22 nt, Mycobacterium avium subsp. paratuberculosis
cggcgaucgagggggucaucag

SEQ ID NO: 2992999 - RNA, 18 nt, Mycobacterium avium subsp. paratuberculosis
cggcgaucgccagcacgg

SEQ ID NO: 2993000 - RNA, 15 nt, Mycobacterium avium subsp. paratuberculosis
cggcgaucgccgcga

SEQ ID NO: 2993001 - RNA, 13 nt, Mycobacterium avium subsp. paratuberculosis
cggcgaucgccgg

SEQ ID NO: 2993002 - RNA, 17 nt, Mycobacterium avium subsp. paratuberculosis
cggcgaucgccggggau

SEQ ID NO: 2993003 - RNA, 14 nt, Mycobacterium avium subsp. paratuberculosis
cggcgaucgccgug

SEQ ID NO: 2993004 - RNA, 16 nt, Mycobacterium avium subsp. paratuberculosis
cggcgaucgccguggu

SEQ ID NO: 2993005 - RNA, 14 nt, Mycobacterium avium subsp. paratuberculosis
cggcgaucgcgagc

SEQ ID NO: 2993006 - RNA, 16 nt, Mycobacterium avium subsp. paratuberculosis
cggcgaucgcgagcag

SEQ ID NO: 2993007 - RNA, 18 nt, Mycobacterium avium subsp. paratuberculosis
cggcgaucgcgagcaggg

SEQ ID NO: 2993008 - RNA, 14 nt, Mycobacterium avium subsp. paratuberculosis
cggcgaucgcgcgc

SEQ ID NO: 2993009 - RNA, 15 nt, Mycobacterium avium subsp. paratuberculosis
cggcgaucggccgcu

SEQ ID NO: 2993010 - RNA, 16 nt, Mycobacterium avium subsp. paratuberculosis
cggcgaucggccgcug

SEQ ID NO: 2993011 - RNA, 17 nt, Mycobacterium avium subsp. paratuberculosis
cggcgaucggccgcugc

SEQ ID NO: 2993012 - RNA, 22 nt, Mycobacterium avium subsp. paratuberculosis
cggcgaucggccgcugcgggcg

SEQ ID NO: 2993013 - RNA, 15 nt, Mycobacterium avium subsp. paratuberculosis
cggcgaucggcgcgg

SEQ ID NO: 2993014 - RNA, 16 nt, Mycobacterium avium subsp. paratuberculosis
cggcgaucggcgcggc

SEQ ID NO: 2993015 - RNA, 17 nt, Mycobacterium avium subsp. paratuberculosis
cggcgaucggcgcggcg

SEQ ID NO: 2993016 - RNA, 15 nt, Mycobacterium avium subsp. paratuberculosis
cggcgaucggcgguc

SEQ ID NO: 2993017 - RNA, 19 nt, Mycobacterium avium subsp. paratuberculosis
cggcgaucgggucaccggc

SEQ ID NO: 2993018 - RNA, 21 nt, Mycobacterium avium subsp. paratuberculosis
cggcgaucgggucaccggccg

SEQ ID NO: 2993019 - RNA, 23 nt, Mycobacterium avium subsp. paratuberculosis
cggcgaucgggucaccggccgag

SEQ ID NO: 2993020 - RNA, 13 nt, Mycobacterium avium subsp. paratuberculosis
cggcgaucgucgc

SEQ ID NO: 2993021 - RNA, 15 nt, Mycobacterium avium subsp. paratuberculosis
cggcgaucgucgccg

SEQ ID NO: 2993022 - RNA, 16 nt, Mycobacterium avium subsp. paratuberculosis
cggcgaucgucgccgu

SEQ ID NO: 2993023 - RNA, 17 nt, Mycobacterium avium subsp. paratuberculosis
cggcgaucgucgccguc

SEQ ID NO: 2993024 - RNA, 19 nt, Mycobacterium avium subsp. paratuberculosis
cggcgaucgucgccgucac

SEQ ID NO: 2993025 - RNA, 14 nt, Mycobacterium avium subsp. paratuberculosis
cggcgaucuccacc

SEQ ID NO: 2993026 - RNA, 17 nt, Mycobacterium avium subsp. paratuberculosis
cggcgaucucgagcauc

SEQ ID NO: 2993027 - RNA, 15 nt, Mycobacterium avium subsp. paratuberculosis
cggcgaucucggcgg

SEQ ID NO: 2993028 - RNA, 16 nt, Mycobacterium avium subsp. paratuberculosis
cggcgaucucggcggc

SEQ ID NO: 2993029 - RNA, 17 nt, Mycobacterium avium subsp. paratuberculosis
cggcgaucucggcggcc

SEQ ID NO: 2993030 - RNA, 18 nt, Mycobacterium avium subsp. paratuberculosis
cggcgaucucggcggccg

SEQ ID NO: 2993031 - RNA, 20 nt, Mycobacterium avium subsp. paratuberculosis
cggcgaucucggcggccgcg

SEQ ID NO: 2993032 - RNA, 16 nt, Mycobacterium avium subsp. paratuberculosis
cggcgaucucggucac

SEQ ID NO: 2993033 - RNA, 24 nt, Mycobacterium avium subsp. paratuberculosis
cggcgaucucggucaccgagcggc

SEQ ID NO: 2993034 - RNA, 15 nt, Mycobacterium avium subsp. paratuberculosis
cggcgaucucguccc

SEQ ID NO: 2993035 - RNA, 16 nt, Mycobacterium avium subsp. paratuberculosis
cggcgaucucgucgcg

SEQ ID NO: 2993036 - RNA, 18 nt, Mycobacterium avium subsp. paratuberculosis
cggcgaucucgucgcgca

SEQ ID NO: 2993037 - RNA, 19 nt, Mycobacterium avium subsp. paratuberculosis
cggcgaucucgucgcgcag

SEQ ID NO: 2993038 - RNA, 17 nt, Mycobacterium avium subsp. paratuberculosis
cggcgaucucgucgcgg

SEQ ID NO: 2993039 - RNA, 15 nt, Mycobacterium avium subsp. paratuberculosis
cggcgaucuggcggu

SEQ ID NO: 2993040 - RNA, 23 nt, Mycobacterium avium subsp. paratuberculosis
cggcgaucuggcgguuggacagg

SEQ ID NO: 2993041 - RNA, 14 nt, Mycobacterium avium subsp. paratuberculosis
cggcgaucuuugcg

SEQ ID NO: 2993042 - RNA, 18 nt, Mycobacterium avium subsp. paratuberculosis
cggcgaucuuugcggccg

SEQ ID NO: 2993043 - RNA, 15 nt, Mycobacterium avium subsp. paratuberculosis
cggcgaugaagcccc

SEQ ID NO: 2993044 - RNA, 21 nt, Mycobacterium avium subsp. paratuberculosis
cggcgaugaagccccggaccg

SEQ ID NO: 2993045 - RNA, 22 nt, Mycobacterium avium subsp. paratuberculosis
cggcgaugaccgccugcggcag

SEQ ID NO: 2993046 - RNA, 15 nt, Mycobacterium avium subsp. paratuberculosis
cggcgaugaccggga

SEQ ID NO: 2993047 - RNA, 16 nt, Mycobacterium avium subsp. paratuberculosis
cggcgaugaccgggac

SEQ ID NO: 2993048 - RNA, 17 nt, Mycobacterium avium subsp. paratuberculosis
cggcgaugaccgggacg

SEQ ID NO: 2993049 - RNA, 17 nt, Mycobacterium avium subsp. paratuberculosis
cggcgaugaucaggccg

SEQ ID NO: 2993050 - RNA, 19 nt, Mycobacterium avium subsp. paratuberculosis
cggcgaugaucaggccgga

SEQ ID NO: 2993051 - RNA, 20 nt, Mycobacterium avium subsp. paratuberculosis
cggcgaugaucaggccggac

SEQ ID NO: 2993052 - RNA, 22 nt, Mycobacterium avium subsp. paratuberculosis
cggcgaugaucaggccggaccg

SEQ ID NO: 2993053 - RNA, 13 nt, Mycobacterium avium subsp. paratuberculosis
cggcgaugauccg

SEQ ID NO: 2993054 - RNA, 17 nt, Mycobacterium avium subsp. paratuberculosis
cggcgaugauccgcggc

SEQ ID NO: 2993055 - RNA, 19 nt, Mycobacterium avium subsp. paratuberculosis
cggcgaugauccgcggcgc

SEQ ID NO: 2993056 - RNA, 20 nt, Mycobacterium avium subsp. paratuberculosis
cggcgaugauccgcggcgcc

SEQ ID NO: 2993057 - RNA, 22 nt, Mycobacterium avium subsp. paratuberculosis
cggcgaugauccgcggcgccgg

SEQ ID NO: 2993058 - RNA, 16 nt, Mycobacterium avium subsp. paratuberculosis
cggcgaugcagaucac

SEQ ID NO: 2993059 - RNA, 21 nt, Mycobacterium avium subsp. paratuberculosis
cggcgaugcagaucaccacgg

SEQ ID NO: 2993060 - RNA, 23 nt, Mycobacterium avium subsp. paratuberculosis
cggcgaugccagcgcaccgggcc

SEQ ID NO: 2993061 - RNA, 20 nt, Mycobacterium avium subsp. paratuberculosis
cggcgaugcccacagccagg

SEQ ID NO: 2993062 - RNA, 22 nt, Mycobacterium avium subsp. paratuberculosis
cggcgaugcccacagccaggug

SEQ ID NO: 2993063 - RNA, 14 nt, Mycobacterium avium subsp. paratuberculosis
cggcgaugcccgug

SEQ ID NO: 2993064 - RNA, 18 nt, Mycobacterium avium subsp. paratuberculosis
cggcgaugcccgugaucg

SEQ ID NO: 2993065 - RNA, 21 nt, Mycobacterium avium subsp. paratuberculosis
cggcgaugccguugaucaccg

SEQ ID NO: 2993066 - RNA, 18 nt, Mycobacterium avium subsp. paratuberculosis
cggcgaugccuuccucgg

SEQ ID NO: 2993067 - RNA, 20 nt, Mycobacterium avium subsp. paratuberculosis
cggcgaugccuuccucggcg

SEQ ID NO: 2993068 - RNA, 15 nt, Mycobacterium avium subsp. paratuberculosis
cggcgaugcgcacca

SEQ ID NO: 2993069 - RNA, 22 nt, Mycobacterium avium subsp. paratuberculosis
cggcgaugcgcaccaucaccug

SEQ ID NO: 2993070 - RNA, 20 nt, Mycobacterium avium subsp. paratuberculosis
cggcgaugcgcacgucggcc

SEQ ID NO: 2993071 - RNA, 21 nt, Mycobacterium avium subsp. paratuberculosis
cggcgaugcgcacgucggccg

SEQ ID NO: 2993072 - RNA, 22 nt, Mycobacterium avium subsp. paratuberculosis
cggcgaugcgcacgucggccgc

SEQ ID NO: 2993073 - RNA, 17 nt, Mycobacterium avium subsp. paratuberculosis
cggcgaugcgccgucuc

SEQ ID NO: 2993074 - RNA, 15 nt, Mycobacterium avium subsp. paratuberculosis
cggcgaugcgcgccu

SEQ ID NO: 2993075 - RNA, 20 nt, Mycobacterium avium subsp. paratuberculosis
cggcgaugcgcgccuccgac

SEQ ID NO: 2993076 - RNA, 14 nt, Mycobacterium avium subsp. paratuberculosis
cggcgaugcgcggc

SEQ ID NO: 2993077 - RNA, 16 nt, Mycobacterium avium subsp. paratuberculosis
cggcgaugcgcggccc

SEQ ID NO: 2993078 - RNA, 19 nt, Mycobacterium avium subsp. paratuberculosis
cggcgaugcgcuccagcag

SEQ ID NO: 2993079 - RNA, 13 nt, Mycobacterium avium subsp. paratuberculosis
cggcgaugcggug

SEQ ID NO: 2993080 - RNA, 21 nt, Mycobacterium avium subsp. paratuberculosis
cggcgaugcguugcgccagca

SEQ ID NO: 2993081 - RNA, 22 nt, Mycobacterium avium subsp. paratuberculosis
cggcgaugcguugcgccagcac

SEQ ID NO: 2993082 - RNA, 19 nt, Mycobacterium avium subsp. paratuberculosis
cggcgauggacguccagcg

SEQ ID NO: 2993083 - RNA, 23 nt, Mycobacterium avium subsp. paratuberculosis
cggcgauggacguccagcggccc

SEQ ID NO: 2993084 - RNA, 23 nt, Mycobacterium avium subsp. paratuberculosis
cggcgauggaguagcugaccgau

SEQ ID NO: 2993085 - RNA, 16 nt, Mycobacterium avium subsp. paratuberculosis
cggcgauggcccgcug

SEQ ID NO: 2993086 - RNA, 19 nt, Mycobacterium avium subsp. paratuberculosis
cggcgauggcccgcugcgc

SEQ ID NO: 2993087 - RNA, 20 nt, Mycobacterium avium subsp. paratuberculosis
cggcgauggcccgcugcgcc

SEQ ID NO: 2993088 - RNA, 23 nt, Mycobacterium avium subsp. paratuberculosis
cggcgauggcccgcugcgccgac

SEQ ID NO: 2993089 - RNA, 14 nt, Mycobacterium avium subsp. paratuberculosis
cggcgauggccgac

SEQ ID NO: 2993090 - RNA, 15 nt, Mycobacterium avium subsp. paratuberculosis
cggcgauggccgaca

SEQ ID NO: 2993091 - RNA, 12 nt, Mycobacterium avium subsp. paratuberculosis
cggcgauggccu

SEQ ID NO: 2993092 - RNA, 14 nt, Mycobacterium avium subsp. paratuberculosis
cggcgauggcgcgg

SEQ ID NO: 2993093 - RNA, 17 nt, Mycobacterium avium subsp. paratuberculosis
cggcgauggcgcggccg

SEQ ID NO: 2993094 - RNA, 15 nt, Mycobacterium avium subsp. paratuberculosis
cggcgauggcggcgu

SEQ ID NO: 2993095 - RNA, 16 nt, Mycobacterium avium subsp. paratuberculosis
cggcgauggugaacuc

SEQ ID NO: 2993096 - RNA, 23 nt, Mycobacterium avium subsp. paratuberculosis
cggcgauggugaugugcggcgcg

SEQ ID NO: 2993097 - RNA, 17 nt, Mycobacterium avium subsp. paratuberculosis
cggcgaugguggcgcug

SEQ ID NO: 2993098 - RNA, 18 nt, Mycobacterium avium subsp. paratuberculosis
cggcgaugguggcgcugc

SEQ ID NO: 2993099 - RNA, 17 nt, Mycobacterium avium subsp. paratuberculosis
cggcgauggugggcagc

SEQ ID NO: 2993100 - RNA, 19 nt, Mycobacterium avium subsp. paratuberculosis
cggcgauggugggcagccg

SEQ ID NO: 2993101 - RNA, 20 nt, Mycobacterium avium subsp. paratuberculosis
cggcgauggugggcagccgg

SEQ ID NO: 2993102 - RNA, 21 nt, Mycobacterium avium subsp. paratuberculosis
cggcgauggugggcagccggc

SEQ ID NO: 2993103 - RNA, 15 nt, Mycobacterium avium subsp. paratuberculosis
cggcgaugucgggca

SEQ ID NO: 2993104 - RNA, 13 nt, Mycobacterium avium subsp. paratuberculosis
cggcgaugucguc

SEQ ID NO: 2993105 - RNA, 16 nt, Mycobacterium avium subsp. paratuberculosis
cggcgaugucgucgac

SEQ ID NO: 2993106 - RNA, 21 nt, Mycobacterium avium subsp. paratuberculosis
cggcgaugucgucgacgcugc

SEQ ID NO: 2993107 - RNA, 22 nt, Mycobacterium avium subsp. paratuberculosis
cggcgauguggcguucgaugcc

SEQ ID NO: 2993108 - RNA, 23 nt, Mycobacterium avium subsp. paratuberculosis
cggcgauguggcguucgaugccc

SEQ ID NO: 2993109 - RNA, 22 nt, Mycobacterium avium subsp. paratuberculosis
cggcgauguugaccacccgcag

SEQ ID NO: 2993110 - RNA, 18 nt, Mycobacterium avium subsp. paratuberculosis
cggcgauuaggucggugg

SEQ ID NO: 2993111 - RNA, 19 nt, Mycobacterium avium subsp. paratuberculosis
cggcgauuaggucgguggc

SEQ ID NO: 2993112 - RNA, 20 nt, Mycobacterium avium subsp. paratuberculosis
cggcgauuaggucgguggcc

SEQ ID NO: 2993113 - RNA, 22 nt, Mycobacterium avium subsp. paratuberculosis
cggcgauuaggucgguggccac

SEQ ID NO: 2993114 - RNA, 18 nt, Mycobacterium avium subsp. paratuberculosis
cggcgauuucggccguga

SEQ ID NO: 2993115 - RNA, 19 nt, Mycobacterium avium subsp. paratuberculosis
cggcgauuucggccgugau

SEQ ID NO: 2993116 - RNA, 19 nt, Mycobacterium avium subsp. paratuberculosis
cggcgcaaccaacucgcga

SEQ ID NO: 2993117 - RNA, 20 nt, Mycobacterium avium subsp. paratuberculosis
cggcgcaaccaacucgcgau

SEQ ID NO: 2993118 - RNA, 15 nt, Mycobacterium avium subsp. paratuberculosis
cggcgcaacgggaug

SEQ ID NO: 2993119 - RNA, 21 nt, Mycobacterium avium subsp. paratuberculosis
cggcgcaaucggggccgaccc

SEQ ID NO: 2993120 - RNA, 21 nt, Mycobacterium avium subsp. paratuberculosis
cggcgcacagcuaggucgugg

SEQ ID NO: 2993121 - RNA, 19 nt, Mycobacterium avium subsp. paratuberculosis
cggcgcacaggaacgcguc

SEQ ID NO: 2993122 - RNA, 15 nt, Mycobacterium avium subsp. paratuberculosis
cggcgcacaucgugg

SEQ ID NO: 2993123 - RNA, 20 nt, Mycobacterium avium subsp. paratuberculosis
cggcgcacaucguggcgacg

SEQ ID NO: 2993124 - RNA, 21 nt, Mycobacterium avium subsp. paratuberculosis
cggcgcaccaaccggccccga

SEQ ID NO: 2993125 - RNA, 22 nt, Mycobacterium avium subsp. paratuberculosis
cggcgcaccaaccggccccgag

SEQ ID NO: 2993126 - RNA, 13 nt, Mycobacterium avium subsp. paratuberculosis
cggcgcaccaggc

SEQ ID NO: 2993127 - RNA, 17 nt, Mycobacterium avium subsp. paratuberculosis
cggcgcaccaggcgcca

SEQ ID NO: 2993128 - RNA, 19 nt, Mycobacterium avium subsp. paratuberculosis
cggcgcaccaggcgccaca

SEQ ID NO: 2993129 - RNA, 21 nt, Mycobacterium avium subsp. paratuberculosis
cggcgcaccagggugucgucg

SEQ ID NO: 2993130 - RNA, 21 nt, Mycobacterium avium subsp. paratuberculosis
cggcgcaccccguccaggaug

SEQ ID NO: 2993131 - RNA, 12 nt, Mycobacterium avium subsp. paratuberculosis
cggcgcacccgc

SEQ ID NO: 2993132 - RNA, 17 nt, Mycobacterium avium subsp. paratuberculosis
cggcgcacccgggcagc

SEQ ID NO: 2993133 - RNA, 15 nt, Mycobacterium avium subsp. paratuberculosis
cggcgcaccgagucg

SEQ ID NO: 2993134 - RNA, 14 nt, Mycobacterium avium subsp. paratuberculosis
cggcgcaccgcccg

SEQ ID NO: 2993135 - RNA, 16 nt, Mycobacterium avium subsp. paratuberculosis
cggcgcaccgcccgcg

SEQ ID NO: 2993136 - RNA, 12 nt, Mycobacterium avium subsp. paratuberculosis
cggcgcaccgcg

SEQ ID NO: 2993137 - RNA, 13 nt, Mycobacterium avium subsp. paratuberculosis
cggcgcaccgcgu

SEQ ID NO: 2993138 - RNA, 14 nt, Mycobacterium avium subsp. paratuberculosis
cggcgcaccgcguc

SEQ ID NO: 2993139 - RNA, 15 nt, Mycobacterium avium subsp. paratuberculosis
cggcgcaccgcgucg

SEQ ID NO: 2993140 - RNA, 19 nt, Mycobacterium avium subsp. paratuberculosis
cggcgcaccgcgucgacca

SEQ ID NO: 2993141 - RNA, 18 nt, Mycobacterium avium subsp. paratuberculosis
cggcgcaccgcgucgaug

SEQ ID NO: 2993142 - RNA, 23 nt, Mycobacterium avium subsp. paratuberculosis
cggcgcaccgugucgucgcugac

SEQ ID NO: 2993143 - RNA, 17 nt, Mycobacterium avium subsp. paratuberculosis
cggcgcaccuggcgcag

SEQ ID NO: 2993144 - RNA, 19 nt, Mycobacterium avium subsp. paratuberculosis
cggcgcaccuggcgcagca

SEQ ID NO: 2993145 - RNA, 22 nt, Mycobacterium avium subsp. paratuberculosis
cggcgcaccuggcgcagcaccg

SEQ ID NO: 2993146 - RNA, 16 nt, Mycobacterium avium subsp. paratuberculosis
cggcgcacgcagugcc

SEQ ID NO: 2993147 - RNA, 18 nt, Mycobacterium avium subsp. paratuberculosis
cggcgcacgcagugccgc

SEQ ID NO: 2993148 - RNA, 22 nt, Mycobacterium avium subsp. paratuberculosis
cggcgcagaaaccauuccgcca

SEQ ID NO: 2993149 - RNA, 17 nt, Mycobacterium avium subsp. paratuberculosis
cggcgcagaugaccggc

SEQ ID NO: 2993150 - RNA, 19 nt, Mycobacterium avium subsp. paratuberculosis
cggcgcagaugaccggccu

SEQ ID NO: 2993151 - RNA, 11 nt, Mycobacterium avium subsp. paratuberculosis
cggcgcagcaa

SEQ ID NO: 2993152 - RNA, 14 nt, Mycobacterium avium subsp. paratuberculosis
cggcgcagcacggc

SEQ ID NO: 2993153 - RNA, 21 nt, Mycobacterium avium subsp. paratuberculosis
cggcgcagcacggccacugcc

SEQ ID NO: 2993154 - RNA, 14 nt, Mycobacterium avium subsp. paratuberculosis
cggcgcagccagcg

SEQ ID NO: 2993155 - RNA, 16 nt, Mycobacterium avium subsp. paratuberculosis
cggcgcagccagcgcc

SEQ ID NO: 2993156 - RNA, 14 nt, Mycobacterium avium subsp. paratuberculosis
cggcgcagccagcu

SEQ ID NO: 2993157 - RNA, 16 nt, Mycobacterium avium subsp. paratuberculosis
cggcgcagccagcucg

SEQ ID NO: 2993158 - RNA, 17 nt, Mycobacterium avium subsp. paratuberculosis
cggcgcagccagcucgg

SEQ ID NO: 2993159 - RNA, 18 nt, Mycobacterium avium subsp. paratuberculosis
cggcgcagccagcucggc

SEQ ID NO: 2993160 - RNA, 21 nt, Mycobacterium avium subsp. paratuberculosis
cggcgcagccagcucggcgua

SEQ ID NO: 2993161 - RNA, 13 nt, Mycobacterium avium subsp. paratuberculosis
cggcgcagccggc

SEQ ID NO: 2993162 - RNA, 14 nt, Mycobacterium avium subsp. paratuberculosis
cggcgcagccggcc

SEQ ID NO: 2993163 - RNA, 16 nt, Mycobacterium avium subsp. paratuberculosis
cggcgcagccggccac

SEQ ID NO: 2993164 - RNA, 17 nt, Mycobacterium avium subsp. paratuberculosis
cggcgcagccggccacc

SEQ ID NO: 2993165 - RNA, 19 nt, Mycobacterium avium subsp. paratuberculosis
cggcgcagccggccaccgc

SEQ ID NO: 2993166 - RNA, 21 nt, Mycobacterium avium subsp. paratuberculosis
cggcgcagccggccaccgccc

SEQ ID NO: 2993167 - RNA, 18 nt, Mycobacterium avium subsp. paratuberculosis
cggcgcagcgcacgucgc

SEQ ID NO: 2993168 - RNA, 15 nt, Mycobacterium avium subsp. paratuberculosis
cggcgcagcgccgcg

SEQ ID NO: 2993169 - RNA, 12 nt, Mycobacterium avium subsp. paratuberculosis
cggcgcagcgcg

SEQ ID NO: 2993170 - RNA, 17 nt, Mycobacterium avium subsp. paratuberculosis
cggcgcagcgcgauguc

SEQ ID NO: 2993171 - RNA, 13 nt, Mycobacterium avium subsp. paratuberculosis
cggcgcagcgcgu

SEQ ID NO: 2993172 - RNA, 19 nt, Mycobacterium avium subsp. paratuberculosis
cggcgcagcgcgucgcgcc

SEQ ID NO: 2993173 - RNA, 21 nt, Mycobacterium avium subsp. paratuberculosis
cggcgcagcgcgucgcgcccg

SEQ ID NO: 2993174 - RNA, 23 nt, Mycobacterium avium subsp. paratuberculosis
cggcgcagcgucucgaucgacga

SEQ ID NO: 2993175 - RNA, 13 nt, Mycobacterium avium subsp. paratuberculosis
cggcgcagcucgc

SEQ ID NO: 2993176 - RNA, 15 nt, Mycobacterium avium subsp. paratuberculosis
cggcgcagcucgcgc

SEQ ID NO: 2993177 - RNA, 17 nt, Mycobacterium avium subsp. paratuberculosis
cggcgcagcucgcgcag

SEQ ID NO: 2993178 - RNA, 21 nt, Mycobacterium avium subsp. paratuberculosis
cggcgcagcucgcgcagcugg

SEQ ID NO: 2993179 - RNA, 19 nt, Mycobacterium avium subsp. paratuberculosis
cggcgcaggcauuuccagg

SEQ ID NO: 2993180 - RNA, 12 nt, Mycobacterium avium subsp. paratuberculosis
cggcgcaggcgc

SEQ ID NO: 2993181 - RNA, 13 nt, Mycobacterium avium subsp. paratuberculosis
cggcgcaggcgcg

SEQ ID NO: 2993182 - RNA, 18 nt, Mycobacterium avium subsp. paratuberculosis
cggcgcaggcgcgcacca

SEQ ID NO: 2993183 - RNA, 20 nt, Mycobacterium avium subsp. paratuberculosis
cggcgcaggcgcgcaccauc

SEQ ID NO: 2993184 - RNA, 14 nt, Mycobacterium avium subsp. paratuberculosis
cggcgcagggcggc

SEQ ID NO: 2993185 - RNA, 18 nt, Mycobacterium avium subsp. paratuberculosis
cggcgcagggcggccggc

SEQ ID NO: 2993186 - RNA, 20 nt, Mycobacterium avium subsp. paratuberculosis
cggcgcagggcggccggcca

SEQ ID NO: 2993187 - RNA, 21 nt, Mycobacterium avium subsp. paratuberculosis
cggcgcagggcggccggccag

SEQ ID NO: 2993188 - RNA, 19 nt, Mycobacterium avium subsp. paratuberculosis
cggcgcagguccggcagcg

SEQ ID NO: 2993189 - RNA, 22 nt, Mycobacterium avium subsp. paratuberculosis
cggcgcagguccggcagcgcgc

SEQ ID NO: 2993190 - RNA, 18 nt, Mycobacterium avium subsp. paratuberculosis
cggcgcagguguccagcc

SEQ ID NO: 2993191 - RNA, 22 nt, Mycobacterium avium subsp. paratuberculosis
cggcgcagucgaucucgucgca

SEQ ID NO: 2993192 - RNA, 16 nt, Mycobacterium avium subsp. paratuberculosis
cggcgcagucggccgg

SEQ ID NO: 2993193 - RNA, 17 nt, Mycobacterium avium subsp. paratuberculosis
cggcgcagucggccgga

SEQ ID NO: 2993194 - RNA, 20 nt, Mycobacterium avium subsp. paratuberculosis
cggcgcaguucgaccggcac

SEQ ID NO: 2993195 - RNA, 21 nt, Mycobacterium avium subsp. paratuberculosis
cggcgcaguucgaccggcacc

SEQ ID NO: 2993196 - RNA, 16 nt, Mycobacterium avium subsp. paratuberculosis
cggcgcaucaucucgg

SEQ ID NO: 2993197 - RNA, 20 nt, Mycobacterium avium subsp. paratuberculosis
cggcgcaugaccgauccgcc

SEQ ID NO: 2993198 - RNA, 23 nt, Mycobacterium avium subsp. paratuberculosis
cggcgcaugaccgauccgccggc

SEQ ID NO: 2993199 - RNA, 20 nt, Mycobacterium avium subsp. paratuberculosis
cggcgcaugaucgcccgcuc

SEQ ID NO: 2993200 - RNA, 17 nt, Mycobacterium avium subsp. paratuberculosis
cggcgccaacaacucag

SEQ ID NO: 2993201 - RNA, 17 nt, Mycobacterium avium subsp. paratuberculosis
cggcgccaacaacucga

SEQ ID NO: 2993202 - RNA, 21 nt, Mycobacterium avium subsp. paratuberculosis
cggcgccaacaacucgacgcu

SEQ ID NO: 2993203 - RNA, 22 nt, Mycobacterium avium subsp. paratuberculosis
cggcgccaacaacucgacgcuc

SEQ ID NO: 2993204 - RNA, 12 nt, Mycobacterium avium subsp. paratuberculosis
cggcgccaaccu

SEQ ID NO: 2993205 - RNA, 12 nt, Mycobacterium avium subsp. paratuberculosis
cggcgccaccag

SEQ ID NO: 2993206 - RNA, 19 nt, Mycobacterium avium subsp. paratuberculosis
cggcgccaccagccacacc

SEQ ID NO: 2993207 - RNA, 14 nt, Mycobacterium avium subsp. paratuberculosis
cggcgccaccccgg

SEQ ID NO: 2993208 - RNA, 15 nt, Mycobacterium avium subsp. paratuberculosis
cggcgccaccccggg

SEQ ID NO: 2993209 - RNA, 14 nt, Mycobacterium avium subsp. paratuberculosis
cggcgccaccggcu

SEQ ID NO: 2993210 - RNA, 14 nt, Mycobacterium avium subsp. paratuberculosis
cggcgccaccggga

SEQ ID NO: 2993211 - RNA, 23 nt, Mycobacterium avium subsp. paratuberculosis
cggcgccaccgggaccugcugcu

SEQ ID NO: 2993212 - RNA, 17 nt, Mycobacterium avium subsp. paratuberculosis
cggcgccacgaccagcg

SEQ ID NO: 2993213 - RNA, 18 nt, Mycobacterium avium subsp. paratuberculosis
cggcgccacgaccagcgg

SEQ ID NO: 2993214 - RNA, 15 nt, Mycobacterium avium subsp. paratuberculosis
cggcgccacgacugc

SEQ ID NO: 2993215 - RNA, 23 nt, Mycobacterium avium subsp. paratuberculosis
cggcgccacgacugcgcggccgg

SEQ ID NO: 2993216 - RNA, 17 nt, Mycobacterium avium subsp. paratuberculosis
cggcgccacgcacaccg

SEQ ID NO: 2993217 - RNA, 20 nt, Mycobacterium avium subsp. paratuberculosis
cggcgccacgcacaccgcgc

SEQ ID NO: 2993218 - RNA, 22 nt, Mycobacterium avium subsp. paratuberculosis
cggcgccacgcacaccgcgcgc

SEQ ID NO: 2993219 - RNA, 20 nt, Mycobacterium avium subsp. paratuberculosis
cggcgccacgccgcgauccg

SEQ ID NO: 2993220 - RNA, 22 nt, Mycobacterium avium subsp. paratuberculosis
cggcgccacgccgcgauccggg

SEQ ID NO: 2993221 - RNA, 15 nt, Mycobacterium avium subsp. paratuberculosis
cggcgccacgugguc

SEQ ID NO: 2993222 - RNA, 17 nt, Mycobacterium avium subsp. paratuberculosis
cggcgccagcccgccga

SEQ ID NO: 2993223 - RNA, 18 nt, Mycobacterium avium subsp. paratuberculosis
cggcgccagccgcaccgc

SEQ ID NO: 2993224 - RNA, 13 nt, Mycobacterium avium subsp. paratuberculosis
cggcgccagcggc

SEQ ID NO: 2993225 - RNA, 14 nt, Mycobacterium avium subsp. paratuberculosis
cggcgccagcggcc

SEQ ID NO: 2993226 - RNA, 15 nt, Mycobacterium avium subsp. paratuberculosis
cggcgccagcggccg

SEQ ID NO: 2993227 - RNA, 20 nt, Mycobacterium avium subsp. paratuberculosis
cggcgccagcggccgaucau

SEQ ID NO: 2993228 - RNA, 14 nt, Mycobacterium avium subsp. paratuberculosis
cggcgccaggccgg

SEQ ID NO: 2993229 - RNA, 16 nt, Mycobacterium avium subsp. paratuberculosis
cggcgccaggccggcg

SEQ ID NO: 2993230 - RNA, 19 nt, Mycobacterium avium subsp. paratuberculosis
cggcgccaggccggcgacg

SEQ ID NO: 2993231 - RNA, 22 nt, Mycobacterium avium subsp. paratuberculosis
cggcgccaggccggcgacgccg

SEQ ID NO: 2993232 - RNA, 23 nt, Mycobacterium avium subsp. paratuberculosis
cggcgccaggccggcgacgccgg

SEQ ID NO: 2993233 - RNA, 13 nt, Mycobacterium avium subsp. paratuberculosis
cggcgccaggucg

SEQ ID NO: 2993234 - RNA, 17 nt, Mycobacterium avium subsp. paratuberculosis
cggcgccaggucggggu

SEQ ID NO: 2993235 - RNA, 18 nt, Mycobacterium avium subsp. paratuberculosis
cggcgccaucguggccgc

SEQ ID NO: 2993236 - RNA, 21 nt, Mycobacterium avium subsp. paratuberculosis
cggcgccaugaacggcggggc

SEQ ID NO: 2993237 - RNA, 19 nt, Mycobacterium avium subsp. paratuberculosis
cggcgccaugaacuccgac

SEQ ID NO: 2993238 - RNA, 22 nt, Mycobacterium avium subsp. paratuberculosis
cggcgccaugaacuccgacucc

SEQ ID NO: 2993239 - RNA, 12 nt, Mycobacterium avium subsp. paratuberculosis
cggcgcccaccg

SEQ ID NO: 2993240 - RNA, 15 nt, Mycobacterium avium subsp. paratuberculosis
cggcgcccaccgcgg

SEQ ID NO: 2993241 - RNA, 17 nt, Mycobacterium avium subsp. paratuberculosis
cggcgcccaccgcggcg

SEQ ID NO: 2993242 - RNA, 19 nt, Mycobacterium avium subsp. paratuberculosis
cggcgcccaccgcggcgcg

SEQ ID NO: 2993243 - RNA, 20 nt, Mycobacterium avium subsp. paratuberculosis
cggcgcccaccgcggcgcgc

SEQ ID NO: 2993244 - RNA, 15 nt, Mycobacterium avium subsp. paratuberculosis
cggcgcccacggcca

SEQ ID NO: 2993245 - RNA, 14 nt, Mycobacterium avium subsp. paratuberculosis
cggcgcccagcggc

SEQ ID NO: 2993246 - RNA, 15 nt, Mycobacterium avium subsp. paratuberculosis
cggcgcccagcggcg

SEQ ID NO: 2993247 - RNA, 19 nt, Mycobacterium avium subsp. paratuberculosis
cggcgcccagcggcgaugc

SEQ ID NO: 2993248 - RNA, 12 nt, Mycobacterium avium subsp. paratuberculosis
cggcgcccagga

SEQ ID NO: 2993249 - RNA, 14 nt, Mycobacterium avium subsp. paratuberculosis
cggcgcccaggucc

SEQ ID NO: 2993250 - RNA, 18 nt, Mycobacterium avium subsp. paratuberculosis
cggcgcccagguccacca

SEQ ID NO: 2993251 - RNA, 23 nt, Mycobacterium avium subsp. paratuberculosis
cggcgcccagguccaccagguga

SEQ ID NO: 2993252 - RNA, 21 nt, Mycobacterium avium subsp. paratuberculosis
cggcgccccacgccuggcgga

SEQ ID NO: 2993253 - RNA, 14 nt, Mycobacterium avium subsp. paratuberculosis
cggcgcccccgcga

SEQ ID NO: 2993254 - RNA, 19 nt, Mycobacterium avium subsp. paratuberculosis
cggcgcccccgcgacgucc

SEQ ID NO: 2993255 - RNA, 12 nt, Mycobacterium avium subsp. paratuberculosis
cggcgccccgcc

SEQ ID NO: 2993256 - RNA, 14 nt, Mycobacterium avium subsp. paratuberculosis
cggcgccccgcccg

SEQ ID NO: 2993257 - RNA, 18 nt, Mycobacterium avium subsp. paratuberculosis
cggcgccccgcccgcgac

SEQ ID NO: 2993258 - RNA, 12 nt, Mycobacterium avium subsp. paratuberculosis
cggcgccccggc

SEQ ID NO: 2993259 - RNA, 14 nt, Mycobacterium avium subsp. paratuberculosis
cggcgccccggcgc

SEQ ID NO: 2993260 - RNA, 17 nt, Mycobacterium avium subsp. paratuberculosis
cggcgccccgggcagcg

SEQ ID NO: 2993261 - RNA, 18 nt, Mycobacterium avium subsp. paratuberculosis
cggcgccccgggcagcga

SEQ ID NO: 2993262 - RNA, 19 nt, Mycobacterium avium subsp. paratuberculosis
cggcgccccgggcagcgaa

SEQ ID NO: 2993263 - RNA, 21 nt, Mycobacterium avium subsp. paratuberculosis
cggcgcccgacauccaggacc

SEQ ID NO: 2993264 - RNA, 18 nt, Mycobacterium avium subsp. paratuberculosis
cggcgcccgaucggcacc

SEQ ID NO: 2993265 - RNA, 21 nt, Mycobacterium avium subsp. paratuberculosis
cggcgcccgaucggcacccgc

SEQ ID NO: 2993266 - RNA, 14 nt, Mycobacterium avium subsp. paratuberculosis
cggcgcccgcaggc

SEQ ID NO: 2993267 - RNA, 21 nt, Mycobacterium avium subsp. paratuberculosis
cggcgcccgcaggccgcgagc

SEQ ID NO: 2993268 - RNA, 12 nt, Mycobacterium avium subsp. paratuberculosis
cggcgcccgccc

SEQ ID NO: 2993269 - RNA, 15 nt, Mycobacterium avium subsp. paratuberculosis
cggcgcccgccccga

SEQ ID NO: 2993270 - RNA, 23 nt, Mycobacterium avium subsp. paratuberculosis
cggcgcccgccccgacgugcagc

SEQ ID NO: 2993271 - RNA, 13 nt, Mycobacterium avium subsp. paratuberculosis
cggcgcccgcggc

SEQ ID NO: 2993272 - RNA, 16 nt, Mycobacterium avium subsp. paratuberculosis
cggcgcccgcggccuc

SEQ ID NO: 2993273 - RNA, 17 nt, Mycobacterium avium subsp. paratuberculosis
cggcgcccgcggccucc

SEQ ID NO: 2993274 - RNA, 22 nt, Mycobacterium avium subsp. paratuberculosis
cggcgcccgcggccuccagccg

SEQ ID NO: 2993275 - RNA, 15 nt, Mycobacterium avium subsp. paratuberculosis
cggcgcccgcuccgg

SEQ ID NO: 2993276 - RNA, 15 nt, Mycobacterium avium subsp. paratuberculosis
cggcgcccggcaccg

SEQ ID NO: 2993277 - RNA, 13 nt, Mycobacterium avium subsp. paratuberculosis
cggcgcccggccc

SEQ ID NO: 2993278 - RNA, 16 nt, Mycobacterium avium subsp. paratuberculosis
cggcgcccggcccagc

SEQ ID NO: 2993279 - RNA, 17 nt, Mycobacterium avium subsp. paratuberculosis
cggcgcccggcccagcc

SEQ ID NO: 2993280 - RNA, 18 nt, Mycobacterium avium subsp. paratuberculosis
cggcgcccggcccagccg

SEQ ID NO: 2993281 - RNA, 20 nt, Mycobacterium avium subsp. paratuberculosis
cggcgcccggcccagccgcu

SEQ ID NO: 2993282 - RNA, 22 nt, Mycobacterium avium subsp. paratuberculosis
cggcgcccggcccagccgcugc

SEQ ID NO: 2993283 - RNA, 14 nt, Mycobacterium avium subsp. paratuberculosis
cggcgcccggccgg

SEQ ID NO: 2993284 - RNA, 21 nt, Mycobacterium avium subsp. paratuberculosis
cggcgcccggccggccccuac

SEQ ID NO: 2993285 - RNA, 15 nt, Mycobacterium avium subsp. paratuberculosis
cggcgcccggccggu

SEQ ID NO: 2993286 - RNA, 18 nt, Mycobacterium avium subsp. paratuberculosis
cggcgcccggccggugcu

SEQ ID NO: 2993287 - RNA, 13 nt, Mycobacterium avium subsp. paratuberculosis
cggcgcccggcgc

SEQ ID NO: 2993288 - RNA, 18 nt, Mycobacterium avium subsp. paratuberculosis
cggcgcccggcgcccggc

SEQ ID NO: 2993289 - RNA, 14 nt, Mycobacterium avium subsp. paratuberculosis
cggcgcccggcgcg

SEQ ID NO: 2993290 - RNA, 15 nt, Mycobacterium avium subsp. paratuberculosis
cggcgcccggcgcgc

SEQ ID NO: 2993291 - RNA, 19 nt, Mycobacterium avium subsp. paratuberculosis
cggcgcccggcgcgccacg

SEQ ID NO: 2993292 - RNA, 14 nt, Mycobacterium avium subsp. paratuberculosis
cggcgcccgucacg

SEQ ID NO: 2993293 - RNA, 20 nt, Mycobacterium avium subsp. paratuberculosis
cggcgcccucgaugcgcacc

SEQ ID NO: 2993294 - RNA, 12 nt, Mycobacterium avium subsp. paratuberculosis
cggcgcccucgc

SEQ ID NO: 2993295 - RNA, 16 nt, Mycobacterium avium subsp. paratuberculosis
cggcgcccucgccgac

SEQ ID NO: 2993296 - RNA, 18 nt, Mycobacterium avium subsp. paratuberculosis
cggcgcccucgccgaccu

SEQ ID NO: 2993297 - RNA, 20 nt, Mycobacterium avium subsp. paratuberculosis
cggcgcccucgccgaccugu

SEQ ID NO: 2993298 - RNA, 15 nt, Mycobacterium avium subsp. paratuberculosis
cggcgcccucgccgg

SEQ ID NO: 2993299 - RNA, 19 nt, Mycobacterium avium subsp. paratuberculosis
cggcgcccucgccggcggc

SEQ ID NO: 2993300 - RNA, 16 nt, Mycobacterium avium subsp. paratuberculosis
cggcgcccucggcgau

SEQ ID NO: 2993301 - RNA, 14 nt, Mycobacterium avium subsp. paratuberculosis
cggcgcccugcacc

SEQ ID NO: 2993302 - RNA, 15 nt, Mycobacterium avium subsp. paratuberculosis
cggcgcccugcaccc

SEQ ID NO: 2993303 - RNA, 16 nt, Mycobacterium avium subsp. paratuberculosis
cggcgcccugcaccca

SEQ ID NO: 2993304 - RNA, 17 nt, Mycobacterium avium subsp. paratuberculosis
cggcgcccugcacccag

SEQ ID NO: 2993305 - RNA, 18 nt, Mycobacterium avium subsp. paratuberculosis
cggcgcccugcacccagc

SEQ ID NO: 2993306 - RNA, 19 nt, Mycobacterium avium subsp. paratuberculosis
cggcgcccugcacccagcc

SEQ ID NO: 2993307 - RNA, 13 nt, Mycobacterium avium subsp. paratuberculosis
cggcgcccugcga

SEQ ID NO: 2993308 - RNA, 16 nt, Mycobacterium avium subsp. paratuberculosis
cggcgcccugcgcgcc

SEQ ID NO: 2993309 - RNA, 23 nt, Mycobacterium avium subsp. paratuberculosis
cggcgcccugcgcgcccugcugg

SEQ ID NO: 2993310 - RNA, 17 nt, Mycobacterium avium subsp. paratuberculosis
cggcgcccuucccgguc

SEQ ID NO: 2993311 - RNA, 20 nt, Mycobacterium avium subsp. paratuberculosis
cggcgcccuucccggucggc

SEQ ID NO: 2993312 - RNA, 17 nt, Mycobacterium avium subsp. paratuberculosis
cggcgcccuucggcgcc

SEQ ID NO: 2993313 - RNA, 13 nt, Mycobacterium avium subsp. paratuberculosis
cggcgccgaaccg

SEQ ID NO: 2993314 - RNA, 18 nt, Mycobacterium avium subsp. paratuberculosis
cggcgccgaaccggguga

SEQ ID NO: 2993315 - RNA, 20 nt, Mycobacterium avium subsp. paratuberculosis
cggcgccgaaccgggugacg

SEQ ID NO: 2993316 - RNA, 18 nt, Mycobacterium avium subsp. paratuberculosis
cggcgccgaacucggcgc

SEQ ID NO: 2993317 - RNA, 21 nt, Mycobacterium avium subsp. paratuberculosis
cggcgccgaacucggcgccgc

SEQ ID NO: 2993318 - RNA, 17 nt, Mycobacterium avium subsp. paratuberculosis
cggcgccgaagcccgca

SEQ ID NO: 2993319 - RNA, 19 nt, Mycobacterium avium subsp. paratuberculosis
cggcgccgaagcccgcagc

SEQ ID NO: 2993320 - RNA, 22 nt, Mycobacterium avium subsp. paratuberculosis
cggcgccgaagcccgcagcgaa

SEQ ID NO: 2993321 - RNA, 18 nt, Mycobacterium avium subsp. paratuberculosis
cggcgccgaagccgucga

SEQ ID NO: 2993322 - RNA, 21 nt, Mycobacterium avium subsp. paratuberculosis
cggcgccgacccccgccgcgu

SEQ ID NO: 2993323 - RNA, 22 nt, Mycobacterium avium subsp. paratuberculosis
cggcgccgacccccgccgcguc

SEQ ID NO: 2993324 - RNA, 18 nt, Mycobacterium avium subsp. paratuberculosis
cggcgccgaccgagggcg

SEQ ID NO: 2993325 - RNA, 17 nt, Mycobacterium avium subsp. paratuberculosis
cggcgccgaccucggcc

SEQ ID NO: 2993326 - RNA, 18 nt, Mycobacterium avium subsp. paratuberculosis
cggcgccgaccucggcca

SEQ ID NO: 2993327 - RNA, 20 nt, Mycobacterium avium subsp. paratuberculosis
cggcgccgaccucggccagc

SEQ ID NO: 2993328 - RNA, 21 nt, Mycobacterium avium subsp. paratuberculosis
cggcgccgacgacgucgcgca

SEQ ID NO: 2993329 - RNA, 23 nt, Mycobacterium avium subsp. paratuberculosis
cggcgccgacgacgucgcgcagg

SEQ ID NO: 2993330 - RNA, 14 nt, Mycobacterium avium subsp. paratuberculosis
cggcgccgacgaug

SEQ ID NO: 2993331 - RNA, 13 nt, Mycobacterium avium subsp. paratuberculosis
cggcgccgacggc

SEQ ID NO: 2993332 - RNA, 15 nt, Mycobacterium avium subsp. paratuberculosis
cggcgccgacggcca

SEQ ID NO: 2993333 - RNA, 17 nt, Mycobacterium avium subsp. paratuberculosis
cggcgccgacggccagc

SEQ ID NO: 2993334 - RNA, 20 nt, Mycobacterium avium subsp. paratuberculosis
cggcgccgacggccagcagg

SEQ ID NO: 2993335 - RNA, 14 nt, Mycobacterium avium subsp. paratuberculosis
cggcgccgacgggc

SEQ ID NO: 2993336 - RNA, 20 nt, Mycobacterium avium subsp. paratuberculosis
cggcgccgacgggcccgcgc

SEQ ID NO: 2993337 - RNA, 16 nt, Mycobacterium avium subsp. paratuberculosis
cggcgccgacguccug

SEQ ID NO: 2993338 - RNA, 13 nt, Mycobacterium avium subsp. paratuberculosis
cggcgccgagcgu

SEQ ID NO: 2993339 - RNA, 16 nt, Mycobacterium avium subsp. paratuberculosis
cggcgccgagcgucac

SEQ ID NO: 2993340 - RNA, 17 nt, Mycobacterium avium subsp. paratuberculosis
cggcgccgagcgucacg

SEQ ID NO: 2993341 - RNA, 20 nt, Mycobacterium avium subsp. paratuberculosis
cggcgccgagcgucacgcug

SEQ ID NO: 2993342 - RNA, 15 nt, Mycobacterium avium subsp. paratuberculosis
cggcgccgagcguga

SEQ ID NO: 2993343 - RNA, 17 nt, Mycobacterium avium subsp. paratuberculosis
cggcgccgaucacgccg

SEQ ID NO: 2993344 - RNA, 18 nt, Mycobacterium avium subsp. paratuberculosis
cggcgccgaucacgccgg

SEQ ID NO: 2993345 - RNA, 21 nt, Mycobacterium avium subsp. paratuberculosis
cggcgccgaucacgccggugg

SEQ ID NO: 2993346 - RNA, 12 nt, Mycobacterium avium subsp. paratuberculosis
cggcgccgaucu

SEQ ID NO: 2993347 - RNA, 22 nt, Mycobacterium avium subsp. paratuberculosis
cggcgccgaucugcucggcugc

SEQ ID NO: 2993348 - RNA, 14 nt, Mycobacterium avium subsp. paratuberculosis
cggcgccgaugcag

SEQ ID NO: 2993349 - RNA, 18 nt, Mycobacterium avium subsp. paratuberculosis
cggcgccgaugcagcaca

SEQ ID NO: 2993350 - RNA, 18 nt, Mycobacterium avium subsp. paratuberculosis
cggcgccgauggcgaagc

SEQ ID NO: 2993351 - RNA, 18 nt, Mycobacterium avium subsp. paratuberculosis
cggcgccgauuccgucgg

SEQ ID NO: 2993352 - RNA, 13 nt, Mycobacterium avium subsp. paratuberculosis
cggcgccgcagca

SEQ ID NO: 2993353 - RNA, 15 nt, Mycobacterium avium subsp. paratuberculosis
cggcgccgccaccac

SEQ ID NO: 2993354 - RNA, 18 nt, Mycobacterium avium subsp. paratuberculosis
cggcgccgccaccacgau

SEQ ID NO: 2993355 - RNA, 15 nt, Mycobacterium avium subsp. paratuberculosis
cggcgccgccacggc

SEQ ID NO: 2993356 - RNA, 20 nt, Mycobacterium avium subsp. paratuberculosis
cggcgccgccacggcacguc

SEQ ID NO: 2993357 - RNA, 13 nt, Mycobacterium avium subsp. paratuberculosis
cggcgccgcccgg

SEQ ID NO: 2993358 - RNA, 14 nt, Mycobacterium avium subsp. paratuberculosis
cggcgccgcccggc

SEQ ID NO: 2993359 - RNA, 15 nt, Mycobacterium avium subsp. paratuberculosis
cggcgccgcccggcg

SEQ ID NO: 2993360 - RNA, 15 nt, Mycobacterium avium subsp. paratuberculosis
cggcgccgcccgggc

SEQ ID NO: 2993361 - RNA, 17 nt, Mycobacterium avium subsp. paratuberculosis
cggcgccgcccgggccc

SEQ ID NO: 2993362 - RNA, 13 nt, Mycobacterium avium subsp. paratuberculosis
cggcgccgccgag

SEQ ID NO: 2993363 - RNA, 12 nt, Mycobacterium avium subsp. paratuberculosis
cggcgccgccgg

SEQ ID NO: 2993364 - RNA, 14 nt, Mycobacterium avium subsp. paratuberculosis
cggcgccgccgguc

SEQ ID NO: 2993365 - RNA, 16 nt, Mycobacterium avium subsp. paratuberculosis
cggcgccgccggucgc

SEQ ID NO: 2993366 - RNA, 17 nt, Mycobacterium avium subsp. paratuberculosis
cggcgccgccggucgcc

SEQ ID NO: 2993367 - RNA, 22 nt, Mycobacterium avium subsp. paratuberculosis
cggcgccgccggucgcccccuc

SEQ ID NO: 2993368 - RNA, 12 nt, Mycobacterium avium subsp. paratuberculosis
cggcgccgccgu

SEQ ID NO: 2993369 - RNA, 15 nt, Mycobacterium avium subsp. paratuberculosis
cggcgccgccguucg

SEQ ID NO: 2993370 - RNA, 17 nt, Mycobacterium avium subsp. paratuberculosis
cggcgccgccguucgcc

SEQ ID NO: 2993371 - RNA, 20 nt, Mycobacterium avium subsp. paratuberculosis
cggcgccgccguucgccggc

SEQ ID NO: 2993372 - RNA, 10 nt, Mycobacterium avium subsp. paratuberculosis
cggcgccgcg

SEQ ID NO: 2993373 - RNA, 13 nt, Mycobacterium avium subsp. paratuberculosis
cggcgccgcgacc

SEQ ID NO: 2993374 - RNA, 15 nt, Mycobacterium avium subsp. paratuberculosis
cggcgccgcgacccc

SEQ ID NO: 2993375 - RNA, 19 nt, Mycobacterium avium subsp. paratuberculosis
cggcgccgcgaccccggac

SEQ ID NO: 2993376 - RNA, 15 nt, Mycobacterium avium subsp. paratuberculosis
cggcgccgcgcgcca

SEQ ID NO: 2993377 - RNA, 16 nt, Mycobacterium avium subsp. paratuberculosis
cggcgccgcgcgccag

SEQ ID NO: 2993378 - RNA, 14 nt, Mycobacterium avium subsp. paratuberculosis
cggcgccgcggccc

SEQ ID NO: 2993379 - RNA, 16 nt, Mycobacterium avium subsp. paratuberculosis
cggcgccgcggcccug

SEQ ID NO: 2993380 - RNA, 20 nt, Mycobacterium avium subsp. paratuberculosis
cggcgccgcggcccugcagc

SEQ ID NO: 2993381 - RNA, 16 nt, Mycobacterium avium subsp. paratuberculosis
cggcgccgcggccguu

SEQ ID NO: 2993382 - RNA, 14 nt, Mycobacterium avium subsp. paratuberculosis
cggcgccgcggcgg

SEQ ID NO: 2993383 - RNA, 16 nt, Mycobacterium avium subsp. paratuberculosis
cggcgccgcggcggca

SEQ ID NO: 2993384 - RNA, 17 nt, Mycobacterium avium subsp. paratuberculosis
cggcgccgcggcggcac

SEQ ID NO: 2993385 - RNA, 18 nt, Mycobacterium avium subsp. paratuberculosis
cggcgccgcggcggcacc

SEQ ID NO: 2993386 - RNA, 20 nt, Mycobacterium avium subsp. paratuberculosis
cggcgccgcggcggcaccca

SEQ ID NO: 2993387 - RNA, 13 nt, Mycobacterium avium subsp. paratuberculosis
cggcgccgcgggc

SEQ ID NO: 2993388 - RNA, 14 nt, Mycobacterium avium subsp. paratuberculosis
cggcgccgcgggcg

SEQ ID NO: 2993389 - RNA, 17 nt, Mycobacterium avium subsp. paratuberculosis
cggcgccgcgggcgccg

SEQ ID NO: 2993390 - RNA, 14 nt, Mycobacterium avium subsp. paratuberculosis
cggcgccgcggggc

SEQ ID NO: 2993391 - RNA, 15 nt, Mycobacterium avium subsp. paratuberculosis
cggcgccgcggggcg

SEQ ID NO: 2993392 - RNA, 13 nt, Mycobacterium avium subsp. paratuberculosis
cggcgccgcggua

SEQ ID NO: 2993393 - RNA, 13 nt, Mycobacterium avium subsp. paratuberculosis
cggcgccgcguac

SEQ ID NO: 2993394 - RNA, 17 nt, Mycobacterium avium subsp. paratuberculosis
cggcgccgcguaccagc

SEQ ID NO: 2993395 - RNA, 20 nt, Mycobacterium avium subsp. paratuberculosis
cggcgccgcguaccagcgcc

SEQ ID NO: 2993396 - RNA, 21 nt, Mycobacterium avium subsp. paratuberculosis
cggcgccgcguaccagcgcca

SEQ ID NO: 2993397 - RNA, 14 nt, Mycobacterium avium subsp. paratuberculosis
cggcgccgcgucgg

SEQ ID NO: 2993398 - RNA, 16 nt, Mycobacterium avium subsp. paratuberculosis
cggcgccggacggccc

SEQ ID NO: 2993399 - RNA, 17 nt, Mycobacterium avium subsp. paratuberculosis
cggcgccggaggccagc

SEQ ID NO: 2993400 - RNA, 20 nt, Mycobacterium avium subsp. paratuberculosis
cggcgccggaggccagcucg

SEQ ID NO: 2993401 - RNA, 21 nt, Mycobacterium avium subsp. paratuberculosis
cggcgccggaggccagcucga

SEQ ID NO: 2993402 - RNA, 15 nt, Mycobacterium avium subsp. paratuberculosis
cggcgccggaggggc

SEQ ID NO: 2993403 - RNA, 17 nt, Mycobacterium avium subsp. paratuberculosis
cggcgccggaggggcga

SEQ ID NO: 2993404 - RNA, 19 nt, Mycobacterium avium subsp. paratuberculosis
cggcgccggaggggcgacg

SEQ ID NO: 2993405 - RNA, 22 nt, Mycobacterium avium subsp. paratuberculosis
cggcgccggaucaugucguuga

SEQ ID NO: 2993406 - RNA, 14 nt, Mycobacterium avium subsp. paratuberculosis
cggcgccggaucgg

SEQ ID NO: 2993407 - RNA, 22 nt, Mycobacterium avium subsp. paratuberculosis
cggcgccggaucggcccccggg

SEQ ID NO: 2993408 - RNA, 15 nt, Mycobacterium avium subsp. paratuberculosis
cggcgccggaugcca

SEQ ID NO: 2993409 - RNA, 20 nt, Mycobacterium avium subsp. paratuberculosis
cggcgccggaugccagcagg

SEQ ID NO: 2993410 - RNA, 12 nt, Mycobacterium avium subsp. paratuberculosis
cggcgccggcac

SEQ ID NO: 2993411 - RNA, 13 nt, Mycobacterium avium subsp. paratuberculosis
cggcgccggcacu

SEQ ID NO: 2993412 - RNA, 13 nt, Mycobacterium avium subsp. paratuberculosis
cggcgccggcauc

SEQ ID NO: 2993413 - RNA, 17 nt, Mycobacterium avium subsp. paratuberculosis
cggcgccggcauccagc

SEQ ID NO: 2993414 - RNA, 12 nt, Mycobacterium avium subsp. paratuberculosis
cggcgccggcca

SEQ ID NO: 2993415 - RNA, 16 nt, Mycobacterium avium subsp. paratuberculosis
cggcgccggccagcgg

SEQ ID NO: 2993416 - RNA, 17 nt, Mycobacterium avium subsp. paratuberculosis
cggcgccggccagcggc

SEQ ID NO: 2993417 - RNA, 13 nt, Mycobacterium avium subsp. paratuberculosis
cggcgccggcccg

SEQ ID NO: 2993418 - RNA, 17 nt, Mycobacterium avium subsp. paratuberculosis
cggcgccggcccgcggc

SEQ ID NO: 2993419 - RNA, 14 nt, Mycobacterium avium subsp. paratuberculosis
cggcgccggccgac

SEQ ID NO: 2993420 - RNA, 15 nt, Mycobacterium avium subsp. paratuberculosis
cggcgccggccgccg

SEQ ID NO: 2993421 - RNA, 13 nt, Mycobacterium avium subsp. paratuberculosis
cggcgccggccgg

SEQ ID NO: 2993422 - RNA, 17 nt, Mycobacterium avium subsp. paratuberculosis
cggcgccggccgggcug

SEQ ID NO: 2993423 - RNA, 19 nt, Mycobacterium avium subsp. paratuberculosis
cggcgccggccgggcugcg

SEQ ID NO: 2993424 - RNA, 23 nt, Mycobacterium avium subsp. paratuberculosis
cggcgccggccgggcugcgcagc

SEQ ID NO: 2993425 - RNA, 16 nt, Mycobacterium avium subsp. paratuberculosis
cggcgccggccgucac

SEQ ID NO: 2993426 - RNA, 17 nt, Mycobacterium avium subsp. paratuberculosis
cggcgccggccgucacg

SEQ ID NO: 2993427 - RNA, 20 nt, Mycobacterium avium subsp. paratuberculosis
cggcgccggccgucacgcug

SEQ ID NO: 2993428 - RNA, 13 nt, Mycobacterium avium subsp. paratuberculosis
cggcgccggcgcg

SEQ ID NO: 2993429 - RNA, 15 nt, Mycobacterium avium subsp. paratuberculosis
cggcgccggcgcgca

SEQ ID NO: 2993430 - RNA, 17 nt, Mycobacterium avium subsp. paratuberculosis
cggcgccggcgcgcaac

SEQ ID NO: 2993431 - RNA, 20 nt, Mycobacterium avium subsp. paratuberculosis
cggcgccggcgcgcaacagc

SEQ ID NO: 2993432 - RNA, 13 nt, Mycobacterium avium subsp. paratuberculosis
cggcgccggcggc

SEQ ID NO: 2993433 - RNA, 15 nt, Mycobacterium avium subsp. paratuberculosis
cggcgccggcggcca

SEQ ID NO: 2993434 - RNA, 17 nt, Mycobacterium avium subsp. paratuberculosis
cggcgccggcggccacg

SEQ ID NO: 2993435 - RNA, 20 nt, Mycobacterium avium subsp. paratuberculosis
cggcgccggcgggugagccg

SEQ ID NO: 2993436 - RNA, 13 nt, Mycobacterium avium subsp. paratuberculosis
cggcgccggcggu

SEQ ID NO: 2993437 - RNA, 14 nt, Mycobacterium avium subsp. paratuberculosis
cggcgccggcuccg

SEQ ID NO: 2993438 - RNA, 16 nt, Mycobacterium avium subsp. paratuberculosis
cggcgccggcuccgca

SEQ ID NO: 2993439 - RNA, 13 nt, Mycobacterium avium subsp. paratuberculosis
cggcgccgggcau

SEQ ID NO: 2993440 - RNA, 13 nt, Mycobacterium avium subsp. paratuberculosis
cggcgccgggcgg

SEQ ID NO: 2993441 - RNA, 18 nt, Mycobacterium avium subsp. paratuberculosis
cggcgccgggcggcccgc

SEQ ID NO: 2993442 - RNA, 13 nt, Mycobacterium avium subsp. paratuberculosis
cggcgccggguca

SEQ ID NO: 2993443 - RNA, 21 nt, Mycobacterium avium subsp. paratuberculosis
cggcgccgguauauucgcgau

SEQ ID NO: 2993444 - RNA, 12 nt, Mycobacterium avium subsp. paratuberculosis
cggcgccgguca

SEQ ID NO: 2993445 - RNA, 13 nt, Mycobacterium avium subsp. paratuberculosis
cggcgccggucag

SEQ ID NO: 2993446 - RNA, 14 nt, Mycobacterium avium subsp. paratuberculosis
cggcgccggugcag

SEQ ID NO: 2993447 - RNA, 15 nt, Mycobacterium avium subsp. paratuberculosis
cggcgccggugcagu

SEQ ID NO: 2993448 - RNA, 15 nt, Mycobacterium avium subsp. paratuberculosis
cggcgccggugccca

SEQ ID NO: 2993449 - RNA, 14 nt, Mycobacterium avium subsp. paratuberculosis
cggcgccggugccg

SEQ ID NO: 2993450 - RNA, 17 nt, Mycobacterium avium subsp. paratuberculosis
cggcgccggugccgcag

SEQ ID NO: 2993451 - RNA, 18 nt, Mycobacterium avium subsp. paratuberculosis
cggcgccgguggugucga

SEQ ID NO: 2993452 - RNA, 16 nt, Mycobacterium avium subsp. paratuberculosis
cggcgccguccuccuc

SEQ ID NO: 2993453 - RNA, 17 nt, Mycobacterium avium subsp. paratuberculosis
cggcgccguccuccucg

SEQ ID NO: 2993454 - RNA, 12 nt, Mycobacterium avium subsp. paratuberculosis
cggcgccgucga

SEQ ID NO: 2993455 - RNA, 24 nt, Mycobacterium avium subsp. paratuberculosis
cggcgccgucgaacacguugcgca

SEQ ID NO: 2993456 - RNA, 14 nt, Mycobacterium avium subsp. paratuberculosis
cggcgccgucgacc

SEQ ID NO: 2993457 - RNA, 15 nt, Mycobacterium avium subsp. paratuberculosis
cggcgccgucgacca

SEQ ID NO: 2993458 - RNA, 14 nt, Mycobacterium avium subsp. paratuberculosis
cggcgccgucgauc

SEQ ID NO: 2993459 - RNA, 12 nt, Mycobacterium avium subsp. paratuberculosis
cggcgccgucgc

SEQ ID NO: 2993460 - RNA, 15 nt, Mycobacterium avium subsp. paratuberculosis
cggcgccgucgccgg

SEQ ID NO: 2993461 - RNA, 16 nt, Mycobacterium avium subsp. paratuberculosis
cggcgccgucgccgga

SEQ ID NO: 2993462 - RNA, 13 nt, Mycobacterium avium subsp. paratuberculosis
cggcgccgucgcg

SEQ ID NO: 2993463 - RNA, 13 nt, Mycobacterium avium subsp. paratuberculosis
cggcgccgugccg

SEQ ID NO: 2993464 - RNA, 14 nt, Mycobacterium avium subsp. paratuberculosis
cggcgccgugccgc

SEQ ID NO: 2993465 - RNA, 18 nt, Mycobacterium avium subsp. paratuberculosis
cggcgccgugccgcgcgg

SEQ ID NO: 2993466 - RNA, 19 nt, Mycobacterium avium subsp. paratuberculosis
cggcgccgugccgcgcggc

SEQ ID NO: 2993467 - RNA, 12 nt, Mycobacterium avium subsp. paratuberculosis
cggcgccgugcg

SEQ ID NO: 2993468 - RNA, 20 nt, Mycobacterium avium subsp. paratuberculosis
cggcgccguugaccggccgg

SEQ ID NO: 2993469 - RNA, 22 nt, Mycobacterium avium subsp. paratuberculosis
cggcgccguugaccggccgguc

SEQ ID NO: 2993470 - RNA, 23 nt, Mycobacterium avium subsp. paratuberculosis
cggcgccucgaugcggguguugc

SEQ ID NO: 2993471 - RNA, 14 nt, Mycobacterium avium subsp. paratuberculosis
cggcgccucggcgc

SEQ ID NO: 2993472 - RNA, 15 nt, Mycobacterium avium subsp. paratuberculosis
cggcgccucggcgcc

SEQ ID NO: 2993473 - RNA, 16 nt, Mycobacterium avium subsp. paratuberculosis
cggcgccucggcgccu

SEQ ID NO: 2993474 - RNA, 15 nt, Mycobacterium avium subsp. paratuberculosis
cggcgccucggcguc

SEQ ID NO: 2993475 - RNA, 17 nt, Mycobacterium avium subsp. paratuberculosis
cggcgccugauccgcgg

SEQ ID NO: 2993476 - RNA, 18 nt, Mycobacterium avium subsp. paratuberculosis
cggcgccugauccgcggu

SEQ ID NO: 2993477 - RNA, 16 nt, Mycobacterium avium subsp. paratuberculosis
cggcgccugcacgcag

SEQ ID NO: 2993478 - RNA, 13 nt, Mycobacterium avium subsp. paratuberculosis
cggcgccugguca

SEQ ID NO: 2993479 - RNA, 22 nt, Mycobacterium avium subsp. paratuberculosis
cggcgccuggucaaggugcuga

SEQ ID NO: 2993480 - RNA, 21 nt, Mycobacterium avium subsp. paratuberculosis
cggcgccuugaaccggcugga

SEQ ID NO: 2993481 - RNA, 17 nt, Mycobacterium avium subsp. paratuberculosis
cggcgccuugccggucu

SEQ ID NO: 2993482 - RNA, 17 nt, Mycobacterium avium subsp. paratuberculosis
cggcgccuugguccgca

SEQ ID NO: 2993483 - RNA, 19 nt, Mycobacterium avium subsp. paratuberculosis
cggcgccuugguccgcaac

SEQ ID NO: 2993484 - RNA, 22 nt, Mycobacterium avium subsp. paratuberculosis
cggcgccuugguccgcaacgcg

SEQ ID NO: 2993485 - RNA, 17 nt, Mycobacterium avium subsp. paratuberculosis
cggcgcgaaccgggcca

SEQ ID NO: 2993486 - RNA, 19 nt, Mycobacterium avium subsp. paratuberculosis
cggcgcgaaccgggccagg

SEQ ID NO: 2993487 - RNA, 21 nt, Mycobacterium avium subsp. paratuberculosis
cggcgcgaaccgggccaggau

SEQ ID NO: 2993488 - RNA, 16 nt, Mycobacterium avium subsp. paratuberculosis
cggcgcgaagcccucg

SEQ ID NO: 2993489 - RNA, 21 nt, Mycobacterium avium subsp. paratuberculosis
cggcgcgaagcccucgaagca

SEQ ID NO: 2993490 - RNA, 18 nt, Mycobacterium avium subsp. paratuberculosis
cggcgcgaagucgagcag

SEQ ID NO: 2993491 - RNA, 20 nt, Mycobacterium avium subsp. paratuberculosis
cggcgcgaagucgagcaggu

SEQ ID NO: 2993492 - RNA, 13 nt, Mycobacterium avium subsp. paratuberculosis
cggcgcgacaccg

SEQ ID NO: 2993493 - RNA, 14 nt, Mycobacterium avium subsp. paratuberculosis
cggcgcgacaccgc

SEQ ID NO: 2993494 - RNA, 15 nt, Mycobacterium avium subsp. paratuberculosis
cggcgcgacaccgcg

SEQ ID NO: 2993495 - RNA, 16 nt, Mycobacterium avium subsp. paratuberculosis
cggcgcgaccagcggc

SEQ ID NO: 2993496 - RNA, 19 nt, Mycobacterium avium subsp. paratuberculosis
cggcgcgaccagcggcagc

SEQ ID NO: 2993497 - RNA, 20 nt, Mycobacterium avium subsp. paratuberculosis
cggcgcgaccagcggcagca

SEQ ID NO: 2993498 - RNA, 15 nt, Mycobacterium avium subsp. paratuberculosis
cggcgcgaccagguu

SEQ ID NO: 2993499 - RNA, 15 nt, Mycobacterium avium subsp. paratuberculosis
cggcgcgacggcggc

SEQ ID NO: 2993500 - RNA, 17 nt, Mycobacterium avium subsp. paratuberculosis
cggcgcgacggcggcga

SEQ ID NO: 2993501 - RNA, 17 nt, Mycobacterium avium subsp. paratuberculosis
cggcgcgaggacgaugg

SEQ ID NO: 2993502 - RNA, 23 nt, Mycobacterium avium subsp. paratuberculosis
cggcgcgaggcggguaggcgucg

SEQ ID NO: 2993503 - RNA, 14 nt, Mycobacterium avium subsp. paratuberculosis
cggcgcgaucggcc

SEQ ID NO: 2993504 - RNA, 20 nt, Mycobacterium avium subsp. paratuberculosis
cggcgcgaucggccgcugcc

SEQ ID NO: 2993505 - RNA, 16 nt, Mycobacterium avium subsp. paratuberculosis
cggcgcgaucgucgac

SEQ ID NO: 2993506 - RNA, 17 nt, Mycobacterium avium subsp. paratuberculosis
cggcgcgaucgucgacc

SEQ ID NO: 2993507 - RNA, 23 nt, Mycobacterium avium subsp. paratuberculosis
cggcgcgaucgucgaccaccacg

SEQ ID NO: 2993508 - RNA, 17 nt, Mycobacterium avium subsp. paratuberculosis
cggcgcgaugaucgccg

SEQ ID NO: 2993509 - RNA, 23 nt, Mycobacterium avium subsp. paratuberculosis
cggcgcgaugaucgccggcgccg

SEQ ID NO: 2993510 - RNA, 13 nt, Mycobacterium avium subsp. paratuberculosis
cggcgcgcaacag

SEQ ID NO: 2993511 - RNA, 15 nt, Mycobacterium avium subsp. paratuberculosis
cggcgcgcaccccgg

SEQ ID NO: 2993512 - RNA, 16 nt, Mycobacterium avium subsp. paratuberculosis
cggcgcgcaccccggc

SEQ ID NO: 2993513 - RNA, 13 nt, Mycobacterium avium subsp. paratuberculosis
cggcgcgcaccgc

SEQ ID NO: 2993514 - RNA, 15 nt, Mycobacterium avium subsp. paratuberculosis
cggcgcgcaccgcga

SEQ ID NO: 2993515 - RNA, 17 nt, Mycobacterium avium subsp. paratuberculosis
cggcgcgcaccgcgggc

SEQ ID NO: 2993516 - RNA, 21 nt, Mycobacterium avium subsp. paratuberculosis
cggcgcgcaccgcgggcagca

SEQ ID NO: 2993517 - RNA, 17 nt, Mycobacterium avium subsp. paratuberculosis
cggcgcgcacggcagcc

SEQ ID NO: 2993518 - RNA, 18 nt, Mycobacterium avium subsp. paratuberculosis
cggcgcgcacggcagccc

SEQ ID NO: 2993519 - RNA, 11 nt, Mycobacterium avium subsp. paratuberculosis
cggcgcgcagc

SEQ ID NO: 2993520 - RNA, 14 nt, Mycobacterium avium subsp. paratuberculosis
cggcgcgcagccag

SEQ ID NO: 2993521 - RNA, 18 nt, Mycobacterium avium subsp. paratuberculosis
cggcgcgcagcccagcca

SEQ ID NO: 2993522 - RNA, 19 nt, Mycobacterium avium subsp. paratuberculosis
cggcgcgcagcccagccag

SEQ ID NO: 2993523 - RNA, 21 nt, Mycobacterium avium subsp. paratuberculosis
cggcgcgcagcccagccagcg

SEQ ID NO: 2993524 - RNA, 15 nt, Mycobacterium avium subsp. paratuberculosis
cggcgcgcagccggc

SEQ ID NO: 2993525 - RNA, 16 nt, Mycobacterium avium subsp. paratuberculosis
cggcgcgcagccggcc

SEQ ID NO: 2993526 - RNA, 16 nt, Mycobacterium avium subsp. paratuberculosis
cggcgcgcagcgugug

SEQ ID NO: 2993527 - RNA, 17 nt, Mycobacterium avium subsp. paratuberculosis
cggcgcggaacgcgccg

SEQ ID NO: 2993528 - RNA, 18 nt, Mycobacterium avium subsp. paratuberculosis
cggcgcggaacgcgccgg

SEQ ID NO: 2993529 - RNA, 20 nt, Mycobacterium avium subsp. paratuberculosis
cggcgcggaacgcgccgggc

SEQ ID NO: 2993530 - RNA, 14 nt, Mycobacterium avium subsp. paratuberculosis
cggcgcggacagcg

SEQ ID NO: 2993531 - RNA, 16 nt, Mycobacterium avium subsp. paratuberculosis
cggcgcggacagcgcg

SEQ ID NO: 2993532 - RNA, 16 nt, Mycobacterium avium subsp. paratuberculosis
cggcgcggaccccagu

SEQ ID NO: 2993533 - RNA, 12 nt, Mycobacterium avium subsp. paratuberculosis
cggcgcggacgg

SEQ ID NO: 2993534 - RNA, 21 nt, Mycobacterium avium subsp. paratuberculosis
cggcgcggacggaucgagucc

SEQ ID NO: 2993535 - RNA, 14 nt, Mycobacterium avium subsp. paratuberculosis
cggcgcggacguga

SEQ ID NO: 2993536 - RNA, 15 nt, Mycobacterium avium subsp. paratuberculosis
cggcgcggacgugau

SEQ ID NO: 2993537 - RNA, 18 nt, Mycobacterium avium subsp. paratuberculosis
cggcgcggagccggccgc

SEQ ID NO: 2993538 - RNA, 17 nt, Mycobacterium avium subsp. paratuberculosis
cggcgcggagcgucgcg

SEQ ID NO: 2993539 - RNA, 19 nt, Mycobacterium avium subsp. paratuberculosis
cggcgcggagcgucgcgau

SEQ ID NO: 2993540 - RNA, 15 nt, Mycobacterium avium subsp. paratuberculosis
cggcgcggaucguca

SEQ ID NO: 2993541 - RNA, 19 nt, Mycobacterium avium subsp. paratuberculosis
cggcgcggaucucgcgcag

SEQ ID NO: 2993542 - RNA, 20 nt, Mycobacterium avium subsp. paratuberculosis
cggcgcggaucucgcgcagg

SEQ ID NO: 2993543 - RNA, 24 nt, Mycobacterium avium subsp. paratuberculosis
cggcgcggaucucgcgcagguccg

SEQ ID NO: 2993544 - RNA, 14 nt, Mycobacterium avium subsp. paratuberculosis
cggcgcggaugacg

SEQ ID NO: 2993545 - RNA, 20 nt, Mycobacterium avium subsp. paratuberculosis
cggcgcggaugacgugcacc

SEQ ID NO: 2993546 - RNA, 21 nt, Mycobacterium avium subsp. paratuberculosis
cggcgcggaugacgugcacca

SEQ ID NO: 2993547 - RNA, 23 nt, Mycobacterium avium subsp. paratuberculosis
cggcgcggaugacgugcaccacc

SEQ ID NO: 2993548 - RNA, 16 nt, Mycobacterium avium subsp. paratuberculosis
cggcgcggcaguccgc

SEQ ID NO: 2993549 - RNA, 23 nt, Mycobacterium avium subsp. paratuberculosis
cggcgcggcaguccgccggagac

SEQ ID NO: 2993550 - RNA, 13 nt, Mycobacterium avium subsp. paratuberculosis
cggcgcggcaucg

SEQ ID NO: 2993551 - RNA, 20 nt, Mycobacterium avium subsp. paratuberculosis
cggcgcggcaucggcgacgg

SEQ ID NO: 2993552 - RNA, 10 nt, Mycobacterium avium subsp. paratuberculosis
cggcgcggcc

SEQ ID NO: 2993553 - RNA, 14 nt, Mycobacterium avium subsp. paratuberculosis
cggcgcggccaccc

SEQ ID NO: 2993554 - RNA, 14 nt, Mycobacterium avium subsp. paratuberculosis
cggcgcggccagcu

SEQ ID NO: 2993555 - RNA, 12 nt, Mycobacterium avium subsp. paratuberculosis
cggcgcggccca

SEQ ID NO: 2993556 - RNA, 14 nt, Mycobacterium avium subsp. paratuberculosis
cggcgcggcccagg

SEQ ID NO: 2993557 - RNA, 16 nt, Mycobacterium avium subsp. paratuberculosis
cggcgcggcccggccc

SEQ ID NO: 2993558 - RNA, 14 nt, Mycobacterium avium subsp. paratuberculosis
cggcgcggccgauu

SEQ ID NO: 2993559 - RNA, 17 nt, Mycobacterium avium subsp. paratuberculosis
cggcgcggccgcccagc

SEQ ID NO: 2993560 - RNA, 12 nt, Mycobacterium avium subsp. paratuberculosis
cggcgcggccgg

SEQ ID NO: 2993561 - RNA, 15 nt, Mycobacterium avium subsp. paratuberculosis
cggcgcggccggugc

SEQ ID NO: 2993562 - RNA, 16 nt, Mycobacterium avium subsp. paratuberculosis
cggcgcggccggugcg

SEQ ID NO: 2993563 - RNA, 23 nt, Mycobacterium avium subsp. paratuberculosis
cggcgcggccggugcgcgucagc

SEQ ID NO: 2993564 - RNA, 21 nt, Mycobacterium avium subsp. paratuberculosis
cggcgcggcgaaucgguccgg

SEQ ID NO: 2993565 - RNA, 13 nt, Mycobacterium avium subsp. paratuberculosis
cggcgcggcgacg

SEQ ID NO: 2993566 - RNA, 16 nt, Mycobacterium avium subsp. paratuberculosis
cggcgcggcgacguga

SEQ ID NO: 2993567 - RNA, 13 nt, Mycobacterium avium subsp. paratuberculosis
cggcgcggcgcag

SEQ ID NO: 2993568 - RNA, 15 nt, Mycobacterium avium subsp. paratuberculosis
cggcgcggcgcagcg

SEQ ID NO: 2993569 - RNA, 14 nt, Mycobacterium avium subsp. paratuberculosis
cggcgcggcggcga

SEQ ID NO: 2993570 - RNA, 16 nt, Mycobacterium avium subsp. paratuberculosis
cggcgcggcggcgacg

SEQ ID NO: 2993571 - RNA, 18 nt, Mycobacterium avium subsp. paratuberculosis
cggcgcggcggcgacguc

SEQ ID NO: 2993572 - RNA, 23 nt, Mycobacterium avium subsp. paratuberculosis
cggcgcggcggcgacgucgacgg

SEQ ID NO: 2993573 - RNA, 14 nt, Mycobacterium avium subsp. paratuberculosis
cggcgcggcggcgc

SEQ ID NO: 2993574 - RNA, 15 nt, Mycobacterium avium subsp. paratuberculosis
cggcgcggcggcgcc

SEQ ID NO: 2993575 - RNA, 16 nt, Mycobacterium avium subsp. paratuberculosis
cggcgcggcggcgccg

SEQ ID NO: 2993576 - RNA, 18 nt, Mycobacterium avium subsp. paratuberculosis
cggcgcggcggcgccgcg

SEQ ID NO: 2993577 - RNA, 12 nt, Mycobacterium avium subsp. paratuberculosis
cggcgcggcggu

SEQ ID NO: 2993578 - RNA, 13 nt, Mycobacterium avium subsp. paratuberculosis
cggcgcggcgguc

SEQ ID NO: 2993579 - RNA, 21 nt, Mycobacterium avium subsp. paratuberculosis
cggcgcggcucacgacuccug

SEQ ID NO: 2993580 - RNA, 20 nt, Mycobacterium avium subsp. paratuberculosis
cggcgcggcuuuuggcgucg

SEQ ID NO: 2993581 - RNA, 23 nt, Mycobacterium avium subsp. paratuberculosis
cggcgcgggcaugaaccaggccg

SEQ ID NO: 2993582 - RNA, 15 nt, Mycobacterium avium subsp. paratuberculosis
cggcgcgggccagca

SEQ ID NO: 2993583 - RNA, 17 nt, Mycobacterium avium subsp. paratuberculosis
cggcgcgggccagcagc

SEQ ID NO: 2993584 - RNA, 17 nt, Mycobacterium avium subsp. paratuberculosis
cggcgcgggccgcagcg

SEQ ID NO: 2993585 - RNA, 22 nt, Mycobacterium avium subsp. paratuberculosis
cggcgcgggccgcagcgcgcgg

SEQ ID NO: 2993586 - RNA, 16 nt, Mycobacterium avium subsp. paratuberculosis
cggcgcgggcgauuuc

SEQ ID NO: 2993587 - RNA, 23 nt, Mycobacterium avium subsp. paratuberculosis
cggcgcgggcgauuucgucggcg

SEQ ID NO: 2993588 - RNA, 24 nt, Mycobacterium avium subsp. paratuberculosis
cggcgcgggcgauuucgucggcgg

SEQ ID NO: 2993589 - RNA, 13 nt, Mycobacterium avium subsp. paratuberculosis
cggcgcgggcgcc

SEQ ID NO: 2993590 - RNA, 15 nt, Mycobacterium avium subsp. paratuberculosis
cggcgcgggcgcccu

SEQ ID NO: 2993591 - RNA, 18 nt, Mycobacterium avium subsp. paratuberculosis
cggcgcgggcgcccucca

SEQ ID NO: 2993592 - RNA, 23 nt, Mycobacterium avium subsp. paratuberculosis
cggcgcgggcggcgucggcgacg

SEQ ID NO: 2993593 - RNA, 17 nt, Mycobacterium avium subsp. paratuberculosis
cggcgcggggccaccag

SEQ ID NO: 2993594 - RNA, 20 nt, Mycobacterium avium subsp. paratuberculosis
cggcgcggggccaccaggcg

SEQ ID NO: 2993595 - RNA, 21 nt, Mycobacterium avium subsp. paratuberculosis
cggcgcggggccaccaggcgc

SEQ ID NO: 2993596 - RNA, 16 nt, Mycobacterium avium subsp. paratuberculosis
cggcgcgggggcggcc

SEQ ID NO: 2993597 - RNA, 19 nt, Mycobacterium avium subsp. paratuberculosis
cggcgcgggggcggccuga

SEQ ID NO: 2993598 - RNA, 16 nt, Mycobacterium avium subsp. paratuberculosis
cggcgcgggucgcggu

SEQ ID NO: 2993599 - RNA, 19 nt, Mycobacterium avium subsp. paratuberculosis
cggcgcgggucgcgguucg

SEQ ID NO: 2993600 - RNA, 23 nt, Mycobacterium avium subsp. paratuberculosis
cggcgcgggucgcuggccgcgac

SEQ ID NO: 2993601 - RNA, 15 nt, Mycobacterium avium subsp. paratuberculosis
cggcgcgguccacgg

SEQ ID NO: 2993602 - RNA, 18 nt, Mycobacterium avium subsp. paratuberculosis
cggcgcgguccacgguca

SEQ ID NO: 2993603 - RNA, 12 nt, Mycobacterium avium subsp. paratuberculosis
cggcgcggucgc

SEQ ID NO: 2993604 - RNA, 18 nt, Mycobacterium avium subsp. paratuberculosis
cggcgcggucgcaggccg

SEQ ID NO: 2993605 - RNA, 18 nt, Mycobacterium avium subsp. paratuberculosis
cggcgcggucgcaggcga

SEQ ID NO: 2993606 - RNA, 23 nt, Mycobacterium avium subsp. paratuberculosis
cggcgcggucgcaggcgagccgg

SEQ ID NO: 2993607 - RNA, 14 nt, Mycobacterium avium subsp. paratuberculosis
cggcgcggugcgcc

SEQ ID NO: 2993608 - RNA, 15 nt, Mycobacterium avium subsp. paratuberculosis
cggcgcggugcgccg

SEQ ID NO: 2993609 - RNA, 20 nt, Mycobacterium avium subsp. paratuberculosis
cggcgcggugcgccgacagc

SEQ ID NO: 2993610 - RNA, 22 nt, Mycobacterium avium subsp. paratuberculosis
cggcgcggugcgccgacagcug

SEQ ID NO: 2993611 - RNA, 23 nt, Mycobacterium avium subsp. paratuberculosis
cggcgcggugcgccgacagcuga

SEQ ID NO: 2993612 - RNA, 19 nt, Mycobacterium avium subsp. paratuberculosis
cggcgcugccgccggccuc

SEQ ID NO: 2993613 - RNA, 16 nt, Mycobacterium avium subsp. paratuberculosis
cggcgcugccggcgca

SEQ ID NO: 2993614 - RNA, 17 nt, Mycobacterium avium subsp. paratuberculosis
cggcgcugccggcgcac

SEQ ID NO: 2993615 - RNA, 18 nt, Mycobacterium avium subsp. paratuberculosis
cggcgcugccggcgcacc

SEQ ID NO: 2993616 - RNA, 17 nt, Mycobacterium avium subsp. paratuberculosis
cggcgcugcgcccgguc

SEQ ID NO: 2993617 - RNA, 19 nt, Mycobacterium avium subsp. paratuberculosis
cggcgcugcgcccggucag

SEQ ID NO: 2993618 - RNA, 20 nt, Mycobacterium avium subsp. paratuberculosis
cggcgcugcgcccggucagg

SEQ ID NO: 2993619 - RNA, 13 nt, Mycobacterium avium subsp. paratuberculosis
cggcgcugcgccg

SEQ ID NO: 2993620 - RNA, 15 nt, Mycobacterium avium subsp. paratuberculosis
cggcgcugcgccguu

SEQ ID NO: 2993621 - RNA, 15 nt, Mycobacterium avium subsp. paratuberculosis
cggcgcuggccagcg

SEQ ID NO: 2993622 - RNA, 16 nt, Mycobacterium avium subsp. paratuberculosis
cggcgcuggccagcgc

SEQ ID NO: 2993623 - RNA, 19 nt, Mycobacterium avium subsp. paratuberculosis
cggcgcuggccagcgcgac

SEQ ID NO: 2993624 - RNA, 21 nt, Mycobacterium avium subsp. paratuberculosis
cggcgcuggccagcgcgacgg

SEQ ID NO: 2993625 - RNA, 13 nt, Mycobacterium avium subsp. paratuberculosis
cggcgcuggccgc

SEQ ID NO: 2993626 - RNA, 18 nt, Mycobacterium avium subsp. paratuberculosis
cggcgcuggccgcggcca

SEQ ID NO: 2993627 - RNA, 21 nt, Mycobacterium avium subsp. paratuberculosis
cggcgcuggccgcggccagcu

SEQ ID NO: 2993628 - RNA, 16 nt, Mycobacterium avium subsp. paratuberculosis
cggcgcuggcgcgccg

SEQ ID NO: 2993629 - RNA, 16 nt, Mycobacterium avium subsp. paratuberculosis
cggcgcuggucggcgg

SEQ ID NO: 2993630 - RNA, 17 nt, Mycobacterium avium subsp. paratuberculosis
cggcgcuggucggcggg

SEQ ID NO: 2993631 - RNA, 21 nt, Mycobacterium avium subsp. paratuberculosis
cggcgcuggucggcgggcagc

SEQ ID NO: 2993632 - RNA, 15 nt, Mycobacterium avium subsp. paratuberculosis
cggcgcugucggcgg

SEQ ID NO: 2993633 - RNA, 18 nt, Mycobacterium avium subsp. paratuberculosis
cggcgcugucggcgggga

SEQ ID NO: 2993634 - RNA, 21 nt, Mycobacterium avium subsp. paratuberculosis
cggcgcuucgggugcgggugc

SEQ ID NO: 2993635 - RNA, 17 nt, Mycobacterium avium subsp. paratuberculosis
cggcgcuucugcgccgg

SEQ ID NO: 2993636 - RNA, 15 nt, Mycobacterium avium subsp. paratuberculosis
cggcgcuugaccucg

SEQ ID NO: 2993637 - RNA, 19 nt, Mycobacterium avium subsp. paratuberculosis
cggcgcuugaccucgccga

SEQ ID NO: 2993638 - RNA, 21 nt, Mycobacterium avium subsp. paratuberculosis
cggcgcuugaccucgccgagc

SEQ ID NO: 2993639 - RNA, 23 nt, Mycobacterium avium subsp. paratuberculosis
cggcgcuugaccucgccgagcag

SEQ ID NO: 2993640 - RNA, 13 nt, Mycobacterium avium subsp. paratuberculosis
cggcgcuugacga

SEQ ID NO: 2993641 - RNA, 18 nt, Mycobacterium avium subsp. paratuberculosis
cggcgcuugacgaacgcc

SEQ ID NO: 2993642 - RNA, 22 nt, Mycobacterium avium subsp. paratuberculosis
cggcgcuugacgaacgccacca

SEQ ID NO: 2993643 - RNA, 23 nt, Mycobacterium avium subsp. paratuberculosis
cggcgcuugacgaacgccaccac

SEQ ID NO: 2993644 - RNA, 18 nt, Mycobacterium avium subsp. paratuberculosis
cggcgcuuuccaccucga

SEQ ID NO: 2993645 - RNA, 21 nt, Mycobacterium avium subsp. paratuberculosis
cggcgcuuucgaagugacgcc

SEQ ID NO: 2993646 - RNA, 23 nt, Mycobacterium avium subsp. paratuberculosis
cggcgcuuucgaagugacgccgc

SEQ ID NO: 2993647 - RNA, 17 nt, Mycobacterium avium subsp. paratuberculosis
cggcggaacccgggugg

SEQ ID NO: 2993648 - RNA, 22 nt, Mycobacterium avium subsp. paratuberculosis
cggcggaacccggguggcccgc

SEQ ID NO: 2993649 - RNA, 16 nt, Mycobacterium avium subsp. paratuberculosis
cggcggaaccgggccg

SEQ ID NO: 2993650 - RNA, 17 nt, Mycobacterium avium subsp. paratuberculosis
cggcggaaccgggccgc

SEQ ID NO: 2993651 - RNA, 19 nt, Mycobacterium avium subsp. paratuberculosis
cggcggaaccgggccgcug

SEQ ID NO: 2993652 - RNA, 15 nt, Mycobacterium avium subsp. paratuberculosis
cggcggaaguagccc

SEQ ID NO: 2993653 - RNA, 22 nt, Mycobacterium avium subsp. paratuberculosis
cggcggaaguagcccggaguga

SEQ ID NO: 2993654 - RNA, 21 nt, Mycobacterium avium subsp. paratuberculosis
cggcggacagccccgagccgc

SEQ ID NO: 2993655 - RNA, 17 nt, Mycobacterium avium subsp. paratuberculosis
cggcggacaucgccucg

SEQ ID NO: 2993656 - RNA, 22 nt, Mycobacterium avium subsp. paratuberculosis
cggcggacaucgccucggcguc

SEQ ID NO: 2993657 - RNA, 16 nt, Mycobacterium avium subsp. paratuberculosis
cggcggacccagcucc

SEQ ID NO: 2993658 - RNA, 19 nt, Mycobacterium avium subsp. paratuberculosis
cggcggacccagcuccucg

SEQ ID NO: 2993659 - RNA, 20 nt, Mycobacterium avium subsp. paratuberculosis
cggcggacccagcuccucgg

SEQ ID NO: 2993660 - RNA, 14 nt, Mycobacterium avium subsp. paratuberculosis
cggcggacccggag

SEQ ID NO: 2993661 - RNA, 17 nt, Mycobacterium avium subsp. paratuberculosis
cggcggacccggaggcg

SEQ ID NO: 2993662 - RNA, 23 nt, Mycobacterium avium subsp. paratuberculosis
cggcggacccggaggcggcgggg

SEQ ID NO: 2993663 - RNA, 14 nt, Mycobacterium avium subsp. paratuberculosis
cggcggaccggcgg

SEQ ID NO: 2993664 - RNA, 15 nt, Mycobacterium avium subsp. paratuberculosis
cggcggaccggcggc

SEQ ID NO: 2993665 - RNA, 19 nt, Mycobacterium avium subsp. paratuberculosis
cggcggaccggcggccgcc

SEQ ID NO: 2993666 - RNA, 22 nt, Mycobacterium avium subsp. paratuberculosis
cggcggaccggcggccgccauc

SEQ ID NO: 2993667 - RNA, 19 nt, Mycobacterium avium subsp. paratuberculosis
cggcggacgauguccgccg

SEQ ID NO: 2993668 - RNA, 17 nt, Mycobacterium avium subsp. paratuberculosis
cggcggacgcggccagc

SEQ ID NO: 2993669 - RNA, 13 nt, Mycobacterium avium subsp. paratuberculosis
cggcggacuggcu

SEQ ID NO: 2993670 - RNA, 22 nt, Mycobacterium avium subsp. paratuberculosis
cggcggacuggcugagcagcac

SEQ ID NO: 2993671 - RNA, 16 nt, Mycobacterium avium subsp. paratuberculosis
cggcggaggccugcgc

SEQ ID NO: 2993672 - RNA, 18 nt, Mycobacterium avium subsp. paratuberculosis
cggcggaggccugcgcgg

SEQ ID NO: 2993673 - RNA, 20 nt, Mycobacterium avium subsp. paratuberculosis
cggcggaggccugcgcggcc

SEQ ID NO: 2993674 - RNA, 22 nt, Mycobacterium avium subsp. paratuberculosis
cggcggaggucagcggcccgau

SEQ ID NO: 2993675 - RNA, 18 nt, Mycobacterium avium subsp. paratuberculosis
cggcggaggucauggcga

SEQ ID NO: 2993676 - RNA, 23 nt, Mycobacterium avium subsp. paratuberculosis
cggcggaggucauggcgaccgcg

SEQ ID NO: 2993677 - RNA, 14 nt, Mycobacterium avium subsp. paratuberculosis
cggcggaucagcac

SEQ ID NO: 2993678 - RNA, 16 nt, Mycobacterium avium subsp. paratuberculosis
cggcggaucagcaccg

SEQ ID NO: 2993679 - RNA, 17 nt, Mycobacterium avium subsp. paratuberculosis
cggcggaucagcaccga

SEQ ID NO: 2993680 - RNA, 22 nt, Mycobacterium avium subsp. paratuberculosis
cggcggaucagcaccgacgcgg

SEQ ID NO: 2993681 - RNA, 18 nt, Mycobacterium avium subsp. paratuberculosis
cggcggauccagcaccgc

SEQ ID NO: 2993682 - RNA, 20 nt, Mycobacterium avium subsp. paratuberculosis
cggcggauccagcaccgcca

SEQ ID NO: 2993683 - RNA, 22 nt, Mycobacterium avium subsp. paratuberculosis
cggcggauccagcaccgccacg

SEQ ID NO: 2993684 - RNA, 17 nt, Mycobacterium avium subsp. paratuberculosis
cggcggauccagguggg

SEQ ID NO: 2993685 - RNA, 18 nt, Mycobacterium avium subsp. paratuberculosis
cggcggaugggugcgguu

SEQ ID NO: 2993686 - RNA, 23 nt, Mycobacterium avium subsp. paratuberculosis
cggcggcaaaacgcugggcgccg

SEQ ID NO: 2993687 - RNA, 20 nt, Mycobacterium avium subsp. paratuberculosis
cggcggcaaagcguugccgc

SEQ ID NO: 2993688 - RNA, 14 nt, Mycobacterium avium subsp. paratuberculosis
cggcggcaaccagc

SEQ ID NO: 2993689 - RNA, 18 nt, Mycobacterium avium subsp. paratuberculosis
cggcggcaaccagcuccg

SEQ ID NO: 2993690 - RNA, 23 nt, Mycobacterium avium subsp. paratuberculosis
cggcggcaaccagcuccggcaac

SEQ ID NO: 2993691 - RNA, 13 nt, Mycobacterium avium subsp. paratuberculosis
cggcggcaacggg

SEQ ID NO: 2993692 - RNA, 15 nt, Mycobacterium avium subsp. paratuberculosis
cggcggcaaguccgg

SEQ ID NO: 2993693 - RNA, 19 nt, Mycobacterium avium subsp. paratuberculosis
cggcggcaaguccgggucc

SEQ ID NO: 2993694 - RNA, 19 nt, Mycobacterium avium subsp. paratuberculosis
cggcggcaccacccgcggc

SEQ ID NO: 2993695 - RNA, 21 nt, Mycobacterium avium subsp. paratuberculosis
cggcggcaccacccgcggccg

SEQ ID NO: 2993696 - RNA, 14 nt, Mycobacterium avium subsp. paratuberculosis
cggcggcccgccgc

SEQ ID NO: 2993697 - RNA, 16 nt, Mycobacterium avium subsp. paratuberculosis
cggcggcccgccgcgc

SEQ ID NO: 2993698 - RNA, 17 nt, Mycobacterium avium subsp. paratuberculosis
cggcggcccgccgcgcc

SEQ ID NO: 2993699 - RNA, 18 nt, Mycobacterium avium subsp. paratuberculosis
cggcggcccgccgcgccc

SEQ ID NO: 2993700 - RNA, 19 nt, Mycobacterium avium subsp. paratuberculosis
cggcggcccgccgcgcccg

SEQ ID NO: 2993701 - RNA, 20 nt, Mycobacterium avium subsp. paratuberculosis
cggcggcccgccgcgcccgg

SEQ ID NO: 2993702 - RNA, 15 nt, Mycobacterium avium subsp. paratuberculosis
cggcggcccgccgga

SEQ ID NO: 2993703 - RNA, 16 nt, Mycobacterium avium subsp. paratuberculosis
cggcggcccgccggaa

SEQ ID NO: 2993704 - RNA, 15 nt, Mycobacterium avium subsp. paratuberculosis
cggcggcccgcgcgg

SEQ ID NO: 2993705 - RNA, 16 nt, Mycobacterium avium subsp. paratuberculosis
cggcggcccgcgcggg

SEQ ID NO: 2993706 - RNA, 20 nt, Mycobacterium avium subsp. paratuberculosis
cggcggcccgcgcggggucc

SEQ ID NO: 2993707 - RNA, 14 nt, Mycobacterium avium subsp. paratuberculosis
cggcggcccgcuug

SEQ ID NO: 2993708 - RNA, 15 nt, Mycobacterium avium subsp. paratuberculosis
cggcggcccgcuugc

SEQ ID NO: 2993709 - RNA, 18 nt, Mycobacterium avium subsp. paratuberculosis
cggcggcccgcuugccga

SEQ ID NO: 2993710 - RNA, 20 nt, Mycobacterium avium subsp. paratuberculosis
cggcggcccggcgucacgcu

SEQ ID NO: 2993711 - RNA, 14 nt, Mycobacterium avium subsp. paratuberculosis
cggcggcccguccg

SEQ ID NO: 2993712 - RNA, 20 nt, Mycobacterium avium subsp. paratuberculosis
cggcggcccguccgccccgc

SEQ ID NO: 2993713 - RNA, 21 nt, Mycobacterium avium subsp. paratuberculosis
cggcggcccguccgccccgcu

SEQ ID NO: 2993714 - RNA, 13 nt, Mycobacterium avium subsp. paratuberculosis
cggcggcccgucg

SEQ ID NO: 2993715 - RNA, 18 nt, Mycobacterium avium subsp. paratuberculosis
cggcggcccgucgccacc

SEQ ID NO: 2993716 - RNA, 19 nt, Mycobacterium avium subsp. paratuberculosis
cggcggcccgucgccacca

SEQ ID NO: 2993717 - RNA, 22 nt, Mycobacterium avium subsp. paratuberculosis
cggcggcccgucgccaccacgg

SEQ ID NO: 2993718 - RNA, 22 nt, Mycobacterium avium subsp. paratuberculosis
cggcggcccuucucggacgccc

SEQ ID NO: 2993719 - RNA, 18 nt, Mycobacterium avium subsp. paratuberculosis
cggcggccgacagcgcgu

SEQ ID NO: 2993720 - RNA, 21 nt, Mycobacterium avium subsp. paratuberculosis
cggcggccgacagcgcgucgg

SEQ ID NO: 2993721 - RNA, 16 nt, Mycobacterium avium subsp. paratuberculosis
cggcggccgacgcgcc

SEQ ID NO: 2993722 - RNA, 17 nt, Mycobacterium avium subsp. paratuberculosis
cggcggccgacgcgccg

SEQ ID NO: 2993723 - RNA, 20 nt, Mycobacterium avium subsp. paratuberculosis
cggcggccgacgcgccgucg

SEQ ID NO: 2993724 - RNA, 12 nt, Mycobacterium avium subsp. paratuberculosis
cggcggccgagc

SEQ ID NO: 2993725 - RNA, 13 nt, Mycobacterium avium subsp. paratuberculosis
cggcggccgagcg

SEQ ID NO: 2993726 - RNA, 18 nt, Mycobacterium avium subsp. paratuberculosis
cggcggccgagcgcaccg

SEQ ID NO: 2993727 - RNA, 19 nt, Mycobacterium avium subsp. paratuberculosis
cggcggccgagcgcaccgc

SEQ ID NO: 2993728 - RNA, 22 nt, Mycobacterium avium subsp. paratuberculosis
cggcggccgagcgcaccgcgga

SEQ ID NO: 2993729 - RNA, 23 nt, Mycobacterium avium subsp. paratuberculosis
cggcggccgagcgcaccgcggag

SEQ ID NO: 2993730 - RNA, 17 nt, Mycobacterium avium subsp. paratuberculosis
cggcggccgcagcgugg

SEQ ID NO: 2993731 - RNA, 21 nt, Mycobacterium avium subsp. paratuberculosis
cggcggccgcagcgugggcac

SEQ ID NO: 2993732 - RNA, 14 nt, Mycobacterium avium subsp. paratuberculosis
cggcggccgccacg

SEQ ID NO: 2993733 - RNA, 23 nt, Mycobacterium avium subsp. paratuberculosis
cggcggccgccacgcugguguga

SEQ ID NO: 2993734 - RNA, 14 nt, Mycobacterium avium subsp. paratuberculosis
cggcggccgccagc

SEQ ID NO: 2993735 - RNA, 13 nt, Mycobacterium avium subsp. paratuberculosis
cggcggccgcccg

SEQ ID NO: 2993736 - RNA, 19 nt, Mycobacterium avium subsp. paratuberculosis
cggcggccgcccgggcggc

SEQ ID NO: 2993737 - RNA, 12 nt, Mycobacterium avium subsp. paratuberculosis
cggcggccgccg

SEQ ID NO: 2993738 - RNA, 16 nt, Mycobacterium avium subsp. paratuberculosis
cggcggccgccgcccg

SEQ ID NO: 2993739 - RNA, 23 nt, Mycobacterium avium subsp. paratuberculosis
cggcggccgccgcccgcgcggcg

SEQ ID NO: 2993740 - RNA, 17 nt, Mycobacterium avium subsp. paratuberculosis
cggcggccgccggcacc

SEQ ID NO: 2993741 - RNA, 20 nt, Mycobacterium avium subsp. paratuberculosis
cggcggccgccggcaccguc

SEQ ID NO: 2993742 - RNA, 15 nt, Mycobacterium avium subsp. paratuberculosis
cggcggccgccuugg

SEQ ID NO: 2993743 - RNA, 24 nt, Mycobacterium avium subsp. paratuberculosis
cggcggccgcgaaggcggcgucga

SEQ ID NO: 2993744 - RNA, 13 nt, Mycobacterium avium subsp. paratuberculosis
cggcggccgcgac

SEQ ID NO: 2993745 - RNA, 15 nt, Mycobacterium avium subsp. paratuberculosis
cggcggccgcgacgg

SEQ ID NO: 2993746 - RNA, 17 nt, Mycobacterium avium subsp. paratuberculosis
cggcggccgcggacccg

SEQ ID NO: 2993747 - RNA, 12 nt, Mycobacterium avium subsp. paratuberculosis
cggcggccgcgu

SEQ ID NO: 2993748 - RNA, 13 nt, Mycobacterium avium subsp. paratuberculosis
cggcggccgcguc

SEQ ID NO: 2993749 - RNA, 20 nt, Mycobacterium avium subsp. paratuberculosis
cggcggccgcguccucgccg

SEQ ID NO: 2993750 - RNA, 17 nt, Mycobacterium avium subsp. paratuberculosis
cggcggccgcgucgccg

SEQ ID NO: 2993751 - RNA, 15 nt, Mycobacterium avium subsp. paratuberculosis
cggcggccgcgucgg

SEQ ID NO: 2993752 - RNA, 12 nt, Mycobacterium avium subsp. paratuberculosis
cggcggccggcc

SEQ ID NO: 2993753 - RNA, 14 nt, Mycobacterium avium subsp. paratuberculosis
cggcggccggccag

SEQ ID NO: 2993754 - RNA, 21 nt, Mycobacterium avium subsp. paratuberculosis
cggcggccggccagcagccgg

SEQ ID NO: 2993755 - RNA, 20 nt, Mycobacterium avium subsp. paratuberculosis
cggcggccggccagcgcgcg

SEQ ID NO: 2993756 - RNA, 22 nt, Mycobacterium avium subsp. paratuberculosis
cggcggccggccagcgcgcggc

SEQ ID NO: 2993757 - RNA, 16 nt, Mycobacterium avium subsp. paratuberculosis
cggcggccggccccgg

SEQ ID NO: 2993758 - RNA, 17 nt, Mycobacterium avium subsp. paratuberculosis
cggcggccggccccggc

SEQ ID NO: 2993759 - RNA, 18 nt, Mycobacterium avium subsp. paratuberculosis
cggcggccggccccggcc

SEQ ID NO: 2993760 - RNA, 19 nt, Mycobacterium avium subsp. paratuberculosis
cggcggccggccccggccg

SEQ ID NO: 2993761 - RNA, 13 nt, Mycobacterium avium subsp. paratuberculosis
cggcggccggccg

SEQ ID NO: 2993762 - RNA, 14 nt, Mycobacterium avium subsp. paratuberculosis
cggcggccggccgc

SEQ ID NO: 2993763 - RNA, 17 nt, Mycobacterium avium subsp. paratuberculosis
cggcggccggccgcgcg

SEQ ID NO: 2993764 - RNA, 18 nt, Mycobacterium avium subsp. paratuberculosis
cggcggccggccgcgcgc

SEQ ID NO: 2993765 - RNA, 13 nt, Mycobacterium avium subsp. paratuberculosis
cggcggccggcga

SEQ ID NO: 2993766 - RNA, 15 nt, Mycobacterium avium subsp. paratuberculosis
cggcggccggcgaug

SEQ ID NO: 2993767 - RNA, 13 nt, Mycobacterium avium subsp. paratuberculosis
cggcggccggcgc

SEQ ID NO: 2993768 - RNA, 14 nt, Mycobacterium avium subsp. paratuberculosis
cggcggccggcgcc

SEQ ID NO: 2993769 - RNA, 16 nt, Mycobacterium avium subsp. paratuberculosis
cggcggccggcgccga

SEQ ID NO: 2993770 - RNA, 17 nt, Mycobacterium avium subsp. paratuberculosis
cggcggccggcgccgac

SEQ ID NO: 2993771 - RNA, 19 nt, Mycobacterium avium subsp. paratuberculosis
cggcggccggcgccgaccg

SEQ ID NO: 2993772 - RNA, 15 nt, Mycobacterium avium subsp. paratuberculosis
cggcggccggcggca

SEQ ID NO: 2993773 - RNA, 20 nt, Mycobacterium avium subsp. paratuberculosis
cggcggccgggaugccgccg

SEQ ID NO: 2993774 - RNA, 12 nt, Mycobacterium avium subsp. paratuberculosis
cggcggccgggg

SEQ ID NO: 2993775 - RNA, 21 nt, Mycobacterium avium subsp. paratuberculosis
cggcggccggggggaggucgc

SEQ ID NO: 2993776 - RNA, 12 nt, Mycobacterium avium subsp. paratuberculosis
cggcggccgucg

SEQ ID NO: 2993777 - RNA, 13 nt, Mycobacterium avium subsp. paratuberculosis
cggcggccgucgg

SEQ ID NO: 2993778 - RNA, 12 nt, Mycobacterium avium subsp. paratuberculosis
cggcggccuccg

SEQ ID NO: 2993779 - RNA, 14 nt, Mycobacterium avium subsp. paratuberculosis
cggcggccuccgga

SEQ ID NO: 2993780 - RNA, 19 nt, Mycobacterium avium subsp. paratuberculosis
cggcggccuccggauggcg

SEQ ID NO: 2993781 - RNA, 21 nt, Mycobacterium avium subsp. paratuberculosis
cggccgggauuucccgggcga

SEQ ID NO: 2993782 - RNA, 13 nt, Mycobacterium avium subsp. paratuberculosis
cggccgggcccuc

SEQ ID NO: 2993783 - RNA, 16 nt, Mycobacterium avium subsp. paratuberculosis
cggccgggccgcggcg

SEQ ID NO: 2993784 - RNA, 15 nt, Mycobacterium avium subsp. paratuberculosis
cggccgggccggaac

SEQ ID NO: 2993785 - RNA, 22 nt, Mycobacterium avium subsp. paratuberculosis
cggccgggccggaacgcccgau

SEQ ID NO: 2993786 - RNA, 15 nt, Mycobacterium avium subsp. paratuberculosis
cggccgggccggcgg

SEQ ID NO: 2993787 - RNA, 17 nt, Mycobacterium avium subsp. paratuberculosis
cggccgggcggacggca

SEQ ID NO: 2993788 - RNA, 14 nt, Mycobacterium avium subsp. paratuberculosis
cggccgggcggccg

SEQ ID NO: 2993789 - RNA, 17 nt, Mycobacterium avium subsp. paratuberculosis
cggccgggcugcccacc

SEQ ID NO: 2993790 - RNA, 18 nt, Mycobacterium avium subsp. paratuberculosis
cggccgggcugcccacca

SEQ ID NO: 2993791 - RNA, 23 nt, Mycobacterium avium subsp. paratuberculosis
cggccgggcugcgcagcaccguc

SEQ ID NO: 2993792 - RNA, 15 nt, Mycobacterium avium subsp. paratuberculosis
cggccggggcagacc

SEQ ID NO: 2993793 - RNA, 19 nt, Mycobacterium avium subsp. paratuberculosis
cggccggggcagacccgcg

SEQ ID NO: 2993794 - RNA, 15 nt, Mycobacterium avium subsp. paratuberculosis
cggccggggccagca

SEQ ID NO: 2993795 - RNA, 16 nt, Mycobacterium avium subsp. paratuberculosis
cggccggggccagcac

SEQ ID NO: 2993796 - RNA, 21 nt, Mycobacterium avium subsp. paratuberculosis
cggccggggccagcacccaga

SEQ ID NO: 2993797 - RNA, 13 nt, Mycobacterium avium subsp. paratuberculosis
cggccggggcgac

SEQ ID NO: 2993798 - RNA, 16 nt, Mycobacterium avium subsp. paratuberculosis
cggccggggcgaccag

SEQ ID NO: 2993799 - RNA, 15 nt, Mycobacterium avium subsp. paratuberculosis
cggccggggcgccac

SEQ ID NO: 2993800 - RNA, 15 nt, Mycobacterium avium subsp. paratuberculosis
cggccggggcggcgg

SEQ ID NO: 2993801 - RNA, 16 nt, Mycobacterium avium subsp. paratuberculosis
cggccggggcggcggu

SEQ ID NO: 2993802 - RNA, 17 nt, Mycobacterium avium subsp. paratuberculosis
cggccggggcgggcacg

SEQ ID NO: 2993803 - RNA, 22 nt, Mycobacterium avium subsp. paratuberculosis
cggccggggcgggcacgucgcg

SEQ ID NO: 2993804 - RNA, 14 nt, Mycobacterium avium subsp. paratuberculosis
cggccgggggcgcg

SEQ ID NO: 2993805 - RNA, 17 nt, Mycobacterium avium subsp. paratuberculosis
cggccgggggcgcgggc

SEQ ID NO: 2993806 - RNA, 18 nt, Mycobacterium avium subsp. paratuberculosis
cggccgggggcgcgggcg

SEQ ID NO: 2993807 - RNA, 19 nt, Mycobacterium avium subsp. paratuberculosis
cggccgggggcgcgggcgg

SEQ ID NO: 2993808 - RNA, 20 nt, Mycobacterium avium subsp. paratuberculosis
cggccgggggcgcgggcggc

SEQ ID NO: 2993809 - RNA, 21 nt, Mycobacterium avium subsp. paratuberculosis
cggccgggggcgcgggcggca

SEQ ID NO: 2993810 - RNA, 21 nt, Mycobacterium avium subsp. paratuberculosis
cggccgggucacgugcaccca

SEQ ID NO: 2993811 - RNA, 17 nt, Mycobacterium avium subsp. paratuberculosis
cggccgggucaggaaca

SEQ ID NO: 2993812 - RNA, 15 nt, Mycobacterium avium subsp. paratuberculosis
cggccggguccugga

SEQ ID NO: 2993813 - RNA, 11 nt, Mycobacterium avium subsp. paratuberculosis
cggccgggucg

SEQ ID NO: 2993814 - RNA, 20 nt, Mycobacterium avium subsp. paratuberculosis
cggccgggucgaccgcgaug

SEQ ID NO: 2993815 - RNA, 15 nt, Mycobacterium avium subsp. paratuberculosis
cggccgggucgagcg

SEQ ID NO: 2993816 - RNA, 19 nt, Mycobacterium avium subsp. paratuberculosis
cggccgggucgagcgcgcc

SEQ ID NO: 2993817 - RNA, 20 nt, Mycobacterium avium subsp. paratuberculosis
cggccgggucgagcgcgccg

SEQ ID NO: 2993818 - RNA, 21 nt, Mycobacterium avium subsp. paratuberculosis
cggccgggucgagcgcgccga

SEQ ID NO: 2993819 - RNA, 12 nt, Mycobacterium avium subsp. paratuberculosis
cggccgggucgc

SEQ ID NO: 2993820 - RNA, 17 nt, Mycobacterium avium subsp. paratuberculosis
cggccgggucgcaggca

SEQ ID NO: 2993821 - RNA, 19 nt, Mycobacterium avium subsp. paratuberculosis
cggccgggucgcaggcagc

SEQ ID NO: 2993822 - RNA, 23 nt, Mycobacterium avium subsp. paratuberculosis
cggccgggucgcaggcagcagca

SEQ ID NO: 2993823 - RNA, 20 nt, Mycobacterium avium subsp. paratuberculosis
cggccggguguagcugggcc

SEQ ID NO: 2993824 - RNA, 18 nt, Mycobacterium avium subsp. paratuberculosis
cggccggguuguccuggc

SEQ ID NO: 2993825 - RNA, 24 nt, Mycobacterium avium subsp. paratuberculosis
cggccgguccgaucguccggcgcc

SEQ ID NO: 2993826 - RNA, 14 nt, Mycobacterium avium subsp. paratuberculosis
cggccgguccgccc

SEQ ID NO: 2993827 - RNA, 15 nt, Mycobacterium avium subsp. paratuberculosis
cggccgguccgccca

SEQ ID NO: 2993828 - RNA, 22 nt, Mycobacterium avium subsp. paratuberculosis
cggccgguccgcccagacgcgg

SEQ ID NO: 2993829 - RNA, 18 nt, Mycobacterium avium subsp. paratuberculosis
cggccgguccgugcacgg

SEQ ID NO: 2993830 - RNA, 21 nt, Mycobacterium avium subsp. paratuberculosis
cggccgguccucugcgaccac

SEQ ID NO: 2993831 - RNA, 23 nt, Mycobacterium avium subsp. paratuberculosis
cggccgguccucugcgaccaccc

SEQ ID NO: 2993832 - RNA, 21 nt, Mycobacterium avium subsp. paratuberculosis
cggccggucgaaggccccggu

SEQ ID NO: 2993833 - RNA, 14 nt, Mycobacterium avium subsp. paratuberculosis
cggccggucgccga

SEQ ID NO: 2993834 - RNA, 17 nt, Mycobacterium avium subsp. paratuberculosis
cggccggucgccgaugg

SEQ ID NO: 2993835 - RNA, 18 nt, Mycobacterium avium subsp. paratuberculosis
cggccggucgccugcuuc

SEQ ID NO: 2993836 - RNA, 12 nt, Mycobacterium avium subsp. paratuberculosis
cggccggugacu

SEQ ID NO: 2993837 - RNA, 22 nt, Mycobacterium avium subsp. paratuberculosis
cggccggugacuccuccucggc

SEQ ID NO: 2993838 - RNA, 14 nt, Mycobacterium avium subsp. paratuberculosis
cggccggugaucgg

SEQ ID NO: 2993839 - RNA, 22 nt, Mycobacterium avium subsp. paratuberculosis
cggccggugaucggucugccug

SEQ ID NO: 2993840 - RNA, 16 nt, Mycobacterium avium subsp. paratuberculosis
cggccggugccacggu

SEQ ID NO: 2993841 - RNA, 20 nt, Mycobacterium avium subsp. paratuberculosis
cggccggugccacggucagg

SEQ ID NO: 2993842 - RNA, 15 nt, Mycobacterium avium subsp. paratuberculosis
cggccggugcgcguc

SEQ ID NO: 2993843 - RNA, 23 nt, Mycobacterium avium subsp. paratuberculosis
cggccggugcgcgucagccgucg

SEQ ID NO: 2993844 - RNA, 14 nt, Mycobacterium avium subsp. paratuberculosis
cggccgguuccacg

SEQ ID NO: 2993845 - RNA, 23 nt, Mycobacterium avium subsp. paratuberculosis
cggccgguugccuuuccgcgcgg

SEQ ID NO: 2993846 - RNA, 12 nt, Mycobacterium avium subsp. paratuberculosis
cggccgguuggc

SEQ ID NO: 2993847 - RNA, 15 nt, Mycobacterium avium subsp. paratuberculosis
cggccgguuggcggc

SEQ ID NO: 2993848 - RNA, 17 nt, Mycobacterium avium subsp. paratuberculosis
cggccgguuggcggccg

SEQ ID NO: 2993849 - RNA, 14 nt, Mycobacterium avium subsp. paratuberculosis
cggccguaccggcg

SEQ ID NO: 2993850 - RNA, 16 nt, Mycobacterium avium subsp. paratuberculosis
cggccguaccggcgua

SEQ ID NO: 2993851 - RNA, 17 nt, Mycobacterium avium subsp. paratuberculosis
cggccguaccggcguac

SEQ ID NO: 2993852 - RNA, 15 nt, Mycobacterium avium subsp. paratuberculosis
cggccguacgcgguu

SEQ ID NO: 2993853 - RNA, 17 nt, Mycobacterium avium subsp. paratuberculosis
cggccguacgcgguucg

SEQ ID NO: 2993854 - RNA, 18 nt, Mycobacterium avium subsp. paratuberculosis
cggccguagccggaccgc

SEQ ID NO: 2993855 - RNA, 19 nt, Mycobacterium avium subsp. paratuberculosis
cggccguagccggaccgcu

SEQ ID NO: 2993856 - RNA, 15 nt, Mycobacterium avium subsp. paratuberculosis
cggccguagccguag

SEQ ID NO: 2993857 - RNA, 21 nt, Mycobacterium avium subsp. paratuberculosis
cggccguagcguugccggccg

SEQ ID NO: 2993858 - RNA, 22 nt, Mycobacterium avium subsp. paratuberculosis
cggccguagcguugccggccga

SEQ ID NO: 2993859 - RNA, 15 nt, Mycobacterium avium subsp. paratuberculosis
cggccguaucggcca

SEQ ID NO: 2993860 - RNA, 16 nt, Mycobacterium avium subsp. paratuberculosis
cggccguaucggccaa

SEQ ID NO: 2993861 - RNA, 13 nt, Mycobacterium avium subsp. paratuberculosis
cggccgucacgcu

SEQ ID NO: 2993862 - RNA, 16 nt, Mycobacterium avium subsp. paratuberculosis
cggccgucacgcuggc

SEQ ID NO: 2993863 - RNA, 17 nt, Mycobacterium avium subsp. paratuberculosis
cggccgucaggaacgcc

SEQ ID NO: 2993864 - RNA, 21 nt, Mycobacterium avium subsp. paratuberculosis
cggccgucaggaacgccggcu

SEQ ID NO: 2993865 - RNA, 20 nt, Mycobacterium avium subsp. paratuberculosis
cggccguccaccaccaaccc

SEQ ID NO: 2993866 - RNA, 14 nt, Mycobacterium avium subsp. paratuberculosis
cggccguccacggc

SEQ ID NO: 2993867 - RNA, 15 nt, Mycobacterium avium subsp. paratuberculosis
cggccguccacggcg

SEQ ID NO: 2993868 - RNA, 17 nt, Mycobacterium avium subsp. paratuberculosis
cggccguccacggcggu

SEQ ID NO: 2993869 - RNA, 13 nt, Mycobacterium avium subsp. paratuberculosis
cggccguccagcg

SEQ ID NO: 2993870 - RNA, 13 nt, Mycobacterium avium subsp. paratuberculosis
cggccguccaggc

SEQ ID NO: 2993871 - RNA, 23 nt, Mycobacterium avium subsp. paratuberculosis
cggccguccaggcgccauugucg

SEQ ID NO: 2993872 - RNA, 15 nt, Mycobacterium avium subsp. paratuberculosis
cggccguccggucgc

SEQ ID NO: 2993873 - RNA, 18 nt, Mycobacterium avium subsp. paratuberculosis
cggccguccggucgcugg

SEQ ID NO: 2993874 - RNA, 20 nt, Mycobacterium avium subsp. paratuberculosis
cggccguccggucgcugggc

SEQ ID NO: 2993875 - RNA, 14 nt, Mycobacterium avium subsp. paratuberculosis
cggccgucgcgcac

SEQ ID NO: 2993876 - RNA, 18 nt, Mycobacterium avium subsp. paratuberculosis
cggccgucgcgcaccacc

SEQ ID NO: 2993877 - RNA, 22 nt, Mycobacterium avium subsp. paratuberculosis
cggccgucgcgcaccaccucga

SEQ ID NO: 2993878 - RNA, 15 nt, Mycobacterium avium subsp. paratuberculosis
cggccgucgcgcagc

SEQ ID NO: 2993879 - RNA, 14 nt, Mycobacterium avium subsp. paratuberculosis
cggccgucgcggcg

SEQ ID NO: 2993880 - RNA, 15 nt, Mycobacterium avium subsp. paratuberculosis
cggccgucggaucga

SEQ ID NO: 2993881 - RNA, 13 nt, Mycobacterium avium subsp. paratuberculosis
cggccgucggcgc

SEQ ID NO: 2993882 - RNA, 14 nt, Mycobacterium avium subsp. paratuberculosis
cggccgucggcgcc

SEQ ID NO: 2993883 - RNA, 15 nt, Mycobacterium avium subsp. paratuberculosis
cggccgucggcgccg

SEQ ID NO: 2993884 - RNA, 18 nt, Mycobacterium avium subsp. paratuberculosis
cggccgucggcgccgccg

SEQ ID NO: 2993885 - RNA, 23 nt, Mycobacterium avium subsp. paratuberculosis
cggccgucggcgccgccgagccg

SEQ ID NO: 2993886 - RNA, 12 nt, Mycobacterium avium subsp. paratuberculosis
cggccgucggga

SEQ ID NO: 2993887 - RNA, 13 nt, Mycobacterium avium subsp. paratuberculosis
cggccgucgggaa

SEQ ID NO: 2993888 - RNA, 23 nt, Mycobacterium avium subsp. paratuberculosis
cggccgucgucgggcaggauguc

SEQ ID NO: 2993889 - RNA, 19 nt, Mycobacterium avium subsp. paratuberculosis
cggccgucgucgugcacca

SEQ ID NO: 2993890 - RNA, 20 nt, Mycobacterium avium subsp. paratuberculosis
cggccgucgucgugcaccac

SEQ ID NO: 2993891 - RNA, 17 nt, Mycobacterium avium subsp. paratuberculosis
cggccgucuugcccggc

SEQ ID NO: 2993892 - RNA, 20 nt, Mycobacterium avium subsp. paratuberculosis
cggccgucuugcccggcgag

SEQ ID NO: 2993893 - RNA, 23 nt, Mycobacterium avium subsp. paratuberculosis
cggccgucuugcccggcgagcga

SEQ ID NO: 2993894 - RNA, 18 nt, Mycobacterium avium subsp. paratuberculosis
cggccgugaucucgugcc

SEQ ID NO: 2993895 - RNA, 19 nt, Mycobacterium avium subsp. paratuberculosis
cggccgugaucucgugccg

SEQ ID NO: 2993896 - RNA, 14 nt, Mycobacterium avium subsp. paratuberculosis
cggccgugaugccg

SEQ ID NO: 2993897 - RNA, 17 nt, Mycobacterium avium subsp. paratuberculosis
cggccgugaugccgggc

SEQ ID NO: 2993898 - RNA, 19 nt, Mycobacterium avium subsp. paratuberculosis
cggccgugaugccgggcaa

SEQ ID NO: 2993899 - RNA, 14 nt, Mycobacterium avium subsp. paratuberculosis
cggccgugaugcgc

SEQ ID NO: 2993900 - RNA, 15 nt, Mycobacterium avium subsp. paratuberculosis
cggccgugccggcuc

SEQ ID NO: 2993901 - RNA, 13 nt, Mycobacterium avium subsp. paratuberculosis
cggccgugccgug

SEQ ID NO: 2993902 - RNA, 22 nt, Mycobacterium avium subsp. paratuberculosis
cggccgugccguggucggugcc

SEQ ID NO: 2993903 - RNA, 14 nt, Mycobacterium avium subsp. paratuberculosis
cggccgugcgcguc

SEQ ID NO: 2993904 - RNA, 15 nt, Mycobacterium avium subsp. paratuberculosis
cggccgugcgcgucg

SEQ ID NO: 2993905 - RNA, 16 nt, Mycobacterium avium subsp. paratuberculosis
cggccgugcgcgucga

SEQ ID NO: 2993906 - RNA, 18 nt, Mycobacterium avium subsp. paratuberculosis
cggccgugcgcgucgaca

SEQ ID NO: 2993907 - RNA, 16 nt, Mycobacterium avium subsp. paratuberculosis
cggccguggacccgcc

SEQ ID NO: 2993908 - RNA, 18 nt, Mycobacterium avium subsp. paratuberculosis
cggccguggacccgcccc

SEQ ID NO: 2993909 - RNA, 20 nt, Mycobacterium avium subsp. paratuberculosis
cggccguggacccgccccga

SEQ ID NO: 2993910 - RNA, 21 nt, Mycobacterium avium subsp. paratuberculosis
cggccguggccgucacgcugg

SEQ ID NO: 2993911 - RNA, 20 nt, Mycobacterium avium subsp. paratuberculosis
cggccguggcgaacucgacg

SEQ ID NO: 2993912 - RNA, 13 nt, Mycobacterium avium subsp. paratuberculosis
cggccguggucga

SEQ ID NO: 2993913 - RNA, 15 nt, Mycobacterium avium subsp. paratuberculosis
cggccguggucgaug

SEQ ID NO: 2993914 - RNA, 16 nt, Mycobacterium avium subsp. paratuberculosis
cggccguguacagcag

SEQ ID NO: 2993915 - RNA, 22 nt, Mycobacterium avium subsp. paratuberculosis
cggccguguacagcagggucga

SEQ ID NO: 2993916 - RNA, 17 nt, Mycobacterium avium subsp. paratuberculosis
cggccguucgccggcca

SEQ ID NO: 2993917 - RNA, 18 nt, Mycobacterium avium subsp. paratuberculosis
cggccguucgccggccag

SEQ ID NO: 2993918 - RNA, 19 nt, Mycobacterium avium subsp. paratuberculosis
cggccguucgccggccagc

SEQ ID NO: 2993919 - RNA, 21 nt, Mycobacterium avium subsp. paratuberculosis
cggccguucgccggccagcac

SEQ ID NO: 2993920 - RNA, 22 nt, Mycobacterium avium subsp. paratuberculosis
cggccguucgccggccagcacg

SEQ ID NO: 2993921 - RNA, 15 nt, Mycobacterium avium subsp. paratuberculosis
cggccguucucggga

SEQ ID NO: 2993922 - RNA, 15 nt, Mycobacterium avium subsp. paratuberculosis
cggccguugcgggug

SEQ ID NO: 2993923 - RNA, 19 nt, Mycobacterium avium subsp. paratuberculosis
cggccguugcgggugucgc

SEQ ID NO: 2993924 - RNA, 21 nt, Mycobacterium avium subsp. paratuberculosis
cggccguugcucucggccucc

SEQ ID NO: 2993925 - RNA, 17 nt, Mycobacterium avium subsp. paratuberculosis
cggccguugggccagcg

SEQ ID NO: 2993926 - RNA, 18 nt, Mycobacterium avium subsp. paratuberculosis
cggccguugggccagcgg

SEQ ID NO: 2993927 - RNA, 20 nt, Mycobacterium avium subsp. paratuberculosis
cggccguugggccagcggcg

SEQ ID NO: 2993928 - RNA, 21 nt, Mycobacterium avium subsp. paratuberculosis
cggccguugggccagcggcgc

SEQ ID NO: 2993929 - RNA, 22 nt, Mycobacterium avium subsp. paratuberculosis
cggccuaacgaguaggcggcuc

SEQ ID NO: 2993930 - RNA, 15 nt, Mycobacterium avium subsp. paratuberculosis
cggccuaugcgcccg

SEQ ID NO: 2993931 - RNA, 17 nt, Mycobacterium avium subsp. paratuberculosis
cggccuaugcgcccggg

SEQ ID NO: 2993932 - RNA, 13 nt, Mycobacterium avium subsp. paratuberculosis
cggccucaccgcg

SEQ ID NO: 2993933 - RNA, 14 nt, Mycobacterium avium subsp. paratuberculosis
cggccucaccgcgg

SEQ ID NO: 2993934 - RNA, 19 nt, Mycobacterium avium subsp. paratuberculosis
cggccucaccgcgggccag

SEQ ID NO: 2993935 - RNA, 22 nt, Mycobacterium avium subsp. paratuberculosis
cggccucaccgcgggccaggcc

SEQ ID NO: 2993936 - RNA, 16 nt, Mycobacterium avium subsp. paratuberculosis
cggccucaggcgucgg

SEQ ID NO: 2993937 - RNA, 21 nt, Mycobacterium avium subsp. paratuberculosis
cggccucaggcgucggucagc

SEQ ID NO: 2993938 - RNA, 21 nt, Mycobacterium avium subsp. paratuberculosis
cggccucaguccgacgcgacg

SEQ ID NO: 2993939 - RNA, 22 nt, Mycobacterium avium subsp. paratuberculosis
cggccucaguccgacgcgacgg

SEQ ID NO: 2993940 - RNA, 12 nt, Mycobacterium avium subsp. paratuberculosis
cggccuccagcc

SEQ ID NO: 2993941 - RNA, 13 nt, Mycobacterium avium subsp. paratuberculosis
cggccuccagccg

SEQ ID NO: 2993942 - RNA, 22 nt, Mycobacterium avium subsp. paratuberculosis
cggccuccagccgcgcggccgc

SEQ ID NO: 2993943 - RNA, 16 nt, Mycobacterium avium subsp. paratuberculosis
cggccuccagccggcg

SEQ ID NO: 2993944 - RNA, 13 nt, Mycobacterium avium subsp. paratuberculosis
cggccuccagcug

SEQ ID NO: 2993945 - RNA, 19 nt, Mycobacterium avium subsp. paratuberculosis
cggccuccagcuguugacg

SEQ ID NO: 2993946 - RNA, 17 nt, Mycobacterium avium subsp. paratuberculosis
cggccucccacucgucg

SEQ ID NO: 2993947 - RNA, 21 nt, Mycobacterium avium subsp. paratuberculosis
cggccucccacucgucgaucg

SEQ ID NO: 2993948 - RNA, 23 nt, Mycobacterium avium subsp. paratuberculosis
cggccucccacucgucgaucgac

SEQ ID NO: 2993949 - RNA, 17 nt, Mycobacterium avium subsp. paratuberculosis
cggccuccgagcggcgc

SEQ ID NO: 2993950 - RNA, 21 nt, Mycobacterium avium subsp. paratuberculosis
cggccuccgagcggcgcaggc

SEQ ID NO: 2993951 - RNA, 12 nt, Mycobacterium avium subsp. paratuberculosis
cggccuccgcca

SEQ ID NO: 2993952 - RNA, 15 nt, Mycobacterium avium subsp. paratuberculosis
cggccuccgccaccu

SEQ ID NO: 2993953 - RNA, 19 nt, Mycobacterium avium subsp. paratuberculosis
cggccuccgccaccuccuc

SEQ ID NO: 2993954 - RNA, 20 nt, Mycobacterium avium subsp. paratuberculosis
cggccuccgccaccuccucc

SEQ ID NO: 2993955 - RNA, 16 nt, Mycobacterium avium subsp. paratuberculosis
cggccuccgcgcgcgg

SEQ ID NO: 2993956 - RNA, 21 nt, Mycobacterium avium subsp. paratuberculosis
cggccuccggauggcggucgc

SEQ ID NO: 2993957 - RNA, 19 nt, Mycobacterium avium subsp. paratuberculosis
cggccuccuccucgcugcc

SEQ ID NO: 2993958 - RNA, 22 nt, Mycobacterium avium subsp. paratuberculosis
cggccuccuccucgcugccggc

SEQ ID NO: 2993959 - RNA, 14 nt, Mycobacterium avium subsp. paratuberculosis
cggccucgaagcug

SEQ ID NO: 2993960 - RNA, 12 nt, Mycobacterium avium subsp. paratuberculosis
cggccucgauca

SEQ ID NO: 2993961 - RNA, 15 nt, Mycobacterium avium subsp. paratuberculosis
cggccucgaucauca

SEQ ID NO: 2993962 - RNA, 23 nt, Mycobacterium avium subsp. paratuberculosis
cggccucgaucaucaccaccgcc

SEQ ID NO: 2993963 - RNA, 13 nt, Mycobacterium avium subsp. paratuberculosis
cggccucgauguc

SEQ ID NO: 2993964 - RNA, 20 nt, Mycobacterium avium subsp. paratuberculosis
cggccucgaugucgucgaug

SEQ ID NO: 2993965 - RNA, 14 nt, Mycobacterium avium subsp. paratuberculosis
cggccucgcccagc

SEQ ID NO: 2993966 - RNA, 18 nt, Mycobacterium avium subsp. paratuberculosis
cggccucgcccagcgccg

SEQ ID NO: 2993967 - RNA, 22 nt, Mycobacterium avium subsp. paratuberculosis
cggccucgcccagcgccgcggc

SEQ ID NO: 2993968 - RNA, 13 nt, Mycobacterium avium subsp. paratuberculosis
cggccucgccggc

SEQ ID NO: 2993969 - RNA, 16 nt, Mycobacterium avium subsp. paratuberculosis
cggccucgccggcgcc

SEQ ID NO: 2993970 - RNA, 23 nt, Mycobacterium avium subsp. paratuberculosis
cggccucgccgucgaaggccggg

SEQ ID NO: 2993971 - RNA, 16 nt, Mycobacterium avium subsp. paratuberculosis
cggccucgccgucgcg

SEQ ID NO: 2993972 - RNA, 13 nt, Mycobacterium avium subsp. paratuberculosis
cggccucggcacc

SEQ ID NO: 2993973 - RNA, 17 nt, Mycobacterium avium subsp. paratuberculosis
cggccucggcaccgugc

SEQ ID NO: 2993974 - RNA, 12 nt, Mycobacterium avium subsp. paratuberculosis
cggccucggcgg

SEQ ID NO: 2993975 - RNA, 14 nt, Mycobacterium avium subsp. paratuberculosis
cggccucggcggcc

SEQ ID NO: 2993976 - RNA, 16 nt, Mycobacterium avium subsp. paratuberculosis
cggccucggcggccgg

SEQ ID NO: 2993977 - RNA, 20 nt, Mycobacterium avium subsp. paratuberculosis
cggccucggcggccgggaug

SEQ ID NO: 2993978 - RNA, 15 nt, Mycobacterium avium subsp. paratuberculosis
cggccucggcggugg

SEQ ID NO: 2993979 - RNA, 21 nt, Mycobacterium avium subsp. paratuberculosis
cggccucggcgguggccucgg

SEQ ID NO: 2993980 - RNA, 14 nt, Mycobacterium avium subsp. paratuberculosis
cggccucggcgucc

SEQ ID NO: 2993981 - RNA, 15 nt, Mycobacterium avium subsp. paratuberculosis
cggccucggcguccg

SEQ ID NO: 2993982 - RNA, 20 nt, Mycobacterium avium subsp. paratuberculosis
cggccucggcguccgcggcg

SEQ ID NO: 2993983 - RNA, 17 nt, Mycobacterium avium subsp. paratuberculosis
cggccucggcgucgaag

SEQ ID NO: 2993984 - RNA, 21 nt, Mycobacterium avium subsp. paratuberculosis
cggccucggugcucaucagcg

SEQ ID NO: 2993985 - RNA, 22 nt, Mycobacterium avium subsp. paratuberculosis
cggccucggugcucaucagcga

SEQ ID NO: 2993986 - RNA, 23 nt, Mycobacterium avium subsp. paratuberculosis
cggccucgucgacgucggggaug

SEQ ID NO: 2993987 - RNA, 17 nt, Mycobacterium avium subsp. paratuberculosis
cggccucgucgagguac

SEQ ID NO: 2993988 - RNA, 14 nt, Mycobacterium avium subsp. paratuberculosis
cggccucgucggcg

SEQ ID NO: 2993989 - RNA, 16 nt, Mycobacterium avium subsp. paratuberculosis
cggccucgucggcgag

SEQ ID NO: 2993990 - RNA, 17 nt, Mycobacterium avium subsp. paratuberculosis
cggccucgucggcgagc

SEQ ID NO: 2993991 - RNA, 20 nt, Mycobacterium avium subsp. paratuberculosis
cggccucgucggcgagcagc

SEQ ID NO: 2993992 - RNA, 21 nt, Mycobacterium avium subsp. paratuberculosis
cggccucguugaccgggucgc

SEQ ID NO: 2993993 - RNA, 23 nt, Mycobacterium avium subsp. paratuberculosis
cggccucguugaccgggucgccg

SEQ ID NO: 2993994 - RNA, 19 nt, Mycobacterium avium subsp. paratuberculosis
cggccucucagcgcugucg

SEQ ID NO: 2993995 - RNA, 16 nt, Mycobacterium avium subsp. paratuberculosis
cggccucucgucgacg

SEQ ID NO: 2993996 - RNA, 16 nt, Mycobacterium avium subsp. paratuberculosis
cggccugagacgacgc

SEQ ID NO: 2993997 - RNA, 20 nt, Mycobacterium avium subsp. paratuberculosis
cggccugagacgacgccacc

SEQ ID NO: 2993998 - RNA, 15 nt, Mycobacterium avium subsp. paratuberculosis
cggccugagccgccg

SEQ ID NO: 2993999 - RNA, 23 nt, Mycobacterium avium subsp. paratuberculosis
cggccugcacaggggcgcguagc

SEQ ID NO: 2994000 - RNA, 13 nt, Mycobacterium avium subsp. paratuberculosis
cggccugcaccac

SEQ ID NO: 2994001 - RNA, 14 nt, Mycobacterium avium subsp. paratuberculosis
cggccugcaccacc

SEQ ID NO: 2994002 - RNA, 19 nt, Mycobacterium avium subsp. paratuberculosis
cggccugcaccaccacacc

SEQ ID NO: 2994003 - RNA, 23 nt, Mycobacterium avium subsp. paratuberculosis
cggccugcaccaccacacccagc

SEQ ID NO: 2994004 - RNA, 13 nt, Mycobacterium avium subsp. paratuberculosis
cggccugcaccca

SEQ ID NO: 2994005 - RNA, 19 nt, Mycobacterium avium subsp. paratuberculosis
cggccugcacccaggucau

SEQ ID NO: 2994006 - RNA, 14 nt, Mycobacterium avium subsp. paratuberculosis
cggccugcacgucg

SEQ ID NO: 2994007 - RNA, 15 nt, Mycobacterium avium subsp. paratuberculosis
cggccugcacgucgg

SEQ ID NO: 2994008 - RNA, 17 nt, Mycobacterium avium subsp. paratuberculosis
cggccugcacgucggcg

SEQ ID NO: 2994009 - RNA, 21 nt, Mycobacterium avium subsp. paratuberculosis
cggccugcacgucggcgcgca

SEQ ID NO: 2994010 - RNA, 23 nt, Mycobacterium avium subsp. paratuberculosis
cggccugcacgucggcgcgcagg

SEQ ID NO: 2994011 - RNA, 13 nt, Mycobacterium avium subsp. paratuberculosis
cggccugcagcac

SEQ ID NO: 2994012 - RNA, 15 nt, Mycobacterium avium subsp. paratuberculosis
cggccugcagcaccg

SEQ ID NO: 2994013 - RNA, 17 nt, Mycobacterium avium subsp. paratuberculosis
cggccugcagcaccgaa

SEQ ID NO: 2994014 - RNA, 14 nt, Mycobacterium avium subsp. paratuberculosis
cggccugcagcgcg

SEQ ID NO: 2994015 - RNA, 16 nt, Mycobacterium avium subsp. paratuberculosis
cggccugcagcgcggu

SEQ ID NO: 2994016 - RNA, 17 nt, Mycobacterium avium subsp. paratuberculosis
cggccugcagcgcgguc

SEQ ID NO: 2994017 - RNA, 14 nt, Mycobacterium avium subsp. paratuberculosis
cggccugcagcucg

SEQ ID NO: 2994018 - RNA, 13 nt, Mycobacterium avium subsp. paratuberculosis
cggccugccaccg

SEQ ID NO: 2994019 - RNA, 14 nt, Mycobacterium avium subsp. paratuberculosis
cggccugccaccgc

SEQ ID NO: 2994020 - RNA, 15 nt, Mycobacterium avium subsp. paratuberculosis
cggccugccaccgcg

SEQ ID NO: 2994021 - RNA, 18 nt, Mycobacterium avium subsp. paratuberculosis
cggccugccaccgcgaau

SEQ ID NO: 2994022 - RNA, 14 nt, Mycobacterium avium subsp. paratuberculosis
cggccugcccgccg

SEQ ID NO: 2994023 - RNA, 17 nt, Mycobacterium avium subsp. paratuberculosis
cggccugcccgccgcgg

SEQ ID NO: 2994024 - RNA, 21 nt, Mycobacterium avium subsp. paratuberculosis
cggccugcccgccgcggccgc

SEQ ID NO: 2994025 - RNA, 17 nt, Mycobacterium avium subsp. paratuberculosis
cggccugcccgcgggug

SEQ ID NO: 2994026 - RNA, 14 nt, Mycobacterium avium subsp. paratuberculosis
cggccugccggaug

SEQ ID NO: 2994027 - RNA, 17 nt, Mycobacterium avium subsp. paratuberculosis
cggccugccggaugccg

SEQ ID NO: 2994028 - RNA, 23 nt, Mycobacterium avium subsp. paratuberculosis
cggccugccggaugccgcgcggc

SEQ ID NO: 2994029 - RNA, 14 nt, Mycobacterium avium subsp. paratuberculosis
cggccugccggccg

SEQ ID NO: 2994030 - RNA, 17 nt, Mycobacterium avium subsp. paratuberculosis
cggccugccggccgccg

SEQ ID NO: 2994031 - RNA, 13 nt, Mycobacterium avium subsp. paratuberculosis
cggccugcgcccg

SEQ ID NO: 2994032 - RNA, 14 nt, Mycobacterium avium subsp. paratuberculosis
cggccugcgcccgg

SEQ ID NO: 2994033 - RNA, 14 nt, Mycobacterium avium subsp. paratuberculosis
cggccugcgcgucg

SEQ ID NO: 2994034 - RNA, 13 nt, Mycobacterium avium subsp. paratuberculosis
cggccugcggcgg

SEQ ID NO: 2994035 - RNA, 14 nt, Mycobacterium avium subsp. paratuberculosis
cggccugcggcggc

SEQ ID NO: 2994036 - RNA, 15 nt, Mycobacterium avium subsp. paratuberculosis
cggccugcgggcgcc

SEQ ID NO: 2994037 - RNA, 18 nt, Mycobacterium avium subsp. paratuberculosis
cggccugcgggcgccggc

SEQ ID NO: 2994038 - RNA, 22 nt, Mycobacterium avium subsp. paratuberculosis
cggccugcgggcgccggcugcc

SEQ ID NO: 2994039 - RNA, 19 nt, Mycobacterium avium subsp. paratuberculosis
cggccugcgucacuccucg

SEQ ID NO: 2994040 - RNA, 22 nt, Mycobacterium avium subsp. paratuberculosis
cggccugcgucacuccucgauc

SEQ ID NO: 2994041 - RNA, 15 nt, Mycobacterium avium subsp. paratuberculosis
cggccugcuccagcg

SEQ ID NO: 2994042 - RNA, 12 nt, Mycobacterium avium subsp. paratuberculosis
cggccugcucga

SEQ ID NO: 2994043 - RNA, 13 nt, Mycobacterium avium subsp. paratuberculosis
cggccugcucgaa

SEQ ID NO: 2994044 - RNA, 18 nt, Mycobacterium avium subsp. paratuberculosis
cggccugcuugaccgcca

SEQ ID NO: 2994045 - RNA, 13 nt, Mycobacterium avium subsp. paratuberculosis
cggccuggcccag

SEQ ID NO: 2994046 - RNA, 16 nt, Mycobacterium avium subsp. paratuberculosis
cggccuggcccagccg

SEQ ID NO: 2994047 - RNA, 17 nt, Mycobacterium avium subsp. paratuberculosis
cggccuggcccagccgc

SEQ ID NO: 2994048 - RNA, 14 nt, Mycobacterium avium subsp. paratuberculosis
cggccuggccgucg

SEQ ID NO: 2994049 - RNA, 15 nt, Mycobacterium avium subsp. paratuberculosis
cggccuggccgucgc

SEQ ID NO: 2994050 - RNA, 18 nt, Mycobacterium avium subsp. paratuberculosis
cggccugggcgaccacgu

SEQ ID NO: 2994051 - RNA, 13 nt, Mycobacterium avium subsp. paratuberculosis
cggccuggggggc

SEQ ID NO: 2994052 - RNA, 23 nt, Mycobacterium avium subsp. paratuberculosis
cggccugggugaccgagucgucg

SEQ ID NO: 2994053 - RNA, 18 nt, Mycobacterium avium subsp. paratuberculosis
cggccugguacagcaccg

SEQ ID NO: 2994054 - RNA, 19 nt, Mycobacterium avium subsp. paratuberculosis
cggccugguacagcaccgc

SEQ ID NO: 2994055 - RNA, 22 nt, Mycobacterium avium subsp. paratuberculosis
cggccugguacagcaccgccgc

SEQ ID NO: 2994056 - RNA, 20 nt, Mycobacterium avium subsp. paratuberculosis
cggccugucaacgagacacc

SEQ ID NO: 2994057 - RNA, 21 nt, Mycobacterium avium subsp. paratuberculosis
cggccugucaacgagacaccc

SEQ ID NO: 2994058 - RNA, 21 nt, Mycobacterium avium subsp. paratuberculosis
cggccuguccggucuucucgg

SEQ ID NO: 2994059 - RNA, 14 nt, Mycobacterium avium subsp. paratuberculosis
cggccuuacgcugc

SEQ ID NO: 2994060 - RNA, 22 nt, Mycobacterium avium subsp. paratuberculosis
cggccuucaccagggugccccg

SEQ ID NO: 2994061 - RNA, 19 nt, Mycobacterium avium subsp. paratuberculosis
cggccuucagugaaccccg

SEQ ID NO: 2994062 - RNA, 15 nt, Mycobacterium avium subsp. paratuberculosis
cggccuucgccucgu

SEQ ID NO: 2994063 - RNA, 17 nt, Mycobacterium avium subsp. paratuberculosis
cggccuucucgcgcacc

SEQ ID NO: 2994064 - RNA, 19 nt, Mycobacterium avium subsp. paratuberculosis
cggccuucucgcgcaccgc

SEQ ID NO: 2994065 - RNA, 23 nt, Mycobacterium avium subsp. paratuberculosis
cggccuucuucugccacucgucg

SEQ ID NO: 2994066 - RNA, 15 nt, Mycobacterium avium subsp. paratuberculosis
cggccuucuuggccg

SEQ ID NO: 2994067 - RNA, 21 nt, Mycobacterium avium subsp. paratuberculosis
cggccuucuuggccggagccu

SEQ ID NO: 2994068 - RNA, 21 nt, Mycobacterium avium subsp. paratuberculosis
cggccuugaacgcguccgacg

SEQ ID NO: 2994069 - RNA, 16 nt, Mycobacterium avium subsp. paratuberculosis
cggccuugaccaggau

SEQ ID NO: 2994070 - RNA, 17 nt, Mycobacterium avium subsp. paratuberculosis
cggccuugaccaggaug

SEQ ID NO: 2994071 - RNA, 18 nt, Mycobacterium avium subsp. paratuberculosis
cggccuugaccaggaugu

SEQ ID NO: 2994072 - RNA, 20 nt, Mycobacterium avium subsp. paratuberculosis
cggccuugccgaucagcugg

SEQ ID NO: 2994073 - RNA, 14 nt, Mycobacterium avium subsp. paratuberculosis
cggccuugccgcug

SEQ ID NO: 2994074 - RNA, 15 nt, Mycobacterium avium subsp. paratuberculosis
cggccuugcgagccg

SEQ ID NO: 2994075 - RNA, 16 nt, Mycobacterium avium subsp. paratuberculosis
cggccuugcgagccgg

SEQ ID NO: 2994076 - RNA, 21 nt, Mycobacterium avium subsp. paratuberculosis
cggccuugcgagccggagccu

SEQ ID NO: 2994077 - RNA, 17 nt, Mycobacterium avium subsp. paratuberculosis
cggccuugcgcaccgga

SEQ ID NO: 2994078 - RNA, 21 nt, Mycobacterium avium subsp. paratuberculosis
cggccuugcgcaccggagccu

SEQ ID NO: 2994079 - RNA, 13 nt, Mycobacterium avium subsp. paratuberculosis
cggccuugcgcca

SEQ ID NO: 2994080 - RNA, 15 nt, Mycobacterium avium subsp. paratuberculosis
cggccuugcgggccg

SEQ ID NO: 2994081 - RNA, 17 nt, Mycobacterium avium subsp. paratuberculosis
cggccuugcgggccgga

SEQ ID NO: 2994082 - RNA, 21 nt, Mycobacterium avium subsp. paratuberculosis
cggccuugcgggccggagccu

SEQ ID NO: 2994083 - RNA, 15 nt, Mycobacterium avium subsp. paratuberculosis
cggccuugcucgccg

SEQ ID NO: 2994084 - RNA, 15 nt, Mycobacterium avium subsp. paratuberculosis
cggccuuggccaccg

SEQ ID NO: 2994085 - RNA, 16 nt, Mycobacterium avium subsp. paratuberculosis
cggccuuggccaccgc

SEQ ID NO: 2994086 - RNA, 17 nt, Mycobacterium avium subsp. paratuberculosis
cggccuuggccaccgcc

SEQ ID NO: 2994087 - RNA, 19 nt, Mycobacterium avium subsp. paratuberculosis
cggccuuggccaccgccug

SEQ ID NO: 2994088 - RNA, 20 nt, Mycobacterium avium subsp. paratuberculosis
cggccuuggccaccgccugc

SEQ ID NO: 2994089 - RNA, 16 nt, Mycobacterium avium subsp. paratuberculosis
cggccuuggcccgcgc

SEQ ID NO: 2994090 - RNA, 17 nt, Mycobacterium avium subsp. paratuberculosis
cggccuuggcccgcgcc

SEQ ID NO: 2994091 - RNA, 19 nt, Mycobacterium avium subsp. paratuberculosis
cggccuuggcccgcgcccg

SEQ ID NO: 2994092 - RNA, 16 nt, Mycobacterium avium subsp. paratuberculosis
cggccuuuuccggcga

SEQ ID NO: 2994093 - RNA, 17 nt, Mycobacterium avium subsp. paratuberculosis
cggccuuuuccggcgac

SEQ ID NO: 2994094 - RNA, 20 nt, Mycobacterium avium subsp. paratuberculosis
cggccuuuuccggcgacacc

SEQ ID NO: 2994095 - RNA, 16 nt, Mycobacterium avium subsp. paratuberculosis
cggcgaaaacgccugc

SEQ ID NO: 2994096 - RNA, 19 nt, Mycobacterium avium subsp. paratuberculosis
cggcgaaaacgccugcgcc

SEQ ID NO: 2994097 - RNA, 22 nt, Mycobacterium avium subsp. paratuberculosis
cggcgaaaacgccugcgccgcc

SEQ ID NO: 2994098 - RNA, 23 nt, Mycobacterium avium subsp. paratuberculosis
cggcgaaaacgccugcgccgccg

SEQ ID NO: 2994099 - RNA, 19 nt, Mycobacterium avium subsp. paratuberculosis
cggcgaaacacagcagcac

SEQ ID NO: 2994100 - RNA, 21 nt, Mycobacterium avium subsp. paratuberculosis
cggcgaaacaccaagcaccag

SEQ ID NO: 2994101 - RNA, 23 nt, Mycobacterium avium subsp. paratuberculosis
cggcgaaauaaccguucaccucu

SEQ ID NO: 2994102 - RNA, 14 nt, Mycobacterium avium subsp. paratuberculosis
cggcgaacaacgcc

SEQ ID NO: 2994103 - RNA, 17 nt, Mycobacterium avium subsp. paratuberculosis
cggcgaacaccacgguc

SEQ ID NO: 2994104 - RNA, 20 nt, Mycobacterium avium subsp. paratuberculosis
cggcgaacaccacggucccc

SEQ ID NO: 2994105 - RNA, 22 nt, Mycobacterium avium subsp. paratuberculosis
cggcgaacaccacgguccccgc

SEQ ID NO: 2994106 - RNA, 15 nt, Mycobacterium avium subsp. paratuberculosis
cggcgaacaccagca

SEQ ID NO: 2994107 - RNA, 21 nt, Mycobacterium avium subsp. paratuberculosis
cggcgaacaccucggcgaugc

SEQ ID NO: 2994108 - RNA, 19 nt, Mycobacterium avium subsp. paratuberculosis
cggcgaacaccucgggauc

SEQ ID NO: 2994109 - RNA, 16 nt, Mycobacterium avium subsp. paratuberculosis
cggcgaacagugcacu

SEQ ID NO: 2994110 - RNA, 19 nt, Mycobacterium avium subsp. paratuberculosis
cggcgaaccagcaugcgcc

SEQ ID NO: 2994111 - RNA, 22 nt, Mycobacterium avium subsp. paratuberculosis
cggcgaaccagcaugcgccaga

SEQ ID NO: 2994112 - RNA, 21 nt, Mycobacterium avium subsp. paratuberculosis
cggcgaaccagggcagccagc

SEQ ID NO: 2994113 - RNA, 20 nt, Mycobacterium avium subsp. paratuberculosis
cggcgaacccugaccgugcu

SEQ ID NO: 2994114 - RNA, 13 nt, Mycobacterium avium subsp. paratuberculosis
cggcgaaccgccg

SEQ ID NO: 2994115 - RNA, 17 nt, Mycobacterium avium subsp. paratuberculosis
cggcgaaccgccgcacc

SEQ ID NO: 2994116 - RNA, 18 nt, Mycobacterium avium subsp. paratuberculosis
cggcgaaccgccgcaccc

SEQ ID NO: 2994117 - RNA, 20 nt, Mycobacterium avium subsp. paratuberculosis
cggcgaaccgccgcacccag

SEQ ID NO: 2994118 - RNA, 14 nt, Mycobacterium avium subsp. paratuberculosis
cggcgaaccgggac

SEQ ID NO: 2994119 - RNA, 22 nt, Mycobacterium avium subsp. paratuberculosis
cggcgaaccgggacagccgcgc

SEQ ID NO: 2994120 - RNA, 17 nt, Mycobacterium avium subsp. paratuberculosis
cggcgaaccgggcccgu

SEQ ID NO: 2994121 - RNA, 20 nt, Mycobacterium avium subsp. paratuberculosis
cggcgaaccguucgucgucg

SEQ ID NO: 2994122 - RNA, 14 nt, Mycobacterium avium subsp. paratuberculosis
cggcgaacgcccgg

SEQ ID NO: 2994123 - RNA, 15 nt, Mycobacterium avium subsp. paratuberculosis
cggcgaacgcccggu

SEQ ID NO: 2994124 - RNA, 16 nt, Mycobacterium avium subsp. paratuberculosis
cggcgaacgcccgguc

SEQ ID NO: 2994125 - RNA, 18 nt, Mycobacterium avium subsp. paratuberculosis
cggcgaacgcccggucga

SEQ ID NO: 2994126 - RNA, 22 nt, Mycobacterium avium subsp. paratuberculosis
cggcgaacgccucgguggucga

SEQ ID NO: 2994127 - RNA, 16 nt, Mycobacterium avium subsp. paratuberculosis
cggcgaacgcgcgguc

SEQ ID NO: 2994128 - RNA, 17 nt, Mycobacterium avium subsp. paratuberculosis
cggcgaacgcgcggucg

SEQ ID NO: 2994129 - RNA, 22 nt, Mycobacterium avium subsp. paratuberculosis
cggcgaacgcgcggucgucgcc

SEQ ID NO: 2994130 - RNA, 23 nt, Mycobacterium avium subsp. paratuberculosis
cggcgaacgcgcggucgucgccc

SEQ ID NO: 2994131 - RNA, 13 nt, Mycobacterium avium subsp. paratuberculosis
cggcgaacgcguc

SEQ ID NO: 2994132 - RNA, 16 nt, Mycobacterium avium subsp. paratuberculosis
cggcgaacggccaguc

SEQ ID NO: 2994133 - RNA, 14 nt, Mycobacterium avium subsp. paratuberculosis
cggcgaacgguucg

SEQ ID NO: 2994134 - RNA, 19 nt, Mycobacterium avium subsp. paratuberculosis
cggcgaacgguucgggaac

SEQ ID NO: 2994135 - RNA, 15 nt, Mycobacterium avium subsp. paratuberculosis
cggcgaacgucgaug

SEQ ID NO: 2994136 - RNA, 14 nt, Mycobacterium avium subsp. paratuberculosis
cggcgaacuccacc

SEQ ID NO: 2994137 - RNA, 15 nt, Mycobacterium avium subsp. paratuberculosis
cggcgaacuccaccc

SEQ ID NO: 2994138 - RNA, 21 nt, Mycobacterium avium subsp. paratuberculosis
cggcgaacuccagaucgccgc

SEQ ID NO: 2994139 - RNA, 22 nt, Mycobacterium avium subsp. paratuberculosis
cggcgaacuccagaucgccgcc

SEQ ID NO: 2994140 - RNA, 14 nt, Mycobacterium avium subsp. paratuberculosis
cggcgaacucgcgg

SEQ ID NO: 2994141 - RNA, 16 nt, Mycobacterium avium subsp. paratuberculosis
cggcgaacucgcggcg

SEQ ID NO: 2994142 - RNA, 17 nt, Mycobacterium avium subsp. paratuberculosis
cggcgaacucgcggcgg

SEQ ID NO: 2994143 - RNA, 20 nt, Mycobacterium avium subsp. paratuberculosis
cggcgaacucgcggcggguc

SEQ ID NO: 2994144 - RNA, 17 nt, Mycobacterium avium subsp. paratuberculosis
cggcgaacuuggccgac

SEQ ID NO: 2994145 - RNA, 18 nt, Mycobacterium avium subsp. paratuberculosis
cggcgaacuuggccgaca

SEQ ID NO: 2994146 - RNA, 19 nt, Mycobacterium avium subsp. paratuberculosis
cggcgaacuuggccgacac

SEQ ID NO: 2994147 - RNA, 15 nt, Mycobacterium avium subsp. paratuberculosis
cggcgaagacgucgg

SEQ ID NO: 2994148 - RNA, 18 nt, Mycobacterium avium subsp. paratuberculosis
cggcgaagacgucggcgc

SEQ ID NO: 2994149 - RNA, 20 nt, Mycobacterium avium subsp. paratuberculosis
cggcgaagacgucggcgcgg

SEQ ID NO: 2994150 - RNA, 23 nt, Mycobacterium avium subsp. paratuberculosis
cggcgaagacgucggcgcggucg

SEQ ID NO: 2994151 - RNA, 13 nt, Mycobacterium avium subsp. paratuberculosis
cggcgaagcaggc

SEQ ID NO: 2994152 - RNA, 15 nt, Mycobacterium avium subsp. paratuberculosis
cggcgaagcaggcca

SEQ ID NO: 2994153 - RNA, 20 nt, Mycobacterium avium subsp. paratuberculosis
cggcgaagcaggccaggugc

SEQ ID NO: 2994154 - RNA, 16 nt, Mycobacterium avium subsp. paratuberculosis
cggcgaagccggcccc

SEQ ID NO: 2994155 - RNA, 18 nt, Mycobacterium avium subsp. paratuberculosis
cggcgaagccggccccgc

SEQ ID NO: 2994156 - RNA, 19 nt, Mycobacterium avium subsp. paratuberculosis
cggcgaagccggccccgcc

SEQ ID NO: 2994157 - RNA, 22 nt, Mycobacterium avium subsp. paratuberculosis
cggcgaagccggccccgcccgg

SEQ ID NO: 2994158 - RNA, 16 nt, Mycobacterium avium subsp. paratuberculosis
cggcgaagccggcguc

SEQ ID NO: 2994159 - RNA, 17 nt, Mycobacterium avium subsp. paratuberculosis
cggcgaagccggcguca

SEQ ID NO: 2994160 - RNA, 17 nt, Mycobacterium avium subsp. paratuberculosis
cggcgaagcuaaacccc

SEQ ID NO: 2994161 - RNA, 19 nt, Mycobacterium avium subsp. paratuberculosis
cggcgaagcuaaaccccac

SEQ ID NO: 2994162 - RNA, 15 nt, Mycobacterium avium subsp. paratuberculosis
cggcgaagcucgacg

SEQ ID NO: 2994163 - RNA, 16 nt, Mycobacterium avium subsp. paratuberculosis
cggcgaagcucgacga

SEQ ID NO: 2994164 - RNA, 20 nt, Mycobacterium avium subsp. paratuberculosis
cggcgaaggagaaccgcugc

SEQ ID NO: 2994165 - RNA, 16 nt, Mycobacterium avium subsp. paratuberculosis
cggcgaaggccagcga

SEQ ID NO: 2994166 - RNA, 21 nt, Mycobacterium avium subsp. paratuberculosis
cggcgaaggcgcgcagggcga

SEQ ID NO: 2994167 - RNA, 17 nt, Mycobacterium avium subsp. paratuberculosis
cggcgaaggugccccgc

SEQ ID NO: 2994168 - RNA, 20 nt, Mycobacterium avium subsp. paratuberculosis
cggcgaagguguccucgagc

SEQ ID NO: 2994169 - RNA, 21 nt, Mycobacterium avium subsp. paratuberculosis
cggcgaagucaucaccgggga

SEQ ID NO: 2994170 - RNA, 20 nt, Mycobacterium avium subsp. paratuberculosis
cggcgaaguugcgguugacg

SEQ ID NO: 2994171 - RNA, 21 nt, Mycobacterium avium subsp. paratuberculosis
cggcgaauaccagggcgagga

SEQ ID NO: 2994172 - RNA, 21 nt, Mycobacterium avium subsp. paratuberculosis
cggcgaauauuucgccgaucu

SEQ ID NO: 2994173 - RNA, 22 nt, Mycobacterium avium subsp. paratuberculosis
cggcgaauauuucgccgaucug

SEQ ID NO: 2994174 - RNA, 17 nt, Mycobacterium avium subsp. paratuberculosis
cggcgaauauuucgugu

SEQ ID NO: 2994175 - RNA, 21 nt, Mycobacterium avium subsp. paratuberculosis
cggcgaauccacacaggacca

SEQ ID NO: 2994176 - RNA, 17 nt, Mycobacterium avium subsp. paratuberculosis
cggcgaauccgaccggc

SEQ ID NO: 2994177 - RNA, 18 nt, Mycobacterium avium subsp. paratuberculosis
cggcgaauccgaccggcu

SEQ ID NO: 2994178 - RNA, 22 nt, Mycobacterium avium subsp. paratuberculosis
cggcgaauccgaccggcucagc

SEQ ID NO: 2994179 - RNA, 20 nt, Mycobacterium avium subsp. paratuberculosis
cggcgaauccgaguuggccg

SEQ ID NO: 2994180 - RNA, 22 nt, Mycobacterium avium subsp. paratuberculosis
cggcgaauccgaguuggccggc

SEQ ID NO: 2994181 - RNA, 23 nt, Mycobacterium avium subsp. paratuberculosis
cggcgaauccgaguuggccggca

SEQ ID NO: 2994182 - RNA, 15 nt, Mycobacterium avium subsp. paratuberculosis
cggcgaaucgguccg

SEQ ID NO: 2994183 - RNA, 19 nt, Mycobacterium avium subsp. paratuberculosis
cggcgaaucgguccggcga

SEQ ID NO: 2994184 - RNA, 16 nt, Mycobacterium avium subsp. paratuberculosis
cggcgaaugccugacg

SEQ ID NO: 2994185 - RNA, 15 nt, Mycobacterium avium subsp. paratuberculosis
cggcgacaacagcgc

SEQ ID NO: 2994186 - RNA, 16 nt, Mycobacterium avium subsp. paratuberculosis
cggcgacaacagcgcc

SEQ ID NO: 2994187 - RNA, 21 nt, Mycobacterium avium subsp. paratuberculosis
cggcgacaacagcgccgagac

SEQ ID NO: 2994188 - RNA, 12 nt, Mycobacterium avium subsp. paratuberculosis
cggcgacaccca

SEQ ID NO: 2994189 - RNA, 13 nt, Mycobacterium avium subsp. paratuberculosis
cggcgacacccag

SEQ ID NO: 2994190 - RNA, 20 nt, Mycobacterium avium subsp. paratuberculosis
cggcgacacccagcggcgcg

SEQ ID NO: 2994191 - RNA, 14 nt, Mycobacterium avium subsp. paratuberculosis
cggcgacaccgcau

SEQ ID NO: 2994192 - RNA, 15 nt, Mycobacterium avium subsp. paratuberculosis
cggcgacacgccgac

SEQ ID NO: 2994193 - RNA, 18 nt, Mycobacterium avium subsp. paratuberculosis
cggcgacacgccgacgau

SEQ ID NO: 2994194 - RNA, 21 nt, Mycobacterium avium subsp. paratuberculosis
cggcgacacgccgacgauccg

SEQ ID NO: 2994195 - RNA, 18 nt, Mycobacterium avium subsp. paratuberculosis
cggcgacacguccagcuc

SEQ ID NO: 2994196 - RNA, 16 nt, Mycobacterium avium subsp. paratuberculosis
cggcgacaucgccgag

SEQ ID NO: 2994197 - RNA, 15 nt, Mycobacterium avium subsp. paratuberculosis
cggcgacauuggccg

SEQ ID NO: 2994198 - RNA, 18 nt, Mycobacterium avium subsp. paratuberculosis
cggcgacauuggccgcgc

SEQ ID NO: 2994199 - RNA, 22 nt, Mycobacterium avium subsp. paratuberculosis
cggcgacauuggccgcgcgcag

SEQ ID NO: 2994200 - RNA, 23 nt, Mycobacterium avium subsp. paratuberculosis
cggcgacauuggccgcgcgcagg

SEQ ID NO: 2994201 - RNA, 22 nt, Mycobacterium avium subsp. paratuberculosis
cggcgaccaaugcccugacccc

SEQ ID NO: 2994202 - RNA, 21 nt, Mycobacterium avium subsp. paratuberculosis
cggcgaccacaccgucgacga

SEQ ID NO: 2994203 - RNA, 23 nt, Mycobacterium avium subsp. paratuberculosis
cggcgaccacaccgucgacgacg

SEQ ID NO: 2994204 - RNA, 13 nt, Mycobacterium avium subsp. paratuberculosis
cggcgaccaccac

SEQ ID NO: 2994205 - RNA, 14 nt, Mycobacterium avium subsp. paratuberculosis
cggcgaccaccacc

SEQ ID NO: 2994206 - RNA, 15 nt, Mycobacterium avium subsp. paratuberculosis
cggcgaccaccaccg

SEQ ID NO: 2994207 - RNA, 16 nt, Mycobacterium avium subsp. paratuberculosis
cggcgaccaccaccgc

SEQ ID NO: 2994208 - RNA, 21 nt, Mycobacterium avium subsp. paratuberculosis
cggcgaccaccaccgcccaca

SEQ ID NO: 2994209 - RNA, 14 nt, Mycobacterium avium subsp. paratuberculosis
cggcgaccacccuc

SEQ ID NO: 2994210 - RNA, 17 nt, Mycobacterium avium subsp. paratuberculosis
cggcgaccacccucacc

SEQ ID NO: 2994211 - RNA, 21 nt, Mycobacterium avium subsp. paratuberculosis
cggcgaccacccucaccacga

SEQ ID NO: 2994212 - RNA, 22 nt, Mycobacterium avium subsp. paratuberculosis
cggcgaccacccucaccacgau

SEQ ID NO: 2994213 - RNA, 12 nt, Mycobacterium avium subsp. paratuberculosis
cggcgaccaccu

SEQ ID NO: 2994214 - RNA, 14 nt, Mycobacterium avium subsp. paratuberculosis
cggcgaccaccucg

SEQ ID NO: 2994215 - RNA, 16 nt, Mycobacterium avium subsp. paratuberculosis
cggcgaccaccucggc

SEQ ID NO: 2994216 - RNA, 19 nt, Mycobacterium avium subsp. paratuberculosis
cggcgaccaccucggcgac

SEQ ID NO: 2994217 - RNA, 23 nt, Mycobacterium avium subsp. paratuberculosis
cggcgaccaccucggcgacgaug

SEQ ID NO: 2994218 - RNA, 21 nt, Mycobacterium avium subsp. paratuberculosis
cggcgaccacgaacaccggcg

SEQ ID NO: 2994219 - RNA, 22 nt, Mycobacterium avium subsp. paratuberculosis
cggcgaccacgaacaccggcgc

SEQ ID NO: 2994220 - RNA, 23 nt, Mycobacterium avium subsp. paratuberculosis
cggcgaccacgaacaccggcgcg

SEQ ID NO: 2994221 - RNA, 24 nt, Mycobacterium avium subsp. paratuberculosis
cggcgaccacgaacaccggcgcga

SEQ ID NO: 2994222 - RNA, 13 nt, Mycobacterium avium subsp. paratuberculosis
cggcgaccagcag

SEQ ID NO: 2994223 - RNA, 14 nt, Mycobacterium avium subsp. paratuberculosis
cggcgaccagcagg

SEQ ID NO: 2994224 - RNA, 12 nt, Mycobacterium avium subsp. paratuberculosis
cggcgaccagcc

SEQ ID NO: 2994225 - RNA, 14 nt, Mycobacterium avium subsp. paratuberculosis
cggcgaccagcccc

SEQ ID NO: 2994226 - RNA, 16 nt, Mycobacterium avium subsp. paratuberculosis
cggcgaccagccccuc

SEQ ID NO: 2994227 - RNA, 21 nt, Mycobacterium avium subsp. paratuberculosis
cggcgaccagccccucgacca

SEQ ID NO: 2994228 - RNA, 24 nt, Mycobacterium avium subsp. paratuberculosis
cggcgaccagcgacggcaggucgg

SEQ ID NO: 2994229 - RNA, 17 nt, Mycobacterium avium subsp. paratuberculosis
cggcgaccccguucgcc

SEQ ID NO: 2994230 - RNA, 20 nt, Mycobacterium avium subsp. paratuberculosis
cggcgaccccguucgccgac

SEQ ID NO: 2994231 - RNA, 21 nt, Mycobacterium avium subsp. paratuberculosis
cggcgaccccguucgccgaca

SEQ ID NO: 2994232 - RNA, 23 nt, Mycobacterium avium subsp. paratuberculosis
cggcgaccccguucgccgacagc

SEQ ID NO: 2994233 - RNA, 19 nt, Mycobacterium avium subsp. paratuberculosis
cggcgacccgcacgaugcc

SEQ ID NO: 2994234 - RNA, 21 nt, Mycobacterium avium subsp. paratuberculosis
cggcgacccgcacgaugccgc

SEQ ID NO: 2994235 - RNA, 19 nt, Mycobacterium avium subsp. paratuberculosis
cggcgacccgcuucgcccg

SEQ ID NO: 2994236 - RNA, 21 nt, Mycobacterium avium subsp. paratuberculosis
cggcgacccgcuucgcccggc

SEQ ID NO: 2994237 - RNA, 22 nt, Mycobacterium avium subsp. paratuberculosis
cggcgacccgcuucgcccggcu

SEQ ID NO: 2994238 - RNA, 17 nt, Mycobacterium avium subsp. paratuberculosis
cggcgacccgcuuggug

SEQ ID NO: 2994239 - RNA, 13 nt, Mycobacterium avium subsp. paratuberculosis
cggcgaccgccac

SEQ ID NO: 2994240 - RNA, 14 nt, Mycobacterium avium subsp. paratuberculosis
cggcgaccgcccgg

SEQ ID NO: 2994241 - RNA, 17 nt, Mycobacterium avium subsp. paratuberculosis
cggcgaccgcccggggc

SEQ ID NO: 2994242 - RNA, 18 nt, Mycobacterium avium subsp. paratuberculosis
cggcgaccgcccggggcg

SEQ ID NO: 2994243 - RNA, 20 nt, Mycobacterium avium subsp. paratuberculosis
cggcgaccgcccggggcgcg

SEQ ID NO: 2994244 - RNA, 23 nt, Mycobacterium avium subsp. paratuberculosis
cggcgaccgcccggggcgcggac

SEQ ID NO: 2994245 - RNA, 13 nt, Mycobacterium avium subsp. paratuberculosis
cggcgaccgccgg

SEQ ID NO: 2994246 - RNA, 15 nt, Mycobacterium avium subsp. paratuberculosis
cggcgaccgccggug

SEQ ID NO: 2994247 - RNA, 21 nt, Mycobacterium avium subsp. paratuberculosis
cggcgaccgccuugucggcga

SEQ ID NO: 2994248 - RNA, 13 nt, Mycobacterium avium subsp. paratuberculosis
cggcgaccgcgac

SEQ ID NO: 2994249 - RNA, 14 nt, Mycobacterium avium subsp. paratuberculosis
cggcgaccgcgacg

SEQ ID NO: 2994250 - RNA, 17 nt, Mycobacterium avium subsp. paratuberculosis
cggcgaccgcgcgcggc

SEQ ID NO: 2994251 - RNA, 22 nt, Mycobacterium avium subsp. paratuberculosis
cggcgaccgcgcgcggcgccgc

SEQ ID NO: 2994252 - RNA, 14 nt, Mycobacterium avium subsp. paratuberculosis
cggcgaccgugccc

SEQ ID NO: 2994253 - RNA, 16 nt, Mycobacterium avium subsp. paratuberculosis
cggcgaccgugcccac

SEQ ID NO: 2994254 - RNA, 17 nt, Mycobacterium avium subsp. paratuberculosis
cggcgaccgugcccacc

SEQ ID NO: 2994255 - RNA, 18 nt, Mycobacterium avium subsp. paratuberculosis
cggcgaccgugcccacca

SEQ ID NO: 2994256 - RNA, 18 nt, Mycobacterium avium subsp. paratuberculosis
cggcgaccucuaacgucu

SEQ ID NO: 2994257 - RNA, 17 nt, Mycobacterium avium subsp. paratuberculosis
cggcgaccugcggcucg

SEQ ID NO: 2994258 - RNA, 21 nt, Mycobacterium avium subsp. paratuberculosis
cggcgaccugcggcucgucgg

SEQ ID NO: 2994259 - RNA, 23 nt, Mycobacterium avium subsp. paratuberculosis
cggcgaccuguuuggccagccag

SEQ ID NO: 2994260 - RNA, 18 nt, Mycobacterium avium subsp. paratuberculosis
cggcgaccuugcggcgcg

SEQ ID NO: 2994261 - RNA, 19 nt, Mycobacterium avium subsp. paratuberculosis
cggcgaccuugcggcgcga

SEQ ID NO: 2994262 - RNA, 19 nt, Mycobacterium avium subsp. paratuberculosis
cggcgacgaaauugggcug

SEQ ID NO: 2994263 - RNA, 22 nt, Mycobacterium avium subsp. paratuberculosis
cggcgacgaaauugggcugggu

SEQ ID NO: 2994264 - RNA, 23 nt, Mycobacterium avium subsp. paratuberculosis
cggcgacgaaauugggcuggguc

SEQ ID NO: 2994265 - RNA, 14 nt, Mycobacterium avium subsp. paratuberculosis
cggcgacgaacgcc

SEQ ID NO: 2994266 - RNA, 20 nt, Mycobacterium avium subsp. paratuberculosis
cggcgacgaacgccggcauc

SEQ ID NO: 2994267 - RNA, 21 nt, Mycobacterium avium subsp. paratuberculosis
cggcgacgaacgccggcauca

SEQ ID NO: 2994268 - RNA, 23 nt, Mycobacterium avium subsp. paratuberculosis
cggcgacgaacgccggcaucagc

SEQ ID NO: 2994269 - RNA, 12 nt, Mycobacterium avium subsp. paratuberculosis
cggcgacgaagc

SEQ ID NO: 2994270 - RNA, 13 nt, Mycobacterium avium subsp. paratuberculosis
cggcgacgaagca

SEQ ID NO: 2994271 - RNA, 13 nt, Mycobacterium avium subsp. paratuberculosis
cggcgacgaccac

SEQ ID NO: 2994272 - RNA, 15 nt, Mycobacterium avium subsp. paratuberculosis
cggcgacgaccacca

SEQ ID NO: 2994273 - RNA, 18 nt, Mycobacterium avium subsp. paratuberculosis
cggcgacgaccaccagga

SEQ ID NO: 2994274 - RNA, 12 nt, Mycobacterium avium subsp. paratuberculosis
cggcgacgaccg

SEQ ID NO: 2994275 - RNA, 16 nt, Mycobacterium avium subsp. paratuberculosis
cggcgacgaccgcacc

SEQ ID NO: 2994276 - RNA, 18 nt, Mycobacterium avium subsp. paratuberculosis
cggcgacgaccgcaccga

SEQ ID NO: 2994277 - RNA, 21 nt, Mycobacterium avium subsp. paratuberculosis
cggcgacgaccgcaccgacca

SEQ ID NO: 2994278 - RNA, 23 nt, Mycobacterium avium subsp. paratuberculosis
cggcgacgaccgcaccgaccagc

SEQ ID NO: 2994279 - RNA, 14 nt, Mycobacterium avium subsp. paratuberculosis
cggcgacgaccguc

SEQ ID NO: 2994280 - RNA, 13 nt, Mycobacterium avium subsp. paratuberculosis
cggcgacgaccuu

SEQ ID NO: 2994281 - RNA, 14 nt, Mycobacterium avium subsp. paratuberculosis
cggcgacgaucggc

SEQ ID NO: 2994282 - RNA, 20 nt, Mycobacterium avium subsp. paratuberculosis
cggcgacgaugaagacccgc

SEQ ID NO: 2994283 - RNA, 23 nt, Mycobacterium avium subsp. paratuberculosis
cggcgacgaugaagacccgccgg

SEQ ID NO: 2994284 - RNA, 17 nt, Mycobacterium avium subsp. paratuberculosis
cggcgacgaugcggccg

SEQ ID NO: 2994285 - RNA, 19 nt, Mycobacterium avium subsp. paratuberculosis
cggcgacgaugcggccguu

SEQ ID NO: 2994286 - RNA, 12 nt, Mycobacterium avium subsp. paratuberculosis
cggcgacgccgc

SEQ ID NO: 2994287 - RNA, 16 nt, Mycobacterium avium subsp. paratuberculosis
cggcgacgccgccguc

SEQ ID NO: 2994288 - RNA, 18 nt, Mycobacterium avium subsp. paratuberculosis
cggcgacgccgccgucgu

SEQ ID NO: 2994289 - RNA, 14 nt, Mycobacterium avium subsp. paratuberculosis
cggcgacgccggcg

SEQ ID NO: 2994290 - RNA, 19 nt, Mycobacterium avium subsp. paratuberculosis
cggcgacgccggcgaggcg

SEQ ID NO: 2994291 - RNA, 12 nt, Mycobacterium avium subsp. paratuberculosis
cggcgacgccgu

SEQ ID NO: 2994292 - RNA, 14 nt, Mycobacterium avium subsp. paratuberculosis
cggcgacgccgucg

SEQ ID NO: 2994293 - RNA, 16 nt, Mycobacterium avium subsp. paratuberculosis
cggcgacgccgucggg

SEQ ID NO: 2994294 - RNA, 13 nt, Mycobacterium avium subsp. paratuberculosis
cggcgacgcggcg

SEQ ID NO: 2994295 - RNA, 14 nt, Mycobacterium avium subsp. paratuberculosis
cggcgacgcggcgg

SEQ ID NO: 2994296 - RNA, 13 nt, Mycobacterium avium subsp. paratuberculosis
cggcgacgcuggu

SEQ ID NO: 2994297 - RNA, 20 nt, Mycobacterium avium subsp. paratuberculosis
cggcgacgcugguggccugc

SEQ ID NO: 2994298 - RNA, 21 nt, Mycobacterium avium subsp. paratuberculosis
cggcgacgcugguggccugca

SEQ ID NO: 2994299 - RNA, 14 nt, Mycobacterium avium subsp. paratuberculosis
cggcgacgcugugc

SEQ ID NO: 2994300 - RNA, 13 nt, Mycobacterium avium subsp. paratuberculosis
cggcgacggcacc

SEQ ID NO: 2994301 - RNA, 14 nt, Mycobacterium avium subsp. paratuberculosis
cggcgacggcaccg

SEQ ID NO: 2994302 - RNA, 15 nt, Mycobacterium avium subsp. paratuberculosis
cggcgacggcaccgc

SEQ ID NO: 2994303 - RNA, 17 nt, Mycobacterium avium subsp. paratuberculosis
cggcgacggcagcgcga

SEQ ID NO: 2994304 - RNA, 23 nt, Mycobacterium avium subsp. paratuberculosis
cggcgacggcagcgcgauccggg

SEQ ID NO: 2994305 - RNA, 12 nt, Mycobacterium avium subsp. paratuberculosis
cggcgacggcca

SEQ ID NO: 2994306 - RNA, 14 nt, Mycobacterium avium subsp. paratuberculosis
cggcgacggccaga

SEQ ID NO: 2994307 - RNA, 14 nt, Mycobacterium avium subsp. paratuberculosis
cggcgacggccagc

SEQ ID NO: 2994308 - RNA, 15 nt, Mycobacterium avium subsp. paratuberculosis
cggcgacggccagcg

SEQ ID NO: 2994309 - RNA, 18 nt, Mycobacterium avium subsp. paratuberculosis
cggcgacggccagcgcgg

SEQ ID NO: 2994310 - RNA, 21 nt, Mycobacterium avium subsp. paratuberculosis
cggcgacggccagcgcggcgg

SEQ ID NO: 2994311 - RNA, 14 nt, Mycobacterium avium subsp. paratuberculosis
cggcgacggccguc

SEQ ID NO: 2994312 - RNA, 16 nt, Mycobacterium avium subsp. paratuberculosis
cggcgacggccguccg

SEQ ID NO: 2994313 - RNA, 20 nt, Mycobacterium avium subsp. paratuberculosis
cggcgacggccguccggucg

SEQ ID NO: 2994314 - RNA, 14 nt, Mycobacterium avium subsp. paratuberculosis
cggcgacggcgacc

SEQ ID NO: 2994315 - RNA, 15 nt, Mycobacterium avium subsp. paratuberculosis
cggcgacggcgacca

SEQ ID NO: 2994316 - RNA, 18 nt, Mycobacterium avium subsp. paratuberculosis
cggcgacggcgaccacac

SEQ ID NO: 2994317 - RNA, 15 nt, Mycobacterium avium subsp. paratuberculosis
cggcgacggcgacgg

SEQ ID NO: 2994318 - RNA, 20 nt, Mycobacterium avium subsp. paratuberculosis
cggcgacggcgacggcgucc

SEQ ID NO: 2994319 - RNA, 15 nt, Mycobacterium avium subsp. paratuberculosis
cggcgacggcgccug

SEQ ID NO: 2994320 - RNA, 13 nt, Mycobacterium avium subsp. paratuberculosis
cggcgacggcgcu

SEQ ID NO: 2994321 - RNA, 15 nt, Mycobacterium avium subsp. paratuberculosis
cggcgacggcggccg

SEQ ID NO: 2994322 - RNA, 17 nt, Mycobacterium avium subsp. paratuberculosis
cggcgacggcggccguc

SEQ ID NO: 2994323 - RNA, 15 nt, Mycobacterium avium subsp. paratuberculosis
cggcgacggcggggu

SEQ ID NO: 2994324 - RNA, 22 nt, Mycobacterium avium subsp. paratuberculosis
cggcgacggcggggugcgcggc

SEQ ID NO: 2994325 - RNA, 14 nt, Mycobacterium avium subsp. paratuberculosis
cggcgacggcggug

SEQ ID NO: 2994326 - RNA, 17 nt, Mycobacterium avium subsp. paratuberculosis
cggcgacggcgguucga

SEQ ID NO: 2994327 - RNA, 15 nt, Mycobacterium avium subsp. paratuberculosis
cggcgacggcgucca

SEQ ID NO: 2994328 - RNA, 16 nt, Mycobacterium avium subsp. paratuberculosis
cggcgacggcguccgg

SEQ ID NO: 2994329 - RNA, 18 nt, Mycobacterium avium subsp. paratuberculosis
cggcgacggcguccgggc

SEQ ID NO: 2994330 - RNA, 19 nt, Mycobacterium avium subsp. paratuberculosis
cggcgacggcguccgggcg

SEQ ID NO: 2994331 - RNA, 15 nt, Mycobacterium avium subsp. paratuberculosis
cggcgacggcgucgg

SEQ ID NO: 2994332 - RNA, 16 nt, Mycobacterium avium subsp. paratuberculosis
cggcgacggcgucggc

SEQ ID NO: 2994333 - RNA, 22 nt, Mycobacterium avium subsp. paratuberculosis
cggcgacggcguugcuggcgcg

SEQ ID NO: 2994334 - RNA, 12 nt, Mycobacterium avium subsp. paratuberculosis
cggcgacggugg

SEQ ID NO: 2994335 - RNA, 18 nt, Mycobacterium avium subsp. paratuberculosis
cggcgacgguggcgccca

SEQ ID NO: 2994336 - RNA, 23 nt, Mycobacterium avium subsp. paratuberculosis
cggcgacgguggcgcccagcgag

SEQ ID NO: 2994337 - RNA, 16 nt, Mycobacterium avium subsp. paratuberculosis
cggcgacgguggcggg

SEQ ID NO: 2994338 - RNA, 22 nt, Mycobacterium avium subsp. paratuberculosis
cggcgacgguggcgggccgccg

SEQ ID NO: 2994339 - RNA, 23 nt, Mycobacterium avium subsp. paratuberculosis
cggcgacgguggcgggccgccgg

SEQ ID NO: 2994340 - RNA, 17 nt, Mycobacterium avium subsp. paratuberculosis
cggcgacgguguccgcg

SEQ ID NO: 2994341 - RNA, 18 nt, Mycobacterium avium subsp. paratuberculosis
cggcgacgguguccgcgg

SEQ ID NO: 2994342 - RNA, 17 nt, Mycobacterium avium subsp. paratuberculosis
cggcgacguacagcgag

SEQ ID NO: 2994343 - RNA, 20 nt, Mycobacterium avium subsp. paratuberculosis
cggcgacguccuugaucagc

SEQ ID NO: 2994344 - RNA, 14 nt, Mycobacterium avium subsp. paratuberculosis
cggcgacgucgacg

SEQ ID NO: 2994345 - RNA, 16 nt, Mycobacterium avium subsp. paratuberculosis
cggcgacgucgacggc

SEQ ID NO: 2994346 - RNA, 19 nt, Mycobacterium avium subsp. paratuberculosis
cggcgacgucgacggcagc

SEQ ID NO: 2994347 - RNA, 23 nt, Mycobacterium avium subsp. paratuberculosis
cggcgacgucgacggcagcgcua

SEQ ID NO: 2994348 - RNA, 14 nt, Mycobacterium avium subsp. paratuberculosis
cggcgacgucgccg

SEQ ID NO: 2994349 - RNA, 15 nt, Mycobacterium avium subsp. paratuberculosis
cggcgacgucgccgg

SEQ ID NO: 2994350 - RNA, 16 nt, Mycobacterium avium subsp. paratuberculosis
cggcgacgucgccggc

SEQ ID NO: 2994351 - RNA, 21 nt, Mycobacterium avium subsp. paratuberculosis
cggcgacgucgccggccugcc

SEQ ID NO: 2994352 - RNA, 15 nt, Mycobacterium avium subsp. paratuberculosis
cggcgacgucgucga

SEQ ID NO: 2994353 - RNA, 14 nt, Mycobacterium avium subsp. paratuberculosis
cggcgacgucgugc

SEQ ID NO: 2994354 - RNA, 18 nt, Mycobacterium avium subsp. paratuberculosis
cggcgacgucgugcacgc

SEQ ID NO: 2994355 - RNA, 21 nt, Mycobacterium avium subsp. paratuberculosis
cggcgacgucguggcccggau

SEQ ID NO: 2994356 - RNA, 22 nt, Mycobacterium avium subsp. paratuberculosis
cggcgacgucguggcccggaug

SEQ ID NO: 2994357 - RNA, 12 nt, Mycobacterium avium subsp. paratuberculosis
cggcgacgugau

SEQ ID NO: 2994358 - RNA, 14 nt, Mycobacterium avium subsp. paratuberculosis
cggcgacgugaucg

SEQ ID NO: 2994359 - RNA, 19 nt, Mycobacterium avium subsp. paratuberculosis
cggcgacgugaucggcggc

SEQ ID NO: 2994360 - RNA, 20 nt, Mycobacterium avium subsp. paratuberculosis
cggcgacgugaucggcggcc

SEQ ID NO: 2994361 - RNA, 20 nt, Mycobacterium avium subsp. paratuberculosis
cggcgacgugauggucgucg

SEQ ID NO: 2994362 - RNA, 14 nt, Mycobacterium avium subsp. paratuberculosis
cggcgacgugccgg

SEQ ID NO: 2994363 - RNA, 15 nt, Mycobacterium avium subsp. paratuberculosis
cggcgacgugccggc

SEQ ID NO: 2994364 - RNA, 17 nt, Mycobacterium avium subsp. paratuberculosis
cggcgacgugccggcgg

SEQ ID NO: 2994365 - RNA, 20 nt, Mycobacterium avium subsp. paratuberculosis
cggcgacgugccggcggcag

SEQ ID NO: 2994366 - RNA, 21 nt, Mycobacterium avium subsp. paratuberculosis
cggcgacgugccggcggcagg

SEQ ID NO: 2994367 - RNA, 23 nt, Mycobacterium avium subsp. paratuberculosis
cggcgacgugccggcggcaggug

SEQ ID NO: 2994368 - RNA, 16 nt, Mycobacterium avium subsp. paratuberculosis
cggcgacuccagcagc

SEQ ID NO: 2994369 - RNA, 17 nt, Mycobacterium avium subsp. paratuberculosis
cggcgacuccagcagcg

SEQ ID NO: 2994370 - RNA, 23 nt, Mycobacterium avium subsp. paratuberculosis
cggcgacuccagcagcgccagca

SEQ ID NO: 2994371 - RNA, 20 nt, Mycobacterium avium subsp. paratuberculosis
cggcgagaucuucuccccgc

SEQ ID NO: 2994372 - RNA, 17 nt, Mycobacterium avium subsp. paratuberculosis
cggcgagauuggccucg

SEQ ID NO: 2994373 - RNA, 19 nt, Mycobacterium avium subsp. paratuberculosis
cggcgagauuggccucggc

SEQ ID NO: 2994374 - RNA, 20 nt, Mycobacterium avium subsp. paratuberculosis
cggcgagauuggccucggcg

SEQ ID NO: 2994375 - RNA, 22 nt, Mycobacterium avium subsp. paratuberculosis
cggcgagauuggccucggcgcg

SEQ ID NO: 2994376 - RNA, 17 nt, Mycobacterium avium subsp. paratuberculosis
cggcgagcaaggcgagc

SEQ ID NO: 2994377 - RNA, 20 nt, Mycobacterium avium subsp. paratuberculosis
cggcgagcaaggcgagcacg

SEQ ID NO: 2994378 - RNA, 17 nt, Mycobacterium avium subsp. paratuberculosis
cggcgagcaccgugccg

SEQ ID NO: 2994379 - RNA, 19 nt, Mycobacterium avium subsp. paratuberculosis
cggcgagcaccgugccguc

SEQ ID NO: 2994380 - RNA, 13 nt, Mycobacterium avium subsp. paratuberculosis
cggcgagcacgcc

SEQ ID NO: 2994381 - RNA, 15 nt, Mycobacterium avium subsp. paratuberculosis
cggcgagcacgccgc

SEQ ID NO: 2994382 - RNA, 18 nt, Mycobacterium avium subsp. paratuberculosis
cggcgagcacgccgccgg

SEQ ID NO: 2994383 - RNA, 17 nt, Mycobacterium avium subsp. paratuberculosis
cggcgagcagcagcgcg

SEQ ID NO: 2994384 - RNA, 18 nt, Mycobacterium avium subsp. paratuberculosis
cggcgagcagcagcgcgg

SEQ ID NO: 2994385 - RNA, 23 nt, Mycobacterium avium subsp. paratuberculosis
cggcgagcagcagcgcggugccg

SEQ ID NO: 2994386 - RNA, 12 nt, Mycobacterium avium subsp. paratuberculosis
cggcgagcagcc

SEQ ID NO: 2994387 - RNA, 13 nt, Mycobacterium avium subsp. paratuberculosis
cggcgagcagccc

SEQ ID NO: 2994388 - RNA, 15 nt, Mycobacterium avium subsp. paratuberculosis
cggcgagcagcccgg

SEQ ID NO: 2994389 - RNA, 16 nt, Mycobacterium avium subsp. paratuberculosis
cggcgagcagcccggc

SEQ ID NO: 2994390 - RNA, 20 nt, Mycobacterium avium subsp. paratuberculosis
cggcgagcagcccggcgaac

SEQ ID NO: 2994391 - RNA, 16 nt, Mycobacterium avium subsp. paratuberculosis
cggcgagcagccgcgc

SEQ ID NO: 2994392 - RNA, 18 nt, Mycobacterium avium subsp. paratuberculosis
cggcgagcagccgcgccg

SEQ ID NO: 2994393 - RNA, 21 nt, Mycobacterium avium subsp. paratuberculosis
cggcgagcagccgcgccgggc

SEQ ID NO: 2994394 - RNA, 15 nt, Mycobacterium avium subsp. paratuberculosis
cggcgagcagcgcga

SEQ ID NO: 2994395 - RNA, 17 nt, Mycobacterium avium subsp. paratuberculosis
cggcgagcagcgcgaug

SEQ ID NO: 2994396 - RNA, 20 nt, Mycobacterium avium subsp. paratuberculosis
cggcgagcagcgcgaugccg

SEQ ID NO: 2994397 - RNA, 15 nt, Mycobacterium avium subsp. paratuberculosis
cggcgagcagcugca

SEQ ID NO: 2994398 - RNA, 17 nt, Mycobacterium avium subsp. paratuberculosis
cggcgagcagcugcagc

SEQ ID NO: 2994399 - RNA, 20 nt, Mycobacterium avium subsp. paratuberculosis
cggcgagcagcugcagcguc

SEQ ID NO: 2994400 - RNA, 13 nt, Mycobacterium avium subsp. paratuberculosis
cggcgagccgcuc

SEQ ID NO: 2994401 - RNA, 16 nt, Mycobacterium avium subsp. paratuberculosis
cggcgagccggccgua

SEQ ID NO: 2994402 - RNA, 16 nt, Mycobacterium avium subsp. paratuberculosis
cggcgagccgggaccg

SEQ ID NO: 2994403 - RNA, 14 nt, Mycobacterium avium subsp. paratuberculosis
cggcgagcgacgcc

SEQ ID NO: 2994404 - RNA, 15 nt, Mycobacterium avium subsp. paratuberculosis
cggcgagcgacgcca

SEQ ID NO: 2994405 - RNA, 17 nt, Mycobacterium avium subsp. paratuberculosis
cggcgagcgacgccacg

SEQ ID NO: 2994406 - RNA, 14 nt, Mycobacterium avium subsp. paratuberculosis
cggcgagcgcgcug

SEQ ID NO: 2994407 - RNA, 16 nt, Mycobacterium avium subsp. paratuberculosis
cggcgagcgcgcugau

SEQ ID NO: 2994408 - RNA, 22 nt, Mycobacterium avium subsp. paratuberculosis
cggcgagcgcgcugaucgccgc

SEQ ID NO: 2994409 - RNA, 15 nt, Mycobacterium avium subsp. paratuberculosis
cggcgagcgcgugca

SEQ ID NO: 2994410 - RNA, 19 nt, Mycobacterium avium subsp. paratuberculosis
cggcgagcgcguucuccac

SEQ ID NO: 2994411 - RNA, 17 nt, Mycobacterium avium subsp. paratuberculosis
cggcgagcgcuucggga

SEQ ID NO: 2994412 - RNA, 19 nt, Mycobacterium avium subsp. paratuberculosis
cggcgagcgcuucgggagc

SEQ ID NO: 2994413 - RNA, 20 nt, Mycobacterium avium subsp. paratuberculosis
cggcgagcgcuucgggagca

SEQ ID NO: 2994414 - RNA, 13 nt, Mycobacterium avium subsp. paratuberculosis
cggcgagcggcac

SEQ ID NO: 2994415 - RNA, 15 nt, Mycobacterium avium subsp. paratuberculosis
cggcgagcggcaccu

SEQ ID NO: 2994416 - RNA, 13 nt, Mycobacterium avium subsp. paratuberculosis
cggcgagcggccc

SEQ ID NO: 2994417 - RNA, 16 nt, Mycobacterium avium subsp. paratuberculosis
cggcgagcggcccugc

SEQ ID NO: 2994418 - RNA, 23 nt, Mycobacterium avium subsp. paratuberculosis
cggcgagcggcccugcgcggccu

SEQ ID NO: 2994419 - RNA, 14 nt, Mycobacterium avium subsp. paratuberculosis
cggcgagcgguucg

SEQ ID NO: 2994420 - RNA, 15 nt, Mycobacterium avium subsp. paratuberculosis
cggcgagcucgcggc

SEQ ID NO: 2994421 - RNA, 16 nt, Mycobacterium avium subsp. paratuberculosis
cggcgagcucgcggcc

SEQ ID NO: 2994422 - RNA, 17 nt, Mycobacterium avium subsp. paratuberculosis
cggcgagcucgcggccg

SEQ ID NO: 2994423 - RNA, 17 nt, Mycobacterium avium subsp. paratuberculosis
cggcgagcugaucggcg

SEQ ID NO: 2994424 - RNA, 18 nt, Mycobacterium avium subsp. paratuberculosis
cggcgagcugaucggcgu

SEQ ID NO: 2994425 - RNA, 15 nt, Mycobacterium avium subsp. paratuberculosis
cggcgagcugcgggu

SEQ ID NO: 2994426 - RNA, 16 nt, Mycobacterium avium subsp. paratuberculosis
cggcgagcugcgggug

SEQ ID NO: 2994427 - RNA, 18 nt, Mycobacterium avium subsp. paratuberculosis
cggcgagcugcgggugcu

SEQ ID NO: 2994428 - RNA, 17 nt, Mycobacterium avium subsp. paratuberculosis
cggcgagcuuggcgggc

SEQ ID NO: 2994429 - RNA, 19 nt, Mycobacterium avium subsp. paratuberculosis
cggcgagcuuggcgggcgu

SEQ ID NO: 2994430 - RNA, 21 nt, Mycobacterium avium subsp. paratuberculosis
cggcgaggaacucagcgccca

SEQ ID NO: 2994431 - RNA, 15 nt, Mycobacterium avium subsp. paratuberculosis
cggcgaggacgucgu

SEQ ID NO: 2994432 - RNA, 17 nt, Mycobacterium avium subsp. paratuberculosis
cggcgaggacgucgucg

SEQ ID NO: 2994433 - RNA, 18 nt, Mycobacterium avium subsp. paratuberculosis
cggcgaggacgucgucga

SEQ ID NO: 2994434 - RNA, 22 nt, Mycobacterium avium subsp. paratuberculosis
cggcgaggacgucgucgacguc

SEQ ID NO: 2994435 - RNA, 14 nt, Mycobacterium avium subsp. paratuberculosis
cggcgaggauggcg

SEQ ID NO: 2994436 - RNA, 15 nt, Mycobacterium avium subsp. paratuberculosis
cggcgaggauggcga

SEQ ID NO: 2994437 - RNA, 18 nt, Mycobacterium avium subsp. paratuberculosis
cggcgaggauggcgauca

SEQ ID NO: 2994438 - RNA, 14 nt, Mycobacterium avium subsp. paratuberculosis
cggcgaggccaggc

SEQ ID NO: 2994439 - RNA, 16 nt, Mycobacterium avium subsp. paratuberculosis
cggcgaggccaggcgu

SEQ ID NO: 2994440 - RNA, 23 nt, Mycobacterium avium subsp. paratuberculosis
cggcgaggccaggcguuucgugu

SEQ ID NO: 2994441 - RNA, 15 nt, Mycobacterium avium subsp. paratuberculosis
cggcgaggcggucgg

SEQ ID NO: 2994442 - RNA, 18 nt, Mycobacterium avium subsp. paratuberculosis
cggcgaggcggucggcgg

SEQ ID NO: 2994443 - RNA, 18 nt, Mycobacterium avium subsp. paratuberculosis
cggcgagguagaccgccg

SEQ ID NO: 2994444 - RNA, 22 nt, Mycobacterium avium subsp. paratuberculosis
cggcgagguagaccgccgaguc

SEQ ID NO: 2994445 - RNA, 15 nt, Mycobacterium avium subsp. paratuberculosis
cggcgaggucguucg

SEQ ID NO: 2994446 - RNA, 18 nt, Mycobacterium avium subsp. paratuberculosis
cggcgaggugaaccgcga

SEQ ID NO: 2994447 - RNA, 14 nt, Mycobacterium avium subsp. paratuberculosis
cggcgaggugcgcc

SEQ ID NO: 2994448 - RNA, 16 nt, Mycobacterium avium subsp. paratuberculosis
cggcgaggugggcacc

SEQ ID NO: 2994449 - RNA, 17 nt, Mycobacterium avium subsp. paratuberculosis
cggcgaggugggcacca

SEQ ID NO: 2994450 - RNA, 16 nt, Mycobacterium avium subsp. paratuberculosis
cggcgaguacccgccg

SEQ ID NO: 2994451 - RNA, 17 nt, Mycobacterium avium subsp. paratuberculosis
cggcgaguacccgccgc

SEQ ID NO: 2994452 - RNA, 18 nt, Mycobacterium avium subsp. paratuberculosis
cggcgaguacccgccgca

SEQ ID NO: 2994453 - RNA, 20 nt, Mycobacterium avium subsp. paratuberculosis
cggcgaguacccgccgcacc

SEQ ID NO: 2994454 - RNA, 23 nt, Mycobacterium avium subsp. paratuberculosis
cggcgaguacccgccgcaccucg

SEQ ID NO: 2994455 - RNA, 16 nt, Mycobacterium avium subsp. paratuberculosis
cggcgagucccggcgc

SEQ ID NO: 2994456 - RNA, 18 nt, Mycobacterium avium subsp. paratuberculosis
cggcgagucccggcgcac

SEQ ID NO: 2994457 - RNA, 21 nt, Mycobacterium avium subsp. paratuberculosis
cggcgagucccggcgcaccag

SEQ ID NO: 2994458 - RNA, 23 nt, Mycobacterium avium subsp. paratuberculosis
cgccggcgcgcugaagcgcgacc

SEQ ID NO: 2994459 - RNA, 15 nt, Mycobacterium avium subsp. paratuberculosis
cgccggcgcggaaca

SEQ ID NO: 2994460 - RNA, 22 nt, Mycobacterium avium subsp. paratuberculosis
cgccggcgcggaacagcgucgc

SEQ ID NO: 2994461 - RNA, 14 nt, Mycobacterium avium subsp. paratuberculosis
cgccggcgcggacg

SEQ ID NO: 2994462 - RNA, 15 nt, Mycobacterium avium subsp. paratuberculosis
cgccggcgcggacgg

SEQ ID NO: 2994463 - RNA, 15 nt, Mycobacterium avium subsp. paratuberculosis
cgccggcgcggccag

SEQ ID NO: 2994464 - RNA, 14 nt, Mycobacterium avium subsp. paratuberculosis
cgccggcgcgggca

SEQ ID NO: 2994465 - RNA, 23 nt, Mycobacterium avium subsp. paratuberculosis
cgccggcgcgggcaugaaccagg

SEQ ID NO: 2994466 - RNA, 18 nt, Mycobacterium avium subsp. paratuberculosis
cgccggcgcgggccgcag

SEQ ID NO: 2994467 - RNA, 20 nt, Mycobacterium avium subsp. paratuberculosis
cgccggcgcgggccgcagcg

SEQ ID NO: 2994468 - RNA, 23 nt, Mycobacterium avium subsp. paratuberculosis
cgccggcgcgggccgcagcgcgc

SEQ ID NO: 2994469 - RNA, 16 nt, Mycobacterium avium subsp. paratuberculosis
cgccggcgcgggggcg

SEQ ID NO: 2994470 - RNA, 20 nt, Mycobacterium avium subsp. paratuberculosis
cgccggcgcgggggcggccu

SEQ ID NO: 2994471 - RNA, 12 nt, Mycobacterium avium subsp. paratuberculosis
cgccggcgcguc

SEQ ID NO: 2994472 - RNA, 13 nt, Mycobacterium avium subsp. paratuberculosis
cgccggcgcgucc

SEQ ID NO: 2994473 - RNA, 15 nt, Mycobacterium avium subsp. paratuberculosis
cgccggcgcguccgg

SEQ ID NO: 2994474 - RNA, 19 nt, Mycobacterium avium subsp. paratuberculosis
cgccggcgcguccggaggu

SEQ ID NO: 2994475 - RNA, 13 nt, Mycobacterium avium subsp. paratuberculosis
cgccggcgcuggc

SEQ ID NO: 2994476 - RNA, 20 nt, Mycobacterium avium subsp. paratuberculosis
cgccggcgcuuugccguccc

SEQ ID NO: 2994477 - RNA, 12 nt, Mycobacterium avium subsp. paratuberculosis
cgccggcggcca

SEQ ID NO: 2994478 - RNA, 21 nt, Mycobacterium avium subsp. paratuberculosis
cgccggcggccaaucccacca

SEQ ID NO: 2994479 - RNA, 22 nt, Mycobacterium avium subsp. paratuberculosis
cgccggcggccaaucccaccau

SEQ ID NO: 2994480 - RNA, 13 nt, Mycobacterium avium subsp. paratuberculosis
cgccggcggccac

SEQ ID NO: 2994481 - RNA, 14 nt, Mycobacterium avium subsp. paratuberculosis
cgccggcggccacg

SEQ ID NO: 2994482 - RNA, 19 nt, Mycobacterium avium subsp. paratuberculosis
cgccggcggccacgaucgc

SEQ ID NO: 2994483 - RNA, 15 nt, Mycobacterium avium subsp. paratuberculosis
cgccggcggccacgc

SEQ ID NO: 2994484 - RNA, 13 nt, Mycobacterium avium subsp. paratuberculosis
cgccggcggccga

SEQ ID NO: 2994485 - RNA, 14 nt, Mycobacterium avium subsp. paratuberculosis
cgccggcggccgac

SEQ ID NO: 2994486 - RNA, 14 nt, Mycobacterium avium subsp. paratuberculosis
cgccggcggccgcc

SEQ ID NO: 2994487 - RNA, 15 nt, Mycobacterium avium subsp. paratuberculosis
cgccggcggccgcca

SEQ ID NO: 2994488 - RNA, 16 nt, Mycobacterium avium subsp. paratuberculosis
cgccggcggccgccac

SEQ ID NO: 2994489 - RNA, 15 nt, Mycobacterium avium subsp. paratuberculosis
cgccggcggccgcga

SEQ ID NO: 2994490 - RNA, 14 nt, Mycobacterium avium subsp. paratuberculosis
cgccggcggccucc

SEQ ID NO: 2994491 - RNA, 13 nt, Mycobacterium avium subsp. paratuberculosis
cgccggcggcgau

SEQ ID NO: 2994492 - RNA, 14 nt, Mycobacterium avium subsp. paratuberculosis
cgccggcggcgauc

SEQ ID NO: 2994493 - RNA, 15 nt, Mycobacterium avium subsp. paratuberculosis
cgccggcggcgauga

SEQ ID NO: 2994494 - RNA, 20 nt, Mycobacterium avium subsp. paratuberculosis
cgccggcggcgaugaucggg

SEQ ID NO: 2994495 - RNA, 15 nt, Mycobacterium avium subsp. paratuberculosis
cgccggcggcgcccg

SEQ ID NO: 2994496 - RNA, 17 nt, Mycobacterium avium subsp. paratuberculosis
cgccggcggcgcccgcg

SEQ ID NO: 2994497 - RNA, 21 nt, Mycobacterium avium subsp. paratuberculosis
cgccggcggcgcccgcggccu

SEQ ID NO: 2994498 - RNA, 14 nt, Mycobacterium avium subsp. paratuberculosis
cgccggcggcgccg

SEQ ID NO: 2994499 - RNA, 12 nt, Mycobacterium avium subsp. paratuberculosis
cgccggcggcgg

SEQ ID NO: 2994500 - RNA, 13 nt, Mycobacterium avium subsp. paratuberculosis
cgccggcggcggc

SEQ ID NO: 2994501 - RNA, 15 nt, Mycobacterium avium subsp. paratuberculosis
cgccggcggcguccc

SEQ ID NO: 2994502 - RNA, 13 nt, Mycobacterium avium subsp. paratuberculosis
cgccggcggggcg

SEQ ID NO: 2994503 - RNA, 15 nt, Mycobacterium avium subsp. paratuberculosis
cgccggcggggcguc

SEQ ID NO: 2994504 - RNA, 16 nt, Mycobacterium avium subsp. paratuberculosis
cgccggcggggcgucg

SEQ ID NO: 2994505 - RNA, 21 nt, Mycobacterium avium subsp. paratuberculosis
cgccggcggggcgucgcccgc

SEQ ID NO: 2994506 - RNA, 19 nt, Mycobacterium avium subsp. paratuberculosis
cgccggcggggguucgacg

SEQ ID NO: 2994507 - RNA, 19 nt, Mycobacterium avium subsp. paratuberculosis
cgccggcgggugagccggu

SEQ ID NO: 2994508 - RNA, 22 nt, Mycobacterium avium subsp. paratuberculosis
cgccggcgggugagccggucga

SEQ ID NO: 2994509 - RNA, 18 nt, Mycobacterium avium subsp. paratuberculosis
cgccggcggguuggccgu

SEQ ID NO: 2994510 - RNA, 23 nt, Mycobacterium avium subsp. paratuberculosis
cgccggcggguuggccgucgaac

SEQ ID NO: 2994511 - RNA, 18 nt, Mycobacterium avium subsp. paratuberculosis
cgccggcgguaugcccgg

SEQ ID NO: 2994512 - RNA, 21 nt, Mycobacterium avium subsp. paratuberculosis
cgccggcgguaugcccgggcc

SEQ ID NO: 2994513 - RNA, 11 nt, Mycobacterium avium subsp. paratuberculosis
cgccggcgguc

SEQ ID NO: 2994514 - RNA, 13 nt, Mycobacterium avium subsp. paratuberculosis
cgccggcggucag

SEQ ID NO: 2994515 - RNA, 19 nt, Mycobacterium avium subsp. paratuberculosis
cgccggcggucgacacgau

SEQ ID NO: 2994516 - RNA, 12 nt, Mycobacterium avium subsp. paratuberculosis
cgccggcggugc

SEQ ID NO: 2994517 - RNA, 13 nt, Mycobacterium avium subsp. paratuberculosis
cgccggcggugcg

SEQ ID NO: 2994518 - RNA, 16 nt, Mycobacterium avium subsp. paratuberculosis
cgccggcggugcggcg

SEQ ID NO: 2994519 - RNA, 17 nt, Mycobacterium avium subsp. paratuberculosis
cgccggcggugcggcgg

SEQ ID NO: 2994520 - RNA, 13 nt, Mycobacterium avium subsp. paratuberculosis
cgccggcguagac

SEQ ID NO: 2994521 - RNA, 19 nt, Mycobacterium avium subsp. paratuberculosis
cgccggcguagaccagcga

SEQ ID NO: 2994522 - RNA, 21 nt, Mycobacterium avium subsp. paratuberculosis
cgccggcguagaccagcgacg

SEQ ID NO: 2994523 - RNA, 20 nt, Mycobacterium avium subsp. paratuberculosis
cgccggcguccagcgccgcc

SEQ ID NO: 2994524 - RNA, 21 nt, Mycobacterium avium subsp. paratuberculosis
cgccggcguccagcgccgcca

SEQ ID NO: 2994525 - RNA, 15 nt, Mycobacterium avium subsp. paratuberculosis
cgccggcgucgccgc

SEQ ID NO: 2994526 - RNA, 16 nt, Mycobacterium avium subsp. paratuberculosis
cgccggcgucgccgcu

SEQ ID NO: 2994527 - RNA, 17 nt, Mycobacterium avium subsp. paratuberculosis
cgccggcgucgccgcuc

SEQ ID NO: 2994528 - RNA, 22 nt, Mycobacterium avium subsp. paratuberculosis
cgccggcgucgccgcucuucga

SEQ ID NO: 2994529 - RNA, 12 nt, Mycobacterium avium subsp. paratuberculosis
cgccggcgucgg

SEQ ID NO: 2994530 - RNA, 14 nt, Mycobacterium avium subsp. paratuberculosis
cgccggcgucggug

SEQ ID NO: 2994531 - RNA, 16 nt, Mycobacterium avium subsp. paratuberculosis
cgccggcgucgguguc

SEQ ID NO: 2994532 - RNA, 19 nt, Mycobacterium avium subsp. paratuberculosis
cgccggcgugcacaggccg

SEQ ID NO: 2994533 - RNA, 17 nt, Mycobacterium avium subsp. paratuberculosis
cgccggcgugucggcgc

SEQ ID NO: 2994534 - RNA, 16 nt, Mycobacterium avium subsp. paratuberculosis
cgccggcuaccggcgc

SEQ ID NO: 2994535 - RNA, 17 nt, Mycobacterium avium subsp. paratuberculosis
cgccggcuaccggcgcu

SEQ ID NO: 2994536 - RNA, 18 nt, Mycobacterium avium subsp. paratuberculosis
cgccggcuagacgcgcag

SEQ ID NO: 2994537 - RNA, 13 nt, Mycobacterium avium subsp. paratuberculosis
cgccggcucagcg

SEQ ID NO: 2994538 - RNA, 14 nt, Mycobacterium avium subsp. paratuberculosis
cgccggcucagcgg

SEQ ID NO: 2994539 - RNA, 16 nt, Mycobacterium avium subsp. paratuberculosis
cgccggcucagcggca

SEQ ID NO: 2994540 - RNA, 14 nt, Mycobacterium avium subsp. paratuberculosis
cgccggcuccaccg

SEQ ID NO: 2994541 - RNA, 15 nt, Mycobacterium avium subsp. paratuberculosis
cgccggcuccaccgc

SEQ ID NO: 2994542 - RNA, 16 nt, Mycobacterium avium subsp. paratuberculosis
cgccggcuccgcaugc

SEQ ID NO: 2994543 - RNA, 20 nt, Mycobacterium avium subsp. paratuberculosis
cgccggcucggucuccucca

SEQ ID NO: 2994544 - RNA, 17 nt, Mycobacterium avium subsp. paratuberculosis
cgccggcugacugccgg

SEQ ID NO: 2994545 - RNA, 18 nt, Mycobacterium avium subsp. paratuberculosis
cgccggcugacugccggc

SEQ ID NO: 2994546 - RNA, 19 nt, Mycobacterium avium subsp. paratuberculosis
cgccggcugacugccggcg

SEQ ID NO: 2994547 - RNA, 22 nt, Mycobacterium avium subsp. paratuberculosis
cgccggcugacugccggcgacg

SEQ ID NO: 2994548 - RNA, 19 nt, Mycobacterium avium subsp. paratuberculosis
cgccggcuggcgggcgauc

SEQ ID NO: 2994549 - RNA, 20 nt, Mycobacterium avium subsp. paratuberculosis
cgccggcuggcgggcgaucg

SEQ ID NO: 2994550 - RNA, 21 nt, Mycobacterium avium subsp. paratuberculosis
cgccggcuggcgggcgaucgc

SEQ ID NO: 2994551 - RNA, 22 nt, Mycobacterium avium subsp. paratuberculosis
cgccggcuggcgggcgaucgcc

SEQ ID NO: 2994552 - RNA, 17 nt, Mycobacterium avium subsp. paratuberculosis
cgccggcuuaccgaccu

SEQ ID NO: 2994553 - RNA, 18 nt, Mycobacterium avium subsp. paratuberculosis
cgccgggaaaguuguagc

SEQ ID NO: 2994554 - RNA, 22 nt, Mycobacterium avium subsp. paratuberculosis
cgccgggaacagcgacgcccag

SEQ ID NO: 2994555 - RNA, 22 nt, Mycobacterium avium subsp. paratuberculosis
cgccgggacgggcauccggcuc

SEQ ID NO: 2994556 - RNA, 17 nt, Mycobacterium avium subsp. paratuberculosis
cgccgggauauucgccc

SEQ ID NO: 2994557 - RNA, 13 nt, Mycobacterium avium subsp. paratuberculosis
cgccgggaucaca

SEQ ID NO: 2994558 - RNA, 18 nt, Mycobacterium avium subsp. paratuberculosis
cgccgggaucacacgcgc

SEQ ID NO: 2994559 - RNA, 15 nt, Mycobacterium avium subsp. paratuberculosis
cgccgggaucggcag

SEQ ID NO: 2994560 - RNA, 19 nt, Mycobacterium avium subsp. paratuberculosis
cgccgggaucggcagcgcg

SEQ ID NO: 2994561 - RNA, 23 nt, Mycobacterium avium subsp. paratuberculosis
cgccgggaucggcagcgcgcccu

SEQ ID NO: 2994562 - RNA, 14 nt, Mycobacterium avium subsp. paratuberculosis
cgccgggaucggcg

SEQ ID NO: 2994563 - RNA, 16 nt, Mycobacterium avium subsp. paratuberculosis
cgccgggaucggcggg

SEQ ID NO: 2994564 - RNA, 13 nt, Mycobacterium avium subsp. paratuberculosis
cgccgggaugcgc

SEQ ID NO: 2994565 - RNA, 15 nt, Mycobacterium avium subsp. paratuberculosis
cgccgggaugcgcca

SEQ ID NO: 2994566 - RNA, 17 nt, Mycobacterium avium subsp. paratuberculosis
cgccgggaugcgccacc

SEQ ID NO: 2994567 - RNA, 18 nt, Mycobacterium avium subsp. paratuberculosis
cgccgggaugcgccaccg

SEQ ID NO: 2994568 - RNA, 21 nt, Mycobacterium avium subsp. paratuberculosis
cgccgggaugcgccaccgaca

SEQ ID NO: 2994569 - RNA, 14 nt, Mycobacterium avium subsp. paratuberculosis
cgccgggaugguga

SEQ ID NO: 2994570 - RNA, 19 nt, Mycobacterium avium subsp. paratuberculosis
cgccgggcaacagcgcgcc

SEQ ID NO: 2994571 - RNA, 22 nt, Mycobacterium avium subsp. paratuberculosis
cgccgggcaacagcgcgccggc

SEQ ID NO: 2994572 - RNA, 13 nt, Mycobacterium avium subsp. paratuberculosis
cgccgggcacccg

SEQ ID NO: 2994573 - RNA, 15 nt, Mycobacterium avium subsp. paratuberculosis
cgccgggcacccggg

SEQ ID NO: 2994574 - RNA, 16 nt, Mycobacterium avium subsp. paratuberculosis
cgccgggcaccucggc

SEQ ID NO: 2994575 - RNA, 17 nt, Mycobacterium avium subsp. paratuberculosis
cgccgggcaccucggcg

SEQ ID NO: 2994576 - RNA, 18 nt, Mycobacterium avium subsp. paratuberculosis
cgccgggcaccucggcgu

SEQ ID NO: 2994577 - RNA, 20 nt, Mycobacterium avium subsp. paratuberculosis
cgccgggcaccucggcgucg

SEQ ID NO: 2994578 - RNA, 14 nt, Mycobacterium avium subsp. paratuberculosis
cgccgggcagcccg

SEQ ID NO: 2994579 - RNA, 15 nt, Mycobacterium avium subsp. paratuberculosis
cgccgggcagcccgc

SEQ ID NO: 2994580 - RNA, 18 nt, Mycobacterium avium subsp. paratuberculosis
cgccgggcagcccgccgc

SEQ ID NO: 2994581 - RNA, 20 nt, Mycobacterium avium subsp. paratuberculosis
cgccgggcagcccgccgcgg

SEQ ID NO: 2994582 - RNA, 19 nt, Mycobacterium avium subsp. paratuberculosis
cgccgggcagcccgggucu

SEQ ID NO: 2994583 - RNA, 20 nt, Mycobacterium avium subsp. paratuberculosis
cgccgggcagcccgggucua

SEQ ID NO: 2994584 - RNA, 16 nt, Mycobacterium avium subsp. paratuberculosis
cgccgggcagcgcgcg

SEQ ID NO: 2994585 - RNA, 20 nt, Mycobacterium avium subsp. paratuberculosis
cgccgggcagcgcgcgagac

SEQ ID NO: 2994586 - RNA, 17 nt, Mycobacterium avium subsp. paratuberculosis
cgccgggcagguggucg

SEQ ID NO: 2994587 - RNA, 19 nt, Mycobacterium avium subsp. paratuberculosis
cgccgggcagguggucggc

SEQ ID NO: 2994588 - RNA, 17 nt, Mycobacterium avium subsp. paratuberculosis
cgccgggcauccgcccg

SEQ ID NO: 2994589 - RNA, 18 nt, Mycobacterium avium subsp. paratuberculosis
cgccgggcauccgcccgu

SEQ ID NO: 2994590 - RNA, 18 nt, Mycobacterium avium subsp. paratuberculosis
cgccgggcauccgggccg

SEQ ID NO: 2994591 - RNA, 19 nt, Mycobacterium avium subsp. paratuberculosis
cgccgggcauccgggccgc

SEQ ID NO: 2994592 - RNA, 20 nt, Mycobacterium avium subsp. paratuberculosis
cgccgggcauccgggccgcc

SEQ ID NO: 2994593 - RNA, 21 nt, Mycobacterium avium subsp. paratuberculosis
cgccgggcauccgggccgccg

SEQ ID NO: 2994594 - RNA, 14 nt, Mycobacterium avium subsp. paratuberculosis
cgccgggcaucucg

SEQ ID NO: 2994595 - RNA, 21 nt, Mycobacterium avium subsp. paratuberculosis
cgccgggcaucucguugucgu

SEQ ID NO: 2994596 - RNA, 15 nt, Mycobacterium avium subsp. paratuberculosis
cgccgggcauuucgg

SEQ ID NO: 2994597 - RNA, 13 nt, Mycobacterium avium subsp. paratuberculosis
cgccgggccacgc

SEQ ID NO: 2994598 - RNA, 14 nt, Mycobacterium avium subsp. paratuberculosis
cgccgggccacgcc

SEQ ID NO: 2994599 - RNA, 17 nt, Mycobacterium avium subsp. paratuberculosis
cgccgggccacgccgac

SEQ ID NO: 2994600 - RNA, 14 nt, Mycobacterium avium subsp. paratuberculosis
cgccgggcccgcuc

SEQ ID NO: 2994601 - RNA, 18 nt, Mycobacterium avium subsp. paratuberculosis
cgccgggcccggucccgc

SEQ ID NO: 2994602 - RNA, 13 nt, Mycobacterium avium subsp. paratuberculosis
cgccgggccgccg

SEQ ID NO: 2994603 - RNA, 14 nt, Mycobacterium avium subsp. paratuberculosis
cgccgggccgccgc

SEQ ID NO: 2994604 - RNA, 16 nt, Mycobacterium avium subsp. paratuberculosis
cgccgggccgccgcgg

SEQ ID NO: 2994605 - RNA, 15 nt, Mycobacterium avium subsp. paratuberculosis
cgccgggccggaucg

SEQ ID NO: 2994606 - RNA, 20 nt, Mycobacterium avium subsp. paratuberculosis
cgccgggccggaucgcgcag

SEQ ID NO: 2994607 - RNA, 15 nt, Mycobacterium avium subsp. paratuberculosis
cgccgggccggccgg

SEQ ID NO: 2994608 - RNA, 16 nt, Mycobacterium avium subsp. paratuberculosis
cgccgggccggccggu

SEQ ID NO: 2994609 - RNA, 15 nt, Mycobacterium avium subsp. paratuberculosis
cgccgggccggcggc

SEQ ID NO: 2994610 - RNA, 18 nt, Mycobacterium avium subsp. paratuberculosis
cgccgggccggcggccag

SEQ ID NO: 2994611 - RNA, 17 nt, Mycobacterium avium subsp. paratuberculosis
cgccgggccuguccagc

SEQ ID NO: 2994612 - RNA, 19 nt, Mycobacterium avium subsp. paratuberculosis
cgccgggcgaagucgccgg

SEQ ID NO: 2994613 - RNA, 22 nt, Mycobacterium avium subsp. paratuberculosis
cgccgggcgaagucgccggcca

SEQ ID NO: 2994614 - RNA, 23 nt, Mycobacterium avium subsp. paratuberculosis
cgccgggcgaagucgccggccag

SEQ ID NO: 2994615 - RNA, 19 nt, Mycobacterium avium subsp. paratuberculosis
cgccgggcgccacgcuggc

SEQ ID NO: 2994616 - RNA, 13 nt, Mycobacterium avium subsp. paratuberculosis
cgccgggcgcccg

SEQ ID NO: 2994617 - RNA, 19 nt, Mycobacterium avium subsp. paratuberculosis
cgccgggcgcccgagccgc

SEQ ID NO: 2994618 - RNA, 16 nt, Mycobacterium avium subsp. paratuberculosis
cgccgggcgcccgcgg

SEQ ID NO: 2994619 - RNA, 22 nt, Mycobacterium avium subsp. paratuberculosis
cgccgggcggaugucggugugg

SEQ ID NO: 2994620 - RNA, 18 nt, Mycobacterium avium subsp. paratuberculosis
cgccgggcggcagcacgu

SEQ ID NO: 2994621 - RNA, 14 nt, Mycobacterium avium subsp. paratuberculosis
cgccgggcggcccg

SEQ ID NO: 2994622 - RNA, 15 nt, Mycobacterium avium subsp. paratuberculosis
cgccgggcggcccgc

SEQ ID NO: 2994623 - RNA, 16 nt, Mycobacterium avium subsp. paratuberculosis
cgccgggcggcccgcc

SEQ ID NO: 2994624 - RNA, 17 nt, Mycobacterium avium subsp. paratuberculosis
cgccgggcggcccgccu

SEQ ID NO: 2994625 - RNA, 13 nt, Mycobacterium avium subsp. paratuberculosis
cgccgggcggccu

SEQ ID NO: 2994626 - RNA, 15 nt, Mycobacterium avium subsp. paratuberculosis
cgccgggcggccucg

SEQ ID NO: 2994627 - RNA, 21 nt, Mycobacterium avium subsp. paratuberculosis
cgccgggcggccucggcgucc

SEQ ID NO: 2994628 - RNA, 18 nt, Mycobacterium avium subsp. paratuberculosis
cgccgggucccagugcca

SEQ ID NO: 2994629 - RNA, 14 nt, Mycobacterium avium subsp. paratuberculosis
cgccgggucgacgc

SEQ ID NO: 2994630 - RNA, 15 nt, Mycobacterium avium subsp. paratuberculosis
cgccgggucgacgcc

SEQ ID NO: 2994631 - RNA, 17 nt, Mycobacterium avium subsp. paratuberculosis
cgccgggucgacgccga

SEQ ID NO: 2994632 - RNA, 18 nt, Mycobacterium avium subsp. paratuberculosis
cgccgggucgacgccgag

SEQ ID NO: 2994633 - RNA, 14 nt, Mycobacterium avium subsp. paratuberculosis
cgccgggucgcacg

SEQ ID NO: 2994634 - RNA, 15 nt, Mycobacterium avium subsp. paratuberculosis
cgccgggucgcacgc

SEQ ID NO: 2994635 - RNA, 17 nt, Mycobacterium avium subsp. paratuberculosis
cgccgggucgcacgccg

SEQ ID NO: 2994636 - RNA, 18 nt, Mycobacterium avium subsp. paratuberculosis
cgccgggucgcacgccgg

SEQ ID NO: 2994637 - RNA, 19 nt, Mycobacterium avium subsp. paratuberculosis
cgccgggucgcacgccggu

SEQ ID NO: 2994638 - RNA, 15 nt, Mycobacterium avium subsp. paratuberculosis
cgccgggucgcggua

SEQ ID NO: 2994639 - RNA, 20 nt, Mycobacterium avium subsp. paratuberculosis
cgccgggucgcgguagaugu

SEQ ID NO: 2994640 - RNA, 16 nt, Mycobacterium avium subsp. paratuberculosis
cgccgggucgcggugg

SEQ ID NO: 2994641 - RNA, 18 nt, Mycobacterium avium subsp. paratuberculosis
cgccgggucuuccacgcc

SEQ ID NO: 2994642 - RNA, 19 nt, Mycobacterium avium subsp. paratuberculosis
cgccgggucuuccacgccg

SEQ ID NO: 2994643 - RNA, 19 nt, Mycobacterium avium subsp. paratuberculosis
cgccggguggccggggcca

SEQ ID NO: 2994644 - RNA, 20 nt, Mycobacterium avium subsp. paratuberculosis
cgccggguugcaggcgccca

SEQ ID NO: 2994645 - RNA, 22 nt, Mycobacterium avium subsp. paratuberculosis
cgccggguugcaggcgcccagg

SEQ ID NO: 2994646 - RNA, 17 nt, Mycobacterium avium subsp. paratuberculosis
cgccggguugggcggcg

SEQ ID NO: 2994647 - RNA, 19 nt, Mycobacterium avium subsp. paratuberculosis
cgccggguugggcggcggc

SEQ ID NO: 2994648 - RNA, 20 nt, Mycobacterium avium subsp. paratuberculosis
cgccggguugggcggcggcc

SEQ ID NO: 2994649 - RNA, 22 nt, Mycobacterium avium subsp. paratuberculosis
cgccggguugggcggcggccac

SEQ ID NO: 2994650 - RNA, 23 nt, Mycobacterium avium subsp. paratuberculosis
cgccggguugggcggcggccacc

SEQ ID NO: 2994651 - RNA, 18 nt, Mycobacterium avium subsp. paratuberculosis
cgccggguuguagcaggc

SEQ ID NO: 2994652 - RNA, 18 nt, Mycobacterium avium subsp. paratuberculosis
cgccggguuuguccggcc

SEQ ID NO: 2994653 - RNA, 18 nt, Mycobacterium avium subsp. paratuberculosis
cgccgguaaugggcgauc

SEQ ID NO: 2994654 - RNA, 15 nt, Mycobacterium avium subsp. paratuberculosis
cgccgguaccgccgg

SEQ ID NO: 2994655 - RNA, 17 nt, Mycobacterium avium subsp. paratuberculosis
cgccgguaccgccggcc

SEQ ID NO: 2994656 - RNA, 19 nt, Mycobacterium avium subsp. paratuberculosis
cgccgguaccgccggccag

SEQ ID NO: 2994657 - RNA, 22 nt, Mycobacterium avium subsp. paratuberculosis
cgccgguaccgccggccaggcg

SEQ ID NO: 2994658 - RNA, 20 nt, Mycobacterium avium subsp. paratuberculosis
cgccgguagagcgccagggu

SEQ ID NO: 2994659 - RNA, 18 nt, Mycobacterium avium subsp. paratuberculosis
cgccgguagccgcucgcc

SEQ ID NO: 2994660 - RNA, 23 nt, Mycobacterium avium subsp. paratuberculosis
cgccgguagccgcucgcccagcg

SEQ ID NO: 2994661 - RNA, 18 nt, Mycobacterium avium subsp. paratuberculosis
cgccgguagcgacacgga

SEQ ID NO: 2994662 - RNA, 16 nt, Mycobacterium avium subsp. paratuberculosis
cgccgguaggcggcca

SEQ ID NO: 2994663 - RNA, 18 nt, Mycobacterium avium subsp. paratuberculosis
cgccgguaggcggccagc

SEQ ID NO: 2994664 - RNA, 16 nt, Mycobacterium avium subsp. paratuberculosis
cgccgguaucgagcac

SEQ ID NO: 2994665 - RNA, 19 nt, Mycobacterium avium subsp. paratuberculosis
cgccgguaucgagcaccag

SEQ ID NO: 2994666 - RNA, 20 nt, Mycobacterium avium subsp. paratuberculosis
cgccgguaucgagcaccagc

SEQ ID NO: 2994667 - RNA, 15 nt, Mycobacterium avium subsp. paratuberculosis
cgccggucacggcgu

SEQ ID NO: 2994668 - RNA, 17 nt, Mycobacterium avium subsp. paratuberculosis
cgccggucacggcgucg

SEQ ID NO: 2994669 - RNA, 19 nt, Mycobacterium avium subsp. paratuberculosis
cgccggucacggcgucggc

SEQ ID NO: 2994670 - RNA, 21 nt, Mycobacterium avium subsp. paratuberculosis
cgccggucacggcgucggcgu

SEQ ID NO: 2994671 - RNA, 23 nt, Mycobacterium avium subsp. paratuberculosis
cgccggucagaccccguaccagc

SEQ ID NO: 2994672 - RNA, 14 nt, Mycobacterium avium subsp. paratuberculosis
cgccggucagcacc

SEQ ID NO: 2994673 - RNA, 15 nt, Mycobacterium avium subsp. paratuberculosis
cgccggucagcacca

SEQ ID NO: 2994674 - RNA, 21 nt, Mycobacterium avium subsp. paratuberculosis
cgccggucagcaccauggcgu

SEQ ID NO: 2994675 - RNA, 22 nt, Mycobacterium avium subsp. paratuberculosis
cgccggucagcaccauggcguc

SEQ ID NO: 2994676 - RNA, 17 nt, Mycobacterium avium subsp. paratuberculosis
cgccggucagcacgucg

SEQ ID NO: 2994677 - RNA, 21 nt, Mycobacterium avium subsp. paratuberculosis
cgccggucagcacgucgguca

SEQ ID NO: 2994678 - RNA, 15 nt, Mycobacterium avium subsp. paratuberculosis
cgccggucagcggca

SEQ ID NO: 2994679 - RNA, 18 nt, Mycobacterium avium subsp. paratuberculosis
cgccggucagcggcaaca

SEQ ID NO: 2994680 - RNA, 20 nt, Mycobacterium avium subsp. paratuberculosis
cgccgguccagugccggcga

SEQ ID NO: 2994681 - RNA, 21 nt, Mycobacterium avium subsp. paratuberculosis
cgccgguccagugccggcgag

SEQ ID NO: 2994682 - RNA, 13 nt, Mycobacterium avium subsp. paratuberculosis
cgccggucccgcg

SEQ ID NO: 2994683 - RNA, 16 nt, Mycobacterium avium subsp. paratuberculosis
cgccggucccgcggcg

SEQ ID NO: 2994684 - RNA, 18 nt, Mycobacterium avium subsp. paratuberculosis
cgccggucccgcggcggc

SEQ ID NO: 2994685 - RNA, 15 nt, Mycobacterium avium subsp. paratuberculosis
cgccggucgacgcgg

SEQ ID NO: 2994686 - RNA, 18 nt, Mycobacterium avium subsp. paratuberculosis
cgccggucgacgcggggc

SEQ ID NO: 2994687 - RNA, 21 nt, Mycobacterium avium subsp. paratuberculosis
cgccggucgcccccucggccg

SEQ ID NO: 2994688 - RNA, 22 nt, Mycobacterium avium subsp. paratuberculosis
cgccggucgcccccucggccgg

SEQ ID NO: 2994689 - RNA, 23 nt, Mycobacterium avium subsp. paratuberculosis
cgccggucgcccccucggccggu

SEQ ID NO: 2994690 - RNA, 13 nt, Mycobacterium avium subsp. paratuberculosis
cgccggucgcugc

SEQ ID NO: 2994691 - RNA, 14 nt, Mycobacterium avium subsp. paratuberculosis
cgccggucgcugcg

SEQ ID NO: 2994692 - RNA, 12 nt, Mycobacterium avium subsp. paratuberculosis
cgccggucggcg

SEQ ID NO: 2994693 - RNA, 14 nt, Mycobacterium avium subsp. paratuberculosis
cgccggucggugcg

SEQ ID NO: 2994694 - RNA, 13 nt, Mycobacterium avium subsp. paratuberculosis
cgccggucguagc

SEQ ID NO: 2994695 - RNA, 18 nt, Mycobacterium avium subsp. paratuberculosis
cgccggucguagcgucgg

SEQ ID NO: 2994696 - RNA, 19 nt, Mycobacterium avium subsp. paratuberculosis
cgccggucguagcgucggg

SEQ ID NO: 2994697 - RNA, 23 nt, Mycobacterium avium subsp. paratuberculosis
cgccggucguagcgucgggggcg

SEQ ID NO: 2994698 - RNA, 15 nt, Mycobacterium avium subsp. paratuberculosis
cgccggucguggggc

SEQ ID NO: 2994699 - RNA, 21 nt, Mycobacterium avium subsp. paratuberculosis
cgccggucguuacgacucggc

SEQ ID NO: 2994700 - RNA, 22 nt, Mycobacterium avium subsp. paratuberculosis
cgccggucuccaugucgucggc

SEQ ID NO: 2994701 - RNA, 23 nt, Mycobacterium avium subsp. paratuberculosis
cgccggucuccaugucgucggcg

SEQ ID NO: 2994702 - RNA, 23 nt, Mycobacterium avium subsp. paratuberculosis
cgccggucucgaacacgccgucg

SEQ ID NO: 2994703 - RNA, 24 nt, Mycobacterium avium subsp. paratuberculosis
cgccggucucgaacacgccgucgu

SEQ ID NO: 2994704 - RNA, 15 nt, Mycobacterium avium subsp. paratuberculosis
cgccggucugguacc

SEQ ID NO: 2994705 - RNA, 18 nt, Mycobacterium avium subsp. paratuberculosis
cgccggugaaaccggcgc

SEQ ID NO: 2994706 - RNA, 20 nt, Mycobacterium avium subsp. paratuberculosis
cgccggugaaaccggcgccg

SEQ ID NO: 2994707 - RNA, 17 nt, Mycobacterium avium subsp. paratuberculosis
cgccggugaacacgaac

SEQ ID NO: 2994708 - RNA, 18 nt, Mycobacterium avium subsp. paratuberculosis
cgccggugaagaucagcg

SEQ ID NO: 2994709 - RNA, 21 nt, Mycobacterium avium subsp. paratuberculosis
cgccggugaagaucagcgcgu

SEQ ID NO: 2994710 - RNA, 22 nt, Mycobacterium avium subsp. paratuberculosis
cgccggugaagaucagcgcguc

SEQ ID NO: 2994711 - RNA, 16 nt, Mycobacterium avium subsp. paratuberculosis
cgccggugaagaucgc

SEQ ID NO: 2994712 - RNA, 21 nt, Mycobacterium avium subsp. paratuberculosis
cgccgucacaccgcggccagc

SEQ ID NO: 2994713 - RNA, 22 nt, Mycobacterium avium subsp. paratuberculosis
cgccgucacaccgcggccagcg

SEQ ID NO: 2994714 - RNA, 23 nt, Mycobacterium avium subsp. paratuberculosis
cgccgucacaccgcggccagcgc

SEQ ID NO: 2994715 - RNA, 14 nt, Mycobacterium avium subsp. paratuberculosis
cgccgucaccgcca

SEQ ID NO: 2994716 - RNA, 16 nt, Mycobacterium avium subsp. paratuberculosis
cgccgucaccgccagg

SEQ ID NO: 2994717 - RNA, 19 nt, Mycobacterium avium subsp. paratuberculosis
cgccgucaccgccaggacc

SEQ ID NO: 2994718 - RNA, 23 nt, Mycobacterium avium subsp. paratuberculosis
cgccgucaccgccaggaccaccc

SEQ ID NO: 2994719 - RNA, 16 nt, Mycobacterium avium subsp. paratuberculosis
cgccgucaccggcugc

SEQ ID NO: 2994720 - RNA, 22 nt, Mycobacterium avium subsp. paratuberculosis
cgccgucaccggcugcccgacc

SEQ ID NO: 2994721 - RNA, 23 nt, Mycobacterium avium subsp. paratuberculosis
cgccgucaccggcugcccgaccc

SEQ ID NO: 2994722 - RNA, 19 nt, Mycobacterium avium subsp. paratuberculosis
cgccgucaccucgaggaac

SEQ ID NO: 2994723 - RNA, 14 nt, Mycobacterium avium subsp. paratuberculosis
cgccgucacgccgu

SEQ ID NO: 2994724 - RNA, 21 nt, Mycobacterium avium subsp. paratuberculosis
cgccgucacggaucgcccacc

SEQ ID NO: 2994725 - RNA, 22 nt, Mycobacterium avium subsp. paratuberculosis
cgccgucacggaucgcccaccc

SEQ ID NO: 2994726 - RNA, 16 nt, Mycobacterium avium subsp. paratuberculosis
cgccgucacguagcgc

SEQ ID NO: 2994727 - RNA, 21 nt, Mycobacterium avium subsp. paratuberculosis
cgccgucacguagcgcggccg

SEQ ID NO: 2994728 - RNA, 23 nt, Mycobacterium avium subsp. paratuberculosis
cgccgucacgucauuucggucgg

SEQ ID NO: 2994729 - RNA, 18 nt, Mycobacterium avium subsp. paratuberculosis
cgccgucacugcacgcac

SEQ ID NO: 2994730 - RNA, 21 nt, Mycobacterium avium subsp. paratuberculosis
cgccgucacugcacgcacggc

SEQ ID NO: 2994731 - RNA, 16 nt, Mycobacterium avium subsp. paratuberculosis
cgccgucaucaccgcc

SEQ ID NO: 2994732 - RNA, 18 nt, Mycobacterium avium subsp. paratuberculosis
cgccgucaucaccgccga

SEQ ID NO: 2994733 - RNA, 19 nt, Mycobacterium avium subsp. paratuberculosis
cgccgucaucaccgccgag

SEQ ID NO: 2994734 - RNA, 14 nt, Mycobacterium avium subsp. paratuberculosis
cgccgucaucggcg

SEQ ID NO: 2994735 - RNA, 15 nt, Mycobacterium avium subsp. paratuberculosis
cgccgucaucggcgg

SEQ ID NO: 2994736 - RNA, 14 nt, Mycobacterium avium subsp. paratuberculosis
cgccguccacgggu

SEQ ID NO: 2994737 - RNA, 21 nt, Mycobacterium avium subsp. paratuberculosis
cgccguccagcucgcguucgg

SEQ ID NO: 2994738 - RNA, 17 nt, Mycobacterium avium subsp. paratuberculosis
cgccgucccaccggcga

SEQ ID NO: 2994739 - RNA, 23 nt, Mycobacterium avium subsp. paratuberculosis
cgccgucccaccggcgauguggc

SEQ ID NO: 2994740 - RNA, 16 nt, Mycobacterium avium subsp. paratuberculosis
cgccgucccagccgga

SEQ ID NO: 2994741 - RNA, 15 nt, Mycobacterium avium subsp. paratuberculosis
cgccguccccaccga

SEQ ID NO: 2994742 - RNA, 20 nt, Mycobacterium avium subsp. paratuberculosis
cgccguccccaccgaucagg

SEQ ID NO: 2994743 - RNA, 14 nt, Mycobacterium avium subsp. paratuberculosis
cgccguccccgcgc

SEQ ID NO: 2994744 - RNA, 20 nt, Mycobacterium avium subsp. paratuberculosis
cgccguccccgcgcggcucg

SEQ ID NO: 2994745 - RNA, 13 nt, Mycobacterium avium subsp. paratuberculosis
cgccgucccggac

SEQ ID NO: 2994746 - RNA, 14 nt, Mycobacterium avium subsp. paratuberculosis
cgccgucccggacg

SEQ ID NO: 2994747 - RNA, 16 nt, Mycobacterium avium subsp. paratuberculosis
cgccgucccggacgcu

SEQ ID NO: 2994748 - RNA, 21 nt, Mycobacterium avium subsp. paratuberculosis
cgccgucccggacgcugcggu

SEQ ID NO: 2994749 - RNA, 19 nt, Mycobacterium avium subsp. paratuberculosis
cgccgucccguccgacggc

SEQ ID NO: 2994750 - RNA, 12 nt, Mycobacterium avium subsp. paratuberculosis
cgccguccgcac

SEQ ID NO: 2994751 - RNA, 13 nt, Mycobacterium avium subsp. paratuberculosis
cgccguccgcacc

SEQ ID NO: 2994752 - RNA, 13 nt, Mycobacterium avium subsp. paratuberculosis
cgccguccgcggc

SEQ ID NO: 2994753 - RNA, 15 nt, Mycobacterium avium subsp. paratuberculosis
cgccguccgcggcgg

SEQ ID NO: 2994754 - RNA, 16 nt, Mycobacterium avium subsp. paratuberculosis
cgccguccgcggcggc

SEQ ID NO: 2994755 - RNA, 17 nt, Mycobacterium avium subsp. paratuberculosis
cgccguccgcggcggcc

SEQ ID NO: 2994756 - RNA, 12 nt, Mycobacterium avium subsp. paratuberculosis
cgccguccggcc

SEQ ID NO: 2994757 - RNA, 14 nt, Mycobacterium avium subsp. paratuberculosis
cgccguccggccac

SEQ ID NO: 2994758 - RNA, 17 nt, Mycobacterium avium subsp. paratuberculosis
cgccguccggccacgac

SEQ ID NO: 2994759 - RNA, 22 nt, Mycobacterium avium subsp. paratuberculosis
cgccguccgggaacacguagcg

SEQ ID NO: 2994760 - RNA, 20 nt, Mycobacterium avium subsp. paratuberculosis
cgccguccgggcacccgacg

SEQ ID NO: 2994761 - RNA, 17 nt, Mycobacterium avium subsp. paratuberculosis
cgccguccggggccggu

SEQ ID NO: 2994762 - RNA, 20 nt, Mycobacterium avium subsp. paratuberculosis
cgccguccggggccggugcg

SEQ ID NO: 2994763 - RNA, 19 nt, Mycobacterium avium subsp. paratuberculosis
cgccguccuccucgucggc

SEQ ID NO: 2994764 - RNA, 19 nt, Mycobacterium avium subsp. paratuberculosis
cgccguccucgcgucgcgc

SEQ ID NO: 2994765 - RNA, 19 nt, Mycobacterium avium subsp. paratuberculosis
cgccguccuugacgaacga

SEQ ID NO: 2994766 - RNA, 21 nt, Mycobacterium avium subsp. paratuberculosis
cgccguccuuggccgccagca

SEQ ID NO: 2994767 - RNA, 23 nt, Mycobacterium avium subsp. paratuberculosis
cgccguccuuggccgccagcacc

SEQ ID NO: 2994768 - RNA, 17 nt, Mycobacterium avium subsp. paratuberculosis
cgccguccuuggucaca

SEQ ID NO: 2994769 - RNA, 17 nt, Mycobacterium avium subsp. paratuberculosis
cgccgucgaaggccggg

SEQ ID NO: 2994770 - RNA, 21 nt, Mycobacterium avium subsp. paratuberculosis
cgccgucgaaggccgggcugg

SEQ ID NO: 2994771 - RNA, 13 nt, Mycobacterium avium subsp. paratuberculosis
cgccgucgaccac

SEQ ID NO: 2994772 - RNA, 14 nt, Mycobacterium avium subsp. paratuberculosis
cgccgucgaccacg

SEQ ID NO: 2994773 - RNA, 15 nt, Mycobacterium avium subsp. paratuberculosis
cgccgucgaccacga

SEQ ID NO: 2994774 - RNA, 17 nt, Mycobacterium avium subsp. paratuberculosis
cgccgucgaccagcuug

SEQ ID NO: 2994775 - RNA, 13 nt, Mycobacterium avium subsp. paratuberculosis
cgccgucgacgcg

SEQ ID NO: 2994776 - RNA, 19 nt, Mycobacterium avium subsp. paratuberculosis
cgccgucgacgcgugcguc

SEQ ID NO: 2994777 - RNA, 20 nt, Mycobacterium avium subsp. paratuberculosis
cgccgucgacgcgugcguca

SEQ ID NO: 2994778 - RNA, 20 nt, Mycobacterium avium subsp. paratuberculosis
cgccgucgacggugaucagg

SEQ ID NO: 2994779 - RNA, 23 nt, Mycobacterium avium subsp. paratuberculosis
cgccgucgaggaauccgguccac

SEQ ID NO: 2994780 - RNA, 15 nt, Mycobacterium avium subsp. paratuberculosis
cgccgucgaguccgu

SEQ ID NO: 2994781 - RNA, 14 nt, Mycobacterium avium subsp. paratuberculosis
cgccgucgaugacg

SEQ ID NO: 2994782 - RNA, 20 nt, Mycobacterium avium subsp. paratuberculosis
cgccgucgaugacgcgcuug

SEQ ID NO: 2994783 - RNA, 21 nt, Mycobacterium avium subsp. paratuberculosis
cgccgucgaugcggaucucgg

SEQ ID NO: 2994784 - RNA, 15 nt, Mycobacterium avium subsp. paratuberculosis
cgccgucgauggcgc

SEQ ID NO: 2994785 - RNA, 20 nt, Mycobacterium avium subsp. paratuberculosis
cgccgucgauggcgcggccc

SEQ ID NO: 2994786 - RNA, 21 nt, Mycobacterium avium subsp. paratuberculosis
cgccgucgauggcgcggccca

SEQ ID NO: 2994787 - RNA, 13 nt, Mycobacterium avium subsp. paratuberculosis
cgccgucgccacc

SEQ ID NO: 2994788 - RNA, 15 nt, Mycobacterium avium subsp. paratuberculosis
cgccgucgccaccac

SEQ ID NO: 2994789 - RNA, 16 nt, Mycobacterium avium subsp. paratuberculosis
cgccgucgccaccacc

SEQ ID NO: 2994790 - RNA, 22 nt, Mycobacterium avium subsp. paratuberculosis
cgccgucgccaccaccgcgccg

SEQ ID NO: 2994791 - RNA, 14 nt, Mycobacterium avium subsp. paratuberculosis
cgccgucgccaccg

SEQ ID NO: 2994792 - RNA, 19 nt, Mycobacterium avium subsp. paratuberculosis
cgccgucgccaccgagucg

SEQ ID NO: 2994793 - RNA, 17 nt, Mycobacterium avium subsp. paratuberculosis
cgccgucgccgaucacc

SEQ ID NO: 2994794 - RNA, 15 nt, Mycobacterium avium subsp. paratuberculosis
cgccgucgccgcacg

SEQ ID NO: 2994795 - RNA, 12 nt, Mycobacterium avium subsp. paratuberculosis
cgccgucgccgg

SEQ ID NO: 2994796 - RNA, 22 nt, Mycobacterium avium subsp. paratuberculosis
cgccgugccggaccgcgcgggc

SEQ ID NO: 2994797 - RNA, 15 nt, Mycobacterium avium subsp. paratuberculosis
cgccgugcgccagcg

SEQ ID NO: 2994798 - RNA, 16 nt, Mycobacterium avium subsp. paratuberculosis
cgccgugcgccagcga

SEQ ID NO: 2994799 - RNA, 18 nt, Mycobacterium avium subsp. paratuberculosis
cgccgugcgccagcgacc

SEQ ID NO: 2994800 - RNA, 22 nt, Mycobacterium avium subsp. paratuberculosis
cgccgugcgccagcgaccgcag

SEQ ID NO: 2994801 - RNA, 15 nt, Mycobacterium avium subsp. paratuberculosis
cgccgugcgcggcga

SEQ ID NO: 2994802 - RNA, 19 nt, Mycobacterium avium subsp. paratuberculosis
cgccgugcgcggcgaccac

SEQ ID NO: 2994803 - RNA, 12 nt, Mycobacterium avium subsp. paratuberculosis
cgccgugcugcc

SEQ ID NO: 2994804 - RNA, 22 nt, Mycobacterium avium subsp. paratuberculosis
cgccgugcugccggaacgagcc

SEQ ID NO: 2994805 - RNA, 19 nt, Mycobacterium avium subsp. paratuberculosis
cgccguggaagauguugcc

SEQ ID NO: 2994806 - RNA, 13 nt, Mycobacterium avium subsp. paratuberculosis
cgccguggcaggg

SEQ ID NO: 2994807 - RNA, 15 nt, Mycobacterium avium subsp. paratuberculosis
cgccguggcagggcc

SEQ ID NO: 2994808 - RNA, 21 nt, Mycobacterium avium subsp. paratuberculosis
cgccguggcagggccagcagc

SEQ ID NO: 2994809 - RNA, 23 nt, Mycobacterium avium subsp. paratuberculosis
cgccguggcagggccagcagccc

SEQ ID NO: 2994810 - RNA, 13 nt, Mycobacterium avium subsp. paratuberculosis
cgccguggcccgc

SEQ ID NO: 2994811 - RNA, 15 nt, Mycobacterium avium subsp. paratuberculosis
cgccguggcccgccc

SEQ ID NO: 2994812 - RNA, 17 nt, Mycobacterium avium subsp. paratuberculosis
cgccguggcccggucgg

SEQ ID NO: 2994813 - RNA, 14 nt, Mycobacterium avium subsp. paratuberculosis
cgccguggccgaac

SEQ ID NO: 2994814 - RNA, 15 nt, Mycobacterium avium subsp. paratuberculosis
cgccguggcggcccg

SEQ ID NO: 2994815 - RNA, 16 nt, Mycobacterium avium subsp. paratuberculosis
cgccguggcggcccga

SEQ ID NO: 2994816 - RNA, 18 nt, Mycobacterium avium subsp. paratuberculosis
cgccguggcggcccgacc

SEQ ID NO: 2994817 - RNA, 19 nt, Mycobacterium avium subsp. paratuberculosis
cgccguggcggcccgacca

SEQ ID NO: 2994818 - RNA, 21 nt, Mycobacterium avium subsp. paratuberculosis
cgccguggcggcccgaccagc

SEQ ID NO: 2994819 - RNA, 13 nt, Mycobacterium avium subsp. paratuberculosis
cgccguggcggcg

SEQ ID NO: 2994820 - RNA, 16 nt, Mycobacterium avium subsp. paratuberculosis
cgccguggcggcgggc

SEQ ID NO: 2994821 - RNA, 20 nt, Mycobacterium avium subsp. paratuberculosis
cgccguggcguuacacccgc

SEQ ID NO: 2994822 - RNA, 22 nt, Mycobacterium avium subsp. paratuberculosis
cgccguggcguuacacccgcgg

SEQ ID NO: 2994823 - RNA, 13 nt, Mycobacterium avium subsp. paratuberculosis
cgccgugggcguc

SEQ ID NO: 2994824 - RNA, 14 nt, Mycobacterium avium subsp. paratuberculosis
cgccgugggcguca

SEQ ID NO: 2994825 - RNA, 14 nt, Mycobacterium avium subsp. paratuberculosis
cgccguggucaacg

SEQ ID NO: 2994826 - RNA, 20 nt, Mycobacterium avium subsp. paratuberculosis
cgccgugguccagccggucg

SEQ ID NO: 2994827 - RNA, 23 nt, Mycobacterium avium subsp. paratuberculosis
cgccgugguccagccggucgcag

SEQ ID NO: 2994828 - RNA, 20 nt, Mycobacterium avium subsp. paratuberculosis
cgccguguaggccgcgcugg

SEQ ID NO: 2994829 - RNA, 17 nt, Mycobacterium avium subsp. paratuberculosis
cgccguuccgaugaaga

SEQ ID NO: 2994830 - RNA, 23 nt, Mycobacterium avium subsp. paratuberculosis
cgccguuccgaugaagaacaccc

SEQ ID NO: 2994831 - RNA, 15 nt, Mycobacterium avium subsp. paratuberculosis
cgccguucgccggcg

SEQ ID NO: 2994832 - RNA, 17 nt, Mycobacterium avium subsp. paratuberculosis
cgccguucgccggcgac

SEQ ID NO: 2994833 - RNA, 19 nt, Mycobacterium avium subsp. paratuberculosis
cgccguucgccggcgacgg

SEQ ID NO: 2994834 - RNA, 21 nt, Mycobacterium avium subsp. paratuberculosis
cgccguucgccggcgacggcc

SEQ ID NO: 2994835 - RNA, 16 nt, Mycobacterium avium subsp. paratuberculosis
cgccguucucgcgcag

SEQ ID NO: 2994836 - RNA, 20 nt, Mycobacterium avium subsp. paratuberculosis
cgccguucucgcgcagguca

SEQ ID NO: 2994837 - RNA, 18 nt, Mycobacterium avium subsp. paratuberculosis
cgccguucuugucgaagu

SEQ ID NO: 2994838 - RNA, 19 nt, Mycobacterium avium subsp. paratuberculosis
cgccguugacaccgggugc

SEQ ID NO: 2994839 - RNA, 14 nt, Mycobacterium avium subsp. paratuberculosis
cgccguugaccccg

SEQ ID NO: 2994840 - RNA, 19 nt, Mycobacterium avium subsp. paratuberculosis
cgccguugaccccgacggc

SEQ ID NO: 2994841 - RNA, 21 nt, Mycobacterium avium subsp. paratuberculosis
cgccguugaccccgacggcgc

SEQ ID NO: 2994842 - RNA, 16 nt, Mycobacterium avium subsp. paratuberculosis
cgccguugaccgcggc

SEQ ID NO: 2994843 - RNA, 18 nt, Mycobacterium avium subsp. paratuberculosis
cgccguugaccgcggcga

SEQ ID NO: 2994844 - RNA, 19 nt, Mycobacterium avium subsp. paratuberculosis
cgccguugaccgcggcgau

SEQ ID NO: 2994845 - RNA, 20 nt, Mycobacterium avium subsp. paratuberculosis
cgccguugaccgcggcgaug

SEQ ID NO: 2994846 - RNA, 15 nt, Mycobacterium avium subsp. paratuberculosis
cgccguugaccggcc

SEQ ID NO: 2994847 - RNA, 18 nt, Mycobacterium avium subsp. paratuberculosis
cgccguugaccggccggu

SEQ ID NO: 2994848 - RNA, 14 nt, Mycobacterium avium subsp. paratuberculosis
cgccguugaccggu

SEQ ID NO: 2994849 - RNA, 19 nt, Mycobacterium avium subsp. paratuberculosis
cgccguugauugcgcccgc

SEQ ID NO: 2994850 - RNA, 20 nt, Mycobacterium avium subsp. paratuberculosis
cgccguugauugcgcccgcc

SEQ ID NO: 2994851 - RNA, 21 nt, Mycobacterium avium subsp. paratuberculosis
cgccguugauugcgcccgccg

SEQ ID NO: 2994852 - RNA, 22 nt, Mycobacterium avium subsp. paratuberculosis
cgccguugauugcgcccgccga

SEQ ID NO: 2994853 - RNA, 24 nt, Mycobacterium avium subsp. paratuberculosis
cgccguugauugcgcccgccgaac

SEQ ID NO: 2994854 - RNA, 17 nt, Mycobacterium avium subsp. paratuberculosis
cgccguugccggcccgc

SEQ ID NO: 2994855 - RNA, 18 nt, Mycobacterium avium subsp. paratuberculosis
cgccguugccggcccgca

SEQ ID NO: 2994856 - RNA, 20 nt, Mycobacterium avium subsp. paratuberculosis
cgccguugcgagucaucgcc

SEQ ID NO: 2994857 - RNA, 14 nt, Mycobacterium avium subsp. paratuberculosis
cgccguugcggccc

SEQ ID NO: 2994858 - RNA, 15 nt, Mycobacterium avium subsp. paratuberculosis
cgccguugcggccca

SEQ ID NO: 2994859 - RNA, 18 nt, Mycobacterium avium subsp. paratuberculosis
cgccguugcggcccacgg

SEQ ID NO: 2994860 - RNA, 21 nt, Mycobacterium avium subsp. paratuberculosis
cgccguugcggcccacgguga

SEQ ID NO: 2994861 - RNA, 15 nt, Mycobacterium avium subsp. paratuberculosis
cgccguugcgggucg

SEQ ID NO: 2994862 - RNA, 20 nt, Mycobacterium avium subsp. paratuberculosis
cgccguugcggugcucgucg

SEQ ID NO: 2994863 - RNA, 21 nt, Mycobacterium avium subsp. paratuberculosis
cgccguugcggugcucgucga

SEQ ID NO: 2994864 - RNA, 14 nt, Mycobacterium avium subsp. paratuberculosis
cgccguuggcgugg

SEQ ID NO: 2994865 - RNA, 17 nt, Mycobacterium avium subsp. paratuberculosis
cgccguuggcguggaug

SEQ ID NO: 2994866 - RNA, 20 nt, Mycobacterium avium subsp. paratuberculosis
cgccguuggcguggauggcc

SEQ ID NO: 2994867 - RNA, 22 nt, Mycobacterium avium subsp. paratuberculosis
cgccguuggcguggauggccgg

SEQ ID NO: 2994868 - RNA, 23 nt, Mycobacterium avium subsp. paratuberculosis
cgccguuggcguggauggccggc

SEQ ID NO: 2994869 - RNA, 21 nt, Mycobacterium avium subsp. paratuberculosis
cgccguuguaggccgcgcggu

SEQ ID NO: 2994870 - RNA, 22 nt, Mycobacterium avium subsp. paratuberculosis
cgccguuguaggccgcgcggug

SEQ ID NO: 2994871 - RNA, 23 nt, Mycobacterium avium subsp. paratuberculosis
cgccguuguaggccgcgcggugc

SEQ ID NO: 2994872 - RNA, 23 nt, Mycobacterium avium subsp. paratuberculosis
cgccguuguugagcguggcagcg

SEQ ID NO: 2994873 - RNA, 15 nt, Mycobacterium avium subsp. paratuberculosis
cgccguuguugagga

SEQ ID NO: 2994874 - RNA, 21 nt, Mycobacterium avium subsp. paratuberculosis
cgccguuguugaggaugacga

SEQ ID NO: 2994875 - RNA, 12 nt, Mycobacterium avium subsp. paratuberculosis
cgccguuucagc

SEQ ID NO: 2994876 - RNA, 15 nt, Mycobacterium avium subsp. paratuberculosis
cgccguuucagcagc

SEQ ID NO: 2994877 - RNA, 17 nt, Mycobacterium avium subsp. paratuberculosis
cgccguuucagcagcgc

SEQ ID NO: 2994878 - RNA, 19 nt, Mycobacterium avium subsp. paratuberculosis
cgccguuucagcagcgcgu

SEQ ID NO: 2994879 - RNA, 23 nt, Mycobacterium avium subsp. paratuberculosis
cgccguuucagcagcgcguaggu

SEQ ID NO: 2994880 - RNA, 16 nt, Mycobacterium avium subsp. paratuberculosis
cgccucgaugcgggug

SEQ ID NO: 2994881 - RNA, 17 nt, Mycobacterium avium subsp. paratuberculosis
cgccucgauggcccgcu

SEQ ID NO: 2994882 - RNA, 20 nt, Mycobacterium avium subsp. paratuberculosis
cgccucgauggcccgcucgg

SEQ ID NO: 2994883 - RNA, 21 nt, Mycobacterium avium subsp. paratuberculosis
cgccucgauggcccgcucggu

SEQ ID NO: 2994884 - RNA, 18 nt, Mycobacterium avium subsp. paratuberculosis
cgccucgcagcgacaauc

SEQ ID NO: 2994885 - RNA, 14 nt, Mycobacterium avium subsp. paratuberculosis
cgccucgccagccc

SEQ ID NO: 2994886 - RNA, 15 nt, Mycobacterium avium subsp. paratuberculosis
cgccucgccagcccc

SEQ ID NO: 2994887 - RNA, 20 nt, Mycobacterium avium subsp. paratuberculosis
cgccucgccagccccaccgg

SEQ ID NO: 2994888 - RNA, 14 nt, Mycobacterium avium subsp. paratuberculosis
cgccucgcccucgg

SEQ ID NO: 2994889 - RNA, 13 nt, Mycobacterium avium subsp. paratuberculosis
cgccucgccgacc

SEQ ID NO: 2994890 - RNA, 23 nt, Mycobacterium avium subsp. paratuberculosis
cgccucgccgaccuuggcguugu

SEQ ID NO: 2994891 - RNA, 13 nt, Mycobacterium avium subsp. paratuberculosis
cgccucgccgggc

SEQ ID NO: 2994892 - RNA, 16 nt, Mycobacterium avium subsp. paratuberculosis
cgccucgccgggcccg

SEQ ID NO: 2994893 - RNA, 16 nt, Mycobacterium avium subsp. paratuberculosis
cgccucgccggucacc

SEQ ID NO: 2994894 - RNA, 12 nt, Mycobacterium avium subsp. paratuberculosis
cgccucgcgcag

SEQ ID NO: 2994895 - RNA, 17 nt, Mycobacterium avium subsp. paratuberculosis
cgccucgcgcagcgcgu

SEQ ID NO: 2994896 - RNA, 19 nt, Mycobacterium avium subsp. paratuberculosis
cgccucgcgcagcgcgucg

SEQ ID NO: 2994897 - RNA, 16 nt, Mycobacterium avium subsp. paratuberculosis
cgccucgcggucgacg

SEQ ID NO: 2994898 - RNA, 18 nt, Mycobacterium avium subsp. paratuberculosis
cgccucgcguacccgggc

SEQ ID NO: 2994899 - RNA, 21 nt, Mycobacterium avium subsp. paratuberculosis
cgccucgcuaaucgccgcgcg

SEQ ID NO: 2994900 - RNA, 17 nt, Mycobacterium avium subsp. paratuberculosis
cgccucggaggccaccg

SEQ ID NO: 2994901 - RNA, 18 nt, Mycobacterium avium subsp. paratuberculosis
cgccucggaggccaccgc

SEQ ID NO: 2994902 - RNA, 19 nt, Mycobacterium avium subsp. paratuberculosis
cgccucggaggccaccgcg

SEQ ID NO: 2994903 - RNA, 20 nt, Mycobacterium avium subsp. paratuberculosis
cgccucggaggccaccgcgc

SEQ ID NO: 2994904 - RNA, 12 nt, Mycobacterium avium subsp. paratuberculosis
cgccucggccac

SEQ ID NO: 2994905 - RNA, 14 nt, Mycobacterium avium subsp. paratuberculosis
cgccucggccacca

SEQ ID NO: 2994906 - RNA, 16 nt, Mycobacterium avium subsp. paratuberculosis
cgccucggccaccaga

SEQ ID NO: 2994907 - RNA, 17 nt, Mycobacterium avium subsp. paratuberculosis
cgccucggccaccagau

SEQ ID NO: 2994908 - RNA, 14 nt, Mycobacterium avium subsp. paratuberculosis
cgccucggccgcgg

SEQ ID NO: 2994909 - RNA, 14 nt, Mycobacterium avium subsp. paratuberculosis
cgccucggccucgu

SEQ ID NO: 2994910 - RNA, 16 nt, Mycobacterium avium subsp. paratuberculosis
cgccucggccucgucg

SEQ ID NO: 2994911 - RNA, 23 nt, Mycobacterium avium subsp. paratuberculosis
cgccucggccuuggccaccgccu

SEQ ID NO: 2994912 - RNA, 12 nt, Mycobacterium avium subsp. paratuberculosis
cgccucggcgag

SEQ ID NO: 2994913 - RNA, 17 nt, Mycobacterium avium subsp. paratuberculosis
cgccucggcgagccgcu

SEQ ID NO: 2994914 - RNA, 13 nt, Mycobacterium avium subsp. paratuberculosis
cgccucggcgagg

SEQ ID NO: 2994915 - RNA, 16 nt, Mycobacterium avium subsp. paratuberculosis
cgccucggcgaggucg

SEQ ID NO: 2994916 - RNA, 18 nt, Mycobacterium avium subsp. paratuberculosis
cgccucggcgaggucguc

SEQ ID NO: 2994917 - RNA, 13 nt, Mycobacterium avium subsp. paratuberculosis
cgccucggcgauc

SEQ ID NO: 2994918 - RNA, 14 nt, Mycobacterium avium subsp. paratuberculosis
cgccucggcgaucg

SEQ ID NO: 2994919 - RNA, 17 nt, Mycobacterium avium subsp. paratuberculosis
cgccucggcgaucggcc

SEQ ID NO: 2994920 - RNA, 18 nt, Mycobacterium avium subsp. paratuberculosis
cgccucggcgaucggccg

SEQ ID NO: 2994921 - RNA, 17 nt, Mycobacterium avium subsp. paratuberculosis
cgccucggcgccucggc

SEQ ID NO: 2994922 - RNA, 20 nt, Mycobacterium avium subsp. paratuberculosis
cgccucggcgccucggcguc

SEQ ID NO: 2994923 - RNA, 21 nt, Mycobacterium avium subsp. paratuberculosis
cgccucggcgccucggcgucc

SEQ ID NO: 2994924 - RNA, 15 nt, Mycobacterium avium subsp. paratuberculosis
cgccucggcggaguc

SEQ ID NO: 2994925 - RNA, 12 nt, Mycobacterium avium subsp. paratuberculosis
cgccucggcggc

SEQ ID NO: 2994926 - RNA, 13 nt, Mycobacterium avium subsp. paratuberculosis
cgccucggcggcc

SEQ ID NO: 2994927 - RNA, 16 nt, Mycobacterium avium subsp. paratuberculosis
cgccucggcggccccu

SEQ ID NO: 2994928 - RNA, 14 nt, Mycobacterium avium subsp. paratuberculosis
cgccucggcggccg

SEQ ID NO: 2994929 - RNA, 15 nt, Mycobacterium avium subsp. paratuberculosis
cgccucggcggccgc

SEQ ID NO: 2994930 - RNA, 16 nt, Mycobacterium avium subsp. paratuberculosis
cgccucggcggccgcc

SEQ ID NO: 2994931 - RNA, 17 nt, Mycobacterium avium subsp. paratuberculosis
cgccucggcggccgccc

SEQ ID NO: 2994932 - RNA, 21 nt, Mycobacterium avium subsp. paratuberculosis
cgccucggcggccgcccgggc

SEQ ID NO: 2994933 - RNA, 22 nt, Mycobacterium avium subsp. paratuberculosis
cgccucggcggccgcccgggcg

SEQ ID NO: 2994934 - RNA, 16 nt, Mycobacterium avium subsp. paratuberculosis
cgccucggcgggccgc

SEQ ID NO: 2994935 - RNA, 20 nt, Mycobacterium avium subsp. paratuberculosis
cgccucggcgggccgcccgg

SEQ ID NO: 2994936 - RNA, 21 nt, Mycobacterium avium subsp. paratuberculosis
cgccucggcgggccgcccggc

SEQ ID NO: 2994937 - RNA, 11 nt, Mycobacterium avium subsp. paratuberculosis
cgccucggcgu

SEQ ID NO: 2994938 - RNA, 13 nt, Mycobacterium avium subsp. paratuberculosis
cgccucggcgucc

SEQ ID NO: 2994939 - RNA, 16 nt, Mycobacterium avium subsp. paratuberculosis
cgccucggcgucccgg

SEQ ID NO: 2994940 - RNA, 12 nt, Mycobacterium avium subsp. paratuberculosis
cgccucggcgug

SEQ ID NO: 2994941 - RNA, 13 nt, Mycobacterium avium subsp. paratuberculosis
cgccucggcgugg

SEQ ID NO: 2994942 - RNA, 15 nt, Mycobacterium avium subsp. paratuberculosis
cgccucgggccggca

SEQ ID NO: 2994943 - RNA, 16 nt, Mycobacterium avium subsp. paratuberculosis
cgccucgggccggcag

SEQ ID NO: 2994944 - RNA, 17 nt, Mycobacterium avium subsp. paratuberculosis
cgccucgggccggcagc

SEQ ID NO: 2994945 - RNA, 19 nt, Mycobacterium avium subsp. paratuberculosis
cgccucgggccggcagccg

SEQ ID NO: 2994946 - RNA, 17 nt, Mycobacterium avium subsp. paratuberculosis
cgccucggucugggcga

SEQ ID NO: 2994947 - RNA, 19 nt, Mycobacterium avium subsp. paratuberculosis
cgccucggugaagccgcgg

SEQ ID NO: 2994948 - RNA, 21 nt, Mycobacterium avium subsp. paratuberculosis
cgccucggugcggaacaccgc

SEQ ID NO: 2994949 - RNA, 20 nt, Mycobacterium avium subsp. paratuberculosis
cgccucgguggucgacgagc

SEQ ID NO: 2994950 - RNA, 24 nt, Mycobacterium avium subsp. paratuberculosis
cgccucgguggucgacgagcccgc

SEQ ID NO: 2994951 - RNA, 16 nt, Mycobacterium avium subsp. paratuberculosis
cgccucgguugaucag

SEQ ID NO: 2994952 - RNA, 14 nt, Mycobacterium avium subsp. paratuberculosis
cgccucgucgaccg

SEQ ID NO: 2994953 - RNA, 17 nt, Mycobacterium avium subsp. paratuberculosis
cgccucgucgaccgcgg

SEQ ID NO: 2994954 - RNA, 18 nt, Mycobacterium avium subsp. paratuberculosis
cgccucgucgaccgcggc

SEQ ID NO: 2994955 - RNA, 21 nt, Mycobacterium avium subsp. paratuberculosis
cgccucgucgaccgcggccug

SEQ ID NO: 2994956 - RNA, 13 nt, Mycobacterium avium subsp. paratuberculosis
cgccucgucgagc

SEQ ID NO: 2994957 - RNA, 23 nt, Mycobacterium avium subsp. paratuberculosis
cgccucgucgagcagcgcccggc

SEQ ID NO: 2994958 - RNA, 15 nt, Mycobacterium avium subsp. paratuberculosis
cgccucgucgggaac

SEQ ID NO: 2994959 - RNA, 22 nt, Mycobacterium avium subsp. paratuberculosis
cgccucgugcaugugcucggcg

SEQ ID NO: 2994960 - RNA, 22 nt, Mycobacterium avium subsp. paratuberculosis
cgccucguucgaguaggcgacc

SEQ ID NO: 2994961 - RNA, 21 nt, Mycobacterium avium subsp. paratuberculosis
cgccucguugagcacaaagcc

SEQ ID NO: 2994962 - RNA, 20 nt, Mycobacterium avium subsp. paratuberculosis
cgccucguuggccagcucgg

SEQ ID NO: 2994963 - RNA, 19 nt, Mycobacterium avium subsp. paratuberculosis
cgccugagcaaccgguucg

SEQ ID NO: 2994964 - RNA, 14 nt, Mycobacterium avium subsp. paratuberculosis
cgccugagcccgcc

SEQ ID NO: 2994965 - RNA, 19 nt, Mycobacterium avium subsp. paratuberculosis
cgcgaaaauaccgccggcc

SEQ ID NO: 2994966 - RNA, 16 nt, Mycobacterium avium subsp. paratuberculosis
cgcgaaaaucgguggu

SEQ ID NO: 2994967 - RNA, 15 nt, Mycobacterium avium subsp. paratuberculosis
cgcgaaacccccggg

SEQ ID NO: 2994968 - RNA, 23 nt, Mycobacterium avium subsp. paratuberculosis
cgcgaaacgcaacagcgagucgg

SEQ ID NO: 2994969 - RNA, 23 nt, Mycobacterium avium subsp. paratuberculosis
cgcgaaagcagcguucggucagc

SEQ ID NO: 2994970 - RNA, 22 nt, Mycobacterium avium subsp. paratuberculosis
cgcgaaagcgucggcuagcggc

SEQ ID NO: 2994971 - RNA, 17 nt, Mycobacterium avium subsp. paratuberculosis
cgcgaaaggcccaccgc

SEQ ID NO: 2994972 - RNA, 18 nt, Mycobacterium avium subsp. paratuberculosis
cgcgaaagugcuacugcc

SEQ ID NO: 2994973 - RNA, 21 nt, Mycobacterium avium subsp. paratuberculosis
cgcgaaauacgacgagccgac

SEQ ID NO: 2994974 - RNA, 19 nt, Mycobacterium avium subsp. paratuberculosis
cgcgaaaucuucgccguca

SEQ ID NO: 2994975 - RNA, 17 nt, Mycobacterium avium subsp. paratuberculosis
cgcgaacaaucgcugcg

SEQ ID NO: 2994976 - RNA, 20 nt, Mycobacterium avium subsp. paratuberculosis
cgcgaacaaucgcugcgagc

SEQ ID NO: 2994977 - RNA, 16 nt, Mycobacterium avium subsp. paratuberculosis
cgcgaacagcgccgac

SEQ ID NO: 2994978 - RNA, 15 nt, Mycobacterium avium subsp. paratuberculosis
cgcgaacagcgcggc

SEQ ID NO: 2994979 - RNA, 16 nt, Mycobacterium avium subsp. paratuberculosis
cgcgaacagcgcggcc

SEQ ID NO: 2994980 - RNA, 17 nt, Mycobacterium avium subsp. paratuberculosis
cgcgaacagcgcggcca

SEQ ID NO: 2994981 - RNA, 18 nt, Mycobacterium avium subsp. paratuberculosis
cgcgaacagcgcggccac

SEQ ID NO: 2994982 - RNA, 20 nt, Mycobacterium avium subsp. paratuberculosis
cgcgaacagcgcggccacca

SEQ ID NO: 2994983 - RNA, 22 nt, Mycobacterium avium subsp. paratuberculosis
cgcgaacagcgcggccaccacg

SEQ ID NO: 2994984 - RNA, 14 nt, Mycobacterium avium subsp. paratuberculosis
cgcgaacagguccu

SEQ ID NO: 2994985 - RNA, 22 nt, Mycobacterium avium subsp. paratuberculosis
cgcgaacagguccuugcccagc

SEQ ID NO: 2994986 - RNA, 13 nt, Mycobacterium avium subsp. paratuberculosis
cgcgaacaucgcc

SEQ ID NO: 2994987 - RNA, 14 nt, Mycobacterium avium subsp. paratuberculosis
cgcgaacaucgcca

SEQ ID NO: 2994988 - RNA, 19 nt, Mycobacterium avium subsp. paratuberculosis
cgcgaacaucgccagcaac

SEQ ID NO: 2994989 - RNA, 12 nt, Mycobacterium avium subsp. paratuberculosis
cgcgaaccgggc

SEQ ID NO: 2994990 - RNA, 19 nt, Mycobacterium avium subsp. paratuberculosis
cgcgaaccgggccaggaug

SEQ ID NO: 2994991 - RNA, 14 nt, Mycobacterium avium subsp. paratuberculosis
cgcgaacgacgacc

SEQ ID NO: 2994992 - RNA, 14 nt, Mycobacterium avium subsp. paratuberculosis
cgcgaacgcgcccc

SEQ ID NO: 2994993 - RNA, 15 nt, Mycobacterium avium subsp. paratuberculosis
cgcgaacgcgccccg

SEQ ID NO: 2994994 - RNA, 17 nt, Mycobacterium avium subsp. paratuberculosis
cgcgaacgcgccccgcc

SEQ ID NO: 2994995 - RNA, 19 nt, Mycobacterium avium subsp. paratuberculosis
cgcgaacgcgccccgccgg

SEQ ID NO: 2994996 - RNA, 13 nt, Mycobacterium avium subsp. paratuberculosis
cgcgaacgcgccg

SEQ ID NO: 2994997 - RNA, 14 nt, Mycobacterium avium subsp. paratuberculosis
cgcgaacgcgccgg

SEQ ID NO: 2994998 - RNA, 16 nt, Mycobacterium avium subsp. paratuberculosis
cgcgaacgcgccggug

SEQ ID NO: 2994999 - RNA, 19 nt, Mycobacterium avium subsp. paratuberculosis
cgcgaacgcgccggugacc

SEQ ID NO: 2995000 - RNA, 13 nt, Mycobacterium avium subsp. paratuberculosis
cgcgaacggcccg

SEQ ID NO: 2995001 - RNA, 16 nt, Mycobacterium avium subsp. paratuberculosis
cgcgaacggcccgccg

SEQ ID NO: 2995002 - RNA, 17 nt, Mycobacterium avium subsp. paratuberculosis
cgcgaacggcccgccgc

SEQ ID NO: 2995003 - RNA, 19 nt, Mycobacterium avium subsp. paratuberculosis
cgcgaacggcccgccgccg

SEQ ID NO: 2995004 - RNA, 20 nt, Mycobacterium avium subsp. paratuberculosis
cgcgaacggcccgccgccgg

SEQ ID NO: 2995005 - RNA, 14 nt, Mycobacterium avium subsp. paratuberculosis
cgcgaacgggucgg

SEQ ID NO: 2995006 - RNA, 23 nt, Mycobacterium avium subsp. paratuberculosis
cgcgaacgggugaccggcggcca

SEQ ID NO: 2995007 - RNA, 16 nt, Mycobacterium avium subsp. paratuberculosis
cgcgaacgggugcggc

SEQ ID NO: 2995008 - RNA, 19 nt, Mycobacterium avium subsp. paratuberculosis
cgcgaacgggugcggcgcu

SEQ ID NO: 2995009 - RNA, 23 nt, Mycobacterium avium subsp. paratuberculosis
cgcgaacgggugcggcgcucggu

SEQ ID NO: 2995010 - RNA, 24 nt, Mycobacterium avium subsp. paratuberculosis
cgcgaacgggugcggcgcucggug

SEQ ID NO: 2995011 - RNA, 18 nt, Mycobacterium avium subsp. paratuberculosis
cgcgaacgucucgcggga

SEQ ID NO: 2995012 - RNA, 17 nt, Mycobacterium avium subsp. paratuberculosis
cgcgaacucaggcgcgc

SEQ ID NO: 2995013 - RNA, 18 nt, Mycobacterium avium subsp. paratuberculosis
cgcgaacucaggcgcgca

SEQ ID NO: 2995014 - RNA, 19 nt, Mycobacterium avium subsp. paratuberculosis
cgcgaacucaggcgcgcac

SEQ ID NO: 2995015 - RNA, 15 nt, Mycobacterium avium subsp. paratuberculosis
cgcgaacucgucgau

SEQ ID NO: 2995016 - RNA, 17 nt, Mycobacterium avium subsp. paratuberculosis
cgcgaacucgucgaugc

SEQ ID NO: 2995017 - RNA, 16 nt, Mycobacterium avium subsp. paratuberculosis
cgcgaacuucaggccc

SEQ ID NO: 2995018 - RNA, 19 nt, Mycobacterium avium subsp. paratuberculosis
cgcgaacuucaggcccuca

SEQ ID NO: 2995019 - RNA, 17 nt, Mycobacterium avium subsp. paratuberculosis
cgcgaagaacgacgcca

SEQ ID NO: 2995020 - RNA, 18 nt, Mycobacterium avium subsp. paratuberculosis
cgcgaagaacgacgccac

SEQ ID NO: 2995021 - RNA, 19 nt, Mycobacterium avium subsp. paratuberculosis
cgcgaagaacgacgccacc

SEQ ID NO: 2995022 - RNA, 14 nt, Mycobacterium avium subsp. paratuberculosis
cgcgaagaccagcg

SEQ ID NO: 2995023 - RNA, 17 nt, Mycobacterium avium subsp. paratuberculosis
cgcgaagaccagcgugu

SEQ ID NO: 2995024 - RNA, 19 nt, Mycobacterium avium subsp. paratuberculosis
cgcgaagacgcuggccacg

SEQ ID NO: 2995025 - RNA, 22 nt, Mycobacterium avium subsp. paratuberculosis
cgcgaagacgcuggccacgauc

SEQ ID NO: 2995026 - RNA, 20 nt, Mycobacterium avium subsp. paratuberculosis
cgcgaagcccucgaagcaga

SEQ ID NO: 2995027 - RNA, 18 nt, Mycobacterium avium subsp. paratuberculosis
cgcgaagcgcgaugcggc

SEQ ID NO: 2995028 - RNA, 21 nt, Mycobacterium avium subsp. paratuberculosis
cgcgaagcguaugccgguggc

SEQ ID NO: 2995029 - RNA, 15 nt, Mycobacterium avium subsp. paratuberculosis
cgcgaaggcggcguc

SEQ ID NO: 2995030 - RNA, 16 nt, Mycobacterium avium subsp. paratuberculosis
cgcgaagguggcgccg

SEQ ID NO: 2995031 - RNA, 17 nt, Mycobacterium avium subsp. paratuberculosis
cgcgaagguggcgccgg

SEQ ID NO: 2995032 - RNA, 19 nt, Mycobacterium avium subsp. paratuberculosis
cgcgaagguggcgccggua

SEQ ID NO: 2995033 - RNA, 20 nt, Mycobacterium avium subsp. paratuberculosis
cgcgaagucccacugcccgu

SEQ ID NO: 2995034 - RNA, 15 nt, Mycobacterium avium subsp. paratuberculosis
cgcgaagucgagcag

SEQ ID NO: 2995035 - RNA, 16 nt, Mycobacterium avium subsp. paratuberculosis
cgcgaagucgccgccc

SEQ ID NO: 2995036 - RNA, 18 nt, Mycobacterium avium subsp. paratuberculosis
cgcgaagucgccgcccgg

SEQ ID NO: 2995037 - RNA, 15 nt, Mycobacterium avium subsp. paratuberculosis
cgcgaaucgauaacg

SEQ ID NO: 2995038 - RNA, 21 nt, Mycobacterium avium subsp. paratuberculosis
cgcgaaugucgaccaccgggu

SEQ ID NO: 2995039 - RNA, 18 nt, Mycobacterium avium subsp. paratuberculosis
cgcgaauuccucagcgcc

SEQ ID NO: 2995040 - RNA, 20 nt, Mycobacterium avium subsp. paratuberculosis
cgcgaauuccucagcgcccc

SEQ ID NO: 2995041 - RNA, 17 nt, Mycobacterium avium subsp. paratuberculosis
cgcgacaaggucgaccg

SEQ ID NO: 2995042 - RNA, 20 nt, Mycobacterium avium subsp. paratuberculosis
cgcgacaaggucgaccgcgc

SEQ ID NO: 2995043 - RNA, 21 nt, Mycobacterium avium subsp. paratuberculosis
cgcgacaaggucgaccgcgca

SEQ ID NO: 2995044 - RNA, 22 nt, Mycobacterium avium subsp. paratuberculosis
cgcgacaaggucgaccgcgcac

SEQ ID NO: 2995045 - RNA, 17 nt, Mycobacterium avium subsp. paratuberculosis
cgcgacacccgcgacga

SEQ ID NO: 2995046 - RNA, 16 nt, Mycobacterium avium subsp. paratuberculosis
cgcgacaccggacugc

SEQ ID NO: 2995047 - RNA, 16 nt, Mycobacterium avium subsp. paratuberculosis
cgcgacacgccgcgca

SEQ ID NO: 2995048 - RNA, 18 nt, Mycobacterium avium subsp. paratuberculosis
cgcgacacgccgcgcauc

SEQ ID NO: 2995049 - RNA, 23 nt, Mycobacterium avium subsp. paratuberculosis
cgcgacgacaccaccgugcuggc

SEQ ID NO: 2995050 - RNA, 16 nt, Mycobacterium avium subsp. paratuberculosis
cgcgacgacaccgugu

SEQ ID NO: 2995051 - RNA, 15 nt, Mycobacterium avium subsp. paratuberculosis
cgcgacgaccgccug

SEQ ID NO: 2995052 - RNA, 23 nt, Mycobacterium avium subsp. paratuberculosis
cgcgacgacgaaaaugaugccga

SEQ ID NO: 2995053 - RNA, 12 nt, Mycobacterium avium subsp. paratuberculosis
cgcgacgagcgg

SEQ ID NO: 2995054 - RNA, 14 nt, Mycobacterium avium subsp. paratuberculosis
cgcgacgagcgggc

SEQ ID NO: 2995055 - RNA, 20 nt, Mycobacterium avium subsp. paratuberculosis
cgcgacgagcgggccgauca

SEQ ID NO: 2995056 - RNA, 12 nt, Mycobacterium avium subsp. paratuberculosis
cgcgacgaucac

SEQ ID NO: 2995057 - RNA, 17 nt, Mycobacterium avium subsp. paratuberculosis
cgcgacgaucagcagcc

SEQ ID NO: 2995058 - RNA, 19 nt, Mycobacterium avium subsp. paratuberculosis
cgcgacgaucagcagccgg

SEQ ID NO: 2995059 - RNA, 17 nt, Mycobacterium avium subsp. paratuberculosis
cgcgacgaucgcgacgg

SEQ ID NO: 2995060 - RNA, 18 nt, Mycobacterium avium subsp. paratuberculosis
cgcgacgaucgcgacggc

SEQ ID NO: 2995061 - RNA, 19 nt, Mycobacterium avium subsp. paratuberculosis
cgcgacgaucgcgacggcc

SEQ ID NO: 2995062 - RNA, 21 nt, Mycobacterium avium subsp. paratuberculosis
cgcgacgaucgcgacggccgg

SEQ ID NO: 2995063 - RNA, 17 nt, Mycobacterium avium subsp. paratuberculosis
cgcgacgaugccggcgu

SEQ ID NO: 2995064 - RNA, 19 nt, Mycobacterium avium subsp. paratuberculosis
cgcgacgaugccggcgucg

SEQ ID NO: 2995065 - RNA, 23 nt, Mycobacterium avium subsp. paratuberculosis
cgcgacgaugccggcgucgucgu

SEQ ID NO: 2995066 - RNA, 17 nt, Mycobacterium avium subsp. paratuberculosis
cgcgacgaugucgaccc

SEQ ID NO: 2995067 - RNA, 19 nt, Mycobacterium avium subsp. paratuberculosis
cgcgacgaugucgacccgc

SEQ ID NO: 2995068 - RNA, 14 nt, Mycobacterium avium subsp. paratuberculosis
cgcgacgcacgccg

SEQ ID NO: 2995069 - RNA, 15 nt, Mycobacterium avium subsp. paratuberculosis
cgcgacgcacgccgg

SEQ ID NO: 2995070 - RNA, 19 nt, Mycobacterium avium subsp. paratuberculosis
cgcgacgccagcaccuucg

SEQ ID NO: 2995071 - RNA, 22 nt, Mycobacterium avium subsp. paratuberculosis
cgcgacgccagcaccuucgggc

SEQ ID NO: 2995072 - RNA, 14 nt, Mycobacterium avium subsp. paratuberculosis
cgcgacgcccaggu

SEQ ID NO: 2995073 - RNA, 11 nt, Mycobacterium avium subsp. paratuberculosis
cgcgacgccga

SEQ ID NO: 2995074 - RNA, 15 nt, Mycobacterium avium subsp. paratuberculosis
cgcgacgccgacgcc

SEQ ID NO: 2995075 - RNA, 13 nt, Mycobacterium avium subsp. paratuberculosis
cgcgacgccgccg

SEQ ID NO: 2995076 - RNA, 15 nt, Mycobacterium avium subsp. paratuberculosis
cgcgacgccgccgcc

SEQ ID NO: 2995077 - RNA, 16 nt, Mycobacterium avium subsp. paratuberculosis
cgcgacgccgccgccg

SEQ ID NO: 2995078 - RNA, 19 nt, Mycobacterium avium subsp. paratuberculosis
cgcgacgccgucaucccca

SEQ ID NO: 2995079 - RNA, 12 nt, Mycobacterium avium subsp. paratuberculosis
cgcgacgccgug

SEQ ID NO: 2995080 - RNA, 13 nt, Mycobacterium avium subsp. paratuberculosis
cgcgacgccgugc

SEQ ID NO: 2995081 - RNA, 15 nt, Mycobacterium avium subsp. paratuberculosis
cgcgacgcgaucgag

SEQ ID NO: 2995082 - RNA, 18 nt, Mycobacterium avium subsp. paratuberculosis
cgcgacgcgcaugcccug

SEQ ID NO: 2995083 - RNA, 14 nt, Mycobacterium avium subsp. paratuberculosis
cgcgacgcgcgguc

SEQ ID NO: 2995084 - RNA, 14 nt, Mycobacterium avium subsp. paratuberculosis
cgcgacgcgcucgg

SEQ ID NO: 2995085 - RNA, 16 nt, Mycobacterium avium subsp. paratuberculosis
cgcgacgcgcucggcg

SEQ ID NO: 2995086 - RNA, 17 nt, Mycobacterium avium subsp. paratuberculosis
cgcgacgcgcucggcga

SEQ ID NO: 2995087 - RNA, 19 nt, Mycobacterium avium subsp. paratuberculosis
cgcgacgcgcucggcgacc

SEQ ID NO: 2995088 - RNA, 21 nt, Mycobacterium avium subsp. paratuberculosis
cgcgacgcgcucggcgaccgc

SEQ ID NO: 2995089 - RNA, 23 nt, Mycobacterium avium subsp. paratuberculosis
cgcgacgcggcucgcgcgguguu

SEQ ID NO: 2995090 - RNA, 17 nt, Mycobacterium avium subsp. paratuberculosis
cgcgacgcugagcgcca

SEQ ID NO: 2995091 - RNA, 18 nt, Mycobacterium avium subsp. paratuberculosis
cgcgacgcugagcgccag

SEQ ID NO: 2995092 - RNA, 21 nt, Mycobacterium avium subsp. paratuberculosis
cgcgacgcugagcgccaggcc

SEQ ID NO: 2995093 - RNA, 21 nt, Mycobacterium avium subsp. paratuberculosis
cgcgacgcugauggcgaggaa

SEQ ID NO: 2995094 - RNA, 18 nt, Mycobacterium avium subsp. paratuberculosis
cgcgacgcugccggggcg

SEQ ID NO: 2995095 - RNA, 22 nt, Mycobacterium avium subsp. paratuberculosis
cgcgacgcugccggggcgcagc

SEQ ID NO: 2995096 - RNA, 15 nt, Mycobacterium avium subsp. paratuberculosis
cgcgacgcugccggu

SEQ ID NO: 2995097 - RNA, 16 nt, Mycobacterium avium subsp. paratuberculosis
cgcgacgcugccggug

SEQ ID NO: 2995098 - RNA, 16 nt, Mycobacterium avium subsp. paratuberculosis
cgcgacggcccggucc

SEQ ID NO: 2995099 - RNA, 11 nt, Mycobacterium avium subsp. paratuberculosis
cgcgacggccg

SEQ ID NO: 2995100 - RNA, 14 nt, Mycobacterium avium subsp. paratuberculosis
cgcgacggccgccg

SEQ ID NO: 2995101 - RNA, 13 nt, Mycobacterium avium subsp. paratuberculosis
cgcgacggccggg

SEQ ID NO: 2995102 - RNA, 16 nt, Mycobacterium avium subsp. paratuberculosis
cgcgacggccggggcc

SEQ ID NO: 2995103 - RNA, 22 nt, Mycobacterium avium subsp. paratuberculosis
cgcgacggccggggccagcacc

SEQ ID NO: 2995104 - RNA, 17 nt, Mycobacterium avium subsp. paratuberculosis
cgcgacggccucgccgu

SEQ ID NO: 2995105 - RNA, 19 nt, Mycobacterium avium subsp. paratuberculosis
cgcgacggcgagccgggcc

SEQ ID NO: 2995106 - RNA, 20 nt, Mycobacterium avium subsp. paratuberculosis
cgcgacggcgagccgggccg

SEQ ID NO: 2995107 - RNA, 23 nt, Mycobacterium avium subsp. paratuberculosis
cgcgacggcgagccgggccgggu

SEQ ID NO: 2995108 - RNA, 11 nt, Mycobacterium avium subsp. paratuberculosis
cgcgacggcgc

SEQ ID NO: 2995109 - RNA, 13 nt, Mycobacterium avium subsp. paratuberculosis
cgcgacggcgccc

SEQ ID NO: 2995110 - RNA, 14 nt, Mycobacterium avium subsp. paratuberculosis
cgcgacggcgcccg

SEQ ID NO: 2995111 - RNA, 13 nt, Mycobacterium avium subsp. paratuberculosis
cgcgacggcggcg

SEQ ID NO: 2995112 - RNA, 23 nt, Mycobacterium avium subsp. paratuberculosis
cgcgacggcggcgaagacgucgg

SEQ ID NO: 2995113 - RNA, 13 nt, Mycobacterium avium subsp. paratuberculosis
cgcgacggcgggu

SEQ ID NO: 2995114 - RNA, 13 nt, Mycobacterium avium subsp. paratuberculosis
cgcgacgggcacc

SEQ ID NO: 2995115 - RNA, 16 nt, Mycobacterium avium subsp. paratuberculosis
cgcgacgggcacccgc

SEQ ID NO: 2995116 - RNA, 18 nt, Mycobacterium avium subsp. paratuberculosis
cgcgacgggcacccgcgc

SEQ ID NO: 2995117 - RNA, 21 nt, Mycobacterium avium subsp. paratuberculosis
cgcgacgggcacccgcgcguc

SEQ ID NO: 2995118 - RNA, 19 nt, Mycobacterium avium subsp. paratuberculosis
cgcgacgggcaugccgucg

SEQ ID NO: 2995119 - RNA, 20 nt, Mycobacterium avium subsp. paratuberculosis
cgcgacgggcaugccgucgg

SEQ ID NO: 2995120 - RNA, 21 nt, Mycobacterium avium subsp. paratuberculosis
cgcgacgggcaugccgucggc

SEQ ID NO: 2995121 - RNA, 22 nt, Mycobacterium avium subsp. paratuberculosis
cgcgacgggcaugccgucggcg

SEQ ID NO: 2995122 - RNA, 13 nt, Mycobacterium avium subsp. paratuberculosis
cgcgacgggcguc

SEQ ID NO: 2995123 - RNA, 14 nt, Mycobacterium avium subsp. paratuberculosis
cgcgacgggcgucc

SEQ ID NO: 2995124 - RNA, 23 nt, Mycobacterium avium subsp. paratuberculosis
cgcgacgggcguccgagaagggc

SEQ ID NO: 2995125 - RNA, 14 nt, Mycobacterium avium subsp. paratuberculosis
cgcgacgggcucgg

SEQ ID NO: 2995126 - RNA, 15 nt, Mycobacterium avium subsp. paratuberculosis
cgcgacgggcucggc

SEQ ID NO: 2995127 - RNA, 17 nt, Mycobacterium avium subsp. paratuberculosis
cgcgacgggcucggcgu

SEQ ID NO: 2995128 - RNA, 16 nt, Mycobacterium avium subsp. paratuberculosis
cgcgacgggcugcugc

SEQ ID NO: 2995129 - RNA, 18 nt, Mycobacterium avium subsp. paratuberculosis
cgcgacgggcugcugcac

SEQ ID NO: 2995130 - RNA, 20 nt, Mycobacterium avium subsp. paratuberculosis
cgcgacgggcugcugcacgu

SEQ ID NO: 2995131 - RNA, 20 nt, Mycobacterium avium subsp. paratuberculosis
cgcgacgggcugucccggcc

SEQ ID NO: 2995132 - RNA, 22 nt, Mycobacterium avium subsp. paratuberculosis
cgcgacgggcugucccggccgc

SEQ ID NO: 2995133 - RNA, 21 nt, Mycobacterium avium subsp. paratuberculosis
cgcgacggguugcggaucggu

SEQ ID NO: 2995134 - RNA, 12 nt, Mycobacterium avium subsp. paratuberculosis
cgccgcgggugc

SEQ ID NO: 2995135 - RNA, 15 nt, Mycobacterium avium subsp. paratuberculosis
cgccgcgggugcggc

SEQ ID NO: 2995136 - RNA, 18 nt, Mycobacterium avium subsp. paratuberculosis
cgccgcgggugcggcacg

SEQ ID NO: 2995137 - RNA, 19 nt, Mycobacterium avium subsp. paratuberculosis
cgccgcgggugcggcacgg

SEQ ID NO: 2995138 - RNA, 20 nt, Mycobacterium avium subsp. paratuberculosis
cgccgcgguagaaccaacgc

SEQ ID NO: 2995139 - RNA, 21 nt, Mycobacterium avium subsp. paratuberculosis
cgccgcgguagaaccaacgcg

SEQ ID NO: 2995140 - RNA, 18 nt, Mycobacterium avium subsp. paratuberculosis
cgccgcgguagacaccgc

SEQ ID NO: 2995141 - RNA, 14 nt, Mycobacterium avium subsp. paratuberculosis
cgccgcgguagcgg

SEQ ID NO: 2995142 - RNA, 21 nt, Mycobacterium avium subsp. paratuberculosis
cgccgcgguagcggaccugcg

SEQ ID NO: 2995143 - RNA, 16 nt, Mycobacterium avium subsp. paratuberculosis
cgccgcggucaucgag

SEQ ID NO: 2995144 - RNA, 21 nt, Mycobacterium avium subsp. paratuberculosis
cgccgcggucaucgagccggu

SEQ ID NO: 2995145 - RNA, 13 nt, Mycobacterium avium subsp. paratuberculosis
cgccgcggucgcu

SEQ ID NO: 2995146 - RNA, 15 nt, Mycobacterium avium subsp. paratuberculosis
cgccgcggucgcuga

SEQ ID NO: 2995147 - RNA, 12 nt, Mycobacterium avium subsp. paratuberculosis
cgccgcggugcg

SEQ ID NO: 2995148 - RNA, 15 nt, Mycobacterium avium subsp. paratuberculosis
cgccgcggugcgcca

SEQ ID NO: 2995149 - RNA, 15 nt, Mycobacterium avium subsp. paratuberculosis
cgccgcgguggccgg

SEQ ID NO: 2995150 - RNA, 21 nt, Mycobacterium avium subsp. paratuberculosis
cgccgcgguggccgggaugcc

SEQ ID NO: 2995151 - RNA, 20 nt, Mycobacterium avium subsp. paratuberculosis
cgccgcgguggguccgccgg

SEQ ID NO: 2995152 - RNA, 14 nt, Mycobacterium avium subsp. paratuberculosis
cgccgcgguggugg

SEQ ID NO: 2995153 - RNA, 12 nt, Mycobacterium avium subsp. paratuberculosis
cgccgcgguugg

SEQ ID NO: 2995154 - RNA, 21 nt, Mycobacterium avium subsp. paratuberculosis
cgccgcgguuggucaccaggu

SEQ ID NO: 2995155 - RNA, 23 nt, Mycobacterium avium subsp. paratuberculosis
cgccgcgguuggucaccaggucg

SEQ ID NO: 2995156 - RNA, 13 nt, Mycobacterium avium subsp. paratuberculosis
cgccgcguacacc

SEQ ID NO: 2995157 - RNA, 16 nt, Mycobacterium avium subsp. paratuberculosis
cgccgcguacaccggc

SEQ ID NO: 2995158 - RNA, 18 nt, Mycobacterium avium subsp. paratuberculosis
cgccgcguacaccggcug

SEQ ID NO: 2995159 - RNA, 19 nt, Mycobacterium avium subsp. paratuberculosis
cgccgcguacaccggcuga

SEQ ID NO: 2995160 - RNA, 20 nt, Mycobacterium avium subsp. paratuberculosis
cgccgcguacaccggcugac

SEQ ID NO: 2995161 - RNA, 14 nt, Mycobacterium avium subsp. paratuberculosis
cgccgcguacagca

SEQ ID NO: 2995162 - RNA, 17 nt, Mycobacterium avium subsp. paratuberculosis
cgccgcguacagcagcu

SEQ ID NO: 2995163 - RNA, 20 nt, Mycobacterium avium subsp. paratuberculosis
cgccgcguacagcagcugcc

SEQ ID NO: 2995164 - RNA, 16 nt, Mycobacterium avium subsp. paratuberculosis
cgccgcguaccagcgc

SEQ ID NO: 2995165 - RNA, 17 nt, Mycobacterium avium subsp. paratuberculosis
cgccgcguaccagcgcc

SEQ ID NO: 2995166 - RNA, 18 nt, Mycobacterium avium subsp. paratuberculosis
cgccgcguaccagcgcca

SEQ ID NO: 2995167 - RNA, 17 nt, Mycobacterium avium subsp. paratuberculosis
cgccgcguacgccgccu

SEQ ID NO: 2995168 - RNA, 22 nt, Mycobacterium avium subsp. paratuberculosis
cgccgcguaggccaggaccggg

SEQ ID NO: 2995169 - RNA, 23 nt, Mycobacterium avium subsp. paratuberculosis
cgccgcguaggucuucggugaag

SEQ ID NO: 2995170 - RNA, 12 nt, Mycobacterium avium subsp. paratuberculosis
cgccgcgucagc

SEQ ID NO: 2995171 - RNA, 16 nt, Mycobacterium avium subsp. paratuberculosis
cgccgcgucagcggcg

SEQ ID NO: 2995172 - RNA, 16 nt, Mycobacterium avium subsp. paratuberculosis
cgccgcguccucgucg

SEQ ID NO: 2995173 - RNA, 18 nt, Mycobacterium avium subsp. paratuberculosis
cgccgcguccucgucgau

SEQ ID NO: 2995174 - RNA, 19 nt, Mycobacterium avium subsp. paratuberculosis
cgccgcguccucgucgaug

SEQ ID NO: 2995175 - RNA, 12 nt, Mycobacterium avium subsp. paratuberculosis
cgccgcgucgac

SEQ ID NO: 2995176 - RNA, 19 nt, Mycobacterium avium subsp. paratuberculosis
cgccgcgucgacgccgcug

SEQ ID NO: 2995177 - RNA, 18 nt, Mycobacterium avium subsp. paratuberculosis
cgccgcgucgccgccggg

SEQ ID NO: 2995178 - RNA, 19 nt, Mycobacterium avium subsp. paratuberculosis
cgccgcgucgcgccgccgc

SEQ ID NO: 2995179 - RNA, 20 nt, Mycobacterium avium subsp. paratuberculosis
cgccgcgucgcgccgccgcg

SEQ ID NO: 2995180 - RNA, 15 nt, Mycobacterium avium subsp. paratuberculosis
cgccgcgucggucag

SEQ ID NO: 2995181 - RNA, 19 nt, Mycobacterium avium subsp. paratuberculosis
cgccgcgucgucaucgucu

SEQ ID NO: 2995182 - RNA, 17 nt, Mycobacterium avium subsp. paratuberculosis
cgccgcgucgucgucga

SEQ ID NO: 2995183 - RNA, 18 nt, Mycobacterium avium subsp. paratuberculosis
cgccgcgucgucgucgac

SEQ ID NO: 2995184 - RNA, 13 nt, Mycobacterium avium subsp. paratuberculosis
cgccgcgucgugc

SEQ ID NO: 2995185 - RNA, 18 nt, Mycobacterium avium subsp. paratuberculosis
cgccgcguggccucccgg

SEQ ID NO: 2995186 - RNA, 19 nt, Mycobacterium avium subsp. paratuberculosis
cgccgcguggccucccggu

SEQ ID NO: 2995187 - RNA, 21 nt, Mycobacterium avium subsp. paratuberculosis
cgccgcguucacccgcgcccg

SEQ ID NO: 2995188 - RNA, 22 nt, Mycobacterium avium subsp. paratuberculosis
cgccgcguucacccgcgcccgc

SEQ ID NO: 2995189 - RNA, 15 nt, Mycobacterium avium subsp. paratuberculosis
cgccgcguucggcgg

SEQ ID NO: 2995190 - RNA, 16 nt, Mycobacterium avium subsp. paratuberculosis
cgccgcguucggcggc

SEQ ID NO: 2995191 - RNA, 21 nt, Mycobacterium avium subsp. paratuberculosis
cgccgcguucggcggcgcgcu

SEQ ID NO: 2995192 - RNA, 14 nt, Mycobacterium avium subsp. paratuberculosis
cgccgcguugucgg

SEQ ID NO: 2995193 - RNA, 16 nt, Mycobacterium avium subsp. paratuberculosis
cgccgcguugucggcg

SEQ ID NO: 2995194 - RNA, 19 nt, Mycobacterium avium subsp. paratuberculosis
cgccgcguugucggcgucc

SEQ ID NO: 2995195 - RNA, 21 nt, Mycobacterium avium subsp. paratuberculosis
cgccgcuagguuuggccagca

SEQ ID NO: 2995196 - RNA, 23 nt, Mycobacterium avium subsp. paratuberculosis
cgccgcuagguuuggccagcacc

SEQ ID NO: 2995197 - RNA, 16 nt, Mycobacterium avium subsp. paratuberculosis
cgccgcuagucgccca

SEQ ID NO: 2995198 - RNA, 14 nt, Mycobacterium avium subsp. paratuberculosis
cgccgcucaccgcc

SEQ ID NO: 2995199 - RNA, 16 nt, Mycobacterium avium subsp. paratuberculosis
cgccgcucaccgccga

SEQ ID NO: 2995200 - RNA, 18 nt, Mycobacterium avium subsp. paratuberculosis
cgccgcucaccgccgagc

SEQ ID NO: 2995201 - RNA, 14 nt, Mycobacterium avium subsp. paratuberculosis
cgccgcucgacccc

SEQ ID NO: 2995202 - RNA, 11 nt, Mycobacterium avium subsp. paratuberculosis
cgccgcucggc

SEQ ID NO: 2995203 - RNA, 12 nt, Mycobacterium avium subsp. paratuberculosis
cgccgcucggcc

SEQ ID NO: 2995204 - RNA, 13 nt, Mycobacterium avium subsp. paratuberculosis
cgccgcucggcca

SEQ ID NO: 2995205 - RNA, 15 nt, Mycobacterium avium subsp. paratuberculosis
cgccgcucggccagc

SEQ ID NO: 2995206 - RNA, 16 nt, Mycobacterium avium subsp. paratuberculosis
cgccgcucggccagca

SEQ ID NO: 2995207 - RNA, 16 nt, Mycobacterium avium subsp. paratuberculosis
cgccgcucggccagcg

SEQ ID NO: 2995208 - RNA, 17 nt, Mycobacterium avium subsp. paratuberculosis
cgccgcucggccagcgc

SEQ ID NO: 2995209 - RNA, 21 nt, Mycobacterium avium subsp. paratuberculosis
cgccgcucggccagcgcagcg

SEQ ID NO: 2995210 - RNA, 19 nt, Mycobacterium avium subsp. paratuberculosis
cgccgcucguaacgccacg

SEQ ID NO: 2995211 - RNA, 21 nt, Mycobacterium avium subsp. paratuberculosis
cgccgcucguaacgccacggc

SEQ ID NO: 2995212 - RNA, 12 nt, Mycobacterium avium subsp. paratuberculosis
cgccgcucgucg

SEQ ID NO: 2995213 - RNA, 16 nt, Mycobacterium avium subsp. paratuberculosis
cgccgcucgucggcca

SEQ ID NO: 2995214 - RNA, 18 nt, Mycobacterium avium subsp. paratuberculosis
cgccgcucgucggccagc

SEQ ID NO: 2995215 - RNA, 23 nt, Mycobacterium avium subsp. paratuberculosis
cgccgcucgucgggcacaucccg

SEQ ID NO: 2995216 - RNA, 18 nt, Mycobacterium avium subsp. paratuberculosis
cgccgcucuucgacgacc

SEQ ID NO: 2995217 - RNA, 17 nt, Mycobacterium avium subsp. paratuberculosis
cgccgcugacgcggcgg

SEQ ID NO: 2995218 - RNA, 19 nt, Mycobacterium avium subsp. paratuberculosis
cgccgcugacgcggcgggc

SEQ ID NO: 2995219 - RNA, 13 nt, Mycobacterium avium subsp. paratuberculosis
cgccgcccaccag

SEQ ID NO: 2995220 - RNA, 14 nt, Mycobacterium avium subsp. paratuberculosis
cgccgcccaccagc

SEQ ID NO: 2995221 - RNA, 15 nt, Mycobacterium avium subsp. paratuberculosis
cgccgcccaccagca

SEQ ID NO: 2995222 - RNA, 16 nt, Mycobacterium avium subsp. paratuberculosis
cgccgcccaccagcac

SEQ ID NO: 2995223 - RNA, 18 nt, Mycobacterium avium subsp. paratuberculosis
cgccgcccaccagcacac

SEQ ID NO: 2995224 - RNA, 13 nt, Mycobacterium avium subsp. paratuberculosis
cgccgcccacgcc

SEQ ID NO: 2995225 - RNA, 14 nt, Mycobacterium avium subsp. paratuberculosis
cgccgcccacgccg

SEQ ID NO: 2995226 - RNA, 17 nt, Mycobacterium avium subsp. paratuberculosis
cgccgcccacgccgugc

SEQ ID NO: 2995227 - RNA, 19 nt, Mycobacterium avium subsp. paratuberculosis
cgccgcccacgccgugcag

SEQ ID NO: 2995228 - RNA, 16 nt, Mycobacterium avium subsp. paratuberculosis
cgccgcccacuggucg

SEQ ID NO: 2995229 - RNA, 15 nt, Mycobacterium avium subsp. paratuberculosis
cgccgcccagcggug

SEQ ID NO: 2995230 - RNA, 12 nt, Mycobacterium avium subsp. paratuberculosis
cgccgcccaggc

SEQ ID NO: 2995231 - RNA, 19 nt, Mycobacterium avium subsp. paratuberculosis
cgccgcccaggccccggcc

SEQ ID NO: 2995232 - RNA, 20 nt, Mycobacterium avium subsp. paratuberculosis
cgccgcccaggccccggccg

SEQ ID NO: 2995233 - RNA, 21 nt, Mycobacterium avium subsp. paratuberculosis
cgccgcccaggccccggccga

SEQ ID NO: 2995234 - RNA, 14 nt, Mycobacterium avium subsp. paratuberculosis
cgccgcccaggccg

SEQ ID NO: 2995235 - RNA, 15 nt, Mycobacterium avium subsp. paratuberculosis
cgccgcccaggccga

SEQ ID NO: 2995236 - RNA, 19 nt, Mycobacterium avium subsp. paratuberculosis
cgccgcccaggccgagcgc

SEQ ID NO: 2995237 - RNA, 20 nt, Mycobacterium avium subsp. paratuberculosis
cgccgcccaggccgagcgca

SEQ ID NO: 2995238 - RNA, 15 nt, Mycobacterium avium subsp. paratuberculosis
cgccgcccaucggca

SEQ ID NO: 2995239 - RNA, 16 nt, Mycobacterium avium subsp. paratuberculosis
cgccgcccaucggcag

SEQ ID NO: 2995240 - RNA, 17 nt, Mycobacterium avium subsp. paratuberculosis
cgccgcccaucggcagc

SEQ ID NO: 2995241 - RNA, 17 nt, Mycobacterium avium subsp. paratuberculosis
cgccgcccccgccgcga

SEQ ID NO: 2995242 - RNA, 21 nt, Mycobacterium avium subsp. paratuberculosis
cgccgcccccgccgcgagcag

SEQ ID NO: 2995243 - RNA, 14 nt, Mycobacterium avium subsp. paratuberculosis
cgccgccgcgucgc

SEQ ID NO: 2995244 - RNA, 15 nt, Mycobacterium avium subsp. paratuberculosis
cgccgccgcgucgcc

SEQ ID NO: 2995245 - RNA, 20 nt, Mycobacterium avium subsp. paratuberculosis
cgccgccgcgucgccgccgg

SEQ ID NO: 2995246 - RNA, 14 nt, Mycobacterium avium subsp. paratuberculosis
cgccgccgcugucg

SEQ ID NO: 2995247 - RNA, 13 nt, Mycobacterium avium subsp. paratuberculosis
cgccgccggcgcu

SEQ ID NO: 2995248 - RNA, 18 nt, Mycobacterium avium subsp. paratuberculosis
cgccgccggcgcuggcgc

SEQ ID NO: 2995249 - RNA, 14 nt, Mycobacterium avium subsp. paratuberculosis
cgccgccggcggcg

SEQ ID NO: 2995250 - RNA, 15 nt, Mycobacterium avium subsp. paratuberculosis
cgccgccggcggcgu

SEQ ID NO: 2995251 - RNA, 14 nt, Mycobacterium avium subsp. paratuberculosis
cgccgccggcggug

SEQ ID NO: 2995252 - RNA, 12 nt, Mycobacterium avium subsp. paratuberculosis
cgccgccggcgu

SEQ ID NO: 2995253 - RNA, 15 nt, Mycobacterium avium subsp. paratuberculosis
cgccgccggcgucgc

SEQ ID NO: 2995254 - RNA, 17 nt, Mycobacterium avium subsp. paratuberculosis
cgccgccggcgucgccg

SEQ ID NO: 2995255 - RNA, 14 nt, Mycobacterium avium subsp. paratuberculosis
cgccgccgggaaca

SEQ ID NO: 2995256 - RNA, 22 nt, Mycobacterium avium subsp. paratuberculosis
cgccgccgggauaacccagcac

SEQ ID NO: 2995257 - RNA, 23 nt, Mycobacterium avium subsp. paratuberculosis
cgccgccgggauaacccagcacc

SEQ ID NO: 2995258 - RNA, 23 nt, Mycobacterium avium subsp. paratuberculosis
cgccgccgggccuguccagccgg

SEQ ID NO: 2995259 - RNA, 16 nt, Mycobacterium avium subsp. paratuberculosis
cgccgccgggcgccac

SEQ ID NO: 2995260 - RNA, 17 nt, Mycobacterium avium subsp. paratuberculosis
cgccgccgggcgccacc

SEQ ID NO: 2995261 - RNA, 14 nt, Mycobacterium avium subsp. paratuberculosis
cgccgccggggcgc

SEQ ID NO: 2995262 - RNA, 15 nt, Mycobacterium avium subsp. paratuberculosis
cgccgccggggcgca

SEQ ID NO: 2995263 - RNA, 19 nt, Mycobacterium avium subsp. paratuberculosis
cgccgccggggcgggcagc

SEQ ID NO: 2995264 - RNA, 23 nt, Mycobacterium avium subsp. paratuberculosis
cgccgccggggcgggcagcacca

SEQ ID NO: 2995265 - RNA, 20 nt, Mycobacterium avium subsp. paratuberculosis
cgccgccggggcgucggacg

SEQ ID NO: 2995266 - RNA, 12 nt, Mycobacterium avium subsp. paratuberculosis
cgccgccggucg

SEQ ID NO: 2995267 - RNA, 12 nt, Mycobacterium avium subsp. paratuberculosis
cgccgccgguga

SEQ ID NO: 2995268 - RNA, 12 nt, Mycobacterium avium subsp. paratuberculosis
cgccgccggugc

SEQ ID NO: 2995269 - RNA, 16 nt, Mycobacterium avium subsp. paratuberculosis
cgccgccggugccgac

SEQ ID NO: 2995270 - RNA, 14 nt, Mycobacterium avium subsp. paratuberculosis
cgccgccgguggag

SEQ ID NO: 2995271 - RNA, 15 nt, Mycobacterium avium subsp. paratuberculosis
cgccgccguccagcg

SEQ ID NO: 2995272 - RNA, 12 nt, Mycobacterium avium subsp. paratuberculosis
cgccgccguccc

SEQ ID NO: 2995273 - RNA, 21 nt, Mycobacterium avium subsp. paratuberculosis
cgccgccgucccaccggcgau

SEQ ID NO: 2995274 - RNA, 13 nt, Mycobacterium avium subsp. paratuberculosis
cgccgccgucggu

SEQ ID NO: 2995275 - RNA, 16 nt, Mycobacterium avium subsp. paratuberculosis
cgccgccgucggugua

SEQ ID NO: 2995276 - RNA, 12 nt, Mycobacterium avium subsp. paratuberculosis
cgccgccgucgu

SEQ ID NO: 2995277 - RNA, 15 nt, Mycobacterium avium subsp. paratuberculosis
cgccgccgucguagc

SEQ ID NO: 2995278 - RNA, 20 nt, Mycobacterium avium subsp. paratuberculosis
cgccgccguguaggccgcgc

SEQ ID NO: 2995279 - RNA, 21 nt, Mycobacterium avium subsp. paratuberculosis
cgccgccguguaggccgcgcu

SEQ ID NO: 2995280 - RNA, 23 nt, Mycobacterium avium subsp. paratuberculosis
cgccgccguguaggccgcgcugg

SEQ ID NO: 2995281 - RNA, 14 nt, Mycobacterium avium subsp. paratuberculosis
cgccgccguucgcc

SEQ ID NO: 2995282 - RNA, 16 nt, Mycobacterium avium subsp. paratuberculosis
cgccgccguucgccgg

SEQ ID NO: 2995283 - RNA, 18 nt, Mycobacterium avium subsp. paratuberculosis
cgccgccguucgccggcg

SEQ ID NO: 2995284 - RNA, 12 nt, Mycobacterium avium subsp. paratuberculosis
cgccgccugagc

SEQ ID NO: 2995285 - RNA, 17 nt, Mycobacterium avium subsp. paratuberculosis
cgccgccugagcccgcc

SEQ ID NO: 2995286 - RNA, 20 nt, Mycobacterium avium subsp. paratuberculosis
cgccgccuucuugcgcggcg

SEQ ID NO: 2995287 - RNA, 23 nt, Mycobacterium avium subsp. paratuberculosis
cgccgccuucuugcgcggcgcga

SEQ ID NO: 2995288 - RNA, 15 nt, Mycobacterium avium subsp. paratuberculosis
cgccgccuugacgcc

SEQ ID NO: 2995289 - RNA, 17 nt, Mycobacterium avium subsp. paratuberculosis
cgccgccuugacgccgg

SEQ ID NO: 2995290 - RNA, 21 nt, Mycobacterium avium subsp. paratuberculosis
cgccgccuugacgccgggcac

SEQ ID NO: 2995291 - RNA, 16 nt, Mycobacterium avium subsp. paratuberculosis
cgccgcgaacgacgac

SEQ ID NO: 2995292 - RNA, 23 nt, Mycobacterium avium subsp. paratuberculosis
cgccgcgaacgacgaccuccccc

SEQ ID NO: 2995293 - RNA, 16 nt, Mycobacterium avium subsp. paratuberculosis
cgccgcgaacgggucg

SEQ ID NO: 2995294 - RNA, 17 nt, Mycobacterium avium subsp. paratuberculosis
cgccgcgaacgggucgg

SEQ ID NO: 2995295 - RNA, 21 nt, Mycobacterium avium subsp. paratuberculosis
cgccgcgaacucaggcgcgca

SEQ ID NO: 2995296 - RNA, 22 nt, Mycobacterium avium subsp. paratuberculosis
cgccgcgaacucaggcgcgcac

SEQ ID NO: 2995297 - RNA, 12 nt, Mycobacterium avium subsp. paratuberculosis
cgccgcgacacc

SEQ ID NO: 2995298 - RNA, 21 nt, Mycobacterium avium subsp. paratuberculosis
cgccgcgacacccgcgacgac

SEQ ID NO: 2995299 - RNA, 12 nt, Mycobacterium avium subsp. paratuberculosis
cgccgcgacccc

SEQ ID NO: 2995300 - RNA, 15 nt, Mycobacterium avium subsp. paratuberculosis
cgccgcgaccccgga

SEQ ID NO: 2995301 - RNA, 14 nt, Mycobacterium avium subsp. paratuberculosis
cgccgcgacccggu

SEQ ID NO: 2995302 - RNA, 13 nt, Mycobacterium avium subsp. paratuberculosis
cgccgcgaccgcg

SEQ ID NO: 2995303 - RNA, 14 nt, Mycobacterium avium subsp. paratuberculosis
cgccgcgaccgcga

SEQ ID NO: 2995304 - RNA, 17 nt, Mycobacterium avium subsp. paratuberculosis
cgccgcgaccgcgauca

SEQ ID NO: 2995305 - RNA, 18 nt, Mycobacterium avium subsp. paratuberculosis
cgccgcgaccgcgaucag

SEQ ID NO: 2995306 - RNA, 22 nt, Mycobacterium avium subsp. paratuberculosis
cgccgcgaccgucagcagggcc

SEQ ID NO: 2995307 - RNA, 15 nt, Mycobacterium avium subsp. paratuberculosis
cgccgcgacgaugcc

SEQ ID NO: 2995308 - RNA, 22 nt, Mycobacterium avium subsp. paratuberculosis
cgccgcgacgaugucgacccgc

SEQ ID NO: 2995309 - RNA, 15 nt, Mycobacterium avium subsp. paratuberculosis
cgccgcgacgccgug

SEQ ID NO: 2995310 - RNA, 14 nt, Mycobacterium avium subsp. paratuberculosis
cgccgcgacggccg

SEQ ID NO: 2995311 - RNA, 18 nt, Mycobacterium avium subsp. paratuberculosis
cgccgcgacggccgccga

SEQ ID NO: 2995312 - RNA, 23 nt, Mycobacterium avium subsp. paratuberculosis
cgccgcgacggguugcggaucgg

SEQ ID NO: 2995313 - RNA, 13 nt, Mycobacterium avium subsp. paratuberculosis
cgccgcgacgucg

SEQ ID NO: 2995314 - RNA, 14 nt, Mycobacterium avium subsp. paratuberculosis
cgccgcgacgucgg

SEQ ID NO: 2995315 - RNA, 15 nt, Mycobacterium avium subsp. paratuberculosis
cgccgcgacgucggu

SEQ ID NO: 2995316 - RNA, 16 nt, Mycobacterium avium subsp. paratuberculosis
cgccgcgacgucggug

SEQ ID NO: 2995317 - RNA, 19 nt, Mycobacterium avium subsp. paratuberculosis
cgccgcgacgucgguguag

SEQ ID NO: 2995318 - RNA, 13 nt, Mycobacterium avium subsp. paratuberculosis
cgccgcgagccgc

SEQ ID NO: 2995319 - RNA, 15 nt, Mycobacterium avium subsp. paratuberculosis
cgccgcgagccgccc

SEQ ID NO: 2995320 - RNA, 17 nt, Mycobacterium avium subsp. paratuberculosis
cgccgcgagcgcagcag

SEQ ID NO: 2995321 - RNA, 10 nt, Mycobacterium avium subsp. paratuberculosis
cgccgcgaua

SEQ ID NO: 2995322 - RNA, 13 nt, Mycobacterium avium subsp. paratuberculosis
cgccgcgaucagg

SEQ ID NO: 2995323 - RNA, 20 nt, Mycobacterium avium subsp. paratuberculosis
cgccgcgaucagggcccaca

SEQ ID NO: 2995324 - RNA, 12 nt, Mycobacterium avium subsp. paratuberculosis
cgccgcgauccg

SEQ ID NO: 2995325 - RNA, 16 nt, Mycobacterium avium subsp. paratuberculosis
cgccgcgauccgggca

SEQ ID NO: 2995326 - RNA, 16 nt, Mycobacterium avium subsp. paratuberculosis
cgccgcgaucucggcg

SEQ ID NO: 2995327 - RNA, 17 nt, Mycobacterium avium subsp. paratuberculosis
cgccgcgaucucggcgg

SEQ ID NO: 2995328 - RNA, 18 nt, Mycobacterium avium subsp. paratuberculosis
cgccgcgaucucggcgga

SEQ ID NO: 2995329 - RNA, 22 nt, Mycobacterium avium subsp. paratuberculosis
cgccgcgaucucggcggacucg

SEQ ID NO: 2995330 - RNA, 18 nt, Mycobacterium avium subsp. paratuberculosis
cgccgcgaucuugccgcc

SEQ ID NO: 2995331 - RNA, 19 nt, Mycobacterium avium subsp. paratuberculosis
cgccgcgaucuugccgccg

SEQ ID NO: 2995332 - RNA, 15 nt, Mycobacterium avium subsp. paratuberculosis
cgccgcgaugaucac

SEQ ID NO: 2995333 - RNA, 22 nt, Mycobacterium avium subsp. paratuberculosis
cgccgcgaugaucacacccacg

SEQ ID NO: 2995334 - RNA, 20 nt, Mycobacterium avium subsp. paratuberculosis
cgccgcgcaccccgaaccgc

SEQ ID NO: 2995335 - RNA, 14 nt, Mycobacterium avium subsp. paratuberculosis
cgccgcgcacccgg

SEQ ID NO: 2995336 - RNA, 15 nt, Mycobacterium avium subsp. paratuberculosis
cgccgcgcacccggc

SEQ ID NO: 2995337 - RNA, 16 nt, Mycobacterium avium subsp. paratuberculosis
cgccgcgcacccggcc

SEQ ID NO: 2995338 - RNA, 18 nt, Mycobacterium avium subsp. paratuberculosis
cgccgcgcacccggccac

SEQ ID NO: 2995339 - RNA, 14 nt, Mycobacterium avium subsp. paratuberculosis
cgccgcgcacgacg

SEQ ID NO: 2995340 - RNA, 15 nt, Mycobacterium avium subsp. paratuberculosis
cgccgcgcacgacgu

SEQ ID NO: 2995341 - RNA, 17 nt, Mycobacterium avium subsp. paratuberculosis
cgccgcgcacgacgugg

SEQ ID NO: 2995342 - RNA, 14 nt, Mycobacterium avium subsp. paratuberculosis
cgccgcgcagcacc

SEQ ID NO: 2995343 - RNA, 17 nt, Mycobacterium avium subsp. paratuberculosis
cgccgcgcagcaccgcg

SEQ ID NO: 2995344 - RNA, 18 nt, Mycobacterium avium subsp. paratuberculosis
cgccgcgcagcaccgcgu

SEQ ID NO: 2995345 - RNA, 19 nt, Mycobacterium avium subsp. paratuberculosis
cgccgcgcagcggggcgcg

SEQ ID NO: 2995346 - RNA, 18 nt, Mycobacterium avium subsp. paratuberculosis
cgccgcgcaggccgccga

SEQ ID NO: 2995347 - RNA, 19 nt, Mycobacterium avium subsp. paratuberculosis
cgccgcgcaggccgccgac

SEQ ID NO: 2995348 - RNA, 20 nt, Mycobacterium avium subsp. paratuberculosis
cgccgcgcaggccgccgacg

SEQ ID NO: 2995349 - RNA, 23 nt, Mycobacterium avium subsp. paratuberculosis
cgccgcgcaggccgccgacgacg

SEQ ID NO: 2995350 - RNA, 20 nt, Mycobacterium avium subsp. paratuberculosis
cgccgcgcaucaucgcccag

SEQ ID NO: 2995351 - RNA, 17 nt, Mycobacterium avium subsp. paratuberculosis
cgccgcgcauccgcacc

SEQ ID NO: 2995352 - RNA, 23 nt, Mycobacterium avium subsp. paratuberculosis
cgccgcgccaccgaggccagcag

SEQ ID NO: 2995353 - RNA, 13 nt, Mycobacterium avium subsp. paratuberculosis
cgccgcgccagca

SEQ ID NO: 2995354 - RNA, 19 nt, Mycobacterium avium subsp. paratuberculosis
cgccgcgccagcaccucgg

SEQ ID NO: 2995355 - RNA, 21 nt, Mycobacterium avium subsp. paratuberculosis
cgccgcgccagcaccucggcg

SEQ ID NO: 2995356 - RNA, 14 nt, Mycobacterium avium subsp. paratuberculosis
cgccgcgccagccg

SEQ ID NO: 2995357 - RNA, 15 nt, Mycobacterium avium subsp. paratuberculosis
cgccgcgccagccgc

SEQ ID NO: 2995358 - RNA, 17 nt, Mycobacterium avium subsp. paratuberculosis
cgccgcgccagccgccg

SEQ ID NO: 2995359 - RNA, 22 nt, Mycobacterium avium subsp. paratuberculosis
cgccgcgccagccgccgccgac

SEQ ID NO: 2995360 - RNA, 23 nt, Mycobacterium avium subsp. paratuberculosis
cgccgcgccagccgccgccgacc

SEQ ID NO: 2995361 - RNA, 12 nt, Mycobacterium avium subsp. paratuberculosis
cgccgcgcccag

SEQ ID NO: 2995362 - RNA, 15 nt, Mycobacterium avium subsp. paratuberculosis
cgccgcgcccagcac

SEQ ID NO: 2995363 - RNA, 20 nt, Mycobacterium avium subsp. paratuberculosis
cgccgcgccccggcgcgccu

SEQ ID NO: 2995364 - RNA, 16 nt, Mycobacterium avium subsp. paratuberculosis
cgccgcgcccgccggc

SEQ ID NO: 2995365 - RNA, 13 nt, Mycobacterium avium subsp. paratuberculosis
cgccgcgcccggc

SEQ ID NO: 2995366 - RNA, 16 nt, Mycobacterium avium subsp. paratuberculosis
cgccgcgcccggcuuc

SEQ ID NO: 2995367 - RNA, 17 nt, Mycobacterium avium subsp. paratuberculosis
cgccgcgcccggcuucg

SEQ ID NO: 2995368 - RNA, 20 nt, Mycobacterium avium subsp. paratuberculosis
cgccgcgcccggcuucgccg

SEQ ID NO: 2995369 - RNA, 21 nt, Mycobacterium avium subsp. paratuberculosis
cgccgcgcccggcuucgccgc

SEQ ID NO: 2995370 - RNA, 24 nt, Mycobacterium avium subsp. paratuberculosis
cgccgcgcccggcuucgccgcgcu

SEQ ID NO: 2995371 - RNA, 12 nt, Mycobacterium avium subsp. paratuberculosis
cgccgcgcccgu

SEQ ID NO: 2995372 - RNA, 15 nt, Mycobacterium avium subsp. paratuberculosis
cgccgcgcccgucga

SEQ ID NO: 2995373 - RNA, 21 nt, Mycobacterium avium subsp. paratuberculosis
cgccgcgcccgucgagcguca

SEQ ID NO: 2995374 - RNA, 22 nt, Mycobacterium avium subsp. paratuberculosis
cgccgcgcccgucgagcgucac

SEQ ID NO: 2995375 - RNA, 11 nt, Mycobacterium avium subsp. paratuberculosis
cgccgcgccga

SEQ ID NO: 2995376 - RNA, 12 nt, Mycobacterium avium subsp. paratuberculosis
cgccgcgccgac

SEQ ID NO: 2995377 - RNA, 16 nt, Mycobacterium avium subsp. paratuberculosis
cgccgcgccgaccucg

SEQ ID NO: 2995378 - RNA, 22 nt, Mycobacterium avium subsp. paratuberculosis
cgccgcgccgaccucgucggcg

SEQ ID NO: 2995379 - RNA, 12 nt, Mycobacterium avium subsp. paratuberculosis
cgccgcgccgcc

SEQ ID NO: 2995380 - RNA, 13 nt, Mycobacterium avium subsp. paratuberculosis
cgccgcgccgccg

SEQ ID NO: 2995381 - RNA, 14 nt, Mycobacterium avium subsp. paratuberculosis
cgccgcgccgccgg

SEQ ID NO: 2995382 - RNA, 16 nt, Mycobacterium avium subsp. paratuberculosis
cgccgcgccgccggug

SEQ ID NO: 2995383 - RNA, 12 nt, Mycobacterium avium subsp. paratuberculosis
cgccgcgccggg

SEQ ID NO: 2995384 - RNA, 15 nt, Mycobacterium avium subsp. paratuberculosis
cgccgcgcgccagcg

SEQ ID NO: 2995385 - RNA, 18 nt, Mycobacterium avium subsp. paratuberculosis
cgccgcgcgccagcgcgu

SEQ ID NO: 2995386 - RNA, 15 nt, Mycobacterium avium subsp. paratuberculosis
cgccgcgcgcgcggc

SEQ ID NO: 2995387 - RNA, 17 nt, Mycobacterium avium subsp. paratuberculosis
cgccgcgcgcgcggccu

SEQ ID NO: 2995388 - RNA, 13 nt, Mycobacterium avium subsp. paratuberculosis
cgccgcgcgcggc

SEQ ID NO: 2995389 - RNA, 14 nt, Mycobacterium avium subsp. paratuberculosis
cgccgcgcgcggcc

SEQ ID NO: 2995390 - RNA, 17 nt, Mycobacterium avium subsp. paratuberculosis
cgccgcgcgcggccacc

SEQ ID NO: 2995391 - RNA, 22 nt, Mycobacterium avium subsp. paratuberculosis
cgccgcgcgcggccaccgcgcg

SEQ ID NO: 2995392 - RNA, 15 nt, Mycobacterium avium subsp. paratuberculosis
cgccgcgcgcgucga

SEQ ID NO: 2995393 - RNA, 16 nt, Mycobacterium avium subsp. paratuberculosis
cgccgcgcgcgucgac

SEQ ID NO: 2995394 - RNA, 20 nt, Mycobacterium avium subsp. paratuberculosis
cgccgcgcgcgucgacguuc

SEQ ID NO: 2995395 - RNA, 19 nt, Mycobacterium avium subsp. paratuberculosis
cgccgcgcggcccgcgacg

SEQ ID NO: 2995396 - RNA, 21 nt, Mycobacterium avium subsp. paratuberculosis
cgccgcgcggcccgcgacguc

SEQ ID NO: 2995397 - RNA, 13 nt, Mycobacterium avium subsp. paratuberculosis
cgccgcgcggccg

SEQ ID NO: 2995398 - RNA, 21 nt, Mycobacterium avium subsp. paratuberculosis
cgccgcgcggccgggcucccg

SEQ ID NO: 2995399 - RNA, 20 nt, Mycobacterium avium subsp. paratuberculosis
cgccgcgcggguacggcggc

SEQ ID NO: 2995400 - RNA, 21 nt, Mycobacterium avium subsp. paratuberculosis
cgccgcgcggguacggcggcc

SEQ ID NO: 2995401 - RNA, 17 nt, Mycobacterium avium subsp. paratuberculosis
cgccgcgcguuccagca

SEQ ID NO: 2995402 - RNA, 20 nt, Mycobacterium avium subsp. paratuberculosis
cgccgcgcguuccagcacgc

SEQ ID NO: 2995403 - RNA, 19 nt, Mycobacterium avium subsp. paratuberculosis
cgccgcgcucaacccgggc

SEQ ID NO: 2995404 - RNA, 22 nt, Mycobacterium avium subsp. paratuberculosis
cgccgcgcucaacccgggccgg

SEQ ID NO: 2995405 - RNA, 16 nt, Mycobacterium avium subsp. paratuberculosis
cgccgcgcucgcacca

SEQ ID NO: 2995406 - RNA, 18 nt, Mycobacterium avium subsp. paratuberculosis
cgccgcgcucgcaccagc

SEQ ID NO: 2995407 - RNA, 20 nt, Mycobacterium avium subsp. paratuberculosis
cgccgcgcucgcaccagcgc

SEQ ID NO: 2995408 - RNA, 15 nt, Mycobacterium avium subsp. paratuberculosis
cgccgcgcucggcca

SEQ ID NO: 2995409 - RNA, 19 nt, Mycobacterium avium subsp. paratuberculosis
cgccgcgcucggccauccg

SEQ ID NO: 2995410 - RNA, 18 nt, Mycobacterium avium subsp. paratuberculosis
cgccgcgcucgugcugcu

SEQ ID NO: 2995411 - RNA, 12 nt, Mycobacterium avium subsp. paratuberculosis
cgccgcgcuggc

SEQ ID NO: 2995412 - RNA, 15 nt, Mycobacterium avium subsp. paratuberculosis
cgccgcgcuggccga

SEQ ID NO: 2995413 - RNA, 19 nt, Mycobacterium avium subsp. paratuberculosis
cgccgcgcuugacggccgg

SEQ ID NO: 2995414 - RNA, 22 nt, Mycobacterium avium subsp. paratuberculosis
cgccgcgcuugacggccgggcc

SEQ ID NO: 2995415 - RNA, 23 nt, Mycobacterium avium subsp. paratuberculosis
cgccgcgcuugacggccgggccc

SEQ ID NO: 2995416 - RNA, 17 nt, Mycobacterium avium subsp. paratuberculosis
cgccgcgcuugcgaccg

SEQ ID NO: 2995417 - RNA, 18 nt, Mycobacterium avium subsp. paratuberculosis
cgccgcgcuugcgaccgc

SEQ ID NO: 2995418 - RNA, 23 nt, Mycobacterium avium subsp. paratuberculosis
cgccgcgcuugcgaccgccgcua

SEQ ID NO: 2995419 - RNA, 19 nt, Mycobacterium avium subsp. paratuberculosis
cgccgcgcuugcgaucgcc

SEQ ID NO: 2995420 - RNA, 20 nt, Mycobacterium avium subsp. paratuberculosis
cgccgcggaaggccagcucc

SEQ ID NO: 2995421 - RNA, 23 nt, Mycobacterium avium subsp. paratuberculosis
cgccgcggacauucugcacgacg

SEQ ID NO: 2995422 - RNA, 16 nt, Mycobacterium avium subsp. paratuberculosis
cgccgcggaccccagc

SEQ ID NO: 2995423 - RNA, 20 nt, Mycobacterium avium subsp. paratuberculosis
cgccgcggaccccagcguga

SEQ ID NO: 2995424 - RNA, 17 nt, Mycobacterium avium subsp. paratuberculosis
cgccgcggagcggcggu

SEQ ID NO: 2995425 - RNA, 14 nt, Mycobacterium avium subsp. paratuberculosis
cgccgcggaucggu

SEQ ID NO: 2995426 - RNA, 21 nt, Mycobacterium avium subsp. paratuberculosis
cgccgcggaucuucuccgcca

SEQ ID NO: 2995427 - RNA, 22 nt, Mycobacterium avium subsp. paratuberculosis
cgccgcggaucuucuccgccac

SEQ ID NO: 2995428 - RNA, 23 nt, Mycobacterium avium subsp. paratuberculosis
cgccgcggauguggaggcgagca

SEQ ID NO: 2995429 - RNA, 17 nt, Mycobacterium avium subsp. paratuberculosis
cgccgcggcaacgccag

SEQ ID NO: 2995430 - RNA, 22 nt, Mycobacterium avium subsp. paratuberculosis
cgccgcggcaccuucaccgacc

SEQ ID NO: 2995431 - RNA, 13 nt, Mycobacterium avium subsp. paratuberculosis
cgccgcggccacc

SEQ ID NO: 2995432 - RNA, 19 nt, Mycobacterium avium subsp. paratuberculosis
cgccgcggccaccgggucg

SEQ ID NO: 2995433 - RNA, 20 nt, Mycobacterium avium subsp. paratuberculosis
cgccgcggccaccgggucgu

SEQ ID NO: 2995434 - RNA, 15 nt, Mycobacterium avium subsp. paratuberculosis
cgccgcggccacgcu

SEQ ID NO: 2995435 - RNA, 19 nt, Mycobacterium avium subsp. paratuberculosis
cgccgcggccacgcucggg

SEQ ID NO: 2995436 - RNA, 12 nt, Mycobacterium avium subsp. paratuberculosis
cgccgcggccag

SEQ ID NO: 2995437 - RNA, 17 nt, Mycobacterium avium subsp. paratuberculosis
cgccgcggccagccggu

SEQ ID NO: 2995438 - RNA, 22 nt, Mycobacterium avium subsp. paratuberculosis
cgccgcggccagccggucgucg

SEQ ID NO: 2995439 - RNA, 14 nt, Mycobacterium avium subsp. paratuberculosis
cgccgcggccagcg

SEQ ID NO: 2995440 - RNA, 16 nt, Mycobacterium avium subsp. paratuberculosis
cgccgcggccagcgcc

SEQ ID NO: 2995441 - RNA, 18 nt, Mycobacterium avium subsp. paratuberculosis
cgccgcggccagcgcccc

SEQ ID NO: 2995442 - RNA, 23 nt, Mycobacterium avium subsp. paratuberculosis
cgccgcggccagcgccccgccgg

SEQ ID NO: 2995443 - RNA, 13 nt, Mycobacterium avium subsp. paratuberculosis
cgccgcggccagg

SEQ ID NO: 2995444 - RNA, 14 nt, Mycobacterium avium subsp. paratuberculosis
cgccgcggccaggu

SEQ ID NO: 2995445 - RNA, 14 nt, Mycobacterium avium subsp. paratuberculosis
cgccgcggcccugc

SEQ ID NO: 2995446 - RNA, 14 nt, Mycobacterium avium subsp. paratuberculosis
cgccgcggccgaac

SEQ ID NO: 2995447 - RNA, 12 nt, Mycobacterium avium subsp. paratuberculosis
cgccgcggccgc

SEQ ID NO: 2995448 - RNA, 13 nt, Mycobacterium avium subsp. paratuberculosis
cgccgcggccgcg

SEQ ID NO: 2995449 - RNA, 14 nt, Mycobacterium avium subsp. paratuberculosis
cgccgcggccgcgg

SEQ ID NO: 2995450 - RNA, 15 nt, Mycobacterium avium subsp. paratuberculosis
cgccgcggccgcggc

SEQ ID NO: 2995451 - RNA, 16 nt, Mycobacterium avium subsp. paratuberculosis
cgccgcggccgcuggc

SEQ ID NO: 2995452 - RNA, 13 nt, Mycobacterium avium subsp. paratuberculosis
cgccgcggccgga

SEQ ID NO: 2995453 - RNA, 13 nt, Mycobacterium avium subsp. paratuberculosis
cgccgcggccggu

SEQ ID NO: 2995454 - RNA, 11 nt, Mycobacterium avium subsp. paratuberculosis
cgccgcggcga

SEQ ID NO: 2995455 - RNA, 12 nt, Mycobacterium avium subsp. paratuberculosis
cgccgcggcgaa

SEQ ID NO: 2995456 - RNA, 20 nt, Mycobacterium avium subsp. paratuberculosis
cgccgcggcgaaaacgccug

SEQ ID NO: 2995457 - RNA, 24 nt, Mycobacterium avium subsp. paratuberculosis
cgccgcggcgaaaacgccugcgcc

SEQ ID NO: 2995458 - RNA, 12 nt, Mycobacterium avium subsp. paratuberculosis
cgccgcggcgac

SEQ ID NO: 2995459 - RNA, 13 nt, Mycobacterium avium subsp. paratuberculosis
cgccgcggcgacc

SEQ ID NO: 2995460 - RNA, 15 nt, Mycobacterium avium subsp. paratuberculosis
cgccgcggcgaccac

SEQ ID NO: 2995461 - RNA, 17 nt, Mycobacterium avium subsp. paratuberculosis
cgccgcggcgaccgggg

SEQ ID NO: 2995462 - RNA, 15 nt, Mycobacterium avium subsp. paratuberculosis
cgccgcggcgagccg

SEQ ID NO: 2995463 - RNA, 16 nt, Mycobacterium avium subsp. paratuberculosis
cgccgcggcgagccgg

SEQ ID NO: 2995464 - RNA, 18 nt, Mycobacterium avium subsp. paratuberculosis
cgccgcggcgagccggcc

SEQ ID NO: 2995465 - RNA, 20 nt, Mycobacterium avium subsp. paratuberculosis
cgccgcggcgagccggccgu

SEQ ID NO: 2995466 - RNA, 11 nt, Mycobacterium avium subsp. paratuberculosis
cgccgcggcgc

SEQ ID NO: 2995467 - RNA, 12 nt, Mycobacterium avium subsp. paratuberculosis
cgccgcggcgcc

SEQ ID NO: 2995468 - RNA, 13 nt, Mycobacterium avium subsp. paratuberculosis
cgccgcggcgccc

SEQ ID NO: 2995469 - RNA, 14 nt, Mycobacterium avium subsp. paratuberculosis
cgccgcggcgcccg

SEQ ID NO: 2995470 - RNA, 16 nt, Mycobacterium avium subsp. paratuberculosis
cgccgcggcgcccggc

SEQ ID NO: 2995471 - RNA, 18 nt, Mycobacterium avium subsp. paratuberculosis
cgccgcggcgcccggcgc

SEQ ID NO: 2995472 - RNA, 19 nt, Mycobacterium avium subsp. paratuberculosis
cgccgcggcgcccggcgcc

SEQ ID NO: 2995473 - RNA, 19 nt, Mycobacterium avium subsp. paratuberculosis
cgccgcggcgcccucgccg

SEQ ID NO: 2995474 - RNA, 14 nt, Mycobacterium avium subsp. paratuberculosis
cgccgcggcgccgc

SEQ ID NO: 2995475 - RNA, 15 nt, Mycobacterium avium subsp. paratuberculosis
cgccgcggcgccgcc

SEQ ID NO: 2995476 - RNA, 16 nt, Mycobacterium avium subsp. paratuberculosis
cgccgcggcgccgcca

SEQ ID NO: 2995477 - RNA, 20 nt, Mycobacterium avium subsp. paratuberculosis
cgccgcggcgccgccacggc

SEQ ID NO: 2995478 - RNA, 12 nt, Mycobacterium avium subsp. paratuberculosis
cgccgcggcgcu

SEQ ID NO: 2995479 - RNA, 23 nt, Mycobacterium avium subsp. paratuberculosis
cgccgcggcgcuugaccucgccg

SEQ ID NO: 2995480 - RNA, 14 nt, Mycobacterium avium subsp. paratuberculosis
cgccgcggcggcaa

SEQ ID NO: 2995481 - RNA, 15 nt, Mycobacterium avium subsp. paratuberculosis
cgccgcggcggcacc

SEQ ID NO: 2995482 - RNA, 21 nt, Mycobacterium avium subsp. paratuberculosis
cgccgcggcggcacccagguc

SEQ ID NO: 2995483 - RNA, 15 nt, Mycobacterium avium subsp. paratuberculosis
cgccgcggcggccug

SEQ ID NO: 2995484 - RNA, 17 nt, Mycobacterium avium subsp. paratuberculosis
cgccgcggcggccugcu

SEQ ID NO: 2995485 - RNA, 17 nt, Mycobacterium avium subsp. paratuberculosis
cgccgcggcggcucggc

SEQ ID NO: 2995486 - RNA, 18 nt, Mycobacterium avium subsp. paratuberculosis
cgccgcggcggcucggcg

SEQ ID NO: 2995487 - RNA, 22 nt, Mycobacterium avium subsp. paratuberculosis
cgccgcggcggcucggcggcgu

SEQ ID NO: 2995488 - RNA, 13 nt, Mycobacterium avium subsp. paratuberculosis
cgccgcggcggug

SEQ ID NO: 2995489 - RNA, 16 nt, Mycobacterium avium subsp. paratuberculosis
cgccgcggcgguggcc

SEQ ID NO: 2995490 - RNA, 17 nt, Mycobacterium avium subsp. paratuberculosis
cgccgcggcuccagcag

SEQ ID NO: 2995491 - RNA, 19 nt, Mycobacterium avium subsp. paratuberculosis
cgccgcggcuccagcagcg

SEQ ID NO: 2995492 - RNA, 12 nt, Mycobacterium avium subsp. paratuberculosis
cgccgcgggaug

SEQ ID NO: 2995493 - RNA, 12 nt, Mycobacterium avium subsp. paratuberculosis
cgccgcgggcca

SEQ ID NO: 2995494 - RNA, 17 nt, Mycobacterium avium subsp. paratuberculosis
cgccgcgggccagccag

SEQ ID NO: 2995495 - RNA, 13 nt, Mycobacterium avium subsp. paratuberculosis
cgccgcgggcggu

SEQ ID NO: 2995496 - RNA, 21 nt, Mycobacterium avium subsp. paratuberculosis
cgccgcgggcucccgcucgcc

SEQ ID NO: 2995497 - RNA, 22 nt, Mycobacterium avium subsp. paratuberculosis
cgccgcgggcucccgcucgcca

SEQ ID NO: 2995498 - RNA, 20 nt, Mycobacterium avium subsp. paratuberculosis
cgccgcgggucggcgacggc

SEQ ID NO: 2995499 - RNA, 21 nt, Mycobacterium avium subsp. paratuberculosis
cgcccgucccgccgacggaga

SEQ ID NO: 2995500 - RNA, 23 nt, Mycobacterium avium subsp. paratuberculosis
cgcccgucccgccgacggagacg

SEQ ID NO: 2995501 - RNA, 16 nt, Mycobacterium avium subsp. paratuberculosis
cgcccgucccugcgcg

SEQ ID NO: 2995502 - RNA, 20 nt, Mycobacterium avium subsp. paratuberculosis
cgcccguccgggccggccag

SEQ ID NO: 2995503 - RNA, 22 nt, Mycobacterium avium subsp. paratuberculosis
cgcccgucgagcgucacgccgc

SEQ ID NO: 2995504 - RNA, 23 nt, Mycobacterium avium subsp. paratuberculosis
cgcccgucgagcgucacgccgcg

SEQ ID NO: 2995505 - RNA, 13 nt, Mycobacterium avium subsp. paratuberculosis
cgcccgucggggc

SEQ ID NO: 2995506 - RNA, 14 nt, Mycobacterium avium subsp. paratuberculosis
cgcccgucggggcc

SEQ ID NO: 2995507 - RNA, 17 nt, Mycobacterium avium subsp. paratuberculosis
cgcccgucggggcccgg

SEQ ID NO: 2995508 - RNA, 19 nt, Mycobacterium avium subsp. paratuberculosis
cgcccgucggggcccggcc

SEQ ID NO: 2995509 - RNA, 14 nt, Mycobacterium avium subsp. paratuberculosis
cgcccgucgguggg

SEQ ID NO: 2995510 - RNA, 18 nt, Mycobacterium avium subsp. paratuberculosis
cgcccgucggugggguga

SEQ ID NO: 2995511 - RNA, 15 nt, Mycobacterium avium subsp. paratuberculosis
cgcccgucgucgccg

SEQ ID NO: 2995512 - RNA, 14 nt, Mycobacterium avium subsp. paratuberculosis
cgcccgucgucggu

SEQ ID NO: 2995513 - RNA, 15 nt, Mycobacterium avium subsp. paratuberculosis
cgcccgucucggcgu

SEQ ID NO: 2995514 - RNA, 19 nt, Mycobacterium avium subsp. paratuberculosis
cgcccgucucggcgugcuc

SEQ ID NO: 2995515 - RNA, 22 nt, Mycobacterium avium subsp. paratuberculosis
cgcccgucucggcgugcucggc

SEQ ID NO: 2995516 - RNA, 18 nt, Mycobacterium avium subsp. paratuberculosis
cgcccguggcccacggga

SEQ ID NO: 2995517 - RNA, 19 nt, Mycobacterium avium subsp. paratuberculosis
cgcccguucgagcgccgga

SEQ ID NO: 2995518 - RNA, 23 nt, Mycobacterium avium subsp. paratuberculosis
cgcccguucgagcgccggacgcu

SEQ ID NO: 2995519 - RNA, 18 nt, Mycobacterium avium subsp. paratuberculosis
cgcccguugacgcccaug

SEQ ID NO: 2995520 - RNA, 18 nt, Mycobacterium avium subsp. paratuberculosis
cgcccuaacgugcccggc

SEQ ID NO: 2995521 - RNA, 20 nt, Mycobacterium avium subsp. paratuberculosis
cgcccuaacgugcccggccc

SEQ ID NO: 2995522 - RNA, 17 nt, Mycobacterium avium subsp. paratuberculosis
cgcccuagucgacgccg

SEQ ID NO: 2995523 - RNA, 18 nt, Mycobacterium avium subsp. paratuberculosis
cgcccuagucgacgccga

SEQ ID NO: 2995524 - RNA, 22 nt, Mycobacterium avium subsp. paratuberculosis
cgcccuagucgacgccgauggu

SEQ ID NO: 2995525 - RNA, 15 nt, Mycobacterium avium subsp. paratuberculosis
cgcccucaggcgucc

SEQ ID NO: 2995526 - RNA, 16 nt, Mycobacterium avium subsp. paratuberculosis
cgcccucaggcgucca

SEQ ID NO: 2995527 - RNA, 20 nt, Mycobacterium avium subsp. paratuberculosis
cgcccucaggcguccagcac

SEQ ID NO: 2995528 - RNA, 22 nt, Mycobacterium avium subsp. paratuberculosis
cgccgaaaugccgugccagccg

SEQ ID NO: 2995529 - RNA, 16 nt, Mycobacterium avium subsp. paratuberculosis
cgccgaacaacggcgg

SEQ ID NO: 2995530 - RNA, 17 nt, Mycobacterium avium subsp. paratuberculosis
cgccgaacaacggcgga

SEQ ID NO: 2995531 - RNA, 20 nt, Mycobacterium avium subsp. paratuberculosis
cgccgaacaacggcggaccg

SEQ ID NO: 2995532 - RNA, 14 nt, Mycobacterium avium subsp. paratuberculosis
cgccgaacaccacg

SEQ ID NO: 2995533 - RNA, 20 nt, Mycobacterium avium subsp. paratuberculosis
cgccgaacaccacgccgagc

SEQ ID NO: 2995534 - RNA, 19 nt, Mycobacterium avium subsp. paratuberculosis
cgccgaacaccggcagcgc

SEQ ID NO: 2995535 - RNA, 21 nt, Mycobacterium avium subsp. paratuberculosis
cgccgaacaccggcagcgcca

SEQ ID NO: 2995536 - RNA, 17 nt, Mycobacterium avium subsp. paratuberculosis
cgccgaacaccugcggc

SEQ ID NO: 2995537 - RNA, 18 nt, Mycobacterium avium subsp. paratuberculosis
cgccgaacaccugcggcg

SEQ ID NO: 2995538 - RNA, 20 nt, Mycobacterium avium subsp. paratuberculosis
cgccgaacaccugcggcggc

SEQ ID NO: 2995539 - RNA, 22 nt, Mycobacterium avium subsp. paratuberculosis
cgccgaacaccugcggcggcag

SEQ ID NO: 2995540 - RNA, 20 nt, Mycobacterium avium subsp. paratuberculosis
cgccgaacagaugccugccc

SEQ ID NO: 2995541 - RNA, 20 nt, Mycobacterium avium subsp. paratuberculosis
cgccgaacagcagcgcgccg

SEQ ID NO: 2995542 - RNA, 15 nt, Mycobacterium avium subsp. paratuberculosis
cgccgaacagccggg

SEQ ID NO: 2995543 - RNA, 15 nt, Mycobacterium avium subsp. paratuberculosis
cgccgaaccagaucg

SEQ ID NO: 2995544 - RNA, 21 nt, Mycobacterium avium subsp. paratuberculosis
cgccgaaccagaucggcgggu

SEQ ID NO: 2995545 - RNA, 23 nt, Mycobacterium avium subsp. paratuberculosis
cgccgaaccccagcuccggguag

SEQ ID NO: 2995546 - RNA, 12 nt, Mycobacterium avium subsp. paratuberculosis
cgccgaacccgc

SEQ ID NO: 2995547 - RNA, 13 nt, Mycobacterium avium subsp. paratuberculosis
cgccgaacccgcc

SEQ ID NO: 2995548 - RNA, 17 nt, Mycobacterium avium subsp. paratuberculosis
cgccgaacccgcccucg

SEQ ID NO: 2995549 - RNA, 20 nt, Mycobacterium avium subsp. paratuberculosis
cgccgaacccgcccucgccc

SEQ ID NO: 2995550 - RNA, 21 nt, Mycobacterium avium subsp. paratuberculosis
cgccgaacccgcccucgcccc

SEQ ID NO: 2995551 - RNA, 15 nt, Mycobacterium avium subsp. paratuberculosis
cgccgaaccgaucac

SEQ ID NO: 2995552 - RNA, 15 nt, Mycobacterium avium subsp. paratuberculosis
cgccgaaccgggcgc

SEQ ID NO: 2995553 - RNA, 16 nt, Mycobacterium avium subsp. paratuberculosis
cgccgaaccgggcgcg

SEQ ID NO: 2995554 - RNA, 18 nt, Mycobacterium avium subsp. paratuberculosis
cgccgaaccgggcgcgca

SEQ ID NO: 2995555 - RNA, 16 nt, Mycobacterium avium subsp. paratuberculosis
cgccgaaccggggccg

SEQ ID NO: 2995556 - RNA, 18 nt, Mycobacterium avium subsp. paratuberculosis
cgccgaaccggggccgca

SEQ ID NO: 2995557 - RNA, 14 nt, Mycobacterium avium subsp. paratuberculosis
cgccgaaccgggug

SEQ ID NO: 2995558 - RNA, 15 nt, Mycobacterium avium subsp. paratuberculosis
cgccgaacgcaccac

SEQ ID NO: 2995559 - RNA, 17 nt, Mycobacterium avium subsp. paratuberculosis
cgccgaacgcaccaccg

SEQ ID NO: 2995560 - RNA, 18 nt, Mycobacterium avium subsp. paratuberculosis
cgccgaacgcaccaccgc

SEQ ID NO: 2995561 - RNA, 13 nt, Mycobacterium avium subsp. paratuberculosis
cgccgaacgccgg

SEQ ID NO: 2995562 - RNA, 22 nt, Mycobacterium avium subsp. paratuberculosis
cgccgaacgccggauuggcguc

SEQ ID NO: 2995563 - RNA, 23 nt, Mycobacterium avium subsp. paratuberculosis
cgccgaacgccggauuggcgucg

SEQ ID NO: 2995564 - RNA, 18 nt, Mycobacterium avium subsp. paratuberculosis
cgccgaacgccuccgccg

SEQ ID NO: 2995565 - RNA, 19 nt, Mycobacterium avium subsp. paratuberculosis
cgccgaacgccuccgccgc

SEQ ID NO: 2995566 - RNA, 20 nt, Mycobacterium avium subsp. paratuberculosis
cgccgaacgccuccgccgcc

SEQ ID NO: 2995567 - RNA, 21 nt, Mycobacterium avium subsp. paratuberculosis
cgccgaacgccuccgccgccc

SEQ ID NO: 2995568 - RNA, 16 nt, Mycobacterium avium subsp. paratuberculosis
cgccgaacgucgagcg

SEQ ID NO: 2995569 - RNA, 22 nt, Mycobacterium avium subsp. paratuberculosis
cgccgaacgucgagcgcggccc

SEQ ID NO: 2995570 - RNA, 18 nt, Mycobacterium avium subsp. paratuberculosis
cgccgaacgugcgcggcg

SEQ ID NO: 2995571 - RNA, 14 nt, Mycobacterium avium subsp. paratuberculosis
cgccgaacucggcg

SEQ ID NO: 2995572 - RNA, 20 nt, Mycobacterium avium subsp. paratuberculosis
cgccgaacucggcgccgccg

SEQ ID NO: 2995573 - RNA, 21 nt, Mycobacterium avium subsp. paratuberculosis
cgccgaacugccggaccaggu

SEQ ID NO: 2995574 - RNA, 20 nt, Mycobacterium avium subsp. paratuberculosis
cgccgaagaucagcgcgucc

SEQ ID NO: 2995575 - RNA, 18 nt, Mycobacterium avium subsp. paratuberculosis
cgccgaagauggccagcg

SEQ ID NO: 2995576 - RNA, 21 nt, Mycobacterium avium subsp. paratuberculosis
cgccgaagauggccagcgcgg

SEQ ID NO: 2995577 - RNA, 15 nt, Mycobacterium avium subsp. paratuberculosis
cgccgaagcccgcag

SEQ ID NO: 2995578 - RNA, 16 nt, Mycobacterium avium subsp. paratuberculosis
cgccgaagccggcucg

SEQ ID NO: 2995579 - RNA, 19 nt, Mycobacterium avium subsp. paratuberculosis
cgccgaagccggcucgaaa

SEQ ID NO: 2995580 - RNA, 15 nt, Mycobacterium avium subsp. paratuberculosis
cgccgaagccgucga

SEQ ID NO: 2995581 - RNA, 16 nt, Mycobacterium avium subsp. paratuberculosis
cgccgaagccgucgac

SEQ ID NO: 2995582 - RNA, 23 nt, Mycobacterium avium subsp. paratuberculosis
cgccgaagccgucgaccccgccg

SEQ ID NO: 2995583 - RNA, 14 nt, Mycobacterium avium subsp. paratuberculosis
cgccaucuccuccg

SEQ ID NO: 2995584 - RNA, 20 nt, Mycobacterium avium subsp. paratuberculosis
cgccaucucgggagugcggc

SEQ ID NO: 2995585 - RNA, 20 nt, Mycobacterium avium subsp. paratuberculosis
cgccaucuucacgugcgcgg

SEQ ID NO: 2995586 - RNA, 23 nt, Mycobacterium avium subsp. paratuberculosis
cgccaucuucacgugcgcggcgu

SEQ ID NO: 2995587 - RNA, 16 nt, Mycobacterium avium subsp. paratuberculosis
cgccaugaacggcggg

SEQ ID NO: 2995588 - RNA, 17 nt, Mycobacterium avium subsp. paratuberculosis
cgccaugaacggcgggg

SEQ ID NO: 2995589 - RNA, 20 nt, Mycobacterium avium subsp. paratuberculosis
cgccaugaacggcggggccu

SEQ ID NO: 2995590 - RNA, 21 nt, Mycobacterium avium subsp. paratuberculosis
cgccaugaacucguccaccga

SEQ ID NO: 2995591 - RNA, 24 nt, Mycobacterium avium subsp. paratuberculosis
cgccaugaacucguccaccgacag

SEQ ID NO: 2995592 - RNA, 17 nt, Mycobacterium avium subsp. paratuberculosis
cgccaugccgccgaccg

SEQ ID NO: 2995593 - RNA, 19 nt, Mycobacterium avium subsp. paratuberculosis
cgccaugccgccgaccgcc

SEQ ID NO: 2995594 - RNA, 20 nt, Mycobacterium avium subsp. paratuberculosis
cgccaugccgccgaccgccg

SEQ ID NO: 2995595 - RNA, 15 nt, Mycobacterium avium subsp. paratuberculosis
cgccaugccgucgcg

SEQ ID NO: 2995596 - RNA, 17 nt, Mycobacterium avium subsp. paratuberculosis
cgccaugccgucgcgca

SEQ ID NO: 2995597 - RNA, 18 nt, Mycobacterium avium subsp. paratuberculosis
cgccaugccgucgcgcac

SEQ ID NO: 2995598 - RNA, 14 nt, Mycobacterium avium subsp. paratuberculosis
cgccaugcgccgcg

SEQ ID NO: 2995599 - RNA, 15 nt, Mycobacterium avium subsp. paratuberculosis
cgccaugcgccgcgc

SEQ ID NO: 2995600 - RNA, 14 nt, Mycobacterium avium subsp. paratuberculosis
cgccaugcugcccu

SEQ ID NO: 2995601 - RNA, 20 nt, Mycobacterium avium subsp. paratuberculosis
cgccaugcuggcacuccuug

SEQ ID NO: 2995602 - RNA, 13 nt, Mycobacterium avium subsp. paratuberculosis
cgccauggcggca

SEQ ID NO: 2995603 - RNA, 15 nt, Mycobacterium avium subsp. paratuberculosis
cgccauggcggcauc

SEQ ID NO: 2995604 - RNA, 16 nt, Mycobacterium avium subsp. paratuberculosis
cgccauggcggcaucc

SEQ ID NO: 2995605 - RNA, 15 nt, Mycobacterium avium subsp. paratuberculosis
cgccaugggcaucgu

SEQ ID NO: 2995606 - RNA, 16 nt, Mycobacterium avium subsp. paratuberculosis
cgccauguacagaccc

SEQ ID NO: 2995607 - RNA, 15 nt, Mycobacterium avium subsp. paratuberculosis
cgccauguccggcag

SEQ ID NO: 2995608 - RNA, 16 nt, Mycobacterium avium subsp. paratuberculosis
cgccauguccggcagg

SEQ ID NO: 2995609 - RNA, 21 nt, Mycobacterium avium subsp. paratuberculosis
cgccauguccggcaggcucag

SEQ ID NO: 2995610 - RNA, 15 nt, Mycobacterium avium subsp. paratuberculosis
cgccaugugccggcg

SEQ ID NO: 2995611 - RNA, 18 nt, Mycobacterium avium subsp. paratuberculosis
cgccaugugccggcgcuc

SEQ ID NO: 2995612 - RNA, 23 nt, Mycobacterium avium subsp. paratuberculosis
cgccauuuccguugugccaccgc

SEQ ID NO: 2995613 - RNA, 21 nt, Mycobacterium avium subsp. paratuberculosis
cgcccaacaacucgacguucg

SEQ ID NO: 2995614 - RNA, 22 nt, Mycobacterium avium subsp. paratuberculosis
cgcccaacaacucgacguucgg

SEQ ID NO: 2995615 - RNA, 24 nt, Mycobacterium avium subsp. paratuberculosis
cgcccaacaacucgacguucggcg

SEQ ID NO: 2995616 - RNA, 15 nt, Mycobacterium avium subsp. paratuberculosis
cgcccaacgacgucg

SEQ ID NO: 2995617 - RNA, 16 nt, Mycobacterium avium subsp. paratuberculosis
cgcccaacgacgucgg

SEQ ID NO: 2995618 - RNA, 21 nt, Mycobacterium avium subsp. paratuberculosis
cgcccaacgacgucggcguca

SEQ ID NO: 2995619 - RNA, 22 nt, Mycobacterium avium subsp. paratuberculosis
cgcccacaccgacaccggccgg

SEQ ID NO: 2995620 - RNA, 23 nt, Mycobacterium avium subsp. paratuberculosis
cgcccacaccgacaccggccggg

SEQ ID NO: 2995621 - RNA, 13 nt, Mycobacterium avium subsp. paratuberculosis
cgcccacaccgga

SEQ ID NO: 2995622 - RNA, 14 nt, Mycobacterium avium subsp. paratuberculosis
cgcccacagcaacg

SEQ ID NO: 2995623 - RNA, 14 nt, Mycobacterium avium subsp. paratuberculosis
cgcccacagcaggu

SEQ ID NO: 2995624 - RNA, 13 nt, Mycobacterium avium subsp. paratuberculosis
cgcccacagcgcc

SEQ ID NO: 2995625 - RNA, 18 nt, Mycobacterium avium subsp. paratuberculosis
cgcccacagcgccagcac

SEQ ID NO: 2995626 - RNA, 15 nt, Mycobacterium avium subsp. paratuberculosis
cgcccacagcugacg

SEQ ID NO: 2995627 - RNA, 22 nt, Mycobacterium avium subsp. paratuberculosis
cgcccacagcugacgggccggc

SEQ ID NO: 2995628 - RNA, 13 nt, Mycobacterium avium subsp. paratuberculosis
cgcccacaggucc

SEQ ID NO: 2995629 - RNA, 14 nt, Mycobacterium avium subsp. paratuberculosis
cgcccacaggucca

SEQ ID NO: 2995630 - RNA, 18 nt, Mycobacterium avium subsp. paratuberculosis
cgcccacaguccgcccag

SEQ ID NO: 2995631 - RNA, 12 nt, Mycobacterium avium subsp. paratuberculosis
cgcccaccaccg

SEQ ID NO: 2995632 - RNA, 14 nt, Mycobacterium avium subsp. paratuberculosis
cgcccaccaccggc

SEQ ID NO: 2995633 - RNA, 15 nt, Mycobacterium avium subsp. paratuberculosis
cgcccaccaccggcu

SEQ ID NO: 2995634 - RNA, 21 nt, Mycobacterium avium subsp. paratuberculosis
cgcccaccacgaaccaggcgc

SEQ ID NO: 2995635 - RNA, 21 nt, Mycobacterium avium subsp. paratuberculosis
cgcccaccacgaacgcgccgc

SEQ ID NO: 2995636 - RNA, 22 nt, Mycobacterium avium subsp. paratuberculosis
cgcccaccacgaacgcgccgcc

SEQ ID NO: 2995637 - RNA, 20 nt, Mycobacterium avium subsp. paratuberculosis
cgcccaccacgacgacgugg

SEQ ID NO: 2995638 - RNA, 22 nt, Mycobacterium avium subsp. paratuberculosis
cgcccaccacgacgacguggug

SEQ ID NO: 2995639 - RNA, 13 nt, Mycobacterium avium subsp. paratuberculosis
cgcccaccccggc

SEQ ID NO: 2995640 - RNA, 22 nt, Mycobacterium avium subsp. paratuberculosis
cgcccaccccggcguccacgcc

SEQ ID NO: 2995641 - RNA, 19 nt, Mycobacterium avium subsp. paratuberculosis
cgcccacccgaugaccggc

SEQ ID NO: 2995642 - RNA, 22 nt, Mycobacterium avium subsp. paratuberculosis
cgcccacccgaugaccggcccg

SEQ ID NO: 2995643 - RNA, 16 nt, Mycobacterium avium subsp. paratuberculosis
cgcccacccgccagcc

SEQ ID NO: 2995644 - RNA, 18 nt, Mycobacterium avium subsp. paratuberculosis
cgcccacccgccagcccg

SEQ ID NO: 2995645 - RNA, 20 nt, Mycobacterium avium subsp. paratuberculosis
cgcccacccgccagcccgcg

SEQ ID NO: 2995646 - RNA, 23 nt, Mycobacterium avium subsp. paratuberculosis
cgcccacccgccagcccgcgucg

SEQ ID NO: 2995647 - RNA, 13 nt, Mycobacterium avium subsp. paratuberculosis
cgcccacccgcgc

SEQ ID NO: 2995648 - RNA, 15 nt, Mycobacterium avium subsp. paratuberculosis
cgcccacccgcgcac

SEQ ID NO: 2995649 - RNA, 17 nt, Mycobacterium avium subsp. paratuberculosis
cgcccacccgcgccggc

SEQ ID NO: 2995650 - RNA, 18 nt, Mycobacterium avium subsp. paratuberculosis
cgcccacccgcgccggca

SEQ ID NO: 2995651 - RNA, 20 nt, Mycobacterium avium subsp. paratuberculosis
cgcccacccgcgccggcaga

SEQ ID NO: 2995652 - RNA, 12 nt, Mycobacterium avium subsp. paratuberculosis
cgcccacccggg

SEQ ID NO: 2995653 - RNA, 16 nt, Mycobacterium avium subsp. paratuberculosis
cgcccaccgacgcggc

SEQ ID NO: 2995654 - RNA, 21 nt, Mycobacterium avium subsp. paratuberculosis
cgcccaccgacgcggcggccg

SEQ ID NO: 2995655 - RNA, 22 nt, Mycobacterium avium subsp. paratuberculosis
cgcccaccgacgcggcggccga

SEQ ID NO: 2995656 - RNA, 15 nt, Mycobacterium avium subsp. paratuberculosis
cgcccaccgcggcgc

SEQ ID NO: 2995657 - RNA, 16 nt, Mycobacterium avium subsp. paratuberculosis
cgcccaccgcggcgcg

SEQ ID NO: 2995658 - RNA, 16 nt, Mycobacterium avium subsp. paratuberculosis
cgcccaccuggaggcc

SEQ ID NO: 2995659 - RNA, 24 nt, Mycobacterium avium subsp. paratuberculosis
cgcccaccuggaggccaacgagcg

SEQ ID NO: 2995660 - RNA, 22 nt, Mycobacterium avium subsp. paratuberculosis
cgcccaccugguucucccgucg

SEQ ID NO: 2995661 - RNA, 14 nt, Mycobacterium avium subsp. paratuberculosis
cgcccaccuuggcg

SEQ ID NO: 2995662 - RNA, 17 nt, Mycobacterium avium subsp. paratuberculosis
cgcccaccuuggcgucg

SEQ ID NO: 2995663 - RNA, 18 nt, Mycobacterium avium subsp. paratuberculosis
cgcccaccuuggcgucga

SEQ ID NO: 2995664 - RNA, 13 nt, Mycobacterium avium subsp. paratuberculosis
cgcccacgccgag

SEQ ID NO: 2995665 - RNA, 14 nt, Mycobacterium avium subsp. paratuberculosis
cgcccacgccgccc

SEQ ID NO: 2995666 - RNA, 16 nt, Mycobacterium avium subsp. paratuberculosis
cgcccacgccgcccag

SEQ ID NO: 2995667 - RNA, 12 nt, Mycobacterium avium subsp. paratuberculosis
cgcccagcgcgg

SEQ ID NO: 2995668 - RNA, 13 nt, Mycobacterium avium subsp. paratuberculosis
cgcccagcgcggc

SEQ ID NO: 2995669 - RNA, 14 nt, Mycobacterium avium subsp. paratuberculosis
cgcccagcgcggcg

SEQ ID NO: 2995670 - RNA, 15 nt, Mycobacterium avium subsp. paratuberculosis
cgcccagcgcggcgg

SEQ ID NO: 2995671 - RNA, 17 nt, Mycobacterium avium subsp. paratuberculosis
cgcccagcgcggcggcc

SEQ ID NO: 2995672 - RNA, 20 nt, Mycobacterium avium subsp. paratuberculosis
cgcccagcgcggcggccacc

SEQ ID NO: 2995673 - RNA, 22 nt, Mycobacterium avium subsp. paratuberculosis
cgcccagcgcggcggccaccuc

SEQ ID NO: 2995674 - RNA, 13 nt, Mycobacterium avium subsp. paratuberculosis
cgcccagcggcac

SEQ ID NO: 2995675 - RNA, 15 nt, Mycobacterium avium subsp. paratuberculosis
cgcccagcggcacga

SEQ ID NO: 2995676 - RNA, 15 nt, Mycobacterium avium subsp. paratuberculosis
cgcccagcggccccg

SEQ ID NO: 2995677 - RNA, 15 nt, Mycobacterium avium subsp. paratuberculosis
cgcccagcggcgaug

SEQ ID NO: 2995678 - RNA, 16 nt, Mycobacterium avium subsp. paratuberculosis
cgcccagcggcgaugc

SEQ ID NO: 2995679 - RNA, 15 nt, Mycobacterium avium subsp. paratuberculosis
cgcccagcggcuuga

SEQ ID NO: 2995680 - RNA, 17 nt, Mycobacterium avium subsp. paratuberculosis
cgcccagcgucucggcg

SEQ ID NO: 2995681 - RNA, 18 nt, Mycobacterium avium subsp. paratuberculosis
cgcccagcgucucggcgg

SEQ ID NO: 2995682 - RNA, 20 nt, Mycobacterium avium subsp. paratuberculosis
cgcccagcgucucggcggcc

SEQ ID NO: 2995683 - RNA, 21 nt, Mycobacterium avium subsp. paratuberculosis
cgcccagcgucucggcggccg

SEQ ID NO: 2995684 - RNA, 22 nt, Mycobacterium avium subsp. paratuberculosis
cgcccagcgucucggcggccga

SEQ ID NO: 2995685 - RNA, 23 nt, Mycobacterium avium subsp. paratuberculosis
cgcccagcgucucggcggccgag

SEQ ID NO: 2995686 - RNA, 22 nt, Mycobacterium avium subsp. paratuberculosis
cgcccagcguggucacccgcag

SEQ ID NO: 2995687 - RNA, 16 nt, Mycobacterium avium subsp. paratuberculosis
cgcccagcgugucggc

SEQ ID NO: 2995688 - RNA, 15 nt, Mycobacterium avium subsp. paratuberculosis
cgcccagcugcaccc

SEQ ID NO: 2995689 - RNA, 16 nt, Mycobacterium avium subsp. paratuberculosis
cgcccagcugcaccca

SEQ ID NO: 2995690 - RNA, 22 nt, Mycobacterium avium subsp. paratuberculosis
cgcccagcugcacccaccggcc

SEQ ID NO: 2995691 - RNA, 19 nt, Mycobacterium avium subsp. paratuberculosis
cgcccagcugggccagcgc

SEQ ID NO: 2995692 - RNA, 17 nt, Mycobacterium avium subsp. paratuberculosis
cgcccaggaacgcgccg

SEQ ID NO: 2995693 - RNA, 18 nt, Mycobacterium avium subsp. paratuberculosis
cgcccaggaacgcgccgg

SEQ ID NO: 2995694 - RNA, 19 nt, Mycobacterium avium subsp. paratuberculosis
cgcccaggaacgcgccggc

SEQ ID NO: 2995695 - RNA, 20 nt, Mycobacterium avium subsp. paratuberculosis
cgcccaggaacgcgccggcg

SEQ ID NO: 2995696 - RNA, 21 nt, Mycobacterium avium subsp. paratuberculosis
cgcccaggaacgcgccggcgc

SEQ ID NO: 2995697 - RNA, 15 nt, Mycobacterium avium subsp. paratuberculosis
cgcccaggaacuggu

SEQ ID NO: 2995698 - RNA, 19 nt, Mycobacterium avium subsp. paratuberculosis
cgcccaggaacuggucgaa

SEQ ID NO: 2995699 - RNA, 13 nt, Mycobacterium avium subsp. paratuberculosis
cgcccaggccccg

SEQ ID NO: 2995700 - RNA, 15 nt, Mycobacterium avium subsp. paratuberculosis
cgcccaggccccggc

SEQ ID NO: 2995701 - RNA, 20 nt, Mycobacterium avium subsp. paratuberculosis
cgcccaggccccggccgagc

SEQ ID NO: 2995702 - RNA, 13 nt, Mycobacterium avium subsp. paratuberculosis
cgcccaggcccga

SEQ ID NO: 2995703 - RNA, 12 nt, Mycobacterium avium subsp. paratuberculosis
cgcccaggccga

SEQ ID NO: 2995704 - RNA, 16 nt, Mycobacterium avium subsp. paratuberculosis
cgcccaggccgagcgc

SEQ ID NO: 2995705 - RNA, 16 nt, Mycobacterium avium subsp. paratuberculosis
cgcccaggccgccagc

SEQ ID NO: 2995706 - RNA, 19 nt, Mycobacterium avium subsp. paratuberculosis
cgcccaggccgccagcucg

SEQ ID NO: 2995707 - RNA, 20 nt, Mycobacterium avium subsp. paratuberculosis
cgcccaggcgggccagcucg

SEQ ID NO: 2995708 - RNA, 21 nt, Mycobacterium avium subsp. paratuberculosis
cgcccaggcgugcgcgugggu

SEQ ID NO: 2995709 - RNA, 22 nt, Mycobacterium avium subsp. paratuberculosis
cgcccaggcgugcgcgugggug

SEQ ID NO: 2995710 - RNA, 20 nt, Mycobacterium avium subsp. paratuberculosis
cgcccaggcucaggaucagc

SEQ ID NO: 2995711 - RNA, 21 nt, Mycobacterium avium subsp. paratuberculosis
cgcccaggcucaggaucagca

SEQ ID NO: 2995712 - RNA, 17 nt, Mycobacterium avium subsp. paratuberculosis
cgcccaggcugaacacc

SEQ ID NO: 2995713 - RNA, 19 nt, Mycobacterium avium subsp. paratuberculosis
cgcccagggcgugcgcggc

SEQ ID NO: 2995714 - RNA, 20 nt, Mycobacterium avium subsp. paratuberculosis
cgcccagggcgugcgcggcc

SEQ ID NO: 2995715 - RNA, 23 nt, Mycobacterium avium subsp. paratuberculosis
cgcccagggcgugcgcggccgcc

SEQ ID NO: 2995716 - RNA, 18 nt, Mycobacterium avium subsp. paratuberculosis
cgcccaggggagcggcgg

SEQ ID NO: 2995717 - RNA, 19 nt, Mycobacterium avium subsp. paratuberculosis
cgcccaggggagcggcgga

SEQ ID NO: 2995718 - RNA, 17 nt, Mycobacterium avium subsp. paratuberculosis
cgcccagguccaccagg

SEQ ID NO: 2995719 - RNA, 19 nt, Mycobacterium avium subsp. paratuberculosis
cgcccagguccaccaggug

SEQ ID NO: 2995720 - RNA, 14 nt, Mycobacterium avium subsp. paratuberculosis
cgcccagucgccgc

SEQ ID NO: 2995721 - RNA, 15 nt, Mycobacterium avium subsp. paratuberculosis
cgcccagucgccgcc

SEQ ID NO: 2995722 - RNA, 17 nt, Mycobacterium avium subsp. paratuberculosis
cgcccagucgccgccgc

SEQ ID NO: 2995723 - RNA, 18 nt, Mycobacterium avium subsp. paratuberculosis
cgcccagucgccgccgcg

SEQ ID NO: 2995724 - RNA, 21 nt, Mycobacterium avium subsp. paratuberculosis
cgcccagucgccgccgcgcac

SEQ ID NO: 2995725 - RNA, 17 nt, Mycobacterium avium subsp. paratuberculosis
cgcccagugcgcgccgu

SEQ ID NO: 2995726 - RNA, 19 nt, Mycobacterium avium subsp. paratuberculosis
cgcccagugcgcgccgugu

SEQ ID NO: 2995727 - RNA, 18 nt, Mycobacterium avium subsp. paratuberculosis
cgcccaguguggggccua

SEQ ID NO: 2995728 - RNA, 17 nt, Mycobacterium avium subsp. paratuberculosis
cgcccaguugcacggug

SEQ ID NO: 2995729 - RNA, 18 nt, Mycobacterium avium subsp. paratuberculosis
cgcccaguugcacggugu

SEQ ID NO: 2995730 - RNA, 15 nt, Mycobacterium avium subsp. paratuberculosis
cgcccaucaccagca

SEQ ID NO: 2995731 - RNA, 16 nt, Mycobacterium avium subsp. paratuberculosis
cgcccaucaccccgaa

SEQ ID NO: 2995732 - RNA, 14 nt, Mycobacterium avium subsp. paratuberculosis
cgcccaucaccgca

SEQ ID NO: 2995733 - RNA, 16 nt, Mycobacterium avium subsp. paratuberculosis
cgcccaucaccgcacc

SEQ ID NO: 2995734 - RNA, 13 nt, Mycobacterium avium subsp. paratuberculosis
cgcccaucagcag

SEQ ID NO: 2995735 - RNA, 22 nt, Mycobacterium avium subsp. paratuberculosis
cgcccaucagcaggaccaggcc

SEQ ID NO: 2995736 - RNA, 15 nt, Mycobacterium avium subsp. paratuberculosis
cgcccauccggcgcc

SEQ ID NO: 2995737 - RNA, 21 nt, Mycobacterium avium subsp. paratuberculosis
cgcccauccggcgccgcgcaa

SEQ ID NO: 2995738 - RNA, 15 nt, Mycobacterium avium subsp. paratuberculosis
cgcccaucgcggccg

SEQ ID NO: 2995739 - RNA, 16 nt, Mycobacterium avium subsp. paratuberculosis
cgcccaucgcggccgc

SEQ ID NO: 2995740 - RNA, 18 nt, Mycobacterium avium subsp. paratuberculosis
cgcccaucgcggccgccc

SEQ ID NO: 2995741 - RNA, 13 nt, Mycobacterium avium subsp. paratuberculosis
cgcccaugcacga

SEQ ID NO: 2995742 - RNA, 14 nt, Mycobacterium avium subsp. paratuberculosis
cgcccaugcacgau

SEQ ID NO: 2995743 - RNA, 17 nt, Mycobacterium avium subsp. paratuberculosis
cgcccauuugccggugu

SEQ ID NO: 2995744 - RNA, 13 nt, Mycobacterium avium subsp. paratuberculosis
cgccccacggcgc

SEQ ID NO: 2995745 - RNA, 14 nt, Mycobacterium avium subsp. paratuberculosis
cgccccacggcgcg

SEQ ID NO: 2995746 - RNA, 18 nt, Mycobacterium avium subsp. paratuberculosis
cgccccacggcgcgugcu

SEQ ID NO: 2995747 - RNA, 21 nt, Mycobacterium avium subsp. paratuberculosis
cgccccagaacugguccucca

SEQ ID NO: 2995748 - RNA, 22 nt, Mycobacterium avium subsp. paratuberculosis
cgccccagacguuuccguccgg

SEQ ID NO: 2995749 - RNA, 23 nt, Mycobacterium avium subsp. paratuberculosis
cgccccagacguuuccguccggc

SEQ ID NO: 2995750 - RNA, 12 nt, Mycobacterium avium subsp. paratuberculosis
cgccccagcccc

SEQ ID NO: 2995751 - RNA, 17 nt, Mycobacterium avium subsp. paratuberculosis
cgccccagccccucgcc

SEQ ID NO: 2995752 - RNA, 13 nt, Mycobacterium avium subsp. paratuberculosis
cgccccgccgcgg

SEQ ID NO: 2995753 - RNA, 15 nt, Mycobacterium avium subsp. paratuberculosis
cgccccgccgcggcc

SEQ ID NO: 2995754 - RNA, 22 nt, Mycobacterium avium subsp. paratuberculosis
cgccccgccgcggccaggucga

SEQ ID NO: 2995755 - RNA, 14 nt, Mycobacterium avium subsp. paratuberculosis
cgccccgccggugu

SEQ ID NO: 2995756 - RNA, 22 nt, Mycobacterium avium subsp. paratuberculosis
cgccccgccggugucggcgacc

SEQ ID NO: 2995757 - RNA, 15 nt, Mycobacterium avium subsp. paratuberculosis
cgccccgcuaaagcc

SEQ ID NO: 2995758 - RNA, 16 nt, Mycobacterium avium subsp. paratuberculosis
cgccccggaguagacc

SEQ ID NO: 2995759 - RNA, 14 nt, Mycobacterium avium subsp. paratuberculosis
cgccccggcccggc

SEQ ID NO: 2995760 - RNA, 16 nt, Mycobacterium avium subsp. paratuberculosis
cgccccggcccggcga

SEQ ID NO: 2995761 - RNA, 13 nt, Mycobacterium avium subsp. paratuberculosis
cgccccggcccgu

SEQ ID NO: 2995762 - RNA, 12 nt, Mycobacterium avium subsp. paratuberculosis
cgccccggccgc

SEQ ID NO: 2995763 - RNA, 18 nt, Mycobacterium avium subsp. paratuberculosis
cgccccggccgcgcaccg

SEQ ID NO: 2995764 - RNA, 14 nt, Mycobacterium avium subsp. paratuberculosis
cgccccggccgcgg

SEQ ID NO: 2995765 - RNA, 12 nt, Mycobacterium avium subsp. paratuberculosis
cgccccggccgu

SEQ ID NO: 2995766 - RNA, 23 nt, Mycobacterium avium subsp. paratuberculosis
cgccccggccguucuugcgggug

SEQ ID NO: 2995767 - RNA, 13 nt, Mycobacterium avium subsp. paratuberculosis
cgccccggccuga

SEQ ID NO: 2995768 - RNA, 13 nt, Mycobacterium avium subsp. paratuberculosis
cgccccggcgacg

SEQ ID NO: 2995769 - RNA, 22 nt, Mycobacterium avium subsp. paratuberculosis
cgccccggcgacgucgccggcc

SEQ ID NO: 2995770 - RNA, 13 nt, Mycobacterium avium subsp. paratuberculosis
cgccccggcgcag

SEQ ID NO: 2995771 - RNA, 23 nt, Mycobacterium avium subsp. paratuberculosis
cgccccggcgcagcgccgcgccg

SEQ ID NO: 2995772 - RNA, 17 nt, Mycobacterium avium subsp. paratuberculosis
cgccccggcgccgucgu

SEQ ID NO: 2995773 - RNA, 23 nt, Mycobacterium avium subsp. paratuberculosis
cgccccggcgccgucguucucca

SEQ ID NO: 2995774 - RNA, 15 nt, Mycobacterium avium subsp. paratuberculosis
cgccccggcgcgccu

SEQ ID NO: 2995775 - RNA, 20 nt, Mycobacterium avium subsp. paratuberculosis
cgccccggcgcgccugcgcg

SEQ ID NO: 2995776 - RNA, 12 nt, Mycobacterium avium subsp. paratuberculosis
cgccccggcgcu

SEQ ID NO: 2995777 - RNA, 13 nt, Mycobacterium avium subsp. paratuberculosis
cgccccggcgcug

SEQ ID NO: 2995778 - RNA, 21 nt, Mycobacterium avium subsp. paratuberculosis
cgccccggcggccacgcaggc

SEQ ID NO: 2995779 - RNA, 12 nt, Mycobacterium avium subsp. paratuberculosis
cgccccggcggg

SEQ ID NO: 2995780 - RNA, 17 nt, Mycobacterium avium subsp. paratuberculosis
cgccccggcgggcggcc

SEQ ID NO: 2995781 - RNA, 19 nt, Mycobacterium avium subsp. paratuberculosis
cgccccggcgggcggccga

SEQ ID NO: 2995782 - RNA, 13 nt, Mycobacterium avium subsp. paratuberculosis
cgccccggcgggu

SEQ ID NO: 2995783 - RNA, 15 nt, Mycobacterium avium subsp. paratuberculosis
cgccccggcgggucu

SEQ ID NO: 2995784 - RNA, 22 nt, Mycobacterium avium subsp. paratuberculosis
cgccccgggauccgaggcguca

SEQ ID NO: 2995785 - RNA, 17 nt, Mycobacterium avium subsp. paratuberculosis
cgccccggucaccccgg

SEQ ID NO: 2995786 - RNA, 18 nt, Mycobacterium avium subsp. paratuberculosis
cgccccggucaccccggc

SEQ ID NO: 2995787 - RNA, 20 nt, Mycobacterium avium subsp. paratuberculosis
cgccccggucaccccggcca

SEQ ID NO: 2995788 - RNA, 16 nt, Mycobacterium avium subsp. paratuberculosis
cgccccggucccgccg

SEQ ID NO: 2995789 - RNA, 17 nt, Mycobacterium avium subsp. paratuberculosis
cgccccgguccggcuga

SEQ ID NO: 2995790 - RNA, 15 nt, Mycobacterium avium subsp. paratuberculosis
cgccccgucggucgg

SEQ ID NO: 2995791 - RNA, 13 nt, Mycobacterium avium subsp. paratuberculosis
cgccccuccaggc

SEQ ID NO: 2995792 - RNA, 18 nt, Mycobacterium avium subsp. paratuberculosis
cgccccugagggugucgg

SEQ ID NO: 2995793 - RNA, 20 nt, Mycobacterium avium subsp. paratuberculosis
cgccccugagggugucggcg

SEQ ID NO: 2995794 - RNA, 21 nt, Mycobacterium avium subsp. paratuberculosis
cgccccugagggugucggcga

SEQ ID NO: 2995795 - RNA, 23 nt, Mycobacterium avium subsp. paratuberculosis
cgccccugagggugucggcgauc

SEQ ID NO: 2995796 - RNA, 20 nt, Mycobacterium avium subsp. paratuberculosis
cgccccugcuggguuccgcg

SEQ ID NO: 2995797 - RNA, 15 nt, Mycobacterium avium subsp. paratuberculosis
cgccccuggcgucgg

SEQ ID NO: 2995798 - RNA, 14 nt, Mycobacterium avium subsp. paratuberculosis
cgcccgaaccgcgu

SEQ ID NO: 2995799 - RNA, 17 nt, Mycobacterium avium subsp. paratuberculosis
cgcccgaaccgcgucca

SEQ ID NO: 2995800 - RNA, 20 nt, Mycobacterium avium subsp. paratuberculosis
cgcccgaaccgcguccacga

SEQ ID NO: 2995801 - RNA, 20 nt, Mycobacterium avium subsp. paratuberculosis
cgcccgaacucauggcgugc

SEQ ID NO: 2995802 - RNA, 18 nt, Mycobacterium avium subsp. paratuberculosis
cgcccgacauccaggacc

SEQ ID NO: 2995803 - RNA, 16 nt, Mycobacterium avium subsp. paratuberculosis
cgcccgacccguccag

SEQ ID NO: 2995804 - RNA, 17 nt, Mycobacterium avium subsp. paratuberculosis
cgcccgacccguccagc

SEQ ID NO: 2995805 - RNA, 14 nt, Mycobacterium avium subsp. paratuberculosis
cgcccgacgacgac

SEQ ID NO: 2995806 - RNA, 14 nt, Mycobacterium avium subsp. paratuberculosis
cgcccgacgaugcg

SEQ ID NO: 2995807 - RNA, 20 nt, Mycobacterium avium subsp. paratuberculosis
cgcccgacgaugcggggcgg

SEQ ID NO: 2995808 - RNA, 22 nt, Mycobacterium avium subsp. paratuberculosis
cgcccgacgaugcggggcggcg

SEQ ID NO: 2995809 - RNA, 18 nt, Mycobacterium avium subsp. paratuberculosis
cgcccgacggucgccacc

SEQ ID NO: 2995810 - RNA, 20 nt, Mycobacterium avium subsp. paratuberculosis
cgcccgacggucgccaccac

SEQ ID NO: 2995811 - RNA, 19 nt, Mycobacterium avium subsp. paratuberculosis
cgcccgagaguccgccgcc

SEQ ID NO: 2995812 - RNA, 21 nt, Mycobacterium avium subsp. paratuberculosis
cgcccgagcauuucgcgcacg

SEQ ID NO: 2995813 - RNA, 23 nt, Mycobacterium avium subsp. paratuberculosis
cgcccgagcauuucgcgcacguc

SEQ ID NO: 2995814 - RNA, 14 nt, Mycobacterium avium subsp. paratuberculosis
cgcccgagcgucau

SEQ ID NO: 2995815 - RNA, 16 nt, Mycobacterium avium subsp. paratuberculosis
cgcccgagcgucauuc

SEQ ID NO: 2995816 - RNA, 22 nt, Mycobacterium avium subsp. paratuberculosis
cgcccgagcgucauuccgccgc

SEQ ID NO: 2995817 - RNA, 14 nt, Mycobacterium avium subsp. paratuberculosis
cgcccgaucccggg

SEQ ID NO: 2995818 - RNA, 15 nt, Mycobacterium avium subsp. paratuberculosis
cgcccgaucccgggc

SEQ ID NO: 2995819 - RNA, 16 nt, Mycobacterium avium subsp. paratuberculosis
cgcccgaucccgggcc

SEQ ID NO: 2995820 - RNA, 19 nt, Mycobacterium avium subsp. paratuberculosis
cgcccgaucccgucgucgg

SEQ ID NO: 2995821 - RNA, 20 nt, Mycobacterium avium subsp. paratuberculosis
cgcccgaucccgucgucggc

SEQ ID NO: 2995822 - RNA, 21 nt, Mycobacterium avium subsp. paratuberculosis
cgcccgaucccgucgucggcg

SEQ ID NO: 2995823 - RNA, 23 nt, Mycobacterium avium subsp. paratuberculosis
cgcccgaucccgucgucggcgcc

SEQ ID NO: 2995824 - RNA, 13 nt, Mycobacterium avium subsp. paratuberculosis
cgcccgaucggca

SEQ ID NO: 2995825 - RNA, 16 nt, Mycobacterium avium subsp. paratuberculosis
cgcccgaucggcaccc

SEQ ID NO: 2995826 - RNA, 18 nt, Mycobacterium avium subsp. paratuberculosis
cgcccgaucggcacccgc

SEQ ID NO: 2995827 - RNA, 22 nt, Mycobacterium avium subsp. paratuberculosis
cgcccgaucggcacccgcaaca

SEQ ID NO: 2995828 - RNA, 13 nt, Mycobacterium avium subsp. paratuberculosis
cgcccgaucggcg

SEQ ID NO: 2995829 - RNA, 16 nt, Mycobacterium avium subsp. paratuberculosis
cgcccgaucggcguga

SEQ ID NO: 2995830 - RNA, 20 nt, Mycobacterium avium subsp. paratuberculosis
cgcccgaucugggaucggug

SEQ ID NO: 2995831 - RNA, 13 nt, Mycobacterium avium subsp. paratuberculosis
cgcccgauggagg

SEQ ID NO: 2995832 - RNA, 16 nt, Mycobacterium avium subsp. paratuberculosis
cgcccgauuccccggc

SEQ ID NO: 2995833 - RNA, 18 nt, Mycobacterium avium subsp. paratuberculosis
cgcccgauuccccggcgu

SEQ ID NO: 2995834 - RNA, 14 nt, Mycobacterium avium subsp. paratuberculosis
cgcccgauucgcgg

SEQ ID NO: 2995835 - RNA, 16 nt, Mycobacterium avium subsp. paratuberculosis
cgcccgauucgcggcc

SEQ ID NO: 2995836 - RNA, 16 nt, Mycobacterium avium subsp. paratuberculosis
cgcccgcaacuccaca

SEQ ID NO: 2995837 - RNA, 13 nt, Mycobacterium avium subsp. paratuberculosis
cgcccgcaccacg

SEQ ID NO: 2995838 - RNA, 14 nt, Mycobacterium avium subsp. paratuberculosis
cgcccgcaccacga

SEQ ID NO: 2995839 - RNA, 15 nt, Mycobacterium avium subsp. paratuberculosis
cgcccgcaccacgac

SEQ ID NO: 2995840 - RNA, 16 nt, Mycobacterium avium subsp. paratuberculosis
cgcccgcaccacgacc

SEQ ID NO: 2995841 - RNA, 12 nt, Mycobacterium avium subsp. paratuberculosis
cgcccgcaccag

SEQ ID NO: 2995842 - RNA, 14 nt, Mycobacterium avium subsp. paratuberculosis
cgcccgcaccagca

SEQ ID NO: 2995843 - RNA, 15 nt, Mycobacterium avium subsp. paratuberculosis
cgcccgcaccugcgc

SEQ ID NO: 2995844 - RNA, 14 nt, Mycobacterium avium subsp. paratuberculosis
cgcccgcagcacgc

SEQ ID NO: 2995845 - RNA, 16 nt, Mycobacterium avium subsp. paratuberculosis
cgcccgcagcacgccc

SEQ ID NO: 2995846 - RNA, 11 nt, Mycobacterium avium subsp. paratuberculosis
cgcccgcagcg

SEQ ID NO: 2995847 - RNA, 17 nt, Mycobacterium avium subsp. paratuberculosis
cgcccgcagcgcaucgg

SEQ ID NO: 2995848 - RNA, 14 nt, Mycobacterium avium subsp. paratuberculosis
cgcccgcagcggcg

SEQ ID NO: 2995849 - RNA, 23 nt, Mycobacterium avium subsp. paratuberculosis
cgcccgcagcggcgguugcucgu

SEQ ID NO: 2995850 - RNA, 19 nt, Mycobacterium avium subsp. paratuberculosis
cgcccgcaguucggccgcc

SEQ ID NO: 2995851 - RNA, 13 nt, Mycobacterium avium subsp. paratuberculosis
cgcccgcccaggc

SEQ ID NO: 2995852 - RNA, 18 nt, Mycobacterium avium subsp. paratuberculosis
cgcccgcccaggccgcca

SEQ ID NO: 2995853 - RNA, 16 nt, Mycobacterium avium subsp. paratuberculosis
cgcccgccccgacgug

SEQ ID NO: 2995854 - RNA, 17 nt, Mycobacterium avium subsp. paratuberculosis
cgcccgccccgacgugc

SEQ ID NO: 2995855 - RNA, 17 nt, Mycobacterium avium subsp. paratuberculosis
cgcccgcccgagcguca

SEQ ID NO: 2995856 - RNA, 12 nt, Mycobacterium avium subsp. paratuberculosis
cgcccgcccgga

SEQ ID NO: 2995857 - RNA, 15 nt, Mycobacterium avium subsp. paratuberculosis
cgcccgcccggacac

SEQ ID NO: 2995858 - RNA, 12 nt, Mycobacterium avium subsp. paratuberculosis
cgcccgcccggc

SEQ ID NO: 2995859 - RNA, 16 nt, Mycobacterium avium subsp. paratuberculosis
cgcccgcccggcacga

SEQ ID NO: 2995860 - RNA, 14 nt, Mycobacterium avium subsp. paratuberculosis
cgcccgcccggccc

SEQ ID NO: 2995861 - RNA, 18 nt, Mycobacterium avium subsp. paratuberculosis
cgcccgcccggcccggcg

SEQ ID NO: 2995862 - RNA, 19 nt, Mycobacterium avium subsp. paratuberculosis
cgcccgcccggcccggcgc

SEQ ID NO: 2995863 - RNA, 13 nt, Mycobacterium avium subsp. paratuberculosis
cgcccgccgaaca

SEQ ID NO: 2995864 - RNA, 22 nt, Mycobacterium avium subsp. paratuberculosis
cgcccgccgacggcugcccggc

SEQ ID NO: 2995865 - RNA, 16 nt, Mycobacterium avium subsp. paratuberculosis
cgcccgccgccaccac

SEQ ID NO: 2995866 - RNA, 13 nt, Mycobacterium avium subsp. paratuberculosis
cgcccgccgcgac

SEQ ID NO: 2995867 - RNA, 21 nt, Mycobacterium avium subsp. paratuberculosis
cgcccgccgcgagccgcccag

SEQ ID NO: 2995868 - RNA, 15 nt, Mycobacterium avium subsp. paratuberculosis
cgcccggcaacacgu

SEQ ID NO: 2995869 - RNA, 14 nt, Mycobacterium avium subsp. paratuberculosis
cgcccggcaccgcg

SEQ ID NO: 2995870 - RNA, 16 nt, Mycobacterium avium subsp. paratuberculosis
cgcccggcaccgcggc

SEQ ID NO: 2995871 - RNA, 20 nt, Mycobacterium avium subsp. paratuberculosis
cgcccggcaccgcggcggug

SEQ ID NO: 2995872 - RNA, 22 nt, Mycobacterium avium subsp. paratuberculosis
cgcccggcaccgcggcgguguc

SEQ ID NO: 2995873 - RNA, 17 nt, Mycobacterium avium subsp. paratuberculosis
cgcccggcacgaacgcg

SEQ ID NO: 2995874 - RNA, 23 nt, Mycobacterium avium subsp. paratuberculosis
cgcccggcagccgcuccggcccg

SEQ ID NO: 2995875 - RNA, 24 nt, Mycobacterium avium subsp. paratuberculosis
cgcccggcagccgcuccggcccga

SEQ ID NO: 2995876 - RNA, 14 nt, Mycobacterium avium subsp. paratuberculosis
cgcccggcagcggu

SEQ ID NO: 2995877 - RNA, 16 nt, Mycobacterium avium subsp. paratuberculosis
cgcccggcagcgguca

SEQ ID NO: 2995878 - RNA, 13 nt, Mycobacterium avium subsp. paratuberculosis
cgcccggccaccu

SEQ ID NO: 2995879 - RNA, 18 nt, Mycobacterium avium subsp. paratuberculosis
cgcccggccaccuggccg

SEQ ID NO: 2995880 - RNA, 13 nt, Mycobacterium avium subsp. paratuberculosis
cgcccggccagcc

SEQ ID NO: 2995881 - RNA, 14 nt, Mycobacterium avium subsp. paratuberculosis
cgcccggccagccg

SEQ ID NO: 2995882 - RNA, 16 nt, Mycobacterium avium subsp. paratuberculosis
cgcccggccagccggc

SEQ ID NO: 2995883 - RNA, 21 nt, Mycobacterium avium subsp. paratuberculosis
cgcccggccagguuccaccgg

SEQ ID NO: 2995884 - RNA, 20 nt, Mycobacterium avium subsp. paratuberculosis
cgcccggccaucugcgcgac

SEQ ID NO: 2995885 - RNA, 16 nt, Mycobacterium avium subsp. paratuberculosis
cgcccggcccgcaugc

SEQ ID NO: 2995886 - RNA, 13 nt, Mycobacterium avium subsp. paratuberculosis
cgcccggcccggc

SEQ ID NO: 2995887 - RNA, 16 nt, Mycobacterium avium subsp. paratuberculosis
cgcccggcccggcgcg

SEQ ID NO: 2995888 - RNA, 20 nt, Mycobacterium avium subsp. paratuberculosis
cgcccggcccggcgcggccg

SEQ ID NO: 2995889 - RNA, 21 nt, Mycobacterium avium subsp. paratuberculosis
cgcccggcccggcgcggccgg

SEQ ID NO: 2995890 - RNA, 12 nt, Mycobacterium avium subsp. paratuberculosis
cgcccggccggu

SEQ ID NO: 2995891 - RNA, 14 nt, Mycobacterium avium subsp. paratuberculosis
cgcccggccggucg

SEQ ID NO: 2995892 - RNA, 18 nt, Mycobacterium avium subsp. paratuberculosis
cgcccggccggucgccga

SEQ ID NO: 2995893 - RNA, 13 nt, Mycobacterium avium subsp. paratuberculosis
cgcccggccggug

SEQ ID NO: 2995894 - RNA, 20 nt, Mycobacterium avium subsp. paratuberculosis
cgcccggccguaucggccaa

SEQ ID NO: 2995895 - RNA, 15 nt, Mycobacterium avium subsp. paratuberculosis
cgcccggcgaccacc

SEQ ID NO: 2995896 - RNA, 20 nt, Mycobacterium avium subsp. paratuberculosis
cgcccggcgaccaccagccg

SEQ ID NO: 2995897 - RNA, 12 nt, Mycobacterium avium subsp. paratuberculosis
cgcccggcgauc

SEQ ID NO: 2995898 - RNA, 14 nt, Mycobacterium avium subsp. paratuberculosis
cgcccggcgcccgg

SEQ ID NO: 2995899 - RNA, 19 nt, Mycobacterium avium subsp. paratuberculosis
cgcccggcgcccggcgcgc

SEQ ID NO: 2995900 - RNA, 12 nt, Mycobacterium avium subsp. paratuberculosis
cgcccggcgccg

SEQ ID NO: 2995901 - RNA, 14 nt, Mycobacterium avium subsp. paratuberculosis
cgcccggcgccgau

SEQ ID NO: 2995902 - RNA, 13 nt, Mycobacterium avium subsp. paratuberculosis
cgcccggcgccgg

SEQ ID NO: 2995903 - RNA, 14 nt, Mycobacterium avium subsp. paratuberculosis
cgcccggcgccggc

SEQ ID NO: 2995904 - RNA, 15 nt, Mycobacterium avium subsp. paratuberculosis
cgcccggcgccggcc

SEQ ID NO: 2995905 - RNA, 16 nt, Mycobacterium avium subsp. paratuberculosis
cgcccggcgccggccc

SEQ ID NO: 2995906 - RNA, 17 nt, Mycobacterium avium subsp. paratuberculosis
cgcccggcgccggccga

SEQ ID NO: 2995907 - RNA, 16 nt, Mycobacterium avium subsp. paratuberculosis
cgcccggcgccggcgg

SEQ ID NO: 2995908 - RNA, 17 nt, Mycobacterium avium subsp. paratuberculosis
cgcccggcgccggcggc

SEQ ID NO: 2995909 - RNA, 18 nt, Mycobacterium avium subsp. paratuberculosis
cgcccggcgccggcggcc

SEQ ID NO: 2995910 - RNA, 21 nt, Mycobacterium avium subsp. paratuberculosis
cgcccggcgccggcggccacg

SEQ ID NO: 2995911 - RNA, 23 nt, Mycobacterium avium subsp. paratuberculosis
cgcccggcgccggcggccacgcu

SEQ ID NO: 2995912 - RNA, 11 nt, Mycobacterium avium subsp. paratuberculosis
cgcccggcgcg

SEQ ID NO: 2995913 - RNA, 14 nt, Mycobacterium avium subsp. paratuberculosis
cgcccggcgcgcag

SEQ ID NO: 2995914 - RNA, 17 nt, Mycobacterium avium subsp. paratuberculosis
cgcccggcgcgcagccc

SEQ ID NO: 2995915 - RNA, 23 nt, Mycobacterium avium subsp. paratuberculosis
cgcccggcgcgcagcccagccag

SEQ ID NO: 2995916 - RNA, 13 nt, Mycobacterium avium subsp. paratuberculosis
cgcccggcgcggc

SEQ ID NO: 2995917 - RNA, 14 nt, Mycobacterium avium subsp. paratuberculosis
cgcccggcgcggca

SEQ ID NO: 2995918 - RNA, 16 nt, Mycobacterium avium subsp. paratuberculosis
cgcccggcgcggcauc

SEQ ID NO: 2995919 - RNA, 23 nt, Mycobacterium avium subsp. paratuberculosis
cgcccggcgcggcaucggcgacg

SEQ ID NO: 2995920 - RNA, 11 nt, Mycobacterium avium subsp. paratuberculosis
cgcccggcggc

SEQ ID NO: 2995921 - RNA, 15 nt, Mycobacterium avium subsp. paratuberculosis
cgcccggcggcaccg

SEQ ID NO: 2995922 - RNA, 12 nt, Mycobacterium avium subsp. paratuberculosis
cgcccggcggcc

SEQ ID NO: 2995923 - RNA, 13 nt, Mycobacterium avium subsp. paratuberculosis
cgcccggcggcca

SEQ ID NO: 2995924 - RNA, 15 nt, Mycobacterium avium subsp. paratuberculosis
cgcccggcggccacc

SEQ ID NO: 2995925 - RNA, 13 nt, Mycobacterium avium subsp. paratuberculosis
cgcccggcggcgc

SEQ ID NO: 2995926 - RNA, 22 nt, Mycobacterium avium subsp. paratuberculosis
cgcccggcggcgcugccccagc

SEQ ID NO: 2995927 - RNA, 16 nt, Mycobacterium avium subsp. paratuberculosis
cgcccggcgggccacg

SEQ ID NO: 2995928 - RNA, 13 nt, Mycobacterium avium subsp. paratuberculosis
cgcccggcgucca

SEQ ID NO: 2995929 - RNA, 14 nt, Mycobacterium avium subsp. paratuberculosis
cgcccggcguccag

SEQ ID NO: 2995930 - RNA, 21 nt, Mycobacterium avium subsp. paratuberculosis
cgcccggcguccagugcaugc

SEQ ID NO: 2995931 - RNA, 23 nt, Mycobacterium avium subsp. paratuberculosis
cgcccggcucaaaccguugacca

SEQ ID NO: 2995932 - RNA, 14 nt, Mycobacterium avium subsp. paratuberculosis
cgcccggcuccacg

SEQ ID NO: 2995933 - RNA, 18 nt, Mycobacterium avium subsp. paratuberculosis
cgcccggcuccccgacca

SEQ ID NO: 2995934 - RNA, 19 nt, Mycobacterium avium subsp. paratuberculosis
cgcccggcuccccgaccac

SEQ ID NO: 2995935 - RNA, 20 nt, Mycobacterium avium subsp. paratuberculosis
cgcccggcuccccgaccaca

SEQ ID NO: 2995936 - RNA, 12 nt, Mycobacterium avium subsp. paratuberculosis
cgcccggcugcg

SEQ ID NO: 2995937 - RNA, 17 nt, Mycobacterium avium subsp. paratuberculosis
cgcccggcugcgccgcg

SEQ ID NO: 2995938 - RNA, 21 nt, Mycobacterium avium subsp. paratuberculosis
cgcccggcugcgccgcgcuug

SEQ ID NO: 2995939 - RNA, 15 nt, Mycobacterium avium subsp. paratuberculosis
cgcccggcuucgccg

SEQ ID NO: 2995940 - RNA, 19 nt, Mycobacterium avium subsp. paratuberculosis
cgcccggcuucgccgccgc

SEQ ID NO: 2995941 - RNA, 20 nt, Mycobacterium avium subsp. paratuberculosis
cgcccggcuucgccgcgcuu

SEQ ID NO: 2995942 - RNA, 23 nt, Mycobacterium avium subsp. paratuberculosis
cgcccgggaaaauuuccuggccg

SEQ ID NO: 2995943 - RNA, 15 nt, Mycobacterium avium subsp. paratuberculosis
cgcccgggcacgacg

SEQ ID NO: 2995944 - RNA, 16 nt, Mycobacterium avium subsp. paratuberculosis
cgcccgggcacgacgg

SEQ ID NO: 2995945 - RNA, 20 nt, Mycobacterium avium subsp. paratuberculosis
cgcccgggcacgacggucag

SEQ ID NO: 2995946 - RNA, 17 nt, Mycobacterium avium subsp. paratuberculosis
cgcccgggccaggaccg

SEQ ID NO: 2995947 - RNA, 14 nt, Mycobacterium avium subsp. paratuberculosis
cgcccgggccaggc

SEQ ID NO: 2995948 - RNA, 14 nt, Mycobacterium avium subsp. paratuberculosis
cgcccgggccgcgc

SEQ ID NO: 2995949 - RNA, 15 nt, Mycobacterium avium subsp. paratuberculosis
cgcccgggccgcgcc

SEQ ID NO: 2995950 - RNA, 16 nt, Mycobacterium avium subsp. paratuberculosis
cgcccgggccgcgccc

SEQ ID NO: 2995951 - RNA, 22 nt, Mycobacterium avium subsp. paratuberculosis
cgcccgggccguaucggccccg

SEQ ID NO: 2995952 - RNA, 12 nt, Mycobacterium avium subsp. paratuberculosis
cgcccgggcgcg

SEQ ID NO: 2995953 - RNA, 17 nt, Mycobacterium avium subsp. paratuberculosis
cgccagcaccgggccca

SEQ ID NO: 2995954 - RNA, 20 nt, Mycobacterium avium subsp. paratuberculosis
cgccagcaccgugcugaucc

SEQ ID NO: 2995955 - RNA, 19 nt, Mycobacterium avium subsp. paratuberculosis
cgccagcaccucgaacgcc

SEQ ID NO: 2995956 - RNA, 21 nt, Mycobacterium avium subsp. paratuberculosis
cgccagcaccucgaacgccgg

SEQ ID NO: 2995957 - RNA, 15 nt, Mycobacterium avium subsp. paratuberculosis
cgccagcaccucgcg

SEQ ID NO: 2995958 - RNA, 19 nt, Mycobacterium avium subsp. paratuberculosis
cgccagcaccucgcggcag

SEQ ID NO: 2995959 - RNA, 21 nt, Mycobacterium avium subsp. paratuberculosis
cgccagcaccucgcggcagcc

SEQ ID NO: 2995960 - RNA, 15 nt, Mycobacterium avium subsp. paratuberculosis
cgccagcaccucggc

SEQ ID NO: 2995961 - RNA, 16 nt, Mycobacterium avium subsp. paratuberculosis
cgccagcaccucggcg

SEQ ID NO: 2995962 - RNA, 17 nt, Mycobacterium avium subsp. paratuberculosis
cgccagcaccucggcga

SEQ ID NO: 2995963 - RNA, 18 nt, Mycobacterium avium subsp. paratuberculosis
cgccagcaccucggcgac

SEQ ID NO: 2995964 - RNA, 22 nt, Mycobacterium avium subsp. paratuberculosis
cgccagcaccucggcgaccacg

SEQ ID NO: 2995965 - RNA, 19 nt, Mycobacterium avium subsp. paratuberculosis
cgccagcaccuucgggccg

SEQ ID NO: 2995966 - RNA, 20 nt, Mycobacterium avium subsp. paratuberculosis
cgccagcaccuucgggccga

SEQ ID NO: 2995967 - RNA, 14 nt, Mycobacterium avium subsp. paratuberculosis
cgccagcacggcca

SEQ ID NO: 2995968 - RNA, 14 nt, Mycobacterium avium subsp. paratuberculosis
cgccagcacggugu

SEQ ID NO: 2995969 - RNA, 23 nt, Mycobacterium avium subsp. paratuberculosis
cgccagcacgguguugcgcaccc

SEQ ID NO: 2995970 - RNA, 17 nt, Mycobacterium avium subsp. paratuberculosis
cgccagcacgugaugca

SEQ ID NO: 2995971 - RNA, 19 nt, Mycobacterium avium subsp. paratuberculosis
cgccagcacgugaugcagc

SEQ ID NO: 2995972 - RNA, 18 nt, Mycobacterium avium subsp. paratuberculosis
cgccagcacguggccggg

SEQ ID NO: 2995973 - RNA, 21 nt, Mycobacterium avium subsp. paratuberculosis
cgccagcacguggccgggcuc

SEQ ID NO: 2995974 - RNA, 20 nt, Mycobacterium avium subsp. paratuberculosis
cgccagcagaugccgcccag

SEQ ID NO: 2995975 - RNA, 14 nt, Mycobacterium avium subsp. paratuberculosis
cgccagcagcaacg

SEQ ID NO: 2995976 - RNA, 18 nt, Mycobacterium avium subsp. paratuberculosis
cgccagcagcaacgcggu

SEQ ID NO: 2995977 - RNA, 19 nt, Mycobacterium avium subsp. paratuberculosis
cgccagcagcaacgcggug

SEQ ID NO: 2995978 - RNA, 15 nt, Mycobacterium avium subsp. paratuberculosis
cgccagcagcaccug

SEQ ID NO: 2995979 - RNA, 13 nt, Mycobacterium avium subsp. paratuberculosis
cgccagcagcacg

SEQ ID NO: 2995980 - RNA, 15 nt, Mycobacterium avium subsp. paratuberculosis
cgccagcagcacggc

SEQ ID NO: 2995981 - RNA, 23 nt, Mycobacterium avium subsp. paratuberculosis
cgccagcagcagccgcgccgccg

SEQ ID NO: 2995982 - RNA, 15 nt, Mycobacterium avium subsp. paratuberculosis
cgccagcagcagcgc

SEQ ID NO: 2995983 - RNA, 16 nt, Mycobacterium avium subsp. paratuberculosis
cgccagcagcagcgcc

SEQ ID NO: 2995984 - RNA, 19 nt, Mycobacterium avium subsp. paratuberculosis
cgccagcagcagcgccgcc

SEQ ID NO: 2995985 - RNA, 20 nt, Mycobacterium avium subsp. paratuberculosis
cgccagcagcagcgccgcca

SEQ ID NO: 2995986 - RNA, 17 nt, Mycobacterium avium subsp. paratuberculosis
cgccagcagcagcgcgg

SEQ ID NO: 2995987 - RNA, 18 nt, Mycobacterium avium subsp. paratuberculosis
cgccagcagcagcgcggc

SEQ ID NO: 2995988 - RNA, 19 nt, Mycobacterium avium subsp. paratuberculosis
cgccagcagccgcagcagu

SEQ ID NO: 2995989 - RNA, 12 nt, Mycobacterium avium subsp. paratuberculosis
cgccagcagcgc

SEQ ID NO: 2995990 - RNA, 13 nt, Mycobacterium avium subsp. paratuberculosis
cgccagcagcgca

SEQ ID NO: 2995991 - RNA, 13 nt, Mycobacterium avium subsp. paratuberculosis
cgccagcagcgcc

SEQ ID NO: 2995992 - RNA, 16 nt, Mycobacterium avium subsp. paratuberculosis
cgccagcgcggcgauc

SEQ ID NO: 2995993 - RNA, 17 nt, Mycobacterium avium subsp. paratuberculosis
cgccagcgcggcgauca

SEQ ID NO: 2995994 - RNA, 14 nt, Mycobacterium avium subsp. paratuberculosis
cgccagcgcggcgg

SEQ ID NO: 2995995 - RNA, 18 nt, Mycobacterium avium subsp. paratuberculosis
cgccagcgcggcggcgcc

SEQ ID NO: 2995996 - RNA, 15 nt, Mycobacterium avium subsp. paratuberculosis
cgccagcgcgggguc

SEQ ID NO: 2995997 - RNA, 17 nt, Mycobacterium avium subsp. paratuberculosis
cgccagcgcggggucgg

SEQ ID NO: 2995998 - RNA, 13 nt, Mycobacterium avium subsp. paratuberculosis
cgccagcgcggug

SEQ ID NO: 2995999 - RNA, 14 nt, Mycobacterium avium subsp. paratuberculosis
cgccagcgcggugc

SEQ ID NO: 2996000 - RNA, 22 nt, Mycobacterium avium subsp. paratuberculosis
cgccagcgcggugcccagccag

SEQ ID NO: 2996001 - RNA, 14 nt, Mycobacterium avium subsp. paratuberculosis
cgccagcgcggugu

SEQ ID NO: 2996002 - RNA, 17 nt, Mycobacterium avium subsp. paratuberculosis
cgccagcgcggugucga

SEQ ID NO: 2996003 - RNA, 19 nt, Mycobacterium avium subsp. paratuberculosis
cgccagcgcgugcggggug

SEQ ID NO: 2996004 - RNA, 13 nt, Mycobacterium avium subsp. paratuberculosis
cgccagcggccga

SEQ ID NO: 2996005 - RNA, 17 nt, Mycobacterium avium subsp. paratuberculosis
cgccagcggccgaucau

SEQ ID NO: 2996006 - RNA, 19 nt, Mycobacterium avium subsp. paratuberculosis
cgccagcggcuugccguug

SEQ ID NO: 2996007 - RNA, 23 nt, Mycobacterium avium subsp. paratuberculosis
cgccagcggcuugccguugucga

SEQ ID NO: 2996008 - RNA, 13 nt, Mycobacterium avium subsp. paratuberculosis
cgccagcgggccg

SEQ ID NO: 2996009 - RNA, 16 nt, Mycobacterium avium subsp. paratuberculosis
cgccagcgggccgacc

SEQ ID NO: 2996010 - RNA, 17 nt, Mycobacterium avium subsp. paratuberculosis
cgccagcgggccgaccu

SEQ ID NO: 2996011 - RNA, 20 nt, Mycobacterium avium subsp. paratuberculosis
cgccagcgggccgaccuggc

SEQ ID NO: 2996012 - RNA, 14 nt, Mycobacterium avium subsp. paratuberculosis
cgccagcgggccgu

SEQ ID NO: 2996013 - RNA, 20 nt, Mycobacterium avium subsp. paratuberculosis
cgccagcgggccgugccgcc

SEQ ID NO: 2996014 - RNA, 22 nt, Mycobacterium avium subsp. paratuberculosis
cgccagcgggccgugccgccau

SEQ ID NO: 2996015 - RNA, 12 nt, Mycobacterium avium subsp. paratuberculosis
cgccagcgggug

SEQ ID NO: 2996016 - RNA, 19 nt, Mycobacterium avium subsp. paratuberculosis
cgccagcgguccagcguga

SEQ ID NO: 2996017 - RNA, 20 nt, Mycobacterium avium subsp. paratuberculosis
cgccagcgucccguccuggg

SEQ ID NO: 2996018 - RNA, 23 nt, Mycobacterium avium subsp. paratuberculosis
cgccagcgugaacagcgcccggc

SEQ ID NO: 2996019 - RNA, 13 nt, Mycobacterium avium subsp. paratuberculosis
cgccagcgugacg

SEQ ID NO: 2996020 - RNA, 19 nt, Mycobacterium avium subsp. paratuberculosis
cgccagcgugacgcccggc

SEQ ID NO: 2996021 - RNA, 20 nt, Mycobacterium avium subsp. paratuberculosis
cgccagcgugacgcccggcg

SEQ ID NO: 2996022 - RNA, 23 nt, Mycobacterium avium subsp. paratuberculosis
cgccagcgugacgcccggcgccg

SEQ ID NO: 2996023 - RNA, 17 nt, Mycobacterium avium subsp. paratuberculosis
cgccagcgugacgccgg

SEQ ID NO: 2996024 - RNA, 15 nt, Mycobacterium avium subsp. paratuberculosis
cgccagcgugacgcu

SEQ ID NO: 2996025 - RNA, 17 nt, Mycobacterium avium subsp. paratuberculosis
cgccagcguggccagca

SEQ ID NO: 2996026 - RNA, 20 nt, Mycobacterium avium subsp. paratuberculosis
cgccagcguggccagcaccg

SEQ ID NO: 2996027 - RNA, 21 nt, Mycobacterium avium subsp. paratuberculosis
cgccagcguggcgaacgcgac

SEQ ID NO: 2996028 - RNA, 12 nt, Mycobacterium avium subsp. paratuberculosis
cgccagcucggc

SEQ ID NO: 2996029 - RNA, 13 nt, Mycobacterium avium subsp. paratuberculosis
cgccagcucggcg

SEQ ID NO: 2996030 - RNA, 16 nt, Mycobacterium avium subsp. paratuberculosis
cgccagcucggcggcc

SEQ ID NO: 2996031 - RNA, 17 nt, Mycobacterium avium subsp. paratuberculosis
cgccagcucggcggccg

SEQ ID NO: 2996032 - RNA, 21 nt, Mycobacterium avium subsp. paratuberculosis
cgccagcucggcggccgggug

SEQ ID NO: 2996033 - RNA, 19 nt, Mycobacterium avium subsp. paratuberculosis
cgccagcucguccagcgug

SEQ ID NO: 2996034 - RNA, 20 nt, Mycobacterium avium subsp. paratuberculosis
cgccagcugccgcgacucgg

SEQ ID NO: 2996035 - RNA, 13 nt, Mycobacterium avium subsp. paratuberculosis
cgccagcugcgga

SEQ ID NO: 2996036 - RNA, 16 nt, Mycobacterium avium subsp. paratuberculosis
cgccagcugggcagcc

SEQ ID NO: 2996037 - RNA, 20 nt, Mycobacterium avium subsp. paratuberculosis
cgccagcugggcagccagau

SEQ ID NO: 2996038 - RNA, 23 nt, Mycobacterium avium subsp. paratuberculosis
cagccgcauguugugcccgacgg

SEQ ID NO: 2996039 - RNA, 24 nt, Mycobacterium avium subsp. paratuberculosis
cagccgcauguugugcccgacggc

SEQ ID NO: 2996040 - RNA, 18 nt, Mycobacterium avium subsp. paratuberculosis
cagccgcauucggugagc

SEQ ID NO: 2996041 - RNA, 13 nt, Mycobacterium avium subsp. paratuberculosis
cagccgccagccg

SEQ ID NO: 2996042 - RNA, 21 nt, Mycobacterium avium subsp. paratuberculosis
cagccgcccagcaucgccgcg

SEQ ID NO: 2996043 - RNA, 23 nt, Mycobacterium avium subsp. paratuberculosis
cagccgcccagcaucgccgcgac

SEQ ID NO: 2996044 - RNA, 12 nt, Mycobacterium avium subsp. paratuberculosis
cagccgccccga

SEQ ID NO: 2996045 - RNA, 16 nt, Mycobacterium avium subsp. paratuberculosis
cagccgccccgaucgg

SEQ ID NO: 2996046 - RNA, 21 nt, Mycobacterium avium subsp. paratuberculosis
cagccgcccggcgccccgcca

SEQ ID NO: 2996047 - RNA, 13 nt, Mycobacterium avium subsp. paratuberculosis
cagccgcccgucc

SEQ ID NO: 2996048 - RNA, 19 nt, Mycobacterium avium subsp. paratuberculosis
cagccgcccuuguugaugg

SEQ ID NO: 2996049 - RNA, 13 nt, Mycobacterium avium subsp. paratuberculosis
cagccgccgccga

SEQ ID NO: 2996050 - RNA, 13 nt, Mycobacterium avium subsp. paratuberculosis
cagccgccgcgac

SEQ ID NO: 2996051 - RNA, 20 nt, Mycobacterium avium subsp. paratuberculosis
cagccgccgcgacacccgcg

SEQ ID NO: 2996052 - RNA, 23 nt, Mycobacterium avium subsp. paratuberculosis
cagccgccgcgacacccgcgacg

SEQ ID NO: 2996053 - RNA, 22 nt, Mycobacterium avium subsp. paratuberculosis
cagccgccgcgccaccgaggcc

SEQ ID NO: 2996054 - RNA, 16 nt, Mycobacterium avium subsp. paratuberculosis
cagccgccgcggagcg

SEQ ID NO: 2996055 - RNA, 12 nt, Mycobacterium avium subsp. paratuberculosis
cagccgccggcc

SEQ ID NO: 2996056 - RNA, 14 nt, Mycobacterium avium subsp. paratuberculosis
cagccgccggccac

SEQ ID NO: 2996057 - RNA, 15 nt, Mycobacterium avium subsp. paratuberculosis
cagccgccggccacc

SEQ ID NO: 2996058 - RNA, 16 nt, Mycobacterium avium subsp. paratuberculosis
cagccgccggccacca

SEQ ID NO: 2996059 - RNA, 16 nt, Mycobacterium avium subsp. paratuberculosis
cagccgccggcucagc

SEQ ID NO: 2996060 - RNA, 19 nt, Mycobacterium avium subsp. paratuberculosis
cagccgccggcucagcggc

SEQ ID NO: 2996061 - RNA, 20 nt, Mycobacterium avium subsp. paratuberculosis
cagccgccggcucagcggca

SEQ ID NO: 2996062 - RNA, 14 nt, Mycobacterium avium subsp. paratuberculosis
cagccgccgggcca

SEQ ID NO: 2996063 - RNA, 19 nt, Mycobacterium avium subsp. paratuberculosis
cagccgccgggccacgccg

SEQ ID NO: 2996064 - RNA, 20 nt, Mycobacterium avium subsp. paratuberculosis
cagccgccgggccacgccga

SEQ ID NO: 2996065 - RNA, 13 nt, Mycobacterium avium subsp. paratuberculosis
cagccgccggucc

SEQ ID NO: 2996066 - RNA, 14 nt, Mycobacterium avium subsp. paratuberculosis
cagccgccgucgcg

SEQ ID NO: 2996067 - RNA, 14 nt, Mycobacterium avium subsp. paratuberculosis
cagccgccuggcga

SEQ ID NO: 2996068 - RNA, 15 nt, Mycobacterium avium subsp. paratuberculosis
cagccgcgacacgug

SEQ ID NO: 2996069 - RNA, 21 nt, Mycobacterium avium subsp. paratuberculosis
cagccgcgacacgugcaucug

SEQ ID NO: 2996070 - RNA, 14 nt, Mycobacterium avium subsp. paratuberculosis
cagccgcgacagcc

SEQ ID NO: 2996071 - RNA, 15 nt, Mycobacterium avium subsp. paratuberculosis
cagccgcgacagccg

SEQ ID NO: 2996072 - RNA, 19 nt, Mycobacterium avium subsp. paratuberculosis
cagccgcgacagccgcccg

SEQ ID NO: 2996073 - RNA, 21 nt, Mycobacterium avium subsp. paratuberculosis
cagccgcgacagccgcccggc

SEQ ID NO: 2996074 - RNA, 17 nt, Mycobacterium avium subsp. paratuberculosis
cagccgcgacggcgggu

SEQ ID NO: 2996075 - RNA, 18 nt, Mycobacterium avium subsp. paratuberculosis
cagccgcgauagccauca

SEQ ID NO: 2996076 - RNA, 19 nt, Mycobacterium avium subsp. paratuberculosis
cagccgcgauagccaucag

SEQ ID NO: 2996077 - RNA, 13 nt, Mycobacterium avium subsp. paratuberculosis
cagccgcgccaau

SEQ ID NO: 2996078 - RNA, 14 nt, Mycobacterium avium subsp. paratuberculosis
cagccgcgccaccg

SEQ ID NO: 2996079 - RNA, 16 nt, Mycobacterium avium subsp. paratuberculosis
cagccgcgccaccgcg

SEQ ID NO: 2996080 - RNA, 18 nt, Mycobacterium avium subsp. paratuberculosis
cagccgcgccaccgcggg

SEQ ID NO: 2996081 - RNA, 16 nt, Mycobacterium avium subsp. paratuberculosis
cagccgcgcccacccg

SEQ ID NO: 2996082 - RNA, 17 nt, Mycobacterium avium subsp. paratuberculosis
cagccgcgcccacccgc

SEQ ID NO: 2996083 - RNA, 22 nt, Mycobacterium avium subsp. paratuberculosis
cagccgcgcccacccgcgcacg

SEQ ID NO: 2996084 - RNA, 24 nt, Mycobacterium avium subsp. paratuberculosis
cagccgcgcccacccgcgcacgcu

SEQ ID NO: 2996085 - RNA, 14 nt, Mycobacterium avium subsp. paratuberculosis
cagccgcgccgaca

SEQ ID NO: 2996086 - RNA, 15 nt, Mycobacterium avium subsp. paratuberculosis
cagccgcgccgacag

SEQ ID NO: 2996087 - RNA, 23 nt, Mycobacterium avium subsp. paratuberculosis
cagccgcgccgacagaugcggca

SEQ ID NO: 2996088 - RNA, 15 nt, Mycobacterium avium subsp. paratuberculosis
cagccgcgccgacgc

SEQ ID NO: 2996089 - RNA, 16 nt, Mycobacterium avium subsp. paratuberculosis
cagccgcgccgccgcg

SEQ ID NO: 2996090 - RNA, 17 nt, Mycobacterium avium subsp. paratuberculosis
cagccgcgccgccgcgu

SEQ ID NO: 2996091 - RNA, 13 nt, Mycobacterium avium subsp. paratuberculosis
cagccgcgccgcg

SEQ ID NO: 2996092 - RNA, 19 nt, Mycobacterium avium subsp. paratuberculosis
cagccgcgccgcgccgccu

SEQ ID NO: 2996093 - RNA, 14 nt, Mycobacterium avium subsp. paratuberculosis
cagccgcgccgggc

SEQ ID NO: 2996094 - RNA, 15 nt, Mycobacterium avium subsp. paratuberculosis
cagccgcgccgggcg

SEQ ID NO: 2996095 - RNA, 13 nt, Mycobacterium avium subsp. paratuberculosis
cagccgcgcgacg

SEQ ID NO: 2996096 - RNA, 14 nt, Mycobacterium avium subsp. paratuberculosis
cagccgcgcgacgc

SEQ ID NO: 2996097 - RNA, 15 nt, Mycobacterium avium subsp. paratuberculosis
cagccgcgcgacgcc

SEQ ID NO: 2996098 - RNA, 12 nt, Mycobacterium avium subsp. paratuberculosis
cagccgcgcgag

SEQ ID NO: 2996099 - RNA, 14 nt, Mycobacterium avium subsp. paratuberculosis
cagccgcgcgagca

SEQ ID NO: 2996100 - RNA, 18 nt, Mycobacterium avium subsp. paratuberculosis
cagccgcgcggccgccuc

SEQ ID NO: 2996101 - RNA, 20 nt, Mycobacterium avium subsp. paratuberculosis
cagccgcgcggccggccacg

SEQ ID NO: 2996102 - RNA, 14 nt, Mycobacterium avium subsp. paratuberculosis
cagccgcgcggcgu

SEQ ID NO: 2996103 - RNA, 15 nt, Mycobacterium avium subsp. paratuberculosis
cagccgcggacggcc

SEQ ID NO: 2996104 - RNA, 20 nt, Mycobacterium avium subsp. paratuberculosis
cagccgcggacggccagccc

SEQ ID NO: 2996105 - RNA, 21 nt, Mycobacterium avium subsp. paratuberculosis
cagccgcggacggccagcccg

SEQ ID NO: 2996106 - RNA, 18 nt, Mycobacterium avium subsp. paratuberculosis
cagccgcgguggcggugu

SEQ ID NO: 2996107 - RNA, 13 nt, Mycobacterium avium subsp. paratuberculosis
cagccgcucccgg

SEQ ID NO: 2996108 - RNA, 16 nt, Mycobacterium avium subsp. paratuberculosis
cagccgcucccggcgc

SEQ ID NO: 2996109 - RNA, 17 nt, Mycobacterium avium subsp. paratuberculosis
cagccgcucccggcgca

SEQ ID NO: 2996110 - RNA, 18 nt, Mycobacterium avium subsp. paratuberculosis
cagccgcucccggcgcag

SEQ ID NO: 2996111 - RNA, 20 nt, Mycobacterium avium subsp. paratuberculosis
cagccgcucccggcgcagca

SEQ ID NO: 2996112 - RNA, 14 nt, Mycobacterium avium subsp. paratuberculosis
cagccgcuccgcgg

SEQ ID NO: 2996113 - RNA, 17 nt, Mycobacterium avium subsp. paratuberculosis
cagccgcuccgcggcgg

SEQ ID NO: 2996114 - RNA, 19 nt, Mycobacterium avium subsp. paratuberculosis
cagccgcuccgcggcgggc

SEQ ID NO: 2996115 - RNA, 21 nt, Mycobacterium avium subsp. paratuberculosis
cagccgcuccgcggcgggcgu

SEQ ID NO: 2996116 - RNA, 16 nt, Mycobacterium avium subsp. paratuberculosis
cagccgcuccggcccg

SEQ ID NO: 2996117 - RNA, 17 nt, Mycobacterium avium subsp. paratuberculosis
cagccgcugaacgcgau

SEQ ID NO: 2996118 - RNA, 18 nt, Mycobacterium avium subsp. paratuberculosis
cagccgcugaacgcgauc

SEQ ID NO: 2996119 - RNA, 16 nt, Mycobacterium avium subsp. paratuberculosis
cagccgcugacgaugg

SEQ ID NO: 2996120 - RNA, 21 nt, Mycobacterium avium subsp. paratuberculosis
cagccgcugacgauggcgacc

SEQ ID NO: 2996121 - RNA, 22 nt, Mycobacterium avium subsp. paratuberculosis
cagccgcugacgauggcgaccg

SEQ ID NO: 2996122 - RNA, 16 nt, Mycobacterium avium subsp. paratuberculosis
cagccgcugcagcgcc

SEQ ID NO: 2996123 - RNA, 13 nt, Mycobacterium avium subsp. paratuberculosis
cgccaccggccgg

SEQ ID NO: 2996124 - RNA, 14 nt, Mycobacterium avium subsp. paratuberculosis
cgccaccggccggu

SEQ ID NO: 2996125 - RNA, 18 nt, Mycobacterium avium subsp. paratuberculosis
cgccaccggccgguccgc

SEQ ID NO: 2996126 - RNA, 21 nt, Mycobacterium avium subsp. paratuberculosis
cgccaccggccgguccgccca

SEQ ID NO: 2996127 - RNA, 14 nt, Mycobacterium avium subsp. paratuberculosis
cgccaccggcuggc

SEQ ID NO: 2996128 - RNA, 17 nt, Mycobacterium avium subsp. paratuberculosis
cgccaccggcuggccgg

SEQ ID NO: 2996129 - RNA, 13 nt, Mycobacterium avium subsp. paratuberculosis
cgccaccgggacc

SEQ ID NO: 2996130 - RNA, 22 nt, Mycobacterium avium subsp. paratuberculosis
cgccaccggguaagugucgugg

SEQ ID NO: 2996131 - RNA, 16 nt, Mycobacterium avium subsp. paratuberculosis
cgccaccgucgccggc

SEQ ID NO: 2996132 - RNA, 15 nt, Mycobacterium avium subsp. paratuberculosis
cgccaccgucgucga

SEQ ID NO: 2996133 - RNA, 19 nt, Mycobacterium avium subsp. paratuberculosis
cgccaccgucgucgagcgc

SEQ ID NO: 2996134 - RNA, 20 nt, Mycobacterium avium subsp. paratuberculosis
cgccaccgucgucgagcgcu

SEQ ID NO: 2996135 - RNA, 19 nt, Mycobacterium avium subsp. paratuberculosis
cgccaccuccuccgguccg

SEQ ID NO: 2996136 - RNA, 13 nt, Mycobacterium avium subsp. paratuberculosis
cgccaccucggag

SEQ ID NO: 2996137 - RNA, 15 nt, Mycobacterium avium subsp. paratuberculosis
cgccaccucggagau

SEQ ID NO: 2996138 - RNA, 17 nt, Mycobacterium avium subsp. paratuberculosis
cgccaccucggagauga

SEQ ID NO: 2996139 - RNA, 19 nt, Mycobacterium avium subsp. paratuberculosis
cgccaccuucaccgcgccg

SEQ ID NO: 2996140 - RNA, 13 nt, Mycobacterium avium subsp. paratuberculosis
cgccacgaccagc

SEQ ID NO: 2996141 - RNA, 17 nt, Mycobacterium avium subsp. paratuberculosis
cgccacgaccagcggca

SEQ ID NO: 2996142 - RNA, 14 nt, Mycobacterium avium subsp. paratuberculosis
cgccacgacgcggc

SEQ ID NO: 2996143 - RNA, 15 nt, Mycobacterium avium subsp. paratuberculosis
cgccacgacgcggcg

SEQ ID NO: 2996144 - RNA, 18 nt, Mycobacterium avium subsp. paratuberculosis
cgccacgacgcggcgauc

SEQ ID NO: 2996145 - RNA, 19 nt, Mycobacterium avium subsp. paratuberculosis
cgccacgacguacccccgc

SEQ ID NO: 2996146 - RNA, 23 nt, Mycobacterium avium subsp. paratuberculosis
cgccacgacguacccccgcacgc

SEQ ID NO: 2996147 - RNA, 19 nt, Mycobacterium avium subsp. paratuberculosis
cgccacgacugcgcggccg

SEQ ID NO: 2996148 - RNA, 20 nt, Mycobacterium avium subsp. paratuberculosis
cgccacgacugcgcggccgg

SEQ ID NO: 2996149 - RNA, 23 nt, Mycobacterium avium subsp. paratuberculosis
cgccacgacugcgcggccggcgu

SEQ ID NO: 2996150 - RNA, 13 nt, Mycobacterium avium subsp. paratuberculosis
cgccacgaucacc

SEQ ID NO: 2996151 - RNA, 15 nt, Mycobacterium avium subsp. paratuberculosis
cgccacgaucaccac

SEQ ID NO: 2996152 - RNA, 17 nt, Mycobacterium avium subsp. paratuberculosis
cgccacgaucaccacca

SEQ ID NO: 2996153 - RNA, 23 nt, Mycobacterium avium subsp. paratuberculosis
cgccacgaucaccaccaccgccg

SEQ ID NO: 2996154 - RNA, 17 nt, Mycobacterium avium subsp. paratuberculosis
cgccacgaugcugauac

SEQ ID NO: 2996155 - RNA, 14 nt, Mycobacterium avium subsp. paratuberculosis
cgccacgcacaccg

SEQ ID NO: 2996156 - RNA, 21 nt, Mycobacterium avium subsp. paratuberculosis
cgccacgcacaccgcgcgcag

SEQ ID NO: 2996157 - RNA, 14 nt, Mycobacterium avium subsp. paratuberculosis
cgccacgcccaggg

SEQ ID NO: 2996158 - RNA, 21 nt, Mycobacterium avium subsp. paratuberculosis
cgccacgcccagggcgccaga

SEQ ID NO: 2996159 - RNA, 17 nt, Mycobacterium avium subsp. paratuberculosis
cgccacgccccggcgcc

SEQ ID NO: 2996160 - RNA, 11 nt, Mycobacterium avium subsp. paratuberculosis
cgccacgccga

SEQ ID NO: 2996161 - RNA, 12 nt, Mycobacterium avium subsp. paratuberculosis
cgccacgccgac

SEQ ID NO: 2996162 - RNA, 16 nt, Mycobacterium avium subsp. paratuberculosis
cgccacgccgaccagg

SEQ ID NO: 2996163 - RNA, 12 nt, Mycobacterium avium subsp. paratuberculosis
cgccacgccgcc

SEQ ID NO: 2996164 - RNA, 17 nt, Mycobacterium avium subsp. paratuberculosis
cgccacgccgcccccgc

SEQ ID NO: 2996165 - RNA, 21 nt, Mycobacterium avium subsp. paratuberculosis
cgccacgccgcccccgccgcg

SEQ ID NO: 2996166 - RNA, 13 nt, Mycobacterium avium subsp. paratuberculosis
cgccacgccgugg

SEQ ID NO: 2996167 - RNA, 17 nt, Mycobacterium avium subsp. paratuberculosis
cgccacgccguggcccg

SEQ ID NO: 2996168 - RNA, 23 nt, Mycobacterium avium subsp. paratuberculosis
cgccacgccguggcccgcccagc

SEQ ID NO: 2996169 - RNA, 13 nt, Mycobacterium avium subsp. paratuberculosis
cgccacgccguug

SEQ ID NO: 2996170 - RNA, 12 nt, Mycobacterium avium subsp. paratuberculosis
cgccacgcggcg

SEQ ID NO: 2996171 - RNA, 16 nt, Mycobacterium avium subsp. paratuberculosis
cgccacgcggcgcgca

SEQ ID NO: 2996172 - RNA, 22 nt, Mycobacterium avium subsp. paratuberculosis
cgccacgcggcgcgcaucgucg

SEQ ID NO: 2996173 - RNA, 19 nt, Mycobacterium avium subsp. paratuberculosis
cgccacgcgucaggcgucg

SEQ ID NO: 2996174 - RNA, 16 nt, Mycobacterium avium subsp. paratuberculosis
cgccacgcucaugccc

SEQ ID NO: 2996175 - RNA, 20 nt, Mycobacterium avium subsp. paratuberculosis
cgccacgcucaugcccgcca

SEQ ID NO: 2996176 - RNA, 21 nt, Mycobacterium avium subsp. paratuberculosis
cgccacgcucaugcccgccac

SEQ ID NO: 2996177 - RNA, 12 nt, Mycobacterium avium subsp. paratuberculosis
cgccacgcuggc

SEQ ID NO: 2996178 - RNA, 13 nt, Mycobacterium avium subsp. paratuberculosis
cgccacgcuggcg

SEQ ID NO: 2996179 - RNA, 14 nt, Mycobacterium avium subsp. paratuberculosis
cgccacgcuggcgu

SEQ ID NO: 2996180 - RNA, 13 nt, Mycobacterium avium subsp. paratuberculosis
cgccacgcuggug

SEQ ID NO: 2996181 - RNA, 14 nt, Mycobacterium avium subsp. paratuberculosis
cgccacggccaccg

SEQ ID NO: 2996182 - RNA, 13 nt, Mycobacterium avium subsp. paratuberculosis
cgccacggccagc

SEQ ID NO: 2996183 - RNA, 15 nt, Mycobacterium avium subsp. paratuberculosis
cgccacggccagcac

SEQ ID NO: 2996184 - RNA, 16 nt, Mycobacterium avium subsp. paratuberculosis
cgccacggccagcacc

SEQ ID NO: 2996185 - RNA, 14 nt, Mycobacterium avium subsp. paratuberculosis
cgccacggccggca

SEQ ID NO: 2996186 - RNA, 12 nt, Mycobacterium avium subsp. paratuberculosis
cgccacggcgaa

SEQ ID NO: 2996187 - RNA, 22 nt, Mycobacterium avium subsp. paratuberculosis
cgccacggcgaacaccucggga

SEQ ID NO: 2996188 - RNA, 12 nt, Mycobacterium avium subsp. paratuberculosis
cgccacggcgac

SEQ ID NO: 2996189 - RNA, 13 nt, Mycobacterium avium subsp. paratuberculosis
cgccacggcgacg

SEQ ID NO: 2996190 - RNA, 15 nt, Mycobacterium avium subsp. paratuberculosis
cgccacggcgacgac

SEQ ID NO: 2996191 - RNA, 16 nt, Mycobacterium avium subsp. paratuberculosis
cgccacggcgacgacc

SEQ ID NO: 2996192 - RNA, 19 nt, Mycobacterium avium subsp. paratuberculosis
cgccacggcgacgaccacc

SEQ ID NO: 2996193 - RNA, 21 nt, Mycobacterium avium subsp. paratuberculosis
cgccacggcgacgaccaccag

SEQ ID NO: 2996194 - RNA, 13 nt, Mycobacterium avium subsp. paratuberculosis
cgccacggcggcc

SEQ ID NO: 2996195 - RNA, 15 nt, Mycobacterium avium subsp. paratuberculosis
cgccacggcggccga

SEQ ID NO: 2996196 - RNA, 20 nt, Mycobacterium avium subsp. paratuberculosis
cgccacggcggccgaauccg

SEQ ID NO: 2996197 - RNA, 12 nt, Mycobacterium avium subsp. paratuberculosis
cgccacggcggg

SEQ ID NO: 2996198 - RNA, 15 nt, Mycobacterium avium subsp. paratuberculosis
cgccacggcgggguc

SEQ ID NO: 2996199 - RNA, 16 nt, Mycobacterium avium subsp. paratuberculosis
cgccacggcgggguca

SEQ ID NO: 2996200 - RNA, 17 nt, Mycobacterium avium subsp. paratuberculosis
cgccacggcggugucgg

SEQ ID NO: 2996201 - RNA, 21 nt, Mycobacterium avium subsp. paratuberculosis
cgccacggcggugucggcggc

SEQ ID NO: 2996202 - RNA, 16 nt, Mycobacterium avium subsp. paratuberculosis
cgccacggggcccgcg

SEQ ID NO: 2996203 - RNA, 19 nt, Mycobacterium avium subsp. paratuberculosis
cgccacggggcccgcgacc

SEQ ID NO: 2996204 - RNA, 12 nt, Mycobacterium avium subsp. paratuberculosis
cgccacggggcg

SEQ ID NO: 2996205 - RNA, 15 nt, Mycobacterium avium subsp. paratuberculosis
cgccacggggcgccg

SEQ ID NO: 2996206 - RNA, 17 nt, Mycobacterium avium subsp. paratuberculosis
cgccacggggcgccgcu

SEQ ID NO: 2996207 - RNA, 20 nt, Mycobacterium avium subsp. paratuberculosis
cgccacggggcgccgcugcg

SEQ ID NO: 2996208 - RNA, 21 nt, Mycobacterium avium subsp. paratuberculosis
cgccacggggcgccgcugcgg

SEQ ID NO: 2996209 - RNA, 22 nt, Mycobacterium avium subsp. paratuberculosis
cgccacggggcgccgcugcggg

SEQ ID NO: 2996210 - RNA, 14 nt, Mycobacterium avium subsp. paratuberculosis
cgccacggggcugc

SEQ ID NO: 2996211 - RNA, 19 nt, Mycobacterium avium subsp. paratuberculosis
cgccacggggcugcgggcc

SEQ ID NO: 2996212 - RNA, 23 nt, Mycobacterium avium subsp. paratuberculosis
cgccacggggcugcgggccaggc

SEQ ID NO: 2996213 - RNA, 13 nt, Mycobacterium avium subsp. paratuberculosis
cgccacgguggcg

SEQ ID NO: 2996214 - RNA, 20 nt, Mycobacterium avium subsp. paratuberculosis
cgccacguagcagcagaccg

SEQ ID NO: 2996215 - RNA, 19 nt, Mycobacterium avium subsp. paratuberculosis
cgccacguccggaugcggc

SEQ ID NO: 2996216 - RNA, 19 nt, Mycobacterium avium subsp. paratuberculosis
cgccacgucgaacccgacc

SEQ ID NO: 2996217 - RNA, 21 nt, Mycobacterium avium subsp. paratuberculosis
cgccacgucguucaugaucgg

SEQ ID NO: 2996218 - RNA, 16 nt, Mycobacterium avium subsp. paratuberculosis
cgccacgugcggcugc

SEQ ID NO: 2996219 - RNA, 17 nt, Mycobacterium avium subsp. paratuberculosis
cgccacgugcggcugcg

SEQ ID NO: 2996220 - RNA, 16 nt, Mycobacterium avium subsp. paratuberculosis
cgccacguggucgagc

SEQ ID NO: 2996221 - RNA, 24 nt, Mycobacterium avium subsp. paratuberculosis
cgccacguggucgagcaugcgggu

SEQ ID NO: 2996222 - RNA, 21 nt, Mycobacterium avium subsp. paratuberculosis
cgccacucauguucagggugc

SEQ ID NO: 2996223 - RNA, 18 nt, Mycobacterium avium subsp. paratuberculosis
cgccacucgggcggccgc

SEQ ID NO: 2996224 - RNA, 16 nt, Mycobacterium avium subsp. paratuberculosis
cgccacucgucgacgu

SEQ ID NO: 2996225 - RNA, 16 nt, Mycobacterium avium subsp. paratuberculosis
cgccacugccgccgcc

SEQ ID NO: 2996226 - RNA, 18 nt, Mycobacterium avium subsp. paratuberculosis
cgccacugccgccgccca

SEQ ID NO: 2996227 - RNA, 20 nt, Mycobacterium avium subsp. paratuberculosis
cgccacugccgccgcccagg

SEQ ID NO: 2996228 - RNA, 23 nt, Mycobacterium avium subsp. paratuberculosis
cgccacugccgccgcccaggccg

SEQ ID NO: 2996229 - RNA, 20 nt, Mycobacterium avium subsp. paratuberculosis
cgccacuggcuggucaccca

SEQ ID NO: 2996230 - RNA, 17 nt, Mycobacterium avium subsp. paratuberculosis
cgccacugggcgucggc

SEQ ID NO: 2996231 - RNA, 19 nt, Mycobacterium avium subsp. paratuberculosis
cgccacugggcgucggcgc

SEQ ID NO: 2996232 - RNA, 14 nt, Mycobacterium avium subsp. paratuberculosis
cgccacuucuccac

SEQ ID NO: 2996233 - RNA, 15 nt, Mycobacterium avium subsp. paratuberculosis
cgccacuucuccacg

SEQ ID NO: 2996234 - RNA, 20 nt, Mycobacterium avium subsp. paratuberculosis
cgccacuucuccacgccgac

SEQ ID NO: 2996235 - RNA, 12 nt, Mycobacterium avium subsp. paratuberculosis
cgccagaaccgg

SEQ ID NO: 2996236 - RNA, 12 nt, Mycobacterium avium subsp. paratuberculosis
cgccagaccggu

SEQ ID NO: 2996237 - RNA, 18 nt, Mycobacterium avium subsp. paratuberculosis
cgccagaccgguugcggc

SEQ ID NO: 2996238 - RNA, 22 nt, Mycobacterium avium subsp. paratuberculosis
cgccagaccgguugcggcgaac

SEQ ID NO: 2996239 - RNA, 15 nt, Mycobacterium avium subsp. paratuberculosis
cgccagacguccagc

SEQ ID NO: 2996240 - RNA, 19 nt, Mycobacterium avium subsp. paratuberculosis
cgccagacguccagcgccg

SEQ ID NO: 2996241 - RNA, 21 nt, Mycobacterium avium subsp. paratuberculosis
cgccagacguccagcgccgcc

SEQ ID NO: 2996242 - RNA, 22 nt, Mycobacterium avium subsp. paratuberculosis
cgccagacguccagcgccgcca

SEQ ID NO: 2996243 - RNA, 18 nt, Mycobacterium avium subsp. paratuberculosis
cgccagacucacggcggc

SEQ ID NO: 2996244 - RNA, 22 nt, Mycobacterium avium subsp. paratuberculosis
cgccagacugaugcccucgccg

SEQ ID NO: 2996245 - RNA, 20 nt, Mycobacterium avium subsp. paratuberculosis
cgccagauagggcagcgucc

SEQ ID NO: 2996246 - RNA, 13 nt, Mycobacterium avium subsp. paratuberculosis
cgccagaucccgc

SEQ ID NO: 2996247 - RNA, 15 nt, Mycobacterium avium subsp. paratuberculosis
cgccagaucccgcag

SEQ ID NO: 2996248 - RNA, 16 nt, Mycobacterium avium subsp. paratuberculosis
cgccagaucccgcagc

SEQ ID NO: 2996249 - RNA, 13 nt, Mycobacterium avium subsp. paratuberculosis
cgccagaucgcca

SEQ ID NO: 2996250 - RNA, 14 nt, Mycobacterium avium subsp. paratuberculosis
cgccagaucgccau

SEQ ID NO: 2996251 - RNA, 17 nt, Mycobacterium avium subsp. paratuberculosis
cgccagaucgccaucag

SEQ ID NO: 2996252 - RNA, 16 nt, Mycobacterium avium subsp. paratuberculosis
cgccagaucgcugaug

SEQ ID NO: 2996253 - RNA, 17 nt, Mycobacterium avium subsp. paratuberculosis
cgccagaucgcugaugc

SEQ ID NO: 2996254 - RNA, 17 nt, Mycobacterium avium subsp. paratuberculosis
cgccagaugcgccgcgg

SEQ ID NO: 2996255 - RNA, 18 nt, Mycobacterium avium subsp. paratuberculosis
cgccagaugcgccgcgga

SEQ ID NO: 2996256 - RNA, 19 nt, Mycobacterium avium subsp. paratuberculosis
cgccagaugcgccgcggau

SEQ ID NO: 2996257 - RNA, 18 nt, Mycobacterium avium subsp. paratuberculosis
cgccagcaacacccagcc

SEQ ID NO: 2996258 - RNA, 19 nt, Mycobacterium avium subsp. paratuberculosis
cgccagcaaccccgcggug

SEQ ID NO: 2996259 - RNA, 21 nt, Mycobacterium avium subsp. paratuberculosis
cgccagcaaccccgcggugca

SEQ ID NO: 2996260 - RNA, 17 nt, Mycobacterium avium subsp. paratuberculosis
cgccagcaacgacccgg

SEQ ID NO: 2996261 - RNA, 22 nt, Mycobacterium avium subsp. paratuberculosis
cgccagcaacgacccggccacc

SEQ ID NO: 2996262 - RNA, 23 nt, Mycobacterium avium subsp. paratuberculosis
cgccagcaacgacccggccaccg

SEQ ID NO: 2996263 - RNA, 13 nt, Mycobacterium avium subsp. paratuberculosis
cgccagcaccacc

SEQ ID NO: 2996264 - RNA, 14 nt, Mycobacterium avium subsp. paratuberculosis
cgccagcaccaccg

SEQ ID NO: 2996265 - RNA, 19 nt, Mycobacterium avium subsp. paratuberculosis
cgccagcaccaccgucacc

SEQ ID NO: 2996266 - RNA, 21 nt, Mycobacterium avium subsp. paratuberculosis
cgccagcaccaccgucaccgc

SEQ ID NO: 2996267 - RNA, 19 nt, Mycobacterium avium subsp. paratuberculosis
cgccagcaccaccucgcgc

SEQ ID NO: 2996268 - RNA, 21 nt, Mycobacterium avium subsp. paratuberculosis
cgccagcaccaccucgcgcgg

SEQ ID NO: 2996269 - RNA, 13 nt, Mycobacterium avium subsp. paratuberculosis
cgccagcaccgac

SEQ ID NO: 2996270 - RNA, 16 nt, Mycobacterium avium subsp. paratuberculosis
cgccagcaccgacagc

SEQ ID NO: 2996271 - RNA, 18 nt, Mycobacterium avium subsp. paratuberculosis
cgccagcaccgacagcuu

SEQ ID NO: 2996272 - RNA, 18 nt, Mycobacterium avium subsp. paratuberculosis
cgccagcaccgacagucc

SEQ ID NO: 2996273 - RNA, 15 nt, Mycobacterium avium subsp. paratuberculosis
cgccagcaccgacgc

SEQ ID NO: 2996274 - RNA, 16 nt, Mycobacterium avium subsp. paratuberculosis
cgccagcaccgacgcg

SEQ ID NO: 2996275 - RNA, 19 nt, Mycobacterium avium subsp. paratuberculosis
cgccagcaccgacgcgccg

SEQ ID NO: 2996276 - RNA, 12 nt, Mycobacterium avium subsp. paratuberculosis
cgccagcaccgc

SEQ ID NO: 2996277 - RNA, 14 nt, Mycobacterium avium subsp. paratuberculosis
cgccagcaccgcca

SEQ ID NO: 2996278 - RNA, 16 nt, Mycobacterium avium subsp. paratuberculosis
cgccagcaccgccacc

SEQ ID NO: 2996279 - RNA, 17 nt, Mycobacterium avium subsp. paratuberculosis
cgccagcaccgccaccg

SEQ ID NO: 2996280 - RNA, 20 nt, Mycobacterium avium subsp. paratuberculosis
cgccagcaccgccaccggcc

SEQ ID NO: 2996281 - RNA, 14 nt, Mycobacterium avium subsp. paratuberculosis
cgccagcaccgccu

SEQ ID NO: 2996282 - RNA, 20 nt, Mycobacterium avium subsp. paratuberculosis
cgccagcaccgccugggucu

SEQ ID NO: 2996283 - RNA, 23 nt, Mycobacterium avium subsp. paratuberculosis
cgccagcaccgccugggucucgg

SEQ ID NO: 2996284 - RNA, 13 nt, Mycobacterium avium subsp. paratuberculosis
cgccagcaccgcg

SEQ ID NO: 2996285 - RNA, 15 nt, Mycobacterium avium subsp. paratuberculosis
cgccagcaccgcggg

SEQ ID NO: 2996286 - RNA, 16 nt, Mycobacterium avium subsp. paratuberculosis
cgccagcaccgcgggg

SEQ ID NO: 2996287 - RNA, 17 nt, Mycobacterium avium subsp. paratuberculosis
cgccagcaccgcggggg

SEQ ID NO: 2996288 - RNA, 19 nt, Mycobacterium avium subsp. paratuberculosis
cgccagcaccgcgggggcg

SEQ ID NO: 2996289 - RNA, 22 nt, Mycobacterium avium subsp. paratuberculosis
cgccagcaccgcgggggcggcc

SEQ ID NO: 2996290 - RNA, 23 nt, Mycobacterium avium subsp. paratuberculosis
cgccagcaccgcgggggcggccg

SEQ ID NO: 2996291 - RNA, 16 nt, Mycobacterium avium subsp. paratuberculosis
cgccagcaccggcgcg

SEQ ID NO: 2996292 - RNA, 17 nt, Mycobacterium avium subsp. paratuberculosis
cgccagcaccggcgcgc

SEQ ID NO: 2996293 - RNA, 19 nt, Mycobacterium avium subsp. paratuberculosis
cgcacgaccaugucggcga

SEQ ID NO: 2996294 - RNA, 20 nt, Mycobacterium avium subsp. paratuberculosis
cgcacgaccugaacgcgcag

SEQ ID NO: 2996295 - RNA, 18 nt, Mycobacterium avium subsp. paratuberculosis
cgcacgagcacccagaaa

SEQ ID NO: 2996296 - RNA, 18 nt, Mycobacterium avium subsp. paratuberculosis
cgcacgaucagggugucg

SEQ ID NO: 2996297 - RNA, 19 nt, Mycobacterium avium subsp. paratuberculosis
cgcacgaucagggugucga

SEQ ID NO: 2996298 - RNA, 15 nt, Mycobacterium avium subsp. paratuberculosis
cgcacgaucgggcgc

SEQ ID NO: 2996299 - RNA, 20 nt, Mycobacterium avium subsp. paratuberculosis
cgcacgaucugcaggccgag

SEQ ID NO: 2996300 - RNA, 17 nt, Mycobacterium avium subsp. paratuberculosis
cgcacgaugccgcgcuc

SEQ ID NO: 2996301 - RNA, 19 nt, Mycobacterium avium subsp. paratuberculosis
cgcacgaugccgcgcucga

SEQ ID NO: 2996302 - RNA, 14 nt, Mycobacterium avium subsp. paratuberculosis
cgcacgcagugccg

SEQ ID NO: 2996303 - RNA, 16 nt, Mycobacterium avium subsp. paratuberculosis
cgcacgcagugccgca

SEQ ID NO: 2996304 - RNA, 18 nt, Mycobacterium avium subsp. paratuberculosis
cgcacgcagugccgcacc

SEQ ID NO: 2996305 - RNA, 19 nt, Mycobacterium avium subsp. paratuberculosis
cgcacgcagugccgcacca

SEQ ID NO: 2996306 - RNA, 20 nt, Mycobacterium avium subsp. paratuberculosis
cgcacgcagugccgcaccag

SEQ ID NO: 2996307 - RNA, 15 nt, Mycobacterium avium subsp. paratuberculosis
cgcacgccagcaucg

SEQ ID NO: 2996308 - RNA, 14 nt, Mycobacterium avium subsp. paratuberculosis
cgcacgccggcggg

SEQ ID NO: 2996309 - RNA, 17 nt, Mycobacterium avium subsp. paratuberculosis
cgcacgccggcgggggu

SEQ ID NO: 2996310 - RNA, 15 nt, Mycobacterium avium subsp. paratuberculosis
cgcacgcgaccgcgu

SEQ ID NO: 2996311 - RNA, 19 nt, Mycobacterium avium subsp. paratuberculosis
cgcacgcgaccgcgucgac

SEQ ID NO: 2996312 - RNA, 24 nt, Mycobacterium avium subsp. paratuberculosis
cgcacgcggacacgaacgacgcgg

SEQ ID NO: 2996313 - RNA, 15 nt, Mycobacterium avium subsp. paratuberculosis
cgcacgcucgcggug

SEQ ID NO: 2996314 - RNA, 13 nt, Mycobacterium avium subsp. paratuberculosis
cgcacgcuggccg

SEQ ID NO: 2996315 - RNA, 15 nt, Mycobacterium avium subsp. paratuberculosis
cgcacgcugucgggg

SEQ ID NO: 2996316 - RNA, 18 nt, Mycobacterium avium subsp. paratuberculosis
cgcacgcugucggggucg

SEQ ID NO: 2996317 - RNA, 13 nt, Mycobacterium avium subsp. paratuberculosis
cgcacggcccauc

SEQ ID NO: 2996318 - RNA, 16 nt, Mycobacterium avium subsp. paratuberculosis
cgcacggcccaucacc

SEQ ID NO: 2996319 - RNA, 21 nt, Mycobacterium avium subsp. paratuberculosis
cgcacggcccaucaccagcgg

SEQ ID NO: 2996320 - RNA, 13 nt, Mycobacterium avium subsp. paratuberculosis
cgcacggccgcca

SEQ ID NO: 2996321 - RNA, 15 nt, Mycobacterium avium subsp. paratuberculosis
cgcacggcgaacggc

SEQ ID NO: 2996322 - RNA, 18 nt, Mycobacterium avium subsp. paratuberculosis
cgcacggcgaacggccgc

SEQ ID NO: 2996323 - RNA, 13 nt, Mycobacterium avium subsp. paratuberculosis
cgcacggcgccca

SEQ ID NO: 2996324 - RNA, 16 nt, Mycobacterium avium subsp. paratuberculosis
cgcacggcgcgcaccg

SEQ ID NO: 2996325 - RNA, 13 nt, Mycobacterium avium subsp. paratuberculosis
cgcacgggcggcg

SEQ ID NO: 2996326 - RNA, 22 nt, Mycobacterium avium subsp. paratuberculosis
cgcacggucgcggugucggcgu

SEQ ID NO: 2996327 - RNA, 21 nt, Mycobacterium avium subsp. paratuberculosis
cgcacggugcagcagcgccgc

SEQ ID NO: 2996328 - RNA, 22 nt, Mycobacterium avium subsp. paratuberculosis
cgcacggugcagcagcgccgcg

SEQ ID NO: 2996329 - RNA, 13 nt, Mycobacterium avium subsp. paratuberculosis
cgcacggugcccg

SEQ ID NO: 2996330 - RNA, 16 nt, Mycobacterium avium subsp. paratuberculosis
cgcacggugcccgucg

SEQ ID NO: 2996331 - RNA, 18 nt, Mycobacterium avium subsp. paratuberculosis
cgcacggugcccgucggc

SEQ ID NO: 2996332 - RNA, 22 nt, Mycobacterium avium subsp. paratuberculosis
cgcacggugcccgucggcaacg

SEQ ID NO: 2996333 - RNA, 16 nt, Mycobacterium avium subsp. paratuberculosis
cgcacguagacggugu

SEQ ID NO: 2996334 - RNA, 15 nt, Mycobacterium avium subsp. paratuberculosis
cgcacguagcccagc

SEQ ID NO: 2996335 - RNA, 17 nt, Mycobacterium avium subsp. paratuberculosis
cgcacguagcccagcgc

SEQ ID NO: 2996336 - RNA, 19 nt, Mycobacterium avium subsp. paratuberculosis
cgcacguagcccagcgcgu

SEQ ID NO: 2996337 - RNA, 19 nt, Mycobacterium avium subsp. paratuberculosis
cgcacguauccgcggucga

SEQ ID NO: 2996338 - RNA, 22 nt, Mycobacterium avium subsp. paratuberculosis
cgcacguauccgcggucgacca

SEQ ID NO: 2996339 - RNA, 13 nt, Mycobacterium avium subsp. paratuberculosis
cgcacgucaccgc

SEQ ID NO: 2996340 - RNA, 14 nt, Mycobacterium avium subsp. paratuberculosis
cgcacgucccgccc

SEQ ID NO: 2996341 - RNA, 17 nt, Mycobacterium avium subsp. paratuberculosis
cgcacgucccgcccggc

SEQ ID NO: 2996342 - RNA, 19 nt, Mycobacterium avium subsp. paratuberculosis
cgcacgucccgcccggcgc

SEQ ID NO: 2996343 - RNA, 21 nt, Mycobacterium avium subsp. paratuberculosis
cgcacgucccgcccggcgccg

SEQ ID NO: 2996344 - RNA, 20 nt, Mycobacterium avium subsp. paratuberculosis
cgcacgucgaggucggacgc

SEQ ID NO: 2996345 - RNA, 18 nt, Mycobacterium avium subsp. paratuberculosis
cgcacgugcgcgccgacc

SEQ ID NO: 2996346 - RNA, 20 nt, Mycobacterium avium subsp. paratuberculosis
cgcacgugcgcgccgaccgc

SEQ ID NO: 2996347 - RNA, 22 nt, Mycobacterium avium subsp. paratuberculosis
cgcacguggcugaccgacggcg

SEQ ID NO: 2996348 - RNA, 21 nt, Mycobacterium avium subsp. paratuberculosis
cgcacguguucucacggcgaa

SEQ ID NO: 2996349 - RNA, 21 nt, Mycobacterium avium subsp. paratuberculosis
cgcacguuggcggccagcgcg

SEQ ID NO: 2996350 - RNA, 23 nt, Mycobacterium avium subsp. paratuberculosis
cgcacguuggcggccagcgcgcc

SEQ ID NO: 2996351 - RNA, 20 nt, Mycobacterium avium subsp. paratuberculosis
cgcacuagguccggcgcgac

SEQ ID NO: 2996352 - RNA, 21 nt, Mycobacterium avium subsp. paratuberculosis
cgcacuagguccggcgcgacc

SEQ ID NO: 2996353 - RNA, 22 nt, Mycobacterium avium subsp. paratuberculosis
cgcacuagguccggcgcgacca

SEQ ID NO: 2996354 - RNA, 15 nt, Mycobacterium avium subsp. paratuberculosis
cgcacucccgcguau

SEQ ID NO: 2996355 - RNA, 14 nt, Mycobacterium avium subsp. paratuberculosis
cgcacucgaacggc

SEQ ID NO: 2996356 - RNA, 18 nt, Mycobacterium avium subsp. paratuberculosis
cgcacucgaacggcccgg

SEQ ID NO: 2996357 - RNA, 20 nt, Mycobacterium avium subsp. paratuberculosis
cgcacucgaacggcccggac

SEQ ID NO: 2996358 - RNA, 13 nt, Mycobacterium avium subsp. paratuberculosis
cgcacucggugug

SEQ ID NO: 2996359 - RNA, 15 nt, Mycobacterium avium subsp. paratuberculosis
cgcacucgguguggc

SEQ ID NO: 2996360 - RNA, 18 nt, Mycobacterium avium subsp. paratuberculosis
cgcacucgguguggccca

SEQ ID NO: 2996361 - RNA, 19 nt, Mycobacterium avium subsp. paratuberculosis
cgcacucuugcgugcgggu

SEQ ID NO: 2996362 - RNA, 21 nt, Mycobacterium avium subsp. paratuberculosis
cgcacucuugcgugcgggucg

SEQ ID NO: 2996363 - RNA, 22 nt, Mycobacterium avium subsp. paratuberculosis
cgcacucuugcgugcgggucgc

SEQ ID NO: 2996364 - RNA, 16 nt, Mycobacterium avium subsp. paratuberculosis
cgcacugaacgggaug

SEQ ID NO: 2996365 - RNA, 14 nt, Mycobacterium avium subsp. paratuberculosis
cgcacugcacggcc

SEQ ID NO: 2996366 - RNA, 17 nt, Mycobacterium avium subsp. paratuberculosis
cgcacugcacggccucg

SEQ ID NO: 2996367 - RNA, 19 nt, Mycobacterium avium subsp. paratuberculosis
cgcacugcacggccucggu

SEQ ID NO: 2996368 - RNA, 12 nt, Mycobacterium avium subsp. paratuberculosis
cgcacugcuucg

SEQ ID NO: 2996369 - RNA, 20 nt, Mycobacterium avium subsp. paratuberculosis
cgcacugcuucgggucgccg

SEQ ID NO: 2996370 - RNA, 21 nt, Mycobacterium avium subsp. paratuberculosis
cgcacuggagugcugcagacc

SEQ ID NO: 2996371 - RNA, 14 nt, Mycobacterium avium subsp. paratuberculosis
cgcacuucgcgggc

SEQ ID NO: 2996372 - RNA, 17 nt, Mycobacterium avium subsp. paratuberculosis
cgcacuucgcgggcggc

SEQ ID NO: 2996373 - RNA, 18 nt, Mycobacterium avium subsp. paratuberculosis
cgcacuucgcgggcggcg

SEQ ID NO: 2996374 - RNA, 20 nt, Mycobacterium avium subsp. paratuberculosis
cgcacuucgcgggcggcgca

SEQ ID NO: 2996375 - RNA, 22 nt, Mycobacterium avium subsp. paratuberculosis
cgcacuuggccucgggcgacga

SEQ ID NO: 2996376 - RNA, 23 nt, Mycobacterium avium subsp. paratuberculosis
cgcacuuggccucgggcgacgac

SEQ ID NO: 2996377 - RNA, 22 nt, Mycobacterium avium subsp. paratuberculosis
cgcagaaaaaggccgccgcugg

SEQ ID NO: 2996378 - RNA, 13 nt, Mycobacterium avium subsp. paratuberculosis
cgcagaacaccac

SEQ ID NO: 2996379 - RNA, 14 nt, Mycobacterium avium subsp. paratuberculosis
cgcagaacaccacg

SEQ ID NO: 2996380 - RNA, 15 nt, Mycobacterium avium subsp. paratuberculosis
cgcagaacaccacgg

SEQ ID NO: 2996381 - RNA, 19 nt, Mycobacterium avium subsp. paratuberculosis
cgcagaacaccacggugua

SEQ ID NO: 2996382 - RNA, 14 nt, Mycobacterium avium subsp. paratuberculosis
cgcagaacaccagc

SEQ ID NO: 2996383 - RNA, 17 nt, Mycobacterium avium subsp. paratuberculosis
cgcagaacaccagcgca

SEQ ID NO: 2996384 - RNA, 15 nt, Mycobacterium avium subsp. paratuberculosis
cgcagaaccgcaccc

SEQ ID NO: 2996385 - RNA, 16 nt, Mycobacterium avium subsp. paratuberculosis
cgcagaaccguugagc

SEQ ID NO: 2996386 - RNA, 19 nt, Mycobacterium avium subsp. paratuberculosis
cgcagaaccguugagcagc

SEQ ID NO: 2996387 - RNA, 20 nt, Mycobacterium avium subsp. paratuberculosis
cgcagaacucgucgccaccg

SEQ ID NO: 2996388 - RNA, 21 nt, Mycobacterium avium subsp. paratuberculosis
cgcagaacucgucgccaccga

SEQ ID NO: 2996389 - RNA, 19 nt, Mycobacterium avium subsp. paratuberculosis
cgcagaagcuaacgccagc

SEQ ID NO: 2996390 - RNA, 16 nt, Mycobacterium avium subsp. paratuberculosis
cgcagacccucguucg

SEQ ID NO: 2996391 - RNA, 19 nt, Mycobacterium avium subsp. paratuberculosis
cgcagauacaucucggugg

SEQ ID NO: 2996392 - RNA, 21 nt, Mycobacterium avium subsp. paratuberculosis
cgcagauacaucucgguggug

SEQ ID NO: 2996393 - RNA, 16 nt, Mycobacterium avium subsp. paratuberculosis
cgcagauagaucgacg

SEQ ID NO: 2996394 - RNA, 21 nt, Mycobacterium avium subsp. paratuberculosis
cgcagauagaucgacgcgacc

SEQ ID NO: 2996395 - RNA, 22 nt, Mycobacterium avium subsp. paratuberculosis
cgcagauagaucgacgcgaccu

SEQ ID NO: 2996396 - RNA, 21 nt, Mycobacterium avium subsp. paratuberculosis
cgcagauagccguacacggcg

SEQ ID NO: 2996397 - RNA, 23 nt, Mycobacterium avium subsp. paratuberculosis
cgcagauagccguacacggcggc

SEQ ID NO: 2996398 - RNA, 14 nt, Mycobacterium avium subsp. paratuberculosis
cgcagaucccgccg

SEQ ID NO: 2996399 - RNA, 16 nt, Mycobacterium avium subsp. paratuberculosis
cgcagaucccgccggc

SEQ ID NO: 2996400 - RNA, 17 nt, Mycobacterium avium subsp. paratuberculosis
cgcagaucccgccggcg

SEQ ID NO: 2996401 - RNA, 20 nt, Mycobacterium avium subsp. paratuberculosis
cgcagaucgagaucagggcg

SEQ ID NO: 2996402 - RNA, 20 nt, Mycobacterium avium subsp. paratuberculosis
cgcagaucgccagcaccggc

SEQ ID NO: 2996403 - RNA, 14 nt, Mycobacterium avium subsp. paratuberculosis
cgcagaucgcgcau

SEQ ID NO: 2996404 - RNA, 22 nt, Mycobacterium avium subsp. paratuberculosis
cgcagaucgcgcaucacccggc

SEQ ID NO: 2996405 - RNA, 15 nt, Mycobacterium avium subsp. paratuberculosis
cgcagaucgucgacc

SEQ ID NO: 2996406 - RNA, 23 nt, Mycobacterium avium subsp. paratuberculosis
cgcagaucuugugccagccgaag

SEQ ID NO: 2996407 - RNA, 18 nt, Mycobacterium avium subsp. paratuberculosis
cgcagaugaccggccugc

SEQ ID NO: 2996408 - RNA, 13 nt, Mycobacterium avium subsp. paratuberculosis
cgcagauggucgg

SEQ ID NO: 2996409 - RNA, 15 nt, Mycobacterium avium subsp. paratuberculosis
cgcagauggucggga

SEQ ID NO: 2996410 - RNA, 22 nt, Mycobacterium avium subsp. paratuberculosis
cgcagauggucgggacgucggc

SEQ ID NO: 2996411 - RNA, 23 nt, Mycobacterium avium subsp. paratuberculosis
cgcagauggucgggacgucggcg

SEQ ID NO: 2996412 - RNA, 16 nt, Mycobacterium avium subsp. paratuberculosis
cgcagcaacuccaccu

SEQ ID NO: 2996413 - RNA, 18 nt, Mycobacterium avium subsp. paratuberculosis
cgcagcaauugacgccga

SEQ ID NO: 2996414 - RNA, 21 nt, Mycobacterium avium subsp. paratuberculosis
cgcagcaauugacgccgacag

SEQ ID NO: 2996415 - RNA, 22 nt, Mycobacterium avium subsp. paratuberculosis
cgcagcaauugacgccgacagc

SEQ ID NO: 2996416 - RNA, 22 nt, Mycobacterium avium subsp. paratuberculosis
cgcagcaauuucguucguccaa

SEQ ID NO: 2996417 - RNA, 22 nt, Mycobacterium avium subsp. paratuberculosis
cgcagcacaaaagggcccaugc

SEQ ID NO: 2996418 - RNA, 16 nt, Mycobacterium avium subsp. paratuberculosis
cgcagcaccaggcccu

SEQ ID NO: 2996419 - RNA, 16 nt, Mycobacterium avium subsp. paratuberculosis
cgcagcaccagggucu

SEQ ID NO: 2996420 - RNA, 12 nt, Mycobacterium avium subsp. paratuberculosis
cgcagcaccgcg

SEQ ID NO: 2996421 - RNA, 17 nt, Mycobacterium avium subsp. paratuberculosis
cgcagcaccgcgucggc

SEQ ID NO: 2996422 - RNA, 18 nt, Mycobacterium avium subsp. paratuberculosis
cgcagcaccgcgucggcg

SEQ ID NO: 2996423 - RNA, 21 nt, Mycobacterium avium subsp. paratuberculosis
cgcagcaccgcgucggcgcug

SEQ ID NO: 2996424 - RNA, 15 nt, Mycobacterium avium subsp. paratuberculosis
cgcagcaccgucacc

SEQ ID NO: 2996425 - RNA, 20 nt, Mycobacterium avium subsp. paratuberculosis
cgcagcaccuccgacagccc

SEQ ID NO: 2996426 - RNA, 23 nt, Mycobacterium avium subsp. paratuberculosis
cgcagcaccuccgacagcccccg

SEQ ID NO: 2996427 - RNA, 12 nt, Mycobacterium avium subsp. paratuberculosis
cgcagcaccuug

SEQ ID NO: 2996428 - RNA, 17 nt, Mycobacterium avium subsp. paratuberculosis
cgcagcaccuugccggu

SEQ ID NO: 2996429 - RNA, 20 nt, Mycobacterium avium subsp. paratuberculosis
cgcagcaccuugccggucgg

SEQ ID NO: 2996430 - RNA, 22 nt, Mycobacterium avium subsp. paratuberculosis
cgcagcaccuugccggucgggu

SEQ ID NO: 2996431 - RNA, 23 nt, Mycobacterium avium subsp. paratuberculosis
cgcagcacgcugaagcccaccgc

SEQ ID NO: 2996432 - RNA, 17 nt, Mycobacterium avium subsp. paratuberculosis
cgcagcacggccacugc

SEQ ID NO: 2996433 - RNA, 21 nt, Mycobacterium avium subsp. paratuberculosis
cgcagcacguguucgggaucg

SEQ ID NO: 2996434 - RNA, 22 nt, Mycobacterium avium subsp. paratuberculosis
cgcagcacguguucgggaucgg

SEQ ID NO: 2996435 - RNA, 14 nt, Mycobacterium avium subsp. paratuberculosis
cgcagcagcagccc

SEQ ID NO: 2996436 - RNA, 19 nt, Mycobacterium avium subsp. paratuberculosis
cgcagcagcaggucggcca

SEQ ID NO: 2996437 - RNA, 22 nt, Mycobacterium avium subsp. paratuberculosis
cgcagcagcaggucggccagcu

SEQ ID NO: 2996438 - RNA, 17 nt, Mycobacterium avium subsp. paratuberculosis
cgcagcagccaggacag

SEQ ID NO: 2996439 - RNA, 20 nt, Mycobacterium avium subsp. paratuberculosis
cgcagcagccgcgccaccgc

SEQ ID NO: 2996440 - RNA, 21 nt, Mycobacterium avium subsp. paratuberculosis
cgcagcagcgaggccucgccg

SEQ ID NO: 2996441 - RNA, 23 nt, Mycobacterium avium subsp. paratuberculosis
cgcagcagcgaggccucgccgcu

SEQ ID NO: 2996442 - RNA, 19 nt, Mycobacterium avium subsp. paratuberculosis
cgcagcagcgccagcagcg

SEQ ID NO: 2996443 - RNA, 14 nt, Mycobacterium avium subsp. paratuberculosis
cgcagcagcggcuu

SEQ ID NO: 2996444 - RNA, 21 nt, Mycobacterium avium subsp. paratuberculosis
cgcagcagcguuccgucggcg

SEQ ID NO: 2996445 - RNA, 15 nt, Mycobacterium avium subsp. paratuberculosis
cgcagcagcucgucg

SEQ ID NO: 2996446 - RNA, 13 nt, Mycobacterium avium subsp. paratuberculosis
cgcagcaggcgcc

SEQ ID NO: 2996447 - RNA, 15 nt, Mycobacterium avium subsp. paratuberculosis
cgcagcaggcgccgg

SEQ ID NO: 2996448 - RNA, 16 nt, Mycobacterium avium subsp. paratuberculosis
cgcagcaggcggacgg

SEQ ID NO: 2996449 - RNA, 21 nt, Mycobacterium avium subsp. paratuberculosis
cgcagcaggcggacggcgacc

SEQ ID NO: 2996450 - RNA, 21 nt, Mycobacterium avium subsp. paratuberculosis
cgcagcagguaaaccagcagc

SEQ ID NO: 2996451 - RNA, 17 nt, Mycobacterium avium subsp. paratuberculosis
cgcagcaggugcaucgc

SEQ ID NO: 2996452 - RNA, 21 nt, Mycobacterium avium subsp. paratuberculosis
cgcagcaggugcaucgccacc

SEQ ID NO: 2996453 - RNA, 13 nt, Mycobacterium avium subsp. paratuberculosis
cgcagcaggugcg

SEQ ID NO: 2996454 - RNA, 19 nt, Mycobacterium avium subsp. paratuberculosis
cgcagcaggugcgccagau

SEQ ID NO: 2996455 - RNA, 21 nt, Mycobacterium avium subsp. paratuberculosis
cgcagcaggugcgccagaucg

SEQ ID NO: 2996456 - RNA, 17 nt, Mycobacterium avium subsp. paratuberculosis
cgcagcaucacgucggc

SEQ ID NO: 2996457 - RNA, 18 nt, Mycobacterium avium subsp. paratuberculosis
cgcagcaucacgucggcg

SEQ ID NO: 2996458 - RNA, 19 nt, Mycobacterium avium subsp. paratuberculosis
cgcagcaucacgucggcga

SEQ ID NO: 2996459 - RNA, 15 nt, Mycobacterium avium subsp. paratuberculosis
cgcagcauccgcacc

SEQ ID NO: 2996460 - RNA, 16 nt, Mycobacterium avium subsp. paratuberculosis
cgcagcauccgcacca

SEQ ID NO: 2996461 - RNA, 20 nt, Mycobacterium avium subsp. paratuberculosis
cagcccgggaaagcggguga

SEQ ID NO: 2996462 - RNA, 17 nt, Mycobacterium avium subsp. paratuberculosis
cagcccgggcugcagca

SEQ ID NO: 2996463 - RNA, 23 nt, Mycobacterium avium subsp. paratuberculosis
cagcccgggcugcagcagcgacu

SEQ ID NO: 2996464 - RNA, 21 nt, Mycobacterium avium subsp. paratuberculosis
cagcccggggguggcgguccc

SEQ ID NO: 2996465 - RNA, 23 nt, Mycobacterium avium subsp. paratuberculosis
cagcccgggugcgaacagccacg

SEQ ID NO: 2996466 - RNA, 13 nt, Mycobacterium avium subsp. paratuberculosis
cagcccggugacg

SEQ ID NO: 2996467 - RNA, 15 nt, Mycobacterium avium subsp. paratuberculosis
cagcccggugacgaa

SEQ ID NO: 2996468 - RNA, 21 nt, Mycobacterium avium subsp. paratuberculosis
cagcccggugacgaacaucga

SEQ ID NO: 2996469 - RNA, 23 nt, Mycobacterium avium subsp. paratuberculosis
cagcccggugacgaacaucgacg

SEQ ID NO: 2996470 - RNA, 13 nt, Mycobacterium avium subsp. paratuberculosis
cagcccggugauc

SEQ ID NO: 2996471 - RNA, 20 nt, Mycobacterium avium subsp. paratuberculosis
cagcccggugaucgccgccc

SEQ ID NO: 2996472 - RNA, 20 nt, Mycobacterium avium subsp. paratuberculosis
cagcccgguuuccaguccgg

SEQ ID NO: 2996473 - RNA, 20 nt, Mycobacterium avium subsp. paratuberculosis
cagcccguacuugcuggcgc

SEQ ID NO: 2996474 - RNA, 17 nt, Mycobacterium avium subsp. paratuberculosis
cagcccgucggccucca

SEQ ID NO: 2996475 - RNA, 20 nt, Mycobacterium avium subsp. paratuberculosis
cagcccgucggccuccagcc

SEQ ID NO: 2996476 - RNA, 18 nt, Mycobacterium avium subsp. paratuberculosis
cagcccguggccagcgcc

SEQ ID NO: 2996477 - RNA, 19 nt, Mycobacterium avium subsp. paratuberculosis
cagcccguggccagcgcca

SEQ ID NO: 2996478 - RNA, 21 nt, Mycobacterium avium subsp. paratuberculosis
cagcccguggccagcgccagc

SEQ ID NO: 2996479 - RNA, 21 nt, Mycobacterium avium subsp. paratuberculosis
cagcccguugucgagcaccgc

SEQ ID NO: 2996480 - RNA, 22 nt, Mycobacterium avium subsp. paratuberculosis
cagcccguugucgagcaccgcg

SEQ ID NO: 2996481 - RNA, 23 nt, Mycobacterium avium subsp. paratuberculosis
cagcccguugucgagcaccgcga

SEQ ID NO: 2996482 - RNA, 14 nt, Mycobacterium avium subsp. paratuberculosis
cagcccguuguggc

SEQ ID NO: 2996483 - RNA, 19 nt, Mycobacterium avium subsp. paratuberculosis
cagcccguuguggcggcca

SEQ ID NO: 2996484 - RNA, 21 nt, Mycobacterium avium subsp. paratuberculosis
cagcccguuguggcggccagc

SEQ ID NO: 2996485 - RNA, 22 nt, Mycobacterium avium subsp. paratuberculosis
cagcccguuguggcggccagcg

SEQ ID NO: 2996486 - RNA, 16 nt, Mycobacterium avium subsp. paratuberculosis
cagcccuacccgucca

SEQ ID NO: 2996487 - RNA, 19 nt, Mycobacterium avium subsp. paratuberculosis
cagcccuacccguccagcg

SEQ ID NO: 2996488 - RNA, 14 nt, Mycobacterium avium subsp. paratuberculosis
cagcccucgucgau

SEQ ID NO: 2996489 - RNA, 16 nt, Mycobacterium avium subsp. paratuberculosis
cagcccucgucgauga

SEQ ID NO: 2996490 - RNA, 17 nt, Mycobacterium avium subsp. paratuberculosis
cagcccucgugcguagc

SEQ ID NO: 2996491 - RNA, 21 nt, Mycobacterium avium subsp. paratuberculosis
cagcccugcuugaccgcgacg

SEQ ID NO: 2996492 - RNA, 16 nt, Mycobacterium avium subsp. paratuberculosis
cagcccuuggcgaagc

SEQ ID NO: 2996493 - RNA, 21 nt, Mycobacterium avium subsp. paratuberculosis
cagccgaagaacuggcugagc

SEQ ID NO: 2996494 - RNA, 14 nt, Mycobacterium avium subsp. paratuberculosis
cagccgaagccggc

SEQ ID NO: 2996495 - RNA, 15 nt, Mycobacterium avium subsp. paratuberculosis
cagccgaagccggcg

SEQ ID NO: 2996496 - RNA, 18 nt, Mycobacterium avium subsp. paratuberculosis
cagccgaagccggcgcag

SEQ ID NO: 2996497 - RNA, 18 nt, Mycobacterium avium subsp. paratuberculosis
cagccgaaguauccgguc

SEQ ID NO: 2996498 - RNA, 18 nt, Mycobacterium avium subsp. paratuberculosis
cagccgaaguuggcgucg

SEQ ID NO: 2996499 - RNA, 23 nt, Mycobacterium avium subsp. paratuberculosis
cagccgaccagcggucgggugcg

SEQ ID NO: 2996500 - RNA, 17 nt, Mycobacterium avium subsp. paratuberculosis
cagccgaccgaucagcg

SEQ ID NO: 2996501 - RNA, 20 nt, Mycobacterium avium subsp. paratuberculosis
cagccgagaucgacccgcuc

SEQ ID NO: 2996502 - RNA, 20 nt, Mycobacterium avium subsp. paratuberculosis
cagccgagauggcaacacgu

SEQ ID NO: 2996503 - RNA, 13 nt, Mycobacterium avium subsp. paratuberculosis
cagccgagccggg

SEQ ID NO: 2996504 - RNA, 17 nt, Mycobacterium avium subsp. paratuberculosis
cagccgagccgggccag

SEQ ID NO: 2996505 - RNA, 15 nt, Mycobacterium avium subsp. paratuberculosis
cagccgagccggguc

SEQ ID NO: 2996506 - RNA, 18 nt, Mycobacterium avium subsp. paratuberculosis
cagccgaugcgcccgcgc

SEQ ID NO: 2996507 - RNA, 20 nt, Mycobacterium avium subsp. paratuberculosis
cagccgaugcgcccgcgcca

SEQ ID NO: 2996508 - RNA, 13 nt, Mycobacterium avium subsp. paratuberculosis
cagccgcaacacg

SEQ ID NO: 2996509 - RNA, 14 nt, Mycobacterium avium subsp. paratuberculosis
cagccgcaacacgg

SEQ ID NO: 2996510 - RNA, 17 nt, Mycobacterium avium subsp. paratuberculosis
cagccgcaacacggccu

SEQ ID NO: 2996511 - RNA, 20 nt, Mycobacterium avium subsp. paratuberculosis
cagccgcaacacggccucga

SEQ ID NO: 2996512 - RNA, 21 nt, Mycobacterium avium subsp. paratuberculosis
cagccgcaacacggccucgau

SEQ ID NO: 2996513 - RNA, 23 nt, Mycobacterium avium subsp. paratuberculosis
cagccgcaaggugauucgcgcgg

SEQ ID NO: 2996514 - RNA, 16 nt, Mycobacterium avium subsp. paratuberculosis
cagccgcacaccgcgg

SEQ ID NO: 2996515 - RNA, 17 nt, Mycobacterium avium subsp. paratuberculosis
cagccgcacaccgcggc

SEQ ID NO: 2996516 - RNA, 13 nt, Mycobacterium avium subsp. paratuberculosis
cagccgcaccaga

SEQ ID NO: 2996517 - RNA, 20 nt, Mycobacterium avium subsp. paratuberculosis
cagccgcaccagaucgucgg

SEQ ID NO: 2996518 - RNA, 14 nt, Mycobacterium avium subsp. paratuberculosis
cagccgcaccaggu

SEQ ID NO: 2996519 - RNA, 14 nt, Mycobacterium avium subsp. paratuberculosis
cagccgcaccgcga

SEQ ID NO: 2996520 - RNA, 15 nt, Mycobacterium avium subsp. paratuberculosis
cagccgcaccgcgac

SEQ ID NO: 2996521 - RNA, 17 nt, Mycobacterium avium subsp. paratuberculosis
cagccgcaccggcgccg

SEQ ID NO: 2996522 - RNA, 20 nt, Mycobacterium avium subsp. paratuberculosis
cagccgcaccggcgccgcca

SEQ ID NO: 2996523 - RNA, 17 nt, Mycobacterium avium subsp. paratuberculosis
cagccgcaccucggggc

SEQ ID NO: 2996524 - RNA, 18 nt, Mycobacterium avium subsp. paratuberculosis
cagccgcacgaaccgcuc

SEQ ID NO: 2996525 - RNA, 18 nt, Mycobacterium avium subsp. paratuberculosis
cagccgcacggauucguc

SEQ ID NO: 2996526 - RNA, 22 nt, Mycobacterium avium subsp. paratuberculosis
cagccgcacuuggccucgggcg

SEQ ID NO: 2996527 - RNA, 14 nt, Mycobacterium avium subsp. paratuberculosis
cagccgcagcagcc

SEQ ID NO: 2996528 - RNA, 18 nt, Mycobacterium avium subsp. paratuberculosis
cagccgcagcagccgcgc

SEQ ID NO: 2996529 - RNA, 15 nt, Mycobacterium avium subsp. paratuberculosis
cagccgcagcaggca

SEQ ID NO: 2996530 - RNA, 23 nt, Mycobacterium avium subsp. paratuberculosis
cagccgcagcaggcacuccuggu

SEQ ID NO: 2996531 - RNA, 15 nt, Mycobacterium avium subsp. paratuberculosis
cagccgcagcgcgcg

SEQ ID NO: 2996532 - RNA, 16 nt, Mycobacterium avium subsp. paratuberculosis
cagccgcagcgcgcga

SEQ ID NO: 2996533 - RNA, 20 nt, Mycobacterium avium subsp. paratuberculosis
cagccgcagcgcgcgaccgc

SEQ ID NO: 2996534 - RNA, 21 nt, Mycobacterium avium subsp. paratuberculosis
cagccgcagcgcgcgaccgcg

SEQ ID NO: 2996535 - RNA, 14 nt, Mycobacterium avium subsp. paratuberculosis
cagccgcagcggcg

SEQ ID NO: 2996536 - RNA, 15 nt, Mycobacterium avium subsp. paratuberculosis
cagccgcagcggcgg

SEQ ID NO: 2996537 - RNA, 17 nt, Mycobacterium avium subsp. paratuberculosis
cagccgcagcuguucgg

SEQ ID NO: 2996538 - RNA, 21 nt, Mycobacterium avium subsp. paratuberculosis
cagccgcagcuguucgggcag

SEQ ID NO: 2996539 - RNA, 19 nt, Mycobacterium avium subsp. paratuberculosis
cagccgcaggugcagcucc

SEQ ID NO: 2996540 - RNA, 20 nt, Mycobacterium avium subsp. paratuberculosis
cagccgcaggugcagcuccu

SEQ ID NO: 2996541 - RNA, 19 nt, Mycobacterium avium subsp. paratuberculosis
cagccgcaggugcucgccg

SEQ ID NO: 2996542 - RNA, 22 nt, Mycobacterium avium subsp. paratuberculosis
cagccgcaggugcucgccggcg

SEQ ID NO: 2996543 - RNA, 23 nt, Mycobacterium avium subsp. paratuberculosis
cagccgcaggugcucgccggcgc

SEQ ID NO: 2996544 - RNA, 14 nt, Mycobacterium avium subsp. paratuberculosis
cagccgcaucaccu

SEQ ID NO: 2996545 - RNA, 16 nt, Mycobacterium avium subsp. paratuberculosis
cagcaccgccacgucu

SEQ ID NO: 2996546 - RNA, 13 nt, Mycobacterium avium subsp. paratuberculosis
cagcaccgccagc

SEQ ID NO: 2996547 - RNA, 16 nt, Mycobacterium avium subsp. paratuberculosis
cagcaccgccagcauc

SEQ ID NO: 2996548 - RNA, 17 nt, Mycobacterium avium subsp. paratuberculosis
cagcaccgccagcaucc

SEQ ID NO: 2996549 - RNA, 14 nt, Mycobacterium avium subsp. paratuberculosis
cagcaccgccagcg

SEQ ID NO: 2996550 - RNA, 15 nt, Mycobacterium avium subsp. paratuberculosis
cagcaccgccagcgc

SEQ ID NO: 2996551 - RNA, 16 nt, Mycobacterium avium subsp. paratuberculosis
cagcaccgccagcgcc

SEQ ID NO: 2996552 - RNA, 19 nt, Mycobacterium avium subsp. paratuberculosis
cagcaccgccagcgccggc

SEQ ID NO: 2996553 - RNA, 23 nt, Mycobacterium avium subsp. paratuberculosis
cagcaccgccagcgccggcagca

SEQ ID NO: 2996554 - RNA, 13 nt, Mycobacterium avium subsp. paratuberculosis
cagcaccgccauc

SEQ ID NO: 2996555 - RNA, 19 nt, Mycobacterium avium subsp. paratuberculosis
cagcaccgccaucgcggcg

SEQ ID NO: 2996556 - RNA, 15 nt, Mycobacterium avium subsp. paratuberculosis
cagcaccgccccggu

SEQ ID NO: 2996557 - RNA, 19 nt, Mycobacterium avium subsp. paratuberculosis
cagcaccgccccggucacc

SEQ ID NO: 2996558 - RNA, 12 nt, Mycobacterium avium subsp. paratuberculosis
cagcaccgccga

SEQ ID NO: 2996559 - RNA, 13 nt, Mycobacterium avium subsp. paratuberculosis
cagcaccgccgac

SEQ ID NO: 2996560 - RNA, 19 nt, Mycobacterium avium subsp. paratuberculosis
cagcaccgccgagccgucg

SEQ ID NO: 2996561 - RNA, 12 nt, Mycobacterium avium subsp. paratuberculosis
cagcaccgccgc

SEQ ID NO: 2996562 - RNA, 15 nt, Mycobacterium avium subsp. paratuberculosis
cagcaccgccgcggc

SEQ ID NO: 2996563 - RNA, 20 nt, Mycobacterium avium subsp. paratuberculosis
cagcaccgccgcggccgcga

SEQ ID NO: 2996564 - RNA, 22 nt, Mycobacterium avium subsp. paratuberculosis
cagcaccgccgcggccgcgaug

SEQ ID NO: 2996565 - RNA, 16 nt, Mycobacterium avium subsp. paratuberculosis
cagcaccgccgcgggc

SEQ ID NO: 2996566 - RNA, 15 nt, Mycobacterium avium subsp. paratuberculosis
cagcaccgccggcgc

SEQ ID NO: 2996567 - RNA, 16 nt, Mycobacterium avium subsp. paratuberculosis
cagcaccgccucggcc

SEQ ID NO: 2996568 - RNA, 17 nt, Mycobacterium avium subsp. paratuberculosis
cagcaccgccucggcca

SEQ ID NO: 2996569 - RNA, 19 nt, Mycobacterium avium subsp. paratuberculosis
cagcaccgccucggccacc

SEQ ID NO: 2996570 - RNA, 10 nt, Mycobacterium avium subsp. paratuberculosis
cagcaccgcg

SEQ ID NO: 2996571 - RNA, 13 nt, Mycobacterium avium subsp. paratuberculosis
cagcaccgcgaac

SEQ ID NO: 2996572 - RNA, 12 nt, Mycobacterium avium subsp. paratuberculosis
cagcaccgcgac

SEQ ID NO: 2996573 - RNA, 13 nt, Mycobacterium avium subsp. paratuberculosis
cagcaccgcgacc

SEQ ID NO: 2996574 - RNA, 17 nt, Mycobacterium avium subsp. paratuberculosis
cagcaccgcgacccagg

SEQ ID NO: 2996575 - RNA, 18 nt, Mycobacterium avium subsp. paratuberculosis
cagcaccgcgacccaggc

SEQ ID NO: 2996576 - RNA, 15 nt, Mycobacterium avium subsp. paratuberculosis
cagcaccgcgaccgg

SEQ ID NO: 2996577 - RNA, 19 nt, Mycobacterium avium subsp. paratuberculosis
cagcaccgcgaccgguccg

SEQ ID NO: 2996578 - RNA, 20 nt, Mycobacterium avium subsp. paratuberculosis
cagcaccgcgacgaucgcga

SEQ ID NO: 2996579 - RNA, 14 nt, Mycobacterium avium subsp. paratuberculosis
cagcaccgcgcggc

SEQ ID NO: 2996580 - RNA, 14 nt, Mycobacterium avium subsp. paratuberculosis
cagcaccgcggccg

SEQ ID NO: 2996581 - RNA, 22 nt, Mycobacterium avium subsp. paratuberculosis
cagcaccgcggcgaucgccgug

SEQ ID NO: 2996582 - RNA, 14 nt, Mycobacterium avium subsp. paratuberculosis
cagcaccgcggcgu

SEQ ID NO: 2996583 - RNA, 20 nt, Mycobacterium avium subsp. paratuberculosis
cagcaccgcggcguagcgcc

SEQ ID NO: 2996584 - RNA, 22 nt, Mycobacterium avium subsp. paratuberculosis
cagcaccgcggcguagcgccag

SEQ ID NO: 2996585 - RNA, 13 nt, Mycobacterium avium subsp. paratuberculosis
cagcaccgcgguc

SEQ ID NO: 2996586 - RNA, 14 nt, Mycobacterium avium subsp. paratuberculosis
cagcaccgcgucga

SEQ ID NO: 2996587 - RNA, 16 nt, Mycobacterium avium subsp. paratuberculosis
cagcaccgcgucgaug

SEQ ID NO: 2996588 - RNA, 19 nt, Mycobacterium avium subsp. paratuberculosis
cagcaccgcgucggcgcug

SEQ ID NO: 2996589 - RNA, 15 nt, Mycobacterium avium subsp. paratuberculosis
cagcaccggcaccgc

SEQ ID NO: 2996590 - RNA, 16 nt, Mycobacterium avium subsp. paratuberculosis
cagcaccggcaccgcg

SEQ ID NO: 2996591 - RNA, 13 nt, Mycobacterium avium subsp. paratuberculosis
cagcaccggccgg

SEQ ID NO: 2996592 - RNA, 13 nt, Mycobacterium avium subsp. paratuberculosis
cagcaccggcgcc

SEQ ID NO: 2996593 - RNA, 16 nt, Mycobacterium avium subsp. paratuberculosis
cagcaccggcgccucg

SEQ ID NO: 2996594 - RNA, 17 nt, Mycobacterium avium subsp. paratuberculosis
cagcaccggcgccucgu

SEQ ID NO: 2996595 - RNA, 20 nt, Mycobacterium avium subsp. paratuberculosis
cagcaccggcgccucgugca

SEQ ID NO: 2996596 - RNA, 14 nt, Mycobacterium avium subsp. paratuberculosis
cagcaccggcgcgc

SEQ ID NO: 2996597 - RNA, 15 nt, Mycobacterium avium subsp. paratuberculosis
cagcaccggcgcgcc

SEQ ID NO: 2996598 - RNA, 12 nt, Mycobacterium avium subsp. paratuberculosis
cagcaccggcgu

SEQ ID NO: 2996599 - RNA, 14 nt, Mycobacterium avium subsp. paratuberculosis
cagcaccggcgucg

SEQ ID NO: 2996600 - RNA, 15 nt, Mycobacterium avium subsp. paratuberculosis
cagcaccggcgucga

SEQ ID NO: 2996601 - RNA, 20 nt, Mycobacterium avium subsp. paratuberculosis
cagcaccggcgucgacagcc

SEQ ID NO: 2996602 - RNA, 23 nt, Mycobacterium avium subsp. paratuberculosis
cagcaccgggaaggugucggccg

SEQ ID NO: 2996603 - RNA, 13 nt, Mycobacterium avium subsp. paratuberculosis
cagcaccgggccc

SEQ ID NO: 2996604 - RNA, 15 nt, Mycobacterium avium subsp. paratuberculosis
cagcaccgggcccag

SEQ ID NO: 2996605 - RNA, 17 nt, Mycobacterium avium subsp. paratuberculosis
cagcaccgggcccagcu

SEQ ID NO: 2996606 - RNA, 19 nt, Mycobacterium avium subsp. paratuberculosis
cagcaccgggcccagcucg

SEQ ID NO: 2996607 - RNA, 12 nt, Mycobacterium avium subsp. paratuberculosis
cagcaccgggug

SEQ ID NO: 2996608 - RNA, 14 nt, Mycobacterium avium subsp. paratuberculosis
cagcaccgggugau

SEQ ID NO: 2996609 - RNA, 18 nt, Mycobacterium avium subsp. paratuberculosis
cagcaccgggugauaccg

SEQ ID NO: 2996610 - RNA, 16 nt, Mycobacterium avium subsp. paratuberculosis
cagcaccgucaccgcc

SEQ ID NO: 2996611 - RNA, 22 nt, Mycobacterium avium subsp. paratuberculosis
cagcaccgucaccuucaccccc

SEQ ID NO: 2996612 - RNA, 13 nt, Mycobacterium avium subsp. paratuberculosis
cagcaccgucagc

SEQ ID NO: 2996613 - RNA, 16 nt, Mycobacterium avium subsp. paratuberculosis
cagcaccguccacagc

SEQ ID NO: 2996614 - RNA, 17 nt, Mycobacterium avium subsp. paratuberculosis
cagcaccguccacagcc

SEQ ID NO: 2996615 - RNA, 23 nt, Mycobacterium avium subsp. paratuberculosis
cagcaccguccacagccggcggc

SEQ ID NO: 2996616 - RNA, 17 nt, Mycobacterium avium subsp. paratuberculosis
cagcaccgucugcgccg

SEQ ID NO: 2996617 - RNA, 19 nt, Mycobacterium avium subsp. paratuberculosis
cagcaccgugggcccgugc

SEQ ID NO: 2996618 - RNA, 23 nt, Mycobacterium avium subsp. paratuberculosis
cagcaccgugggcccgugcgggu

SEQ ID NO: 2996619 - RNA, 14 nt, Mycobacterium avium subsp. paratuberculosis
cagcaccuccgaca

SEQ ID NO: 2996620 - RNA, 16 nt, Mycobacterium avium subsp. paratuberculosis
cagcaccuccgacagc

SEQ ID NO: 2996621 - RNA, 15 nt, Mycobacterium avium subsp. paratuberculosis
cagcaccuccggcag

SEQ ID NO: 2996622 - RNA, 16 nt, Mycobacterium avium subsp. paratuberculosis
cagcaccuccggcagc

SEQ ID NO: 2996623 - RNA, 13 nt, Mycobacterium avium subsp. paratuberculosis
cagcaccuccugg

SEQ ID NO: 2996624 - RNA, 17 nt, Mycobacterium avium subsp. paratuberculosis
cagcaccuccuggguga

SEQ ID NO: 2996625 - RNA, 18 nt, Mycobacterium avium subsp. paratuberculosis
cagcaccucgaacgccgg

SEQ ID NO: 2996626 - RNA, 19 nt, Mycobacterium avium subsp. paratuberculosis
cagcaccucgcccugcagc

SEQ ID NO: 2996627 - RNA, 23 nt, Mycobacterium avium subsp. paratuberculosis
cagcaccucgcccugcagcgcga

SEQ ID NO: 2996628 - RNA, 17 nt, Mycobacterium avium subsp. paratuberculosis
cagcaccucgcgcgcga

SEQ ID NO: 2996629 - RNA, 17 nt, Mycobacterium avium subsp. paratuberculosis
cagcaccucgcggcagc

SEQ ID NO: 2996630 - RNA, 16 nt, Mycobacterium avium subsp. paratuberculosis
cagcaccucggcgacc

SEQ ID NO: 2996631 - RNA, 20 nt, Mycobacterium avium subsp. paratuberculosis
cagccgcugcagcgccgccc

SEQ ID NO: 2996632 - RNA, 16 nt, Mycobacterium avium subsp. paratuberculosis
cagccgcugccgcacc

SEQ ID NO: 2996633 - RNA, 23 nt, Mycobacterium avium subsp. paratuberculosis
cagccgcugccguucgccgguac

SEQ ID NO: 2996634 - RNA, 23 nt, Mycobacterium avium subsp. paratuberculosis
cagccgcugcgacaggucggcgg

SEQ ID NO: 2996635 - RNA, 17 nt, Mycobacterium avium subsp. paratuberculosis
cagccgcugcugggugc

SEQ ID NO: 2996636 - RNA, 13 nt, Mycobacterium avium subsp. paratuberculosis
cagccgcuuggcc

SEQ ID NO: 2996637 - RNA, 14 nt, Mycobacterium avium subsp. paratuberculosis
cagccgcuuggccg

SEQ ID NO: 2996638 - RNA, 18 nt, Mycobacterium avium subsp. paratuberculosis
cagccgcuuggcgcgccg

SEQ ID NO: 2996639 - RNA, 13 nt, Mycobacterium avium subsp. paratuberculosis
cagccggaacaca

SEQ ID NO: 2996640 - RNA, 19 nt, Mycobacterium avium subsp. paratuberculosis
cagccggaaggccaaggcc

SEQ ID NO: 2996641 - RNA, 13 nt, Mycobacterium avium subsp. paratuberculosis
cagccggacagcg

SEQ ID NO: 2996642 - RNA, 16 nt, Mycobacterium avium subsp. paratuberculosis
cagccggacagcgggu

SEQ ID NO: 2996643 - RNA, 19 nt, Mycobacterium avium subsp. paratuberculosis
cagccggacccauucgucg

SEQ ID NO: 2996644 - RNA, 20 nt, Mycobacterium avium subsp. paratuberculosis
cagccggacccauucgucgg

SEQ ID NO: 2996645 - RNA, 21 nt, Mycobacterium avium subsp. paratuberculosis
cagccggacgggaucggcgcg

SEQ ID NO: 2996646 - RNA, 22 nt, Mycobacterium avium subsp. paratuberculosis
cagccggacgggaucggcgcgu

SEQ ID NO: 2996647 - RNA, 19 nt, Mycobacterium avium subsp. paratuberculosis
cagccggagccggccucgc

SEQ ID NO: 2996648 - RNA, 22 nt, Mycobacterium avium subsp. paratuberculosis
cagccggagccggccucgccgg

SEQ ID NO: 2996649 - RNA, 17 nt, Mycobacterium avium subsp. paratuberculosis
cagccggaucaccuggu

SEQ ID NO: 2996650 - RNA, 19 nt, Mycobacterium avium subsp. paratuberculosis
cagccggaucagcguuccg

SEQ ID NO: 2996651 - RNA, 23 nt, Mycobacterium avium subsp. paratuberculosis
cagccggaucagcguuccggcgg

SEQ ID NO: 2996652 - RNA, 17 nt, Mycobacterium avium subsp. paratuberculosis
cagccggaucucgucgg

SEQ ID NO: 2996653 - RNA, 16 nt, Mycobacterium avium subsp. paratuberculosis
cagccggcagcauucg

SEQ ID NO: 2996654 - RNA, 14 nt, Mycobacterium avium subsp. paratuberculosis
cagccggccaacag

SEQ ID NO: 2996655 - RNA, 13 nt, Mycobacterium avium subsp. paratuberculosis
cagccggccaccg

SEQ ID NO: 2996656 - RNA, 14 nt, Mycobacterium avium subsp. paratuberculosis
cagccggccaccgc

SEQ ID NO: 2996657 - RNA, 16 nt, Mycobacterium avium subsp. paratuberculosis
cagccggccaccgccc

SEQ ID NO: 2996658 - RNA, 17 nt, Mycobacterium avium subsp. paratuberculosis
cagccggccaccgcccc

SEQ ID NO: 2996659 - RNA, 21 nt, Mycobacterium avium subsp. paratuberculosis
cagccggccaccgccccagcc

SEQ ID NO: 2996660 - RNA, 22 nt, Mycobacterium avium subsp. paratuberculosis
cagccggccaccgccccagccg

SEQ ID NO: 2996661 - RNA, 23 nt, Mycobacterium avium subsp. paratuberculosis
cagccggccaccgccccagccga

SEQ ID NO: 2996662 - RNA, 21 nt, Mycobacterium avium subsp. paratuberculosis
cagccggcccgagcccugcgc

SEQ ID NO: 2996663 - RNA, 13 nt, Mycobacterium avium subsp. paratuberculosis
cagccggcccgca

SEQ ID NO: 2996664 - RNA, 17 nt, Mycobacterium avium subsp. paratuberculosis
cagccggcccgcaucgc

SEQ ID NO: 2996665 - RNA, 22 nt, Mycobacterium avium subsp. paratuberculosis
cagccggcccgcaucgcggcga

SEQ ID NO: 2996666 - RNA, 14 nt, Mycobacterium avium subsp. paratuberculosis
cagccggcccucca

SEQ ID NO: 2996667 - RNA, 19 nt, Mycobacterium avium subsp. paratuberculosis
cagccggcccuccaggaag

SEQ ID NO: 2996668 - RNA, 14 nt, Mycobacterium avium subsp. paratuberculosis
cagccggccgaccg

SEQ ID NO: 2996669 - RNA, 17 nt, Mycobacterium avium subsp. paratuberculosis
cagccggccgaccgccu

SEQ ID NO: 2996670 - RNA, 17 nt, Mycobacterium avium subsp. paratuberculosis
cagccggccgacgcggc

SEQ ID NO: 2996671 - RNA, 13 nt, Mycobacterium avium subsp. paratuberculosis
cagccggccgagc

SEQ ID NO: 2996672 - RNA, 21 nt, Mycobacterium avium subsp. paratuberculosis
cagccggccgagcgaaggucc

SEQ ID NO: 2996673 - RNA, 14 nt, Mycobacterium avium subsp. paratuberculosis
cagccggccgcuga

SEQ ID NO: 2996674 - RNA, 19 nt, Mycobacterium avium subsp. paratuberculosis
cagccggccgcugaggaug

SEQ ID NO: 2996675 - RNA, 15 nt, Mycobacterium avium subsp. paratuberculosis
cagccggccggccga

SEQ ID NO: 2996676 - RNA, 13 nt, Mycobacterium avium subsp. paratuberculosis
cagccggccggcg

SEQ ID NO: 2996677 - RNA, 15 nt, Mycobacterium avium subsp. paratuberculosis
cagccggccggcgaa

SEQ ID NO: 2996678 - RNA, 18 nt, Mycobacterium avium subsp. paratuberculosis
cagccggccggcggacgc

SEQ ID NO: 2996679 - RNA, 14 nt, Mycobacterium avium subsp. paratuberculosis
cagccggccgucca

SEQ ID NO: 2996680 - RNA, 17 nt, Mycobacterium avium subsp. paratuberculosis
cagccggccguccacgg

SEQ ID NO: 2996681 - RNA, 15 nt, Mycobacterium avium subsp. paratuberculosis
cagccggccugcuuu

SEQ ID NO: 2996682 - RNA, 22 nt, Mycobacterium avium subsp. paratuberculosis
cagccggccugcuuuucggccg

SEQ ID NO: 2996683 - RNA, 15 nt, Mycobacterium avium subsp. paratuberculosis
cagccggcgagcgcg

SEQ ID NO: 2996684 - RNA, 14 nt, Mycobacterium avium subsp. paratuberculosis
cagccggcgcacca

SEQ ID NO: 2996685 - RNA, 17 nt, Mycobacterium avium subsp. paratuberculosis
cagccggcgcaccaggg

SEQ ID NO: 2996686 - RNA, 19 nt, Mycobacterium avium subsp. paratuberculosis
cagccggcgcaccagggug

SEQ ID NO: 2996687 - RNA, 16 nt, Mycobacterium avium subsp. paratuberculosis
cagccggcgcccgcag

SEQ ID NO: 2996688 - RNA, 20 nt, Mycobacterium avium subsp. paratuberculosis
cagccggcgcccgcaggccg

SEQ ID NO: 2996689 - RNA, 15 nt, Mycobacterium avium subsp. paratuberculosis
cagccggcgcgcggu

SEQ ID NO: 2996690 - RNA, 14 nt, Mycobacterium avium subsp. paratuberculosis
cagccggcgcggca

SEQ ID NO: 2996691 - RNA, 15 nt, Mycobacterium avium subsp. paratuberculosis
cagccggcgcggcag

SEQ ID NO: 2996692 - RNA, 20 nt, Mycobacterium avium subsp. paratuberculosis
cagccggcgcggcagggcca

SEQ ID NO: 2996693 - RNA, 23 nt, Mycobacterium avium subsp. paratuberculosis
cagccggcgcggcagggccaggc

SEQ ID NO: 2996694 - RNA, 15 nt, Mycobacterium avium subsp. paratuberculosis
cagccggcgcgguga

SEQ ID NO: 2996695 - RNA, 22 nt, Mycobacterium avium subsp. paratuberculosis
cagccggcggauauagccgacg

SEQ ID NO: 2996696 - RNA, 21 nt, Mycobacterium avium subsp. paratuberculosis
cagccggcggaucgcgugcgu

SEQ ID NO: 2996697 - RNA, 11 nt, Mycobacterium avium subsp. paratuberculosis
cagccggcggc

SEQ ID NO: 2996698 - RNA, 13 nt, Mycobacterium avium subsp. paratuberculosis
cagccggcggcgc

SEQ ID NO: 2996699 - RNA, 14 nt, Mycobacterium avium subsp. paratuberculosis
cagccggcggcgcc

SEQ ID NO: 2996700 - RNA, 15 nt, Mycobacterium avium subsp. paratuberculosis
cagccggcggcggcg

SEQ ID NO: 2996701 - RNA, 15 nt, Mycobacterium avium subsp. paratuberculosis
cagccggcgggcgcu

SEQ ID NO: 2996702 - RNA, 14 nt, Mycobacterium avium subsp. paratuberculosis
cagccggcggugca

SEQ ID NO: 2996703 - RNA, 17 nt, Mycobacterium avium subsp. paratuberculosis
cagccggcggugcaggg

SEQ ID NO: 2996704 - RNA, 20 nt, Mycobacterium avium subsp. paratuberculosis
cagccggcgguucggcgggc

SEQ ID NO: 2996705 - RNA, 14 nt, Mycobacterium avium subsp. paratuberculosis
cagccggcucaggg

SEQ ID NO: 2996706 - RNA, 17 nt, Mycobacterium avium subsp. paratuberculosis
cagccggcucagggugc

SEQ ID NO: 2996707 - RNA, 18 nt, Mycobacterium avium subsp. paratuberculosis
cagccggcucagggugcg

SEQ ID NO: 2996708 - RNA, 17 nt, Mycobacterium avium subsp. paratuberculosis
cagccggcucuuggcga

SEQ ID NO: 2996709 - RNA, 20 nt, Mycobacterium avium subsp. paratuberculosis
cagccggcucuuggcgaccu

SEQ ID NO: 2996710 - RNA, 17 nt, Mycobacterium avium subsp. paratuberculosis
cagccggcugagcagcc

SEQ ID NO: 2996711 - RNA, 22 nt, Mycobacterium avium subsp. paratuberculosis
cagccggcugagcagccagucg

SEQ ID NO: 2996712 - RNA, 15 nt, Mycobacterium avium subsp. paratuberculosis
cagccgggccagcaa

SEQ ID NO: 2996713 - RNA, 17 nt, Mycobacterium avium subsp. paratuberculosis
cagccgggccagcaaca

SEQ ID NO: 2996714 - RNA, 21 nt, Mycobacterium avium subsp. paratuberculosis
cagccgggccagcaacagcag

SEQ ID NO: 2996715 - RNA, 23 nt, Mycobacterium avium subsp. paratuberculosis
cagccgggccagcaacagcagcg

SEQ ID NO: 2996716 - RNA, 15 nt, Mycobacterium avium subsp. paratuberculosis
cagccgggccagcag

SEQ ID NO: 2996717 - RNA, 17 nt, Mycobacterium avium subsp. paratuberculosis
cagccgggccagcagcu

SEQ ID NO: 2996718 - RNA, 16 nt, Mycobacterium avium subsp. paratuberculosis
cagccgggccagcccg

SEQ ID NO: 2996719 - RNA, 14 nt, Mycobacterium avium subsp. paratuberculosis
cagccgggccgagc

SEQ ID NO: 2996720 - RNA, 15 nt, Mycobacterium avium subsp. paratuberculosis
cagccgggccgagcg

SEQ ID NO: 2996721 - RNA, 17 nt, Mycobacterium avium subsp. paratuberculosis
cagccgggccgagcgcg

SEQ ID NO: 2996722 - RNA, 22 nt, Mycobacterium avium subsp. paratuberculosis
cagccgggccgagcgcgccgcc

SEQ ID NO: 2996723 - RNA, 23 nt, Mycobacterium avium subsp. paratuberculosis
cagccgggccgagcgcgccgccg

SEQ ID NO: 2996724 - RNA, 13 nt, Mycobacterium avium subsp. paratuberculosis
cagccgggccgcc

SEQ ID NO: 2996725 - RNA, 16 nt, Mycobacterium avium subsp. paratuberculosis
cagccgggccgcccgc

SEQ ID NO: 2996726 - RNA, 20 nt, Mycobacterium avium subsp. paratuberculosis
cagccgggccgcccgcgcgu

SEQ ID NO: 2996727 - RNA, 14 nt, Mycobacterium avium subsp. paratuberculosis
cagccgggccugca

SEQ ID NO: 2996728 - RNA, 17 nt, Mycobacterium avium subsp. paratuberculosis
cagccgggccugcagca

SEQ ID NO: 2996729 - RNA, 16 nt, Mycobacterium avium subsp. paratuberculosis
cagccgggccugcggc

SEQ ID NO: 2996730 - RNA, 19 nt, Mycobacterium avium subsp. paratuberculosis
cagccgggccugcggcgcg

SEQ ID NO: 2996731 - RNA, 22 nt, Mycobacterium avium subsp. paratuberculosis
cagccgggccugcggcgcggcc

SEQ ID NO: 2996732 - RNA, 13 nt, Mycobacterium avium subsp. paratuberculosis
cagccgggcgacc

SEQ ID NO: 2996733 - RNA, 14 nt, Mycobacterium avium subsp. paratuberculosis
cagccgggcgauca

SEQ ID NO: 2996734 - RNA, 14 nt, Mycobacterium avium subsp. paratuberculosis
cagccgggcggccg

SEQ ID NO: 2996735 - RNA, 15 nt, Mycobacterium avium subsp. paratuberculosis
cagccgggcggccgg

SEQ ID NO: 2996736 - RNA, 18 nt, Mycobacterium avium subsp. paratuberculosis
cagccgggcggccgggcc

SEQ ID NO: 2996737 - RNA, 14 nt, Mycobacterium avium subsp. paratuberculosis
cagccgggcggcgc

SEQ ID NO: 2996738 - RNA, 16 nt, Mycobacterium avium subsp. paratuberculosis
cagccgggcggcgccg

SEQ ID NO: 2996739 - RNA, 19 nt, Mycobacterium avium subsp. paratuberculosis
cagccgggcggcgccgaac

SEQ ID NO: 2996740 - RNA, 15 nt, Mycobacterium avium subsp. paratuberculosis
cagccgggcggcggc

SEQ ID NO: 2996741 - RNA, 16 nt, Mycobacterium avium subsp. paratuberculosis
cagccgggcggcggcc

SEQ ID NO: 2996742 - RNA, 20 nt, Mycobacterium avium subsp. paratuberculosis
cagccgggcggcggccuccg

SEQ ID NO: 2996743 - RNA, 12 nt, Mycobacterium avium subsp. paratuberculosis
cagccgggcggu

SEQ ID NO: 2996744 - RNA, 17 nt, Mycobacterium avium subsp. paratuberculosis
cagccgggcggugaugg

SEQ ID NO: 2996745 - RNA, 15 nt, Mycobacterium avium subsp. paratuberculosis
cagccggggaucgcg

SEQ ID NO: 2996746 - RNA, 22 nt, Mycobacterium avium subsp. paratuberculosis
cagccggggcagcugcugggac

SEQ ID NO: 2996747 - RNA, 22 nt, Mycobacterium avium subsp. paratuberculosis
cagccgggggaucaccucaucg

SEQ ID NO: 2996748 - RNA, 17 nt, Mycobacterium avium subsp. paratuberculosis
cagccgggggcggugca

SEQ ID NO: 2996749 - RNA, 18 nt, Mycobacterium avium subsp. paratuberculosis
cagccgggggcggugcag

SEQ ID NO: 2996750 - RNA, 20 nt, Mycobacterium avium subsp. paratuberculosis
cagccgggggcggugcagcc

SEQ ID NO: 2996751 - RNA, 21 nt, Mycobacterium avium subsp. paratuberculosis
cagccgggggcggugcagccg

SEQ ID NO: 2996752 - RNA, 23 nt, Mycobacterium avium subsp. paratuberculosis
cagccgggggcggugcagccggg

SEQ ID NO: 2996753 - RNA, 21 nt, Mycobacterium avium subsp. paratuberculosis
cagccgggguagggcggcggg

SEQ ID NO: 2996754 - RNA, 18 nt, Mycobacterium avium subsp. paratuberculosis
cagccggggugcccgggc

SEQ ID NO: 2996755 - RNA, 21 nt, Mycobacterium avium subsp. paratuberculosis
cagccggggugcccgggccgc

SEQ ID NO: 2996756 - RNA, 16 nt, Mycobacterium avium subsp. paratuberculosis
cagccggguagcgccg

SEQ ID NO: 2996757 - RNA, 19 nt, Mycobacterium avium subsp. paratuberculosis
cagccggguagcgccgccg

SEQ ID NO: 2996758 - RNA, 20 nt, Mycobacterium avium subsp. paratuberculosis
cagccggguagcgccgccgg

SEQ ID NO: 2996759 - RNA, 21 nt, Mycobacterium avium subsp. paratuberculosis
cagccggguagcgccgccggg

SEQ ID NO: 2996760 - RNA, 21 nt, Mycobacterium avium subsp. paratuberculosis
cagccgggucaguucgcggcg

SEQ ID NO: 2996761 - RNA, 20 nt, Mycobacterium avium subsp. paratuberculosis
cagccggguccgcacccggg

SEQ ID NO: 2996762 - RNA, 21 nt, Mycobacterium avium subsp. paratuberculosis
cagccggguccgcacccgggc

SEQ ID NO: 2996763 - RNA, 16 nt, Mycobacterium avium subsp. paratuberculosis
cagccgggugcccauc

SEQ ID NO: 2996764 - RNA, 17 nt, Mycobacterium avium subsp. paratuberculosis
cagccgggugcgggcca

SEQ ID NO: 2996765 - RNA, 16 nt, Mycobacterium avium subsp. paratuberculosis
cagccgggugcggugc

SEQ ID NO: 2996766 - RNA, 19 nt, Mycobacterium avium subsp. paratuberculosis
cagccgggugcggugcagc

SEQ ID NO: 2996767 - RNA, 16 nt, Mycobacterium avium subsp. paratuberculosis
cagccggguggcccgc

SEQ ID NO: 2996768 - RNA, 17 nt, Mycobacterium avium subsp. paratuberculosis
cagccggguggcccgcc

SEQ ID NO: 2996769 - RNA, 18 nt, Mycobacterium avium subsp. paratuberculosis
cagccggguggcccgccc

SEQ ID NO: 2996770 - RNA, 19 nt, Mycobacterium avium subsp. paratuberculosis
cagccggguggcccgcccg

SEQ ID NO: 2996771 - RNA, 20 nt, Mycobacterium avium subsp. paratuberculosis
cagccggguggcccgcccgg

SEQ ID NO: 2996772 - RNA, 18 nt, Mycobacterium avium subsp. paratuberculosis
cagccggguggcccgcgc

SEQ ID NO: 2996773 - RNA, 22 nt, Mycobacterium avium subsp. paratuberculosis
cagccgguacggaucgccggac

SEQ ID NO: 2996774 - RNA, 19 nt, Mycobacterium avium subsp. paratuberculosis
cagccgguaggccugcguc

SEQ ID NO: 2996775 - RNA, 18 nt, Mycobacterium avium subsp. paratuberculosis
cagccgguaugcgaucgc

SEQ ID NO: 2996776 - RNA, 19 nt, Mycobacterium avium subsp. paratuberculosis
cagccgguaugcgaucgcg

SEQ ID NO: 2996777 - RNA, 22 nt, Mycobacterium avium subsp. paratuberculosis
cagccggucauaggccgcgcag

SEQ ID NO: 2996778 - RNA, 17 nt, Mycobacterium avium subsp. paratuberculosis
cagccgguccaugugcc

SEQ ID NO: 2996779 - RNA, 22 nt, Mycobacterium avium subsp. paratuberculosis
cagccgguccaugugccgcauc

SEQ ID NO: 2996780 - RNA, 19 nt, Mycobacterium avium subsp. paratuberculosis
cagccgguccgaccgccac

SEQ ID NO: 2996781 - RNA, 21 nt, Mycobacterium avium subsp. paratuberculosis
cagccgguccgaccgccacca

SEQ ID NO: 2996782 - RNA, 20 nt, Mycobacterium avium subsp. paratuberculosis
cagccgguccggcggcacca

SEQ ID NO: 2996783 - RNA, 20 nt, Mycobacterium avium subsp. paratuberculosis
cagccgguccugggccuccg

SEQ ID NO: 2996784 - RNA, 16 nt, Mycobacterium avium subsp. paratuberculosis
cagccgguccuuggcc

SEQ ID NO: 2996785 - RNA, 14 nt, Mycobacterium avium subsp. paratuberculosis
cagccggucgacga

SEQ ID NO: 2996786 - RNA, 16 nt, Mycobacterium avium subsp. paratuberculosis
cagccggucgcgcauc

SEQ ID NO: 2996787 - RNA, 16 nt, Mycobacterium avium subsp. paratuberculosis
cagccggucggaggcc

SEQ ID NO: 2996788 - RNA, 19 nt, Mycobacterium avium subsp. paratuberculosis
cagccggucgucggggcau

SEQ ID NO: 2996789 - RNA, 22 nt, Mycobacterium avium subsp. paratuberculosis
cagccggucuuggacagcagca

SEQ ID NO: 2996790 - RNA, 20 nt, Mycobacterium avium subsp. paratuberculosis
cagccggugcaccacgauga

SEQ ID NO: 2996791 - RNA, 15 nt, Mycobacterium avium subsp. paratuberculosis
cagccggugcgagcc

SEQ ID NO: 2996792 - RNA, 16 nt, Mycobacterium avium subsp. paratuberculosis
cagccggugcgagccg

SEQ ID NO: 2996793 - RNA, 17 nt, Mycobacterium avium subsp. paratuberculosis
cagccggugcgagccgc

SEQ ID NO: 2996794 - RNA, 18 nt, Mycobacterium avium subsp. paratuberculosis
cagccggugcgagccgcu

SEQ ID NO: 2996795 - RNA, 19 nt, Mycobacterium avium subsp. paratuberculosis
cagccggugcgagccgcug

SEQ ID NO: 2996796 - RNA, 16 nt, Mycobacterium avium subsp. paratuberculosis
cagccggugcggucgg

SEQ ID NO: 2996797 - RNA, 20 nt, Mycobacterium avium subsp. paratuberculosis
cagccggugcggucggcguc

SEQ ID NO: 2996798 - RNA, 15 nt, Mycobacterium avium subsp. paratuberculosis
cagccggugcugacc

SEQ ID NO: 2996799 - RNA, 22 nt, Mycobacterium avium subsp. paratuberculosis
cagccggugcugacccggucgc

SEQ ID NO: 2996800 - RNA, 23 nt, Mycobacterium avium subsp. paratuberculosis
cagccggugcugacccggucgcg

SEQ ID NO: 2996801 - RNA, 21 nt, Mycobacterium avium subsp. paratuberculosis
cagccgguggaauucuggccg

SEQ ID NO: 2996802 - RNA, 18 nt, Mycobacterium avium subsp. paratuberculosis
cagccgguggcggccacg

SEQ ID NO: 2996803 - RNA, 23 nt, Mycobacterium avium subsp. paratuberculosis
cagccgguggcggccacgaucgc

SEQ ID NO: 2996804 - RNA, 20 nt, Mycobacterium avium subsp. paratuberculosis
cagccgguugcgguggccga

SEQ ID NO: 2996805 - RNA, 23 nt, Mycobacterium avium subsp. paratuberculosis
cagccgguugcgguggccgauca

SEQ ID NO: 2996806 - RNA, 21 nt, Mycobacterium avium subsp. paratuberculosis
cagccguaccgauccgcgggc

SEQ ID NO: 2996807 - RNA, 13 nt, Mycobacterium avium subsp. paratuberculosis
cagccguccagcc

SEQ ID NO: 2996808 - RNA, 13 nt, Mycobacterium avium subsp. paratuberculosis
cagccgucccagg

SEQ ID NO: 2996809 - RNA, 13 nt, Mycobacterium avium subsp. paratuberculosis
cagccgucccgcc

SEQ ID NO: 2996810 - RNA, 17 nt, Mycobacterium avium subsp. paratuberculosis
cagccgucccgccgucu

SEQ ID NO: 2996811 - RNA, 23 nt, Mycobacterium avium subsp. paratuberculosis
cagccgucccuguucgcgccggu

SEQ ID NO: 2996812 - RNA, 17 nt, Mycobacterium avium subsp. paratuberculosis
cagccgucgaugccggc

SEQ ID NO: 2996813 - RNA, 14 nt, Mycobacterium avium subsp. paratuberculosis
cagccgucgcaccg

SEQ ID NO: 2996814 - RNA, 20 nt, Mycobacterium avium subsp. paratuberculosis
cagccgucgcaucagcucgg

SEQ ID NO: 2996815 - RNA, 24 nt, Mycobacterium avium subsp. paratuberculosis
cagccgucgcaucagcucggcagc

SEQ ID NO: 2996816 - RNA, 15 nt, Mycobacterium avium subsp. paratuberculosis
cagccgucgccgcgc

SEQ ID NO: 2996817 - RNA, 16 nt, Mycobacterium avium subsp. paratuberculosis
cagccgucgccgcgcc

SEQ ID NO: 2996818 - RNA, 17 nt, Mycobacterium avium subsp. paratuberculosis
cagccgucgccgcgccc

SEQ ID NO: 2996819 - RNA, 18 nt, Mycobacterium avium subsp. paratuberculosis
cagccgucgccgcgcccg

SEQ ID NO: 2996820 - RNA, 20 nt, Mycobacterium avium subsp. paratuberculosis
cagccgucgucguccgcaac

SEQ ID NO: 2996821 - RNA, 23 nt, Mycobacterium avium subsp. paratuberculosis
cagccgucgucguccgcaaccgc

SEQ ID NO: 2996822 - RNA, 22 nt, Mycobacterium avium subsp. paratuberculosis
cagccgucguugcgggcggcgc

SEQ ID NO: 2996823 - RNA, 15 nt, Mycobacterium avium subsp. paratuberculosis
cagccgugcggcacg

SEQ ID NO: 2996824 - RNA, 16 nt, Mycobacterium avium subsp. paratuberculosis
cagccgugcggcacgc

SEQ ID NO: 2996825 - RNA, 20 nt, Mycobacterium avium subsp. paratuberculosis
cagccgugcggcacgccgca

SEQ ID NO: 2996826 - RNA, 16 nt, Mycobacterium avium subsp. paratuberculosis
cagccgugcggcuugc

SEQ ID NO: 2996827 - RNA, 13 nt, Mycobacterium avium subsp. paratuberculosis
cagccgugcuggg

SEQ ID NO: 2996828 - RNA, 16 nt, Mycobacterium avium subsp. paratuberculosis
cagccgugggugucgg

SEQ ID NO: 2996829 - RNA, 19 nt, Mycobacterium avium subsp. paratuberculosis
cagccgugggugucggcga

SEQ ID NO: 2996830 - RNA, 20 nt, Mycobacterium avium subsp. paratuberculosis
cagccgugggugucggcgaa

SEQ ID NO: 2996831 - RNA, 20 nt, Mycobacterium avium subsp. paratuberculosis
cagccguuccaucgggccca

SEQ ID NO: 2996832 - RNA, 23 nt, Mycobacterium avium subsp. paratuberculosis
cagccguuccaucgggcccagca

SEQ ID NO: 2996833 - RNA, 14 nt, Mycobacterium avium subsp. paratuberculosis
cagccguucccggc

SEQ ID NO: 2996834 - RNA, 16 nt, Mycobacterium avium subsp. paratuberculosis
cagccguucccggcag

SEQ ID NO: 2996835 - RNA, 16 nt, Mycobacterium avium subsp. paratuberculosis
cagccguucgcgcacg

SEQ ID NO: 2996836 - RNA, 15 nt, Mycobacterium avium subsp. paratuberculosis
cagccguucgcugcc

SEQ ID NO: 2996837 - RNA, 18 nt, Mycobacterium avium subsp. paratuberculosis
cagccguucgcugcccuc

SEQ ID NO: 2996838 - RNA, 20 nt, Mycobacterium avium subsp. paratuberculosis
cagccguucgcugcccucgg

SEQ ID NO: 2996839 - RNA, 18 nt, Mycobacterium avium subsp. paratuberculosis
cagccguucuagguucga

SEQ ID NO: 2996840 - RNA, 16 nt, Mycobacterium avium subsp. paratuberculosis
cagccguucucguccu

SEQ ID NO: 2996841 - RNA, 19 nt, Mycobacterium avium subsp. paratuberculosis
cagccguucucguccuggg

SEQ ID NO: 2996842 - RNA, 16 nt, Mycobacterium avium subsp. paratuberculosis
cagccguugggcagcu

SEQ ID NO: 2996843 - RNA, 19 nt, Mycobacterium avium subsp. paratuberculosis
cagccguugggcagcucgg

SEQ ID NO: 2996844 - RNA, 22 nt, Mycobacterium avium subsp. paratuberculosis
cagccuagccuuggccgcaggc

SEQ ID NO: 2996845 - RNA, 18 nt, Mycobacterium avium subsp. paratuberculosis
cagccucagauucuucuu

SEQ ID NO: 2996846 - RNA, 15 nt, Mycobacterium avium subsp. paratuberculosis
cagccugaccgcggg

SEQ ID NO: 2996847 - RNA, 19 nt, Mycobacterium avium subsp. paratuberculosis
cagccugaucuugcugguc

SEQ ID NO: 2996848 - RNA, 16 nt, Mycobacterium avium subsp. paratuberculosis
cagccugaugccgguc

SEQ ID NO: 2996849 - RNA, 16 nt, Mycobacterium avium subsp. paratuberculosis
cagccugccuccacgu

SEQ ID NO: 2996850 - RNA, 16 nt, Mycobacterium avium subsp. paratuberculosis
cagccuggcggcgacc

SEQ ID NO: 2996851 - RNA, 17 nt, Mycobacterium avium subsp. paratuberculosis
cagccuucuucgccggg

SEQ ID NO: 2996852 - RNA, 19 nt, Mycobacterium avium subsp. paratuberculosis
cagccuucuucgccggggc

SEQ ID NO: 2996853 - RNA, 12 nt, Mycobacterium avium subsp. paratuberculosis
cagccuucuugg

SEQ ID NO: 2996854 - RNA, 15 nt, Mycobacterium avium subsp. paratuberculosis
cagccuucuuggcgg

SEQ ID NO: 2996855 - RNA, 19 nt, Mycobacterium avium subsp. paratuberculosis
cagccuucuuggcgggcgc

SEQ ID NO: 2996856 - RNA, 21 nt, Mycobacterium avium subsp. paratuberculosis
cagccuucuuggcgggcgccu

SEQ ID NO: 2996857 - RNA, 20 nt, Mycobacterium avium subsp. paratuberculosis
cagccuugcagccgcugccg

SEQ ID NO: 2996858 - RNA, 16 nt, Mycobacterium avium subsp. paratuberculosis
cagccuuuccacaucu

SEQ ID NO: 2996859 - RNA, 22 nt, Mycobacterium avium subsp. paratuberculosis
cagcgaaacucguugccagccg

SEQ ID NO: 2996860 - RNA, 15 nt, Mycobacterium avium subsp. paratuberculosis
cagcgaacccgccag

SEQ ID NO: 2996861 - RNA, 20 nt, Mycobacterium avium subsp. paratuberculosis
cagcgaacccgccagggcga

SEQ ID NO: 2996862 - RNA, 14 nt, Mycobacterium avium subsp. paratuberculosis
cagcgaacgcggcu

SEQ ID NO: 2996863 - RNA, 17 nt, Mycobacterium avium subsp. paratuberculosis
cagcgaacgcggcugau

SEQ ID NO: 2996864 - RNA, 18 nt, Mycobacterium avium subsp. paratuberculosis
cagcgaacgucaggaucc

SEQ ID NO: 2996865 - RNA, 14 nt, Mycobacterium avium subsp. paratuberculosis
cagcgaacugccgg

SEQ ID NO: 2996866 - RNA, 22 nt, Mycobacterium avium subsp. paratuberculosis
cagcgaaggcaugggcgugccg

SEQ ID NO: 2996867 - RNA, 23 nt, Mycobacterium avium subsp. paratuberculosis
cagcgaaggcaugggcgugccgg

SEQ ID NO: 2996868 - RNA, 21 nt, Mycobacterium avium subsp. paratuberculosis
cagcgaauacaccguccagcu

SEQ ID NO: 2996869 - RNA, 15 nt, Mycobacterium avium subsp. paratuberculosis
cagcgaaucgaccgg

SEQ ID NO: 2996870 - RNA, 22 nt, Mycobacterium avium subsp. paratuberculosis
cagcgaaucgaccggguuggcg

SEQ ID NO: 2996871 - RNA, 20 nt, Mycobacterium avium subsp. paratuberculosis
cagcgaaucggggucgauca

SEQ ID NO: 2996872 - RNA, 16 nt, Mycobacterium avium subsp. paratuberculosis
cagcgacaacgggccg

SEQ ID NO: 2996873 - RNA, 19 nt, Mycobacterium avium subsp. paratuberculosis
cagcgacaacgggccgccu

SEQ ID NO: 2996874 - RNA, 23 nt, Mycobacterium avium subsp. paratuberculosis
cagcgacaacgggccgccucacg

SEQ ID NO: 2996875 - RNA, 17 nt, Mycobacterium avium subsp. paratuberculosis
cagcgacaaucucgggc

SEQ ID NO: 2996876 - RNA, 15 nt, Mycobacterium avium subsp. paratuberculosis
cagcgacagcagcgu

SEQ ID NO: 2996877 - RNA, 20 nt, Mycobacterium avium subsp. paratuberculosis
cagcgacagggugccgaaca

SEQ ID NO: 2996878 - RNA, 22 nt, Mycobacterium avium subsp. paratuberculosis
cagcgacagggugccgaacagc

SEQ ID NO: 2996879 - RNA, 18 nt, Mycobacterium avium subsp. paratuberculosis
cagcgacaugaccaccgc

SEQ ID NO: 2996880 - RNA, 13 nt, Mycobacterium avium subsp. paratuberculosis
cagcgaccagucg

SEQ ID NO: 2996881 - RNA, 15 nt, Mycobacterium avium subsp. paratuberculosis
cagcgaccagucggc

SEQ ID NO: 2996882 - RNA, 19 nt, Mycobacterium avium subsp. paratuberculosis
cagcgaccagucggcgucu

SEQ ID NO: 2996883 - RNA, 16 nt, Mycobacterium avium subsp. paratuberculosis
cagcgacccgaaccgg

SEQ ID NO: 2996884 - RNA, 18 nt, Mycobacterium avium subsp. paratuberculosis
cagcgaccgcggaugacg

SEQ ID NO: 2996885 - RNA, 19 nt, Mycobacterium avium subsp. paratuberculosis
cagcgaccugguccaccgc

SEQ ID NO: 2996886 - RNA, 20 nt, Mycobacterium avium subsp. paratuberculosis
cagcgacgagagcggaucgg

SEQ ID NO: 2996887 - RNA, 15 nt, Mycobacterium avium subsp. paratuberculosis
cagcgacgccagcgg

SEQ ID NO: 2996888 - RNA, 17 nt, Mycobacterium avium subsp. paratuberculosis
cagcgacgccagcggca

SEQ ID NO: 2996889 - RNA, 12 nt, Mycobacterium avium subsp. paratuberculosis
cagcgacgcggu

SEQ ID NO: 2996890 - RNA, 14 nt, Mycobacterium avium subsp. paratuberculosis
cagcgacggaucgg

SEQ ID NO: 2996891 - RNA, 17 nt, Mycobacterium avium subsp. paratuberculosis
cagcgacggaucggccg

SEQ ID NO: 2996892 - RNA, 20 nt, Mycobacterium avium subsp. paratuberculosis
cagcgacggaucggccgcgu

SEQ ID NO: 2996893 - RNA, 16 nt, Mycobacterium avium subsp. paratuberculosis
cagcgacggcaggucg

SEQ ID NO: 2996894 - RNA, 13 nt, Mycobacterium avium subsp. paratuberculosis
cagcgacggcccg

SEQ ID NO: 2996895 - RNA, 14 nt, Mycobacterium avium subsp. paratuberculosis
cagcgacggcccgc

SEQ ID NO: 2996896 - RNA, 16 nt, Mycobacterium avium subsp. paratuberculosis
cagcgacggcccgccg

SEQ ID NO: 2996897 - RNA, 18 nt, Mycobacterium avium subsp. paratuberculosis
cagcgacggcccgccgga

SEQ ID NO: 2996898 - RNA, 20 nt, Mycobacterium avium subsp. paratuberculosis
cagcgacggcccgccggagc

SEQ ID NO: 2996899 - RNA, 23 nt, Mycobacterium avium subsp. paratuberculosis
cagcgacggcccgccggagccga

SEQ ID NO: 2996900 - RNA, 13 nt, Mycobacterium avium subsp. paratuberculosis
cagcgacgggccg

SEQ ID NO: 2996901 - RNA, 16 nt, Mycobacterium avium subsp. paratuberculosis
cagcgacgggccgggc

SEQ ID NO: 2996902 - RNA, 18 nt, Mycobacterium avium subsp. paratuberculosis
cagcgacgggccgggcac

SEQ ID NO: 2996903 - RNA, 22 nt, Mycobacterium avium subsp. paratuberculosis
cagcgacgggccgggcacgucg

SEQ ID NO: 2996904 - RNA, 16 nt, Mycobacterium avium subsp. paratuberculosis
cagcgacgucaggucg

SEQ ID NO: 2996905 - RNA, 22 nt, Mycobacterium avium subsp. paratuberculosis
cagcgacgucaggucgaccggc

SEQ ID NO: 2996906 - RNA, 14 nt, Mycobacterium avium subsp. paratuberculosis
cagcgacuccagcg

SEQ ID NO: 2996907 - RNA, 16 nt, Mycobacterium avium subsp. paratuberculosis
cagcgacuccagcgcg

SEQ ID NO: 2996908 - RNA, 19 nt, Mycobacterium avium subsp. paratuberculosis
cagcgacuccagcgcgauc

SEQ ID NO: 2996909 - RNA, 20 nt, Mycobacterium avium subsp. paratuberculosis
cagcgacuccagcgcgauca

SEQ ID NO: 2996910 - RNA, 13 nt, Mycobacterium avium subsp. paratuberculosis
cagcgacuccuga

SEQ ID NO: 2996911 - RNA, 17 nt, Mycobacterium avium subsp. paratuberculosis
cagcgacuccugacgca

SEQ ID NO: 2996912 - RNA, 20 nt, Mycobacterium avium subsp. paratuberculosis
cagcgacuccugguccucga

SEQ ID NO: 2996913 - RNA, 14 nt, Mycobacterium avium subsp. paratuberculosis
cagcgacucgaccc

SEQ ID NO: 2996914 - RNA, 14 nt, Mycobacterium avium subsp. paratuberculosis
cagcgacucggcca

SEQ ID NO: 2996915 - RNA, 17 nt, Mycobacterium avium subsp. paratuberculosis
cagcgacugcacccggg

SEQ ID NO: 2996916 - RNA, 21 nt, Mycobacterium avium subsp. paratuberculosis
cagcgacugcacccgggucag

SEQ ID NO: 2996917 - RNA, 23 nt, Mycobacterium avium subsp. paratuberculosis
cagcgacugcacccgggucaggu

SEQ ID NO: 2996918 - RNA, 13 nt, Mycobacterium avium subsp. paratuberculosis
cagcgacuugacc

SEQ ID NO: 2996919 - RNA, 18 nt, Mycobacterium avium subsp. paratuberculosis
cagcgacuugaccagcag

SEQ ID NO: 2996920 - RNA, 20 nt, Mycobacterium avium subsp. paratuberculosis
cagcgacuugaccagcagcu

SEQ ID NO: 2996921 - RNA, 18 nt, Mycobacterium avium subsp. paratuberculosis
cagcgacuugccgccggc

SEQ ID NO: 2996922 - RNA, 21 nt, Mycobacterium avium subsp. paratuberculosis
cagcgacuugccgccggcgca

SEQ ID NO: 2996923 - RNA, 22 nt, Mycobacterium avium subsp. paratuberculosis
cagcgacuugccgccggcgcag

SEQ ID NO: 2996924 - RNA, 19 nt, Mycobacterium avium subsp. paratuberculosis
cagcgagaaccggcgcaga

SEQ ID NO: 2996925 - RNA, 19 nt, Mycobacterium avium subsp. paratuberculosis
cagcgagaagucgccgacg

SEQ ID NO: 2996926 - RNA, 21 nt, Mycobacterium avium subsp. paratuberculosis
cagcgagaagucgccgacgcc

SEQ ID NO: 2996927 - RNA, 17 nt, Mycobacterium avium subsp. paratuberculosis
cagcgagaccggcacgg

SEQ ID NO: 2996928 - RNA, 21 nt, Mycobacterium avium subsp. paratuberculosis
cagcgagaccggcacggugca

SEQ ID NO: 2996929 - RNA, 19 nt, Mycobacterium avium subsp. paratuberculosis
cagcgagaccucccggcgc

SEQ ID NO: 2996930 - RNA, 21 nt, Mycobacterium avium subsp. paratuberculosis
cagcgagaccucccggcgcca

SEQ ID NO: 2996931 - RNA, 18 nt, Mycobacterium avium subsp. paratuberculosis
cagcgagacgaccaggau

SEQ ID NO: 2996932 - RNA, 19 nt, Mycobacterium avium subsp. paratuberculosis
cagcgagacgaccaggaug

SEQ ID NO: 2996933 - RNA, 16 nt, Mycobacterium avium subsp. paratuberculosis
cagcgagcacagcggc

SEQ ID NO: 2996934 - RNA, 14 nt, Mycobacterium avium subsp. paratuberculosis
cagcgagcagguca

SEQ ID NO: 2996935 - RNA, 23 nt, Mycobacterium avium subsp. paratuberculosis
cagcgagcaggucaccggaugca

SEQ ID NO: 2996936 - RNA, 14 nt, Mycobacterium avium subsp. paratuberculosis
cagcgagcccagcu

SEQ ID NO: 2996937 - RNA, 23 nt, Mycobacterium avium subsp. paratuberculosis
cagcgagcccagcugcgcggagc

SEQ ID NO: 2996938 - RNA, 18 nt, Mycobacterium avium subsp. paratuberculosis
cagcgagcccuucgcggu

SEQ ID NO: 2996939 - RNA, 21 nt, Mycobacterium avium subsp. paratuberculosis
cagcgagcccuucgcggugug

SEQ ID NO: 2996940 - RNA, 21 nt, Mycobacterium avium subsp. paratuberculosis
cagcgagccgucgaccggguc

SEQ ID NO: 2996941 - RNA, 21 nt, Mycobacterium avium subsp. paratuberculosis
cagcgagcgguuggcgacgcu

SEQ ID NO: 2996942 - RNA, 21 nt, Mycobacterium avium subsp. paratuberculosis
cagcgagcucaggccggccuu

SEQ ID NO: 2996943 - RNA, 21 nt, Mycobacterium avium subsp. paratuberculosis
cagcgagcugccggcggccgc

SEQ ID NO: 2996944 - RNA, 23 nt, Mycobacterium avium subsp. paratuberculosis
cagcgagcugccggcggccgccg

SEQ ID NO: 2996945 - RNA, 13 nt, Mycobacterium avium subsp. paratuberculosis
cagcgaggccucg

SEQ ID NO: 2996946 - RNA, 16 nt, Mycobacterium avium subsp. paratuberculosis
cagcgaggccucgccg

SEQ ID NO: 2996947 - RNA, 18 nt, Mycobacterium avium subsp. paratuberculosis
cagcgaggccucgccgcu

SEQ ID NO: 2996948 - RNA, 15 nt, Mycobacterium avium subsp. paratuberculosis
cagcgaggcgacguc

SEQ ID NO: 2996949 - RNA, 22 nt, Mycobacterium avium subsp. paratuberculosis
cagcgaggcgacgucgaacgcg

SEQ ID NO: 2996950 - RNA, 14 nt, Mycobacterium avium subsp. paratuberculosis
cagcgaggcgaugg

SEQ ID NO: 2996951 - RNA, 12 nt, Mycobacterium avium subsp. paratuberculosis
cagcgaggcgcg

SEQ ID NO: 2996952 - RNA, 13 nt, Mycobacterium avium subsp. paratuberculosis
cagcgaggcgcgc

SEQ ID NO: 2996953 - RNA, 16 nt, Mycobacterium avium subsp. paratuberculosis
cagcgaggcgcgcagg

SEQ ID NO: 2996954 - RNA, 17 nt, Mycobacterium avium subsp. paratuberculosis
cagcgaggcggccagcg

SEQ ID NO: 2996955 - RNA, 19 nt, Mycobacterium avium subsp. paratuberculosis
cagcgaggggguggguccg

SEQ ID NO: 2996956 - RNA, 20 nt, Mycobacterium avium subsp. paratuberculosis
cagcgaggugaagccguugu

SEQ ID NO: 2996957 - RNA, 20 nt, Mycobacterium avium subsp. paratuberculosis
cagcgaguccagccagccgc

SEQ ID NO: 2996958 - RNA, 22 nt, Mycobacterium avium subsp. paratuberculosis
cagcgaguccagccagccgcgc

SEQ ID NO: 2996959 - RNA, 15 nt, Mycobacterium avium subsp. paratuberculosis
cagcgagucgaagcc

SEQ ID NO: 2996960 - RNA, 16 nt, Mycobacterium avium subsp. paratuberculosis
cagcgagucgaagccg

SEQ ID NO: 2996961 - RNA, 15 nt, Mycobacterium avium subsp. paratuberculosis
cagcgagucgaaggc

SEQ ID NO: 2996962 - RNA, 17 nt, Mycobacterium avium subsp. paratuberculosis
cagcgagucgaaggcgc

SEQ ID NO: 2996963 - RNA, 21 nt, Mycobacterium avium subsp. paratuberculosis
cagcgagucgaaggcgcgggc

SEQ ID NO: 2996964 - RNA, 21 nt, Mycobacterium avium subsp. paratuberculosis
cagcgagucgagaaacgcgcg

SEQ ID NO: 2996965 - RNA, 23 nt, Mycobacterium avium subsp. paratuberculosis
cagcgagucgaugaccucgcgcc

SEQ ID NO: 2996966 - RNA, 16 nt, Mycobacterium avium subsp. paratuberculosis
cagcgagucggcgaag

SEQ ID NO: 2996967 - RNA, 22 nt, Mycobacterium avium subsp. paratuberculosis
cagcgauacccguugcgcccca

SEQ ID NO: 2996968 - RNA, 15 nt, Mycobacterium avium subsp. paratuberculosis
cagcgaucggcggcu

SEQ ID NO: 2996969 - RNA, 22 nt, Mycobacterium avium subsp. paratuberculosis
cagcgaucggcggcucgccggc

SEQ ID NO: 2996970 - RNA, 24 nt, Mycobacterium avium subsp. paratuberculosis
cagcgaucggcggcucgccggcgu

SEQ ID NO: 2996971 - RNA, 16 nt, Mycobacterium avium subsp. paratuberculosis
cagcgauucccgccgg

SEQ ID NO: 2996972 - RNA, 18 nt, Mycobacterium avium subsp. paratuberculosis
cagcgauucccgccggau

SEQ ID NO: 2996973 - RNA, 15 nt, Mycobacterium avium subsp. paratuberculosis
cagcgauugcggccg

SEQ ID NO: 2996974 - RNA, 20 nt, Mycobacterium avium subsp. paratuberculosis
cagcgauugcggccgccggc

SEQ ID NO: 2996975 - RNA, 12 nt, Mycobacterium avium subsp. paratuberculosis
cagcgcaaccgc

SEQ ID NO: 2996976 - RNA, 17 nt, Mycobacterium avium subsp. paratuberculosis
cagcgcaaccgcggcgg

SEQ ID NO: 2996977 - RNA, 19 nt, Mycobacterium avium subsp. paratuberculosis
cagcgcaacggcgucgaca

SEQ ID NO: 2996978 - RNA, 14 nt, Mycobacterium avium subsp. paratuberculosis
cagcgcacacaccg

SEQ ID NO: 2996979 - RNA, 22 nt, Mycobacterium avium subsp. paratuberculosis
cagcgcacacagcagcagcacc

SEQ ID NO: 2996980 - RNA, 23 nt, Mycobacterium avium subsp. paratuberculosis
cagcgcacacagcagcagcacca

SEQ ID NO: 2996981 - RNA, 12 nt, Mycobacterium avium subsp. paratuberculosis
cagcgcaccgcc

SEQ ID NO: 2996982 - RNA, 15 nt, Mycobacterium avium subsp. paratuberculosis
cagcgcaccgccguc

SEQ ID NO: 2996983 - RNA, 22 nt, Mycobacterium avium subsp. paratuberculosis
cagcgcaccgccgucggggcgu

SEQ ID NO: 2996984 - RNA, 12 nt, Mycobacterium avium subsp. paratuberculosis
cagcgcaccggc

SEQ ID NO: 2996985 - RNA, 13 nt, Mycobacterium avium subsp. paratuberculosis
cagcgcaccggcg

SEQ ID NO: 2996986 - RNA, 14 nt, Mycobacterium avium subsp. paratuberculosis
cagcgcaccggcga

SEQ ID NO: 2996987 - RNA, 14 nt, Mycobacterium avium subsp. paratuberculosis
cagcgcaccgggcc

SEQ ID NO: 2996988 - RNA, 19 nt, Mycobacterium avium subsp. paratuberculosis
cagcgcaccgggcccgccc

SEQ ID NO: 2996989 - RNA, 13 nt, Mycobacterium avium subsp. paratuberculosis
cagcgcacgucgc

SEQ ID NO: 2996990 - RNA, 15 nt, Mycobacterium avium subsp. paratuberculosis
cagcgcacgucgccg

SEQ ID NO: 2996991 - RNA, 18 nt, Mycobacterium avium subsp. paratuberculosis
cagcgcacgucgccgccg

SEQ ID NO: 2996992 - RNA, 19 nt, Mycobacterium avium subsp. paratuberculosis
cagcgcacgucgccgccgc

SEQ ID NO: 2996993 - RNA, 20 nt, Mycobacterium avium subsp. paratuberculosis
cagcgcacgucgccgccgca

SEQ ID NO: 2996994 - RNA, 14 nt, Mycobacterium avium subsp. paratuberculosis
cagcgcagcaccau

SEQ ID NO: 2996995 - RNA, 17 nt, Mycobacterium avium subsp. paratuberculosis
cagcgcagcaccauccg

SEQ ID NO: 2996996 - RNA, 13 nt, Mycobacterium avium subsp. paratuberculosis
cagcgcagcaucg

SEQ ID NO: 2996997 - RNA, 15 nt, Mycobacterium avium subsp. paratuberculosis
cagcgcagcaucggc

SEQ ID NO: 2996998 - RNA, 17 nt, Mycobacterium avium subsp. paratuberculosis
cagcgcagcaucggcag

SEQ ID NO: 2996999 - RNA, 12 nt, Mycobacterium avium subsp. paratuberculosis
cagcgcagcgcc

SEQ ID NO: 2997000 - RNA, 16 nt, Mycobacterium avium subsp. paratuberculosis
cagcgcagcgccucgg

SEQ ID NO: 2997001 - RNA, 22 nt, Mycobacterium avium subsp. paratuberculosis
cagcgcagcgccucggcggccc

SEQ ID NO: 2997002 - RNA, 19 nt, Mycobacterium avium subsp. paratuberculosis
cagcgcagcgucggcgugc

SEQ ID NO: 2997003 - RNA, 16 nt, Mycobacterium avium subsp. paratuberculosis
cagcgcagguccucgg

SEQ ID NO: 2997004 - RNA, 17 nt, Mycobacterium avium subsp. paratuberculosis
cagcgcaguucaccgaa

SEQ ID NO: 2997005 - RNA, 21 nt, Mycobacterium avium subsp. paratuberculosis
cagcgcaguucaccgaagucc

SEQ ID NO: 2997006 - RNA, 23 nt, Mycobacterium avium subsp. paratuberculosis
cagcgcauacaacucgaagcugc

SEQ ID NO: 2997007 - RNA, 18 nt, Mycobacterium avium subsp. paratuberculosis
cagcgcauccgacaccgc

SEQ ID NO: 2997008 - RNA, 21 nt, Mycobacterium avium subsp. paratuberculosis
cagcgcauccgacaccgccuu

SEQ ID NO: 2997009 - RNA, 15 nt, Mycobacterium avium subsp. paratuberculosis
cagcgcaucgccggc

SEQ ID NO: 2997010 - RNA, 18 nt, Mycobacterium avium subsp. paratuberculosis
cagcgcaucgccggcgau

SEQ ID NO: 2997011 - RNA, 21 nt, Mycobacterium avium subsp. paratuberculosis
cagcgcaucggucaccagcuc

SEQ ID NO: 2997012 - RNA, 21 nt, Mycobacterium avium subsp. paratuberculosis
cagcgcaucggugagacgacc

SEQ ID NO: 2997013 - RNA, 15 nt, Mycobacterium avium subsp. paratuberculosis
cagcgcaucguugcc

SEQ ID NO: 2997014 - RNA, 20 nt, Mycobacterium avium subsp. paratuberculosis
cagcgcaucguugccggcgg

SEQ ID NO: 2997015 - RNA, 21 nt, Mycobacterium avium subsp. paratuberculosis
cagcgcaucguugccggcggc

SEQ ID NO: 2997016 - RNA, 12 nt, Mycobacterium avium subsp. paratuberculosis
cagcgcauggag

SEQ ID NO: 2997017 - RNA, 23 nt, Mycobacterium avium subsp. paratuberculosis
cagcgcauggagaugcuucagcc

SEQ ID NO: 2997018 - RNA, 17 nt, Mycobacterium avium subsp. paratuberculosis
cagcgccaacauggcgc

SEQ ID NO: 2997019 - RNA, 22 nt, Mycobacterium avium subsp. paratuberculosis
cagcgccaacauggcgcagaac

SEQ ID NO: 2997020 - RNA, 13 nt, Mycobacterium avium subsp. paratuberculosis
cagcgccacaccg

SEQ ID NO: 2997021 - RNA, 13 nt, Mycobacterium avium subsp. paratuberculosis
cagcgccaccagc

SEQ ID NO: 2997022 - RNA, 22 nt, Mycobacterium avium subsp. paratuberculosis
cagcgccaccagcaccgggaag

SEQ ID NO: 2997023 - RNA, 15 nt, Mycobacterium avium subsp. paratuberculosis
cagcgccaccagcuc

SEQ ID NO: 2997024 - RNA, 17 nt, Mycobacterium avium subsp. paratuberculosis
cagcgccaccagcuccu

SEQ ID NO: 2997025 - RNA, 14 nt, Mycobacterium avium subsp. paratuberculosis
cagcgccacccccc

SEQ ID NO: 2997026 - RNA, 14 nt, Mycobacterium avium subsp. paratuberculosis
cagcgccacgcuca

SEQ ID NO: 2997027 - RNA, 22 nt, Mycobacterium avium subsp. paratuberculosis
cagcgccacgcucaugcccgcc

SEQ ID NO: 2997028 - RNA, 23 nt, Mycobacterium avium subsp. paratuberculosis
cagcgccacgcucaugcccgcca

SEQ ID NO: 2997029 - RNA, 13 nt, Mycobacterium avium subsp. paratuberculosis
cagcgccacgggu

SEQ ID NO: 2997030 - RNA, 23 nt, Mycobacterium avium subsp. paratuberculosis
cagcgccacggguugagccagac

SEQ ID NO: 2997031 - RNA, 20 nt, Mycobacterium avium subsp. paratuberculosis
cagcgccacuggcuggucac

SEQ ID NO: 2997032 - RNA, 22 nt, Mycobacterium avium subsp. paratuberculosis
cagcgccagcaacacccagccg

SEQ ID NO: 2997033 - RNA, 18 nt, Mycobacterium avium subsp. paratuberculosis
cagcgccagcaccgccug

SEQ ID NO: 2997034 - RNA, 15 nt, Mycobacterium avium subsp. paratuberculosis
cagcgccagcaccgg

SEQ ID NO: 2997035 - RNA, 17 nt, Mycobacterium avium subsp. paratuberculosis
cagcgccagcaccgggc

SEQ ID NO: 2997036 - RNA, 13 nt, Mycobacterium avium subsp. paratuberculosis
cagcgccagcacg

SEQ ID NO: 2997037 - RNA, 23 nt, Mycobacterium avium subsp. paratuberculosis
cagcgccagcacggccaccagca

SEQ ID NO: 2997038 - RNA, 16 nt, Mycobacterium avium subsp. paratuberculosis
cagcgccagcagcggc

SEQ ID NO: 2997039 - RNA, 17 nt, Mycobacterium avium subsp. paratuberculosis
cagcgccagcagcggca

SEQ ID NO: 2997040 - RNA, 18 nt, Mycobacterium avium subsp. paratuberculosis
cagcgccagcagcggcac

SEQ ID NO: 2997041 - RNA, 13 nt, Mycobacterium avium subsp. paratuberculosis
cagcgccagcgag

SEQ ID NO: 2997042 - RNA, 12 nt, Mycobacterium avium subsp. paratuberculosis
cagcgccagcgg

SEQ ID NO: 2997043 - RNA, 14 nt, Mycobacterium avium subsp. paratuberculosis
cagcgccagcggcu

SEQ ID NO: 2997044 - RNA, 15 nt, Mycobacterium avium subsp. paratuberculosis
cagcgccagcggcuu

SEQ ID NO: 2997045 - RNA, 14 nt, Mycobacterium avium subsp. paratuberculosis
cagcgccagcggga

SEQ ID NO: 2997046 - RNA, 16 nt, Mycobacterium avium subsp. paratuberculosis
cagcgccagcguggcc

SEQ ID NO: 2997047 - RNA, 18 nt, Mycobacterium avium subsp. paratuberculosis
cagcgccagggugccccg

SEQ ID NO: 2997048 - RNA, 20 nt, Mycobacterium avium subsp. paratuberculosis
cagcgccagggugccccgca

SEQ ID NO: 2997049 - RNA, 15 nt, Mycobacterium avium subsp. paratuberculosis
cagcgcccaccgcuc

SEQ ID NO: 2997050 - RNA, 16 nt, Mycobacterium avium subsp. paratuberculosis
cagcgcccaccgcucg

SEQ ID NO: 2997051 - RNA, 13 nt, Mycobacterium avium subsp. paratuberculosis
cagcgcccagccg

SEQ ID NO: 2997052 - RNA, 20 nt, Mycobacterium avium subsp. paratuberculosis
cagcgcccaggaugacgccg

SEQ ID NO: 2997053 - RNA, 21 nt, Mycobacterium avium subsp. paratuberculosis
cagcgcccaggaugacgccga

SEQ ID NO: 2997054 - RNA, 14 nt, Mycobacterium avium subsp. paratuberculosis
cagcgcccaggcgu

SEQ ID NO: 2997055 - RNA, 20 nt, Mycobacterium avium subsp. paratuberculosis
cagcgcccaggcgugcgcgu

SEQ ID NO: 2997056 - RNA, 12 nt, Mycobacterium avium subsp. paratuberculosis
cagcgcccccag

SEQ ID NO: 2997057 - RNA, 17 nt, Mycobacterium avium subsp. paratuberculosis
cagcgcccccagcgggg

SEQ ID NO: 2997058 - RNA, 20 nt, Mycobacterium avium subsp. paratuberculosis
cagcgcccccagcggggcaa

SEQ ID NO: 2997059 - RNA, 12 nt, Mycobacterium avium subsp. paratuberculosis
cagcgcccccga

SEQ ID NO: 2997060 - RNA, 23 nt, Mycobacterium avium subsp. paratuberculosis
cagcgcccccgaggagacgucgg

SEQ ID NO: 2997061 - RNA, 20 nt, Mycobacterium avium subsp. paratuberculosis
cagcgccccgaaguucgaca

SEQ ID NO: 2997062 - RNA, 14 nt, Mycobacterium avium subsp. paratuberculosis
cagcgccccgccgg

SEQ ID NO: 2997063 - RNA, 12 nt, Mycobacterium avium subsp. paratuberculosis
cagcgccccggu

SEQ ID NO: 2997064 - RNA, 20 nt, Mycobacterium avium subsp. paratuberculosis
cagcgccccgguccggcuga

SEQ ID NO: 2997065 - RNA, 14 nt, Mycobacterium avium subsp. paratuberculosis
cagcgcccgauucg

SEQ ID NO: 2997066 - RNA, 13 nt, Mycobacterium avium subsp. paratuberculosis
cagcgcccgcccg

SEQ ID NO: 2997067 - RNA, 14 nt, Mycobacterium avium subsp. paratuberculosis
cagcgcccgcccgg

SEQ ID NO: 2997068 - RNA, 18 nt, Mycobacterium avium subsp. paratuberculosis
cagcgcccgcccggcccg

SEQ ID NO: 2997069 - RNA, 22 nt, Mycobacterium avium subsp. paratuberculosis
cagcgcccgcccggcccggcgc

SEQ ID NO: 2997070 - RNA, 15 nt, Mycobacterium avium subsp. paratuberculosis
cagcgcccgccgcaa

SEQ ID NO: 2997071 - RNA, 19 nt, Mycobacterium avium subsp. paratuberculosis
cagcgcccgccgcaacgcg

SEQ ID NO: 2997072 - RNA, 23 nt, Mycobacterium avium subsp. paratuberculosis
cagcgcccgcgcgaucggcgagc

SEQ ID NO: 2997073 - RNA, 18 nt, Mycobacterium avium subsp. paratuberculosis
cagcgcccgcgcgggcug

SEQ ID NO: 2997074 - RNA, 14 nt, Mycobacterium avium subsp. paratuberculosis
cagcgcccgcgcgu

SEQ ID NO: 2997075 - RNA, 18 nt, Mycobacterium avium subsp. paratuberculosis
cagcgcccgcgcgugggc

SEQ ID NO: 2997076 - RNA, 20 nt, Mycobacterium avium subsp. paratuberculosis
cagcgcccgcgcgugggcca

SEQ ID NO: 2997077 - RNA, 23 nt, Mycobacterium avium subsp. paratuberculosis
cagcgcccgcgcgugggccaacg

SEQ ID NO: 2997078 - RNA, 16 nt, Mycobacterium avium subsp. paratuberculosis
cagcgcccgcgggugc

SEQ ID NO: 2997079 - RNA, 15 nt, Mycobacterium avium subsp. paratuberculosis
cagcgcccggcagcg

SEQ ID NO: 2997080 - RNA, 13 nt, Mycobacterium avium subsp. paratuberculosis
cagcgcccggccg

SEQ ID NO: 2997081 - RNA, 16 nt, Mycobacterium avium subsp. paratuberculosis
cagcgcccggccguga

SEQ ID NO: 2997082 - RNA, 13 nt, Mycobacterium avium subsp. paratuberculosis
cagcgcccggcga

SEQ ID NO: 2997083 - RNA, 16 nt, Mycobacterium avium subsp. paratuberculosis
cagcgcccggcgacca

SEQ ID NO: 2997084 - RNA, 22 nt, Mycobacterium avium subsp. paratuberculosis
cagcgcccggcgaccaccagcc

SEQ ID NO: 2997085 - RNA, 15 nt, Mycobacterium avium subsp. paratuberculosis
cagcgcccggcgauc

SEQ ID NO: 2997086 - RNA, 15 nt, Mycobacterium avium subsp. paratuberculosis
cagcgcccgggccag

SEQ ID NO: 2997087 - RNA, 17 nt, Mycobacterium avium subsp. paratuberculosis
cagcgcccgggccagga

SEQ ID NO: 2997088 - RNA, 20 nt, Mycobacterium avium subsp. paratuberculosis
cagcgcccgggccaggaccg

SEQ ID NO: 2997089 - RNA, 21 nt, Mycobacterium avium subsp. paratuberculosis
cagcgcccgggccaggaccgg

SEQ ID NO: 2997090 - RNA, 14 nt, Mycobacterium avium subsp. paratuberculosis
cagcgcccgggcgc

SEQ ID NO: 2997091 - RNA, 19 nt, Mycobacterium avium subsp. paratuberculosis
cagcgcccgggcgcgugca

SEQ ID NO: 2997092 - RNA, 23 nt, Mycobacterium avium subsp. paratuberculosis
cagcgcccgggugggcgggacgu

SEQ ID NO: 2997093 - RNA, 19 nt, Mycobacterium avium subsp. paratuberculosis
cagcgcccguagccgcggu

SEQ ID NO: 2997094 - RNA, 19 nt, Mycobacterium avium subsp. paratuberculosis
cagcgccgacuuggugcca

SEQ ID NO: 2997095 - RNA, 16 nt, Mycobacterium avium subsp. paratuberculosis
cagcgccgagacgugg

SEQ ID NO: 2997096 - RNA, 13 nt, Mycobacterium avium subsp. paratuberculosis
cagcgccgaggcc

SEQ ID NO: 2997097 - RNA, 19 nt, Mycobacterium avium subsp. paratuberculosis
cagcgccgaggccagcacg

SEQ ID NO: 2997098 - RNA, 15 nt, Mycobacterium avium subsp. paratuberculosis
cagcgccgaggugcu

SEQ ID NO: 2997099 - RNA, 18 nt, Mycobacterium avium subsp. paratuberculosis
cagcgccgaggugcuguc

SEQ ID NO: 2997100 - RNA, 14 nt, Mycobacterium avium subsp. paratuberculosis
cagcgccgccaacc

SEQ ID NO: 2997101 - RNA, 15 nt, Mycobacterium avium subsp. paratuberculosis
cagcgccgccaacca

SEQ ID NO: 2997102 - RNA, 16 nt, Mycobacterium avium subsp. paratuberculosis
cagcgccgccaaccag

SEQ ID NO: 2997103 - RNA, 19 nt, Mycobacterium avium subsp. paratuberculosis
cagcgccgccaaccagguc

SEQ ID NO: 2997104 - RNA, 13 nt, Mycobacterium avium subsp. paratuberculosis
cagcgccgccacc

SEQ ID NO: 2997105 - RNA, 15 nt, Mycobacterium avium subsp. paratuberculosis
cagcgccgccaccgg

SEQ ID NO: 2997106 - RNA, 17 nt, Mycobacterium avium subsp. paratuberculosis
cagcgccgccaccggcc

SEQ ID NO: 2997107 - RNA, 21 nt, Mycobacterium avium subsp. paratuberculosis
cagcgccgccaccggccgguc

SEQ ID NO: 2997108 - RNA, 16 nt, Mycobacterium avium subsp. paratuberculosis
cagcgccgccagccgc

SEQ ID NO: 2997109 - RNA, 16 nt, Mycobacterium avium subsp. paratuberculosis
cagcgccgcccgcacc

SEQ ID NO: 2997110 - RNA, 18 nt, Mycobacterium avium subsp. paratuberculosis
cagcgccgcccgcaguuc

SEQ ID NO: 2997111 - RNA, 15 nt, Mycobacterium avium subsp. paratuberculosis
cagcgccgcccgggc

SEQ ID NO: 2997112 - RNA, 18 nt, Mycobacterium avium subsp. paratuberculosis
cagcgccgcccgggcggc

SEQ ID NO: 2997113 - RNA, 20 nt, Mycobacterium avium subsp. paratuberculosis
cagcgccgcccgggcggccc

SEQ ID NO: 2997114 - RNA, 13 nt, Mycobacterium avium subsp. paratuberculosis
cagcgccgcgacg

SEQ ID NO: 2997115 - RNA, 14 nt, Mycobacterium avium subsp. paratuberculosis
cagcgccgcgccga

SEQ ID NO: 2997116 - RNA, 15 nt, Mycobacterium avium subsp. paratuberculosis
cagcgccgcgccgac

SEQ ID NO: 2997117 - RNA, 13 nt, Mycobacterium avium subsp. paratuberculosis
cagcgccgcgcgc

SEQ ID NO: 2997118 - RNA, 14 nt, Mycobacterium avium subsp. paratuberculosis
cagcgccgcgcgcg

SEQ ID NO: 2997119 - RNA, 19 nt, Mycobacterium avium subsp. paratuberculosis
cagcgccgcgcgcgcggcc

SEQ ID NO: 2997120 - RNA, 20 nt, Mycobacterium avium subsp. paratuberculosis
cagcgccgcgcgcgcggccu

SEQ ID NO: 2997121 - RNA, 14 nt, Mycobacterium avium subsp. paratuberculosis
cagcgccgcggcca

SEQ ID NO: 2997122 - RNA, 15 nt, Mycobacterium avium subsp. paratuberculosis
cagcgccgcggccag

SEQ ID NO: 2997123 - RNA, 16 nt, Mycobacterium avium subsp. paratuberculosis
cagcgccgcggccagc

SEQ ID NO: 2997124 - RNA, 16 nt, Mycobacterium avium subsp. paratuberculosis
cagcgccgcggccggu

SEQ ID NO: 2997125 - RNA, 19 nt, Mycobacterium avium subsp. paratuberculosis
cagcgccgcggccggugcc

SEQ ID NO: 2997126 - RNA, 15 nt, Mycobacterium avium subsp. paratuberculosis
cagcgccgcggcgcc

SEQ ID NO: 2997127 - RNA, 20 nt, Mycobacterium avium subsp. paratuberculosis
cagcgccgcguugucggcgu

SEQ ID NO: 2997128 - RNA, 19 nt, Mycobacterium avium subsp. paratuberculosis
cagcgccgcuucgucgccg

SEQ ID NO: 2997129 - RNA, 16 nt, Mycobacterium avium subsp. paratuberculosis
cagcgccggcaccagc

SEQ ID NO: 2997130 - RNA, 20 nt, Mycobacterium avium subsp. paratuberculosis
cagcgccggcaccagcagcc

SEQ ID NO: 2997131 - RNA, 12 nt, Mycobacterium avium subsp. paratuberculosis
cagcgccggcag

SEQ ID NO: 2997132 - RNA, 13 nt, Mycobacterium avium subsp. paratuberculosis
cagcgccggcagc

SEQ ID NO: 2997133 - RNA, 14 nt, Mycobacterium avium subsp. paratuberculosis
cagcgccggcagca

SEQ ID NO: 2997134 - RNA, 18 nt, Mycobacterium avium subsp. paratuberculosis
cagcgccggcagcaaccg

SEQ ID NO: 2997135 - RNA, 20 nt, Mycobacterium avium subsp. paratuberculosis
cagcgccggcagcaaccggc

SEQ ID NO: 2997136 - RNA, 22 nt, Mycobacterium avium subsp. paratuberculosis
cagcgccggcagcaaccggcgg

SEQ ID NO: 2997137 - RNA, 16 nt, Mycobacterium avium subsp. paratuberculosis
cagcgccggcagcgcc

SEQ ID NO: 2997138 - RNA, 17 nt, Mycobacterium avium subsp. paratuberculosis
cagcgccgucaucaccg

SEQ ID NO: 2997139 - RNA, 16 nt, Mycobacterium avium subsp. paratuberculosis
cagcgccguccgcacc

SEQ ID NO: 2997140 - RNA, 17 nt, Mycobacterium avium subsp. paratuberculosis
cagcgccguccgcaccg

SEQ ID NO: 2997141 - RNA, 18 nt, Mycobacterium avium subsp. paratuberculosis
cagcgccguccgcaccgc

SEQ ID NO: 2997142 - RNA, 22 nt, Mycobacterium avium subsp. paratuberculosis
cagcgccguccgcaccgcgacg

SEQ ID NO: 2997143 - RNA, 20 nt, Mycobacterium avium subsp. paratuberculosis
cagcgccgucuccucgacca

SEQ ID NO: 2997144 - RNA, 17 nt, Mycobacterium avium subsp. paratuberculosis
cagcgccguggcccggu

SEQ ID NO: 2997145 - RNA, 14 nt, Mycobacterium avium subsp. paratuberculosis
cagcgccuccagcc

SEQ ID NO: 2997146 - RNA, 16 nt, Mycobacterium avium subsp. paratuberculosis
cagcgccuccagccgc

SEQ ID NO: 2997147 - RNA, 18 nt, Mycobacterium avium subsp. paratuberculosis
cagcgccuccagccgcuc

SEQ ID NO: 2997148 - RNA, 14 nt, Mycobacterium avium subsp. paratuberculosis
cagcgccucccgga

SEQ ID NO: 2997149 - RNA, 21 nt, Mycobacterium avium subsp. paratuberculosis
cagcgccucccggaccaccag

SEQ ID NO: 2997150 - RNA, 20 nt, Mycobacterium avium subsp. paratuberculosis
cagcgccucgagcaccacgg

SEQ ID NO: 2997151 - RNA, 22 nt, Mycobacterium avium subsp. paratuberculosis
cagcgccucgagcaccacggcc

SEQ ID NO: 2997152 - RNA, 13 nt, Mycobacterium avium subsp. paratuberculosis
cagcgccucgccg

SEQ ID NO: 2997153 - RNA, 15 nt, Mycobacterium avium subsp. paratuberculosis
cagcgccucgccggg

SEQ ID NO: 2997154 - RNA, 18 nt, Mycobacterium avium subsp. paratuberculosis
cagcgccucgccgggccc

SEQ ID NO: 2997155 - RNA, 15 nt, Mycobacterium avium subsp. paratuberculosis
cagcgccucgcgggu

SEQ ID NO: 2997156 - RNA, 17 nt, Mycobacterium avium subsp. paratuberculosis
cagcgccucgcgggugc

SEQ ID NO: 2997157 - RNA, 23 nt, Mycobacterium avium subsp. paratuberculosis
cagcgccucgcuaaucgccgcgc

SEQ ID NO: 2997158 - RNA, 13 nt, Mycobacterium avium subsp. paratuberculosis
cagcgccucggcc

SEQ ID NO: 2997159 - RNA, 14 nt, Mycobacterium avium subsp. paratuberculosis
cagcgccucggccu

SEQ ID NO: 2997160 - RNA, 15 nt, Mycobacterium avium subsp. paratuberculosis
cagcgccucggccug

SEQ ID NO: 2997161 - RNA, 19 nt, Mycobacterium avium subsp. paratuberculosis
cagcgccucggccugcgcc

SEQ ID NO: 2997162 - RNA, 14 nt, Mycobacterium avium subsp. paratuberculosis
cagcgccucggcga

SEQ ID NO: 2997163 - RNA, 15 nt, Mycobacterium avium subsp. paratuberculosis
cagcgccucggcgau

SEQ ID NO: 2997164 - RNA, 16 nt, Mycobacterium avium subsp. paratuberculosis
cagcgccucggcgauc

SEQ ID NO: 2997165 - RNA, 17 nt, Mycobacterium avium subsp. paratuberculosis
cagcgccucggcgaucg

SEQ ID NO: 2997166 - RNA, 18 nt, Mycobacterium avium subsp. paratuberculosis
cagcgccucggcgaucgg

SEQ ID NO: 2997167 - RNA, 22 nt, Mycobacterium avium subsp. paratuberculosis
cagcgccucggcgaucggccgc

SEQ ID NO: 2997168 - RNA, 18 nt, Mycobacterium avium subsp. paratuberculosis
cagcgccucggcggcccc

SEQ ID NO: 2997169 - RNA, 15 nt, Mycobacterium avium subsp. paratuberculosis
cagcgccucggcggg

SEQ ID NO: 2997170 - RNA, 15 nt, Mycobacterium avium subsp. paratuberculosis
cagcgccucggcguc

SEQ ID NO: 2997171 - RNA, 16 nt, Mycobacterium avium subsp. paratuberculosis
cagcgccucggcgugg

SEQ ID NO: 2997172 - RNA, 17 nt, Mycobacterium avium subsp. paratuberculosis
cagcgccucggcguggc

SEQ ID NO: 2997173 - RNA, 19 nt, Mycobacterium avium subsp. paratuberculosis
cagcgccucggugaagccg

SEQ ID NO: 2997174 - RNA, 16 nt, Mycobacterium avium subsp. paratuberculosis
cagcgccucgucgagc

SEQ ID NO: 2997175 - RNA, 19 nt, Mycobacterium avium subsp. paratuberculosis
cagcgccucgucgagccgg

SEQ ID NO: 2997176 - RNA, 14 nt, Mycobacterium avium subsp. paratuberculosis
cagcgccugcccgg

SEQ ID NO: 2997177 - RNA, 16 nt, Mycobacterium avium subsp. paratuberculosis
cagcgccugcccggag

SEQ ID NO: 2997178 - RNA, 20 nt, Mycobacterium avium subsp. paratuberculosis
cagcgccugcugccaggaca

SEQ ID NO: 2997179 - RNA, 20 nt, Mycobacterium avium subsp. paratuberculosis
cagcgccugguccucccggg

SEQ ID NO: 2997180 - RNA, 23 nt, Mycobacterium avium subsp. paratuberculosis
cagcgccugguccucccgggugg

SEQ ID NO: 2997181 - RNA, 15 nt, Mycobacterium avium subsp. paratuberculosis
cagcgccuucggcgc

SEQ ID NO: 2997182 - RNA, 16 nt, Mycobacterium avium subsp. paratuberculosis
cagcgccuucggcgcc

SEQ ID NO: 2997183 - RNA, 17 nt, Mycobacterium avium subsp. paratuberculosis
cagcgccuucggcgcca

SEQ ID NO: 2997184 - RNA, 19 nt, Mycobacterium avium subsp. paratuberculosis
cagcgccuucuccagcucc

SEQ ID NO: 2997185 - RNA, 23 nt, Mycobacterium avium subsp. paratuberculosis
cagcgccuucuccagcuccucgg

SEQ ID NO: 2997186 - RNA, 16 nt, Mycobacterium avium subsp. paratuberculosis
cagcgccuugaccgcg

SEQ ID NO: 2997187 - RNA, 18 nt, Mycobacterium avium subsp. paratuberculosis
cagcgccuugccgacgac

SEQ ID NO: 2997188 - RNA, 23 nt, Mycobacterium avium subsp. paratuberculosis
cagcgccuugccgacgacgucgu

SEQ ID NO: 2997189 - RNA, 18 nt, Mycobacterium avium subsp. paratuberculosis
cagcgccuugggucccau

SEQ ID NO: 2997190 - RNA, 20 nt, Mycobacterium avium subsp. paratuberculosis
cagcgcgaacaaucgcugcg

SEQ ID NO: 2997191 - RNA, 23 nt, Mycobacterium avium subsp. paratuberculosis
cagcgcgaacaaucgcugcgagc

SEQ ID NO: 2997192 - RNA, 17 nt, Mycobacterium avium subsp. paratuberculosis
cagcgcgaauccgguca

SEQ ID NO: 2997193 - RNA, 15 nt, Mycobacterium avium subsp. paratuberculosis
cagcgcgacaccgga

SEQ ID NO: 2997194 - RNA, 22 nt, Mycobacterium avium subsp. paratuberculosis
cagcgcgacaucgccggcgacc

SEQ ID NO: 2997195 - RNA, 14 nt, Mycobacterium avium subsp. paratuberculosis
cagcgcgaccagcc

SEQ ID NO: 2997196 - RNA, 18 nt, Mycobacterium avium subsp. paratuberculosis
cagcgcgaccagcccggc

SEQ ID NO: 2997197 - RNA, 19 nt, Mycobacterium avium subsp. paratuberculosis
cagcgcgaccagcccggcc

SEQ ID NO: 2997198 - RNA, 24 nt, Mycobacterium avium subsp. paratuberculosis
cagcgcgaccagcccggccgccga

SEQ ID NO: 2997199 - RNA, 18 nt, Mycobacterium avium subsp. paratuberculosis
cagcgcgacccgcucgac

SEQ ID NO: 2997200 - RNA, 18 nt, Mycobacterium avium subsp. paratuberculosis
cagcgcgaccgcccgggc

SEQ ID NO: 2997201 - RNA, 13 nt, Mycobacterium avium subsp. paratuberculosis
cagcgcgaccucg

SEQ ID NO: 2997202 - RNA, 21 nt, Mycobacterium avium subsp. paratuberculosis
cagcgcgaccucgguggugcu

SEQ ID NO: 2997203 - RNA, 17 nt, Mycobacterium avium subsp. paratuberculosis
cagcgcgacgaacagca

SEQ ID NO: 2997204 - RNA, 20 nt, Mycobacterium avium subsp. paratuberculosis
cagcgcgacgaacagcaccg

SEQ ID NO: 2997205 - RNA, 21 nt, Mycobacterium avium subsp. paratuberculosis
cagcgcgacgaacagcaccgc

SEQ ID NO: 2997206 - RNA, 22 nt, Mycobacterium avium subsp. paratuberculosis
cagcgcgacgaacagcaccgcc

SEQ ID NO: 2997207 - RNA, 23 nt, Mycobacterium avium subsp. paratuberculosis
cagcgcgacgaacagcaccgcca

SEQ ID NO: 2997208 - RNA, 15 nt, Mycobacterium avium subsp. paratuberculosis
cagcgcgacgccgac

SEQ ID NO: 2997209 - RNA, 16 nt, Mycobacterium avium subsp. paratuberculosis
cagcgcgacgccgacg

SEQ ID NO: 2997210 - RNA, 17 nt, Mycobacterium avium subsp. paratuberculosis
cagcgcgacgccgacgc

SEQ ID NO: 2997211 - RNA, 14 nt, Mycobacterium avium subsp. paratuberculosis
cagcgcgacgcgca

SEQ ID NO: 2997212 - RNA, 14 nt, Mycobacterium avium subsp. paratuberculosis
cagcgcgacggccu

SEQ ID NO: 2997213 - RNA, 15 nt, Mycobacterium avium subsp. paratuberculosis
cagcgcgacggccuc

SEQ ID NO: 2997214 - RNA, 19 nt, Mycobacterium avium subsp. paratuberculosis
cagcgcgacgggcacccgc

SEQ ID NO: 2997215 - RNA, 19 nt, Mycobacterium avium subsp. paratuberculosis
cagcgcgacgucgaccgcg

SEQ ID NO: 2997216 - RNA, 20 nt, Mycobacterium avium subsp. paratuberculosis
cagcgcgacgucgaccgcga

SEQ ID NO: 2997217 - RNA, 16 nt, Mycobacterium avium subsp. paratuberculosis
cagcgcgacgugccgg

SEQ ID NO: 2997218 - RNA, 17 nt, Mycobacterium avium subsp. paratuberculosis
cagcgcgacgugccggc

SEQ ID NO: 2997219 - RNA, 22 nt, Mycobacterium avium subsp. paratuberculosis
cagcgcgacgugccggcgaugg

SEQ ID NO: 2997220 - RNA, 22 nt, Mycobacterium avium subsp. paratuberculosis
cagcgcgacugggugcucccgc

SEQ ID NO: 2997221 - RNA, 13 nt, Mycobacterium avium subsp. paratuberculosis
cagcgcgaggcgc

SEQ ID NO: 2997222 - RNA, 20 nt, Mycobacterium avium subsp. paratuberculosis
cagccaaagccuacggcgcc

SEQ ID NO: 2997223 - RNA, 21 nt, Mycobacterium avium subsp. paratuberculosis
cagccaaagccuacggcgccg

SEQ ID NO: 2997224 - RNA, 13 nt, Mycobacterium avium subsp. paratuberculosis
cagccaaccgccg

SEQ ID NO: 2997225 - RNA, 15 nt, Mycobacterium avium subsp. paratuberculosis
cagccaaccgccggg

SEQ ID NO: 2997226 - RNA, 19 nt, Mycobacterium avium subsp. paratuberculosis
cagccaaucgccgaugacc

SEQ ID NO: 2997227 - RNA, 22 nt, Mycobacterium avium subsp. paratuberculosis
cagccaaugccggaucgggacc

SEQ ID NO: 2997228 - RNA, 14 nt, Mycobacterium avium subsp. paratuberculosis
cagccacaccgccg

SEQ ID NO: 2997229 - RNA, 20 nt, Mycobacterium avium subsp. paratuberculosis
cagccacaccgccgcggcgg

SEQ ID NO: 2997230 - RNA, 21 nt, Mycobacterium avium subsp. paratuberculosis
cagccacaccgccgcggcggu

SEQ ID NO: 2997231 - RNA, 15 nt, Mycobacterium avium subsp. paratuberculosis
cagccacaccgccgg

SEQ ID NO: 2997232 - RNA, 16 nt, Mycobacterium avium subsp. paratuberculosis
cagccacaccgccggc

SEQ ID NO: 2997233 - RNA, 17 nt, Mycobacterium avium subsp. paratuberculosis
cagccacaccgccggcg

SEQ ID NO: 2997234 - RNA, 12 nt, Mycobacterium avium subsp. paratuberculosis
cagccacagccg

SEQ ID NO: 2997235 - RNA, 13 nt, Mycobacterium avium subsp. paratuberculosis
cagccacagccgc

SEQ ID NO: 2997236 - RNA, 16 nt, Mycobacterium avium subsp. paratuberculosis
cagccacagccgcaug

SEQ ID NO: 2997237 - RNA, 14 nt, Mycobacterium avium subsp. paratuberculosis
cagccacagcucgg

SEQ ID NO: 2997238 - RNA, 12 nt, Mycobacterium avium subsp. paratuberculosis
cagccacaucug

SEQ ID NO: 2997239 - RNA, 13 nt, Mycobacterium avium subsp. paratuberculosis
cagccacaucugg

SEQ ID NO: 2997240 - RNA, 14 nt, Mycobacterium avium subsp. paratuberculosis
cagccacaucuggu

SEQ ID NO: 2997241 - RNA, 21 nt, Mycobacterium avium subsp. paratuberculosis
cagccacaucugguugcggua

SEQ ID NO: 2997242 - RNA, 23 nt, Mycobacterium avium subsp. paratuberculosis
cagccacauguucuccucgucgc

SEQ ID NO: 2997243 - RNA, 16 nt, Mycobacterium avium subsp. paratuberculosis
cagccacccgucggug

SEQ ID NO: 2997244 - RNA, 14 nt, Mycobacterium avium subsp. paratuberculosis
cagccaccgcccga

SEQ ID NO: 2997245 - RNA, 17 nt, Mycobacterium avium subsp. paratuberculosis
cagccaccguggcccca

SEQ ID NO: 2997246 - RNA, 22 nt, Mycobacterium avium subsp. paratuberculosis
cagccaccguggccccacgggc

SEQ ID NO: 2997247 - RNA, 16 nt, Mycobacterium avium subsp. paratuberculosis
cagccacgagcccagc

SEQ ID NO: 2997248 - RNA, 17 nt, Mycobacterium avium subsp. paratuberculosis
cagccacgagcccagcc

SEQ ID NO: 2997249 - RNA, 16 nt, Mycobacterium avium subsp. paratuberculosis
cagccacgccagccag

SEQ ID NO: 2997250 - RNA, 22 nt, Mycobacterium avium subsp. paratuberculosis
cagccacgccagccaggcgaug

SEQ ID NO: 2997251 - RNA, 15 nt, Mycobacterium avium subsp. paratuberculosis
cagccacgccgacac

SEQ ID NO: 2997252 - RNA, 13 nt, Mycobacterium avium subsp. paratuberculosis
cagccacgccggc

SEQ ID NO: 2997253 - RNA, 14 nt, Mycobacterium avium subsp. paratuberculosis
cagccacgccggca

SEQ ID NO: 2997254 - RNA, 17 nt, Mycobacterium avium subsp. paratuberculosis
cagccacggcagcugca

SEQ ID NO: 2997255 - RNA, 14 nt, Mycobacterium avium subsp. paratuberculosis
cagccacgggcggu

SEQ ID NO: 2997256 - RNA, 16 nt, Mycobacterium avium subsp. paratuberculosis
cagccacgggcggucg

SEQ ID NO: 2997257 - RNA, 17 nt, Mycobacterium avium subsp. paratuberculosis
cagccacgggcggucgg

SEQ ID NO: 2997258 - RNA, 17 nt, Mycobacterium avium subsp. paratuberculosis
cagccacuccaccaccg

SEQ ID NO: 2997259 - RNA, 18 nt, Mycobacterium avium subsp. paratuberculosis
cagccacuccaccaccgg

SEQ ID NO: 2997260 - RNA, 19 nt, Mycobacterium avium subsp. paratuberculosis
cagccacuccaccaccggc

SEQ ID NO: 2997261 - RNA, 22 nt, Mycobacterium avium subsp. paratuberculosis
cagccacuccaccaccggccgc

SEQ ID NO: 2997262 - RNA, 15 nt, Mycobacterium avium subsp. paratuberculosis
cagccacucgccgug

SEQ ID NO: 2997263 - RNA, 18 nt, Mycobacterium avium subsp. paratuberculosis
cagccacucgccgugaga

SEQ ID NO: 2997264 - RNA, 17 nt, Mycobacterium avium subsp. paratuberculosis
cagccagaacacgcccc

SEQ ID NO: 2997265 - RNA, 20 nt, Mycobacterium avium subsp. paratuberculosis
cagccagaacacgccccggc

SEQ ID NO: 2997266 - RNA, 23 nt, Mycobacterium avium subsp. paratuberculosis
cagccagaacacgccccggcggg

SEQ ID NO: 2997267 - RNA, 15 nt, Mycobacterium avium subsp. paratuberculosis
cagccagaccucgcc

SEQ ID NO: 2997268 - RNA, 23 nt, Mycobacterium avium subsp. paratuberculosis
cagccagaccucgccgacggugu

SEQ ID NO: 2997269 - RNA, 17 nt, Mycobacterium avium subsp. paratuberculosis
cagccagaucgaggcca

SEQ ID NO: 2997270 - RNA, 22 nt, Mycobacterium avium subsp. paratuberculosis
cagccagaucgaggccagcgcg

SEQ ID NO: 2997271 - RNA, 23 nt, Mycobacterium avium subsp. paratuberculosis
cagccagaucgaggccagcgcga

SEQ ID NO: 2997272 - RNA, 14 nt, Mycobacterium avium subsp. paratuberculosis
cagccagaugucgc

SEQ ID NO: 2997273 - RNA, 14 nt, Mycobacterium avium subsp. paratuberculosis
cagccagcccagcc

SEQ ID NO: 2997274 - RNA, 15 nt, Mycobacterium avium subsp. paratuberculosis
cagccagcccagccg

SEQ ID NO: 2997275 - RNA, 16 nt, Mycobacterium avium subsp. paratuberculosis
cagccagcccagccgc

SEQ ID NO: 2997276 - RNA, 18 nt, Mycobacterium avium subsp. paratuberculosis
cagccagcccagccgcca

SEQ ID NO: 2997277 - RNA, 16 nt, Mycobacterium avium subsp. paratuberculosis
cagccagcccgcgcaa

SEQ ID NO: 2997278 - RNA, 12 nt, Mycobacterium avium subsp. paratuberculosis
cagccagcccgu

SEQ ID NO: 2997279 - RNA, 16 nt, Mycobacterium avium subsp. paratuberculosis
cagccagcccguggcc

SEQ ID NO: 2997280 - RNA, 19 nt, Mycobacterium avium subsp. paratuberculosis
cagccagcccguggccagc

SEQ ID NO: 2997281 - RNA, 21 nt, Mycobacterium avium subsp. paratuberculosis
cagccagcccguggccagcgc

SEQ ID NO: 2997282 - RNA, 13 nt, Mycobacterium avium subsp. paratuberculosis
cagccagccgccc

SEQ ID NO: 2997283 - RNA, 16 nt, Mycobacterium avium subsp. paratuberculosis
cagccagccgcccagc

SEQ ID NO: 2997284 - RNA, 17 nt, Mycobacterium avium subsp. paratuberculosis
cagccagccgcccagca

SEQ ID NO: 2997285 - RNA, 11 nt, Mycobacterium avium subsp. paratuberculosis
cagccagccgg

SEQ ID NO: 2997286 - RNA, 22 nt, Mycobacterium avium subsp. paratuberculosis
cagccagccggugcggucggcg

SEQ ID NO: 2997287 - RNA, 20 nt, Mycobacterium avium subsp. paratuberculosis
cagccagccgguggcggcca

SEQ ID NO: 2997288 - RNA, 19 nt, Mycobacterium avium subsp. paratuberculosis
cagccagccuggcggcgac

SEQ ID NO: 2997289 - RNA, 17 nt, Mycobacterium avium subsp. paratuberculosis
cagccagcgcagcacug

SEQ ID NO: 2997290 - RNA, 14 nt, Mycobacterium avium subsp. paratuberculosis
cagccagcgcccgg

SEQ ID NO: 2997291 - RNA, 14 nt, Mycobacterium avium subsp. paratuberculosis
cagccagcgcgcga

SEQ ID NO: 2997292 - RNA, 15 nt, Mycobacterium avium subsp. paratuberculosis
cagccagcggucacg

SEQ ID NO: 2997293 - RNA, 15 nt, Mycobacterium avium subsp. paratuberculosis
cagccagcguuuggc

SEQ ID NO: 2997294 - RNA, 23 nt, Mycobacterium avium subsp. paratuberculosis
cagccagcguuuggccugcggca

SEQ ID NO: 2997295 - RNA, 14 nt, Mycobacterium avium subsp. paratuberculosis
cagccagcucggcg

SEQ ID NO: 2997296 - RNA, 15 nt, Mycobacterium avium subsp. paratuberculosis
cagccagcucggcgu

SEQ ID NO: 2997297 - RNA, 16 nt, Mycobacterium avium subsp. paratuberculosis
cagccaggacagcguc

SEQ ID NO: 2997298 - RNA, 22 nt, Mycobacterium avium subsp. paratuberculosis
cagccaggauccgaugacgcug

SEQ ID NO: 2997299 - RNA, 15 nt, Mycobacterium avium subsp. paratuberculosis
cagccaggccgccgg

SEQ ID NO: 2997300 - RNA, 13 nt, Mycobacterium avium subsp. paratuberculosis
cagccaggccguc

SEQ ID NO: 2997301 - RNA, 17 nt, Mycobacterium avium subsp. paratuberculosis
cagccaggccgucggcg

SEQ ID NO: 2997302 - RNA, 20 nt, Mycobacterium avium subsp. paratuberculosis
cagccaggccgucggcgcgg

SEQ ID NO: 2997303 - RNA, 22 nt, Mycobacterium avium subsp. paratuberculosis
cagccaggcgaugaagccggcg

SEQ ID NO: 2997304 - RNA, 20 nt, Mycobacterium avium subsp. paratuberculosis
cagccagguacuccgguacc

SEQ ID NO: 2997305 - RNA, 14 nt, Mycobacterium avium subsp. paratuberculosis
cagccagguccggg

SEQ ID NO: 2997306 - RNA, 17 nt, Mycobacterium avium subsp. paratuberculosis
cagccagguccgggcac

SEQ ID NO: 2997307 - RNA, 19 nt, Mycobacterium avium subsp. paratuberculosis
cagccagguggugaacucu

SEQ ID NO: 2997308 - RNA, 13 nt, Mycobacterium avium subsp. paratuberculosis
cagccaggugugc

SEQ ID NO: 2997309 - RNA, 16 nt, Mycobacterium avium subsp. paratuberculosis
cagccaggugugcggc

SEQ ID NO: 2997310 - RNA, 19 nt, Mycobacterium avium subsp. paratuberculosis
cagccaggugugcggcacg

SEQ ID NO: 2997311 - RNA, 20 nt, Mycobacterium avium subsp. paratuberculosis
cagccaggugugcggcacga

SEQ ID NO: 2997312 - RNA, 13 nt, Mycobacterium avium subsp. paratuberculosis
cagccagguuggc

SEQ ID NO: 2997313 - RNA, 20 nt, Mycobacterium avium subsp. paratuberculosis
cagccagguuggccagguug

SEQ ID NO: 2997314 - RNA, 15 nt, Mycobacterium avium subsp. paratuberculosis
cagccaguccgccgc

SEQ ID NO: 2997315 - RNA, 17 nt, Mycobacterium avium subsp. paratuberculosis
cagccaguccgccgccg

SEQ ID NO: 2997316 - RNA, 18 nt, Mycobacterium avium subsp. paratuberculosis
cagccaguccgccgccgu

SEQ ID NO: 2997317 - RNA, 20 nt, Mycobacterium avium subsp. paratuberculosis
cagccaguccgccgccgucc

SEQ ID NO: 2997318 - RNA, 21 nt, Mycobacterium avium subsp. paratuberculosis
cagccaguccgccgccguccc

SEQ ID NO: 2997319 - RNA, 23 nt, Mycobacterium avium subsp. paratuberculosis
cagccaguccgccgccgucccac

SEQ ID NO: 2997320 - RNA, 16 nt, Mycobacterium avium subsp. paratuberculosis
cagccagucgaagacc

SEQ ID NO: 2997321 - RNA, 22 nt, Mycobacterium avium subsp. paratuberculosis
cagccagucgaagaccacgaac

SEQ ID NO: 2997322 - RNA, 14 nt, Mycobacterium avium subsp. paratuberculosis
cagccagucgccgg

SEQ ID NO: 2997323 - RNA, 17 nt, Mycobacterium avium subsp. paratuberculosis
cagccagucgccggcca

SEQ ID NO: 2997324 - RNA, 23 nt, Mycobacterium avium subsp. paratuberculosis
cagccagucggucaacgugucga

SEQ ID NO: 2997325 - RNA, 17 nt, Mycobacterium avium subsp. paratuberculosis
cagccaguugggggcca

SEQ ID NO: 2997326 - RNA, 20 nt, Mycobacterium avium subsp. paratuberculosis
cagccaguugggggccagcg

SEQ ID NO: 2997327 - RNA, 19 nt, Mycobacterium avium subsp. paratuberculosis
cagccauaccuugucggcg

SEQ ID NO: 2997328 - RNA, 20 nt, Mycobacterium avium subsp. paratuberculosis
cagccauacugacgccgguc

SEQ ID NO: 2997329 - RNA, 14 nt, Mycobacterium avium subsp. paratuberculosis
cagccaucugcuga

SEQ ID NO: 2997330 - RNA, 15 nt, Mycobacterium avium subsp. paratuberculosis
cagccaugccggugg

SEQ ID NO: 2997331 - RNA, 15 nt, Mycobacterium avium subsp. paratuberculosis
cagccauucgucggg

SEQ ID NO: 2997332 - RNA, 16 nt, Mycobacterium avium subsp. paratuberculosis
cagccauucgucgggg

SEQ ID NO: 2997333 - RNA, 17 nt, Mycobacterium avium subsp. paratuberculosis
cagccauucgucgggga

SEQ ID NO: 2997334 - RNA, 16 nt, Mycobacterium avium subsp. paratuberculosis
cagcccagccgccagc

SEQ ID NO: 2997335 - RNA, 15 nt, Mycobacterium avium subsp. paratuberculosis
cagcccaggcccagc

SEQ ID NO: 2997336 - RNA, 16 nt, Mycobacterium avium subsp. paratuberculosis
cagcccaggcccagca

SEQ ID NO: 2997337 - RNA, 19 nt, Mycobacterium avium subsp. paratuberculosis
cagcccaggcccagcagca

SEQ ID NO: 2997338 - RNA, 15 nt, Mycobacterium avium subsp. paratuberculosis
cagcccaucccgauc

SEQ ID NO: 2997339 - RNA, 17 nt, Mycobacterium avium subsp. paratuberculosis
cagcccaucccgauccg

SEQ ID NO: 2997340 - RNA, 14 nt, Mycobacterium avium subsp. paratuberculosis
cagccccaccaccg

SEQ ID NO: 2997341 - RNA, 17 nt, Mycobacterium avium subsp. paratuberculosis
cagccccaccaccgcca

SEQ ID NO: 2997342 - RNA, 13 nt, Mycobacterium avium subsp. paratuberculosis
cagccccaccggc

SEQ ID NO: 2997343 - RNA, 17 nt, Mycobacterium avium subsp. paratuberculosis
cagccccaccggccacu

SEQ ID NO: 2997344 - RNA, 19 nt, Mycobacterium avium subsp. paratuberculosis
cagccccaccggccacucg

SEQ ID NO: 2997345 - RNA, 20 nt, Mycobacterium avium subsp. paratuberculosis
cagccccagcacgaugacga

SEQ ID NO: 2997346 - RNA, 23 nt, Mycobacterium avium subsp. paratuberculosis
cagccccagcacgaugacgaccg

SEQ ID NO: 2997347 - RNA, 15 nt, Mycobacterium avium subsp. paratuberculosis
cagccccagcgagca

SEQ ID NO: 2997348 - RNA, 17 nt, Mycobacterium avium subsp. paratuberculosis
cagccccagcgagcagg

SEQ ID NO: 2997349 - RNA, 22 nt, Mycobacterium avium subsp. paratuberculosis
cagccccagcgagcaggucacc

SEQ ID NO: 2997350 - RNA, 23 nt, Mycobacterium avium subsp. paratuberculosis
cagccccagcgagcaggucaccg

SEQ ID NO: 2997351 - RNA, 13 nt, Mycobacterium avium subsp. paratuberculosis
cagccccagcgga

SEQ ID NO: 2997352 - RNA, 15 nt, Mycobacterium avium subsp. paratuberculosis
cagccccagcggagc

SEQ ID NO: 2997353 - RNA, 16 nt, Mycobacterium avium subsp. paratuberculosis
cagcccccaccgcgcc

SEQ ID NO: 2997354 - RNA, 20 nt, Mycobacterium avium subsp. paratuberculosis
cagcccccaccgcgccguga

SEQ ID NO: 2997355 - RNA, 14 nt, Mycobacterium avium subsp. paratuberculosis
cagcccccacgcuc

SEQ ID NO: 2997356 - RNA, 20 nt, Mycobacterium avium subsp. paratuberculosis
cagcccccacgcucggcgca

SEQ ID NO: 2997357 - RNA, 14 nt, Mycobacterium avium subsp. paratuberculosis
cagcccccgcagcc

SEQ ID NO: 2997358 - RNA, 16 nt, Mycobacterium avium subsp. paratuberculosis
cagcccccgcagcccg

SEQ ID NO: 2997359 - RNA, 14 nt, Mycobacterium avium subsp. paratuberculosis
cagcccccgcgggu

SEQ ID NO: 2997360 - RNA, 19 nt, Mycobacterium avium subsp. paratuberculosis
cagcccccggaccacgucc

SEQ ID NO: 2997361 - RNA, 18 nt, Mycobacterium avium subsp. paratuberculosis
cagccccgagccgcggau

SEQ ID NO: 2997362 - RNA, 17 nt, Mycobacterium avium subsp. paratuberculosis
cagccccgggaaccagc

SEQ ID NO: 2997363 - RNA, 18 nt, Mycobacterium avium subsp. paratuberculosis
cagccccgggaaccagcc

SEQ ID NO: 2997364 - RNA, 13 nt, Mycobacterium avium subsp. paratuberculosis
cagccccucgacc

SEQ ID NO: 2997365 - RNA, 12 nt, Mycobacterium avium subsp. paratuberculosis
cagccccucgcc

SEQ ID NO: 2997366 - RNA, 14 nt, Mycobacterium avium subsp. paratuberculosis
cagccccucggggc

SEQ ID NO: 2997367 - RNA, 17 nt, Mycobacterium avium subsp. paratuberculosis
cagccccucggggcugc

SEQ ID NO: 2997368 - RNA, 18 nt, Mycobacterium avium subsp. paratuberculosis
cagccccucggggcugcg

SEQ ID NO: 2997369 - RNA, 14 nt, Mycobacterium avium subsp. paratuberculosis
cagccccucgucca

SEQ ID NO: 2997370 - RNA, 19 nt, Mycobacterium avium subsp. paratuberculosis
cagccccucguccaggugc

SEQ ID NO: 2997371 - RNA, 17 nt, Mycobacterium avium subsp. paratuberculosis
cagccccugcaccacga

SEQ ID NO: 2997372 - RNA, 13 nt, Mycobacterium avium subsp. paratuberculosis
cagcccgaaaguc

SEQ ID NO: 2997373 - RNA, 22 nt, Mycobacterium avium subsp. paratuberculosis
cagcccgaaaguccccgggugg

SEQ ID NO: 2997374 - RNA, 17 nt, Mycobacterium avium subsp. paratuberculosis
cagcccgaacagccggg

SEQ ID NO: 2997375 - RNA, 22 nt, Mycobacterium avium subsp. paratuberculosis
cagcccgaacagccgggccagc

SEQ ID NO: 2997376 - RNA, 22 nt, Mycobacterium avium subsp. paratuberculosis
cagcccgaacagccgggcggcc

SEQ ID NO: 2997377 - RNA, 23 nt, Mycobacterium avium subsp. paratuberculosis
cagcccgaacagcuugccgaucu

SEQ ID NO: 2997378 - RNA, 14 nt, Mycobacterium avium subsp. paratuberculosis
cagcccgaccaccu

SEQ ID NO: 2997379 - RNA, 20 nt, Mycobacterium avium subsp. paratuberculosis
cagcccgacccggcucucca

SEQ ID NO: 2997380 - RNA, 13 nt, Mycobacterium avium subsp. paratuberculosis
cagcccgaccguc

SEQ ID NO: 2997381 - RNA, 22 nt, Mycobacterium avium subsp. paratuberculosis
cagcccgaccgucgucccggug

SEQ ID NO: 2997382 - RNA, 19 nt, Mycobacterium avium subsp. paratuberculosis
cagcccgaccuucugcugc

SEQ ID NO: 2997383 - RNA, 17 nt, Mycobacterium avium subsp. paratuberculosis
cagcccgagcaccagcg

SEQ ID NO: 2997384 - RNA, 20 nt, Mycobacterium avium subsp. paratuberculosis
cagcccgagcaccagcggac

SEQ ID NO: 2997385 - RNA, 12 nt, Mycobacterium avium subsp. paratuberculosis
cagcccgagcgg

SEQ ID NO: 2997386 - RNA, 16 nt, Mycobacterium avium subsp. paratuberculosis
cagcccgagcggcauc

SEQ ID NO: 2997387 - RNA, 13 nt, Mycobacterium avium subsp. paratuberculosis
cagcccgaucacc

SEQ ID NO: 2997388 - RNA, 19 nt, Mycobacterium avium subsp. paratuberculosis
cagcccgaucacccccgac

SEQ ID NO: 2997389 - RNA, 17 nt, Mycobacterium avium subsp. paratuberculosis
cagcccgaucgccagcg

SEQ ID NO: 2997390 - RNA, 19 nt, Mycobacterium avium subsp. paratuberculosis
cagcccgaucgccagcgcc

SEQ ID NO: 2997391 - RNA, 19 nt, Mycobacterium avium subsp. paratuberculosis
cagcccgaucucgcggucg

SEQ ID NO: 2997392 - RNA, 16 nt, Mycobacterium avium subsp. paratuberculosis
cagcccgaugccgccg

SEQ ID NO: 2997393 - RNA, 17 nt, Mycobacterium avium subsp. paratuberculosis
cagcccgaugccgccga

SEQ ID NO: 2997394 - RNA, 19 nt, Mycobacterium avium subsp. paratuberculosis
cagcccgaugccgccgagg

SEQ ID NO: 2997395 - RNA, 17 nt, Mycobacterium avium subsp. paratuberculosis
cagcccgauucagccgg

SEQ ID NO: 2997396 - RNA, 18 nt, Mycobacterium avium subsp. paratuberculosis
cagcccgauucagccggc

SEQ ID NO: 2997397 - RNA, 20 nt, Mycobacterium avium subsp. paratuberculosis
cagcccgauucagccggcgg

SEQ ID NO: 2997398 - RNA, 12 nt, Mycobacterium avium subsp. paratuberculosis
cagcccgcccac

SEQ ID NO: 2997399 - RNA, 21 nt, Mycobacterium avium subsp. paratuberculosis
cagcccgcccacauacaccgg

SEQ ID NO: 2997400 - RNA, 15 nt, Mycobacterium avium subsp. paratuberculosis
cagcccgcccaccac

SEQ ID NO: 2997401 - RNA, 17 nt, Mycobacterium avium subsp. paratuberculosis
cagcccgcccaccacga

SEQ ID NO: 2997402 - RNA, 21 nt, Mycobacterium avium subsp. paratuberculosis
cagcccgcccaccacgaacgc

SEQ ID NO: 2997403 - RNA, 15 nt, Mycobacterium avium subsp. paratuberculosis
cagcccgcccagcgc

SEQ ID NO: 2997404 - RNA, 16 nt, Mycobacterium avium subsp. paratuberculosis
cagcccgcccagcgcc

SEQ ID NO: 2997405 - RNA, 19 nt, Mycobacterium avium subsp. paratuberculosis
cagcccgcccagcgccacg

SEQ ID NO: 2997406 - RNA, 23 nt, Mycobacterium avium subsp. paratuberculosis
cagcccgcccagcgccacggugg

SEQ ID NO: 2997407 - RNA, 14 nt, Mycobacterium avium subsp. paratuberculosis
cagcccgccgaacc

SEQ ID NO: 2997408 - RNA, 13 nt, Mycobacterium avium subsp. paratuberculosis
cagcccgccgacc

SEQ ID NO: 2997409 - RNA, 17 nt, Mycobacterium avium subsp. paratuberculosis
cagcccgccgaccaccu

SEQ ID NO: 2997410 - RNA, 19 nt, Mycobacterium avium subsp. paratuberculosis
cagcccgccgauggacacg

SEQ ID NO: 2997411 - RNA, 14 nt, Mycobacterium avium subsp. paratuberculosis
cagcccgccgcgga

SEQ ID NO: 2997412 - RNA, 15 nt, Mycobacterium avium subsp. paratuberculosis
cagcccgccgcgucc

SEQ ID NO: 2997413 - RNA, 16 nt, Mycobacterium avium subsp. paratuberculosis
cagcccgccgcguccg

SEQ ID NO: 2997414 - RNA, 11 nt, Mycobacterium avium subsp. paratuberculosis
cagcccgccgg

SEQ ID NO: 2997415 - RNA, 13 nt, Mycobacterium avium subsp. paratuberculosis
cagcccgccggga

SEQ ID NO: 2997416 - RNA, 16 nt, Mycobacterium avium subsp. paratuberculosis
cagcccgccgggaugc

SEQ ID NO: 2997417 - RNA, 13 nt, Mycobacterium avium subsp. paratuberculosis
cagcccgccgggc

SEQ ID NO: 2997418 - RNA, 14 nt, Mycobacterium avium subsp. paratuberculosis
cagcccgccgggcu

SEQ ID NO: 2997419 - RNA, 15 nt, Mycobacterium avium subsp. paratuberculosis
cagcccgccgggcug

SEQ ID NO: 2997420 - RNA, 17 nt, Mycobacterium avium subsp. paratuberculosis
cagcccgcgcaccgcga

SEQ ID NO: 2997421 - RNA, 12 nt, Mycobacterium avium subsp. paratuberculosis
cagcccgcgcca

SEQ ID NO: 2997422 - RNA, 21 nt, Mycobacterium avium subsp. paratuberculosis
cagcccgcgccagcucggcgg

SEQ ID NO: 2997423 - RNA, 22 nt, Mycobacterium avium subsp. paratuberculosis
cagcccgcgccagcucggcggc

SEQ ID NO: 2997424 - RNA, 13 nt, Mycobacterium avium subsp. paratuberculosis
cagcccgcgccga

SEQ ID NO: 2997425 - RNA, 14 nt, Mycobacterium avium subsp. paratuberculosis
cagcccgcgccgag

SEQ ID NO: 2997426 - RNA, 16 nt, Mycobacterium avium subsp. paratuberculosis
cagcccgcgccgagca

SEQ ID NO: 2997427 - RNA, 22 nt, Mycobacterium avium subsp. paratuberculosis
cagcccgcgccgagcaaccggg

SEQ ID NO: 2997428 - RNA, 23 nt, Mycobacterium avium subsp. paratuberculosis
cagcccgcgcgagcgcagcgcca

SEQ ID NO: 2997429 - RNA, 16 nt, Mycobacterium avium subsp. paratuberculosis
cagcccgcggaucgcg

SEQ ID NO: 2997430 - RNA, 18 nt, Mycobacterium avium subsp. paratuberculosis
cagcccgcggcagccagc

SEQ ID NO: 2997431 - RNA, 19 nt, Mycobacterium avium subsp. paratuberculosis
cagcccgcguccagcagca

SEQ ID NO: 2997432 - RNA, 12 nt, Mycobacterium avium subsp. paratuberculosis
cagcccgcgucg

SEQ ID NO: 2997433 - RNA, 13 nt, Mycobacterium avium subsp. paratuberculosis
cagcccgcgucgc

SEQ ID NO: 2997434 - RNA, 14 nt, Mycobacterium avium subsp. paratuberculosis
cagcccgcgucgcg

SEQ ID NO: 2997435 - RNA, 17 nt, Mycobacterium avium subsp. paratuberculosis
cagcccgcgucgcgcag

SEQ ID NO: 2997436 - RNA, 13 nt, Mycobacterium avium subsp. paratuberculosis
cagcccgcgucgu

SEQ ID NO: 2997437 - RNA, 15 nt, Mycobacterium avium subsp. paratuberculosis
cagcccgcugaccag

SEQ ID NO: 2997438 - RNA, 16 nt, Mycobacterium avium subsp. paratuberculosis
cagcccgcugaccagg

SEQ ID NO: 2997439 - RNA, 19 nt, Mycobacterium avium subsp. paratuberculosis
cagcccgcugaccaggccg

SEQ ID NO: 2997440 - RNA, 20 nt, Mycobacterium avium subsp. paratuberculosis
cagcccgcugaccaggccga

SEQ ID NO: 2997441 - RNA, 22 nt, Mycobacterium avium subsp. paratuberculosis
cagcccggaaaaccccaccccg

SEQ ID NO: 2997442 - RNA, 18 nt, Mycobacterium avium subsp. paratuberculosis
cagcccggaggcgaugcg

SEQ ID NO: 2997443 - RNA, 20 nt, Mycobacterium avium subsp. paratuberculosis
cagcccggaguagccgguuc

SEQ ID NO: 2997444 - RNA, 19 nt, Mycobacterium avium subsp. paratuberculosis
cagcccggcagcggggcga

SEQ ID NO: 2997445 - RNA, 13 nt, Mycobacterium avium subsp. paratuberculosis
cagcccggccagc

SEQ ID NO: 2997446 - RNA, 14 nt, Mycobacterium avium subsp. paratuberculosis
cagcccggccagca

SEQ ID NO: 2997447 - RNA, 15 nt, Mycobacterium avium subsp. paratuberculosis
cagcccggccagcac

SEQ ID NO: 2997448 - RNA, 17 nt, Mycobacterium avium subsp. paratuberculosis
cagcccggccagcaccc

SEQ ID NO: 2997449 - RNA, 18 nt, Mycobacterium avium subsp. paratuberculosis
cagcccggccagcacccg

SEQ ID NO: 2997450 - RNA, 16 nt, Mycobacterium avium subsp. paratuberculosis
cagcccggccagccgg

SEQ ID NO: 2997451 - RNA, 19 nt, Mycobacterium avium subsp. paratuberculosis
cagcccggccagccgggcg

SEQ ID NO: 2997452 - RNA, 15 nt, Mycobacterium avium subsp. paratuberculosis
cagcccggccagcgg

SEQ ID NO: 2997453 - RNA, 16 nt, Mycobacterium avium subsp. paratuberculosis
cagcccggccagcggc

SEQ ID NO: 2997454 - RNA, 13 nt, Mycobacterium avium subsp. paratuberculosis
cagcccggccagu

SEQ ID NO: 2997455 - RNA, 15 nt, Mycobacterium avium subsp. paratuberculosis
cagcccggcccagcc

SEQ ID NO: 2997456 - RNA, 16 nt, Mycobacterium avium subsp. paratuberculosis
cagcccggcccagccg

SEQ ID NO: 2997457 - RNA, 18 nt, Mycobacterium avium subsp. paratuberculosis
cagcccggcccagccggu

SEQ ID NO: 2997458 - RNA, 21 nt, Mycobacterium avium subsp. paratuberculosis
cagcccggccccaccgccgcu

SEQ ID NO: 2997459 - RNA, 12 nt, Mycobacterium avium subsp. paratuberculosis
cagcccggcccg

SEQ ID NO: 2997460 - RNA, 14 nt, Mycobacterium avium subsp. paratuberculosis
cagcccggcccgca

SEQ ID NO: 2997461 - RNA, 18 nt, Mycobacterium avium subsp. paratuberculosis
cagcccggcccgcaucga

SEQ ID NO: 2997462 - RNA, 13 nt, Mycobacterium avium subsp. paratuberculosis
cagcccggcccgu

SEQ ID NO: 2997463 - RNA, 20 nt, Mycobacterium avium subsp. paratuberculosis
cagcccggcccgucgagcgg

SEQ ID NO: 2997464 - RNA, 20 nt, Mycobacterium avium subsp. paratuberculosis
cagcccggccgaggucacca

SEQ ID NO: 2997465 - RNA, 13 nt, Mycobacterium avium subsp. paratuberculosis
cagcccggcgaac

SEQ ID NO: 2997466 - RNA, 20 nt, Mycobacterium avium subsp. paratuberculosis
cagcccggcgaacaccacgg

SEQ ID NO: 2997467 - RNA, 13 nt, Mycobacterium avium subsp. paratuberculosis
cagcccggcgacg

SEQ ID NO: 2997468 - RNA, 19 nt, Mycobacterium avium subsp. paratuberculosis
cagcccggcgaugaucagg

SEQ ID NO: 2997469 - RNA, 22 nt, Mycobacterium avium subsp. paratuberculosis
cagcccggcgcucaccgcgaug

SEQ ID NO: 2997470 - RNA, 23 nt, Mycobacterium avium subsp. paratuberculosis
cagcccggcgcucaccgcgauga

SEQ ID NO: 2997471 - RNA, 21 nt, Mycobacterium avium subsp. paratuberculosis
cagcccggcgguugauacucg

SEQ ID NO: 2997472 - RNA, 16 nt, Mycobacterium avium subsp. paratuberculosis
cagcccggcguacagc

SEQ ID NO: 2997473 - RNA, 13 nt, Mycobacterium avium subsp. paratuberculosis
cagcccggcgucc

SEQ ID NO: 2997474 - RNA, 16 nt, Mycobacterium avium subsp. paratuberculosis
cagcccggcugcgcag

SEQ ID NO: 2997475 - RNA, 17 nt, Mycobacterium avium subsp. paratuberculosis
cagcccggcugcgcagc

SEQ ID NO: 2997476 - RNA, 20 nt, Mycobacterium avium subsp. paratuberculosis
cagcccggcugcgcagcgca

SEQ ID NO: 2997477 - RNA, 13 nt, Mycobacterium avium subsp. paratuberculosis
cagauacgccgcg

SEQ ID NO: 2997478 - RNA, 16 nt, Mycobacterium avium subsp. paratuberculosis
cagauacgccgcgacg

SEQ ID NO: 2997479 - RNA, 18 nt, Mycobacterium avium subsp. paratuberculosis
cagauacuccucgcgguc

SEQ ID NO: 2997480 - RNA, 15 nt, Mycobacterium avium subsp. paratuberculosis
cagauacuucgucga

SEQ ID NO: 2997481 - RNA, 20 nt, Mycobacterium avium subsp. paratuberculosis
cagauagaugagccgcagcc

SEQ ID NO: 2997482 - RNA, 22 nt, Mycobacterium avium subsp. paratuberculosis
cagauagaugagccgcagccgg

SEQ ID NO: 2997483 - RNA, 22 nt, Mycobacterium avium subsp. paratuberculosis
cagauagcccagccagccggug

SEQ ID NO: 2997484 - RNA, 23 nt, Mycobacterium avium subsp. paratuberculosis
cagauagcccagccagccggugg

SEQ ID NO: 2997485 - RNA, 20 nt, Mycobacterium avium subsp. paratuberculosis
cagauagccguacacggcgg

SEQ ID NO: 2997486 - RNA, 22 nt, Mycobacterium avium subsp. paratuberculosis
cagauagccguacacggcggcg

SEQ ID NO: 2997487 - RNA, 23 nt, Mycobacterium avium subsp. paratuberculosis
cagauagccguacacggcggcga

SEQ ID NO: 2997488 - RNA, 20 nt, Mycobacterium avium subsp. paratuberculosis
cagauagccuuugccgugcu

SEQ ID NO: 2997489 - RNA, 15 nt, Mycobacterium avium subsp. paratuberculosis
cagauaggacccggc

SEQ ID NO: 2997490 - RNA, 16 nt, Mycobacterium avium subsp. paratuberculosis
cagauaggccagcgcg

SEQ ID NO: 2997491 - RNA, 17 nt, Mycobacterium avium subsp. paratuberculosis
cagauaggccagcgcgu

SEQ ID NO: 2997492 - RNA, 13 nt, Mycobacterium avium subsp. paratuberculosis
cagauaggcggcg

SEQ ID NO: 2997493 - RNA, 14 nt, Mycobacterium avium subsp. paratuberculosis
cagauaggcggcga

SEQ ID NO: 2997494 - RNA, 20 nt, Mycobacterium avium subsp. paratuberculosis
cagauaggcggcgacggcgu

SEQ ID NO: 2997495 - RNA, 22 nt, Mycobacterium avium subsp. paratuberculosis
cagauaggcggcgacggcgucg

SEQ ID NO: 2997496 - RNA, 21 nt, Mycobacterium avium subsp. paratuberculosis
cagaucaccacgguggccgcg

SEQ ID NO: 2997497 - RNA, 13 nt, Mycobacterium avium subsp. paratuberculosis
cagaucagcgugg

SEQ ID NO: 2997498 - RNA, 19 nt, Mycobacterium avium subsp. paratuberculosis
cagaucagcguggucagcg

SEQ ID NO: 2997499 - RNA, 15 nt, Mycobacterium avium subsp. paratuberculosis
cagaucccgccggcg

SEQ ID NO: 2997500 - RNA, 17 nt, Mycobacterium avium subsp. paratuberculosis
cagaucccgccggcggc

SEQ ID NO: 2997501 - RNA, 18 nt, Mycobacterium avium subsp. paratuberculosis
cagaucccgccggcggcc

SEQ ID NO: 2997502 - RNA, 19 nt, Mycobacterium avium subsp. paratuberculosis
cagaucccgccggcggcca

SEQ ID NO: 2997503 - RNA, 21 nt, Mycobacterium avium subsp. paratuberculosis
cagaucccgccggcggccacg

SEQ ID NO: 2997504 - RNA, 15 nt, Mycobacterium avium subsp. paratuberculosis
cagauccucagcagc

SEQ ID NO: 2997505 - RNA, 23 nt, Mycobacterium avium subsp. paratuberculosis
cagauccucgaauccgcgggcgu

SEQ ID NO: 2997506 - RNA, 18 nt, Mycobacterium avium subsp. paratuberculosis
cagaucgacccccaccgc

SEQ ID NO: 2997507 - RNA, 22 nt, Mycobacterium avium subsp. paratuberculosis
cagaucgacccccaccgcgaca

SEQ ID NO: 2997508 - RNA, 19 nt, Mycobacterium avium subsp. paratuberculosis
cagaucgacgccgcggugg

SEQ ID NO: 2997509 - RNA, 19 nt, Mycobacterium avium subsp. paratuberculosis
cagaucgagcugggcccgc

SEQ ID NO: 2997510 - RNA, 15 nt, Mycobacterium avium subsp. paratuberculosis
cagaucgaggccagc

SEQ ID NO: 2997511 - RNA, 17 nt, Mycobacterium avium subsp. paratuberculosis
cagaucgaggccagcgc

SEQ ID NO: 2997512 - RNA, 18 nt, Mycobacterium avium subsp. paratuberculosis
cagaucgaggccagcgcg

SEQ ID NO: 2997513 - RNA, 17 nt, Mycobacterium avium subsp. paratuberculosis
cagaucgauggggaugg

SEQ ID NO: 2997514 - RNA, 22 nt, Mycobacterium avium subsp. paratuberculosis
cagaucgauggggauggugcgc

SEQ ID NO: 2997515 - RNA, 18 nt, Mycobacterium avium subsp. paratuberculosis
cagaucgccagcaccggc

SEQ ID NO: 2997516 - RNA, 22 nt, Mycobacterium avium subsp. paratuberculosis
cagaucgccagcaccggcgcgc

SEQ ID NO: 2997517 - RNA, 18 nt, Mycobacterium avium subsp. paratuberculosis
cagaucgccaucaggguc

SEQ ID NO: 2997518 - RNA, 19 nt, Mycobacterium avium subsp. paratuberculosis
cagaucgcccaucaccgca

SEQ ID NO: 2997519 - RNA, 21 nt, Mycobacterium avium subsp. paratuberculosis
cagaucgcccaucaccgcacc

SEQ ID NO: 2997520 - RNA, 22 nt, Mycobacterium avium subsp. paratuberculosis
cagaucgcccaucaccgcaccg

SEQ ID NO: 2997521 - RNA, 14 nt, Mycobacterium avium subsp. paratuberculosis
cagaucgccccgcu

SEQ ID NO: 2997522 - RNA, 18 nt, Mycobacterium avium subsp. paratuberculosis
cagaucgcccgggcggcg

SEQ ID NO: 2997523 - RNA, 19 nt, Mycobacterium avium subsp. paratuberculosis
cagaucgcccgggcggcgg

SEQ ID NO: 2997524 - RNA, 22 nt, Mycobacterium avium subsp. paratuberculosis
cagaucgcccgggcggcggggc

SEQ ID NO: 2997525 - RNA, 13 nt, Mycobacterium avium subsp. paratuberculosis
cagaucgccuggc

SEQ ID NO: 2997526 - RNA, 14 nt, Mycobacterium avium subsp. paratuberculosis
cagaucgccuggca

SEQ ID NO: 2997527 - RNA, 16 nt, Mycobacterium avium subsp. paratuberculosis
cagaucgccuggcagc

SEQ ID NO: 2997528 - RNA, 22 nt, Mycobacterium avium subsp. paratuberculosis
cagaucgccuggcagcugccga

SEQ ID NO: 2997529 - RNA, 21 nt, Mycobacterium avium subsp. paratuberculosis
cagaucgcgcaucacccggcg

SEQ ID NO: 2997530 - RNA, 14 nt, Mycobacterium avium subsp. paratuberculosis
cagaucgcggcccg

SEQ ID NO: 2997531 - RNA, 20 nt, Mycobacterium avium subsp. paratuberculosis
cagaucggagacguccucgg

SEQ ID NO: 2997532 - RNA, 22 nt, Mycobacterium avium subsp. paratuberculosis
cagaucggagacguccucgguc

SEQ ID NO: 2997533 - RNA, 12 nt, Mycobacterium avium subsp. paratuberculosis
cagaucggccag

SEQ ID NO: 2997534 - RNA, 18 nt, Mycobacterium avium subsp. paratuberculosis
cagaucggccagcgcggc

SEQ ID NO: 2997535 - RNA, 14 nt, Mycobacterium avium subsp. paratuberculosis
cagaucggccaggu

SEQ ID NO: 2997536 - RNA, 14 nt, Mycobacterium avium subsp. paratuberculosis
cagaucggcgcgcg

SEQ ID NO: 2997537 - RNA, 18 nt, Mycobacterium avium subsp. paratuberculosis
cagaucggcgcgcggggu

SEQ ID NO: 2997538 - RNA, 13 nt, Mycobacterium avium subsp. paratuberculosis
cagaucggguccc

SEQ ID NO: 2997539 - RNA, 20 nt, Mycobacterium avium subsp. paratuberculosis
cagaucgggucccagaugcg

SEQ ID NO: 2997540 - RNA, 18 nt, Mycobacterium avium subsp. paratuberculosis
cagaucgggucgcccggg

SEQ ID NO: 2997541 - RNA, 20 nt, Mycobacterium avium subsp. paratuberculosis
cagaucguagggcucggcgu

SEQ ID NO: 2997542 - RNA, 14 nt, Mycobacterium avium subsp. paratuberculosis
cagaucguccaucg

SEQ ID NO: 2997543 - RNA, 19 nt, Mycobacterium avium subsp. paratuberculosis
cagaucguccaucgcgucg

SEQ ID NO: 2997544 - RNA, 21 nt, Mycobacterium avium subsp. paratuberculosis
cagaucgucgaacucgggccc

SEQ ID NO: 2997545 - RNA, 14 nt, Mycobacterium avium subsp. paratuberculosis
cagaucgucggcac

SEQ ID NO: 2997546 - RNA, 20 nt, Mycobacterium avium subsp. paratuberculosis
cagaucgucggcacugcccg

SEQ ID NO: 2997547 - RNA, 21 nt, Mycobacterium avium subsp. paratuberculosis
cagaucgucggcacugcccgc

SEQ ID NO: 2997548 - RNA, 21 nt, Mycobacterium avium subsp. paratuberculosis
cagaucgucucggccagccgg

SEQ ID NO: 2997549 - RNA, 22 nt, Mycobacterium avium subsp. paratuberculosis
cagaucuguauuaagcuggcag

SEQ ID NO: 2997550 - RNA, 13 nt, Mycobacterium avium subsp. paratuberculosis
cagaugcccagca

SEQ ID NO: 2997551 - RNA, 15 nt, Mycobacterium avium subsp. paratuberculosis
cagaugcccagcagg

SEQ ID NO: 2997552 - RNA, 17 nt, Mycobacterium avium subsp. paratuberculosis
cagaugcccgccccgcc

SEQ ID NO: 2997553 - RNA, 14 nt, Mycobacterium avium subsp. paratuberculosis
cagaugccgcccag

SEQ ID NO: 2997554 - RNA, 16 nt, Mycobacterium avium subsp. paratuberculosis
cagaugccgcccaggu

SEQ ID NO: 2997555 - RNA, 19 nt, Mycobacterium avium subsp. paratuberculosis
cagaugccgccgccagcgc

SEQ ID NO: 2997556 - RNA, 20 nt, Mycobacterium avium subsp. paratuberculosis
cagaugccgccgccagcgcg

SEQ ID NO: 2997557 - RNA, 16 nt, Mycobacterium avium subsp. paratuberculosis
cagaugccgcucggcg

SEQ ID NO: 2997558 - RNA, 17 nt, Mycobacterium avium subsp. paratuberculosis
cagaugccgcucggcgc

SEQ ID NO: 2997559 - RNA, 19 nt, Mycobacterium avium subsp. paratuberculosis
cagaugccgcucggcgcuc

SEQ ID NO: 2997560 - RNA, 13 nt, Mycobacterium avium subsp. paratuberculosis
cagaugccggcgu

SEQ ID NO: 2997561 - RNA, 18 nt, Mycobacterium avium subsp. paratuberculosis
cagaugccgggcuccgcg

SEQ ID NO: 2997562 - RNA, 16 nt, Mycobacterium avium subsp. paratuberculosis
cagaugccggugcaga

SEQ ID NO: 2997563 - RNA, 23 nt, Mycobacterium avium subsp. paratuberculosis
cagaugccguuccagggugucga

SEQ ID NO: 2997564 - RNA, 15 nt, Mycobacterium avium subsp. paratuberculosis
cagaugccugcccag

SEQ ID NO: 2997565 - RNA, 14 nt, Mycobacterium avium subsp. paratuberculosis
cagaugcgcgacgg

SEQ ID NO: 2997566 - RNA, 16 nt, Mycobacterium avium subsp. paratuberculosis
cagaugcgcgacggcc

SEQ ID NO: 2997567 - RNA, 18 nt, Mycobacterium avium subsp. paratuberculosis
cagaugcgcgacggccuc

SEQ ID NO: 2997568 - RNA, 15 nt, Mycobacterium avium subsp. paratuberculosis
cagaugcgcgucgcg

SEQ ID NO: 2997569 - RNA, 17 nt, Mycobacterium avium subsp. paratuberculosis
cagaugcgcgucgcggc

SEQ ID NO: 2997570 - RNA, 21 nt, Mycobacterium avium subsp. paratuberculosis
cagaugcgcgucgcggcgcgg

SEQ ID NO: 2997571 - RNA, 17 nt, Mycobacterium avium subsp. paratuberculosis
cagaugcggcaccagcc

SEQ ID NO: 2997572 - RNA, 22 nt, Mycobacterium avium subsp. paratuberculosis
cagaugcggcaccagcccgccg

SEQ ID NO: 2997573 - RNA, 23 nt, Mycobacterium avium subsp. paratuberculosis
cagaugcgugcgguggucggcgu

SEQ ID NO: 2997574 - RNA, 15 nt, Mycobacterium avium subsp. paratuberculosis
cagauggggaucgaa

SEQ ID NO: 2997575 - RNA, 15 nt, Mycobacterium avium subsp. paratuberculosis
cagauggucgccgac

SEQ ID NO: 2997576 - RNA, 18 nt, Mycobacterium avium subsp. paratuberculosis
cagauggucgccgacggu

SEQ ID NO: 2997577 - RNA, 23 nt, Mycobacterium avium subsp. paratuberculosis
cagauggucgggacgucggcgcg

SEQ ID NO: 2997578 - RNA, 12 nt, Mycobacterium avium subsp. paratuberculosis
cagauggugaag

SEQ ID NO: 2997579 - RNA, 20 nt, Mycobacterium avium subsp. paratuberculosis
cagauggugaaggugcccuc

SEQ ID NO: 2997580 - RNA, 21 nt, Mycobacterium avium subsp. paratuberculosis
cagauggugaaggugcccucc

SEQ ID NO: 2997581 - RNA, 22 nt, Mycobacterium avium subsp. paratuberculosis
cagauggugaaggugcccuccu

SEQ ID NO: 2997582 - RNA, 12 nt, Mycobacterium avium subsp. paratuberculosis
cagauugcggcc

SEQ ID NO: 2997583 - RNA, 23 nt, Mycobacterium avium subsp. paratuberculosis
cagauugcggcccuugcggccga

SEQ ID NO: 2997584 - RNA, 11 nt, Mycobacterium avium subsp. paratuberculosis
cagcaaaaccc

SEQ ID NO: 2997585 - RNA, 15 nt, Mycobacterium avium subsp. paratuberculosis
cagcaaacccagcac

SEQ ID NO: 2997586 - RNA, 19 nt, Mycobacterium avium subsp. paratuberculosis
cagcaaaccgaccgccgcg

SEQ ID NO: 2997587 - RNA, 21 nt, Mycobacterium avium subsp. paratuberculosis
cagcaaaccgaccgccgcggc

SEQ ID NO: 2997588 - RNA, 19 nt, Mycobacterium avium subsp. paratuberculosis
cagcaacaccuuucggccg

SEQ ID NO: 2997589 - RNA, 13 nt, Mycobacterium avium subsp. paratuberculosis
cagcaacagcagc

SEQ ID NO: 2997590 - RNA, 14 nt, Mycobacterium avium subsp. paratuberculosis
cagcaacagcagcg

SEQ ID NO: 2997591 - RNA, 22 nt, Mycobacterium avium subsp. paratuberculosis
cagcaacagcagcggcaugccc

SEQ ID NO: 2997592 - RNA, 22 nt, Mycobacterium avium subsp. paratuberculosis
cagcaacauccugguccggcgc

SEQ ID NO: 2997593 - RNA, 21 nt, Mycobacterium avium subsp. paratuberculosis
cagcaacaugauuccgccggg

SEQ ID NO: 2997594 - RNA, 22 nt, Mycobacterium avium subsp. paratuberculosis
cagcaacaugauuccgccgggc

SEQ ID NO: 2997595 - RNA, 21 nt, Mycobacterium avium subsp. paratuberculosis
cagcaaccccgcggugcacga

SEQ ID NO: 2997596 - RNA, 18 nt, Mycobacterium avium subsp. paratuberculosis
cagcaacccgaaagcccc

SEQ ID NO: 2997597 - RNA, 22 nt, Mycobacterium avium subsp. paratuberculosis
cagcaacccgaaagcccccagc

SEQ ID NO: 2997598 - RNA, 18 nt, Mycobacterium avium subsp. paratuberculosis
cagcaacccgccgagcgu

SEQ ID NO: 2997599 - RNA, 13 nt, Mycobacterium avium subsp. paratuberculosis
cagcaaccgccgu

SEQ ID NO: 2997600 - RNA, 16 nt, Mycobacterium avium subsp. paratuberculosis
cagcaaccgccguggc

SEQ ID NO: 2997601 - RNA, 22 nt, Mycobacterium avium subsp. paratuberculosis
cagcaaccgccguggcagggcc

SEQ ID NO: 2997602 - RNA, 23 nt, Mycobacterium avium subsp. paratuberculosis
cagcaaccgcgaaaacagcgacc

SEQ ID NO: 2997603 - RNA, 20 nt, Mycobacterium avium subsp. paratuberculosis
cagcaaccggaauggcagca

SEQ ID NO: 2997604 - RNA, 16 nt, Mycobacterium avium subsp. paratuberculosis
cagcaacgacccggcc

SEQ ID NO: 2997605 - RNA, 22 nt, Mycobacterium avium subsp. paratuberculosis
cagcaacgacccggccaccgcc

SEQ ID NO: 2997606 - RNA, 17 nt, Mycobacterium avium subsp. paratuberculosis
cagcaacgccagggccc

SEQ ID NO: 2997607 - RNA, 12 nt, Mycobacterium avium subsp. paratuberculosis
cagcaacgccga

SEQ ID NO: 2997608 - RNA, 14 nt, Mycobacterium avium subsp. paratuberculosis
cagcaacgccgaca

SEQ ID NO: 2997609 - RNA, 15 nt, Mycobacterium avium subsp. paratuberculosis
cagcaacgccgacau

SEQ ID NO: 2997610 - RNA, 15 nt, Mycobacterium avium subsp. paratuberculosis
cagcaacggcggcgg

SEQ ID NO: 2997611 - RNA, 21 nt, Mycobacterium avium subsp. paratuberculosis
cagcaacggcggcggcaccga

SEQ ID NO: 2997612 - RNA, 16 nt, Mycobacterium avium subsp. paratuberculosis
cagcaacuccaccucg

SEQ ID NO: 2997613 - RNA, 16 nt, Mycobacterium avium subsp. paratuberculosis
cagcaacucgcgcucc

SEQ ID NO: 2997614 - RNA, 14 nt, Mycobacterium avium subsp. paratuberculosis
cagcaacugaccga

SEQ ID NO: 2997615 - RNA, 17 nt, Mycobacterium avium subsp. paratuberculosis
cagcaacugcucgacca

SEQ ID NO: 2997616 - RNA, 19 nt, Mycobacterium avium subsp. paratuberculosis
cagcaacugcucgaccagc

SEQ ID NO: 2997617 - RNA, 22 nt, Mycobacterium avium subsp. paratuberculosis
cagcaacugcucgaccagcccc

SEQ ID NO: 2997618 - RNA, 15 nt, Mycobacterium avium subsp. paratuberculosis
cagcaauccgcugaa

SEQ ID NO: 2997619 - RNA, 20 nt, Mycobacterium avium subsp. paratuberculosis
cagcaauugacgccgacagc

SEQ ID NO: 2997620 - RNA, 22 nt, Mycobacterium avium subsp. paratuberculosis
cagcacaaaagggcccaugccg

SEQ ID NO: 2997621 - RNA, 17 nt, Mycobacterium avium subsp. paratuberculosis
cagcacaacgccuccga

SEQ ID NO: 2997622 - RNA, 13 nt, Mycobacterium avium subsp. paratuberculosis
cagcacaccggca

SEQ ID NO: 2997623 - RNA, 23 nt, Mycobacterium avium subsp. paratuberculosis
cagcacaccggcauucguguggc

SEQ ID NO: 2997624 - RNA, 16 nt, Mycobacterium avium subsp. paratuberculosis
cagcacagccgucgca

SEQ ID NO: 2997625 - RNA, 17 nt, Mycobacterium avium subsp. paratuberculosis
cagcacagcgaggcgac

SEQ ID NO: 2997626 - RNA, 22 nt, Mycobacterium avium subsp. paratuberculosis
cagcacagcgaggcgacgucga

SEQ ID NO: 2997627 - RNA, 23 nt, Mycobacterium avium subsp. paratuberculosis
cagcacauccgguugcaccgcga

SEQ ID NO: 2997628 - RNA, 16 nt, Mycobacterium avium subsp. paratuberculosis
cagcaccaacagcggc

SEQ ID NO: 2997629 - RNA, 11 nt, Mycobacterium avium subsp. paratuberculosis
cagcaccacca

SEQ ID NO: 2997630 - RNA, 13 nt, Mycobacterium avium subsp. paratuberculosis
cagcaccaccaac

SEQ ID NO: 2997631 - RNA, 15 nt, Mycobacterium avium subsp. paratuberculosis
cagcaccaccaacag

SEQ ID NO: 2997632 - RNA, 17 nt, Mycobacterium avium subsp. paratuberculosis
cagcaccaccaacagca

SEQ ID NO: 2997633 - RNA, 20 nt, Mycobacterium avium subsp. paratuberculosis
cagcaccaccaacagcagcg

SEQ ID NO: 2997634 - RNA, 21 nt, Mycobacterium avium subsp. paratuberculosis
cagcaccaccaacagcagcga

SEQ ID NO: 2997635 - RNA, 24 nt, Mycobacterium avium subsp. paratuberculosis
cagcaccaccaacagcagcgaggc

SEQ ID NO: 2997636 - RNA, 12 nt, Mycobacterium avium subsp. paratuberculosis
cagcaccaccac

SEQ ID NO: 2997637 - RNA, 14 nt, Mycobacterium avium subsp. paratuberculosis
cagcaccaccacgc

SEQ ID NO: 2997638 - RNA, 19 nt, Mycobacterium avium subsp. paratuberculosis
cagcaccaccacgcuggcc

SEQ ID NO: 2997639 - RNA, 22 nt, Mycobacterium avium subsp. paratuberculosis
cagcaccaccacgcuggccccg

SEQ ID NO: 2997640 - RNA, 17 nt, Mycobacterium avium subsp. paratuberculosis
cagcaccaccacguugc

SEQ ID NO: 2997641 - RNA, 16 nt, Mycobacterium avium subsp. paratuberculosis
cagcaccaccaggucu

SEQ ID NO: 2997642 - RNA, 22 nt, Mycobacterium avium subsp. paratuberculosis
cagcaccaccaggucuccgucg

SEQ ID NO: 2997643 - RNA, 14 nt, Mycobacterium avium subsp. paratuberculosis
cagcaccacccgca

SEQ ID NO: 2997644 - RNA, 20 nt, Mycobacterium avium subsp. paratuberculosis
cagcaccacccggucgaugu

SEQ ID NO: 2997645 - RNA, 14 nt, Mycobacterium avium subsp. paratuberculosis
cagcaccaccgcga

SEQ ID NO: 2997646 - RNA, 16 nt, Mycobacterium avium subsp. paratuberculosis
cagcaccaccgcgagc

SEQ ID NO: 2997647 - RNA, 17 nt, Mycobacterium avium subsp. paratuberculosis
cagcaccaccgcgagcg

SEQ ID NO: 2997648 - RNA, 12 nt, Mycobacterium avium subsp. paratuberculosis
cagcaccaccgu

SEQ ID NO: 2997649 - RNA, 13 nt, Mycobacterium avium subsp. paratuberculosis
cagcaccaccguc

SEQ ID NO: 2997650 - RNA, 20 nt, Mycobacterium avium subsp. paratuberculosis
cagcaccaccgucaccgccg

SEQ ID NO: 2997651 - RNA, 22 nt, Mycobacterium avium subsp. paratuberculosis
cagcaccaccgucaccgccgca

SEQ ID NO: 2997652 - RNA, 16 nt, Mycobacterium avium subsp. paratuberculosis
cagcaccaccguggcg

SEQ ID NO: 2997653 - RNA, 13 nt, Mycobacterium avium subsp. paratuberculosis
cagcaccaccucg

SEQ ID NO: 2997654 - RNA, 21 nt, Mycobacterium avium subsp. paratuberculosis
cagcaccaccuugucaccgaa

SEQ ID NO: 2997655 - RNA, 19 nt, Mycobacterium avium subsp. paratuberculosis
cagcaccacgaacgcugcc

SEQ ID NO: 2997656 - RNA, 14 nt, Mycobacterium avium subsp. paratuberculosis
cagcaccacgguga

SEQ ID NO: 2997657 - RNA, 15 nt, Mycobacterium avium subsp. paratuberculosis
cagcaccacggugau

SEQ ID NO: 2997658 - RNA, 16 nt, Mycobacterium avium subsp. paratuberculosis
cagcaccacguccgcg

SEQ ID NO: 2997659 - RNA, 14 nt, Mycobacterium avium subsp. paratuberculosis
cagcaccacguugc

SEQ ID NO: 2997660 - RNA, 22 nt, Mycobacterium avium subsp. paratuberculosis
cagcaccacuuccagcaccggc

SEQ ID NO: 2997661 - RNA, 24 nt, Mycobacterium avium subsp. paratuberculosis
cagcaccacuuccagcaccggcug

SEQ ID NO: 2997662 - RNA, 13 nt, Mycobacterium avium subsp. paratuberculosis
cagcaccagcacc

SEQ ID NO: 2997663 - RNA, 14 nt, Mycobacterium avium subsp. paratuberculosis
cagcaccagcacca

SEQ ID NO: 2997664 - RNA, 14 nt, Mycobacterium avium subsp. paratuberculosis
cagcaccagcacgg

SEQ ID NO: 2997665 - RNA, 17 nt, Mycobacterium avium subsp. paratuberculosis
cagcaccagcacggcga

SEQ ID NO: 2997666 - RNA, 12 nt, Mycobacterium avium subsp. paratuberculosis
cagcaccagccc

SEQ ID NO: 2997667 - RNA, 18 nt, Mycobacterium avium subsp. paratuberculosis
cagcaccagcccgaugcc

SEQ ID NO: 2997668 - RNA, 12 nt, Mycobacterium avium subsp. paratuberculosis
cagcaccagcgc

SEQ ID NO: 2997669 - RNA, 15 nt, Mycobacterium avium subsp. paratuberculosis
cagcaccagcgccgc

SEQ ID NO: 2997670 - RNA, 16 nt, Mycobacterium avium subsp. paratuberculosis
cagcaccagcgccgcg

SEQ ID NO: 2997671 - RNA, 17 nt, Mycobacterium avium subsp. paratuberculosis
cagcaccagcgccgcga

SEQ ID NO: 2997672 - RNA, 14 nt, Mycobacterium avium subsp. paratuberculosis
cagcaccagcgcgc

SEQ ID NO: 2997673 - RNA, 13 nt, Mycobacterium avium subsp. paratuberculosis
cagcaccagcggc

SEQ ID NO: 2997674 - RNA, 14 nt, Mycobacterium avium subsp. paratuberculosis
cagcaccagcggca

SEQ ID NO: 2997675 - RNA, 16 nt, Mycobacterium avium subsp. paratuberculosis
cagcaccagcggcacc

SEQ ID NO: 2997676 - RNA, 17 nt, Mycobacterium avium subsp. paratuberculosis
cagcaccagcggcacca

SEQ ID NO: 2997677 - RNA, 22 nt, Mycobacterium avium subsp. paratuberculosis
cagcaccagcguggccggcagg

SEQ ID NO: 2997678 - RNA, 13 nt, Mycobacterium avium subsp. paratuberculosis
cagcaccaggccc

SEQ ID NO: 2997679 - RNA, 23 nt, Mycobacterium avium subsp. paratuberculosis
cagcaccaggcccuccuggguga

SEQ ID NO: 2997680 - RNA, 20 nt, Mycobacterium avium subsp. paratuberculosis
cagcaccaggcccucgccgc

SEQ ID NO: 2997681 - RNA, 12 nt, Mycobacterium avium subsp. paratuberculosis
cagcaccaggcg

SEQ ID NO: 2997682 - RNA, 20 nt, Mycobacterium avium subsp. paratuberculosis
cagcaccaggcugaccagcg

SEQ ID NO: 2997683 - RNA, 16 nt, Mycobacterium avium subsp. paratuberculosis
cagcaccagggcgugu

SEQ ID NO: 2997684 - RNA, 13 nt, Mycobacterium avium subsp. paratuberculosis
cagcaccaggugg

SEQ ID NO: 2997685 - RNA, 22 nt, Mycobacterium avium subsp. paratuberculosis
cagcaccagguggcccgacccg

SEQ ID NO: 2997686 - RNA, 19 nt, Mycobacterium avium subsp. paratuberculosis
cagcaccaguugcaccggc

SEQ ID NO: 2997687 - RNA, 21 nt, Mycobacterium avium subsp. paratuberculosis
cagcaccaguugcaccggcac

SEQ ID NO: 2997688 - RNA, 16 nt, Mycobacterium avium subsp. paratuberculosis
cagcaccauccgcgcg

SEQ ID NO: 2997689 - RNA, 19 nt, Mycobacterium avium subsp. paratuberculosis
cagcaccaugaucaggccc

SEQ ID NO: 2997690 - RNA, 14 nt, Mycobacterium avium subsp. paratuberculosis
cagcacccagaugc

SEQ ID NO: 2997691 - RNA, 15 nt, Mycobacterium avium subsp. paratuberculosis
cagcacccagcacag

SEQ ID NO: 2997692 - RNA, 17 nt, Mycobacterium avium subsp. paratuberculosis
cagcacccagcacagcg

SEQ ID NO: 2997693 - RNA, 23 nt, Mycobacterium avium subsp. paratuberculosis
cagcacccccucggcgccggugg

SEQ ID NO: 2997694 - RNA, 22 nt, Mycobacterium avium subsp. paratuberculosis
cagcaccccgaucgcgaucacc

SEQ ID NO: 2997695 - RNA, 14 nt, Mycobacterium avium subsp. paratuberculosis
cagcaccccgccgc

SEQ ID NO: 2997696 - RNA, 15 nt, Mycobacterium avium subsp. paratuberculosis
cagcaccccgccgca

SEQ ID NO: 2997697 - RNA, 17 nt, Mycobacterium avium subsp. paratuberculosis
cagcaccccgccgcagc

SEQ ID NO: 2997698 - RNA, 18 nt, Mycobacterium avium subsp. paratuberculosis
cagcaccccgccgcagcc

SEQ ID NO: 2997699 - RNA, 21 nt, Mycobacterium avium subsp. paratuberculosis
cagcaccccgccgcagcccag

SEQ ID NO: 2997700 - RNA, 19 nt, Mycobacterium avium subsp. paratuberculosis
cagcaccccgucgagguuc

SEQ ID NO: 2997701 - RNA, 16 nt, Mycobacterium avium subsp. paratuberculosis
cagcacccgacuucgg

SEQ ID NO: 2997702 - RNA, 19 nt, Mycobacterium avium subsp. paratuberculosis
cagcacccgacuucggcuc

SEQ ID NO: 2997703 - RNA, 20 nt, Mycobacterium avium subsp. paratuberculosis
cagcacccgacuucggcucg

SEQ ID NO: 2997704 - RNA, 21 nt, Mycobacterium avium subsp. paratuberculosis
cagcacccgcaacgcgcgcga

SEQ ID NO: 2997705 - RNA, 23 nt, Mycobacterium avium subsp. paratuberculosis
cagcacccgcaacgcgcgcgacg

SEQ ID NO: 2997706 - RNA, 13 nt, Mycobacterium avium subsp. paratuberculosis
cagcacccgcacc

SEQ ID NO: 2997707 - RNA, 14 nt, Mycobacterium avium subsp. paratuberculosis
cagcacccgcagcc

SEQ ID NO: 2997708 - RNA, 19 nt, Mycobacterium avium subsp. paratuberculosis
cagcacccgcucgccgaug

SEQ ID NO: 2997709 - RNA, 20 nt, Mycobacterium avium subsp. paratuberculosis
cagcacccgcucgcgggccc

SEQ ID NO: 2997710 - RNA, 16 nt, Mycobacterium avium subsp. paratuberculosis
cagcacccgcugcagc

SEQ ID NO: 2997711 - RNA, 17 nt, Mycobacterium avium subsp. paratuberculosis
cagcacccgcugcagcc

SEQ ID NO: 2997712 - RNA, 20 nt, Mycobacterium avium subsp. paratuberculosis
cagcacccgcugcagccggu

SEQ ID NO: 2997713 - RNA, 13 nt, Mycobacterium avium subsp. paratuberculosis
cagcacccggccc

SEQ ID NO: 2997714 - RNA, 22 nt, Mycobacterium avium subsp. paratuberculosis
cagcacccggcccacgccgucg

SEQ ID NO: 2997715 - RNA, 15 nt, Mycobacterium avium subsp. paratuberculosis
cagcacccggccccc

SEQ ID NO: 2997716 - RNA, 16 nt, Mycobacterium avium subsp. paratuberculosis
cagcacccgggccugc

SEQ ID NO: 2997717 - RNA, 17 nt, Mycobacterium avium subsp. paratuberculosis
cagcacccgggccuugu

SEQ ID NO: 2997718 - RNA, 14 nt, Mycobacterium avium subsp. paratuberculosis
cagcacccggguga

SEQ ID NO: 2997719 - RNA, 22 nt, Mycobacterium avium subsp. paratuberculosis
cagcacccggucggugagcugg

SEQ ID NO: 2997720 - RNA, 14 nt, Mycobacterium avium subsp. paratuberculosis
cagcaccgaaccgg

SEQ ID NO: 2997721 - RNA, 20 nt, Mycobacterium avium subsp. paratuberculosis
cagcaccgaaccggcggggu

SEQ ID NO: 2997722 - RNA, 12 nt, Mycobacterium avium subsp. paratuberculosis
cagcaccgacgc

SEQ ID NO: 2997723 - RNA, 13 nt, Mycobacterium avium subsp. paratuberculosis
cagcaccgagauc

SEQ ID NO: 2997724 - RNA, 20 nt, Mycobacterium avium subsp. paratuberculosis
cagcaccgagaucucgucga

SEQ ID NO: 2997725 - RNA, 15 nt, Mycobacterium avium subsp. paratuberculosis
cagcaccgaugccag

SEQ ID NO: 2997726 - RNA, 11 nt, Mycobacterium avium subsp. paratuberculosis
cagcaccgcca

SEQ ID NO: 2997727 - RNA, 19 nt, Mycobacterium avium subsp. paratuberculosis
cagcaccgccacgccguug

SEQ ID NO: 2997728 - RNA, 16 nt, Mycobacterium avium subsp. paratuberculosis
cagcaccgccacggcg

SEQ ID NO: 2997729 - RNA, 17 nt, Mycobacterium avium subsp. paratuberculosis
cagcaccgccacggcga

SEQ ID NO: 2997730 - RNA, 16 nt, Mycobacterium avium subsp. paratuberculosis
cagcaccucgucgccc

SEQ ID NO: 2997731 - RNA, 20 nt, Mycobacterium avium subsp. paratuberculosis
cagcaccucgucgcccggcg

SEQ ID NO: 2997732 - RNA, 23 nt, Mycobacterium avium subsp. paratuberculosis
cagcaccucgucgcccggcgucc

SEQ ID NO: 2997733 - RNA, 23 nt, Mycobacterium avium subsp. paratuberculosis
cagcaccugcucgaugcgcgcca

SEQ ID NO: 2997734 - RNA, 17 nt, Mycobacterium avium subsp. paratuberculosis
cagcaccuggcgcaccg

SEQ ID NO: 2997735 - RNA, 14 nt, Mycobacterium avium subsp. paratuberculosis
cagcaccuucagcg

SEQ ID NO: 2997736 - RNA, 19 nt, Mycobacterium avium subsp. paratuberculosis
cagcaccuucagcgggcgc

SEQ ID NO: 2997737 - RNA, 20 nt, Mycobacterium avium subsp. paratuberculosis
cagcaccuucagcgggcgca

SEQ ID NO: 2997738 - RNA, 17 nt, Mycobacterium avium subsp. paratuberculosis
cagcaccuucgggccga

SEQ ID NO: 2997739 - RNA, 19 nt, Mycobacterium avium subsp. paratuberculosis
cagcaccuugcccaggugc

SEQ ID NO: 2997740 - RNA, 16 nt, Mycobacterium avium subsp. paratuberculosis
cagcaccuugccgguc

SEQ ID NO: 2997741 - RNA, 16 nt, Mycobacterium avium subsp. paratuberculosis
cagcacgaacaccacg

SEQ ID NO: 2997742 - RNA, 17 nt, Mycobacterium avium subsp. paratuberculosis
cagcacgaacaccacgu

SEQ ID NO: 2997743 - RNA, 17 nt, Mycobacterium avium subsp. paratuberculosis
cagcacgaacagcagcg

SEQ ID NO: 2997744 - RNA, 23 nt, Mycobacterium avium subsp. paratuberculosis
cagcacgacaccgacgaccauca

SEQ ID NO: 2997745 - RNA, 15 nt, Mycobacterium avium subsp. paratuberculosis
cagcacgaccccgcc

SEQ ID NO: 2997746 - RNA, 18 nt, Mycobacterium avium subsp. paratuberculosis
cagcacgaccccgcccac

SEQ ID NO: 2997747 - RNA, 19 nt, Mycobacterium avium subsp. paratuberculosis
cagcacgaucccgccgccc

SEQ ID NO: 2997748 - RNA, 20 nt, Mycobacterium avium subsp. paratuberculosis
cagcacgaucccgccgcccg

SEQ ID NO: 2997749 - RNA, 23 nt, Mycobacterium avium subsp. paratuberculosis
cagcacgaucggguagacgucgg

SEQ ID NO: 2997750 - RNA, 17 nt, Mycobacterium avium subsp. paratuberculosis
cagcacgaugaucccga

SEQ ID NO: 2997751 - RNA, 22 nt, Mycobacterium avium subsp. paratuberculosis
cagcacgaugaucccgaggaug

SEQ ID NO: 2997752 - RNA, 23 nt, Mycobacterium avium subsp. paratuberculosis
cagcacgaugaucccgaggaugc

SEQ ID NO: 2997753 - RNA, 23 nt, Mycobacterium avium subsp. paratuberculosis
cagcacgcccagaucgacgccga

SEQ ID NO: 2997754 - RNA, 20 nt, Mycobacterium avium subsp. paratuberculosis
cagcacgcccagaucgccga

SEQ ID NO: 2997755 - RNA, 16 nt, Mycobacterium avium subsp. paratuberculosis
cagcacgcccagaugc

SEQ ID NO: 2997756 - RNA, 22 nt, Mycobacterium avium subsp. paratuberculosis
cagcacgcccagaugcaggcuc

SEQ ID NO: 2997757 - RNA, 18 nt, Mycobacterium avium subsp. paratuberculosis
cagcacgcccccgcuggc

SEQ ID NO: 2997758 - RNA, 20 nt, Mycobacterium avium subsp. paratuberculosis
cagcacgcccccgcuggccc

SEQ ID NO: 2997759 - RNA, 14 nt, Mycobacterium avium subsp. paratuberculosis
cagcacgcccucgu

SEQ ID NO: 2997760 - RNA, 20 nt, Mycobacterium avium subsp. paratuberculosis
cagcacgcccuggaaggcga

SEQ ID NO: 2997761 - RNA, 14 nt, Mycobacterium avium subsp. paratuberculosis
cagcacgccgcgga

SEQ ID NO: 2997762 - RNA, 14 nt, Mycobacterium avium subsp. paratuberculosis
cagcacgccggccg

SEQ ID NO: 2997763 - RNA, 15 nt, Mycobacterium avium subsp. paratuberculosis
cagcacgccggccgg

SEQ ID NO: 2997764 - RNA, 16 nt, Mycobacterium avium subsp. paratuberculosis
cagcacgccggccggc

SEQ ID NO: 2997765 - RNA, 17 nt, Mycobacterium avium subsp. paratuberculosis
cagcacgccggccggcg

SEQ ID NO: 2997766 - RNA, 18 nt, Mycobacterium avium subsp. paratuberculosis
cagcacgccggccggcgu

SEQ ID NO: 2997767 - RNA, 13 nt, Mycobacterium avium subsp. paratuberculosis
cagcacgccgggc

SEQ ID NO: 2997768 - RNA, 16 nt, Mycobacterium avium subsp. paratuberculosis
cagcacgccgggcaug

SEQ ID NO: 2997769 - RNA, 19 nt, Mycobacterium avium subsp. paratuberculosis
cagcacgccgggcaugccg

SEQ ID NO: 2997770 - RNA, 13 nt, Mycobacterium avium subsp. paratuberculosis
cagcacgccgguc

SEQ ID NO: 2997771 - RNA, 23 nt, Mycobacterium avium subsp. paratuberculosis
cagcacgccguugaccccgacgg

SEQ ID NO: 2997772 - RNA, 23 nt, Mycobacterium avium subsp. paratuberculosis
cagcacgccuuccacgaccuggc

SEQ ID NO: 2997773 - RNA, 22 nt, Mycobacterium avium subsp. paratuberculosis
cagcacgcggaucgcgcugacc

SEQ ID NO: 2997774 - RNA, 19 nt, Mycobacterium avium subsp. paratuberculosis
cagcacgcugaagcccacc

SEQ ID NO: 2997775 - RNA, 20 nt, Mycobacterium avium subsp. paratuberculosis
cagcacgcugaagcccaccg

SEQ ID NO: 2997776 - RNA, 21 nt, Mycobacterium avium subsp. paratuberculosis
cagcacgcugaagcccaccgc

SEQ ID NO: 2997777 - RNA, 23 nt, Mycobacterium avium subsp. paratuberculosis
cagcacgcugaucaccacgguca

SEQ ID NO: 2997778 - RNA, 17 nt, Mycobacterium avium subsp. paratuberculosis
cagcacggcaucgaugg

SEQ ID NO: 2997779 - RNA, 20 nt, Mycobacterium avium subsp. paratuberculosis
cagcacggcaucgauggcgg

SEQ ID NO: 2997780 - RNA, 13 nt, Mycobacterium avium subsp. paratuberculosis
cagcacggccacc

SEQ ID NO: 2997781 - RNA, 19 nt, Mycobacterium avium subsp. paratuberculosis
cagcacggccaccagcagc

SEQ ID NO: 2997782 - RNA, 14 nt, Mycobacterium avium subsp. paratuberculosis
cagcacggccacug

SEQ ID NO: 2997783 - RNA, 23 nt, Mycobacterium avium subsp. paratuberculosis
cagcacggccacugccccggcga

SEQ ID NO: 2997784 - RNA, 14 nt, Mycobacterium avium subsp. paratuberculosis
cagcacggccgcca

SEQ ID NO: 2997785 - RNA, 16 nt, Mycobacterium avium subsp. paratuberculosis
cagcacggccgccagg

SEQ ID NO: 2997786 - RNA, 14 nt, Mycobacterium avium subsp. paratuberculosis
cagcacggccgcgg

SEQ ID NO: 2997787 - RNA, 16 nt, Mycobacterium avium subsp. paratuberculosis
cagcacggccgcggcc

SEQ ID NO: 2997788 - RNA, 19 nt, Mycobacterium avium subsp. paratuberculosis
cagcacggccgcggccagc

SEQ ID NO: 2997789 - RNA, 16 nt, Mycobacterium avium subsp. paratuberculosis
cagcacggcgaccagc

SEQ ID NO: 2997790 - RNA, 17 nt, Mycobacterium avium subsp. paratuberculosis
cagcacggcgaccagcg

SEQ ID NO: 2997791 - RNA, 15 nt, Mycobacterium avium subsp. paratuberculosis
cagcacggcggcgcu

SEQ ID NO: 2997792 - RNA, 14 nt, Mycobacterium avium subsp. paratuberculosis
cagcacggcggcgu

SEQ ID NO: 2997793 - RNA, 15 nt, Mycobacterium avium subsp. paratuberculosis
cagcacggcggcgug

SEQ ID NO: 2997794 - RNA, 17 nt, Mycobacterium avium subsp. paratuberculosis
cagcacggcggcgugca

SEQ ID NO: 2997795 - RNA, 14 nt, Mycobacterium avium subsp. paratuberculosis
cagcacgggcgggc

SEQ ID NO: 2997796 - RNA, 15 nt, Mycobacterium avium subsp. paratuberculosis
cagcacgggcgggca

SEQ ID NO: 2997797 - RNA, 14 nt, Mycobacterium avium subsp. paratuberculosis
cagcacggggacgc

SEQ ID NO: 2997798 - RNA, 15 nt, Mycobacterium avium subsp. paratuberculosis
cagcacggucagcgg

SEQ ID NO: 2997799 - RNA, 16 nt, Mycobacterium avium subsp. paratuberculosis
cagcacggucagcggc

SEQ ID NO: 2997800 - RNA, 17 nt, Mycobacterium avium subsp. paratuberculosis
cagcacggucagcggcc

SEQ ID NO: 2997801 - RNA, 18 nt, Mycobacterium avium subsp. paratuberculosis
cagcacggucagcggcca

SEQ ID NO: 2997802 - RNA, 23 nt, Mycobacterium avium subsp. paratuberculosis
cagcacggucagcggccagccca

SEQ ID NO: 2997803 - RNA, 19 nt, Mycobacterium avium subsp. paratuberculosis
cagcacggugaugcgggug

SEQ ID NO: 2997804 - RNA, 16 nt, Mycobacterium avium subsp. paratuberculosis
cagcacgucaccgcug

SEQ ID NO: 2997805 - RNA, 15 nt, Mycobacterium avium subsp. paratuberculosis
cagcacguccccggg

SEQ ID NO: 2997806 - RNA, 17 nt, Mycobacterium avium subsp. paratuberculosis
cagcacguccccgggca

SEQ ID NO: 2997807 - RNA, 22 nt, Mycobacterium avium subsp. paratuberculosis
cagcacgucgcggcccuggaug

SEQ ID NO: 2997808 - RNA, 13 nt, Mycobacterium avium subsp. paratuberculosis
cagcacgucgggg

SEQ ID NO: 2997809 - RNA, 23 nt, Mycobacterium avium subsp. paratuberculosis
cagcacgucgggguggccggcca

SEQ ID NO: 2997810 - RNA, 19 nt, Mycobacterium avium subsp. paratuberculosis
cagcacgugcccagcccgc

SEQ ID NO: 2997811 - RNA, 21 nt, Mycobacterium avium subsp. paratuberculosis
cagcacgugcccagcccgcgc

SEQ ID NO: 2997812 - RNA, 16 nt, Mycobacterium avium subsp. paratuberculosis
cagcacgugcccgccg

SEQ ID NO: 2997813 - RNA, 20 nt, Mycobacterium avium subsp. paratuberculosis
cagcacgugcccgccgugcg

SEQ ID NO: 2997814 - RNA, 16 nt, Mycobacterium avium subsp. paratuberculosis
cagcacguggccgggc

SEQ ID NO: 2997815 - RNA, 21 nt, Mycobacterium avium subsp. paratuberculosis
cagcacguugucgcccgggua

SEQ ID NO: 2997816 - RNA, 17 nt, Mycobacterium avium subsp. paratuberculosis
cagcacguugugcucgu

SEQ ID NO: 2997817 - RNA, 20 nt, Mycobacterium avium subsp. paratuberculosis
cagcacguugugcucgucga

SEQ ID NO: 2997818 - RNA, 17 nt, Mycobacterium avium subsp. paratuberculosis
cagcacguugugggcgg

SEQ ID NO: 2997819 - RNA, 23 nt, Mycobacterium avium subsp. paratuberculosis
cagcacguugugggcgggcgcgu

SEQ ID NO: 2997820 - RNA, 19 nt, Mycobacterium avium subsp. paratuberculosis
cagcacguuguucaggucg

SEQ ID NO: 2997821 - RNA, 21 nt, Mycobacterium avium subsp. paratuberculosis
cagcacguuguucaggucgau

SEQ ID NO: 2997822 - RNA, 18 nt, Mycobacterium avium subsp. paratuberculosis
cagcacuucauggucguc

SEQ ID NO: 2997823 - RNA, 22 nt, Mycobacterium avium subsp. paratuberculosis
cagcacuucauggucgucgucg

SEQ ID NO: 2997824 - RNA, 21 nt, Mycobacterium avium subsp. paratuberculosis
cagcagaaaauagcccagcca

SEQ ID NO: 2997825 - RNA, 22 nt, Mycobacterium avium subsp. paratuberculosis
cagcagaaaauagcccagccag

SEQ ID NO: 2997826 - RNA, 15 nt, Mycobacterium avium subsp. paratuberculosis
cagcagaaccagcac

SEQ ID NO: 2997827 - RNA, 18 nt, Mycobacterium avium subsp. paratuberculosis
cagcagaaccagcaccgc

SEQ ID NO: 2997828 - RNA, 19 nt, Mycobacterium avium subsp. paratuberculosis
cagcagaaccagcaccgcc

SEQ ID NO: 2997829 - RNA, 15 nt, Mycobacterium avium subsp. paratuberculosis
cagcagacccgacgg

SEQ ID NO: 2997830 - RNA, 13 nt, Mycobacterium avium subsp. paratuberculosis
cagcagaccgccg

SEQ ID NO: 2997831 - RNA, 21 nt, Mycobacterium avium subsp. paratuberculosis
cagcagaccgccggugcgcag

SEQ ID NO: 2997832 - RNA, 16 nt, Mycobacterium avium subsp. paratuberculosis
cagcagauagcccagc

SEQ ID NO: 2997833 - RNA, 22 nt, Mycobacterium avium subsp. paratuberculosis
cagcagauagcccagccagccg

SEQ ID NO: 2997834 - RNA, 14 nt, Mycobacterium avium subsp. paratuberculosis
cagcagaucggcgu

SEQ ID NO: 2997835 - RNA, 15 nt, Mycobacterium avium subsp. paratuberculosis
cagcagaucggcguc

SEQ ID NO: 2997836 - RNA, 11 nt, Mycobacterium avium subsp. paratuberculosis
cagcagaugcc

SEQ ID NO: 2997837 - RNA, 15 nt, Mycobacterium avium subsp. paratuberculosis
cagcagaugccgccc

SEQ ID NO: 2997838 - RNA, 17 nt, Mycobacterium avium subsp. paratuberculosis
cagcagaugccgcccag

SEQ ID NO: 2997839 - RNA, 13 nt, Mycobacterium avium subsp. paratuberculosis
cagcagaugcgcc

SEQ ID NO: 2997840 - RNA, 17 nt, Mycobacterium avium subsp. paratuberculosis
cagcagaugcgccucga

SEQ ID NO: 2997841 - RNA, 19 nt, Mycobacterium avium subsp. paratuberculosis
cagcagaugcgccucgauc

SEQ ID NO: 2997842 - RNA, 16 nt, Mycobacterium avium subsp. paratuberculosis
cagcagaugcgcgucg

SEQ ID NO: 2997843 - RNA, 17 nt, Mycobacterium avium subsp. paratuberculosis
cagcagaugcgcgucgc

SEQ ID NO: 2997844 - RNA, 18 nt, Mycobacterium avium subsp. paratuberculosis
cagcagaugcgugcggug

SEQ ID NO: 2997845 - RNA, 21 nt, Mycobacterium avium subsp. paratuberculosis
cagcagcaacgcgguguuggc

SEQ ID NO: 2997846 - RNA, 12 nt, Mycobacterium avium subsp. paratuberculosis
cagcagcaccag

SEQ ID NO: 2997847 - RNA, 13 nt, Mycobacterium avium subsp. paratuberculosis
cagcagcaccaga

SEQ ID NO: 2997848 - RNA, 14 nt, Mycobacterium avium subsp. paratuberculosis
cagcagcaccagcg

SEQ ID NO: 2997849 - RNA, 16 nt, Mycobacterium avium subsp. paratuberculosis
cagcagcaccagcgcc

SEQ ID NO: 2997850 - RNA, 17 nt, Mycobacterium avium subsp. paratuberculosis
cagcagcaccagcgccg

SEQ ID NO: 2997851 - RNA, 18 nt, Mycobacterium avium subsp. paratuberculosis
cagcagcaccagcgccgc

SEQ ID NO: 2997852 - RNA, 14 nt, Mycobacterium avium subsp. paratuberculosis
cagcagcaccaggg

SEQ ID NO: 2997853 - RNA, 11 nt, Mycobacterium avium subsp. paratuberculosis
cagcagcaccc

SEQ ID NO: 2997854 - RNA, 15 nt, Mycobacterium avium subsp. paratuberculosis
cagcagcaccccgau

SEQ ID NO: 2997855 - RNA, 16 nt, Mycobacterium avium subsp. paratuberculosis
cagcagcaccccgauc

SEQ ID NO: 2997856 - RNA, 23 nt, Mycobacterium avium subsp. paratuberculosis
cagcagcaccccgaucgcgauca

SEQ ID NO: 2997857 - RNA, 17 nt, Mycobacterium avium subsp. paratuberculosis
cagcagcacccggguga

SEQ ID NO: 2997858 - RNA, 15 nt, Mycobacterium avium subsp. paratuberculosis
cagcagcaccgcaug

SEQ ID NO: 2997859 - RNA, 15 nt, Mycobacterium avium subsp. paratuberculosis
cagcagcaccgcgac

SEQ ID NO: 2997860 - RNA, 20 nt, Mycobacterium avium subsp. paratuberculosis
cagcagcaccgcgaccgguc

SEQ ID NO: 2997861 - RNA, 22 nt, Mycobacterium avium subsp. paratuberculosis
cagcagcaccgcgaccgguccg

SEQ ID NO: 2997862 - RNA, 14 nt, Mycobacterium avium subsp. paratuberculosis
cagcagcaccggca

SEQ ID NO: 2997863 - RNA, 15 nt, Mycobacterium avium subsp. paratuberculosis
cagcagcaccggcac

SEQ ID NO: 2997864 - RNA, 11 nt, Mycobacterium avium subsp. paratuberculosis
cagcagcaccu

SEQ ID NO: 2997865 - RNA, 14 nt, Mycobacterium avium subsp. paratuberculosis
cagcagcaccugga

SEQ ID NO: 2997866 - RNA, 14 nt, Mycobacterium avium subsp. paratuberculosis
cagcagcacgccca

SEQ ID NO: 2997867 - RNA, 16 nt, Mycobacterium avium subsp. paratuberculosis
cagcagcacgcccagc

SEQ ID NO: 2997868 - RNA, 22 nt, Mycobacterium avium subsp. paratuberculosis
cagcagcacgcccagcccgcgg

SEQ ID NO: 2997869 - RNA, 14 nt, Mycobacterium avium subsp. paratuberculosis
cagcagcacguugu

SEQ ID NO: 2997870 - RNA, 16 nt, Mycobacterium avium subsp. paratuberculosis
cagcagcagaaccagc

SEQ ID NO: 2997871 - RNA, 17 nt, Mycobacterium avium subsp. paratuberculosis
cagcagcagaaccagca

SEQ ID NO: 2997872 - RNA, 16 nt, Mycobacterium avium subsp. paratuberculosis
cagcagcagcaccagg

SEQ ID NO: 2997873 - RNA, 13 nt, Mycobacterium avium subsp. paratuberculosis
cagcagcagcagc

SEQ ID NO: 2997874 - RNA, 17 nt, Mycobacterium avium subsp. paratuberculosis
cagcagcagcagcggca

SEQ ID NO: 2997875 - RNA, 16 nt, Mycobacterium avium subsp. paratuberculosis
cagcagcagcaggucg

SEQ ID NO: 2997876 - RNA, 13 nt, Mycobacterium avium subsp. paratuberculosis
cagcagcagcccg

SEQ ID NO: 2997877 - RNA, 14 nt, Mycobacterium avium subsp. paratuberculosis
cagcagcagcccga

SEQ ID NO: 2997878 - RNA, 16 nt, Mycobacterium avium subsp. paratuberculosis
cagcagcagcccgaac

SEQ ID NO: 2997879 - RNA, 13 nt, Mycobacterium avium subsp. paratuberculosis
cagcagcagccgc

SEQ ID NO: 2997880 - RNA, 13 nt, Mycobacterium avium subsp. paratuberculosis
cagcagcagcgcc

SEQ ID NO: 2997881 - RNA, 17 nt, Mycobacterium avium subsp. paratuberculosis
cagcagcagcgccgcca

SEQ ID NO: 2997882 - RNA, 14 nt, Mycobacterium avium subsp. paratuberculosis
cagcagcagcgcgg

SEQ ID NO: 2997883 - RNA, 15 nt, Mycobacterium avium subsp. paratuberculosis
cagcagcagcgcggc

SEQ ID NO: 2997884 - RNA, 13 nt, Mycobacterium avium subsp. paratuberculosis
cagcagcaggucc

SEQ ID NO: 2997885 - RNA, 14 nt, Mycobacterium avium subsp. paratuberculosis
cagcagcagguccu

SEQ ID NO: 2997886 - RNA, 18 nt, Mycobacterium avium subsp. paratuberculosis
cagcagcaggucggccag

SEQ ID NO: 2997887 - RNA, 20 nt, Mycobacterium avium subsp. paratuberculosis
cagcagcaggucggccagcu

SEQ ID NO: 2997888 - RNA, 17 nt, Mycobacterium avium subsp. paratuberculosis
cagcagcaggucgucga

SEQ ID NO: 2997889 - RNA, 16 nt, Mycobacterium avium subsp. paratuberculosis
cagcagccacgccagc

SEQ ID NO: 2997890 - RNA, 18 nt, Mycobacterium avium subsp. paratuberculosis
cagcagccacgccagcca

SEQ ID NO: 2997891 - RNA, 14 nt, Mycobacterium avium subsp. paratuberculosis
cagcagccagcugg

SEQ ID NO: 2997892 - RNA, 15 nt, Mycobacterium avium subsp. paratuberculosis
cagcagccagcuggu

SEQ ID NO: 2997893 - RNA, 13 nt, Mycobacterium avium subsp. paratuberculosis
cagcagccaggac

SEQ ID NO: 2997894 - RNA, 15 nt, Mycobacterium avium subsp. paratuberculosis
cagcagccaggacag

SEQ ID NO: 2997895 - RNA, 19 nt, Mycobacterium avium subsp. paratuberculosis
cagcagccaggacagcguc

SEQ ID NO: 2997896 - RNA, 16 nt, Mycobacterium avium subsp. paratuberculosis
cagcagccaggauccg

SEQ ID NO: 2997897 - RNA, 17 nt, Mycobacterium avium subsp. paratuberculosis
cagcagccccugcacca

SEQ ID NO: 2997898 - RNA, 19 nt, Mycobacterium avium subsp. paratuberculosis
cagcagccccugcaccacg

SEQ ID NO: 2997899 - RNA, 20 nt, Mycobacterium avium subsp. paratuberculosis
cagcagccccugcaccacga

SEQ ID NO: 2997900 - RNA, 14 nt, Mycobacterium avium subsp. paratuberculosis
cagcagcccgaaca

SEQ ID NO: 2997901 - RNA, 14 nt, Mycobacterium avium subsp. paratuberculosis
cagcagcccgauca

SEQ ID NO: 2997902 - RNA, 16 nt, Mycobacterium avium subsp. paratuberculosis
cagcagcccgaucacc

SEQ ID NO: 2997903 - RNA, 16 nt, Mycobacterium avium subsp. paratuberculosis
cagcagcccgccgaug

SEQ ID NO: 2997904 - RNA, 17 nt, Mycobacterium avium subsp. paratuberculosis
cagcagcccgccgaugg

SEQ ID NO: 2997905 - RNA, 24 nt, Mycobacterium avium subsp. paratuberculosis
cagcagcccgccgauggacacgcu

SEQ ID NO: 2997906 - RNA, 13 nt, Mycobacterium avium subsp. paratuberculosis
cagcagcccggcc

SEQ ID NO: 2997907 - RNA, 18 nt, Mycobacterium avium subsp. paratuberculosis
cagcagcccggccagccg

SEQ ID NO: 2997908 - RNA, 16 nt, Mycobacterium avium subsp. paratuberculosis
cagcagcccgggcugc

SEQ ID NO: 2997909 - RNA, 20 nt, Mycobacterium avium subsp. paratuberculosis
cagcagcccgucccggccca

SEQ ID NO: 2997910 - RNA, 13 nt, Mycobacterium avium subsp. paratuberculosis
cagcagccgcacc

SEQ ID NO: 2997911 - RNA, 22 nt, Mycobacterium avium subsp. paratuberculosis
cagcagccgcaccucggggcgu

SEQ ID NO: 2997912 - RNA, 17 nt, Mycobacterium avium subsp. paratuberculosis
cagcagccgcagcgcgc

SEQ ID NO: 2997913 - RNA, 15 nt, Mycobacterium avium subsp. paratuberculosis
cagcagccgccgggc

SEQ ID NO: 2997914 - RNA, 12 nt, Mycobacterium avium subsp. paratuberculosis
cagcagccgcga

SEQ ID NO: 2997915 - RNA, 13 nt, Mycobacterium avium subsp. paratuberculosis
cagcagccgcgac

SEQ ID NO: 2997916 - RNA, 12 nt, Mycobacterium avium subsp. paratuberculosis
cagcagccgcgc

SEQ ID NO: 2997917 - RNA, 14 nt, Mycobacterium avium subsp. paratuberculosis
cagcagccgcgccg

SEQ ID NO: 2997918 - RNA, 17 nt, Mycobacterium avium subsp. paratuberculosis
cagcagccgcgccgacg

SEQ ID NO: 2997919 - RNA, 17 nt, Mycobacterium avium subsp. paratuberculosis
cagcagccgcgccgccg

SEQ ID NO: 2997920 - RNA, 20 nt, Mycobacterium avium subsp. paratuberculosis
cagcagccgcgccgccgcgu

SEQ ID NO: 2997921 - RNA, 14 nt, Mycobacterium avium subsp. paratuberculosis
cagcagccgcugcu

SEQ ID NO: 2997922 - RNA, 19 nt, Mycobacterium avium subsp. paratuberculosis
cagcagccgcugcugggug

SEQ ID NO: 2997923 - RNA, 23 nt, Mycobacterium avium subsp. paratuberculosis
cagcagccgcugcugggugccgc

SEQ ID NO: 2997924 - RNA, 13 nt, Mycobacterium avium subsp. paratuberculosis
cagcagccggcag

SEQ ID NO: 2997925 - RNA, 19 nt, Mycobacterium avium subsp. paratuberculosis
cagcagccgggccugcggc

SEQ ID NO: 2997926 - RNA, 21 nt, Mycobacterium avium subsp. paratuberculosis
cagcagccgggccugcggcgc

SEQ ID NO: 2997927 - RNA, 22 nt, Mycobacterium avium subsp. paratuberculosis
cagcagccguuccaucgggccc

SEQ ID NO: 2997928 - RNA, 19 nt, Mycobacterium avium subsp. paratuberculosis
cagcagcgacuugaccagc

SEQ ID NO: 2997929 - RNA, 22 nt, Mycobacterium avium subsp. paratuberculosis
cagcagcgacuugaccagcagc

SEQ ID NO: 2997930 - RNA, 23 nt, Mycobacterium avium subsp. paratuberculosis
cagcagcgacuugaccagcagcu

SEQ ID NO: 2997931 - RNA, 19 nt, Mycobacterium avium subsp. paratuberculosis
cagcagcgagaaccggcgc

SEQ ID NO: 2997932 - RNA, 22 nt, Mycobacterium avium subsp. paratuberculosis
cagcagcgagaccggcacggug

SEQ ID NO: 2997933 - RNA, 23 nt, Mycobacterium avium subsp. paratuberculosis
cagcagcgagaccggcacggugc

SEQ ID NO: 2997934 - RNA, 20 nt, Mycobacterium avium subsp. paratuberculosis
cagcagcgaggccucgccgc

SEQ ID NO: 2997935 - RNA, 21 nt, Mycobacterium avium subsp. paratuberculosis
cagcagcgaggccucgccgcu

SEQ ID NO: 2997936 - RNA, 21 nt, Mycobacterium avium subsp. paratuberculosis
cagcagcgaggcguccagcgc

SEQ ID NO: 2997937 - RNA, 14 nt, Mycobacterium avium subsp. paratuberculosis
cagcagcgcaccgg

SEQ ID NO: 2997938 - RNA, 19 nt, Mycobacterium avium subsp. paratuberculosis
cagcagcgcaccggcgaug

SEQ ID NO: 2997939 - RNA, 13 nt, Mycobacterium avium subsp. paratuberculosis
cagcagcgccaca

SEQ ID NO: 2997940 - RNA, 21 nt, Mycobacterium avium subsp. paratuberculosis
cagcagcgccacaauggaucc

SEQ ID NO: 2997941 - RNA, 14 nt, Mycobacterium avium subsp. paratuberculosis
cagcagcgccagca

SEQ ID NO: 2997942 - RNA, 16 nt, Mycobacterium avium subsp. paratuberculosis
cagcagcgccagcagc

SEQ ID NO: 2997943 - RNA, 17 nt, Mycobacterium avium subsp. paratuberculosis
cagcagcgccagcagcg

SEQ ID NO: 2997944 - RNA, 12 nt, Mycobacterium avium subsp. paratuberculosis
cagcagcgccca

SEQ ID NO: 2997945 - RNA, 13 nt, Mycobacterium avium subsp. paratuberculosis
cagcagcgcccac

SEQ ID NO: 2997946 - RNA, 14 nt, Mycobacterium avium subsp. paratuberculosis
cagcagcgcccacc

SEQ ID NO: 2997947 - RNA, 18 nt, Mycobacterium avium subsp. paratuberculosis
cagcagcgcccaccgcuc

SEQ ID NO: 2997948 - RNA, 22 nt, Mycobacterium avium subsp. paratuberculosis
cagcagcgcccaccgcucgucg

SEQ ID NO: 2997949 - RNA, 14 nt, Mycobacterium avium subsp. paratuberculosis
cagcagcgccgcca

SEQ ID NO: 2997950 - RNA, 16 nt, Mycobacterium avium subsp. paratuberculosis
cagcagcgccgccacc

SEQ ID NO: 2997951 - RNA, 19 nt, Mycobacterium avium subsp. paratuberculosis
cagcagcgccgccaccggc

SEQ ID NO: 2997952 - RNA, 20 nt, Mycobacterium avium subsp. paratuberculosis
cagcagcgccgccaccggcc

SEQ ID NO: 2997953 - RNA, 15 nt, Mycobacterium avium subsp. paratuberculosis
cagcagcgccgcggc

SEQ ID NO: 2997954 - RNA, 17 nt, Mycobacterium avium subsp. paratuberculosis
cagcagcgccgcggccg

SEQ ID NO: 2997955 - RNA, 18 nt, Mycobacterium avium subsp. paratuberculosis
cagcagcgccgcggccgg

SEQ ID NO: 2997956 - RNA, 16 nt, Mycobacterium avium subsp. paratuberculosis
cagcagcgccggcagc

SEQ ID NO: 2997957 - RNA, 13 nt, Mycobacterium avium subsp. paratuberculosis
cagcagcgcgacg

SEQ ID NO: 2997958 - RNA, 17 nt, Mycobacterium avium subsp. paratuberculosis
cagcagcgcgacgccga

SEQ ID NO: 2997959 - RNA, 18 nt, Mycobacterium avium subsp. paratuberculosis
cagcagcgcgacgccgac

SEQ ID NO: 2997960 - RNA, 22 nt, Mycobacterium avium subsp. paratuberculosis
cagcagcgcgacgccgacgccc

SEQ ID NO: 2997961 - RNA, 12 nt, Mycobacterium avium subsp. paratuberculosis
cagcagcgcgcc

SEQ ID NO: 2997962 - RNA, 17 nt, Mycobacterium avium subsp. paratuberculosis
cagcagcgcgccgcgcu

SEQ ID NO: 2997963 - RNA, 12 nt, Mycobacterium avium subsp. paratuberculosis
cagcagcgcggc

SEQ ID NO: 2997964 - RNA, 13 nt, Mycobacterium avium subsp. paratuberculosis
cagcagcgcggca

SEQ ID NO: 2997965 - RNA, 14 nt, Mycobacterium avium subsp. paratuberculosis
cagcagcgcggcau

SEQ ID NO: 2997966 - RNA, 15 nt, Mycobacterium avium subsp. paratuberculosis
cagcagcgcggcaug

SEQ ID NO: 2997967 - RNA, 22 nt, Mycobacterium avium subsp. paratuberculosis
cagcagcgcggcauggcuggcg

SEQ ID NO: 2997968 - RNA, 16 nt, Mycobacterium avium subsp. paratuberculosis
cagcagcgcggcgauc

SEQ ID NO: 2997969 - RNA, 22 nt, Mycobacterium avium subsp. paratuberculosis
cagcagcgcggucaacaccggg

SEQ ID NO: 2997970 - RNA, 16 nt, Mycobacterium avium subsp. paratuberculosis
cagcagcgcggugccg

SEQ ID NO: 2997971 - RNA, 23 nt, Mycobacterium avium subsp. paratuberculosis
cagcagcgcgguuuccggcgauu

SEQ ID NO: 2997972 - RNA, 11 nt, Mycobacterium avium subsp. paratuberculosis
cagcagcgcgu

SEQ ID NO: 2997973 - RNA, 21 nt, Mycobacterium avium subsp. paratuberculosis
cagcagcgcguaggugcgguc

SEQ ID NO: 2997974 - RNA, 13 nt, Mycobacterium avium subsp. paratuberculosis
cagcagcgcgucg

SEQ ID NO: 2997975 - RNA, 13 nt, Mycobacterium avium subsp. paratuberculosis
cagcagcggcacc

SEQ ID NO: 2997976 - RNA, 16 nt, Mycobacterium avium subsp. paratuberculosis
cagcagcggcagcgaa

SEQ ID NO: 2997977 - RNA, 17 nt, Mycobacterium avium subsp. paratuberculosis
cagcagcggcaguagcg

SEQ ID NO: 2997978 - RNA, 16 nt, Mycobacterium avium subsp. paratuberculosis
cagcagcggccggcgc

SEQ ID NO: 2997979 - RNA, 16 nt, Mycobacterium avium subsp. paratuberculosis
cagcagcggcucggcc

SEQ ID NO: 2997980 - RNA, 23 nt, Mycobacterium avium subsp. paratuberculosis
cagcagcggcuugagcgccagcg

SEQ ID NO: 2997981 - RNA, 17 nt, Mycobacterium avium subsp. paratuberculosis
cagcagcgggaucagcu

SEQ ID NO: 2997982 - RNA, 17 nt, Mycobacterium avium subsp. paratuberculosis
cagcagcgggcccgggc

SEQ ID NO: 2997983 - RNA, 14 nt, Mycobacterium avium subsp. paratuberculosis
cagcagcgggccga

SEQ ID NO: 2997984 - RNA, 21 nt, Mycobacterium avium subsp. paratuberculosis
cagcagcggggcgagcuggcc

SEQ ID NO: 2997985 - RNA, 13 nt, Mycobacterium avium subsp. paratuberculosis
cagcagcggggug

SEQ ID NO: 2997986 - RNA, 16 nt, Mycobacterium avium subsp. paratuberculosis
cagcagcggggugugc

SEQ ID NO: 2997987 - RNA, 20 nt, Mycobacterium avium subsp. paratuberculosis
cagcagcgucacgucgacgg

SEQ ID NO: 2997988 - RNA, 23 nt, Mycobacterium avium subsp. paratuberculosis
cagcagcgucgucaggccgugau

SEQ ID NO: 2997989 - RNA, 15 nt, Mycobacterium avium subsp. paratuberculosis
cagcagcgucugcgc

SEQ ID NO: 2997990 - RNA, 11 nt, Mycobacterium avium subsp. paratuberculosis
cagcagcgugg

SEQ ID NO: 2997991 - RNA, 17 nt, Mycobacterium avium subsp. paratuberculosis
cagcagcguuccgucgg

SEQ ID NO: 2997992 - RNA, 20 nt, Mycobacterium avium subsp. paratuberculosis
cagcagcguuccgucggcga

SEQ ID NO: 2997993 - RNA, 21 nt, Mycobacterium avium subsp. paratuberculosis
cagcagcguuccgucggcgag

SEQ ID NO: 2997994 - RNA, 16 nt, Mycobacterium avium subsp. paratuberculosis
cagcagcuagcccaga

SEQ ID NO: 2997995 - RNA, 14 nt, Mycobacterium avium subsp. paratuberculosis
cagcagcuccaucg

SEQ ID NO: 2997996 - RNA, 13 nt, Mycobacterium avium subsp. paratuberculosis
cagcagcucggcg

SEQ ID NO: 2997997 - RNA, 14 nt, Mycobacterium avium subsp. paratuberculosis
cagcagcucggcga

SEQ ID NO: 2997998 - RNA, 16 nt, Mycobacterium avium subsp. paratuberculosis
cagcagcucggcgauc

SEQ ID NO: 2997999 - RNA, 17 nt, Mycobacterium avium subsp. paratuberculosis
cagcagcucggcgauca

SEQ ID NO: 2998000 - RNA, 16 nt, Mycobacterium avium subsp. paratuberculosis
cagcagcugcacccgc

SEQ ID NO: 2998001 - RNA, 18 nt, Mycobacterium avium subsp. paratuberculosis
cagcagcugcccgagcgg

SEQ ID NO: 2998002 - RNA, 19 nt, Mycobacterium avium subsp. paratuberculosis
cagcagcugcccgagcggc

SEQ ID NO: 2998003 - RNA, 22 nt, Mycobacterium avium subsp. paratuberculosis
cagcagcugcgggaccagcgcc

SEQ ID NO: 2998004 - RNA, 19 nt, Mycobacterium avium subsp. paratuberculosis
cagcagcugcgucggcacc

SEQ ID NO: 2998005 - RNA, 23 nt, Mycobacterium avium subsp. paratuberculosis
cagcagcugcgucggcaccagcg

SEQ ID NO: 2998006 - RNA, 20 nt, Mycobacterium avium subsp. paratuberculosis
cagcagcuucaugcccgcga

SEQ ID NO: 2998007 - RNA, 18 nt, Mycobacterium avium subsp. paratuberculosis
cagcagcuugacgucggu

SEQ ID NO: 2998008 - RNA, 21 nt, Mycobacterium avium subsp. paratuberculosis
cagcagcuugacgucggucag

SEQ ID NO: 2998009 - RNA, 18 nt, Mycobacterium avium subsp. paratuberculosis
cagcagcuugaucgccgg

SEQ ID NO: 2998010 - RNA, 19 nt, Mycobacterium avium subsp. paratuberculosis
cagcagcuugaucgccggg

SEQ ID NO: 2998011 - RNA, 21 nt, Mycobacterium avium subsp. paratuberculosis
cagcagcuugaucgccggggc

SEQ ID NO: 2998012 - RNA, 22 nt, Mycobacterium avium subsp. paratuberculosis
cagcagcuugaucgccggggcg

SEQ ID NO: 2998013 - RNA, 17 nt, Mycobacterium avium subsp. paratuberculosis
cagcagcuuggcgaagu

SEQ ID NO: 2998014 - RNA, 17 nt, Mycobacterium avium subsp. paratuberculosis
cagcagcuugggggccg

SEQ ID NO: 2998015 - RNA, 22 nt, Mycobacterium avium subsp. paratuberculosis
cagcaggaacucccgcgccgca

SEQ ID NO: 2998016 - RNA, 14 nt, Mycobacterium avium subsp. paratuberculosis
cagcaggaaguagc

SEQ ID NO: 2998017 - RNA, 11 nt, Mycobacterium avium subsp. paratuberculosis
cagcaggacca

SEQ ID NO: 2998018 - RNA, 14 nt, Mycobacterium avium subsp. paratuberculosis
cagcaggaccaggc

SEQ ID NO: 2998019 - RNA, 15 nt, Mycobacterium avium subsp. paratuberculosis
cagcaggacgcgccc

SEQ ID NO: 2998020 - RNA, 16 nt, Mycobacterium avium subsp. paratuberculosis
cagcaggacgcgcccg

SEQ ID NO: 2998021 - RNA, 17 nt, Mycobacterium avium subsp. paratuberculosis
cagcaggacgcgcccgg

SEQ ID NO: 2998022 - RNA, 19 nt, Mycobacterium avium subsp. paratuberculosis
cagcaggacgcgcccggcg

SEQ ID NO: 2998023 - RNA, 21 nt, Mycobacterium avium subsp. paratuberculosis
cagcaggacgcgcccggcgac

SEQ ID NO: 2998024 - RNA, 19 nt, Mycobacterium avium subsp. paratuberculosis
cagcaggaucuccggccgg

SEQ ID NO: 2998025 - RNA, 20 nt, Mycobacterium avium subsp. paratuberculosis
cagcaggaucuccggccggu

SEQ ID NO: 2998026 - RNA, 21 nt, Mycobacterium avium subsp. paratuberculosis
cagcaggaucuggugcgcgcg

SEQ ID NO: 2998027 - RNA, 22 nt, Mycobacterium avium subsp. paratuberculosis
cagcaggaucuggugcgcgcgc

SEQ ID NO: 2998028 - RNA, 14 nt, Mycobacterium avium subsp. paratuberculosis
cagcaggaugauga

SEQ ID NO: 2998029 - RNA, 18 nt, Mycobacterium avium subsp. paratuberculosis
cagcaggaugaugaccga

SEQ ID NO: 2998030 - RNA, 17 nt, Mycobacterium avium subsp. paratuberculosis
cagcaggcccaacguga

SEQ ID NO: 2998031 - RNA, 16 nt, Mycobacterium avium subsp. paratuberculosis
cagcaggcccaggccg

SEQ ID NO: 2998032 - RNA, 22 nt, Mycobacterium avium subsp. paratuberculosis
cagcaggccccguucgguggcc

SEQ ID NO: 2998033 - RNA, 14 nt, Mycobacterium avium subsp. paratuberculosis
cagcaggcccucgg

SEQ ID NO: 2998034 - RNA, 19 nt, Mycobacterium avium subsp. paratuberculosis
cagcaggcccucggccagc

SEQ ID NO: 2998035 - RNA, 14 nt, Mycobacterium avium subsp. paratuberculosis
cagcaggcgccgca

SEQ ID NO: 2998036 - RNA, 22 nt, Mycobacterium avium subsp. paratuberculosis
cagcaggcgccgcagcaggugc

SEQ ID NO: 2998037 - RNA, 14 nt, Mycobacterium avium subsp. paratuberculosis
cagcaggcgccggu

SEQ ID NO: 2998038 - RNA, 15 nt, Mycobacterium avium subsp. paratuberculosis
cagcaggcgccgguc

SEQ ID NO: 2998039 - RNA, 19 nt, Mycobacterium avium subsp. paratuberculosis
cagcaggcgcgccgagcgc

SEQ ID NO: 2998040 - RNA, 14 nt, Mycobacterium avium subsp. paratuberculosis
cagcaggcggacgg

SEQ ID NO: 2998041 - RNA, 17 nt, Mycobacterium avium subsp. paratuberculosis
cagcaggcggacggcga

SEQ ID NO: 2998042 - RNA, 13 nt, Mycobacterium avium subsp. paratuberculosis
cagcaggcuggcg

SEQ ID NO: 2998043 - RNA, 21 nt, Mycobacterium avium subsp. paratuberculosis
cagcaggcuggcggcgaucac

SEQ ID NO: 2998044 - RNA, 22 nt, Mycobacterium avium subsp. paratuberculosis
cagcaggcuggcggcgaucacc

SEQ ID NO: 2998045 - RNA, 14 nt, Mycobacterium avium subsp. paratuberculosis
cagcaggcuggcgu

SEQ ID NO: 2998046 - RNA, 12 nt, Mycobacterium avium subsp. paratuberculosis
cagcaggcuguc

SEQ ID NO: 2998047 - RNA, 21 nt, Mycobacterium avium subsp. paratuberculosis
cagcaggcuguccugcgguuc

SEQ ID NO: 2998048 - RNA, 21 nt, Mycobacterium avium subsp. paratuberculosis
cagcagggcaccgacggccgc

SEQ ID NO: 2998049 - RNA, 16 nt, Mycobacterium avium subsp. paratuberculosis
cagcagggccucgccg

SEQ ID NO: 2998050 - RNA, 16 nt, Mycobacterium avium subsp. paratuberculosis
cagcagggcgccgacg

SEQ ID NO: 2998051 - RNA, 15 nt, Mycobacterium avium subsp. paratuberculosis
cagcagggcggcacc

SEQ ID NO: 2998052 - RNA, 13 nt, Mycobacterium avium subsp. paratuberculosis
cagcagggcggcg

SEQ ID NO: 2998053 - RNA, 14 nt, Mycobacterium avium subsp. paratuberculosis
cagcagggcggcga

SEQ ID NO: 2998054 - RNA, 16 nt, Mycobacterium avium subsp. paratuberculosis
cagcagggcggcgauc

SEQ ID NO: 2998055 - RNA, 17 nt, Mycobacterium avium subsp. paratuberculosis
cagcagggugccgccgc

SEQ ID NO: 2998056 - RNA, 18 nt, Mycobacterium avium subsp. paratuberculosis
cagcagggugccgccgcc

SEQ ID NO: 2998057 - RNA, 19 nt, Mycobacterium avium subsp. paratuberculosis
cagcagguaaaccagcagc

SEQ ID NO: 2998058 - RNA, 20 nt, Mycobacterium avium subsp. paratuberculosis
cagcagguaaaccagcagcg

SEQ ID NO: 2998059 - RNA, 21 nt, Mycobacterium avium subsp. paratuberculosis
cagcagguaaaccagcagcgc

SEQ ID NO: 2998060 - RNA, 12 nt, Mycobacterium avium subsp. paratuberculosis
cagcagguagau

SEQ ID NO: 2998061 - RNA, 17 nt, Mycobacterium avium subsp. paratuberculosis
cagcagguagaucgcca

SEQ ID NO: 2998062 - RNA, 23 nt, Mycobacterium avium subsp. paratuberculosis
cagcagguagaucgccagcgccc

SEQ ID NO: 2998063 - RNA, 20 nt, Mycobacterium avium subsp. paratuberculosis
cagcagguauuuggugaccu

SEQ ID NO: 2998064 - RNA, 15 nt, Mycobacterium avium subsp. paratuberculosis
cagcagguccgccgg

SEQ ID NO: 2998065 - RNA, 16 nt, Mycobacterium avium subsp. paratuberculosis
cagcagguccgccggu

SEQ ID NO: 2998066 - RNA, 19 nt, Mycobacterium avium subsp. paratuberculosis
cagcagguccgccggugcc

SEQ ID NO: 2998067 - RNA, 17 nt, Mycobacterium avium subsp. paratuberculosis
cagcaggucgaaggcgg

SEQ ID NO: 2998068 - RNA, 16 nt, Mycobacterium avium subsp. paratuberculosis
cagcaggucgagcaug

SEQ ID NO: 2998069 - RNA, 17 nt, Mycobacterium avium subsp. paratuberculosis
cagcaggucgagcaugc

SEQ ID NO: 2998070 - RNA, 12 nt, Mycobacterium avium subsp. paratuberculosis
cagcaggucggc

SEQ ID NO: 2998071 - RNA, 13 nt, Mycobacterium avium subsp. paratuberculosis
cagcaggucggcc

SEQ ID NO: 2998072 - RNA, 14 nt, Mycobacterium avium subsp. paratuberculosis
cagcaggucggcca

SEQ ID NO: 2998073 - RNA, 17 nt, Mycobacterium avium subsp. paratuberculosis
cagcaggucggccagcu

SEQ ID NO: 2998074 - RNA, 16 nt, Mycobacterium avium subsp. paratuberculosis
cagcaggucggcgugc

SEQ ID NO: 2998075 - RNA, 20 nt, Mycobacterium avium subsp. paratuberculosis
cagcaggucggcgugcucgu

SEQ ID NO: 2998076 - RNA, 22 nt, Mycobacterium avium subsp. paratuberculosis
cagcaggucgucgaucagggcg

SEQ ID NO: 2998077 - RNA, 16 nt, Mycobacterium avium subsp. paratuberculosis
cagcaggugcaccacc

SEQ ID NO: 2998078 - RNA, 17 nt, Mycobacterium avium subsp. paratuberculosis
cagcaggugcaccaccc

SEQ ID NO: 2998079 - RNA, 20 nt, Mycobacterium avium subsp. paratuberculosis
cagcaggugcaucgaccggc

SEQ ID NO: 2998080 - RNA, 21 nt, Mycobacterium avium subsp. paratuberculosis
cagcaggugcaucgaccggcg

SEQ ID NO: 2998081 - RNA, 23 nt, Mycobacterium avium subsp. paratuberculosis
cagcaggugcaucgaccggcgga

SEQ ID NO: 2998082 - RNA, 15 nt, Mycobacterium avium subsp. paratuberculosis
cagcaggugcaucgc

SEQ ID NO: 2998083 - RNA, 17 nt, Mycobacterium avium subsp. paratuberculosis
cagcaggugcaucgcca

SEQ ID NO: 2998084 - RNA, 20 nt, Mycobacterium avium subsp. paratuberculosis
cagcaggugcaucgccaccg

SEQ ID NO: 2998085 - RNA, 14 nt, Mycobacterium avium subsp. paratuberculosis
cagcaggugcgcca

SEQ ID NO: 2998086 - RNA, 15 nt, Mycobacterium avium subsp. paratuberculosis
cagcaggugcgccag

SEQ ID NO: 2998087 - RNA, 14 nt, Mycobacterium avium subsp. paratuberculosis
cagcagguugaucc

SEQ ID NO: 2998088 - RNA, 18 nt, Mycobacterium avium subsp. paratuberculosis
cagcagguugauccgcgc

SEQ ID NO: 2998089 - RNA, 17 nt, Mycobacterium avium subsp. paratuberculosis
cagcagguugcgguguu

SEQ ID NO: 2998090 - RNA, 23 nt, Mycobacterium avium subsp. paratuberculosis
cagcagguuguagucggcgccga

SEQ ID NO: 2998091 - RNA, 14 nt, Mycobacterium avium subsp. paratuberculosis
cagcagucccucga

SEQ ID NO: 2998092 - RNA, 19 nt, Mycobacterium avium subsp. paratuberculosis
cagcagucccucgaucagc

SEQ ID NO: 2998093 - RNA, 15 nt, Mycobacterium avium subsp. paratuberculosis
cagcaguccggcggu

SEQ ID NO: 2998094 - RNA, 17 nt, Mycobacterium avium subsp. paratuberculosis
cagcaguccggcgguca

SEQ ID NO: 2998095 - RNA, 23 nt, Mycobacterium avium subsp. paratuberculosis
cagcaguccggcggucagcaccg

SEQ ID NO: 2998096 - RNA, 18 nt, Mycobacterium avium subsp. paratuberculosis
cagcagucgugacgcggc

SEQ ID NO: 2998097 - RNA, 21 nt, Mycobacterium avium subsp. paratuberculosis
cagcagugccaacacggcggc

SEQ ID NO: 2998098 - RNA, 23 nt, Mycobacterium avium subsp. paratuberculosis
cagcagugccaacacggcggcgc

SEQ ID NO: 2998099 - RNA, 14 nt, Mycobacterium avium subsp. paratuberculosis
cagcagugccacca

SEQ ID NO: 2998100 - RNA, 15 nt, Mycobacterium avium subsp. paratuberculosis
cagcagugccaccac

SEQ ID NO: 2998101 - RNA, 17 nt, Mycobacterium avium subsp. paratuberculosis
cagcagugccaccacca

SEQ ID NO: 2998102 - RNA, 14 nt, Mycobacterium avium subsp. paratuberculosis
cagcagugccccgu

SEQ ID NO: 2998103 - RNA, 21 nt, Mycobacterium avium subsp. paratuberculosis
cagcagugccccguccggcgc

SEQ ID NO: 2998104 - RNA, 17 nt, Mycobacterium avium subsp. paratuberculosis
cagcaguuccggagcgc

SEQ ID NO: 2998105 - RNA, 20 nt, Mycobacterium avium subsp. paratuberculosis
cagcaguucguccacgcugg

SEQ ID NO: 2998106 - RNA, 22 nt, Mycobacterium avium subsp. paratuberculosis
cagcaguucguccacgcuggcg

SEQ ID NO: 2998107 - RNA, 15 nt, Mycobacterium avium subsp. paratuberculosis
cagcaguuuguccug

SEQ ID NO: 2998108 - RNA, 20 nt, Mycobacterium avium subsp. paratuberculosis
cagcaguuuguccugcucgg

SEQ ID NO: 2998109 - RNA, 23 nt, Mycobacterium avium subsp. paratuberculosis
cagcaguuuguccugcucggcga

SEQ ID NO: 2998110 - RNA, 19 nt, Mycobacterium avium subsp. paratuberculosis
cagcaucacgucggcgagc

SEQ ID NO: 2998111 - RNA, 15 nt, Mycobacterium avium subsp. paratuberculosis
cagcaucagcauccc

SEQ ID NO: 2998112 - RNA, 18 nt, Mycobacterium avium subsp. paratuberculosis
cagcaucauugagccgcu

SEQ ID NO: 2998113 - RNA, 13 nt, Mycobacterium avium subsp. paratuberculosis
cagcauccaggug

SEQ ID NO: 2998114 - RNA, 17 nt, Mycobacterium avium subsp. paratuberculosis
cagcauccagguggcgc

SEQ ID NO: 2998115 - RNA, 20 nt, Mycobacterium avium subsp. paratuberculosis
cagcauccccuuggugcggu

SEQ ID NO: 2998116 - RNA, 23 nt, Mycobacterium avium subsp. paratuberculosis
cagcauccccuuggugcggucga

SEQ ID NO: 2998117 - RNA, 17 nt, Mycobacterium avium subsp. paratuberculosis
cagcauccgcaacgugc

SEQ ID NO: 2998118 - RNA, 14 nt, Mycobacterium avium subsp. paratuberculosis
cagcauccgccgac

SEQ ID NO: 2998119 - RNA, 15 nt, Mycobacterium avium subsp. paratuberculosis
cagcauccgccgacg

SEQ ID NO: 2998120 - RNA, 16 nt, Mycobacterium avium subsp. paratuberculosis
cagcauccgcuggugc

SEQ ID NO: 2998121 - RNA, 21 nt, Mycobacterium avium subsp. paratuberculosis
cagcauccgcuggugcgcgcc

SEQ ID NO: 2998122 - RNA, 22 nt, Mycobacterium avium subsp. paratuberculosis
cagcauccgcuggugcgcgccg

SEQ ID NO: 2998123 - RNA, 12 nt, Mycobacterium avium subsp. paratuberculosis
cagcaucgccgc

SEQ ID NO: 2998124 - RNA, 13 nt, Mycobacterium avium subsp. paratuberculosis
cagcaucgccgcg

SEQ ID NO: 2998125 - RNA, 22 nt, Mycobacterium avium subsp. paratuberculosis
cagcaucgccgcggugcgcgag

SEQ ID NO: 2998126 - RNA, 13 nt, Mycobacterium avium subsp. paratuberculosis
cagcaucgccguc

SEQ ID NO: 2998127 - RNA, 14 nt, Mycobacterium avium subsp. paratuberculosis
cagcaucgccgucg

SEQ ID NO: 2998128 - RNA, 15 nt, Mycobacterium avium subsp. paratuberculosis
cagcaucgccgucgu

SEQ ID NO: 2998129 - RNA, 16 nt, Mycobacterium avium subsp. paratuberculosis
cagcaucgccgucguc

SEQ ID NO: 2998130 - RNA, 13 nt, Mycobacterium avium subsp. paratuberculosis
cagcaucggcaga

SEQ ID NO: 2998131 - RNA, 22 nt, Mycobacterium avium subsp. paratuberculosis
cagcaucggcagaucguugggc

SEQ ID NO: 2998132 - RNA, 19 nt, Mycobacterium avium subsp. paratuberculosis
cagcaucgggacgccugcc

SEQ ID NO: 2998133 - RNA, 14 nt, Mycobacterium avium subsp. paratuberculosis
cagcaucggguaga

SEQ ID NO: 2998134 - RNA, 16 nt, Mycobacterium avium subsp. paratuberculosis
cagcaucggucccagu

SEQ ID NO: 2998135 - RNA, 19 nt, Mycobacterium avium subsp. paratuberculosis
cagcaucggucccaguccc

SEQ ID NO: 2998136 - RNA, 17 nt, Mycobacterium avium subsp. paratuberculosis
cagcaucuccgagucgg

SEQ ID NO: 2998137 - RNA, 14 nt, Mycobacterium avium subsp. paratuberculosis
cagcaucucggcga

SEQ ID NO: 2998138 - RNA, 16 nt, Mycobacterium avium subsp. paratuberculosis
cagcaucucggcgaag

SEQ ID NO: 2998139 - RNA, 22 nt, Mycobacterium avium subsp. paratuberculosis
cagcaucucuugaugcagcgcc

SEQ ID NO: 2998140 - RNA, 19 nt, Mycobacterium avium subsp. paratuberculosis
cagcaugaagaucagcacc

SEQ ID NO: 2998141 - RNA, 21 nt, Mycobacterium avium subsp. paratuberculosis
cagcaugaagaucagcaccgu

SEQ ID NO: 2998142 - RNA, 19 nt, Mycobacterium avium subsp. paratuberculosis
cagcaugaucaccgccagc

SEQ ID NO: 2998143 - RNA, 13 nt, Mycobacterium avium subsp. paratuberculosis
cagcaugcccacg

SEQ ID NO: 2998144 - RNA, 22 nt, Mycobacterium avium subsp. paratuberculosis
cagcaugcccacgccgucgacc

SEQ ID NO: 2998145 - RNA, 15 nt, Mycobacterium avium subsp. paratuberculosis
cagcaugccgagcac

SEQ ID NO: 2998146 - RNA, 17 nt, Mycobacterium avium subsp. paratuberculosis
cagcaugccgagcaccu

SEQ ID NO: 2998147 - RNA, 13 nt, Mycobacterium avium subsp. paratuberculosis
cagcaugccgguc

SEQ ID NO: 2998148 - RNA, 14 nt, Mycobacterium avium subsp. paratuberculosis
cagcaugcgccaga

SEQ ID NO: 2998149 - RNA, 15 nt, Mycobacterium avium subsp. paratuberculosis
cagcaugcgccagag

SEQ ID NO: 2998150 - RNA, 21 nt, Mycobacterium avium subsp. paratuberculosis
cagcauggcgaugacgucguc

SEQ ID NO: 2998151 - RNA, 17 nt, Mycobacterium avium subsp. paratuberculosis
cagcauguccucggggu

SEQ ID NO: 2998152 - RNA, 16 nt, Mycobacterium avium subsp. paratuberculosis
cagcauuuccgagcga

SEQ ID NO: 2998153 - RNA, 19 nt, Mycobacterium avium subsp. paratuberculosis
cagccaaacagguuggcgc

SEQ ID NO: 2998154 - RNA, 22 nt, Mycobacterium avium subsp. paratuberculosis
cagccaaacagguuggcgccga

SEQ ID NO: 2998155 - RNA, 22 nt, Mycobacterium avium subsp. paratuberculosis
ccggccgaugaccucgcacagc

SEQ ID NO: 2998156 - RNA, 16 nt, Mycobacterium avium subsp. paratuberculosis
ccggccgauggcccag

SEQ ID NO: 2998157 - RNA, 14 nt, Mycobacterium avium subsp. paratuberculosis
ccggccgcacacca

SEQ ID NO: 2998158 - RNA, 15 nt, Mycobacterium avium subsp. paratuberculosis
ccggccgcacaccac

SEQ ID NO: 2998159 - RNA, 16 nt, Mycobacterium avium subsp. paratuberculosis
ccggccgcagcugcug

SEQ ID NO: 2998160 - RNA, 21 nt, Mycobacterium avium subsp. paratuberculosis
ccggccgcagcugcugcggcc

SEQ ID NO: 2998161 - RNA, 12 nt, Mycobacterium avium subsp. paratuberculosis
ccggccgccagc

SEQ ID NO: 2998162 - RNA, 15 nt, Mycobacterium avium subsp. paratuberculosis
ccggccgccagcgcc

SEQ ID NO: 2998163 - RNA, 17 nt, Mycobacterium avium subsp. paratuberculosis
ccggccgccagcgcccg

SEQ ID NO: 2998164 - RNA, 18 nt, Mycobacterium avium subsp. paratuberculosis
ccggccgccagcgcccgc

SEQ ID NO: 2998165 - RNA, 10 nt, Mycobacterium avium subsp. paratuberculosis
ccggccgccc

SEQ ID NO: 2998166 - RNA, 12 nt, Mycobacterium avium subsp. paratuberculosis
ccggccgcccgc

SEQ ID NO: 2998167 - RNA, 14 nt, Mycobacterium avium subsp. paratuberculosis
ccggccgcccgcac

SEQ ID NO: 2998168 - RNA, 20 nt, Mycobacterium avium subsp. paratuberculosis
ccggccgcccgcaccagcag

SEQ ID NO: 2998169 - RNA, 13 nt, Mycobacterium avium subsp. paratuberculosis
ccggccgcccggc

SEQ ID NO: 2998170 - RNA, 14 nt, Mycobacterium avium subsp. paratuberculosis
ccggccgcccggcg

SEQ ID NO: 2998171 - RNA, 17 nt, Mycobacterium avium subsp. paratuberculosis
ccggccgcccggcgagc

SEQ ID NO: 2998172 - RNA, 12 nt, Mycobacterium avium subsp. paratuberculosis
ccggccgccgaa

SEQ ID NO: 2998173 - RNA, 13 nt, Mycobacterium avium subsp. paratuberculosis
ccggccgccgaag

SEQ ID NO: 2998174 - RNA, 14 nt, Mycobacterium avium subsp. paratuberculosis
ccggccgccgaagc

SEQ ID NO: 2998175 - RNA, 21 nt, Mycobacterium avium subsp. paratuberculosis
ccggccgccgaagccggcucg

SEQ ID NO: 2998176 - RNA, 15 nt, Mycobacterium avium subsp. paratuberculosis
ccggccgccgaggac

SEQ ID NO: 2998177 - RNA, 14 nt, Mycobacterium avium subsp. paratuberculosis
ccggccgccgcgau

SEQ ID NO: 2998178 - RNA, 15 nt, Mycobacterium avium subsp. paratuberculosis
ccggccgccgcgauc

SEQ ID NO: 2998179 - RNA, 13 nt, Mycobacterium avium subsp. paratuberculosis
ccggccgccgcgc

SEQ ID NO: 2998180 - RNA, 14 nt, Mycobacterium avium subsp. paratuberculosis
ccggccgccgcgca

SEQ ID NO: 2998181 - RNA, 16 nt, Mycobacterium avium subsp. paratuberculosis
ccggccgccgcgcauc

SEQ ID NO: 2998182 - RNA, 23 nt, Mycobacterium avium subsp. paratuberculosis
ccggccgccgcgcauccgcaccg

SEQ ID NO: 2998183 - RNA, 15 nt, Mycobacterium avium subsp. paratuberculosis
ccggccgccggaucg

SEQ ID NO: 2998184 - RNA, 14 nt, Mycobacterium avium subsp. paratuberculosis
ccggccgccggcgg

SEQ ID NO: 2998185 - RNA, 17 nt, Mycobacterium avium subsp. paratuberculosis
ccggccgccggcggcca

SEQ ID NO: 2998186 - RNA, 15 nt, Mycobacterium avium subsp. paratuberculosis
ccggccgccgggacg

SEQ ID NO: 2998187 - RNA, 13 nt, Mycobacterium avium subsp. paratuberculosis
ccggccgccugga

SEQ ID NO: 2998188 - RNA, 16 nt, Mycobacterium avium subsp. paratuberculosis
ccggccgccuggacga

SEQ ID NO: 2998189 - RNA, 14 nt, Mycobacterium avium subsp. paratuberculosis
ccggccgcgacagc

SEQ ID NO: 2998190 - RNA, 17 nt, Mycobacterium avium subsp. paratuberculosis
ccggccgcgacagccgg

SEQ ID NO: 2998191 - RNA, 16 nt, Mycobacterium avium subsp. paratuberculosis
ccggccgcgauccagc

SEQ ID NO: 2998192 - RNA, 20 nt, Mycobacterium avium subsp. paratuberculosis
ccggccgcgauccagcgcug

SEQ ID NO: 2998193 - RNA, 13 nt, Mycobacterium avium subsp. paratuberculosis
ccggccgcgcacc

SEQ ID NO: 2998194 - RNA, 13 nt, Mycobacterium avium subsp. paratuberculosis
ccggccgcgccca

SEQ ID NO: 2998195 - RNA, 23 nt, Mycobacterium avium subsp. paratuberculosis
ccggccgcgcccaucgcggccgc

SEQ ID NO: 2998196 - RNA, 12 nt, Mycobacterium avium subsp. paratuberculosis
ccggccgcgccg

SEQ ID NO: 2998197 - RNA, 13 nt, Mycobacterium avium subsp. paratuberculosis
ccggccgcgccgg

SEQ ID NO: 2998198 - RNA, 15 nt, Mycobacterium avium subsp. paratuberculosis
ccggccgcgccggau

SEQ ID NO: 2998199 - RNA, 15 nt, Mycobacterium avium subsp. paratuberculosis
ccggccgcgccggcc

SEQ ID NO: 2998200 - RNA, 12 nt, Mycobacterium avium subsp. paratuberculosis
ccggccgcgcgc

SEQ ID NO: 2998201 - RNA, 13 nt, Mycobacterium avium subsp. paratuberculosis
ccggccgcgcgcg

SEQ ID NO: 2998202 - RNA, 16 nt, Mycobacterium avium subsp. paratuberculosis
ccggccgcgcgcggcg

SEQ ID NO: 2998203 - RNA, 17 nt, Mycobacterium avium subsp. paratuberculosis
ccggccgcgcgcggcgc

SEQ ID NO: 2998204 - RNA, 18 nt, Mycobacterium avium subsp. paratuberculosis
ccggccgcggaugaccag

SEQ ID NO: 2998205 - RNA, 22 nt, Mycobacterium avium subsp. paratuberculosis
ccggccgcggaugaccaggucg

SEQ ID NO: 2998206 - RNA, 23 nt, Mycobacterium avium subsp. paratuberculosis
ccggccgcggaugaccaggucgc

SEQ ID NO: 2998207 - RNA, 13 nt, Mycobacterium avium subsp. paratuberculosis
ccggccgcggcgu

SEQ ID NO: 2998208 - RNA, 15 nt, Mycobacterium avium subsp. paratuberculosis
ccggccgcggcgugc

SEQ ID NO: 2998209 - RNA, 15 nt, Mycobacterium avium subsp. paratuberculosis
ccggccgcggugacc

SEQ ID NO: 2998210 - RNA, 16 nt, Mycobacterium avium subsp. paratuberculosis
ccggccgcggugaccg

SEQ ID NO: 2998211 - RNA, 19 nt, Mycobacterium avium subsp. paratuberculosis
ccggccgcggugaccgcgc

SEQ ID NO: 2998212 - RNA, 22 nt, Mycobacterium avium subsp. paratuberculosis
ccggccgcggugaccgcgccgc

SEQ ID NO: 2998213 - RNA, 13 nt, Mycobacterium avium subsp. paratuberculosis
ccggccgcgucgc

SEQ ID NO: 2998214 - RNA, 18 nt, Mycobacterium avium subsp. paratuberculosis
ccggccgcgucgccgacc

SEQ ID NO: 2998215 - RNA, 19 nt, Mycobacterium avium subsp. paratuberculosis
ccggccgcgucgccgacca

SEQ ID NO: 2998216 - RNA, 21 nt, Mycobacterium avium subsp. paratuberculosis
ccggccgcgucgccgaccagc

SEQ ID NO: 2998217 - RNA, 23 nt, Mycobacterium avium subsp. paratuberculosis
ccggccgcgucgccgaccagcag

SEQ ID NO: 2998218 - RNA, 16 nt, Mycobacterium avium subsp. paratuberculosis
ccggccgcucgcgggc

SEQ ID NO: 2998219 - RNA, 14 nt, Mycobacterium avium subsp. paratuberculosis
ccggccgcugagga

SEQ ID NO: 2998220 - RNA, 13 nt, Mycobacterium avium subsp. paratuberculosis
ccggccggacacc

SEQ ID NO: 2998221 - RNA, 18 nt, Mycobacterium avium subsp. paratuberculosis
ccggccggacagaucgcc

SEQ ID NO: 2998222 - RNA, 20 nt, Mycobacterium avium subsp. paratuberculosis
ccggccggagaccgccgugg

SEQ ID NO: 2998223 - RNA, 13 nt, Mycobacterium avium subsp. paratuberculosis
ccggccggcacga

SEQ ID NO: 2998224 - RNA, 17 nt, Mycobacterium avium subsp. paratuberculosis
ccggccggcacgauggc

SEQ ID NO: 2998225 - RNA, 12 nt, Mycobacterium avium subsp. paratuberculosis
ccggccggcagc

SEQ ID NO: 2998226 - RNA, 14 nt, Mycobacterium avium subsp. paratuberculosis
ccggccggcagcug

SEQ ID NO: 2998227 - RNA, 16 nt, Mycobacterium avium subsp. paratuberculosis
ccggccggcagcugcc

SEQ ID NO: 2998228 - RNA, 21 nt, Mycobacterium avium subsp. paratuberculosis
ccggccggcagcugcccgucg

SEQ ID NO: 2998229 - RNA, 15 nt, Mycobacterium avium subsp. paratuberculosis
ccggccggcaggucg

SEQ ID NO: 2998230 - RNA, 23 nt, Mycobacterium avium subsp. paratuberculosis
ccggccggcccgcccggcggcgc

SEQ ID NO: 2998231 - RNA, 17 nt, Mycobacterium avium subsp. paratuberculosis
ccggccggccgaacacg

SEQ ID NO: 2998232 - RNA, 13 nt, Mycobacterium avium subsp. paratuberculosis
ccggccggccgac

SEQ ID NO: 2998233 - RNA, 12 nt, Mycobacterium avium subsp. paratuberculosis
ccggccggccgc

SEQ ID NO: 2998234 - RNA, 14 nt, Mycobacterium avium subsp. paratuberculosis
ccggccggccgccg

SEQ ID NO: 2998235 - RNA, 15 nt, Mycobacterium avium subsp. paratuberculosis
ccggccggccgccgg

SEQ ID NO: 2998236 - RNA, 16 nt, Mycobacterium avium subsp. paratuberculosis
ccggccggccgccggc

SEQ ID NO: 2998237 - RNA, 18 nt, Mycobacterium avium subsp. paratuberculosis
ccggccggccgccggcgg

SEQ ID NO: 2998238 - RNA, 13 nt, Mycobacterium avium subsp. paratuberculosis
ccggccggccgug

SEQ ID NO: 2998239 - RNA, 14 nt, Mycobacterium avium subsp. paratuberculosis
ccggccggccgugc

SEQ ID NO: 2998240 - RNA, 16 nt, Mycobacterium avium subsp. paratuberculosis
ccggccggccgugccg

SEQ ID NO: 2998241 - RNA, 10 nt, Mycobacterium avium subsp. paratuberculosis
ccggccggcg

SEQ ID NO: 2998242 - RNA, 19 nt, Mycobacterium avium subsp. paratuberculosis
ccggccggcgaagccgcuc

SEQ ID NO: 2998243 - RNA, 14 nt, Mycobacterium avium subsp. paratuberculosis
ccggccggcgagga

SEQ ID NO: 2998244 - RNA, 17 nt, Mycobacterium avium subsp. paratuberculosis
ccggccggcgaggaacu

SEQ ID NO: 2998245 - RNA, 15 nt, Mycobacterium avium subsp. paratuberculosis
ccggccggcgcgacc

SEQ ID NO: 2998246 - RNA, 16 nt, Mycobacterium avium subsp. paratuberculosis
ccggccggcgcgacca

SEQ ID NO: 2998247 - RNA, 19 nt, Mycobacterium avium subsp. paratuberculosis
ccggccggcgcgaccagcg

SEQ ID NO: 2998248 - RNA, 21 nt, Mycobacterium avium subsp. paratuberculosis
ccggccggcgcgcacggcagc

SEQ ID NO: 2998249 - RNA, 15 nt, Mycobacterium avium subsp. paratuberculosis
ccggccggcgcggcg

SEQ ID NO: 2998250 - RNA, 17 nt, Mycobacterium avium subsp. paratuberculosis
ccggccggcgcggcggc

SEQ ID NO: 2998251 - RNA, 14 nt, Mycobacterium avium subsp. paratuberculosis
ccggccggcgcgug

SEQ ID NO: 2998252 - RNA, 15 nt, Mycobacterium avium subsp. paratuberculosis
ccggccggcgcgugc

SEQ ID NO: 2998253 - RNA, 15 nt, Mycobacterium avium subsp. paratuberculosis
ccggccggcggacgc

SEQ ID NO: 2998254 - RNA, 22 nt, Mycobacterium avium subsp. paratuberculosis
ccggccggcggacgcggccagc

SEQ ID NO: 2998255 - RNA, 23 nt, Mycobacterium avium subsp. paratuberculosis
ccggccggcggacgcggccagcg

SEQ ID NO: 2998256 - RNA, 15 nt, Mycobacterium avium subsp. paratuberculosis
ccggccggcggcggu

SEQ ID NO: 2998257 - RNA, 23 nt, Mycobacterium avium subsp. paratuberculosis
ccggccggcggguucugauacac

SEQ ID NO: 2998258 - RNA, 15 nt, Mycobacterium avium subsp. paratuberculosis
ccggccggcggucag

SEQ ID NO: 2998259 - RNA, 15 nt, Mycobacterium avium subsp. paratuberculosis
ccggccgggacgcgg

SEQ ID NO: 2998260 - RNA, 15 nt, Mycobacterium avium subsp. paratuberculosis
ccggccgggacgggu

SEQ ID NO: 2998261 - RNA, 13 nt, Mycobacterium avium subsp. paratuberculosis
ccggccgggcgac

SEQ ID NO: 2998262 - RNA, 15 nt, Mycobacterium avium subsp. paratuberculosis
ccggccgggcgacug

SEQ ID NO: 2998263 - RNA, 16 nt, Mycobacterium avium subsp. paratuberculosis
ccggccgggcgacugc

SEQ ID NO: 2998264 - RNA, 18 nt, Mycobacterium avium subsp. paratuberculosis
ccggccgggcggacggca

SEQ ID NO: 2998265 - RNA, 13 nt, Mycobacterium avium subsp. paratuberculosis
ccggccggggcgc

SEQ ID NO: 2998266 - RNA, 14 nt, Mycobacterium avium subsp. paratuberculosis
ccggccggggcggc

SEQ ID NO: 2998267 - RNA, 16 nt, Mycobacterium avium subsp. paratuberculosis
ccggccggggcggcgg

SEQ ID NO: 2998268 - RNA, 15 nt, Mycobacterium avium subsp. paratuberculosis
ccggccggggcgggc

SEQ ID NO: 2998269 - RNA, 18 nt, Mycobacterium avium subsp. paratuberculosis
ccggccgggucacgugca

SEQ ID NO: 2998270 - RNA, 15 nt, Mycobacterium avium subsp. paratuberculosis
ccggccgguccgccc

SEQ ID NO: 2998271 - RNA, 20 nt, Mycobacterium avium subsp. paratuberculosis
ccggccggucgccgauggug

SEQ ID NO: 2998272 - RNA, 15 nt, Mycobacterium avium subsp. paratuberculosis
ccggccgguggccgg

SEQ ID NO: 2998273 - RNA, 18 nt, Mycobacterium avium subsp. paratuberculosis
ccggccgguggccggugg

SEQ ID NO: 2998274 - RNA, 17 nt, Mycobacterium avium subsp. paratuberculosis
ccggccgguuggcggcc

SEQ ID NO: 2998275 - RNA, 22 nt, Mycobacterium avium subsp. paratuberculosis
ccggccgguuggcggccggguc

SEQ ID NO: 2998276 - RNA, 20 nt, Mycobacterium avium subsp. paratuberculosis
ccggccguagcggacgacgg

SEQ ID NO: 2998277 - RNA, 21 nt, Mycobacterium avium subsp. paratuberculosis
ccggccguagcggacgacggc

SEQ ID NO: 2998278 - RNA, 23 nt, Mycobacterium avium subsp. paratuberculosis
ccggccguagcggacgacggcca

SEQ ID NO: 2998279 - RNA, 17 nt, Mycobacterium avium subsp. paratuberculosis
ccggccguaucggccaa

SEQ ID NO: 2998280 - RNA, 12 nt, Mycobacterium avium subsp. paratuberculosis
ccggccgucacg

SEQ ID NO: 2998281 - RNA, 13 nt, Mycobacterium avium subsp. paratuberculosis
ccggccgucacgc

SEQ ID NO: 2998282 - RNA, 23 nt, Mycobacterium avium subsp. paratuberculosis
ccggccgucaggaacgccggcuu

SEQ ID NO: 2998283 - RNA, 15 nt, Mycobacterium avium subsp. paratuberculosis
ccggccguccacggc

SEQ ID NO: 2998284 - RNA, 17 nt, Mycobacterium avium subsp. paratuberculosis
ccggccguccacggcgg

SEQ ID NO: 2998285 - RNA, 20 nt, Mycobacterium avium subsp. paratuberculosis
ccggccguccacggcggugg

SEQ ID NO: 2998286 - RNA, 13 nt, Mycobacterium avium subsp. paratuberculosis
ccggccgucgucg

SEQ ID NO: 2998287 - RNA, 16 nt, Mycobacterium avium subsp. paratuberculosis
ccggccgucgucgggc

SEQ ID NO: 2998288 - RNA, 20 nt, Mycobacterium avium subsp. paratuberculosis
ccggccgugaugcgccggcg

SEQ ID NO: 2998289 - RNA, 20 nt, Mycobacterium avium subsp. paratuberculosis
ccggccguggacccgccccg

SEQ ID NO: 2998290 - RNA, 22 nt, Mycobacterium avium subsp. paratuberculosis
ccggccguggacccgccccgac

SEQ ID NO: 2998291 - RNA, 13 nt, Mycobacterium avium subsp. paratuberculosis
ccggccguucgcc

SEQ ID NO: 2998292 - RNA, 18 nt, Mycobacterium avium subsp. paratuberculosis
ccggccguucgccggcca

SEQ ID NO: 2998293 - RNA, 20 nt, Mycobacterium avium subsp. paratuberculosis
ccggccguucgccggccagc

SEQ ID NO: 2998294 - RNA, 21 nt, Mycobacterium avium subsp. paratuberculosis
ccggccguucgccggccagca

SEQ ID NO: 2998295 - RNA, 19 nt, Mycobacterium avium subsp. paratuberculosis
ccggccguucuugcgggug

SEQ ID NO: 2998296 - RNA, 17 nt, Mycobacterium avium subsp. paratuberculosis
ccggccguugggccagc

SEQ ID NO: 2998297 - RNA, 22 nt, Mycobacterium avium subsp. paratuberculosis
ccggccguugggccagcggcgc

SEQ ID NO: 2998298 - RNA, 15 nt, Mycobacterium avium subsp. paratuberculosis
ccggccuccagcugu

SEQ ID NO: 2998299 - RNA, 19 nt, Mycobacterium avium subsp. paratuberculosis
ccggccucgaugucgucga

SEQ ID NO: 2998300 - RNA, 14 nt, Mycobacterium avium subsp. paratuberculosis
ccggccucgccggc

SEQ ID NO: 2998301 - RNA, 15 nt, Mycobacterium avium subsp. paratuberculosis
ccggccucgccggcg

SEQ ID NO: 2998302 - RNA, 16 nt, Mycobacterium avium subsp. paratuberculosis
ccggccucgccggcgc

SEQ ID NO: 2998303 - RNA, 17 nt, Mycobacterium avium subsp. paratuberculosis
ccggccucgccggcgcc

SEQ ID NO: 2998304 - RNA, 23 nt, Mycobacterium avium subsp. paratuberculosis
ccggccucgccggcgccgggcgg

SEQ ID NO: 2998305 - RNA, 21 nt, Mycobacterium avium subsp. paratuberculosis
ccggccucgucggcgagcagc

SEQ ID NO: 2998306 - RNA, 16 nt, Mycobacterium avium subsp. paratuberculosis
ccggccucucgucgac

SEQ ID NO: 2998307 - RNA, 20 nt, Mycobacterium avium subsp. paratuberculosis
ccggccucucgucgacgaug

SEQ ID NO: 2998308 - RNA, 20 nt, Mycobacterium avium subsp. paratuberculosis
ccggccugcagcgcggucau

SEQ ID NO: 2998309 - RNA, 12 nt, Mycobacterium avium subsp. paratuberculosis
ccggccugccac

SEQ ID NO: 2998310 - RNA, 15 nt, Mycobacterium avium subsp. paratuberculosis
ccggccugccaccgc

SEQ ID NO: 2998311 - RNA, 16 nt, Mycobacterium avium subsp. paratuberculosis
ccggccugccaccgcg

SEQ ID NO: 2998312 - RNA, 13 nt, Mycobacterium avium subsp. paratuberculosis
ccggccugcccgc

SEQ ID NO: 2998313 - RNA, 18 nt, Mycobacterium avium subsp. paratuberculosis
ccggccugcccgccgcgg

SEQ ID NO: 2998314 - RNA, 22 nt, Mycobacterium avium subsp. paratuberculosis
ccggccugcccgccgcggccgc

SEQ ID NO: 2998315 - RNA, 16 nt, Mycobacterium avium subsp. paratuberculosis
ccggccugccggaugc

SEQ ID NO: 2998316 - RNA, 17 nt, Mycobacterium avium subsp. paratuberculosis
ccggccuggcccagccg

SEQ ID NO: 2998317 - RNA, 15 nt, Mycobacterium avium subsp. paratuberculosis
ccggccuucaccagg

SEQ ID NO: 2998318 - RNA, 17 nt, Mycobacterium avium subsp. paratuberculosis
ccggccuucaccagggu

SEQ ID NO: 2998319 - RNA, 18 nt, Mycobacterium avium subsp. paratuberculosis
ccggccuucaccagggug

SEQ ID NO: 2998320 - RNA, 19 nt, Mycobacterium avium subsp. paratuberculosis
ccggccuucucgcgcaccg

SEQ ID NO: 2998321 - RNA, 20 nt, Mycobacterium avium subsp. paratuberculosis
ccggccuucucgcgcaccgc

SEQ ID NO: 2998322 - RNA, 22 nt, Mycobacterium avium subsp. paratuberculosis
ccggccuucucgcgcaccgcgg

SEQ ID NO: 2998323 - RNA, 19 nt, Mycobacterium avium subsp. paratuberculosis
ccggccuuggcccgcgccc

SEQ ID NO: 2998324 - RNA, 17 nt, Mycobacterium avium subsp. paratuberculosis
ccggcgaaacacagcag

SEQ ID NO: 2998325 - RNA, 18 nt, Mycobacterium avium subsp. paratuberculosis
ccggcgaaacacagcagc

SEQ ID NO: 2998326 - RNA, 19 nt, Mycobacterium avium subsp. paratuberculosis
ccggcgaaacacagcagca

SEQ ID NO: 2998327 - RNA, 14 nt, Mycobacterium avium subsp. paratuberculosis
ccggcgaacaccac

SEQ ID NO: 2998328 - RNA, 15 nt, Mycobacterium avium subsp. paratuberculosis
ccggcgaacaccacg

SEQ ID NO: 2998329 - RNA, 16 nt, Mycobacterium avium subsp. paratuberculosis
ccggcgaacaccacgg

SEQ ID NO: 2998330 - RNA, 22 nt, Mycobacterium avium subsp. paratuberculosis
ccggcgaacaccacgguccccg

SEQ ID NO: 2998331 - RNA, 15 nt, Mycobacterium avium subsp. paratuberculosis
ccggcgaaccgggac

SEQ ID NO: 2998332 - RNA, 17 nt, Mycobacterium avium subsp. paratuberculosis
ccggcgaacgacgucga

SEQ ID NO: 2998333 - RNA, 20 nt, Mycobacterium avium subsp. paratuberculosis
ccggcgaacgacgucgaggu

SEQ ID NO: 2998334 - RNA, 15 nt, Mycobacterium avium subsp. paratuberculosis
ccggcgaacgccucg

SEQ ID NO: 2998335 - RNA, 23 nt, Mycobacterium avium subsp. paratuberculosis
ccggcgaacuccacccugccgac

SEQ ID NO: 2998336 - RNA, 17 nt, Mycobacterium avium subsp. paratuberculosis
ccggcgaacucgcggcg

SEQ ID NO: 2998337 - RNA, 18 nt, Mycobacterium avium subsp. paratuberculosis
ccggcgaacucgcggcgg

SEQ ID NO: 2998338 - RNA, 15 nt, Mycobacterium avium subsp. paratuberculosis
ccggcgaagccgcuc

SEQ ID NO: 2998339 - RNA, 22 nt, Mycobacterium avium subsp. paratuberculosis
ccggcgaagcuaaaccccacgg

SEQ ID NO: 2998340 - RNA, 15 nt, Mycobacterium avium subsp. paratuberculosis
ccggcgaaggacagc

SEQ ID NO: 2998341 - RNA, 18 nt, Mycobacterium avium subsp. paratuberculosis
ccggcgaaggacagccgg

SEQ ID NO: 2998342 - RNA, 21 nt, Mycobacterium avium subsp. paratuberculosis
ccggcgaaggacagccggacg

SEQ ID NO: 2998343 - RNA, 20 nt, Mycobacterium avium subsp. paratuberculosis
ccggcgaaucagcagcuuga

SEQ ID NO: 2998344 - RNA, 20 nt, Mycobacterium avium subsp. paratuberculosis
ccggcgaauccgaccggcuc

SEQ ID NO: 2998345 - RNA, 21 nt, Mycobacterium avium subsp. paratuberculosis
ccggcgaauccgaguuggccg

SEQ ID NO: 2998346 - RNA, 19 nt, Mycobacterium avium subsp. paratuberculosis
ccggcgaauucggugaucg

SEQ ID NO: 2998347 - RNA, 22 nt, Mycobacterium avium subsp. paratuberculosis
ccggcgaauucggugaucgcgg

SEQ ID NO: 2998348 - RNA, 23 nt, Mycobacterium avium subsp. paratuberculosis
ccggcgaauucggugaucgcggu

SEQ ID NO: 2998349 - RNA, 12 nt, Mycobacterium avium subsp. paratuberculosis
ccggcgacaccg

SEQ ID NO: 2998350 - RNA, 14 nt, Mycobacterium avium subsp. paratuberculosis
ccggcgacaccgca

SEQ ID NO: 2998351 - RNA, 22 nt, Mycobacterium avium subsp. paratuberculosis
ccggcgacaccgcauggccggc

SEQ ID NO: 2998352 - RNA, 23 nt, Mycobacterium avium subsp. paratuberculosis
ccggcgacaccgcauggccggcg

SEQ ID NO: 2998353 - RNA, 18 nt, Mycobacterium avium subsp. paratuberculosis
ccggcgacacguccagcu

SEQ ID NO: 2998354 - RNA, 20 nt, Mycobacterium avium subsp. paratuberculosis
ccggcgacaugcgcagcgcc

SEQ ID NO: 2998355 - RNA, 22 nt, Mycobacterium avium subsp. paratuberculosis
ccggcgacaugcgcagcgccca

SEQ ID NO: 2998356 - RNA, 18 nt, Mycobacterium avium subsp. paratuberculosis
ccggcgaccaccagccgc

SEQ ID NO: 2998357 - RNA, 20 nt, Mycobacterium avium subsp. paratuberculosis
ccggcgaccaccagccgcag

SEQ ID NO: 2998358 - RNA, 21 nt, Mycobacterium avium subsp. paratuberculosis
ccggcgaccacccucaccacg

SEQ ID NO: 2998359 - RNA, 20 nt, Mycobacterium avium subsp. paratuberculosis
ccggcgaccagcaggucgag

SEQ ID NO: 2998360 - RNA, 23 nt, Mycobacterium avium subsp. paratuberculosis
ccggcgaccagccccucgaccac

SEQ ID NO: 2998361 - RNA, 24 nt, Mycobacterium avium subsp. paratuberculosis
ccggcgaccagccccucgaccacc

SEQ ID NO: 2998362 - RNA, 14 nt, Mycobacterium avium subsp. paratuberculosis
ccggcgaccgccac

SEQ ID NO: 2998363 - RNA, 14 nt, Mycobacterium avium subsp. paratuberculosis
ccggcgaccgccuu

SEQ ID NO: 2998364 - RNA, 14 nt, Mycobacterium avium subsp. paratuberculosis
ccggcgaccgugcc

SEQ ID NO: 2998365 - RNA, 20 nt, Mycobacterium avium subsp. paratuberculosis
ccggcgaccgugcccaccag

SEQ ID NO: 2998366 - RNA, 19 nt, Mycobacterium avium subsp. paratuberculosis
ccggcgacgaacgcuucca

SEQ ID NO: 2998367 - RNA, 20 nt, Mycobacterium avium subsp. paratuberculosis
ccggcgacgaagcagcucgc

SEQ ID NO: 2998368 - RNA, 21 nt, Mycobacterium avium subsp. paratuberculosis
ccggcgacgaagcagcucgcg

SEQ ID NO: 2998369 - RNA, 12 nt, Mycobacterium avium subsp. paratuberculosis
ccggcgacgacc

SEQ ID NO: 2998370 - RNA, 20 nt, Mycobacterium avium subsp. paratuberculosis
ccggcgacgaccgcaccgac

SEQ ID NO: 2998371 - RNA, 15 nt, Mycobacterium avium subsp. paratuberculosis
ccggcgacgccgcgc

SEQ ID NO: 2998372 - RNA, 17 nt, Mycobacterium avium subsp. paratuberculosis
ccggcgacgccgcgcug

SEQ ID NO: 2998373 - RNA, 13 nt, Mycobacterium avium subsp. paratuberculosis
ccggcgacgccgg

SEQ ID NO: 2998374 - RNA, 18 nt, Mycobacterium avium subsp. paratuberculosis
ccggcgacgccggcgagg

SEQ ID NO: 2998375 - RNA, 14 nt, Mycobacterium avium subsp. paratuberculosis
ccggcgacgcggcg

SEQ ID NO: 2998376 - RNA, 16 nt, Mycobacterium avium subsp. paratuberculosis
ccggcgacggccagcg

SEQ ID NO: 2998377 - RNA, 17 nt, Mycobacterium avium subsp. paratuberculosis
ccggcgacggccagcgc

SEQ ID NO: 2998378 - RNA, 21 nt, Mycobacterium avium subsp. paratuberculosis
ccggcgacggccagcgcggcg

SEQ ID NO: 2998379 - RNA, 13 nt, Mycobacterium avium subsp. paratuberculosis
ccggcgacggcgc

SEQ ID NO: 2998380 - RNA, 16 nt, Mycobacterium avium subsp. paratuberculosis
ccggcgacggcgccug

SEQ ID NO: 2998381 - RNA, 18 nt, Mycobacterium avium subsp. paratuberculosis
ccggcgacggcgccugau

SEQ ID NO: 2998382 - RNA, 15 nt, Mycobacterium avium subsp. paratuberculosis
ccggcgacggcggcc

SEQ ID NO: 2998383 - RNA, 15 nt, Mycobacterium avium subsp. paratuberculosis
ccggcgacggcggug

SEQ ID NO: 2998384 - RNA, 16 nt, Mycobacterium avium subsp. paratuberculosis
ccggcgacggcggugg

SEQ ID NO: 2998385 - RNA, 16 nt, Mycobacterium avium subsp. paratuberculosis
ccggcgacgguggcgc

SEQ ID NO: 2998386 - RNA, 21 nt, Mycobacterium avium subsp. paratuberculosis
ccggcgacgguggcgcccagc

SEQ ID NO: 2998387 - RNA, 18 nt, Mycobacterium avium subsp. paratuberculosis
ccggcgacgucgccggcc

SEQ ID NO: 2998388 - RNA, 20 nt, Mycobacterium avium subsp. paratuberculosis
ccggcgacgucgccggccug

SEQ ID NO: 2998389 - RNA, 21 nt, Mycobacterium avium subsp. paratuberculosis
ccggcgagaucuucuccccgc

SEQ ID NO: 2998390 - RNA, 23 nt, Mycobacterium avium subsp. paratuberculosis
ccggcgagcacaggaacgcgacg

SEQ ID NO: 2998391 - RNA, 15 nt, Mycobacterium avium subsp. paratuberculosis
ccggcgagcacgccg

SEQ ID NO: 2998392 - RNA, 16 nt, Mycobacterium avium subsp. paratuberculosis
ccggcgagcacgccgc

SEQ ID NO: 2998393 - RNA, 18 nt, Mycobacterium avium subsp. paratuberculosis
ccggcgagcacgccgccg

SEQ ID NO: 2998394 - RNA, 20 nt, Mycobacterium avium subsp. paratuberculosis
ccggcgagcacgccgccggu

SEQ ID NO: 2998395 - RNA, 16 nt, Mycobacterium avium subsp. paratuberculosis
ccggcgagcgcgcuga

SEQ ID NO: 2998396 - RNA, 14 nt, Mycobacterium avium subsp. paratuberculosis
ccggcgagcggcac

SEQ ID NO: 2998397 - RNA, 16 nt, Mycobacterium avium subsp. paratuberculosis
ccggcgaggcggucgg

SEQ ID NO: 2998398 - RNA, 17 nt, Mycobacterium avium subsp. paratuberculosis
ccggcgaggcggucggc

SEQ ID NO: 2998399 - RNA, 17 nt, Mycobacterium avium subsp. paratuberculosis
ccggcgaggugaaccgc

SEQ ID NO: 2998400 - RNA, 21 nt, Mycobacterium avium subsp. paratuberculosis
ccggcgaggugaaccgcgacg

SEQ ID NO: 2998401 - RNA, 22 nt, Mycobacterium avium subsp. paratuberculosis
ccggcgaggugaaccgcgacgc

SEQ ID NO: 2998402 - RNA, 16 nt, Mycobacterium avium subsp. paratuberculosis
ccggcgaggugggcac

SEQ ID NO: 2998403 - RNA, 21 nt, Mycobacterium avium subsp. paratuberculosis
ccggcgaguacccgccgcacc

SEQ ID NO: 2998404 - RNA, 14 nt, Mycobacterium avium subsp. paratuberculosis
ccggcgaguccgcg

SEQ ID NO: 2998405 - RNA, 15 nt, Mycobacterium avium subsp. paratuberculosis
ccggcgaguccgcgg

SEQ ID NO: 2998406 - RNA, 16 nt, Mycobacterium avium subsp. paratuberculosis
ccggcgaguccgcgga

SEQ ID NO: 2998407 - RNA, 18 nt, Mycobacterium avium subsp. paratuberculosis
ccggcgagucgcggauca

SEQ ID NO: 2998408 - RNA, 15 nt, Mycobacterium avium subsp. paratuberculosis
ccggcgaguggaagu

SEQ ID NO: 2998409 - RNA, 23 nt, Mycobacterium avium subsp. paratuberculosis
ccggcgaguggaagucagcgcgu

SEQ ID NO: 2998410 - RNA, 14 nt, Mycobacterium avium subsp. paratuberculosis
ccggcgaucaccgg

SEQ ID NO: 2998411 - RNA, 17 nt, Mycobacterium avium subsp. paratuberculosis
ccggcgauccgcgcggc

SEQ ID NO: 2998412 - RNA, 19 nt, Mycobacterium avium subsp. paratuberculosis
ccggcgauccgcgcggcga

SEQ ID NO: 2998413 - RNA, 21 nt, Mycobacterium avium subsp. paratuberculosis
ccggcgauccgcgcggcgacg

SEQ ID NO: 2998414 - RNA, 18 nt, Mycobacterium avium subsp. paratuberculosis
ccggcgaucgacgucacc

SEQ ID NO: 2998415 - RNA, 22 nt, Mycobacterium avium subsp. paratuberculosis
ccggcgaucgacgucaccaccg

SEQ ID NO: 2998416 - RNA, 16 nt, Mycobacterium avium subsp. paratuberculosis
ccggcgaucgucaggu

SEQ ID NO: 2998417 - RNA, 16 nt, Mycobacterium avium subsp. paratuberculosis
ccggcgaucgucgccg

SEQ ID NO: 2998418 - RNA, 17 nt, Mycobacterium avium subsp. paratuberculosis
ccggcgaucgucgccgu

SEQ ID NO: 2998419 - RNA, 19 nt, Mycobacterium avium subsp. paratuberculosis
ccggcgaucgucgccguca

SEQ ID NO: 2998420 - RNA, 12 nt, Mycobacterium avium subsp. paratuberculosis
ccggcgaucucg

SEQ ID NO: 2998421 - RNA, 16 nt, Mycobacterium avium subsp. paratuberculosis
ccggcgaucucgagca

SEQ ID NO: 2998422 - RNA, 13 nt, Mycobacterium avium subsp. paratuberculosis
ccggcgaucucgu

SEQ ID NO: 2998423 - RNA, 18 nt, Mycobacterium avium subsp. paratuberculosis
ccggcgaucucgucgcgc

SEQ ID NO: 2998424 - RNA, 23 nt, Mycobacterium avium subsp. paratuberculosis
ccggcgaucucgucgcgcagcug

SEQ ID NO: 2998425 - RNA, 19 nt, Mycobacterium avium subsp. paratuberculosis
ccggcgaugaacacgccga

SEQ ID NO: 2998426 - RNA, 20 nt, Mycobacterium avium subsp. paratuberculosis
ccggcgaugaacacgccgau

SEQ ID NO: 2998427 - RNA, 23 nt, Mycobacterium avium subsp. paratuberculosis
ccggcgaugaccgggacgaaggu

SEQ ID NO: 2998428 - RNA, 21 nt, Mycobacterium avium subsp. paratuberculosis
ccggcgaugaucaggccggac

SEQ ID NO: 2998429 - RNA, 18 nt, Mycobacterium avium subsp. paratuberculosis
ccggcgaugcagaucacc

SEQ ID NO: 2998430 - RNA, 20 nt, Mycobacterium avium subsp. paratuberculosis
ccggcgaugcagaucaccac

SEQ ID NO: 2998431 - RNA, 21 nt, Mycobacterium avium subsp. paratuberculosis
ccggcgaugcagaucaccacg

SEQ ID NO: 2998432 - RNA, 22 nt, Mycobacterium avium subsp. paratuberculosis
ccggcgaugcagaucaccacgg

SEQ ID NO: 2998433 - RNA, 14 nt, Mycobacterium avium subsp. paratuberculosis
ccggcgaugccagc

SEQ ID NO: 2998434 - RNA, 21 nt, Mycobacterium avium subsp. paratuberculosis
ccggcgaugccagcgcaccgg

SEQ ID NO: 2998435 - RNA, 17 nt, Mycobacterium avium subsp. paratuberculosis
ccggcgaugcccgugau

SEQ ID NO: 2998436 - RNA, 22 nt, Mycobacterium avium subsp. paratuberculosis
ccggcgaugcccgugaucgcca

SEQ ID NO: 2998437 - RNA, 23 nt, Mycobacterium avium subsp. paratuberculosis
ccggcgaugcccgugaucgccac

SEQ ID NO: 2998438 - RNA, 13 nt, Mycobacterium avium subsp. paratuberculosis
ccggcgaugccga

SEQ ID NO: 2998439 - RNA, 15 nt, Mycobacterium avium subsp. paratuberculosis
ccggcgaugccgagc

SEQ ID NO: 2998440 - RNA, 16 nt, Mycobacterium avium subsp. paratuberculosis
ccggcgaugccgagcc

SEQ ID NO: 2998441 - RNA, 18 nt, Mycobacterium avium subsp. paratuberculosis
ccggcgaugcgcacgucg

SEQ ID NO: 2998442 - RNA, 20 nt, Mycobacterium avium subsp. paratuberculosis
ccggcgaugcgcacgucggc

SEQ ID NO: 2998443 - RNA, 22 nt, Mycobacterium avium subsp. paratuberculosis
ccggcgaugcgcacgucggccg

SEQ ID NO: 2998444 - RNA, 19 nt, Mycobacterium avium subsp. paratuberculosis
ccggcgaugcgcgccuccg

SEQ ID NO: 2998445 - RNA, 22 nt, Mycobacterium avium subsp. paratuberculosis
ccggcgaugcgcgccuccgacg

SEQ ID NO: 2998446 - RNA, 20 nt, Mycobacterium avium subsp. paratuberculosis
ccggcgauggcgcggccggc

SEQ ID NO: 2998447 - RNA, 21 nt, Mycobacterium avium subsp. paratuberculosis
ccggcgauggcgcggccggcc

SEQ ID NO: 2998448 - RNA, 16 nt, Mycobacterium avium subsp. paratuberculosis
ccggcgaugguggcgc

SEQ ID NO: 2998449 - RNA, 18 nt, Mycobacterium avium subsp. paratuberculosis
ccggcgaugguggcgcug

SEQ ID NO: 2998450 - RNA, 15 nt, Mycobacterium avium subsp. paratuberculosis
ccggcgaugucgggc

SEQ ID NO: 2998451 - RNA, 20 nt, Mycobacterium avium subsp. paratuberculosis
ccggcgaugucgggcaccug

SEQ ID NO: 2998452 - RNA, 19 nt, Mycobacterium avium subsp. paratuberculosis
ccggcgauuaggucggugg

SEQ ID NO: 2998453 - RNA, 23 nt, Mycobacterium avium subsp. paratuberculosis
ccggcgauuaggucgguggccac

SEQ ID NO: 2998454 - RNA, 24 nt, Mycobacterium avium subsp. paratuberculosis
ccggcgcaacucguccagcgucgc

SEQ ID NO: 2998455 - RNA, 16 nt, Mycobacterium avium subsp. paratuberculosis
ccggcgcacaucgugg

SEQ ID NO: 2998456 - RNA, 22 nt, Mycobacterium avium subsp. paratuberculosis
ccggcgcacaucguggcgacga

SEQ ID NO: 2998457 - RNA, 16 nt, Mycobacterium avium subsp. paratuberculosis
ccggcgcaccaggcgc

SEQ ID NO: 2998458 - RNA, 17 nt, Mycobacterium avium subsp. paratuberculosis
ccggcgcaccaggcgcc

SEQ ID NO: 2998459 - RNA, 19 nt, Mycobacterium avium subsp. paratuberculosis
ccggcgcaccaggcgccac

SEQ ID NO: 2998460 - RNA, 16 nt, Mycobacterium avium subsp. paratuberculosis
ccggcgcaccagggug

SEQ ID NO: 2998461 - RNA, 17 nt, Mycobacterium avium subsp. paratuberculosis
ccggcgcacccgcacga

SEQ ID NO: 2998462 - RNA, 13 nt, Mycobacterium avium subsp. paratuberculosis
ccggcgcaccgcg

SEQ ID NO: 2998463 - RNA, 16 nt, Mycobacterium avium subsp. paratuberculosis
ccggcgcaccgcgucg

SEQ ID NO: 2998464 - RNA, 17 nt, Mycobacterium avium subsp. paratuberculosis
ccggcgcaccgcgucga

SEQ ID NO: 2998465 - RNA, 22 nt, Mycobacterium avium subsp. paratuberculosis
ccggcgcacgcuuuuucgcgaa

SEQ ID NO: 2998466 - RNA, 21 nt, Mycobacterium avium subsp. paratuberculosis
ccggcgcacggcgcccagguc

SEQ ID NO: 2998467 - RNA, 13 nt, Mycobacterium avium subsp. paratuberculosis
ccggcgcagcaac

SEQ ID NO: 2998468 - RNA, 17 nt, Mycobacterium avium subsp. paratuberculosis
ccggcgcagccggccac

SEQ ID NO: 2998469 - RNA, 19 nt, Mycobacterium avium subsp. paratuberculosis
ccggcgcagccggccaccg

SEQ ID NO: 2998470 - RNA, 13 nt, Mycobacterium avium subsp. paratuberculosis
ccggcgcagcggc

SEQ ID NO: 2998471 - RNA, 14 nt, Mycobacterium avium subsp. paratuberculosis
ccggcgcagcggcc

SEQ ID NO: 2998472 - RNA, 17 nt, Mycobacterium avium subsp. paratuberculosis
ccggcgcaguccagggu

SEQ ID NO: 2998473 - RNA, 19 nt, Mycobacterium avium subsp. paratuberculosis
ccggcgcaguccagggugg

SEQ ID NO: 2998474 - RNA, 21 nt, Mycobacterium avium subsp. paratuberculosis
ccggcgcaucaucucggcgaa

SEQ ID NO: 2998475 - RNA, 12 nt, Mycobacterium avium subsp. paratuberculosis
ccggcgccacga

SEQ ID NO: 2998476 - RNA, 13 nt, Mycobacterium avium subsp. paratuberculosis
ccggcgccacgac

SEQ ID NO: 2998477 - RNA, 20 nt, Mycobacterium avium subsp. paratuberculosis
ccggcgccacgcacaccgcg

SEQ ID NO: 2998478 - RNA, 22 nt, Mycobacterium avium subsp. paratuberculosis
ccggcgccacgcacaccgcgcg

SEQ ID NO: 2998479 - RNA, 17 nt, Mycobacterium avium subsp. paratuberculosis
ccggcgccaggccggcg

SEQ ID NO: 2998480 - RNA, 22 nt, Mycobacterium avium subsp. paratuberculosis
ccggcgccaggccggcgacgcc

SEQ ID NO: 2998481 - RNA, 16 nt, Mycobacterium avium subsp. paratuberculosis
ccggcgcccagcggcg

SEQ ID NO: 2998482 - RNA, 18 nt, Mycobacterium avium subsp. paratuberculosis
ccggcgcccagcggcgau

SEQ ID NO: 2998483 - RNA, 16 nt, Mycobacterium avium subsp. paratuberculosis
ccggcgccccgggcag

SEQ ID NO: 2998484 - RNA, 11 nt, Mycobacterium avium subsp. paratuberculosis
ccggcgcccga

SEQ ID NO: 2998485 - RNA, 17 nt, Mycobacterium avium subsp. paratuberculosis
ccggcgcccgaucggca

SEQ ID NO: 2998486 - RNA, 18 nt, Mycobacterium avium subsp. paratuberculosis
ccggcgcccgaucggcac

SEQ ID NO: 2998487 - RNA, 18 nt, Mycobacterium avium subsp. paratuberculosis
ccggcgcccgcaggccgc

SEQ ID NO: 2998488 - RNA, 20 nt, Mycobacterium avium subsp. paratuberculosis
ccggcgcccgcaggccgcga

SEQ ID NO: 2998489 - RNA, 13 nt, Mycobacterium avium subsp. paratuberculosis
ccggcgcccggcc

SEQ ID NO: 2998490 - RNA, 16 nt, Mycobacterium avium subsp. paratuberculosis
ccggcgcccggccggu

SEQ ID NO: 2998491 - RNA, 17 nt, Mycobacterium avium subsp. paratuberculosis
ccggcgcccggccggug

SEQ ID NO: 2998492 - RNA, 18 nt, Mycobacterium avium subsp. paratuberculosis
ccggcgcccggccggugc

SEQ ID NO: 2998493 - RNA, 18 nt, Mycobacterium avium subsp. paratuberculosis
ccggcgcccggcgcgcca

SEQ ID NO: 2998494 - RNA, 13 nt, Mycobacterium avium subsp. paratuberculosis
ccggcgcccggcu

SEQ ID NO: 2998495 - RNA, 14 nt, Mycobacterium avium subsp. paratuberculosis
ccggcgcccggcuc

SEQ ID NO: 2998496 - RNA, 19 nt, Mycobacterium avium subsp. paratuberculosis
ccggcgcccgucacgcugg

SEQ ID NO: 2998497 - RNA, 23 nt, Mycobacterium avium subsp. paratuberculosis
ccggcgcccgucacgcuggcgug

SEQ ID NO: 2998498 - RNA, 18 nt, Mycobacterium avium subsp. paratuberculosis
ccggcgcccugcacccag

SEQ ID NO: 2998499 - RNA, 22 nt, Mycobacterium avium subsp. paratuberculosis
ccggcgcccugcacccagccgu

SEQ ID NO: 2998500 - RNA, 15 nt, Mycobacterium avium subsp. paratuberculosis
ccggcgcccugcgcg

SEQ ID NO: 2998501 - RNA, 16 nt, Mycobacterium avium subsp. paratuberculosis
ccggcgcccuucggcg

SEQ ID NO: 2998502 - RNA, 17 nt, Mycobacterium avium subsp. paratuberculosis
ccggcgcccuucggcgc

SEQ ID NO: 2998503 - RNA, 21 nt, Mycobacterium avium subsp. paratuberculosis
ccggcgcccuucggcgcccgc

SEQ ID NO: 2998504 - RNA, 23 nt, Mycobacterium avium subsp. paratuberculosis
ccggcgcccuucggcgcccgcuc

SEQ ID NO: 2998505 - RNA, 19 nt, Mycobacterium avium subsp. paratuberculosis
ccggcgccgaagcccgcag

SEQ ID NO: 2998506 - RNA, 15 nt, Mycobacterium avium subsp. paratuberculosis
ccggcgccgaagccg

SEQ ID NO: 2998507 - RNA, 19 nt, Mycobacterium avium subsp. paratuberculosis
ccggcgccgaagccgucga

SEQ ID NO: 2998508 - RNA, 20 nt, Mycobacterium avium subsp. paratuberculosis
ccggcgccgaagccgucgac

SEQ ID NO: 2998509 - RNA, 24 nt, Mycobacterium avium subsp. paratuberculosis
ccggcgccgaagccgucgaccccg

SEQ ID NO: 2998510 - RNA, 13 nt, Mycobacterium avium subsp. paratuberculosis
ccggcgccgaccc

SEQ ID NO: 2998511 - RNA, 16 nt, Mycobacterium avium subsp. paratuberculosis
ccggcgccgacccccg

SEQ ID NO: 2998512 - RNA, 15 nt, Mycobacterium avium subsp. paratuberculosis
ccggcgccgaccgag

SEQ ID NO: 2998513 - RNA, 22 nt, Mycobacterium avium subsp. paratuberculosis
ccggcgccgaccgagggcgcgg

SEQ ID NO: 2998514 - RNA, 14 nt, Mycobacterium avium subsp. paratuberculosis
ccggcgccgacgac

SEQ ID NO: 2998515 - RNA, 15 nt, Mycobacterium avium subsp. paratuberculosis
ccggcgccgacgacg

SEQ ID NO: 2998516 - RNA, 18 nt, Mycobacterium avium subsp. paratuberculosis
ccggcgccgaucugcucg

SEQ ID NO: 2998517 - RNA, 22 nt, Mycobacterium avium subsp. paratuberculosis
ccggcgccgcagcggcgccggg

SEQ ID NO: 2998518 - RNA, 12 nt, Mycobacterium avium subsp. paratuberculosis
ccggcgccgcca

SEQ ID NO: 2998519 - RNA, 15 nt, Mycobacterium avium subsp. paratuberculosis
ccggcgccgccacca

SEQ ID NO: 2998520 - RNA, 16 nt, Mycobacterium avium subsp. paratuberculosis
ccggcgccgccaccac

SEQ ID NO: 2998521 - RNA, 21 nt, Mycobacterium avium subsp. paratuberculosis
ccggcgccgccgaccgcccgc

SEQ ID NO: 2998522 - RNA, 23 nt, Mycobacterium avium subsp. paratuberculosis
ccggcgccgccgaccgcccgcug

SEQ ID NO: 2998523 - RNA, 22 nt, Mycobacterium avium subsp. paratuberculosis
ccggcgccgccguucgccggcg

SEQ ID NO: 2998524 - RNA, 12 nt, Mycobacterium avium subsp. paratuberculosis
ccggcgccgcgg

SEQ ID NO: 2998525 - RNA, 19 nt, Mycobacterium avium subsp. paratuberculosis
ccggcgccggacggcccgc

SEQ ID NO: 2998526 - RNA, 13 nt, Mycobacterium avium subsp. paratuberculosis
ccggcgccggauc

SEQ ID NO: 2998527 - RNA, 15 nt, Mycobacterium avium subsp. paratuberculosis
ccggcgccggaucau

SEQ ID NO: 2998528 - RNA, 14 nt, Mycobacterium avium subsp. paratuberculosis
ccggcgccggcccg

SEQ ID NO: 2998529 - RNA, 14 nt, Mycobacterium avium subsp. paratuberculosis
ccggcgccggccga

SEQ ID NO: 2998530 - RNA, 16 nt, Mycobacterium avium subsp. paratuberculosis
ccggcgccggccgaca

SEQ ID NO: 2998531 - RNA, 14 nt, Mycobacterium avium subsp. paratuberculosis
ccggcgccggccgc

SEQ ID NO: 2998532 - RNA, 16 nt, Mycobacterium avium subsp. paratuberculosis
ccggcgccggccgccg

SEQ ID NO: 2998533 - RNA, 12 nt, Mycobacterium avium subsp. paratuberculosis
ccggcgccggcg

SEQ ID NO: 2998534 - RNA, 13 nt, Mycobacterium avium subsp. paratuberculosis
ccggcgccggcgg

SEQ ID NO: 2998535 - RNA, 16 nt, Mycobacterium avium subsp. paratuberculosis
ccggcgccggcggcca

SEQ ID NO: 2998536 - RNA, 14 nt, Mycobacterium avium subsp. paratuberculosis
ccggcgccggcggu

SEQ ID NO: 2998537 - RNA, 16 nt, Mycobacterium avium subsp. paratuberculosis
ccggcgccggcgguca

SEQ ID NO: 2998538 - RNA, 18 nt, Mycobacterium avium subsp. paratuberculosis
ccggcgccggcggucagc

SEQ ID NO: 2998539 - RNA, 12 nt, Mycobacterium avium subsp. paratuberculosis
ccggcgccgggc

SEQ ID NO: 2998540 - RNA, 18 nt, Mycobacterium avium subsp. paratuberculosis
ccggcgccgggcagcccg

SEQ ID NO: 2998541 - RNA, 15 nt, Mycobacterium avium subsp. paratuberculosis
ccggcgccgggucgc

SEQ ID NO: 2998542 - RNA, 15 nt, Mycobacterium avium subsp. paratuberculosis
ccggcgccggucagc

SEQ ID NO: 2998543 - RNA, 18 nt, Mycobacterium avium subsp. paratuberculosis
ccggcgccggucguuacg

SEQ ID NO: 2998544 - RNA, 12 nt, Mycobacterium avium subsp. paratuberculosis
ccggcgccggug

SEQ ID NO: 2998545 - RNA, 13 nt, Mycobacterium avium subsp. paratuberculosis
ccggcgccggugc

SEQ ID NO: 2998546 - RNA, 19 nt, Mycobacterium avium subsp. paratuberculosis
ccggcgccggugccgcagc

SEQ ID NO: 2998547 - RNA, 23 nt, Mycobacterium avium subsp. paratuberculosis
ccggcgccggugccgcagccguc

SEQ ID NO: 2998548 - RNA, 23 nt, Mycobacterium avium subsp. paratuberculosis
ccggcgccgucgauccacccacc

SEQ ID NO: 2998549 - RNA, 15 nt, Mycobacterium avium subsp. paratuberculosis
ccggcgccgucguuc

SEQ ID NO: 2998550 - RNA, 21 nt, Mycobacterium avium subsp. paratuberculosis
ccggcgccgucguucuccauc

SEQ ID NO: 2998551 - RNA, 12 nt, Mycobacterium avium subsp. paratuberculosis
ccggcgccucga

SEQ ID NO: 2998552 - RNA, 16 nt, Mycobacterium avium subsp. paratuberculosis
ccggcgccucggcgcc

SEQ ID NO: 2998553 - RNA, 17 nt, Mycobacterium avium subsp. paratuberculosis
ccggcgccucgugcaug

SEQ ID NO: 2998554 - RNA, 14 nt, Mycobacterium avium subsp. paratuberculosis
ccggcgcgaccagc

SEQ ID NO: 2998555 - RNA, 21 nt, Mycobacterium avium subsp. paratuberculosis
ccggcgcgaccagcggcagca

SEQ ID NO: 2998556 - RNA, 23 nt, Mycobacterium avium subsp. paratuberculosis
ccggcgcgaccagcggcagcagc

SEQ ID NO: 2998557 - RNA, 17 nt, Mycobacterium avium subsp. paratuberculosis
ccggcgcgaccagguuc

SEQ ID NO: 2998558 - RNA, 14 nt, Mycobacterium avium subsp. paratuberculosis
ccggcgcgacggca

SEQ ID NO: 2998559 - RNA, 15 nt, Mycobacterium avium subsp. paratuberculosis
ccggcgcgacggcgg

SEQ ID NO: 2998560 - RNA, 13 nt, Mycobacterium avium subsp. paratuberculosis
ccggcgcgaucgg

SEQ ID NO: 2998561 - RNA, 14 nt, Mycobacterium avium subsp. paratuberculosis
ccggcgcgaucggc

SEQ ID NO: 2998562 - RNA, 16 nt, Mycobacterium avium subsp. paratuberculosis
ccggcgcgcacggcag

SEQ ID NO: 2998563 - RNA, 12 nt, Mycobacterium avium subsp. paratuberculosis
ccggcgcgcagc

SEQ ID NO: 2998564 - RNA, 13 nt, Mycobacterium avium subsp. paratuberculosis
ccggcgcgcagca

SEQ ID NO: 2998565 - RNA, 21 nt, Mycobacterium avium subsp. paratuberculosis
ccggcgcgcagccagucgccg

SEQ ID NO: 2998566 - RNA, 23 nt, Mycobacterium avium subsp. paratuberculosis
ccggcgcgcagccagucgccggc

SEQ ID NO: 2998567 - RNA, 15 nt, Mycobacterium avium subsp. paratuberculosis
ccggcgcgcagcgug

SEQ ID NO: 2998568 - RNA, 23 nt, Mycobacterium avium subsp. paratuberculosis
ccggcgcgcagcgugugcaccug

SEQ ID NO: 2998569 - RNA, 11 nt, Mycobacterium avium subsp. paratuberculosis
ccggcgcgccc

SEQ ID NO: 2998570 - RNA, 19 nt, Mycobacterium avium subsp. paratuberculosis
ccggcgcgcccgagucacc

SEQ ID NO: 2998571 - RNA, 22 nt, Mycobacterium avium subsp. paratuberculosis
ccggcgcgcccgagucacccgg

SEQ ID NO: 2998572 - RNA, 19 nt, Mycobacterium avium subsp. paratuberculosis
ccggcgcgcccggaaagcg

SEQ ID NO: 2998573 - RNA, 12 nt, Mycobacterium avium subsp. paratuberculosis
ccggcgcgccgc

SEQ ID NO: 2998574 - RNA, 14 nt, Mycobacterium avium subsp. paratuberculosis
ccggcgcgccgcga

SEQ ID NO: 2998575 - RNA, 15 nt, Mycobacterium avium subsp. paratuberculosis
ccggcgcgccgcgau

SEQ ID NO: 2998576 - RNA, 12 nt, Mycobacterium avium subsp. paratuberculosis
ccggcgcgccgu

SEQ ID NO: 2998577 - RNA, 16 nt, Mycobacterium avium subsp. paratuberculosis
ccggcgcgccguccuu

SEQ ID NO: 2998578 - RNA, 22 nt, Mycobacterium avium subsp. paratuberculosis
ccggcgcgccguccuuggucac

SEQ ID NO: 2998579 - RNA, 13 nt, Mycobacterium avium subsp. paratuberculosis
ccggcgcgccugc

SEQ ID NO: 2998580 - RNA, 19 nt, Mycobacterium avium subsp. paratuberculosis
ccggcgcgccugcgcggcg

SEQ ID NO: 2998581 - RNA, 20 nt, Mycobacterium avium subsp. paratuberculosis
ccggcgcgccugcgcggcgg

SEQ ID NO: 2998582 - RNA, 18 nt, Mycobacterium avium subsp. paratuberculosis
ccggcgcgcgagcgucac

SEQ ID NO: 2998583 - RNA, 19 nt, Mycobacterium avium subsp. paratuberculosis
ccggcgcgcgagcgucacg

SEQ ID NO: 2998584 - RNA, 23 nt, Mycobacterium avium subsp. paratuberculosis
ccggcgcgcgagcgucacgcugg

SEQ ID NO: 2998585 - RNA, 19 nt, Mycobacterium avium subsp. paratuberculosis
ccggcgcgcggagaucacc

SEQ ID NO: 2998586 - RNA, 14 nt, Mycobacterium avium subsp. paratuberculosis
ccggcgcgcggugg

SEQ ID NO: 2998587 - RNA, 22 nt, Mycobacterium avium subsp. paratuberculosis
ccggcgcggaacagcgucgccg

SEQ ID NO: 2998588 - RNA, 19 nt, Mycobacterium avium subsp. paratuberculosis
ccggcgcggaacgcgccgg

SEQ ID NO: 2998589 - RNA, 21 nt, Mycobacterium avium subsp. paratuberculosis
ccggcgcggaacgcgccgggc

SEQ ID NO: 2998590 - RNA, 14 nt, Mycobacterium avium subsp. paratuberculosis
ccggcgcggacagc

SEQ ID NO: 2998591 - RNA, 19 nt, Mycobacterium avium subsp. paratuberculosis
ccggcgcggacagcgcggu

SEQ ID NO: 2998592 - RNA, 16 nt, Mycobacterium avium subsp. paratuberculosis
ccggcgcggcagggcc

SEQ ID NO: 2998593 - RNA, 20 nt, Mycobacterium avium subsp. paratuberculosis
ccggcgcggcagggccaggc

SEQ ID NO: 2998594 - RNA, 13 nt, Mycobacterium avium subsp. paratuberculosis
ccggcgcggcauc

SEQ ID NO: 2998595 - RNA, 14 nt, Mycobacterium avium subsp. paratuberculosis
ccggcgcggcaucg

SEQ ID NO: 2998596 - RNA, 15 nt, Mycobacterium avium subsp. paratuberculosis
ccggcgcggcaucgg

SEQ ID NO: 2998597 - RNA, 18 nt, Mycobacterium avium subsp. paratuberculosis
ccggcgcggcaucggcga

SEQ ID NO: 2998598 - RNA, 12 nt, Mycobacterium avium subsp. paratuberculosis
ccggcgcggcca

SEQ ID NO: 2998599 - RNA, 14 nt, Mycobacterium avium subsp. paratuberculosis
ccggcgcggccagc

SEQ ID NO: 2998600 - RNA, 15 nt, Mycobacterium avium subsp. paratuberculosis
ccggcgcggccagcu

SEQ ID NO: 2998601 - RNA, 17 nt, Mycobacterium avium subsp. paratuberculosis
ccggcgcggccagcuga

SEQ ID NO: 2998602 - RNA, 12 nt, Mycobacterium avium subsp. paratuberculosis
ccggcgcggccg

SEQ ID NO: 2998603 - RNA, 13 nt, Mycobacterium avium subsp. paratuberculosis
ccggcgcggccgc

SEQ ID NO: 2998604 - RNA, 24 nt, Mycobacterium avium subsp. paratuberculosis
ccggcgcggccggugcgcgucagc

SEQ ID NO: 2998605 - RNA, 21 nt, Mycobacterium avium subsp. paratuberculosis
ccggcgcggcggcgacgucga

SEQ ID NO: 2998606 - RNA, 22 nt, Mycobacterium avium subsp. paratuberculosis
ccggcgcggcggcgacgucgac

SEQ ID NO: 2998607 - RNA, 18 nt, Mycobacterium avium subsp. paratuberculosis
ccggcgcggcggcgccgc

SEQ ID NO: 2998608 - RNA, 21 nt, Mycobacterium avium subsp. paratuberculosis
ccggcgcggcggcgccgcggu

SEQ ID NO: 2998609 - RNA, 13 nt, Mycobacterium avium subsp. paratuberculosis
ccggcgcgggcau

SEQ ID NO: 2998610 - RNA, 15 nt, Mycobacterium avium subsp. paratuberculosis
ccggcgcgggcauga

SEQ ID NO: 2998611 - RNA, 17 nt, Mycobacterium avium subsp. paratuberculosis
ccggcgcgggccgcagc

SEQ ID NO: 2998612 - RNA, 22 nt, Mycobacterium avium subsp. paratuberculosis
ccggcgcgggccgcagcgcgcg

SEQ ID NO: 2998613 - RNA, 19 nt, Mycobacterium avium subsp. paratuberculosis
ccggcgcgggggcggccug

SEQ ID NO: 2998614 - RNA, 23 nt, Mycobacterium avium subsp. paratuberculosis
ccggcgcggugauucgaagaaca

SEQ ID NO: 2998615 - RNA, 12 nt, Mycobacterium avium subsp. paratuberculosis
ccggcgcggugc

SEQ ID NO: 2998616 - RNA, 22 nt, Mycobacterium avium subsp. paratuberculosis
ccggcgcggugcucggcgcgcg

SEQ ID NO: 2998617 - RNA, 19 nt, Mycobacterium avium subsp. paratuberculosis
ccggcgcggugggcggcgg

SEQ ID NO: 2998618 - RNA, 20 nt, Mycobacterium avium subsp. paratuberculosis
ccggcgcgguugcccgcacc

SEQ ID NO: 2998619 - RNA, 16 nt, Mycobacterium avium subsp. paratuberculosis
ccggcgcgugcgcgac

SEQ ID NO: 2998620 - RNA, 18 nt, Mycobacterium avium subsp. paratuberculosis
ccggcgcguuccaucagc

SEQ ID NO: 2998621 - RNA, 21 nt, Mycobacterium avium subsp. paratuberculosis
ccggcgcguuccaucagcgcc

SEQ ID NO: 2998622 - RNA, 22 nt, Mycobacterium avium subsp. paratuberculosis
ccggcgcguuccaucagcgccc

SEQ ID NO: 2998623 - RNA, 21 nt, Mycobacterium avium subsp. paratuberculosis
ccggcgcguuggcccgugucg

SEQ ID NO: 2998624 - RNA, 18 nt, Mycobacterium avium subsp. paratuberculosis
ccggcgcuaaagccgacc

SEQ ID NO: 2998625 - RNA, 20 nt, Mycobacterium avium subsp. paratuberculosis
ccggcgcuaaagccgaccgc

SEQ ID NO: 2998626 - RNA, 18 nt, Mycobacterium avium subsp. paratuberculosis
ccggcgcuacgccggcuc

SEQ ID NO: 2998627 - RNA, 13 nt, Mycobacterium avium subsp. paratuberculosis
ccggcgcucaccg

SEQ ID NO: 2998628 - RNA, 15 nt, Mycobacterium avium subsp. paratuberculosis
ccggcgcucaccgcg

SEQ ID NO: 2998629 - RNA, 18 nt, Mycobacterium avium subsp. paratuberculosis
ccggcgcucaccgcgaug

SEQ ID NO: 2998630 - RNA, 15 nt, Mycobacterium avium subsp. paratuberculosis
ccggcgcucgucguc

SEQ ID NO: 2998631 - RNA, 12 nt, Mycobacterium avium subsp. paratuberculosis
ccggcgcugccc

SEQ ID NO: 2998632 - RNA, 19 nt, Mycobacterium avium subsp. paratuberculosis
ccggcgcugcccgcgaucg

SEQ ID NO: 2998633 - RNA, 13 nt, Mycobacterium avium subsp. paratuberculosis
ccggcgcugcgcc

SEQ ID NO: 2998634 - RNA, 18 nt, Mycobacterium avium subsp. paratuberculosis
ccggcgcugcgcccgguc

SEQ ID NO: 2998635 - RNA, 14 nt, Mycobacterium avium subsp. paratuberculosis
ccggcgcuucugcg

SEQ ID NO: 2998636 - RNA, 22 nt, Mycobacterium avium subsp. paratuberculosis
ccggcggaaguagcccggagug

SEQ ID NO: 2998637 - RNA, 12 nt, Mycobacterium avium subsp. paratuberculosis
ccggcggacagc

SEQ ID NO: 2998638 - RNA, 13 nt, Mycobacterium avium subsp. paratuberculosis
ccggcggacagcc

SEQ ID NO: 2998639 - RNA, 15 nt, Mycobacterium avium subsp. paratuberculosis
ccggcggacagcccc

SEQ ID NO: 2998640 - RNA, 21 nt, Mycobacterium avium subsp. paratuberculosis
ccggcggacccagcuccucgg

SEQ ID NO: 2998641 - RNA, 14 nt, Mycobacterium avium subsp. paratuberculosis
ccggcggacccgga

SEQ ID NO: 2998642 - RNA, 22 nt, Mycobacterium avium subsp. paratuberculosis
ccggcggacccggaggcggcgg

SEQ ID NO: 2998643 - RNA, 14 nt, Mycobacterium avium subsp. paratuberculosis
ccggcggacgcggc

SEQ ID NO: 2998644 - RNA, 19 nt, Mycobacterium avium subsp. paratuberculosis
ccggcggacgcggccagcg

SEQ ID NO: 2998645 - RNA, 17 nt, Mycobacterium avium subsp. paratuberculosis
ccggcggauauagccga

SEQ ID NO: 2998646 - RNA, 20 nt, Mycobacterium avium subsp. paratuberculosis
ccggcggauccucaguccgc

SEQ ID NO: 2998647 - RNA, 14 nt, Mycobacterium avium subsp. paratuberculosis
ccggcggauucucg

SEQ ID NO: 2998648 - RNA, 21 nt, Mycobacterium avium subsp. paratuberculosis
ccggcggcaaaacgcugggcg

SEQ ID NO: 2998649 - RNA, 14 nt, Mycobacterium avium subsp. paratuberculosis
ccggcggcaccacc

SEQ ID NO: 2998650 - RNA, 17 nt, Mycobacterium avium subsp. paratuberculosis
ccggcggcaccacccgc

SEQ ID NO: 2998651 - RNA, 24 nt, Mycobacterium avium subsp. paratuberculosis
ccggcggcaccacccgcggccggc

SEQ ID NO: 2998652 - RNA, 14 nt, Mycobacterium avium subsp. paratuberculosis
ccggcggcaccgcg

SEQ ID NO: 2998653 - RNA, 15 nt, Mycobacterium avium subsp. paratuberculosis
ccggcggcaccgcgg

SEQ ID NO: 2998654 - RNA, 16 nt, Mycobacterium avium subsp. paratuberculosis
ccggcggcaccgcggc

SEQ ID NO: 2998655 - RNA, 16 nt, Mycobacterium avium subsp. paratuberculosis
ccggcggcagccaggc

SEQ ID NO: 2998656 - RNA, 18 nt, Mycobacterium avium subsp. paratuberculosis
ccggcggcagccaggcgu

SEQ ID NO: 2998657 - RNA, 22 nt, Mycobacterium avium subsp. paratuberculosis
ccggcggcagcgacucgggcag

SEQ ID NO: 2998658 - RNA, 14 nt, Mycobacterium avium subsp. paratuberculosis
ccggcggcagguga

SEQ ID NO: 2998659 - RNA, 18 nt, Mycobacterium avium subsp. paratuberculosis
ccggcggcaguccggcga

SEQ ID NO: 2998660 - RNA, 19 nt, Mycobacterium avium subsp. paratuberculosis
ccggcggcagugcgccguc

SEQ ID NO: 2998661 - RNA, 21 nt, Mycobacterium avium subsp. paratuberculosis
ccggcggcagugcgccguccc

SEQ ID NO: 2998662 - RNA, 22 nt, Mycobacterium avium subsp. paratuberculosis
ccggcggcagugcgccgucccg

SEQ ID NO: 2998663 - RNA, 14 nt, Mycobacterium avium subsp. paratuberculosis
ccggcggccaccau

SEQ ID NO: 2998664 - RNA, 15 nt, Mycobacterium avium subsp. paratuberculosis
ccggcggccaccaug

SEQ ID NO: 2998665 - RNA, 13 nt, Mycobacterium avium subsp. paratuberculosis
ccggcggccacgc

SEQ ID NO: 2998666 - RNA, 15 nt, Mycobacterium avium subsp. paratuberculosis
ccggcggccacgcag

SEQ ID NO: 2998667 - RNA, 13 nt, Mycobacterium avium subsp. paratuberculosis
ccggcggccagca

SEQ ID NO: 2998668 - RNA, 16 nt, Mycobacterium avium subsp. paratuberculosis
ccggcggccagcaucg

SEQ ID NO: 2998669 - RNA, 14 nt, Mycobacterium avium subsp. paratuberculosis
ccggcggccagcga

SEQ ID NO: 2998670 - RNA, 20 nt, Mycobacterium avium subsp. paratuberculosis
ccggcggccauggucgcggc

SEQ ID NO: 2998671 - RNA, 12 nt, Mycobacterium avium subsp. paratuberculosis
ccggcggccccg

SEQ ID NO: 2998672 - RNA, 13 nt, Mycobacterium avium subsp. paratuberculosis
ccggcggccgaca

SEQ ID NO: 2998673 - RNA, 15 nt, Mycobacterium avium subsp. paratuberculosis
ccggcggccgacagg

SEQ ID NO: 2998674 - RNA, 18 nt, Mycobacterium avium subsp. paratuberculosis
ccggcggccgacagggug

SEQ ID NO: 2998675 - RNA, 12 nt, Mycobacterium avium subsp. paratuberculosis
ccggcggccgcc

SEQ ID NO: 2998676 - RNA, 13 nt, Mycobacterium avium subsp. paratuberculosis
ccggcggccgcca

SEQ ID NO: 2998677 - RNA, 14 nt, Mycobacterium avium subsp. paratuberculosis
ccggcggccgccac

SEQ ID NO: 2998678 - RNA, 23 nt, Mycobacterium avium subsp. paratuberculosis
ccggcggccgccacgcuggugug

SEQ ID NO: 2998679 - RNA, 14 nt, Mycobacterium avium subsp. paratuberculosis
ccggcggccgccau

SEQ ID NO: 2998680 - RNA, 17 nt, Mycobacterium avium subsp. paratuberculosis
ccggcggccgccaucau

SEQ ID NO: 2998681 - RNA, 21 nt, Mycobacterium avium subsp. paratuberculosis
ccggcggccgccgcccgcgcg

SEQ ID NO: 2998682 - RNA, 14 nt, Mycobacterium avium subsp. paratuberculosis
ccggcggccgccgg

SEQ ID NO: 2998683 - RNA, 15 nt, Mycobacterium avium subsp. paratuberculosis
ccggcggccgccggc

SEQ ID NO: 2998684 - RNA, 16 nt, Mycobacterium avium subsp. paratuberculosis
ccggcggccgccggca

SEQ ID NO: 2998685 - RNA, 17 nt, Mycobacterium avium subsp. paratuberculosis
ccggcggccgccggcac

SEQ ID NO: 2998686 - RNA, 13 nt, Mycobacterium avium subsp. paratuberculosis
ccggcggccgcga

SEQ ID NO: 2998687 - RNA, 15 nt, Mycobacterium avium subsp. paratuberculosis
ccggcggccgcgacg

SEQ ID NO: 2998688 - RNA, 16 nt, Mycobacterium avium subsp. paratuberculosis
ccggcggccgcgacgg

SEQ ID NO: 2998689 - RNA, 21 nt, Mycobacterium avium subsp. paratuberculosis
ccggcggccgcgacggaccag

SEQ ID NO: 2998690 - RNA, 15 nt, Mycobacterium avium subsp. paratuberculosis
ccggcggccgcgucg

SEQ ID NO: 2998691 - RNA, 16 nt, Mycobacterium avium subsp. paratuberculosis
ccggcggccgcgucgg

SEQ ID NO: 2998692 - RNA, 17 nt, Mycobacterium avium subsp. paratuberculosis
ccggcggccgcgucggc

SEQ ID NO: 2998693 - RNA, 19 nt, Mycobacterium avium subsp. paratuberculosis
ccggcggccgcgucggcgg

SEQ ID NO: 2998694 - RNA, 12 nt, Mycobacterium avium subsp. paratuberculosis
ccggcggccggc

SEQ ID NO: 2998695 - RNA, 15 nt, Mycobacterium avium subsp. paratuberculosis
ccggcggccggcccc

SEQ ID NO: 2998696 - RNA, 13 nt, Mycobacterium avium subsp. paratuberculosis
ccggcggccggcg

SEQ ID NO: 2998697 - RNA, 15 nt, Mycobacterium avium subsp. paratuberculosis
ccggcggccggcggc

SEQ ID NO: 2998698 - RNA, 17 nt, Mycobacterium avium subsp. paratuberculosis
ccggcggcgaagccggc

SEQ ID NO: 2998699 - RNA, 18 nt, Mycobacterium avium subsp. paratuberculosis
ccggcggcgaagccggcc

SEQ ID NO: 2998700 - RNA, 19 nt, Mycobacterium avium subsp. paratuberculosis
ccggcggcgaagccggccc

SEQ ID NO: 2998701 - RNA, 22 nt, Mycobacterium avium subsp. paratuberculosis
ccggcggcgaagccggccccgc

SEQ ID NO: 2998702 - RNA, 14 nt, Mycobacterium avium subsp. paratuberculosis
ccggcggcgacggc

SEQ ID NO: 2998703 - RNA, 22 nt, Mycobacterium avium subsp. paratuberculosis
ccggcggcgacggcaccgccgg

SEQ ID NO: 2998704 - RNA, 18 nt, Mycobacterium avium subsp. paratuberculosis
ccggcggcgaucgccgcg

SEQ ID NO: 2998705 - RNA, 19 nt, Mycobacterium avium subsp. paratuberculosis
ccggcggcgaucggcgcgg

SEQ ID NO: 2998706 - RNA, 13 nt, Mycobacterium avium subsp. paratuberculosis
ccggcggcgauga

SEQ ID NO: 2998707 - RNA, 15 nt, Mycobacterium avium subsp. paratuberculosis
ccggcggcgaugauc

SEQ ID NO: 2998708 - RNA, 21 nt, Mycobacterium avium subsp. paratuberculosis
ccggcggcgaugaucgggaug

SEQ ID NO: 2998709 - RNA, 19 nt, Mycobacterium avium subsp. paratuberculosis
ccggcggcgcccgcggccu

SEQ ID NO: 2998710 - RNA, 13 nt, Mycobacterium avium subsp. paratuberculosis
ccggcggcgccgg

SEQ ID NO: 2998711 - RNA, 22 nt, Mycobacterium avium subsp. paratuberculosis
ccggcggcgccggaggccagcu

SEQ ID NO: 2998712 - RNA, 19 nt, Mycobacterium avium subsp. paratuberculosis
ccggcggcgccuugccggu

SEQ ID NO: 2998713 - RNA, 12 nt, Mycobacterium avium subsp. paratuberculosis
ccggcggcgcgg

SEQ ID NO: 2998714 - RNA, 13 nt, Mycobacterium avium subsp. paratuberculosis
ccggcggcgcggc

SEQ ID NO: 2998715 - RNA, 17 nt, Mycobacterium avium subsp. paratuberculosis
ccggcggcgcucagcgc

SEQ ID NO: 2998716 - RNA, 20 nt, Mycobacterium avium subsp. paratuberculosis
ccggcggcgcucagcgcggc

SEQ ID NO: 2998717 - RNA, 17 nt, Mycobacterium avium subsp. paratuberculosis
ccggcggcgcugcccca

SEQ ID NO: 2998718 - RNA, 21 nt, Mycobacterium avium subsp. paratuberculosis
ccggcggcgcugccccagcca

SEQ ID NO: 2998719 - RNA, 13 nt, Mycobacterium avium subsp. paratuberculosis
ccggcggcggacc

SEQ ID NO: 2998720 - RNA, 14 nt, Mycobacterium avium subsp. paratuberculosis
ccggcggcggaccg

SEQ ID NO: 2998721 - RNA, 16 nt, Mycobacterium avium subsp. paratuberculosis
ccggcggcggaccguc

SEQ ID NO: 2998722 - RNA, 13 nt, Mycobacterium avium subsp. paratuberculosis
ccggcggcggcca

SEQ ID NO: 2998723 - RNA, 15 nt, Mycobacterium avium subsp. paratuberculosis
ccggcggcggccagc

SEQ ID NO: 2998724 - RNA, 17 nt, Mycobacterium avium subsp. paratuberculosis
ccggcggcggccagcga

SEQ ID NO: 2998725 - RNA, 18 nt, Mycobacterium avium subsp. paratuberculosis
ccggcggcggcggucggc

SEQ ID NO: 2998726 - RNA, 19 nt, Mycobacterium avium subsp. paratuberculosis
ccggcggcggcggucggca

SEQ ID NO: 2998727 - RNA, 15 nt, Mycobacterium avium subsp. paratuberculosis
ccggcggcggugagc

SEQ ID NO: 2998728 - RNA, 18 nt, Mycobacterium avium subsp. paratuberculosis
ccggcggcggugcgucgg

SEQ ID NO: 2998729 - RNA, 23 nt, Mycobacterium avium subsp. paratuberculosis
ccggcggcgguuuuggucggcac

SEQ ID NO: 2998730 - RNA, 19 nt, Mycobacterium avium subsp. paratuberculosis
ccggcggcgucccacgugg

SEQ ID NO: 2998731 - RNA, 22 nt, Mycobacterium avium subsp. paratuberculosis
ccggcggcgucccacgugguga

SEQ ID NO: 2998732 - RNA, 19 nt, Mycobacterium avium subsp. paratuberculosis
ccggcggcgucgugaccga

SEQ ID NO: 2998733 - RNA, 18 nt, Mycobacterium avium subsp. paratuberculosis
ccggcggcguugaggcgu

SEQ ID NO: 2998734 - RNA, 16 nt, Mycobacterium avium subsp. paratuberculosis
ccggcggcugggcagc

SEQ ID NO: 2998735 - RNA, 17 nt, Mycobacterium avium subsp. paratuberculosis
ccggcggcugggcagcc

SEQ ID NO: 2998736 - RNA, 19 nt, Mycobacterium avium subsp. paratuberculosis
ccggcggcugggcagccgc

SEQ ID NO: 2998737 - RNA, 22 nt, Mycobacterium avium subsp. paratuberculosis
ccggcggcugggcagccgcgcg

SEQ ID NO: 2998738 - RNA, 18 nt, Mycobacterium avium subsp. paratuberculosis
ccggcgggcgccggucgg

SEQ ID NO: 2998739 - RNA, 21 nt, Mycobacterium avium subsp. paratuberculosis
ccggcgggcgccggucggcgg

SEQ ID NO: 2998740 - RNA, 18 nt, Mycobacterium avium subsp. paratuberculosis
ccggcgggcggccgaucc

SEQ ID NO: 2998741 - RNA, 13 nt, Mycobacterium avium subsp. paratuberculosis
ccggcgggcggcg

SEQ ID NO: 2998742 - RNA, 14 nt, Mycobacterium avium subsp. paratuberculosis
ccggcgggcggcgg

SEQ ID NO: 2998743 - RNA, 19 nt, Mycobacterium avium subsp. paratuberculosis
ccggcgggcggcggcguug

SEQ ID NO: 2998744 - RNA, 13 nt, Mycobacterium avium subsp. paratuberculosis
ccggcgggcucgc

SEQ ID NO: 2998745 - RNA, 15 nt, Mycobacterium avium subsp. paratuberculosis
ccggcgggcucgccg

SEQ ID NO: 2998746 - RNA, 19 nt, Mycobacterium avium subsp. paratuberculosis
ccggcgggcucgccggccc

SEQ ID NO: 2998747 - RNA, 15 nt, Mycobacterium avium subsp. paratuberculosis
ccggcgggcuggugc

SEQ ID NO: 2998748 - RNA, 20 nt, Mycobacterium avium subsp. paratuberculosis
ccggcgggcuggugcgcagc

SEQ ID NO: 2998749 - RNA, 22 nt, Mycobacterium avium subsp. paratuberculosis
ccggcgggcuggugcgcagccg

SEQ ID NO: 2998750 - RNA, 17 nt, Mycobacterium avium subsp. paratuberculosis
ccggcggggcgucgccc

SEQ ID NO: 2998751 - RNA, 20 nt, Mycobacterium avium subsp. paratuberculosis
ccggcggggcgucgcccgcc

SEQ ID NO: 2998752 - RNA, 23 nt, Mycobacterium avium subsp. paratuberculosis
ccggcggggcgucgcccgccgac

SEQ ID NO: 2998753 - RNA, 24 nt, Mycobacterium avium subsp. paratuberculosis
ccggcggggcgucgcccgccgacg

SEQ ID NO: 2998754 - RNA, 16 nt, Mycobacterium avium subsp. paratuberculosis
ccggcgggggaucggg

SEQ ID NO: 2998755 - RNA, 13 nt, Mycobacterium avium subsp. paratuberculosis
ccggcgggggcgc

SEQ ID NO: 2998756 - RNA, 22 nt, Mycobacterium avium subsp. paratuberculosis
ccggcgggggcgcguccgcggg

SEQ ID NO: 2998757 - RNA, 16 nt, Mycobacterium avium subsp. paratuberculosis
ccggcgggggcggcgg

SEQ ID NO: 2998758 - RNA, 21 nt, Mycobacterium avium subsp. paratuberculosis
ccggcgggggcggcgggguga

SEQ ID NO: 2998759 - RNA, 23 nt, Mycobacterium avium subsp. paratuberculosis
ccggcgggggcggcggggugacg

SEQ ID NO: 2998760 - RNA, 18 nt, Mycobacterium avium subsp. paratuberculosis
ccggcggggguucgacgu

SEQ ID NO: 2998761 - RNA, 13 nt, Mycobacterium avium subsp. paratuberculosis
ccggcgggucagc

SEQ ID NO: 2998762 - RNA, 19 nt, Mycobacterium avium subsp. paratuberculosis
ccggcgggucagcaccgcg

SEQ ID NO: 2998763 - RNA, 15 nt, Mycobacterium avium subsp. paratuberculosis
ccggcgggucagcag

SEQ ID NO: 2998764 - RNA, 16 nt, Mycobacterium avium subsp. paratuberculosis
ccggcgggucagcagc

SEQ ID NO: 2998765 - RNA, 17 nt, Mycobacterium avium subsp. paratuberculosis
ccggcgggugagccggu

SEQ ID NO: 2998766 - RNA, 18 nt, Mycobacterium avium subsp. paratuberculosis
ccggcgggugagccgguc

SEQ ID NO: 2998767 - RNA, 24 nt, Mycobacterium avium subsp. paratuberculosis
ccggcgggugagccggucgaacgc

SEQ ID NO: 2998768 - RNA, 18 nt, Mycobacterium avium subsp. paratuberculosis
ccggcggguuggccgucg

SEQ ID NO: 2998769 - RNA, 21 nt, Mycobacterium avium subsp. paratuberculosis
ccggcggguuggucccgauca

SEQ ID NO: 2998770 - RNA, 23 nt, Mycobacterium avium subsp. paratuberculosis
ccggcggguuggucccgaucacc

SEQ ID NO: 2998771 - RNA, 19 nt, Mycobacterium avium subsp. paratuberculosis
ccggcgguaccgccgaucg

SEQ ID NO: 2998772 - RNA, 22 nt, Mycobacterium avium subsp. paratuberculosis
ccggcgguaugcccgggccguc

SEQ ID NO: 2998773 - RNA, 13 nt, Mycobacterium avium subsp. paratuberculosis
ccggcggucacca

SEQ ID NO: 2998774 - RNA, 19 nt, Mycobacterium avium subsp. paratuberculosis
ccggcggucaccaaggcga

SEQ ID NO: 2998775 - RNA, 16 nt, Mycobacterium avium subsp. paratuberculosis
ccggcggucagcaccg

SEQ ID NO: 2998776 - RNA, 18 nt, Mycobacterium avium subsp. paratuberculosis
ccggcggucagcaccguc

SEQ ID NO: 2998777 - RNA, 16 nt, Mycobacterium avium subsp. paratuberculosis
ccggcggucagcucag

SEQ ID NO: 2998778 - RNA, 14 nt, Mycobacterium avium subsp. paratuberculosis
ccggcggucgacac

SEQ ID NO: 2998779 - RNA, 13 nt, Mycobacterium avium subsp. paratuberculosis
ccggcggucgccg

SEQ ID NO: 2998780 - RNA, 14 nt, Mycobacterium avium subsp. paratuberculosis
ccggcggucgccga

SEQ ID NO: 2998781 - RNA, 23 nt, Mycobacterium avium subsp. paratuberculosis
ccggcggucgccgaaaggaucug

SEQ ID NO: 2998782 - RNA, 18 nt, Mycobacterium avium subsp. paratuberculosis
ccggcggucgcugcagcg

SEQ ID NO: 2998783 - RNA, 20 nt, Mycobacterium avium subsp. paratuberculosis
ccggcggucgcugcagcggc

SEQ ID NO: 2998784 - RNA, 23 nt, Mycobacterium avium subsp. paratuberculosis
ccggcggucgcugcagcggcggc

SEQ ID NO: 2998785 - RNA, 19 nt, Mycobacterium avium subsp. paratuberculosis
ccggcggugauccgcccgg

SEQ ID NO: 2998786 - RNA, 20 nt, Mycobacterium avium subsp. paratuberculosis
ccggcggugauccgcccggc

SEQ ID NO: 2998787 - RNA, 21 nt, Mycobacterium avium subsp. paratuberculosis
ccggcggugauccgcccggcc

SEQ ID NO: 2998788 - RNA, 13 nt, Mycobacterium avium subsp. paratuberculosis
ccggcggugcagg

SEQ ID NO: 2998789 - RNA, 16 nt, Mycobacterium avium subsp. paratuberculosis
ccggcggugccgaacc

SEQ ID NO: 2998790 - RNA, 19 nt, Mycobacterium avium subsp. paratuberculosis
ccggcggugccgaaccgga

SEQ ID NO: 2998791 - RNA, 14 nt, Mycobacterium avium subsp. paratuberculosis
ccggcggugccggc

SEQ ID NO: 2998792 - RNA, 15 nt, Mycobacterium avium subsp. paratuberculosis
ccggcggugccggcc

SEQ ID NO: 2998793 - RNA, 16 nt, Mycobacterium avium subsp. paratuberculosis
ccggcggugcgggugg

SEQ ID NO: 2998794 - RNA, 13 nt, Mycobacterium avium subsp. paratuberculosis
ccggcgguggugc

SEQ ID NO: 2998795 - RNA, 16 nt, Mycobacterium avium subsp. paratuberculosis
ccggcggugucggugc

SEQ ID NO: 2998796 - RNA, 22 nt, Mycobacterium avium subsp. paratuberculosis
ccggcggugucggugccgagca

SEQ ID NO: 2998797 - RNA, 14 nt, Mycobacterium avium subsp. paratuberculosis
ccggcgguucggcg

SEQ ID NO: 2998798 - RNA, 17 nt, Mycobacterium avium subsp. paratuberculosis
ccggcgguucggcgggc

SEQ ID NO: 2998799 - RNA, 19 nt, Mycobacterium avium subsp. paratuberculosis
ccggcgguucggcgggccu

SEQ ID NO: 2998800 - RNA, 17 nt, Mycobacterium avium subsp. paratuberculosis
ccggcgguuuuguugac

SEQ ID NO: 2998801 - RNA, 15 nt, Mycobacterium avium subsp. paratuberculosis
ccggcguacccgccc

SEQ ID NO: 2998802 - RNA, 16 nt, Mycobacterium avium subsp. paratuberculosis
ccggcguagaacaccg

SEQ ID NO: 2998803 - RNA, 20 nt, Mycobacterium avium subsp. paratuberculosis
ccggcguagaccagcgacgc

SEQ ID NO: 2998804 - RNA, 17 nt, Mycobacterium avium subsp. paratuberculosis
ccggcguagcagucggc

SEQ ID NO: 2998805 - RNA, 20 nt, Mycobacterium avium subsp. paratuberculosis
ccggcguagcagucggccug

SEQ ID NO: 2998806 - RNA, 17 nt, Mycobacterium avium subsp. paratuberculosis
ccggcguaguucgucga

SEQ ID NO: 2998807 - RNA, 20 nt, Mycobacterium avium subsp. paratuberculosis
ccggcguaguucgucgaaca

SEQ ID NO: 2998808 - RNA, 21 nt, Mycobacterium avium subsp. paratuberculosis
ccggcguaucuccaccgucga

SEQ ID NO: 2998809 - RNA, 15 nt, Mycobacterium avium subsp. paratuberculosis
ccggcgucacucugg

SEQ ID NO: 2998810 - RNA, 20 nt, Mycobacterium avium subsp. paratuberculosis
ccggcgucacucuggcguga

SEQ ID NO: 2998811 - RNA, 21 nt, Mycobacterium avium subsp. paratuberculosis
ccggcgucacucuggcgugac

SEQ ID NO: 2998812 - RNA, 19 nt, Mycobacterium avium subsp. paratuberculosis
ccggcgucauggugcgcgg

SEQ ID NO: 2998813 - RNA, 20 nt, Mycobacterium avium subsp. paratuberculosis
ccggcguccaccggucgacg

SEQ ID NO: 2998814 - RNA, 14 nt, Mycobacterium avium subsp. paratuberculosis
ccggcguccacgcc

SEQ ID NO: 2998815 - RNA, 16 nt, Mycobacterium avium subsp. paratuberculosis
ccggcguccacgccgu

SEQ ID NO: 2998816 - RNA, 15 nt, Mycobacterium avium subsp. paratuberculosis
ccggcguccagcgcc

SEQ ID NO: 2998817 - RNA, 18 nt, Mycobacterium avium subsp. paratuberculosis
ccggcguccagcgccgcc

SEQ ID NO: 2998818 - RNA, 21 nt, Mycobacterium avium subsp. paratuberculosis
ccggcguccagcgccgccacg

SEQ ID NO: 2998819 - RNA, 20 nt, Mycobacterium avium subsp. paratuberculosis
ccggcguccaggcgcaccgc

SEQ ID NO: 2998820 - RNA, 18 nt, Mycobacterium avium subsp. paratuberculosis
ccggcguccaguagccgc

SEQ ID NO: 2998821 - RNA, 22 nt, Mycobacterium avium subsp. paratuberculosis
ccggcguccaguagccgccggg

SEQ ID NO: 2998822 - RNA, 17 nt, Mycobacterium avium subsp. paratuberculosis
ccggcguccaguucggc

SEQ ID NO: 2998823 - RNA, 22 nt, Mycobacterium avium subsp. paratuberculosis
ccggcguccaguugcggcacgc

SEQ ID NO: 2998824 - RNA, 18 nt, Mycobacterium avium subsp. paratuberculosis
ccggcguccugcagcagc

SEQ ID NO: 2998825 - RNA, 21 nt, Mycobacterium avium subsp. paratuberculosis
ccggcgucgaaauagcggcgc

SEQ ID NO: 2998826 - RNA, 14 nt, Mycobacterium avium subsp. paratuberculosis
ccggcgucgacagc

SEQ ID NO: 2998827 - RNA, 17 nt, Mycobacterium avium subsp. paratuberculosis
ccggcgucgacagccgg

SEQ ID NO: 2998828 - RNA, 13 nt, Mycobacterium avium subsp. paratuberculosis
ccggcgucgacgu

SEQ ID NO: 2998829 - RNA, 13 nt, Mycobacterium avium subsp. paratuberculosis
ccggcgucgauga

SEQ ID NO: 2998830 - RNA, 22 nt, Mycobacterium avium subsp. paratuberculosis
ccggcgucgaugaugccggcgg

SEQ ID NO: 2998831 - RNA, 15 nt, Mycobacterium avium subsp. paratuberculosis
ccggcgucgccgcug

SEQ ID NO: 2998832 - RNA, 19 nt, Mycobacterium avium subsp. paratuberculosis
ccggcgucgccgcugguga

SEQ ID NO: 2998833 - RNA, 18 nt, Mycobacterium avium subsp. paratuberculosis
ccggcgucgcggugaagu

SEQ ID NO: 2998834 - RNA, 20 nt, Mycobacterium avium subsp. paratuberculosis
ccggcgucguaaugcgucau

SEQ ID NO: 2998835 - RNA, 13 nt, Mycobacterium avium subsp. paratuberculosis
ccggcgucgucga

SEQ ID NO: 2998836 - RNA, 16 nt, Mycobacterium avium subsp. paratuberculosis
ccggcgucgucgagca

SEQ ID NO: 2998837 - RNA, 13 nt, Mycobacterium avium subsp. paratuberculosis
ccggcgucgucgu

SEQ ID NO: 2998838 - RNA, 16 nt, Mycobacterium avium subsp. paratuberculosis
ccggcgucgucgucgc

SEQ ID NO: 2998839 - RNA, 19 nt, Mycobacterium avium subsp. paratuberculosis
ccggcgucgucgucgcagu

SEQ ID NO: 2998840 - RNA, 23 nt, Mycobacterium avium subsp. paratuberculosis
ccggcgucgucgucgcagugccc

SEQ ID NO: 2998841 - RNA, 16 nt, Mycobacterium avium subsp. paratuberculosis
ccggcgucucagucgg

SEQ ID NO: 2998842 - RNA, 18 nt, Mycobacterium avium subsp. paratuberculosis
ccggcgucucagucggcc

SEQ ID NO: 2998843 - RNA, 20 nt, Mycobacterium avium subsp. paratuberculosis
ccggcgucucagucggccac

SEQ ID NO: 2998844 - RNA, 16 nt, Mycobacterium avium subsp. paratuberculosis
ccggcgucucggcguc

SEQ ID NO: 2998845 - RNA, 13 nt, Mycobacterium avium subsp. paratuberculosis
ccggcgugagcga

SEQ ID NO: 2998846 - RNA, 23 nt, Mycobacterium avium subsp. paratuberculosis
ccggcgugagcgagccggcacgc

SEQ ID NO: 2998847 - RNA, 16 nt, Mycobacterium avium subsp. paratuberculosis
ccggcgugaugacggc

SEQ ID NO: 2998848 - RNA, 24 nt, Mycobacterium avium subsp. paratuberculosis
ccggcgugaugacggcggcggugc

SEQ ID NO: 2998849 - RNA, 15 nt, Mycobacterium avium subsp. paratuberculosis
ccggcgugcacaggc

SEQ ID NO: 2998850 - RNA, 16 nt, Mycobacterium avium subsp. paratuberculosis
ccggcgugcacaggcc

SEQ ID NO: 2998851 - RNA, 19 nt, Mycobacterium avium subsp. paratuberculosis
ccggcgugcacaggccgcc

SEQ ID NO: 2998852 - RNA, 21 nt, Mycobacterium avium subsp. paratuberculosis
ccggcgugcacaggccgccgc

SEQ ID NO: 2998853 - RNA, 17 nt, Mycobacterium avium subsp. paratuberculosis
ccggcgugcagcacgcc

SEQ ID NO: 2998854 - RNA, 22 nt, Mycobacterium avium subsp. paratuberculosis
ccggcgugcaggauccgcucga

SEQ ID NO: 2998855 - RNA, 23 nt, Mycobacterium avium subsp. paratuberculosis
ccggcgugcaggauccgcucgac

SEQ ID NO: 2998856 - RNA, 16 nt, Mycobacterium avium subsp. paratuberculosis
ccggcgugccaccgcu

SEQ ID NO: 2998857 - RNA, 21 nt, Mycobacterium avium subsp. paratuberculosis
ccggcgugccaccgcugggcg

SEQ ID NO: 2998858 - RNA, 22 nt, Mycobacterium avium subsp. paratuberculosis
ccggcgugccaccgcugggcgg

SEQ ID NO: 2998859 - RNA, 17 nt, Mycobacterium avium subsp. paratuberculosis
ccggcgugcuccagcag

SEQ ID NO: 2998860 - RNA, 19 nt, Mycobacterium avium subsp. paratuberculosis
ccggcgugcuccagcaggc

SEQ ID NO: 2998861 - RNA, 21 nt, Mycobacterium avium subsp. paratuberculosis
ccggcgugcuccagcaggcgc

SEQ ID NO: 2998862 - RNA, 15 nt, Mycobacterium avium subsp. paratuberculosis
ccggcgugggccgca

SEQ ID NO: 2998863 - RNA, 16 nt, Mycobacterium avium subsp. paratuberculosis
ccggcgugggccgcag

SEQ ID NO: 2998864 - RNA, 17 nt, Mycobacterium avium subsp. paratuberculosis
ccggcgugggccgcagc

SEQ ID NO: 2998865 - RNA, 14 nt, Mycobacterium avium subsp. paratuberculosis
ccggcguggguguc

SEQ ID NO: 2998866 - RNA, 21 nt, Mycobacterium avium subsp. paratuberculosis
ccggcguguaguacugcucga

SEQ ID NO: 2998867 - RNA, 22 nt, Mycobacterium avium subsp. paratuberculosis
ccggcguguaguacugcucgac

SEQ ID NO: 2998868 - RNA, 23 nt, Mycobacterium avium subsp. paratuberculosis
ccggcguguaguacugcucgacg

SEQ ID NO: 2998869 - RNA, 16 nt, Mycobacterium avium subsp. paratuberculosis
ccggcgugucgcgugc

SEQ ID NO: 2998870 - RNA, 15 nt, Mycobacterium avium subsp. paratuberculosis
ccggcgugucggcgc

SEQ ID NO: 2998871 - RNA, 17 nt, Mycobacterium avium subsp. paratuberculosis
ccggcgugucggcgcca

SEQ ID NO: 2998872 - RNA, 23 nt, Mycobacterium avium subsp. paratuberculosis
ccggcgugucggcgccaccgggu

SEQ ID NO: 2998873 - RNA, 17 nt, Mycobacterium avium subsp. paratuberculosis
ccggcguuacccgaacc

SEQ ID NO: 2998874 - RNA, 18 nt, Mycobacterium avium subsp. paratuberculosis
ccggcguuacccgaaccc

SEQ ID NO: 2998875 - RNA, 22 nt, Mycobacterium avium subsp. paratuberculosis
ccggcguuauuugugcgcuggc

SEQ ID NO: 2998876 - RNA, 17 nt, Mycobacterium avium subsp. paratuberculosis
ccggcguugacgaugac

SEQ ID NO: 2998877 - RNA, 21 nt, Mycobacterium avium subsp. paratuberculosis
ccggcguugacgaugacgcgg

SEQ ID NO: 2998878 - RNA, 22 nt, Mycobacterium avium subsp. paratuberculosis
ccggcguugacgaugacgcggu

SEQ ID NO: 2998879 - RNA, 21 nt, Mycobacterium avium subsp. paratuberculosis
ccggcguugcauuucggcguc

SEQ ID NO: 2998880 - RNA, 13 nt, Mycobacterium avium subsp. paratuberculosis
ccggcguugucca

SEQ ID NO: 2998881 - RNA, 18 nt, Mycobacterium avium subsp. paratuberculosis
ccggcguuguccagguag

SEQ ID NO: 2998882 - RNA, 19 nt, Mycobacterium avium subsp. paratuberculosis
ccggcguuguccagguagc

SEQ ID NO: 2998883 - RNA, 20 nt, Mycobacterium avium subsp. paratuberculosis
ccggcguuguccagguagcc

SEQ ID NO: 2998884 - RNA, 18 nt, Mycobacterium avium subsp. paratuberculosis
ccggcuaauucgggccgc

SEQ ID NO: 2998885 - RNA, 23 nt, Mycobacterium avium subsp. paratuberculosis
ccggcuaauucgggccgccgcgc

SEQ ID NO: 2998886 - RNA, 13 nt, Mycobacterium avium subsp. paratuberculosis
ccggcuaccgcgc

SEQ ID NO: 2998887 - RNA, 14 nt, Mycobacterium avium subsp. paratuberculosis
ccggcuaccgcgcg

SEQ ID NO: 2998888 - RNA, 15 nt, Mycobacterium avium subsp. paratuberculosis
ccggcuaccggcgcu

SEQ ID NO: 2998889 - RNA, 16 nt, Mycobacterium avium subsp. paratuberculosis
ccggcuaccggcgcug

SEQ ID NO: 2998890 - RNA, 16 nt, Mycobacterium avium subsp. paratuberculosis
ccggcuacucggacgc

SEQ ID NO: 2998891 - RNA, 19 nt, Mycobacterium avium subsp. paratuberculosis
ccggcuacucggacgccgg

SEQ ID NO: 2998892 - RNA, 20 nt, Mycobacterium avium subsp. paratuberculosis
ccggcuacucggacgccggc

SEQ ID NO: 2998893 - RNA, 22 nt, Mycobacterium avium subsp. paratuberculosis
ccggcuacucggacgccggcag

SEQ ID NO: 2998894 - RNA, 17 nt, Mycobacterium avium subsp. paratuberculosis
ccggcuagacgcgcagc

SEQ ID NO: 2998895 - RNA, 20 nt, Mycobacterium avium subsp. paratuberculosis
ccggcuagacgcgcagcacg

SEQ ID NO: 2998896 - RNA, 20 nt, Mycobacterium avium subsp. paratuberculosis
ccggcuauucgggccugacc

SEQ ID NO: 2998897 - RNA, 22 nt, Mycobacterium avium subsp. paratuberculosis
ccggcucaaaccguugaccacc

SEQ ID NO: 2998898 - RNA, 22 nt, Mycobacterium avium subsp. paratuberculosis
ccggcucaaugccuuugccgug

SEQ ID NO: 2998899 - RNA, 22 nt, Mycobacterium avium subsp. paratuberculosis
ccggcucagcccgauucagccg

SEQ ID NO: 2998900 - RNA, 16 nt, Mycobacterium avium subsp. paratuberculosis
ccggcucagcccggcg

SEQ ID NO: 2998901 - RNA, 23 nt, Mycobacterium avium subsp. paratuberculosis
ccggcucagcccggcgcucaccg

SEQ ID NO: 2998902 - RNA, 13 nt, Mycobacterium avium subsp. paratuberculosis
ccggcucagcggc

SEQ ID NO: 2998903 - RNA, 15 nt, Mycobacterium avium subsp. paratuberculosis
ccggcucagcggcaa

SEQ ID NO: 2998904 - RNA, 16 nt, Mycobacterium avium subsp. paratuberculosis
ccggcucagcggcaac

SEQ ID NO: 2998905 - RNA, 19 nt, Mycobacterium avium subsp. paratuberculosis
ccggcucagcggcaacugc

SEQ ID NO: 2998906 - RNA, 23 nt, Mycobacterium avium subsp. paratuberculosis
ccggcucagggugcgcuggccga

SEQ ID NO: 2998907 - RNA, 17 nt, Mycobacterium avium subsp. paratuberculosis
ccggcuccaccgcgccg

SEQ ID NO: 2998908 - RNA, 19 nt, Mycobacterium avium subsp. paratuberculosis
ccggcuccaccgcgccggc

SEQ ID NO: 2998909 - RNA, 16 nt, Mycobacterium avium subsp. paratuberculosis
ccggcuccccgaccac

SEQ ID NO: 2998910 - RNA, 20 nt, Mycobacterium avium subsp. paratuberculosis
ccggcuccccgaccacaccg

SEQ ID NO: 2998911 - RNA, 20 nt, Mycobacterium avium subsp. paratuberculosis
ccggcuccgcaugcccgggc

SEQ ID NO: 2998912 - RNA, 20 nt, Mycobacterium avium subsp. paratuberculosis
ccggcucgaaguggcagcgc

SEQ ID NO: 2998913 - RNA, 21 nt, Mycobacterium avium subsp. paratuberculosis
ccggcucgaccucaccccgcu

SEQ ID NO: 2998914 - RNA, 13 nt, Mycobacterium avium subsp. paratuberculosis
ccggcucgagcag

SEQ ID NO: 2998915 - RNA, 17 nt, Mycobacterium avium subsp. paratuberculosis
ccggcucgaucgcgguc

SEQ ID NO: 2998916 - RNA, 18 nt, Mycobacterium avium subsp. paratuberculosis
ccggcucgaucgcgguca

SEQ ID NO: 2998917 - RNA, 12 nt, Mycobacterium avium subsp. paratuberculosis
ccggcucgccgg

SEQ ID NO: 2998918 - RNA, 14 nt, Mycobacterium avium subsp. paratuberculosis
ccggcucgccggcg

SEQ ID NO: 2998919 - RNA, 18 nt, Mycobacterium avium subsp. paratuberculosis
ccggcucgccggcgcgca

SEQ ID NO: 2998920 - RNA, 13 nt, Mycobacterium avium subsp. paratuberculosis
ccggcucgccggg

SEQ ID NO: 2998921 - RNA, 15 nt, Mycobacterium avium subsp. paratuberculosis
ccggcucgccgggcu

SEQ ID NO: 2998922 - RNA, 12 nt, Mycobacterium avium subsp. paratuberculosis
ccggcucgccgu

SEQ ID NO: 2998923 - RNA, 15 nt, Mycobacterium avium subsp. paratuberculosis
ccggcucgccguugc

SEQ ID NO: 2998924 - RNA, 13 nt, Mycobacterium avium subsp. paratuberculosis
ccggcucgcgggg

SEQ ID NO: 2998925 - RNA, 16 nt, Mycobacterium avium subsp. paratuberculosis
ccggcucgcggggugu

SEQ ID NO: 2998926 - RNA, 16 nt, Mycobacterium avium subsp. paratuberculosis
ccggcucgcugaucug

SEQ ID NO: 2998927 - RNA, 20 nt, Mycobacterium avium subsp. paratuberculosis
ccggcucgcugaucugcggc

SEQ ID NO: 2998928 - RNA, 21 nt, Mycobacterium avium subsp. paratuberculosis
ccggcucgcugaucugcggca

SEQ ID NO: 2998929 - RNA, 12 nt, Mycobacterium avium subsp. paratuberculosis
ccggcucggccc

SEQ ID NO: 2998930 - RNA, 12 nt, Mycobacterium avium subsp. paratuberculosis
ccggcucgggaa

SEQ ID NO: 2998931 - RNA, 20 nt, Mycobacterium avium subsp. paratuberculosis
ccggcucgggaacggucagc

SEQ ID NO: 2998932 - RNA, 21 nt, Mycobacterium avium subsp. paratuberculosis
ccggcucgggaacggucagcc

SEQ ID NO: 2998933 - RNA, 22 nt, Mycobacterium avium subsp. paratuberculosis
ccggcucgggaacggucagccg

SEQ ID NO: 2998934 - RNA, 17 nt, Mycobacterium avium subsp. paratuberculosis
ccggcucgguaugcggc

SEQ ID NO: 2998935 - RNA, 21 nt, Mycobacterium avium subsp. paratuberculosis
ccggcucgguaugcggcgacg

SEQ ID NO: 2998936 - RNA, 20 nt, Mycobacterium avium subsp. paratuberculosis
ccggcucggucuccuccagg

SEQ ID NO: 2998937 - RNA, 13 nt, Mycobacterium avium subsp. paratuberculosis
ccggcucggugcc

SEQ ID NO: 2998938 - RNA, 14 nt, Mycobacterium avium subsp. paratuberculosis
ccggcucggugccg

SEQ ID NO: 2998939 - RNA, 15 nt, Mycobacterium avium subsp. paratuberculosis
ccggcucggugccgc

SEQ ID NO: 2998940 - RNA, 17 nt, Mycobacterium avium subsp. paratuberculosis
ccggcucggugccgcgg

SEQ ID NO: 2998941 - RNA, 15 nt, Mycobacterium avium subsp. paratuberculosis
ccggcucggugcgcc

SEQ ID NO: 2998942 - RNA, 16 nt, Mycobacterium avium subsp. paratuberculosis
ccggcucggugcgcca

SEQ ID NO: 2998943 - RNA, 18 nt, Mycobacterium avium subsp. paratuberculosis
ccggcucguagcuggugc

SEQ ID NO: 2998944 - RNA, 22 nt, Mycobacterium avium subsp. paratuberculosis
ccggcucguagcuggugcgcag

SEQ ID NO: 2998945 - RNA, 23 nt, Mycobacterium avium subsp. paratuberculosis
ccggcucguagcuggugcgcagc

SEQ ID NO: 2998946 - RNA, 17 nt, Mycobacterium avium subsp. paratuberculosis
ccggcucuccaucuucg

SEQ ID NO: 2998947 - RNA, 17 nt, Mycobacterium avium subsp. paratuberculosis
ccggcucugccugcagg

SEQ ID NO: 2998948 - RNA, 18 nt, Mycobacterium avium subsp. paratuberculosis
ccggcucugccugcagga

SEQ ID NO: 2998949 - RNA, 15 nt, Mycobacterium avium subsp. paratuberculosis
ccggcucuuggcgac

SEQ ID NO: 2998950 - RNA, 19 nt, Mycobacterium avium subsp. paratuberculosis
ccggcucuuggcgaccucg

SEQ ID NO: 2998951 - RNA, 21 nt, Mycobacterium avium subsp. paratuberculosis
ccggcugaaccugcugggcgg

SEQ ID NO: 2998952 - RNA, 15 nt, Mycobacterium avium subsp. paratuberculosis
ccggcugaacgccag

SEQ ID NO: 2998953 - RNA, 16 nt, Mycobacterium avium subsp. paratuberculosis
ccggcugaacgccagc

SEQ ID NO: 2998954 - RNA, 14 nt, Mycobacterium avium subsp. paratuberculosis
ccggcugaccggcg

SEQ ID NO: 2998955 - RNA, 16 nt, Mycobacterium avium subsp. paratuberculosis
ccggcugaccggcggu

SEQ ID NO: 2998956 - RNA, 20 nt, Mycobacterium avium subsp. paratuberculosis
ccggcugaccggcggugccg

SEQ ID NO: 2998957 - RNA, 17 nt, Mycobacterium avium subsp. paratuberculosis
ccggcugacugccggcg

SEQ ID NO: 2998958 - RNA, 19 nt, Mycobacterium avium subsp. paratuberculosis
ccggcugacugccggcgac

SEQ ID NO: 2998959 - RNA, 15 nt, Mycobacterium avium subsp. paratuberculosis
ccggcugagcagcuc

SEQ ID NO: 2998960 - RNA, 17 nt, Mycobacterium avium subsp. paratuberculosis
ccggcugagcagcucgc

SEQ ID NO: 2998961 - RNA, 20 nt, Mycobacterium avium subsp. paratuberculosis
ccggcugagcagcucgcgga

SEQ ID NO: 2998962 - RNA, 21 nt, Mycobacterium avium subsp. paratuberculosis
ccggcugagcgucggucucga

SEQ ID NO: 2998963 - RNA, 23 nt, Mycobacterium avium subsp. paratuberculosis
ccggcugagcgucggucucgacg

SEQ ID NO: 2998964 - RNA, 13 nt, Mycobacterium avium subsp. paratuberculosis
ccggcugcagccg

SEQ ID NO: 2998965 - RNA, 14 nt, Mycobacterium avium subsp. paratuberculosis
ccggcugcagccgg

SEQ ID NO: 2998966 - RNA, 16 nt, Mycobacterium avium subsp. paratuberculosis
ccggcugcagccgggc

SEQ ID NO: 2998967 - RNA, 17 nt, Mycobacterium avium subsp. paratuberculosis
ccggcugcagccgggcg

SEQ ID NO: 2998968 - RNA, 18 nt, Mycobacterium avium subsp. paratuberculosis
ccggcugcagccgggcgg

SEQ ID NO: 2998969 - RNA, 14 nt, Mycobacterium avium subsp. paratuberculosis
ccggcugcccgacc

SEQ ID NO: 2998970 - RNA, 18 nt, Mycobacterium avium subsp. paratuberculosis
ccggcugcccgacccgca

SEQ ID NO: 2998971 - RNA, 15 nt, Mycobacterium avium subsp. paratuberculosis
ccggcugcccgcgac

SEQ ID NO: 2998972 - RNA, 16 nt, Mycobacterium avium subsp. paratuberculosis
ccggcugcccgcgacu

SEQ ID NO: 2998973 - RNA, 17 nt, Mycobacterium avium subsp. paratuberculosis
ccggcugcccgcgacug

SEQ ID NO: 2998974 - RNA, 14 nt, Mycobacterium avium subsp. paratuberculosis
ccggcugcccuggg

SEQ ID NO: 2998975 - RNA, 13 nt, Mycobacterium avium subsp. paratuberculosis
ccggcugcgcagc

SEQ ID NO: 2998976 - RNA, 16 nt, Mycobacterium avium subsp. paratuberculosis
ccggcugcgcagcgca

SEQ ID NO: 2998977 - RNA, 15 nt, Mycobacterium avium subsp. paratuberculosis
ccggcugcgccgcgc

SEQ ID NO: 2998978 - RNA, 14 nt, Mycobacterium avium subsp. paratuberculosis
ccggcugcucgcgc

SEQ ID NO: 2998979 - RNA, 22 nt, Mycobacterium avium subsp. paratuberculosis
ccggcugcucgcgcugccgcgc

SEQ ID NO: 2998980 - RNA, 18 nt, Mycobacterium avium subsp. paratuberculosis
ccggcugcugcacgacga

SEQ ID NO: 2998981 - RNA, 22 nt, Mycobacterium avium subsp. paratuberculosis
ccggcugcugcacgacgaccgc

SEQ ID NO: 2998982 - RNA, 23 nt, Mycobacterium avium subsp. paratuberculosis
ccggcugcugcacgacgaccgcg

SEQ ID NO: 2998983 - RNA, 23 nt, Mycobacterium avium subsp. paratuberculosis
ccggcuggaacaucccggagccg

SEQ ID NO: 2998984 - RNA, 20 nt, Mycobacterium avium subsp. paratuberculosis
ccggcuggcaggucgcgccg

SEQ ID NO: 2998985 - RNA, 16 nt, Mycobacterium avium subsp. paratuberculosis
ccggcuggccgagcgg

SEQ ID NO: 2998986 - RNA, 15 nt, Mycobacterium avium subsp. paratuberculosis
ccggcuggccgcaca

SEQ ID NO: 2998987 - RNA, 20 nt, Mycobacterium avium subsp. paratuberculosis
ccggcuggccgcacaccugc

SEQ ID NO: 2998988 - RNA, 12 nt, Mycobacterium avium subsp. paratuberculosis
ccggcuggccgg

SEQ ID NO: 2998989 - RNA, 13 nt, Mycobacterium avium subsp. paratuberculosis
ccggcuggcgggc

SEQ ID NO: 2998990 - RNA, 19 nt, Mycobacterium avium subsp. paratuberculosis
ccggcuggcgggcgaucgc

SEQ ID NO: 2998991 - RNA, 21 nt, Mycobacterium avium subsp. paratuberculosis
ccggcuggcgggcgaucgccu

SEQ ID NO: 2998992 - RNA, 14 nt, Mycobacterium avium subsp. paratuberculosis
ccggcugggcgcgc

SEQ ID NO: 2998993 - RNA, 17 nt, Mycobacterium avium subsp. paratuberculosis
ccggcugggcgcgcaac

SEQ ID NO: 2998994 - RNA, 18 nt, Mycobacterium avium subsp. paratuberculosis
ccggcuggucggccuggc

SEQ ID NO: 2998995 - RNA, 14 nt, Mycobacterium avium subsp. paratuberculosis
ccggcuggucggcg

SEQ ID NO: 2998996 - RNA, 15 nt, Mycobacterium avium subsp. paratuberculosis
ccggcuggugcagca

SEQ ID NO: 2998997 - RNA, 17 nt, Mycobacterium avium subsp. paratuberculosis
ccggcuggugcagcagc

SEQ ID NO: 2998998 - RNA, 18 nt, Mycobacterium avium subsp. paratuberculosis
ccggcuggugcagcagcu

SEQ ID NO: 2998999 - RNA, 23 nt, Mycobacterium avium subsp. paratuberculosis
ccggcuggugcagcagcuggaac

SEQ ID NO: 2999000 - RNA, 17 nt, Mycobacterium avium subsp. paratuberculosis
ccggcuuaccgaccucg

SEQ ID NO: 2999001 - RNA, 20 nt, Mycobacterium avium subsp. paratuberculosis
ccggcuucaccgucagggug

SEQ ID NO: 2999002 - RNA, 20 nt, Mycobacterium avium subsp. paratuberculosis
ccggcuuccgagacgugguc

SEQ ID NO: 2999003 - RNA, 16 nt, Mycobacterium avium subsp. paratuberculosis
ccggcuucgccgccgc

SEQ ID NO: 2999004 - RNA, 19 nt, Mycobacterium avium subsp. paratuberculosis
ccggcuucgccgccgcacc

SEQ ID NO: 2999005 - RNA, 14 nt, Mycobacterium avium subsp. paratuberculosis
ccggcuucgccgcg

SEQ ID NO: 2999006 - RNA, 16 nt, Mycobacterium avium subsp. paratuberculosis
ccggcuucgccgcgcu

SEQ ID NO: 2999007 - RNA, 17 nt, Mycobacterium avium subsp. paratuberculosis
ccggcuucgccgcgcuu

SEQ ID NO: 2999008 - RNA, 18 nt, Mycobacterium avium subsp. paratuberculosis
ccggcuucgcugcgccgg

SEQ ID NO: 2999009 - RNA, 19 nt, Mycobacterium avium subsp. paratuberculosis
ccggcuucgcugcgccggc

SEQ ID NO: 2999010 - RNA, 21 nt, Mycobacterium avium subsp. paratuberculosis
ccggcuucgcugcgccggcgg

SEQ ID NO: 2999011 - RNA, 21 nt, Mycobacterium avium subsp. paratuberculosis
ccggcuucgggaucagcggga

SEQ ID NO: 2999012 - RNA, 14 nt, Mycobacterium avium subsp. paratuberculosis
ccggcuucucggcg

SEQ ID NO: 2999013 - RNA, 15 nt, Mycobacterium avium subsp. paratuberculosis
ccggcuucucggcgu

SEQ ID NO: 2999014 - RNA, 16 nt, Mycobacterium avium subsp. paratuberculosis
ccggcuucucggcgug

SEQ ID NO: 2999015 - RNA, 17 nt, Mycobacterium avium subsp. paratuberculosis
ccggcuucucggcgugc

SEQ ID NO: 2999016 - RNA, 23 nt, Mycobacterium avium subsp. paratuberculosis
ccggcuucucggcgugcccgccg

SEQ ID NO: 2999017 - RNA, 14 nt, Mycobacterium avium subsp. paratuberculosis
ccggcuugaucucg

SEQ ID NO: 2999018 - RNA, 20 nt, Mycobacterium avium subsp. paratuberculosis
ccggcuugccccggucccgg

SEQ ID NO: 2999019 - RNA, 22 nt, Mycobacterium avium subsp. paratuberculosis
ccggcuugccccggucccgggg

SEQ ID NO: 2999020 - RNA, 15 nt, Mycobacterium avium subsp. paratuberculosis
ccggcuugccgaucg

SEQ ID NO: 2999021 - RNA, 22 nt, Mycobacterium avium subsp. paratuberculosis
ccggcuugccgaucgccgcggc

SEQ ID NO: 2999022 - RNA, 17 nt, Mycobacterium avium subsp. paratuberculosis
ccggcuuucgaagagcc

SEQ ID NO: 2999023 - RNA, 18 nt, Mycobacterium avium subsp. paratuberculosis
ccgggaaacccucgacgc

SEQ ID NO: 2999024 - RNA, 20 nt, Mycobacterium avium subsp. paratuberculosis
ccgggaaacccucgacgccg

SEQ ID NO: 2999025 - RNA, 21 nt, Mycobacterium avium subsp. paratuberculosis
ccgggaaacccucgacgccgg

SEQ ID NO: 2999026 - RNA, 17 nt, Mycobacterium avium subsp. paratuberculosis
ccgggaaaugcugcacc

SEQ ID NO: 2999027 - RNA, 13 nt, Mycobacterium avium subsp. paratuberculosis
ccgggaacagcca

SEQ ID NO: 2999028 - RNA, 14 nt, Mycobacterium avium subsp. paratuberculosis
ccgggaacgacggu

SEQ ID NO: 2999029 - RNA, 17 nt, Mycobacterium avium subsp. paratuberculosis
ccgggaacgacggugcg

SEQ ID NO: 2999030 - RNA, 14 nt, Mycobacterium avium subsp. paratuberculosis
ccgggaacgcggcg

SEQ ID NO: 2999031 - RNA, 15 nt, Mycobacterium avium subsp. paratuberculosis
ccgggaacgcggcga

SEQ ID NO: 2999032 - RNA, 15 nt, Mycobacterium avium subsp. paratuberculosis
ccgggaagccgagcu

SEQ ID NO: 2999033 - RNA, 16 nt, Mycobacterium avium subsp. paratuberculosis
ccgggaagccgcagca

SEQ ID NO: 2999034 - RNA, 21 nt, Mycobacterium avium subsp. paratuberculosis
ccgggaagccgcagcaggugc

SEQ ID NO: 2999035 - RNA, 13 nt, Mycobacterium avium subsp. paratuberculosis
ccgggaagcgaag

SEQ ID NO: 2999036 - RNA, 13 nt, Mycobacterium avium subsp. paratuberculosis
ccgggaaggcggc

SEQ ID NO: 2999037 - RNA, 18 nt, Mycobacterium avium subsp. paratuberculosis
ccgggaaggcggccgcga

SEQ ID NO: 2999038 - RNA, 21 nt, Mycobacterium avium subsp. paratuberculosis
ccgggaaggugucggccggga

SEQ ID NO: 2999039 - RNA, 21 nt, Mycobacterium avium subsp. paratuberculosis
ccgggaaguagggcagcccga

SEQ ID NO: 2999040 - RNA, 19 nt, Mycobacterium avium subsp. paratuberculosis
ccgggaaguuggccuccca

SEQ ID NO: 2999041 - RNA, 20 nt, Mycobacterium avium subsp. paratuberculosis
ccgggaaucgagggcgcgca

SEQ ID NO: 2999042 - RNA, 18 nt, Mycobacterium avium subsp. paratuberculosis
ccgggaaugucgcgcagc

SEQ ID NO: 2999043 - RNA, 15 nt, Mycobacterium avium subsp. paratuberculosis
ccgggacaccgcugg

SEQ ID NO: 2999044 - RNA, 18 nt, Mycobacterium avium subsp. paratuberculosis
ccgggacaccgcuggccg

SEQ ID NO: 2999045 - RNA, 14 nt, Mycobacterium avium subsp. paratuberculosis
ccgggacagcccga

SEQ ID NO: 2999046 - RNA, 23 nt, Mycobacterium avium subsp. paratuberculosis
ccgggacagcccgaacagcuugc

SEQ ID NO: 2999047 - RNA, 12 nt, Mycobacterium avium subsp. paratuberculosis
ccgggacagccg

SEQ ID NO: 2999048 - RNA, 17 nt, Mycobacterium avium subsp. paratuberculosis
ccgggacagccgcgccg

SEQ ID NO: 2999049 - RNA, 14 nt, Mycobacterium avium subsp. paratuberculosis
ccgggacagguagc

SEQ ID NO: 2999050 - RNA, 19 nt, Mycobacterium avium subsp. paratuberculosis
ccgggacagguagcgcagc

SEQ ID NO: 2999051 - RNA, 17 nt, Mycobacterium avium subsp. paratuberculosis
ccgggacaucgucgcgc

SEQ ID NO: 2999052 - RNA, 18 nt, Mycobacterium avium subsp. paratuberculosis
ccgggaccagcgcggugc

SEQ ID NO: 2999053 - RNA, 22 nt, Mycobacterium avium subsp. paratuberculosis
ccgggaccagcgcggugccggu

SEQ ID NO: 2999054 - RNA, 12 nt, Mycobacterium avium subsp. paratuberculosis
ccgggaccggcg

SEQ ID NO: 2999055 - RNA, 14 nt, Mycobacterium avium subsp. paratuberculosis
ccgggaccggcguc

SEQ ID NO: 2999056 - RNA, 15 nt, Mycobacterium avium subsp. paratuberculosis
ccgggaccggcguca

SEQ ID NO: 2999057 - RNA, 15 nt, Mycobacterium avium subsp. paratuberculosis
ccgggaccgucggga

SEQ ID NO: 2999058 - RNA, 16 nt, Mycobacterium avium subsp. paratuberculosis
ccgggaccgucgggaa

SEQ ID NO: 2999059 - RNA, 22 nt, Mycobacterium avium subsp. paratuberculosis
ccgggaccugggucugcggccg

SEQ ID NO: 2999060 - RNA, 17 nt, Mycobacterium avium subsp. paratuberculosis
ccgggacgaaggugcgc

SEQ ID NO: 2999061 - RNA, 18 nt, Mycobacterium avium subsp. paratuberculosis
ccgggacgaaggugcgca

SEQ ID NO: 2999062 - RNA, 15 nt, Mycobacterium avium subsp. paratuberculosis
ccgggacgacggcgc

SEQ ID NO: 2999063 - RNA, 16 nt, Mycobacterium avium subsp. paratuberculosis
ccgggacgacggcgcc

SEQ ID NO: 2999064 - RNA, 18 nt, Mycobacterium avium subsp. paratuberculosis
ccgggacgacggcgccgc

SEQ ID NO: 2999065 - RNA, 20 nt, Mycobacterium avium subsp. paratuberculosis
ccgggacgacggcgccgccc

SEQ ID NO: 2999066 - RNA, 22 nt, Mycobacterium avium subsp. paratuberculosis
ccgggacgacggcgccgcccgg

SEQ ID NO: 2999067 - RNA, 15 nt, Mycobacterium avium subsp. paratuberculosis
ccgggacgcggucca

SEQ ID NO: 2999068 - RNA, 16 nt, Mycobacterium avium subsp. paratuberculosis
ccgggacgcgguccag

SEQ ID NO: 2999069 - RNA, 18 nt, Mycobacterium avium subsp. paratuberculosis
ccgggacgggcauccggc

SEQ ID NO: 2999070 - RNA, 23 nt, Mycobacterium avium subsp. paratuberculosis
ccgggacgggggugccgaccgcg

SEQ ID NO: 2999071 - RNA, 20 nt, Mycobacterium avium subsp. paratuberculosis
ccgggacggguugcaggcca

SEQ ID NO: 2999072 - RNA, 14 nt, Mycobacterium avium subsp. paratuberculosis
ccgggagaaccuca

SEQ ID NO: 2999073 - RNA, 17 nt, Mycobacterium avium subsp. paratuberculosis
ccgggagacguccugug

SEQ ID NO: 2999074 - RNA, 17 nt, Mycobacterium avium subsp. paratuberculosis
ccgggagauacggucgc

SEQ ID NO: 2999075 - RNA, 21 nt, Mycobacterium avium subsp. paratuberculosis
ccgggagauacggucgcaccg

SEQ ID NO: 2999076 - RNA, 13 nt, Mycobacterium avium subsp. paratuberculosis
ccgggagcaucgg

SEQ ID NO: 2999077 - RNA, 17 nt, Mycobacterium avium subsp. paratuberculosis
ccgggaggacagggagg

SEQ ID NO: 2999078 - RNA, 13 nt, Mycobacterium avium subsp. paratuberculosis
ccgggaggccagc

SEQ ID NO: 2999079 - RNA, 14 nt, Mycobacterium avium subsp. paratuberculosis
ccgggaggccagca

SEQ ID NO: 2999080 - RNA, 16 nt, Mycobacterium avium subsp. paratuberculosis
ccgggaggccagcacc

SEQ ID NO: 2999081 - RNA, 18 nt, Mycobacterium avium subsp. paratuberculosis
ccgggaggccagcaccuu

SEQ ID NO: 2999082 - RNA, 20 nt, Mycobacterium avium subsp. paratuberculosis
ccgggauaacccagcaccac

SEQ ID NO: 2999083 - RNA, 13 nt, Mycobacterium avium subsp. paratuberculosis
ccgggauaccgcg

SEQ ID NO: 2999084 - RNA, 15 nt, Mycobacterium avium subsp. paratuberculosis
ccgggauaccgcgac

SEQ ID NO: 2999085 - RNA, 16 nt, Mycobacterium avium subsp. paratuberculosis
ccgggauaccgcgacc

SEQ ID NO: 2999086 - RNA, 17 nt, Mycobacterium avium subsp. paratuberculosis
ccgggauaccgcgaccg

SEQ ID NO: 2999087 - RNA, 18 nt, Mycobacterium avium subsp. paratuberculosis
ccgggauaccgcgaccgc

SEQ ID NO: 2999088 - RNA, 13 nt, Mycobacterium avium subsp. paratuberculosis
ccgggauagccgg

SEQ ID NO: 2999089 - RNA, 16 nt, Mycobacterium avium subsp. paratuberculosis
ccgggauaguucgccg

SEQ ID NO: 2999090 - RNA, 19 nt, Mycobacterium avium subsp. paratuberculosis
ccgggauaguucgccgccg

SEQ ID NO: 2999091 - RNA, 22 nt, Mycobacterium avium subsp. paratuberculosis
ccgggauaguucgccgccgcca

SEQ ID NO: 2999092 - RNA, 21 nt, Mycobacterium avium subsp. paratuberculosis
ccgggauauucgcccagcggc

SEQ ID NO: 2999093 - RNA, 15 nt, Mycobacterium avium subsp. paratuberculosis
ccgggaucacacgcg

SEQ ID NO: 2999094 - RNA, 20 nt, Mycobacterium avium subsp. paratuberculosis
ccgggaucacccucggcguc

SEQ ID NO: 2999095 - RNA, 18 nt, Mycobacterium avium subsp. paratuberculosis
ccgggauccgaggcguca

SEQ ID NO: 2999096 - RNA, 13 nt, Mycobacterium avium subsp. paratuberculosis
ccgggaucggcag

SEQ ID NO: 2999097 - RNA, 14 nt, Mycobacterium avium subsp. paratuberculosis
ccgggaucggcagc

SEQ ID NO: 2999098 - RNA, 15 nt, Mycobacterium avium subsp. paratuberculosis
ccgggaucggcagcg

SEQ ID NO: 2999099 - RNA, 16 nt, Mycobacterium avium subsp. paratuberculosis
ccgggaucggcagcgc

SEQ ID NO: 2999100 - RNA, 17 nt, Mycobacterium avium subsp. paratuberculosis
ccgggaucggcagcgcg

SEQ ID NO: 2999101 - RNA, 18 nt, Mycobacterium avium subsp. paratuberculosis
ccgggaucguguggccgc

SEQ ID NO: 2999102 - RNA, 16 nt, Mycobacterium avium subsp. paratuberculosis
ccgggaucuggccggu

SEQ ID NO: 2999103 - RNA, 17 nt, Mycobacterium avium subsp. paratuberculosis
ccgggaugaagccgccc

SEQ ID NO: 2999104 - RNA, 19 nt, Mycobacterium avium subsp. paratuberculosis
ccgggaugccgccggucac

SEQ ID NO: 2999105 - RNA, 20 nt, Mycobacterium avium subsp. paratuberculosis
ccgggaugccgccggucacg

SEQ ID NO: 2999106 - RNA, 19 nt, Mycobacterium avium subsp. paratuberculosis
ccgggaugccugcccgcgc

SEQ ID NO: 2999107 - RNA, 21 nt, Mycobacterium avium subsp. paratuberculosis
ccgggaugccugcccgcgcag

SEQ ID NO: 2999108 - RNA, 23 nt, Mycobacterium avium subsp. paratuberculosis
ccgggaugccugcccgcgcaggc

SEQ ID NO: 2999109 - RNA, 20 nt, Mycobacterium avium subsp. paratuberculosis
ccgggaugcgccaccgacac

SEQ ID NO: 2999110 - RNA, 21 nt, Mycobacterium avium subsp. paratuberculosis
ccgggaugcgccaccgacacc

SEQ ID NO: 2999111 - RNA, 12 nt, Mycobacterium avium subsp. paratuberculosis
ccgggauggcgu

SEQ ID NO: 2999112 - RNA, 21 nt, Mycobacterium avium subsp. paratuberculosis
ccgggauggcguucugcaccg

SEQ ID NO: 2999113 - RNA, 23 nt, Mycobacterium avium subsp. paratuberculosis
ccgggauggcguucugcaccgac

SEQ ID NO: 2999114 - RNA, 18 nt, Mycobacterium avium subsp. paratuberculosis
ccgggauggugaccagcg

SEQ ID NO: 2999115 - RNA, 19 nt, Mycobacterium avium subsp. paratuberculosis
ccgggauggugaccagcgc

SEQ ID NO: 2999116 - RNA, 20 nt, Mycobacterium avium subsp. paratuberculosis
ccgggauggugaccagcgcc

SEQ ID NO: 2999117 - RNA, 21 nt, Mycobacterium avium subsp. paratuberculosis
ccgggauggugaccagcgccc

SEQ ID NO: 2999118 - RNA, 16 nt, Mycobacterium avium subsp. paratuberculosis
ccgggcaacagcgcgc

SEQ ID NO: 2999119 - RNA, 18 nt, Mycobacterium avium subsp. paratuberculosis
ccgggcaacagcgcgccg

SEQ ID NO: 2999120 - RNA, 23 nt, Mycobacterium avium subsp. paratuberculosis
ccgggcaacagcgcgccggccgg

SEQ ID NO: 2999121 - RNA, 24 nt, Mycobacterium avium subsp. paratuberculosis
ccgggcaacagcgcgccggccggc

SEQ ID NO: 2999122 - RNA, 14 nt, Mycobacterium avium subsp. paratuberculosis
ccgggcaaccacag

SEQ ID NO: 2999123 - RNA, 21 nt, Mycobacterium avium subsp. paratuberculosis
ccgggcaaccacagcggcgca

SEQ ID NO: 2999124 - RNA, 24 nt, Mycobacterium avium subsp. paratuberculosis
ccgggcaaccacagcggcgcauga

SEQ ID NO: 2999125 - RNA, 18 nt, Mycobacterium avium subsp. paratuberculosis
ccgggcaaugaugucggc

SEQ ID NO: 2999126 - RNA, 21 nt, Mycobacterium avium subsp. paratuberculosis
ccgggcacauagcucaggugc

SEQ ID NO: 2999127 - RNA, 22 nt, Mycobacterium avium subsp. paratuberculosis
ccgggcacauagcucaggugcg

SEQ ID NO: 2999128 - RNA, 14 nt, Mycobacterium avium subsp. paratuberculosis
ccgggcaccaccac

SEQ ID NO: 2999129 - RNA, 16 nt, Mycobacterium avium subsp. paratuberculosis
ccgggcaccaccaccg

SEQ ID NO: 2999130 - RNA, 21 nt, Mycobacterium avium subsp. paratuberculosis
ccgggcaccaccaccgacacc

SEQ ID NO: 2999131 - RNA, 13 nt, Mycobacterium avium subsp. paratuberculosis
ccgggcaccagcg

SEQ ID NO: 2999132 - RNA, 15 nt, Mycobacterium avium subsp. paratuberculosis
ccgggcaccagcgac

SEQ ID NO: 2999133 - RNA, 16 nt, Mycobacterium avium subsp. paratuberculosis
ccgggcaccagcgcga

SEQ ID NO: 2999134 - RNA, 18 nt, Mycobacterium avium subsp. paratuberculosis
ccgggcaccagcgcgacg

SEQ ID NO: 2999135 - RNA, 14 nt, Mycobacterium avium subsp. paratuberculosis
ccgggcaccccggu

SEQ ID NO: 2999136 - RNA, 14 nt, Mycobacterium avium subsp. paratuberculosis
ccgggcacccgacg

SEQ ID NO: 2999137 - RNA, 13 nt, Mycobacterium avium subsp. paratuberculosis
ccgggcacccggc

SEQ ID NO: 2999138 - RNA, 16 nt, Mycobacterium avium subsp. paratuberculosis
ccgggcacccggcgcg

SEQ ID NO: 2999139 - RNA, 21 nt, Mycobacterium avium subsp. paratuberculosis
ccgggcacccggcgcggccgc

SEQ ID NO: 2999140 - RNA, 12 nt, Mycobacterium avium subsp. paratuberculosis
ccgggcaccgcg

SEQ ID NO: 2999141 - RNA, 18 nt, Mycobacterium avium subsp. paratuberculosis
ccgggcaccgcgcccgcc

SEQ ID NO: 2999142 - RNA, 15 nt, Mycobacterium avium subsp. paratuberculosis
ccgggcaccucggcg

SEQ ID NO: 2999143 - RNA, 17 nt, Mycobacterium avium subsp. paratuberculosis
ccgggcaccucggcguc

SEQ ID NO: 2999144 - RNA, 14 nt, Mycobacterium avium subsp. paratuberculosis
ccgggcacgacggu

SEQ ID NO: 2999145 - RNA, 12 nt, Mycobacterium avium subsp. paratuberculosis
ccgggcacgcag

SEQ ID NO: 2999146 - RNA, 23 nt, Mycobacterium avium subsp. paratuberculosis
ccgggcacgcgagacgagccgcc

SEQ ID NO: 2999147 - RNA, 14 nt, Mycobacterium avium subsp. paratuberculosis
ccgggcagcccgcc

SEQ ID NO: 2999148 - RNA, 16 nt, Mycobacterium avium subsp. paratuberculosis
ccgggcagcccgccgc

SEQ ID NO: 2999149 - RNA, 18 nt, Mycobacterium avium subsp. paratuberculosis
ccgggcagcccgccgcgg

SEQ ID NO: 2999150 - RNA, 13 nt, Mycobacterium avium subsp. paratuberculosis
ccgggcagccgca

SEQ ID NO: 2999151 - RNA, 15 nt, Mycobacterium avium subsp. paratuberculosis
ccgggcagccgcaca

SEQ ID NO: 2999152 - RNA, 23 nt, Mycobacterium avium subsp. paratuberculosis
ccgggcagccgcacaccgcggcg

SEQ ID NO: 2999153 - RNA, 12 nt, Mycobacterium avium subsp. paratuberculosis
ccgggcagcgcg

SEQ ID NO: 2999154 - RNA, 13 nt, Mycobacterium avium subsp. paratuberculosis
ccgggcagcgcgc

SEQ ID NO: 2999155 - RNA, 13 nt, Mycobacterium avium subsp. paratuberculosis
ccgggcagcggcc

SEQ ID NO: 2999156 - RNA, 19 nt, Mycobacterium avium subsp. paratuberculosis
ccgggcagcggccccacgu

SEQ ID NO: 2999157 - RNA, 17 nt, Mycobacterium avium subsp. paratuberculosis
ccgggcaggcacggugu

SEQ ID NO: 2999158 - RNA, 12 nt, Mycobacterium avium subsp. paratuberculosis
ccgggcaggcau

SEQ ID NO: 2999159 - RNA, 16 nt, Mycobacterium avium subsp. paratuberculosis
ccgggcaggccgggau

SEQ ID NO: 2999160 - RNA, 13 nt, Mycobacterium avium subsp. paratuberculosis
ccgggcaggcggc

SEQ ID NO: 2999161 - RNA, 18 nt, Mycobacterium avium subsp. paratuberculosis
ccgggcagguggucggcg

SEQ ID NO: 2999162 - RNA, 21 nt, Mycobacterium avium subsp. paratuberculosis
ccgggcaguuccuugcgcagc

SEQ ID NO: 2999163 - RNA, 17 nt, Mycobacterium avium subsp. paratuberculosis
ccgggcaucccgccgaa

SEQ ID NO: 2999164 - RNA, 19 nt, Mycobacterium avium subsp. paratuberculosis
ccgggcaucccgccgaacc

SEQ ID NO: 2999165 - RNA, 21 nt, Mycobacterium avium subsp. paratuberculosis
ccgggcaucccgccgaacccg

SEQ ID NO: 2999166 - RNA, 15 nt, Mycobacterium avium subsp. paratuberculosis
ccgggcauccgcccg

SEQ ID NO: 2999167 - RNA, 14 nt, Mycobacterium avium subsp. paratuberculosis
ccgggcauccgggc

SEQ ID NO: 2999168 - RNA, 16 nt, Mycobacterium avium subsp. paratuberculosis
ccgggcauccgggccg

SEQ ID NO: 2999169 - RNA, 17 nt, Mycobacterium avium subsp. paratuberculosis
ccgggcauccgggccgc

SEQ ID NO: 2999170 - RNA, 20 nt, Mycobacterium avium subsp. paratuberculosis
ccgggcauccgggccgccgc

SEQ ID NO: 2999171 - RNA, 15 nt, Mycobacterium avium subsp. paratuberculosis
ccgggcaugcccgua

SEQ ID NO: 2999172 - RNA, 20 nt, Mycobacterium avium subsp. paratuberculosis
ccgggcaugccguucagcgc

SEQ ID NO: 2999173 - RNA, 21 nt, Mycobacterium avium subsp. paratuberculosis
ccgggcaugccguucagcgcg

SEQ ID NO: 2999174 - RNA, 22 nt, Mycobacterium avium subsp. paratuberculosis
ccgggcaugccguucagcgcgg

SEQ ID NO: 2999175 - RNA, 14 nt, Mycobacterium avium subsp. paratuberculosis
ccgggcauggucac

SEQ ID NO: 2999176 - RNA, 19 nt, Mycobacterium avium subsp. paratuberculosis
ccgggcauuucggcuucca

SEQ ID NO: 2999177 - RNA, 23 nt, Mycobacterium avium subsp. paratuberculosis
ccgggccaacgguucggccgcuc

SEQ ID NO: 2999178 - RNA, 22 nt, Mycobacterium avium subsp. paratuberculosis
ccgggccaauuacgcugcggcg

SEQ ID NO: 2999179 - RNA, 14 nt, Mycobacterium avium subsp. paratuberculosis
ccgggccacacccg

SEQ ID NO: 2999180 - RNA, 15 nt, Mycobacterium avium subsp. paratuberculosis
ccgggccacacccgu

SEQ ID NO: 2999181 - RNA, 24 nt, Mycobacterium avium subsp. paratuberculosis
ccgggccacacccgucgacucggc

SEQ ID NO: 2999182 - RNA, 13 nt, Mycobacterium avium subsp. paratuberculosis
ccgggccaccacc

SEQ ID NO: 2999183 - RNA, 14 nt, Mycobacterium avium subsp. paratuberculosis
ccgggccaccacca

SEQ ID NO: 2999184 - RNA, 21 nt, Mycobacterium avium subsp. paratuberculosis
ccgggccaccaccacggccgc

SEQ ID NO: 2999185 - RNA, 23 nt, Mycobacterium avium subsp. paratuberculosis
ccgggccaccaccacggccgccg

SEQ ID NO: 2999186 - RNA, 12 nt, Mycobacterium avium subsp. paratuberculosis
ccgggccacgcc

SEQ ID NO: 2999187 - RNA, 14 nt, Mycobacterium avium subsp. paratuberculosis
ccgggccacgccga

SEQ ID NO: 2999188 - RNA, 19 nt, Mycobacterium avium subsp. paratuberculosis
ccgggccacgccgacuagc

SEQ ID NO: 2999189 - RNA, 14 nt, Mycobacterium avium subsp. paratuberculosis
ccgggccagauagc

SEQ ID NO: 2999190 - RNA, 23 nt, Mycobacterium avium subsp. paratuberculosis
ccgggccagcaacagcagcggca

SEQ ID NO: 2999191 - RNA, 22 nt, Mycobacterium avium subsp. paratuberculosis
ccgggccagcaggaucuggugc

SEQ ID NO: 2999192 - RNA, 12 nt, Mycobacterium avium subsp. paratuberculosis
ccgggccagccg

SEQ ID NO: 2999193 - RNA, 13 nt, Mycobacterium avium subsp. paratuberculosis
ccgggccagccgg

SEQ ID NO: 2999194 - RNA, 16 nt, Mycobacterium avium subsp. paratuberculosis
ccgggccagccggccc

SEQ ID NO: 2999195 - RNA, 14 nt, Mycobacterium avium subsp. paratuberculosis
ccgggccaggaccg

SEQ ID NO: 2999196 - RNA, 16 nt, Mycobacterium avium subsp. paratuberculosis
ccgggccaggaccgga

SEQ ID NO: 2999197 - RNA, 23 nt, Mycobacterium avium subsp. paratuberculosis
ccgggccaggaccggauccacca

SEQ ID NO: 2999198 - RNA, 17 nt, Mycobacterium avium subsp. paratuberculosis
ccgggccaggaugaccg

SEQ ID NO: 2999199 - RNA, 19 nt, Mycobacterium avium subsp. paratuberculosis
ccgggccaggaugaccgcc

SEQ ID NO: 2999200 - RNA, 13 nt, Mycobacterium avium subsp. paratuberculosis
ccgggccaggcgc

SEQ ID NO: 2999201 - RNA, 13 nt, Mycobacterium avium subsp. paratuberculosis
ccgggccaggucc

SEQ ID NO: 2999202 - RNA, 14 nt, Mycobacterium avium subsp. paratuberculosis
ccgggccagguccc

SEQ ID NO: 2999203 - RNA, 20 nt, Mycobacterium avium subsp. paratuberculosis
ccgggccaggucccaggcgu

SEQ ID NO: 2999204 - RNA, 22 nt, Mycobacterium avium subsp. paratuberculosis
ccgggccaggucccaggcgugg

SEQ ID NO: 2999205 - RNA, 22 nt, Mycobacterium avium subsp. paratuberculosis
ccgggccaggucgaagcgcagc

SEQ ID NO: 2999206 - RNA, 14 nt, Mycobacterium avium subsp. paratuberculosis
ccgggccaggucgg

SEQ ID NO: 2999207 - RNA, 18 nt, Mycobacterium avium subsp. paratuberculosis
ccgggccagguucgcgcc

SEQ ID NO: 2999208 - RNA, 18 nt, Mycobacterium avium subsp. paratuberculosis
ccgggcccaccaggucga

SEQ ID NO: 2999209 - RNA, 14 nt, Mycobacterium avium subsp. paratuberculosis
ccgggcccagcacc

SEQ ID NO: 2999210 - RNA, 17 nt, Mycobacterium avium subsp. paratuberculosis
ccgggcccagcaccacc

SEQ ID NO: 2999211 - RNA, 18 nt, Mycobacterium avium subsp. paratuberculosis
ccgggcccagcaccacca

SEQ ID NO: 2999212 - RNA, 12 nt, Mycobacterium avium subsp. paratuberculosis
ccgggcccagcu

SEQ ID NO: 2999213 - RNA, 22 nt, Mycobacterium avium subsp. paratuberculosis
ccgggcccgaacaucgccucgg

SEQ ID NO: 2999214 - RNA, 23 nt, Mycobacterium avium subsp. paratuberculosis
ccgggcccgaacaucgccucggc

SEQ ID NO: 2999215 - RNA, 17 nt, Mycobacterium avium subsp. paratuberculosis
ccgggcccgaagcgcuu

SEQ ID NO: 2999216 - RNA, 14 nt, Mycobacterium avium subsp. paratuberculosis
ccgggcccgcccgc

SEQ ID NO: 2999217 - RNA, 20 nt, Mycobacterium avium subsp. paratuberculosis
ccgggcccgcccgcagcggc

SEQ ID NO: 2999218 - RNA, 21 nt, Mycobacterium avium subsp. paratuberculosis
ccgggcccgcccgcagcggcg

SEQ ID NO: 2999219 - RNA, 12 nt, Mycobacterium avium subsp. paratuberculosis
ccgggcccgcuc

SEQ ID NO: 2999220 - RNA, 19 nt, Mycobacterium avium subsp. paratuberculosis
ccgggcccgcucaccugcg

SEQ ID NO: 2999221 - RNA, 12 nt, Mycobacterium avium subsp. paratuberculosis
ccgggcccggcg

SEQ ID NO: 2999222 - RNA, 13 nt, Mycobacterium avium subsp. paratuberculosis
ccgggcccggcgc

SEQ ID NO: 2999223 - RNA, 14 nt, Mycobacterium avium subsp. paratuberculosis
ccgggcccggcgcc

SEQ ID NO: 2999224 - RNA, 15 nt, Mycobacterium avium subsp. paratuberculosis
ccgggcccggcgcca

SEQ ID NO: 2999225 - RNA, 15 nt, Mycobacterium avium subsp. paratuberculosis
ccgggcccggucguc

SEQ ID NO: 2999226 - RNA, 20 nt, Mycobacterium avium subsp. paratuberculosis
ccgggcccggucgucgccgg

SEQ ID NO: 2999227 - RNA, 21 nt, Mycobacterium avium subsp. paratuberculosis
ccgggcccggucgucgccgga

SEQ ID NO: 2999228 - RNA, 20 nt, Mycobacterium avium subsp. paratuberculosis
ccgggcccucguccgacagc

SEQ ID NO: 2999229 - RNA, 15 nt, Mycobacterium avium subsp. paratuberculosis
ccgggccgaaggcgg

SEQ ID NO: 2999230 - RNA, 18 nt, Mycobacterium avium subsp. paratuberculosis
ccgggccgaaggcggcgc

SEQ ID NO: 2999231 - RNA, 20 nt, Mycobacterium avium subsp. paratuberculosis
ccgggccgaaggcggcgccg

SEQ ID NO: 2999232 - RNA, 22 nt, Mycobacterium avium subsp. paratuberculosis
ccgggccgaaggcggcgccggc

SEQ ID NO: 2999233 - RNA, 18 nt, Mycobacterium avium subsp. paratuberculosis
ccgggccgagcgcgccgc

SEQ ID NO: 2999234 - RNA, 20 nt, Mycobacterium avium subsp. paratuberculosis
ccgggccgagcgcgccgccg

SEQ ID NO: 2999235 - RNA, 23 nt, Mycobacterium avium subsp. paratuberculosis
ccgggccgagcgcgccgccgccg

SEQ ID NO: 2999236 - RNA, 16 nt, Mycobacterium avium subsp. paratuberculosis
ccgggccgcagcucgc

SEQ ID NO: 2999237 - RNA, 22 nt, Mycobacterium avium subsp. paratuberculosis
ccgggccgcaggguggccagca

SEQ ID NO: 2999238 - RNA, 17 nt, Mycobacterium avium subsp. paratuberculosis
ccgggccgcauccagcg

SEQ ID NO: 2999239 - RNA, 20 nt, Mycobacterium avium subsp. paratuberculosis
ccgggccgcauccagcgccg

SEQ ID NO: 2999240 - RNA, 21 nt, Mycobacterium avium subsp. paratuberculosis
ccgggccgcauccagcgccgc

SEQ ID NO: 2999241 - RNA, 23 nt, Mycobacterium avium subsp. paratuberculosis
ccgggccgcauccagcgccgcca

SEQ ID NO: 2999242 - RNA, 14 nt, Mycobacterium avium subsp. paratuberculosis
ccgggccgccacgg

SEQ ID NO: 2999243 - RNA, 15 nt, Mycobacterium avium subsp. paratuberculosis
ccgggccgccacggc

SEQ ID NO: 2999244 - RNA, 16 nt, Mycobacterium avium subsp. paratuberculosis
ccgggccgccacggcg

SEQ ID NO: 2999245 - RNA, 18 nt, Mycobacterium avium subsp. paratuberculosis
ccgggccgccacggcgcc

SEQ ID NO: 2999246 - RNA, 19 nt, Mycobacterium avium subsp. paratuberculosis
ccgggccgccacggcgcca

SEQ ID NO: 2999247 - RNA, 16 nt, Mycobacterium avium subsp. paratuberculosis
ccgggccgccaucacc

SEQ ID NO: 2999248 - RNA, 17 nt, Mycobacterium avium subsp. paratuberculosis
ccgggccgccaucaccg

SEQ ID NO: 2999249 - RNA, 20 nt, Mycobacterium avium subsp. paratuberculosis
ccgggccgccaucaccgcgc

SEQ ID NO: 2999250 - RNA, 16 nt, Mycobacterium avium subsp. paratuberculosis
ccgggccgcccgcgcg

SEQ ID NO: 2999251 - RNA, 18 nt, Mycobacterium avium subsp. paratuberculosis
ccgggccgcccgcgcgug

SEQ ID NO: 2999252 - RNA, 19 nt, Mycobacterium avium subsp. paratuberculosis
ccgggccgcccgcgcgugg

SEQ ID NO: 2999253 - RNA, 23 nt, Mycobacterium avium subsp. paratuberculosis
ccgggccgccgaugcgcccgcug

SEQ ID NO: 2999254 - RNA, 17 nt, Mycobacterium avium subsp. paratuberculosis
ccgggccgccgcggaca

SEQ ID NO: 2999255 - RNA, 17 nt, Mycobacterium avium subsp. paratuberculosis
ccgggccgccgcggcca

SEQ ID NO: 2999256 - RNA, 16 nt, Mycobacterium avium subsp. paratuberculosis
ccgggccgccggccgc

SEQ ID NO: 2999257 - RNA, 18 nt, Mycobacterium avium subsp. paratuberculosis
ccgggccgccggccgcgg

SEQ ID NO: 2999258 - RNA, 19 nt, Mycobacterium avium subsp. paratuberculosis
ccgggccgccggccgcggc

SEQ ID NO: 2999259 - RNA, 20 nt, Mycobacterium avium subsp. paratuberculosis
ccgggccgccggccgcggcg

SEQ ID NO: 2999260 - RNA, 22 nt, Mycobacterium avium subsp. paratuberculosis
ccgggccgccggccgcggcgug

SEQ ID NO: 2999261 - RNA, 14 nt, Mycobacterium avium subsp. paratuberculosis
ccgggccgccucga

SEQ ID NO: 2999262 - RNA, 22 nt, Mycobacterium avium subsp. paratuberculosis
ccgggccgccucgaagucgccg

SEQ ID NO: 2999263 - RNA, 23 nt, Mycobacterium avium subsp. paratuberculosis
ccgggccgccuucuccgggucgc

SEQ ID NO: 2999264 - RNA, 18 nt, Mycobacterium avium subsp. paratuberculosis
ccgggccgcggcgguagc

SEQ ID NO: 2999265 - RNA, 17 nt, Mycobacterium avium subsp. paratuberculosis
ccgggccgcuggccgcc

SEQ ID NO: 2999266 - RNA, 13 nt, Mycobacterium avium subsp. paratuberculosis
ccgggccgcuggu

SEQ ID NO: 2999267 - RNA, 12 nt, Mycobacterium avium subsp. paratuberculosis
ccgggccggaca

SEQ ID NO: 2999268 - RNA, 17 nt, Mycobacterium avium subsp. paratuberculosis
ccgggccggacacggcu

SEQ ID NO: 2999269 - RNA, 13 nt, Mycobacterium avium subsp. paratuberculosis
ccgggccggccag

SEQ ID NO: 2999270 - RNA, 15 nt, Mycobacterium avium subsp. paratuberculosis
ccgggccggccagac

SEQ ID NO: 2999271 - RNA, 13 nt, Mycobacterium avium subsp. paratuberculosis
ccgggccggcguc

SEQ ID NO: 2999272 - RNA, 17 nt, Mycobacterium avium subsp. paratuberculosis
ccgggccggucggucag

SEQ ID NO: 2999273 - RNA, 18 nt, Mycobacterium avium subsp. paratuberculosis
ccgggccgucaucgccga

SEQ ID NO: 2999274 - RNA, 19 nt, Mycobacterium avium subsp. paratuberculosis
ccgggccgucaucgccgac

SEQ ID NO: 2999275 - RNA, 14 nt, Mycobacterium avium subsp. paratuberculosis
ccgggccguucagc

SEQ ID NO: 2999276 - RNA, 13 nt, Mycobacterium avium subsp. paratuberculosis
ccgggccuccugu

SEQ ID NO: 2999277 - RNA, 15 nt, Mycobacterium avium subsp. paratuberculosis
ccgggccugcgcgcc

SEQ ID NO: 2999278 - RNA, 20 nt, Mycobacterium avium subsp. paratuberculosis
ccgggccugcggcgcggcca

SEQ ID NO: 2999279 - RNA, 16 nt, Mycobacterium avium subsp. paratuberculosis
ccgggccugcggcggc

SEQ ID NO: 2999280 - RNA, 21 nt, Mycobacterium avium subsp. paratuberculosis
ccgggccugcggcggccgcag

SEQ ID NO: 2999281 - RNA, 13 nt, Mycobacterium avium subsp. paratuberculosis
ccgggccugucca

SEQ ID NO: 2999282 - RNA, 21 nt, Mycobacterium avium subsp. paratuberculosis
ccgggccuguuucugcgccuu

SEQ ID NO: 2999283 - RNA, 18 nt, Mycobacterium avium subsp. paratuberculosis
ccgggccuugacggccug

SEQ ID NO: 2999284 - RNA, 23 nt, Mycobacterium avium subsp. paratuberculosis
ccgggccuugacggccugggcga

SEQ ID NO: 2999285 - RNA, 19 nt, Mycobacterium avium subsp. paratuberculosis
ccgggccuuggccaacgcg

SEQ ID NO: 2999286 - RNA, 20 nt, Mycobacterium avium subsp. paratuberculosis
ccgggccuuguugcggcgca

SEQ ID NO: 2999287 - RNA, 20 nt, Mycobacterium avium subsp. paratuberculosis
ccgggcgaaccacgggucgc

SEQ ID NO: 2999288 - RNA, 15 nt, Mycobacterium avium subsp. paratuberculosis
ccgggcgaacgucgg

SEQ ID NO: 2999289 - RNA, 18 nt, Mycobacterium avium subsp. paratuberculosis
ccgggcgaagucgccggc

SEQ ID NO: 2999290 - RNA, 20 nt, Mycobacterium avium subsp. paratuberculosis
ccgggcgaagucgccggcca

SEQ ID NO: 2999291 - RNA, 16 nt, Mycobacterium avium subsp. paratuberculosis
ccgggcgacaccccgc

SEQ ID NO: 2999292 - RNA, 19 nt, Mycobacterium avium subsp. paratuberculosis
ccgggcgacaccccgcgag

SEQ ID NO: 2999293 - RNA, 13 nt, Mycobacterium avium subsp. paratuberculosis
ccgggcgaccccg

SEQ ID NO: 2999294 - RNA, 14 nt, Mycobacterium avium subsp. paratuberculosis
ccgggcgaccccgg

SEQ ID NO: 2999295 - RNA, 15 nt, Mycobacterium avium subsp. paratuberculosis
ccgggcgaccccggc

SEQ ID NO: 2999296 - RNA, 16 nt, Mycobacterium avium subsp. paratuberculosis
ccgggcgaccccggcc

SEQ ID NO: 2999297 - RNA, 20 nt, Mycobacterium avium subsp. paratuberculosis
ccgggcgaccccggccagga

SEQ ID NO: 2999298 - RNA, 20 nt, Mycobacterium avium subsp. paratuberculosis
ccgggcgaccgucuucuuca

SEQ ID NO: 2999299 - RNA, 22 nt, Mycobacterium avium subsp. paratuberculosis
ccgggcgacugcgugcugggca

SEQ ID NO: 2999300 - RNA, 23 nt, Mycobacterium avium subsp. paratuberculosis
ccgggcgacugcgugcugggcac

SEQ ID NO: 2999301 - RNA, 18 nt, Mycobacterium avium subsp. paratuberculosis
ccgggcgagcgucgccgc

SEQ ID NO: 2999302 - RNA, 20 nt, Mycobacterium avium subsp. paratuberculosis
ccgggcgagcgucgccgcgu

SEQ ID NO: 2999303 - RNA, 14 nt, Mycobacterium avium subsp. paratuberculosis
ccgggcgaucagcc

SEQ ID NO: 2999304 - RNA, 18 nt, Mycobacterium avium subsp. paratuberculosis
ccgggcgaucauccaggu

SEQ ID NO: 2999305 - RNA, 19 nt, Mycobacterium avium subsp. paratuberculosis
ccgggcgaucauccaggug

SEQ ID NO: 2999306 - RNA, 17 nt, Mycobacterium avium subsp. paratuberculosis
ccgggcgauggugccgc

SEQ ID NO: 2999307 - RNA, 23 nt, Mycobacterium avium subsp. paratuberculosis
ccgggcgauggugccgccgguga

SEQ ID NO: 2999308 - RNA, 20 nt, Mycobacterium avium subsp. paratuberculosis
ccgggcgccacccgcaugcu

SEQ ID NO: 2999309 - RNA, 13 nt, Mycobacterium avium subsp. paratuberculosis
ccgggcgccacgc

SEQ ID NO: 2999310 - RNA, 14 nt, Mycobacterium avium subsp. paratuberculosis
ccgggcgccacgcu

SEQ ID NO: 2999311 - RNA, 18 nt, Mycobacterium avium subsp. paratuberculosis
ccgggcgccacgcuggcg

SEQ ID NO: 2999312 - RNA, 20 nt, Mycobacterium avium subsp. paratuberculosis
ccgggcgccacgcuggcgug

SEQ ID NO: 2999313 - RNA, 19 nt, Mycobacterium avium subsp. paratuberculosis
ccgggcgccauccgcagcc

SEQ ID NO: 2999314 - RNA, 21 nt, Mycobacterium avium subsp. paratuberculosis
ccgggcgccauccgcagcccg

SEQ ID NO: 2999315 - RNA, 23 nt, Mycobacterium avium subsp. paratuberculosis
ccgggcgccauccgccacccgcu

SEQ ID NO: 2999316 - RNA, 12 nt, Mycobacterium avium subsp. paratuberculosis
ccgggcgccggc

SEQ ID NO: 2999317 - RNA, 14 nt, Mycobacterium avium subsp. paratuberculosis
ccgggcgccggccg

SEQ ID NO: 2999318 - RNA, 16 nt, Mycobacterium avium subsp. paratuberculosis
ccgggcgccggccggc

SEQ ID NO: 2999319 - RNA, 22 nt, Mycobacterium avium subsp. paratuberculosis
ccgggcgccggccggcgcgugc

SEQ ID NO: 2999320 - RNA, 12 nt, Mycobacterium avium subsp. paratuberculosis
ccgggcgccggu

SEQ ID NO: 2999321 - RNA, 14 nt, Mycobacterium avium subsp. paratuberculosis
ccgggcgcgacggu

SEQ ID NO: 2999322 - RNA, 19 nt, Mycobacterium avium subsp. paratuberculosis
ccgggcgcgacggucacgc

SEQ ID NO: 2999323 - RNA, 21 nt, Mycobacterium avium subsp. paratuberculosis
ccgggcgcgcagaucgucgac

SEQ ID NO: 2999324 - RNA, 12 nt, Mycobacterium avium subsp. paratuberculosis
ccgggcgcgccc

SEQ ID NO: 2999325 - RNA, 14 nt, Mycobacterium avium subsp. paratuberculosis
ccgggcgcgcccac

SEQ ID NO: 2999326 - RNA, 20 nt, Mycobacterium avium subsp. paratuberculosis
ccgggcgcgcccacccgcgc

SEQ ID NO: 2999327 - RNA, 22 nt, Mycobacterium avium subsp. paratuberculosis
ccgggcgcgcccacccgcgccg

SEQ ID NO: 2999328 - RNA, 18 nt, Mycobacterium avium subsp. paratuberculosis
ccgggcgcgggcgccguc

SEQ ID NO: 2999329 - RNA, 22 nt, Mycobacterium avium subsp. paratuberculosis
ccgggcgcgggcgccgucgggg

SEQ ID NO: 2999330 - RNA, 19 nt, Mycobacterium avium subsp. paratuberculosis
ccgggcgcgugcacaccgg

SEQ ID NO: 2999331 - RNA, 19 nt, Mycobacterium avium subsp. paratuberculosis
ccgggcgcuggccguggcc

SEQ ID NO: 2999332 - RNA, 19 nt, Mycobacterium avium subsp. paratuberculosis
ccgggcggacggcaccgac

SEQ ID NO: 2999333 - RNA, 13 nt, Mycobacterium avium subsp. paratuberculosis
ccgggcggcagca

SEQ ID NO: 2999334 - RNA, 19 nt, Mycobacterium avium subsp. paratuberculosis
ccgggcggcagcacgucgu

SEQ ID NO: 2999335 - RNA, 15 nt, Mycobacterium avium subsp. paratuberculosis
ccgggcggcagcagc

SEQ ID NO: 2999336 - RNA, 17 nt, Mycobacterium avium subsp. paratuberculosis
ccgggcggcagcagcug

SEQ ID NO: 2999337 - RNA, 18 nt, Mycobacterium avium subsp. paratuberculosis
ccgggcggcagcagcugc

SEQ ID NO: 2999338 - RNA, 15 nt, Mycobacterium avium subsp. paratuberculosis
ccgggcggcaggugg

SEQ ID NO: 2999339 - RNA, 16 nt, Mycobacterium avium subsp. paratuberculosis
ccgggcggcaucgcgc

SEQ ID NO: 2999340 - RNA, 19 nt, Mycobacterium avium subsp. paratuberculosis
ccgggcggcaucgcgcgcg

SEQ ID NO: 2999341 - RNA, 15 nt, Mycobacterium avium subsp. paratuberculosis
ccgggcggccagccg

SEQ ID NO: 2999342 - RNA, 17 nt, Mycobacterium avium subsp. paratuberculosis
ccgggcggccagccgcg

SEQ ID NO: 2999343 - RNA, 22 nt, Mycobacterium avium subsp. paratuberculosis
ccgggcggccagccgcgcggcg

SEQ ID NO: 2999344 - RNA, 17 nt, Mycobacterium avium subsp. paratuberculosis
ccgggcggccagcgugg

SEQ ID NO: 2999345 - RNA, 23 nt, Mycobacterium avium subsp. paratuberculosis
ccgggcggccagcguggcgcgcc

SEQ ID NO: 2999346 - RNA, 14 nt, Mycobacterium avium subsp. paratuberculosis
ccgggcggcccgca

SEQ ID NO: 2999347 - RNA, 22 nt, Mycobacterium avium subsp. paratuberculosis
ccgggcggcccgccucggcggc

SEQ ID NO: 2999348 - RNA, 23 nt, Mycobacterium avium subsp. paratuberculosis
ccgggcggcccgccucggcggcc

SEQ ID NO: 2999349 - RNA, 13 nt, Mycobacterium avium subsp. paratuberculosis
ccgggcggccgga

SEQ ID NO: 2999350 - RNA, 14 nt, Mycobacterium avium subsp. paratuberculosis
ccgggcggccgggc

SEQ ID NO: 2999351 - RNA, 17 nt, Mycobacterium avium subsp. paratuberculosis
ccgggcggccguggucg

SEQ ID NO: 2999352 - RNA, 23 nt, Mycobacterium avium subsp. paratuberculosis
ccgggcggccguggucgaugaac

SEQ ID NO: 2999353 - RNA, 12 nt, Mycobacterium avium subsp. paratuberculosis
ccgggcggccuc

SEQ ID NO: 2999354 - RNA, 16 nt, Mycobacterium avium subsp. paratuberculosis
ccgggcggccucggcg

SEQ ID NO: 2999355 - RNA, 17 nt, Mycobacterium avium subsp. paratuberculosis
ccgggcggccucggcgu

SEQ ID NO: 2999356 - RNA, 22 nt, Mycobacterium avium subsp. paratuberculosis
ccgggcggccucggcguccgcg

SEQ ID NO: 2999357 - RNA, 16 nt, Mycobacterium avium subsp. paratuberculosis
ccgggcggcgacgucg

SEQ ID NO: 2999358 - RNA, 14 nt, Mycobacterium avium subsp. paratuberculosis
ccgggcggcgccga

SEQ ID NO: 2999359 - RNA, 15 nt, Mycobacterium avium subsp. paratuberculosis
ccgggcggcgccgaa

SEQ ID NO: 2999360 - RNA, 17 nt, Mycobacterium avium subsp. paratuberculosis
ccgggcggcgccgaacc

SEQ ID NO: 2999361 - RNA, 15 nt, Mycobacterium avium subsp. paratuberculosis
ccgggcggcggccuc

SEQ ID NO: 2999362 - RNA, 17 nt, Mycobacterium avium subsp. paratuberculosis
ccgggcggcggggcugc

SEQ ID NO: 2999363 - RNA, 21 nt, Mycobacterium avium subsp. paratuberculosis
ccgggcggcggggcugcccag

SEQ ID NO: 2999364 - RNA, 17 nt, Mycobacterium avium subsp. paratuberculosis
ccgggcgggcaccccau

SEQ ID NO: 2999365 - RNA, 14 nt, Mycobacterium avium subsp. paratuberculosis
ccgggcgggccgca

SEQ ID NO: 2999366 - RNA, 15 nt, Mycobacterium avium subsp. paratuberculosis
ccgggcgggccgcag

SEQ ID NO: 2999367 - RNA, 21 nt, Mycobacterium avium subsp. paratuberculosis
ccgggcgggccgcagcaccac

SEQ ID NO: 2999368 - RNA, 19 nt, Mycobacterium avium subsp. paratuberculosis
ccgggcgggcugcgggcau

SEQ ID NO: 2999369 - RNA, 18 nt, Mycobacterium avium subsp. paratuberculosis
ccgggcgggggcugucca

SEQ ID NO: 2999370 - RNA, 20 nt, Mycobacterium avium subsp. paratuberculosis
ccgggcggggugguggacgu

SEQ ID NO: 2999371 - RNA, 17 nt, Mycobacterium avium subsp. paratuberculosis
ccgggcgguacgcgccg

SEQ ID NO: 2999372 - RNA, 20 nt, Mycobacterium avium subsp. paratuberculosis
ccgggcgguacgcgccgcgc

SEQ ID NO: 2999373 - RNA, 12 nt, Mycobacterium avium subsp. paratuberculosis
ccgggcggucgc

SEQ ID NO: 2999374 - RNA, 14 nt, Mycobacterium avium subsp. paratuberculosis
ccgggcggucgcgu

SEQ ID NO: 2999375 - RNA, 15 nt, Mycobacterium avium subsp. paratuberculosis
ccgggcggucgcguc

SEQ ID NO: 2999376 - RNA, 17 nt, Mycobacterium avium subsp. paratuberculosis
ccgggcggucgcgucgu

SEQ ID NO: 2999377 - RNA, 23 nt, Mycobacterium avium subsp. paratuberculosis
ccgggcggucgcgucgucggcgg

SEQ ID NO: 2999378 - RNA, 20 nt, Mycobacterium avium subsp. paratuberculosis
ccgggcggugaccacgccgu

SEQ ID NO: 2999379 - RNA, 23 nt, Mycobacterium avium subsp. paratuberculosis
ccgggcguagugcagcugcagcg

SEQ ID NO: 2999380 - RNA, 24 nt, Mycobacterium avium subsp. paratuberculosis
ccgggcguagugcagcugcagcga

SEQ ID NO: 2999381 - RNA, 14 nt, Mycobacterium avium subsp. paratuberculosis
ccgggcgucacgcc

SEQ ID NO: 2999382 - RNA, 17 nt, Mycobacterium avium subsp. paratuberculosis
ccgggcgucacgccagc

SEQ ID NO: 2999383 - RNA, 19 nt, Mycobacterium avium subsp. paratuberculosis
ccgggcgucacgccagcgu

SEQ ID NO: 2999384 - RNA, 21 nt, Mycobacterium avium subsp. paratuberculosis
ccgggcgucacgccagcguga

SEQ ID NO: 2999385 - RNA, 16 nt, Mycobacterium avium subsp. paratuberculosis
ccgggcgucacucugg

SEQ ID NO: 2999386 - RNA, 22 nt, Mycobacterium avium subsp. paratuberculosis
ccgggcgucacucuggcgugac

SEQ ID NO: 2999387 - RNA, 13 nt, Mycobacterium avium subsp. paratuberculosis
ccgggcgucgcgc

SEQ ID NO: 2999388 - RNA, 15 nt, Mycobacterium avium subsp. paratuberculosis
ccgggcgucggcggu

SEQ ID NO: 2999389 - RNA, 22 nt, Mycobacterium avium subsp. paratuberculosis
ccgggcgucggcggugguccgc

SEQ ID NO: 2999390 - RNA, 16 nt, Mycobacterium avium subsp. paratuberculosis
ccgggcgucggggccc

SEQ ID NO: 2999391 - RNA, 18 nt, Mycobacterium avium subsp. paratuberculosis
ccgggcgugcccggcgca

SEQ ID NO: 2999392 - RNA, 18 nt, Mycobacterium avium subsp. paratuberculosis
ccgggcgugccggacacc

SEQ ID NO: 2999393 - RNA, 19 nt, Mycobacterium avium subsp. paratuberculosis
ccgggcgugccggacaccg

SEQ ID NO: 2999394 - RNA, 15 nt, Mycobacterium avium subsp. paratuberculosis
ccgggcguucccgcg

SEQ ID NO: 2999395 - RNA, 16 nt, Mycobacterium avium subsp. paratuberculosis
ccgggcguucccgcgc

SEQ ID NO: 2999396 - RNA, 18 nt, Mycobacterium avium subsp. paratuberculosis
ccgggcguucccgcgcgc

SEQ ID NO: 2999397 - RNA, 19 nt, Mycobacterium avium subsp. paratuberculosis
ccgggcguucccgcgcgcg

SEQ ID NO: 2999398 - RNA, 18 nt, Mycobacterium avium subsp. paratuberculosis
ccgggcguugcccgccgc

SEQ ID NO: 2999399 - RNA, 21 nt, Mycobacterium avium subsp. paratuberculosis
ccgggcguugcccgccgcggc

SEQ ID NO: 2999400 - RNA, 22 nt, Mycobacterium avium subsp. paratuberculosis
ccgggcguugcccgccgcggcg

SEQ ID NO: 2999401 - RNA, 17 nt, Mycobacterium avium subsp. paratuberculosis
ccgggcuagacgcgcac

SEQ ID NO: 2999402 - RNA, 18 nt, Mycobacterium avium subsp. paratuberculosis
ccgggcuaucgcccggcg

SEQ ID NO: 2999403 - RNA, 22 nt, Mycobacterium avium subsp. paratuberculosis
ccgggcuaucgcccggcgcccg

SEQ ID NO: 2999404 - RNA, 23 nt, Mycobacterium avium subsp. paratuberculosis
ccgggcucccgcuccauggcggc

SEQ ID NO: 2999405 - RNA, 18 nt, Mycobacterium avium subsp. paratuberculosis
ccgggcucgagcaccgaa

SEQ ID NO: 2999406 - RNA, 21 nt, Mycobacterium avium subsp. paratuberculosis
ccgggcucgagcaccgaaacc

SEQ ID NO: 2999407 - RNA, 21 nt, Mycobacterium avium subsp. paratuberculosis
ccgggcucgagggcggcgacc

SEQ ID NO: 2999408 - RNA, 21 nt, Mycobacterium avium subsp. paratuberculosis
ccgggcucgaguuuggccagc

SEQ ID NO: 2999409 - RNA, 19 nt, Mycobacterium avium subsp. paratuberculosis
ccgggcucggucaccccgg

SEQ ID NO: 2999410 - RNA, 20 nt, Mycobacterium avium subsp. paratuberculosis
ccgggcucggucaccccgga

SEQ ID NO: 2999411 - RNA, 14 nt, Mycobacterium avium subsp. paratuberculosis
ccgggcugacccgg

SEQ ID NO: 2999412 - RNA, 17 nt, Mycobacterium avium subsp. paratuberculosis
ccgggcugaccgucgac

SEQ ID NO: 2999413 - RNA, 19 nt, Mycobacterium avium subsp. paratuberculosis
ccgggcugaccgucgacca

SEQ ID NO: 2999414 - RNA, 23 nt, Mycobacterium avium subsp. paratuberculosis
ccgggcugaccucgcgcaccggc

SEQ ID NO: 2999415 - RNA, 20 nt, Mycobacterium avium subsp. paratuberculosis
ccgggcugcacgcugcgcac

SEQ ID NO: 2999416 - RNA, 16 nt, Mycobacterium avium subsp. paratuberculosis
ccgggcugcccaccac

SEQ ID NO: 2999417 - RNA, 18 nt, Mycobacterium avium subsp. paratuberculosis
ccgggcugcccaccacca

SEQ ID NO: 2999418 - RNA, 19 nt, Mycobacterium avium subsp. paratuberculosis
ccgggcugcgcagcaccgu

SEQ ID NO: 2999419 - RNA, 19 nt, Mycobacterium avium subsp. paratuberculosis
ccgggcugcgguuccgggc

SEQ ID NO: 2999420 - RNA, 18 nt, Mycobacterium avium subsp. paratuberculosis
ccgggcuggccgucggcg

SEQ ID NO: 2999421 - RNA, 18 nt, Mycobacterium avium subsp. paratuberculosis
ccgggcuggugucccgcg

SEQ ID NO: 2999422 - RNA, 12 nt, Mycobacterium avium subsp. paratuberculosis
ccgggcugucgg

SEQ ID NO: 2999423 - RNA, 14 nt, Mycobacterium avium subsp. paratuberculosis
ccgggcugucgggc

SEQ ID NO: 2999424 - RNA, 16 nt, Mycobacterium avium subsp. paratuberculosis
ccgggcugucgggcag

SEQ ID NO: 2999425 - RNA, 21 nt, Mycobacterium avium subsp. paratuberculosis
ccgggcugucgggcaggccgg

SEQ ID NO: 2999426 - RNA, 15 nt, Mycobacterium avium subsp. paratuberculosis
ccgggcugugggcgc

SEQ ID NO: 2999427 - RNA, 18 nt, Mycobacterium avium subsp. paratuberculosis
ccgggcuguugaccacgg

SEQ ID NO: 2999428 - RNA, 20 nt, Mycobacterium avium subsp. paratuberculosis
ccgggcuguugaccacggcc

SEQ ID NO: 2999429 - RNA, 21 nt, Mycobacterium avium subsp. paratuberculosis
ccgggcuguugaccacggccu

SEQ ID NO: 2999430 - RNA, 22 nt, Mycobacterium avium subsp. paratuberculosis
ccgggcuguugaccacggccug

SEQ ID NO: 2999431 - RNA, 12 nt, Mycobacterium avium subsp. paratuberculosis
ccgggcuucccc

SEQ ID NO: 2999432 - RNA, 23 nt, Mycobacterium avium subsp. paratuberculosis
ccgggcuuggucaugaacgccgg

SEQ ID NO: 2999433 - RNA, 14 nt, Mycobacterium avium subsp. paratuberculosis
ccggggaacaccgg

SEQ ID NO: 2999434 - RNA, 18 nt, Mycobacterium avium subsp. paratuberculosis
ccggggaacaccggcgag

SEQ ID NO: 2999435 - RNA, 12 nt, Mycobacterium avium subsp. paratuberculosis
ccggggacccgc

SEQ ID NO: 2999436 - RNA, 14 nt, Mycobacterium avium subsp. paratuberculosis
ccggggacgacggc

SEQ ID NO: 2999437 - RNA, 21 nt, Mycobacterium avium subsp. paratuberculosis
ccggggacggguugcggucca

SEQ ID NO: 2999438 - RNA, 18 nt, Mycobacterium avium subsp. paratuberculosis
ccggggacggugcagccg

SEQ ID NO: 2999439 - RNA, 16 nt, Mycobacterium avium subsp. paratuberculosis
ccggggaucaccucgc

SEQ ID NO: 2999440 - RNA, 20 nt, Mycobacterium avium subsp. paratuberculosis
ccggggaucaccucgcugac

SEQ ID NO: 2999441 - RNA, 22 nt, Mycobacterium avium subsp. paratuberculosis
ccggggcaccacguccaccagc

SEQ ID NO: 2999442 - RNA, 23 nt, Mycobacterium avium subsp. paratuberculosis
ccggggcaccacguccaccagca

SEQ ID NO: 2999443 - RNA, 16 nt, Mycobacterium avium subsp. paratuberculosis
ccggggcacgaugaac

SEQ ID NO: 2999444 - RNA, 15 nt, Mycobacterium avium subsp. paratuberculosis
ccggggcagacccgc

SEQ ID NO: 2999445 - RNA, 20 nt, Mycobacterium avium subsp. paratuberculosis
ccggggcagcacccgcaccg

SEQ ID NO: 2999446 - RNA, 13 nt, Mycobacterium avium subsp. paratuberculosis
ccggggcagcagc

SEQ ID NO: 2999447 - RNA, 13 nt, Mycobacterium avium subsp. paratuberculosis
ccggggcagcugc

SEQ ID NO: 2999448 - RNA, 16 nt, Mycobacterium avium subsp. paratuberculosis
ccggggcagcugcugg

SEQ ID NO: 2999449 - RNA, 17 nt, Mycobacterium avium subsp. paratuberculosis
ccggggccagcacccag

SEQ ID NO: 2999450 - RNA, 15 nt, Mycobacterium avium subsp. paratuberculosis
ccggggccagcacgc

SEQ ID NO: 2999451 - RNA, 20 nt, Mycobacterium avium subsp. paratuberculosis
ccggggccagcacgcccccg

SEQ ID NO: 2999452 - RNA, 21 nt, Mycobacterium avium subsp. paratuberculosis
ccggggccagcacgcccccgc

SEQ ID NO: 2999453 - RNA, 12 nt, Mycobacterium avium subsp. paratuberculosis
ccggggccaggu

SEQ ID NO: 2999454 - RNA, 14 nt, Mycobacterium avium subsp. paratuberculosis
ccggggccgcggcu

SEQ ID NO: 2999455 - RNA, 15 nt, Mycobacterium avium subsp. paratuberculosis
ccggggccgcggcuc

SEQ ID NO: 2999456 - RNA, 21 nt, Mycobacterium avium subsp. paratuberculosis
ccggggccgcggcucgcgacg

SEQ ID NO: 2999457 - RNA, 16 nt, Mycobacterium avium subsp. paratuberculosis
ccggggccggcgaugc

SEQ ID NO: 2999458 - RNA, 20 nt, Mycobacterium avium subsp. paratuberculosis
ccggggccggcgggggcgcg

SEQ ID NO: 2999459 - RNA, 13 nt, Mycobacterium avium subsp. paratuberculosis
ccggggccguccg

SEQ ID NO: 2999460 - RNA, 15 nt, Mycobacterium avium subsp. paratuberculosis
ccggggccuucuugg

SEQ ID NO: 2999461 - RNA, 19 nt, Mycobacterium avium subsp. paratuberculosis
ccggggccuucuuggcggc

SEQ ID NO: 2999462 - RNA, 15 nt, Mycobacterium avium subsp. paratuberculosis
ccggggcgcagcugc

SEQ ID NO: 2999463 - RNA, 12 nt, Mycobacterium avium subsp. paratuberculosis
ccggggcgcccc

SEQ ID NO: 2999464 - RNA, 14 nt, Mycobacterium avium subsp. paratuberculosis
ccggggcgccccgc

SEQ ID NO: 2999465 - RNA, 18 nt, Mycobacterium avium subsp. paratuberculosis
ccggggcgccccgcuggu

SEQ ID NO: 2999466 - RNA, 13 nt, Mycobacterium avium subsp. paratuberculosis
ccggggcgcgcug

SEQ ID NO: 2999467 - RNA, 16 nt, Mycobacterium avium subsp. paratuberculosis
ccggggcgcggaccgc

SEQ ID NO: 2999468 - RNA, 15 nt, Mycobacterium avium subsp. paratuberculosis
ccggggcgcugagca

SEQ ID NO: 2999469 - RNA, 13 nt, Mycobacterium avium subsp. paratuberculosis
ccggggcggcgau

SEQ ID NO: 2999470 - RNA, 20 nt, Mycobacterium avium subsp. paratuberculosis
ccggggcggcgaugcgcggc

SEQ ID NO: 2999471 - RNA, 21 nt, Mycobacterium avium subsp. paratuberculosis
ccggggcggcgaugcgcggcc

SEQ ID NO: 2999472 - RNA, 16 nt, Mycobacterium avium subsp. paratuberculosis
ccggggcgucggacgc

SEQ ID NO: 2999473 - RNA, 17 nt, Mycobacterium avium subsp. paratuberculosis
ccggggcgucggacgcc

SEQ ID NO: 2999474 - RNA, 21 nt, Mycobacterium avium subsp. paratuberculosis
ccggggcucauacggcggcuc

SEQ ID NO: 2999475 - RNA, 15 nt, Mycobacterium avium subsp. paratuberculosis
ccggggcuucgaacg

SEQ ID NO: 2999476 - RNA, 19 nt, Mycobacterium avium subsp. paratuberculosis
ccgggggaagcccagcacc

SEQ ID NO: 2999477 - RNA, 23 nt, Mycobacterium avium subsp. paratuberculosis
ccgggggaccagcgcaaccgcgg

SEQ ID NO: 2999478 - RNA, 18 nt, Mycobacterium avium subsp. paratuberculosis
ccgggggauagggcguga

SEQ ID NO: 2999479 - RNA, 19 nt, Mycobacterium avium subsp. paratuberculosis
ccgggggauagggcgugau

SEQ ID NO: 2999480 - RNA, 14 nt, Mycobacterium avium subsp. paratuberculosis
ccgggggcaccgcc

SEQ ID NO: 2999481 - RNA, 16 nt, Mycobacterium avium subsp. paratuberculosis
ccgggggcaccgccag

SEQ ID NO: 2999482 - RNA, 21 nt, Mycobacterium avium subsp. paratuberculosis
ccgggggccgucacaggccgc

SEQ ID NO: 2999483 - RNA, 18 nt, Mycobacterium avium subsp. paratuberculosis
ccgggggcggcggcgcgu

SEQ ID NO: 2999484 - RNA, 21 nt, Mycobacterium avium subsp. paratuberculosis
ccgggggcggugcagccgggu

SEQ ID NO: 2999485 - RNA, 15 nt, Mycobacterium avium subsp. paratuberculosis
ccggggguagcggug

SEQ ID NO: 2999486 - RNA, 17 nt, Mycobacterium avium subsp. paratuberculosis
ccggggguccagggugc

SEQ ID NO: 2999487 - RNA, 18 nt, Mycobacterium avium subsp. paratuberculosis
ccggggguggcggucccg

SEQ ID NO: 2999488 - RNA, 23 nt, Mycobacterium avium subsp. paratuberculosis
ccggggguggcggucccggcgga

SEQ ID NO: 2999489 - RNA, 17 nt, Mycobacterium avium subsp. paratuberculosis
ccggggguuucgugugc

SEQ ID NO: 2999490 - RNA, 15 nt, Mycobacterium avium subsp. paratuberculosis
ccggggucaccuugg

SEQ ID NO: 2999491 - RNA, 20 nt, Mycobacterium avium subsp. paratuberculosis
ccggggucaccuuggccgga

SEQ ID NO: 2999492 - RNA, 13 nt, Mycobacterium avium subsp. paratuberculosis
ccgggguccaccg

SEQ ID NO: 2999493 - RNA, 18 nt, Mycobacterium avium subsp. paratuberculosis
ccgggguccaccggccga

SEQ ID NO: 2999494 - RNA, 20 nt, Mycobacterium avium subsp. paratuberculosis
ccgggguccgcaacgccggc

SEQ ID NO: 2999495 - RNA, 21 nt, Mycobacterium avium subsp. paratuberculosis
ccgggguccgcaacgccggcg

SEQ ID NO: 2999496 - RNA, 22 nt, Mycobacterium avium subsp. paratuberculosis
ccgggguccgcaacgccggcgu

SEQ ID NO: 2999497 - RNA, 17 nt, Mycobacterium avium subsp. paratuberculosis
ccgggguccucucggcg

SEQ ID NO: 2999498 - RNA, 21 nt, Mycobacterium avium subsp. paratuberculosis
ccgggguccucucggcgccgu

SEQ ID NO: 2999499 - RNA, 22 nt, Mycobacterium avium subsp. paratuberculosis
ccgggguccucucggcgccguc

SEQ ID NO: 2999500 - RNA, 18 nt, Mycobacterium avium subsp. paratuberculosis
ccggggucgacagccuga

SEQ ID NO: 2999501 - RNA, 12 nt, Mycobacterium avium subsp. paratuberculosis
ccggggucgcgc

SEQ ID NO: 2999502 - RNA, 18 nt, Mycobacterium avium subsp. paratuberculosis
ccggggucgcgcgcgaac

SEQ ID NO: 2999503 - RNA, 17 nt, Mycobacterium avium subsp. paratuberculosis
ccggggucggcgcccuc

SEQ ID NO: 2999504 - RNA, 15 nt, Mycobacterium avium subsp. paratuberculosis
ccggggucugcacga

SEQ ID NO: 2999505 - RNA, 21 nt, Mycobacterium avium subsp. paratuberculosis
ccggggugagcagggccagcg

SEQ ID NO: 2999506 - RNA, 23 nt, Mycobacterium avium subsp. paratuberculosis
ccggggugagcagggccagcggc

SEQ ID NO: 2999507 - RNA, 18 nt, Mycobacterium avium subsp. paratuberculosis
ccggggugaugccggcgg

SEQ ID NO: 2999508 - RNA, 16 nt, Mycobacterium avium subsp. paratuberculosis
ccggggugcaccgugg

SEQ ID NO: 2999509 - RNA, 22 nt, Mycobacterium avium subsp. paratuberculosis
ccggggugcaccguggugaccc

SEQ ID NO: 2999510 - RNA, 13 nt, Mycobacterium avium subsp. paratuberculosis
ccggggugcagca

SEQ ID NO: 2999511 - RNA, 19 nt, Mycobacterium avium subsp. paratuberculosis
ccggggugcccgggccgca

SEQ ID NO: 2999512 - RNA, 21 nt, Mycobacterium avium subsp. paratuberculosis
ccggggugggcacgucggcca

SEQ ID NO: 2999513 - RNA, 18 nt, Mycobacterium avium subsp. paratuberculosis
ccggggugggccaucggc

SEQ ID NO: 2999514 - RNA, 20 nt, Mycobacterium avium subsp. paratuberculosis
ccggggugggccaucggcag

SEQ ID NO: 2999515 - RNA, 17 nt, Mycobacterium avium subsp. paratuberculosis
ccgggguguagcggaug

SEQ ID NO: 2999516 - RNA, 16 nt, Mycobacterium avium subsp. paratuberculosis
ccgggguguaggcguc

SEQ ID NO: 2999517 - RNA, 20 nt, Mycobacterium avium subsp. paratuberculosis
ccgggguguaggcgucggcg

SEQ ID NO: 2999518 - RNA, 18 nt, Mycobacterium avium subsp. paratuberculosis
ccggggugugcagcggga

SEQ ID NO: 2999519 - RNA, 14 nt, Mycobacterium avium subsp. paratuberculosis
ccggguacaccggc

SEQ ID NO: 2999520 - RNA, 16 nt, Mycobacterium avium subsp. paratuberculosis
ccggguacaccggcuc

SEQ ID NO: 2999521 - RNA, 15 nt, Mycobacterium avium subsp. paratuberculosis
ccggguaccucugcg

SEQ ID NO: 2999522 - RNA, 16 nt, Mycobacterium avium subsp. paratuberculosis
ccggguagcgccgccg

SEQ ID NO: 2999523 - RNA, 17 nt, Mycobacterium avium subsp. paratuberculosis
ccggguaggacaccguc

SEQ ID NO: 2999524 - RNA, 21 nt, Mycobacterium avium subsp. paratuberculosis
ccggguaucgacagucccgcg

SEQ ID NO: 2999525 - RNA, 16 nt, Mycobacterium avium subsp. paratuberculosis
ccggguauuucgagca

SEQ ID NO: 2999526 - RNA, 22 nt, Mycobacterium avium subsp. paratuberculosis
ccgggucaccggaugcaccggc

SEQ ID NO: 2999527 - RNA, 13 nt, Mycobacterium avium subsp. paratuberculosis
ccgggucacgaac

SEQ ID NO: 2999528 - RNA, 13 nt, Mycobacterium avium subsp. paratuberculosis
ccgggucacgugc

SEQ ID NO: 2999529 - RNA, 13 nt, Mycobacterium avium subsp. paratuberculosis
ccgggucagcacc

SEQ ID NO: 2999530 - RNA, 14 nt, Mycobacterium avium subsp. paratuberculosis
ccgggucagcacca

SEQ ID NO: 2999531 - RNA, 16 nt, Mycobacterium avium subsp. paratuberculosis
ccgggucagcaccacc

SEQ ID NO: 2999532 - RNA, 17 nt, Mycobacterium avium subsp. paratuberculosis
ccgggucagcaccacca

SEQ ID NO: 2999533 - RNA, 19 nt, Mycobacterium avium subsp. paratuberculosis
ccgggucagcaccaccaac

SEQ ID NO: 2999534 - RNA, 22 nt, Mycobacterium avium subsp. paratuberculosis
ccgggucagcaccaccaacagc

SEQ ID NO: 2999535 - RNA, 22 nt, Mycobacterium avium subsp. paratuberculosis
ccgggucaggaacaccgagccg

SEQ ID NO: 2999536 - RNA, 24 nt, Mycobacterium avium subsp. paratuberculosis
ccgggucaggaacaccgagccggc

SEQ ID NO: 2999537 - RNA, 14 nt, Mycobacterium avium subsp. paratuberculosis
ccgggucaggucga

SEQ ID NO: 2999538 - RNA, 17 nt, Mycobacterium avium subsp. paratuberculosis
ccgggucaguucgcggc

SEQ ID NO: 2999539 - RNA, 20 nt, Mycobacterium avium subsp. paratuberculosis
ccgggucaguucgcggcgca

SEQ ID NO: 2999540 - RNA, 19 nt, Mycobacterium avium subsp. paratuberculosis
ccgggucauccccgugcgg

SEQ ID NO: 2999541 - RNA, 15 nt, Mycobacterium avium subsp. paratuberculosis
ccggguccagccgcg

SEQ ID NO: 2999542 - RNA, 13 nt, Mycobacterium avium subsp. paratuberculosis
ccgggucccccgc

SEQ ID NO: 2999543 - RNA, 14 nt, Mycobacterium avium subsp. paratuberculosis
ccggguccgaggug

SEQ ID NO: 2999544 - RNA, 12 nt, Mycobacterium avium subsp. paratuberculosis
ccggguccggcu

SEQ ID NO: 2999545 - RNA, 17 nt, Mycobacterium avium subsp. paratuberculosis
ccggguccuaucaggac

SEQ ID NO: 2999546 - RNA, 13 nt, Mycobacterium avium subsp. paratuberculosis
ccggguccuugcg

SEQ ID NO: 2999547 - RNA, 18 nt, Mycobacterium avium subsp. paratuberculosis
ccggguccuugcgccccg

SEQ ID NO: 2999548 - RNA, 16 nt, Mycobacterium avium subsp. paratuberculosis
ccgggucgaacggcaa

SEQ ID NO: 2999549 - RNA, 16 nt, Mycobacterium avium subsp. paratuberculosis
ccgggucgaccgccuc

SEQ ID NO: 2999550 - RNA, 18 nt, Mycobacterium avium subsp. paratuberculosis
ccgggucgaccgccucgg

SEQ ID NO: 2999551 - RNA, 15 nt, Mycobacterium avium subsp. paratuberculosis
ccgggucgacgccga

SEQ ID NO: 2999552 - RNA, 17 nt, Mycobacterium avium subsp. paratuberculosis
ccgggucgagcgcgccg

SEQ ID NO: 2999553 - RNA, 20 nt, Mycobacterium avium subsp. paratuberculosis
ccgggucgagcggcccgcac

SEQ ID NO: 2999554 - RNA, 16 nt, Mycobacterium avium subsp. paratuberculosis
ccgggucgcacagccg

SEQ ID NO: 2999555 - RNA, 23 nt, Mycobacterium avium subsp. paratuberculosis
ccgggucgcacagccgcagcagc

SEQ ID NO: 2999556 - RNA, 14 nt, Mycobacterium avium subsp. paratuberculosis
ccgggucgcacgcc

SEQ ID NO: 2999557 - RNA, 16 nt, Mycobacterium avium subsp. paratuberculosis
ccgggucgcagcggca

SEQ ID NO: 2999558 - RNA, 17 nt, Mycobacterium avium subsp. paratuberculosis
ccgggucgcagcggcac

SEQ ID NO: 2999559 - RNA, 20 nt, Mycobacterium avium subsp. paratuberculosis
ccgggucgcagcggcacguc

SEQ ID NO: 2999560 - RNA, 20 nt, Mycobacterium avium subsp. paratuberculosis
ccgggucgcaggcagcagca

SEQ ID NO: 2999561 - RNA, 12 nt, Mycobacterium avium subsp. paratuberculosis
ccgggucgccgu

SEQ ID NO: 2999562 - RNA, 13 nt, Mycobacterium avium subsp. paratuberculosis
ccgggucgccguc

SEQ ID NO: 2999563 - RNA, 23 nt, Mycobacterium avium subsp. paratuberculosis
ccgggucgcggcuggugccgccg

SEQ ID NO: 2999564 - RNA, 17 nt, Mycobacterium avium subsp. paratuberculosis
ccgggucgcggugggcu

SEQ ID NO: 2999565 - RNA, 23 nt, Mycobacterium avium subsp. paratuberculosis
ccgggucgcggugggcucggcgc

SEQ ID NO: 2999566 - RNA, 14 nt, Mycobacterium avium subsp. paratuberculosis
ccgggucguccgcg

SEQ ID NO: 2999567 - RNA, 17 nt, Mycobacterium avium subsp. paratuberculosis
ccgggucguccgcgacg

SEQ ID NO: 2999568 - RNA, 23 nt, Mycobacterium avium subsp. paratuberculosis
ccgggucguccgcgacgcugagc

SEQ ID NO: 2999569 - RNA, 13 nt, Mycobacterium avium subsp. paratuberculosis
ccgggucgucggu

SEQ ID NO: 2999570 - RNA, 17 nt, Mycobacterium avium subsp. paratuberculosis
ccgggucgugcggcggc

SEQ ID NO: 2999571 - RNA, 24 nt, Mycobacterium avium subsp. paratuberculosis
ccgggucuagaucuccaggcucga

SEQ ID NO: 2999572 - RNA, 16 nt, Mycobacterium avium subsp. paratuberculosis
ccgggucugccacgcc

SEQ ID NO: 2999573 - RNA, 21 nt, Mycobacterium avium subsp. paratuberculosis
ccgggucugccacgcccaccg

SEQ ID NO: 2999574 - RNA, 21 nt, Mycobacterium avium subsp. paratuberculosis
ccgggucuuccacgccgguga

SEQ ID NO: 2999575 - RNA, 12 nt, Mycobacterium avium subsp. paratuberculosis
ccgggugaaccc

SEQ ID NO: 2999576 - RNA, 16 nt, Mycobacterium avium subsp. paratuberculosis
ccgggugaacgaggcc

SEQ ID NO: 2999577 - RNA, 22 nt, Mycobacterium avium subsp. paratuberculosis
ccgggugaacgaggccgcgccg

SEQ ID NO: 2999578 - RNA, 13 nt, Mycobacterium avium subsp. paratuberculosis
ccgggugaccgcc

SEQ ID NO: 2999579 - RNA, 13 nt, Mycobacterium avium subsp. paratuberculosis
ccgggugaccggc

SEQ ID NO: 2999580 - RNA, 17 nt, Mycobacterium avium subsp. paratuberculosis
ccgggugaccggcgcgc

SEQ ID NO: 2999581 - RNA, 18 nt, Mycobacterium avium subsp. paratuberculosis
ccgggugaccggcgcgca

SEQ ID NO: 2999582 - RNA, 19 nt, Mycobacterium avium subsp. paratuberculosis
ccgggugaccggcgcgcag

SEQ ID NO: 2999583 - RNA, 20 nt, Mycobacterium avium subsp. paratuberculosis
ccgggugaccggcgcgcagc

SEQ ID NO: 2999584 - RNA, 21 nt, Mycobacterium avium subsp. paratuberculosis
ccgggugaccggcgcgcagca

SEQ ID NO: 2999585 - RNA, 18 nt, Mycobacterium avium subsp. paratuberculosis
ccgggugauaccggccca

SEQ ID NO: 2999586 - RNA, 16 nt, Mycobacterium avium subsp. paratuberculosis
ccgggugaucaacgcg

SEQ ID NO: 2999587 - RNA, 19 nt, Mycobacterium avium subsp. paratuberculosis
ccgggugaucaacgcggac

SEQ ID NO: 2999588 - RNA, 20 nt, Mycobacterium avium subsp. paratuberculosis
ccgggugaucaacgcggaca

SEQ ID NO: 2999589 - RNA, 23 nt, Mycobacterium avium subsp. paratuberculosis
ccgggugauggucucccgggcgg

SEQ ID NO: 2999590 - RNA, 15 nt, Mycobacterium avium subsp. paratuberculosis
ccgggugaugucgcc

SEQ ID NO: 2999591 - RNA, 19 nt, Mycobacterium avium subsp. paratuberculosis
ccgggugaugucgccgacc

SEQ ID NO: 2999592 - RNA, 17 nt, Mycobacterium avium subsp. paratuberculosis
ccgggugcaggcccagc

SEQ ID NO: 2999593 - RNA, 18 nt, Mycobacterium avium subsp. paratuberculosis
ccgggugcaggcccagcu

SEQ ID NO: 2999594 - RNA, 19 nt, Mycobacterium avium subsp. paratuberculosis
ccgggugcccaucugcaca

SEQ ID NO: 2999595 - RNA, 12 nt, Mycobacterium avium subsp. paratuberculosis
ccgggugcccgc

SEQ ID NO: 2999596 - RNA, 13 nt, Mycobacterium avium subsp. paratuberculosis
ccgggugcccgcg

SEQ ID NO: 2999597 - RNA, 13 nt, Mycobacterium avium subsp. paratuberculosis
ccgggugcccggc

SEQ ID NO: 2999598 - RNA, 14 nt, Mycobacterium avium subsp. paratuberculosis
ccgggugcccggcu

SEQ ID NO: 2999599 - RNA, 20 nt, Mycobacterium avium subsp. paratuberculosis
ccgggugcgaacagccacgg

SEQ ID NO: 2999600 - RNA, 22 nt, Mycobacterium avium subsp. paratuberculosis
ccgggugcgauggcaacgccgg

SEQ ID NO: 2999601 - RNA, 18 nt, Mycobacterium avium subsp. paratuberculosis
ccgggugcgcgucgcggu

SEQ ID NO: 2999602 - RNA, 20 nt, Mycobacterium avium subsp. paratuberculosis
ccgggugcgcuugucggcgu

SEQ ID NO: 2999603 - RNA, 21 nt, Mycobacterium avium subsp. paratuberculosis
ccgggugcgcuugucggcgug

SEQ ID NO: 2999604 - RNA, 22 nt, Mycobacterium avium subsp. paratuberculosis
ccgggugcgcuugucggcgugg

SEQ ID NO: 2999605 - RNA, 12 nt, Mycobacterium avium subsp. paratuberculosis
ccgggugcgggc

SEQ ID NO: 2999606 - RNA, 14 nt, Mycobacterium avium subsp. paratuberculosis
ccgggugcgggcca

SEQ ID NO: 2999607 - RNA, 18 nt, Mycobacterium avium subsp. paratuberculosis
ccgggugcgggccagcag

SEQ ID NO: 2999608 - RNA, 13 nt, Mycobacterium avium subsp. paratuberculosis
ccgggugcgucca

SEQ ID NO: 2999609 - RNA, 18 nt, Mycobacterium avium subsp. paratuberculosis
ccgggugcguccagaccg

SEQ ID NO: 2999610 - RNA, 22 nt, Mycobacterium avium subsp. paratuberculosis
ccgggugcguccagaccggccg

SEQ ID NO: 2999611 - RNA, 19 nt, Mycobacterium avium subsp. paratuberculosis
ccgggugcugaacgccugc

SEQ ID NO: 2999612 - RNA, 16 nt, Mycobacterium avium subsp. paratuberculosis
ccgggugcugcggcuc

SEQ ID NO: 2999613 - RNA, 19 nt, Mycobacterium avium subsp. paratuberculosis
ccggguggaacuggacgcc

SEQ ID NO: 2999614 - RNA, 21 nt, Mycobacterium avium subsp. paratuberculosis
ccggguggaacuggacgccgu

SEQ ID NO: 2999615 - RNA, 22 nt, Mycobacterium avium subsp. paratuberculosis
ccggguggacaccgcgaucacc

SEQ ID NO: 2999616 - RNA, 17 nt, Mycobacterium avium subsp. paratuberculosis
ccggguggccagcacca

SEQ ID NO: 2999617 - RNA, 17 nt, Mycobacterium avium subsp. paratuberculosis
ccggguggcccgcccgg

SEQ ID NO: 2999618 - RNA, 17 nt, Mycobacterium avium subsp. paratuberculosis
ccggguggccggggcca

SEQ ID NO: 2999619 - RNA, 12 nt, Mycobacterium avium subsp. paratuberculosis
ccggguggccgu

SEQ ID NO: 2999620 - RNA, 21 nt, Mycobacterium avium subsp. paratuberculosis
ccggguggcguccagaugccg

SEQ ID NO: 2999621 - RNA, 14 nt, Mycobacterium avium subsp. paratuberculosis
ccgggugggcagcc

SEQ ID NO: 2999622 - RNA, 19 nt, Mycobacterium avium subsp. paratuberculosis
ccgggugggcagccccagc

SEQ ID NO: 2999623 - RNA, 15 nt, Mycobacterium avium subsp. paratuberculosis
ccgggugggcagcgc

SEQ ID NO: 2999624 - RNA, 17 nt, Mycobacterium avium subsp. paratuberculosis
ccgggugggcagcgcga

SEQ ID NO: 2999625 - RNA, 18 nt, Mycobacterium avium subsp. paratuberculosis
ccgggugggcagcgcgau

SEQ ID NO: 2999626 - RNA, 14 nt, Mycobacterium avium subsp. paratuberculosis
ccgggugggccgac

SEQ ID NO: 2999627 - RNA, 15 nt, Mycobacterium avium subsp. paratuberculosis
ccgggugggccgacc

SEQ ID NO: 2999628 - RNA, 16 nt, Mycobacterium avium subsp. paratuberculosis
ccgggugggccgaccu

SEQ ID NO: 2999629 - RNA, 18 nt, Mycobacterium avium subsp. paratuberculosis
ccgggugggccgaccugc

SEQ ID NO: 2999630 - RNA, 20 nt, Mycobacterium avium subsp. paratuberculosis
ccgggugggugcucaccccg

SEQ ID NO: 2999631 - RNA, 21 nt, Mycobacterium avium subsp. paratuberculosis
ccgggugggugcucaccccgg

SEQ ID NO: 2999632 - RNA, 13 nt, Mycobacterium avium subsp. paratuberculosis
ccggguggugggc

SEQ ID NO: 2999633 - RNA, 16 nt, Mycobacterium avium subsp. paratuberculosis
ccggguguagcugggc

SEQ ID NO: 2999634 - RNA, 15 nt, Mycobacterium avium subsp. paratuberculosis
ccgggugucgacgcc

SEQ ID NO: 2999635 - RNA, 17 nt, Mycobacterium avium subsp. paratuberculosis
ccgggugucgacgccgg

SEQ ID NO: 2999636 - RNA, 14 nt, Mycobacterium avium subsp. paratuberculosis
ccgggugugggcgc

SEQ ID NO: 2999637 - RNA, 18 nt, Mycobacterium avium subsp. paratuberculosis
ccgggugugggcgccguc

SEQ ID NO: 2999638 - RNA, 23 nt, Mycobacterium avium subsp. paratuberculosis
ccggguguugcggcagggccacc

SEQ ID NO: 2999639 - RNA, 20 nt, Mycobacterium avium subsp. paratuberculosis
ccggguguuggagccguccg

SEQ ID NO: 2999640 - RNA, 23 nt, Mycobacterium avium subsp. paratuberculosis
ccggguguuggagccguccgggu

SEQ ID NO: 2999641 - RNA, 14 nt, Mycobacterium avium subsp. paratuberculosis
ccggguguuggcgc

SEQ ID NO: 2999642 - RNA, 22 nt, Mycobacterium avium subsp. paratuberculosis
ccggguucgacgccucggugcg

SEQ ID NO: 2999643 - RNA, 15 nt, Mycobacterium avium subsp. paratuberculosis
ccggguugcacaggu

SEQ ID NO: 2999644 - RNA, 18 nt, Mycobacterium avium subsp. paratuberculosis
ccggguugcacaggucga

SEQ ID NO: 2999645 - RNA, 16 nt, Mycobacterium avium subsp. paratuberculosis
ccggguugcgugcagc

SEQ ID NO: 2999646 - RNA, 14 nt, Mycobacterium avium subsp. paratuberculosis
ccggguuggcgcgc

SEQ ID NO: 2999647 - RNA, 16 nt, Mycobacterium avium subsp. paratuberculosis
ccggguugggcgccug

SEQ ID NO: 2999648 - RNA, 17 nt, Mycobacterium avium subsp. paratuberculosis
ccggguugggcgccugc

SEQ ID NO: 2999649 - RNA, 17 nt, Mycobacterium avium subsp. paratuberculosis
ccggguugggcggcggc

SEQ ID NO: 2999650 - RNA, 19 nt, Mycobacterium avium subsp. paratuberculosis
ccggguugggcggcggcca

SEQ ID NO: 2999651 - RNA, 16 nt, Mycobacterium avium subsp. paratuberculosis
ccggguuguccuggcc

SEQ ID NO: 2999652 - RNA, 17 nt, Mycobacterium avium subsp. paratuberculosis
ccggguugucgacgugg

SEQ ID NO: 2999653 - RNA, 20 nt, Mycobacterium avium subsp. paratuberculosis
ccggguuucgaagacgcccc

SEQ ID NO: 2999654 - RNA, 14 nt, Mycobacterium avium subsp. paratuberculosis
ccggguuucggccc

SEQ ID NO: 2999655 - RNA, 16 nt, Mycobacterium avium subsp. paratuberculosis
ccggguuucggcccgg

SEQ ID NO: 2999656 - RNA, 18 nt, Mycobacterium avium subsp. paratuberculosis
ccggguuucggcccggcu

SEQ ID NO: 2999657 - RNA, 19 nt, Mycobacterium avium subsp. paratuberculosis
ccggguuucggcccggcuc

SEQ ID NO: 2999658 - RNA, 18 nt, Mycobacterium avium subsp. paratuberculosis
ccggguuuguccggccag

SEQ ID NO: 2999659 - RNA, 21 nt, Mycobacterium avium subsp. paratuberculosis
ccggguuuucgggccggucag

SEQ ID NO: 2999660 - RNA, 12 nt, Mycobacterium avium subsp. paratuberculosis
ccgguacagcgc

SEQ ID NO: 2999661 - RNA, 18 nt, Mycobacterium avium subsp. paratuberculosis
ccgguacaggucgcugcc

SEQ ID NO: 2999662 - RNA, 23 nt, Mycobacterium avium subsp. paratuberculosis
ccgguacaggucgcugcccggcg

SEQ ID NO: 2999663 - RNA, 15 nt, Mycobacterium avium subsp. paratuberculosis
ccgguacaucgacgc

SEQ ID NO: 2999664 - RNA, 18 nt, Mycobacterium avium subsp. paratuberculosis
ccgguacaucgacgcgac

SEQ ID NO: 2999665 - RNA, 23 nt, Mycobacterium avium subsp. paratuberculosis
ccgguacaucgacgcgaccggcc

SEQ ID NO: 2999666 - RNA, 17 nt, Mycobacterium avium subsp. paratuberculosis
ccgguaccacgccgucg

SEQ ID NO: 2999667 - RNA, 18 nt, Mycobacterium avium subsp. paratuberculosis
ccgguaccacgccgucga

SEQ ID NO: 2999668 - RNA, 16 nt, Mycobacterium avium subsp. paratuberculosis
ccgguaccgccggcca

SEQ ID NO: 2999669 - RNA, 21 nt, Mycobacterium avium subsp. paratuberculosis
ccgguaccgccggccaggcga

SEQ ID NO: 2999670 - RNA, 13 nt, Mycobacterium avium subsp. paratuberculosis
ccgguacggaucg

SEQ ID NO: 2999671 - RNA, 19 nt, Mycobacterium avium subsp. paratuberculosis
ccgguacggaucgccggac

SEQ ID NO: 2999672 - RNA, 17 nt, Mycobacterium avium subsp. paratuberculosis
ccgguacggccgacgcc

SEQ ID NO: 2999673 - RNA, 22 nt, Mycobacterium avium subsp. paratuberculosis
ccgguacggccgacgcccagca

SEQ ID NO: 2999674 - RNA, 18 nt, Mycobacterium avium subsp. paratuberculosis
ccgguacggcucaacggc

SEQ ID NO: 2999675 - RNA, 22 nt, Mycobacterium avium subsp. paratuberculosis
ccgguacggcucaacggccggc

SEQ ID NO: 2999676 - RNA, 18 nt, Mycobacterium avium subsp. paratuberculosis
ccgguagaucagcgccug

SEQ ID NO: 2999677 - RNA, 18 nt, Mycobacterium avium subsp. paratuberculosis
ccgguagaucgccggauc

SEQ ID NO: 2999678 - RNA, 23 nt, Mycobacterium avium subsp. paratuberculosis
ccgguagaucgccggaucgagca

SEQ ID NO: 2999679 - RNA, 16 nt, Mycobacterium avium subsp. paratuberculosis
ccgguagccagcaccg

SEQ ID NO: 2999680 - RNA, 18 nt, Mycobacterium avium subsp. paratuberculosis
ccgguagccagcaccgcc

SEQ ID NO: 2999681 - RNA, 15 nt, Mycobacterium avium subsp. paratuberculosis
ccgguagccgcucgc

SEQ ID NO: 2999682 - RNA, 16 nt, Mycobacterium avium subsp. paratuberculosis
ccgguagccgcucgcc

SEQ ID NO: 2999683 - RNA, 14 nt, Mycobacterium avium subsp. paratuberculosis
ccgguagcgacacg

SEQ ID NO: 2999684 - RNA, 13 nt, Mycobacterium avium subsp. paratuberculosis
ccgguaggccgcc

SEQ ID NO: 2999685 - RNA, 22 nt, Mycobacterium avium subsp. paratuberculosis
ccgguaggccgccgcgaccguc

SEQ ID NO: 2999686 - RNA, 16 nt, Mycobacterium avium subsp. paratuberculosis
ccgguaggccgcgccg

SEQ ID NO: 2999687 - RNA, 13 nt, Mycobacterium avium subsp. paratuberculosis
ccgguaggccggc

SEQ ID NO: 2999688 - RNA, 16 nt, Mycobacterium avium subsp. paratuberculosis
ccgguaggccggccgc

SEQ ID NO: 2999689 - RNA, 16 nt, Mycobacterium avium subsp. paratuberculosis
ccgguaggcgcaccgc

SEQ ID NO: 2999690 - RNA, 17 nt, Mycobacterium avium subsp. paratuberculosis
ccgguaggcgcaccgcc

SEQ ID NO: 2999691 - RNA, 18 nt, Mycobacterium avium subsp. paratuberculosis
ccgguaggcgcaccgccg

SEQ ID NO: 2999692 - RNA, 20 nt, Mycobacterium avium subsp. paratuberculosis
ccgguaggcgcaccgccggg

SEQ ID NO: 2999693 - RNA, 16 nt, Mycobacterium avium subsp. paratuberculosis
ccgguaggcggccagc

SEQ ID NO: 2999694 - RNA, 17 nt, Mycobacterium avium subsp. paratuberculosis
ccgguaggcggccagcg

SEQ ID NO: 2999695 - RNA, 22 nt, Mycobacterium avium subsp. paratuberculosis
ccgguaggcggccagcgcccgc

SEQ ID NO: 2999696 - RNA, 14 nt, Mycobacterium avium subsp. paratuberculosis
ccgguaggcggcga

SEQ ID NO: 2999697 - RNA, 13 nt, Mycobacterium avium subsp. paratuberculosis
ccgguagggccgg

SEQ ID NO: 2999698 - RNA, 20 nt, Mycobacterium avium subsp. paratuberculosis
ccgguagggccggucaccgg

SEQ ID NO: 2999699 - RNA, 14 nt, Mycobacterium avium subsp. paratuberculosis
ccgguagucgucga

SEQ ID NO: 2999700 - RNA, 20 nt, Mycobacterium avium subsp. paratuberculosis
ccgguaucgagcaccagcaa

SEQ ID NO: 2999701 - RNA, 18 nt, Mycobacterium avium subsp. paratuberculosis
ccgguaucgggucaccgu

SEQ ID NO: 2999702 - RNA, 16 nt, Mycobacterium avium subsp. paratuberculosis
ccgguauuggccacgc

SEQ ID NO: 2999703 - RNA, 18 nt, Mycobacterium avium subsp. paratuberculosis
ccgguauuggccacgcug

SEQ ID NO: 2999704 - RNA, 12 nt, Mycobacterium avium subsp. paratuberculosis
ccggucaacgcc

SEQ ID NO: 2999705 - RNA, 17 nt, Mycobacterium avium subsp. paratuberculosis
ccggucaacgccgcgcg

SEQ ID NO: 2999706 - RNA, 15 nt, Mycobacterium avium subsp. paratuberculosis
ccggucaacggcucg

SEQ ID NO: 2999707 - RNA, 21 nt, Mycobacterium avium subsp. paratuberculosis
ccggucaagcgcuuucgccga

SEQ ID NO: 2999708 - RNA, 20 nt, Mycobacterium avium subsp. paratuberculosis
ccggucaccaucagcaccgc

SEQ ID NO: 2999709 - RNA, 16 nt, Mycobacterium avium subsp. paratuberculosis
ccggucacccaggccg

SEQ ID NO: 2999710 - RNA, 15 nt, Mycobacterium avium subsp. paratuberculosis
ccggucaccccggcc

SEQ ID NO: 2999711 - RNA, 16 nt, Mycobacterium avium subsp. paratuberculosis
ccggucaccccggcca

SEQ ID NO: 2999712 - RNA, 20 nt, Mycobacterium avium subsp. paratuberculosis
ccggucacccgugggccgac

SEQ ID NO: 2999713 - RNA, 13 nt, Mycobacterium avium subsp. paratuberculosis
ccggucacgcccg

SEQ ID NO: 2999714 - RNA, 16 nt, Mycobacterium avium subsp. paratuberculosis
ccggucacgcccgggg

SEQ ID NO: 2999715 - RNA, 15 nt, Mycobacterium avium subsp. paratuberculosis
ccggucacggcgucg

SEQ ID NO: 2999716 - RNA, 16 nt, Mycobacterium avium subsp. paratuberculosis
ccggucacggcgucgg

SEQ ID NO: 2999717 - RNA, 19 nt, Mycobacterium avium subsp. paratuberculosis
ccggucacggcgucggcgu

SEQ ID NO: 2999718 - RNA, 18 nt, Mycobacterium avium subsp. paratuberculosis
ccggucagaccccguacc

SEQ ID NO: 2999719 - RNA, 18 nt, Mycobacterium avium subsp. paratuberculosis
ccggucagaccuucgcga

SEQ ID NO: 2999720 - RNA, 11 nt, Mycobacterium avium subsp. paratuberculosis
ccggucagcac

SEQ ID NO: 2999721 - RNA, 12 nt, Mycobacterium avium subsp. paratuberculosis
ccggucagcacc

SEQ ID NO: 2999722 - RNA, 13 nt, Mycobacterium avium subsp. paratuberculosis
ccggucagcaccg

SEQ ID NO: 2999723 - RNA, 16 nt, Mycobacterium avium subsp. paratuberculosis
ccggucagcaccgcgc

SEQ ID NO: 2999724 - RNA, 18 nt, Mycobacterium avium subsp. paratuberculosis
ccggucagcaccgcgcgg

SEQ ID NO: 2999725 - RNA, 16 nt, Mycobacterium avium subsp. paratuberculosis
ccggucagcacgucgg

SEQ ID NO: 2999726 - RNA, 19 nt, Mycobacterium avium subsp. paratuberculosis
ccggucagcccccaccgcg

SEQ ID NO: 2999727 - RNA, 16 nt, Mycobacterium avium subsp. paratuberculosis
ccggucagcgccagca

SEQ ID NO: 2999728 - RNA, 18 nt, Mycobacterium avium subsp. paratuberculosis
ccggucagcgcgacaucg

SEQ ID NO: 2999729 - RNA, 19 nt, Mycobacterium avium subsp. paratuberculosis
ccggucagcgcuccuggcc

SEQ ID NO: 2999730 - RNA, 21 nt, Mycobacterium avium subsp. paratuberculosis
ccggucagcgcuccuggccgg

SEQ ID NO: 2999731 - RNA, 12 nt, Mycobacterium avium subsp. paratuberculosis
ccggucagcggc

SEQ ID NO: 2999732 - RNA, 14 nt, Mycobacterium avium subsp. paratuberculosis
ccggucagcgucca

SEQ ID NO: 2999733 - RNA, 21 nt, Mycobacterium avium subsp. paratuberculosis
ccggucagcguccaguccggc

SEQ ID NO: 2999734 - RNA, 13 nt, Mycobacterium avium subsp. paratuberculosis
ccggucagcgugg

SEQ ID NO: 2999735 - RNA, 19 nt, Mycobacterium avium subsp. paratuberculosis
ccggucagcguggcgucgg

SEQ ID NO: 2999736 - RNA, 20 nt, Mycobacterium avium subsp. paratuberculosis
ccggucagcguggcgucggc

SEQ ID NO: 2999737 - RNA, 22 nt, Mycobacterium avium subsp. paratuberculosis
ccggucagcguggcgucggcgc

SEQ ID NO: 2999738 - RNA, 12 nt, Mycobacterium avium subsp. paratuberculosis
ccggucagcucg

SEQ ID NO: 2999739 - RNA, 20 nt, Mycobacterium avium subsp. paratuberculosis
ccggucaggaacccggcccg

SEQ ID NO: 2999740 - RNA, 22 nt, Mycobacterium avium subsp. paratuberculosis
ccggucaggcauuccaccgcgc

SEQ ID NO: 2999741 - RNA, 23 nt, Mycobacterium avium subsp. paratuberculosis
ccggucagggcucgcaaccgucu

SEQ ID NO: 2999742 - RNA, 19 nt, Mycobacterium avium subsp. paratuberculosis
ccggucagguugacgccga

SEQ ID NO: 2999743 - RNA, 17 nt, Mycobacterium avium subsp. paratuberculosis
ccggucaguucgucggu

SEQ ID NO: 2999744 - RNA, 20 nt, Mycobacterium avium subsp. paratuberculosis
ccggucaguucgucggucac

SEQ ID NO: 2999745 - RNA, 21 nt, Mycobacterium avium subsp. paratuberculosis
ccggucaguucgucggucacg

SEQ ID NO: 2999746 - RNA, 16 nt, Mycobacterium avium subsp. paratuberculosis
ccggucauaggccgcg

SEQ ID NO: 2999747 - RNA, 17 nt, Mycobacterium avium subsp. paratuberculosis
ccggucauaggccgcgc

SEQ ID NO: 2999748 - RNA, 21 nt, Mycobacterium avium subsp. paratuberculosis
ccggucauaggccgcgcagau

SEQ ID NO: 2999749 - RNA, 16 nt, Mycobacterium avium subsp. paratuberculosis
ccggucauccgggcca

SEQ ID NO: 2999750 - RNA, 18 nt, Mycobacterium avium subsp. paratuberculosis
ccggucauccgggccacc

SEQ ID NO: 2999751 - RNA, 17 nt, Mycobacterium avium subsp. paratuberculosis
ccggucauccucgccgc

SEQ ID NO: 2999752 - RNA, 18 nt, Mycobacterium avium subsp. paratuberculosis
ccggucauccucgccgcg

SEQ ID NO: 2999753 - RNA, 23 nt, Mycobacterium avium subsp. paratuberculosis
ccgguccaaagacguugaccgcg

SEQ ID NO: 2999754 - RNA, 17 nt, Mycobacterium avium subsp. paratuberculosis
ccgguccacggugucgc

SEQ ID NO: 2999755 - RNA, 17 nt, Mycobacterium avium subsp. paratuberculosis
ccgguccacucgucggc

SEQ ID NO: 2999756 - RNA, 18 nt, Mycobacterium avium subsp. paratuberculosis
ccgguccacucgucggcg

SEQ ID NO: 2999757 - RNA, 13 nt, Mycobacterium avium subsp. paratuberculosis
ccgguccagaucg

SEQ ID NO: 2999758 - RNA, 16 nt, Mycobacterium avium subsp. paratuberculosis
ccgguccagaucggcg

SEQ ID NO: 2999759 - RNA, 17 nt, Mycobacterium avium subsp. paratuberculosis
ccgguccagaucggcgc

SEQ ID NO: 2999760 - RNA, 13 nt, Mycobacterium avium subsp. paratuberculosis
ccgguccagcccg

SEQ ID NO: 2999761 - RNA, 14 nt, Mycobacterium avium subsp. paratuberculosis
ccgguccagcccgg

SEQ ID NO: 2999762 - RNA, 19 nt, Mycobacterium avium subsp. paratuberculosis
ccgguccaggcgaccggcc

SEQ ID NO: 2999763 - RNA, 16 nt, Mycobacterium avium subsp. paratuberculosis
ccgguccaguccggcc

SEQ ID NO: 2999764 - RNA, 16 nt, Mycobacterium avium subsp. paratuberculosis
ccgguccagugccggc

SEQ ID NO: 2999765 - RNA, 17 nt, Mycobacterium avium subsp. paratuberculosis
ccgguccagugccggcg

SEQ ID NO: 2999766 - RNA, 16 nt, Mycobacterium avium subsp. paratuberculosis
ccgguccccggagucg

SEQ ID NO: 2999767 - RNA, 20 nt, Mycobacterium avium subsp. paratuberculosis
ccgguccccggagucgucga

SEQ ID NO: 2999768 - RNA, 14 nt, Mycobacterium avium subsp. paratuberculosis
ccgguccccggcga

SEQ ID NO: 2999769 - RNA, 12 nt, Mycobacterium avium subsp. paratuberculosis
ccggucccgcgg

SEQ ID NO: 2999770 - RNA, 14 nt, Mycobacterium avium subsp. paratuberculosis
ccgguccgaccagc

SEQ ID NO: 2999771 - RNA, 20 nt, Mycobacterium avium subsp. paratuberculosis
ccgguccgaccgccaccacc

SEQ ID NO: 2999772 - RNA, 23 nt, Mycobacterium avium subsp. paratuberculosis
ccgguccgaccgccaccacccgg

SEQ ID NO: 2999773 - RNA, 13 nt, Mycobacterium avium subsp. paratuberculosis
ccgguccgacggc

SEQ ID NO: 2999774 - RNA, 18 nt, Mycobacterium avium subsp. paratuberculosis
ccgguccgaucguccggc

SEQ ID NO: 2999775 - RNA, 20 nt, Mycobacterium avium subsp. paratuberculosis
ccgguccgaucguccggcgc

SEQ ID NO: 2999776 - RNA, 13 nt, Mycobacterium avium subsp. paratuberculosis
ccgguccgcccag

SEQ ID NO: 2999777 - RNA, 15 nt, Mycobacterium avium subsp. paratuberculosis
ccgguccgcccagac

SEQ ID NO: 2999778 - RNA, 16 nt, Mycobacterium avium subsp. paratuberculosis
ccgguccgcccagacg

SEQ ID NO: 2999779 - RNA, 18 nt, Mycobacterium avium subsp. paratuberculosis
ccgguccgccgccggcgg

SEQ ID NO: 2999780 - RNA, 15 nt, Mycobacterium avium subsp. paratuberculosis
ccgguccgccgucgg

SEQ ID NO: 2999781 - RNA, 12 nt, Mycobacterium avium subsp. paratuberculosis
ccgguccgcggu

SEQ ID NO: 2999782 - RNA, 22 nt, Mycobacterium avium subsp. paratuberculosis
ccgguccgcugugcggcccggc

SEQ ID NO: 2999783 - RNA, 16 nt, Mycobacterium avium subsp. paratuberculosis
ccgguccggcccgggg

SEQ ID NO: 2999784 - RNA, 23 nt, Mycobacterium avium subsp. paratuberculosis
ccgguccggcccuggucggccag

SEQ ID NO: 2999785 - RNA, 15 nt, Mycobacterium avium subsp. paratuberculosis
ccgguccggccgugc

SEQ ID NO: 2999786 - RNA, 18 nt, Mycobacterium avium subsp. paratuberculosis
ccgguccggcggcaccac

SEQ ID NO: 2999787 - RNA, 19 nt, Mycobacterium avium subsp. paratuberculosis
ccgguccggcggcaccacc

SEQ ID NO: 2999788 - RNA, 20 nt, Mycobacterium avium subsp. paratuberculosis
ccgguccggcggcaccaccc

SEQ ID NO: 2999789 - RNA, 21 nt, Mycobacterium avium subsp. paratuberculosis
ccgguccggcggcaccacccg

SEQ ID NO: 2999790 - RNA, 14 nt, Mycobacterium avium subsp. paratuberculosis
ccgguccggcuggu

SEQ ID NO: 2999791 - RNA, 17 nt, Mycobacterium avium subsp. paratuberculosis
ccgguccggcuggucgg

SEQ ID NO: 2999792 - RNA, 20 nt, Mycobacterium avium subsp. paratuberculosis
ccgguccggcuggucggccu

SEQ ID NO: 2999793 - RNA, 12 nt, Mycobacterium avium subsp. paratuberculosis
ccgguccgggcu

SEQ ID NO: 2999794 - RNA, 12 nt, Mycobacterium avium subsp. paratuberculosis
ccgguccggguc

SEQ ID NO: 2999795 - RNA, 14 nt, Mycobacterium avium subsp. paratuberculosis
ccgguccgggucgc

SEQ ID NO: 2999796 - RNA, 20 nt, Mycobacterium avium subsp. paratuberculosis
ccgguccgggucgcugagca

SEQ ID NO: 2999797 - RNA, 14 nt, Mycobacterium avium subsp. paratuberculosis
ccgguccggucacg

SEQ ID NO: 2999798 - RNA, 18 nt, Mycobacterium avium subsp. paratuberculosis
ccgguccgugcacggcca

SEQ ID NO: 2999799 - RNA, 19 nt, Mycobacterium avium subsp. paratuberculosis
ccgguccgugcacggccaa

SEQ ID NO: 2999800 - RNA, 20 nt, Mycobacterium avium subsp. paratuberculosis
ccgguccgugccacggccgc

SEQ ID NO: 2999801 - RNA, 19 nt, Mycobacterium avium subsp. paratuberculosis
ccgguccuggccaacucga

SEQ ID NO: 2999802 - RNA, 20 nt, Mycobacterium avium subsp. paratuberculosis
ccgguccugggccuccggcg

SEQ ID NO: 2999803 - RNA, 21 nt, Mycobacterium avium subsp. paratuberculosis
ccgguccugggccuccggcgg

SEQ ID NO: 2999804 - RNA, 22 nt, Mycobacterium avium subsp. paratuberculosis
ccgguccugggccuccggcggc

SEQ ID NO: 2999805 - RNA, 19 nt, Mycobacterium avium subsp. paratuberculosis
ccgguccuucucgcacagc

SEQ ID NO: 2999806 - RNA, 20 nt, Mycobacterium avium subsp. paratuberculosis
ccgguccuugagguagucgc

SEQ ID NO: 2999807 - RNA, 22 nt, Mycobacterium avium subsp. paratuberculosis
ccgguccuugagguagucgcgc

SEQ ID NO: 2999808 - RNA, 16 nt, Mycobacterium avium subsp. paratuberculosis
ccggucgaacgccagc

SEQ ID NO: 2999809 - RNA, 21 nt, Mycobacterium avium subsp. paratuberculosis
ccggucgaacgccagcgccgc

SEQ ID NO: 2999810 - RNA, 17 nt, Mycobacterium avium subsp. paratuberculosis
ccggucgaaggaggcca

SEQ ID NO: 2999811 - RNA, 21 nt, Mycobacterium avium subsp. paratuberculosis
ccggucgaaggaggccagcug

SEQ ID NO: 2999812 - RNA, 22 nt, Mycobacterium avium subsp. paratuberculosis
ccggucgaaggaggccagcugc

SEQ ID NO: 2999813 - RNA, 23 nt, Mycobacterium avium subsp. paratuberculosis
ccggucgacgauggcccgggcca

SEQ ID NO: 2999814 - RNA, 14 nt, Mycobacterium avium subsp. paratuberculosis
ccggucgacgcggg

SEQ ID NO: 2999815 - RNA, 22 nt, Mycobacterium avium subsp. paratuberculosis
ccggucgacgcggggcggcggc

SEQ ID NO: 2999816 - RNA, 17 nt, Mycobacterium avium subsp. paratuberculosis
ccggucgaggucgccga

SEQ ID NO: 2999817 - RNA, 18 nt, Mycobacterium avium subsp. paratuberculosis
ccggucgaggucggccag

SEQ ID NO: 2999818 - RNA, 13 nt, Mycobacterium avium subsp. paratuberculosis
ccggucgaucacc

SEQ ID NO: 2999819 - RNA, 23 nt, Mycobacterium avium subsp. paratuberculosis
ccggucgaugaauuccggugugc

SEQ ID NO: 2999820 - RNA, 16 nt, Mycobacterium avium subsp. paratuberculosis
ccggucgaugucggcg

SEQ ID NO: 2999821 - RNA, 19 nt, Mycobacterium avium subsp. paratuberculosis
ccggucgaugucggcgaac

SEQ ID NO: 2999822 - RNA, 18 nt, Mycobacterium avium subsp. paratuberculosis
ccggucgaugugcgcgcu

SEQ ID NO: 2999823 - RNA, 14 nt, Mycobacterium avium subsp. paratuberculosis
ccggucgcagguga

SEQ ID NO: 2999824 - RNA, 22 nt, Mycobacterium avium subsp. paratuberculosis
ccggucgcccccucggccgguc

SEQ ID NO: 2999825 - RNA, 16 nt, Mycobacterium avium subsp. paratuberculosis
ccggucgccgggccgg

SEQ ID NO: 2999826 - RNA, 20 nt, Mycobacterium avium subsp. paratuberculosis
ccggucgccugcuucuggau

SEQ ID NO: 2999827 - RNA, 14 nt, Mycobacterium avium subsp. paratuberculosis
ccggucgcgcaucg

SEQ ID NO: 2999828 - RNA, 15 nt, Mycobacterium avium subsp. paratuberculosis
ccggucgcgcaucgc

SEQ ID NO: 2999829 - RNA, 23 nt, Mycobacterium avium subsp. paratuberculosis
ccggucgcgcaucgccucggcgg

SEQ ID NO: 2999830 - RNA, 22 nt, Mycobacterium avium subsp. paratuberculosis
ccggucgcguugaaagccgcga

SEQ ID NO: 2999831 - RNA, 16 nt, Mycobacterium avium subsp. paratuberculosis
ccggucgcugcgauga

SEQ ID NO: 2999832 - RNA, 17 nt, Mycobacterium avium subsp. paratuberculosis
ccggucgcugggcucga

SEQ ID NO: 2999833 - RNA, 22 nt, Mycobacterium avium subsp. paratuberculosis
ccggucggaaaagugggucagc

SEQ ID NO: 2999834 - RNA, 13 nt, Mycobacterium avium subsp. paratuberculosis
ccggucggccgcg

SEQ ID NO: 2999835 - RNA, 14 nt, Mycobacterium avium subsp. paratuberculosis
ccggucggccgcgu

SEQ ID NO: 2999836 - RNA, 16 nt, Mycobacterium avium subsp. paratuberculosis
ccggucggccgcgugc

SEQ ID NO: 2999837 - RNA, 21 nt, Mycobacterium avium subsp. paratuberculosis
ccggucggcgcucgcgggugc

SEQ ID NO: 2999838 - RNA, 13 nt, Mycobacterium avium subsp. paratuberculosis
ccggucgggaucg

SEQ ID NO: 2999839 - RNA, 16 nt, Mycobacterium avium subsp. paratuberculosis
ccggucgggauggcgg

SEQ ID NO: 2999840 - RNA, 13 nt, Mycobacterium avium subsp. paratuberculosis
ccggucgggccaa

SEQ ID NO: 2999841 - RNA, 18 nt, Mycobacterium avium subsp. paratuberculosis
ccggucggucagucgcgc

SEQ ID NO: 2999842 - RNA, 20 nt, Mycobacterium avium subsp. paratuberculosis
ccggucggucagucgcgccg

SEQ ID NO: 2999843 - RNA, 15 nt, Mycobacterium avium subsp. paratuberculosis
ccggucggucggccg

SEQ ID NO: 2999844 - RNA, 16 nt, Mycobacterium avium subsp. paratuberculosis
ccggucggucggccgc

SEQ ID NO: 2999845 - RNA, 17 nt, Mycobacterium avium subsp. paratuberculosis
ccggucggucggccgca

SEQ ID NO: 2999846 - RNA, 18 nt, Mycobacterium avium subsp. paratuberculosis
ccggucggucggccgcac

SEQ ID NO: 2999847 - RNA, 16 nt, Mycobacterium avium subsp. paratuberculosis
ccggucggugcccagc

SEQ ID NO: 2999848 - RNA, 19 nt, Mycobacterium avium subsp. paratuberculosis
ccggucggugcccagcacc

SEQ ID NO: 2999849 - RNA, 22 nt, Mycobacterium avium subsp. paratuberculosis
ccggucggugcccagcaccgcc

SEQ ID NO: 2999850 - RNA, 16 nt, Mycobacterium avium subsp. paratuberculosis
ccggucguagcgucgg

SEQ ID NO: 2999851 - RNA, 17 nt, Mycobacterium avium subsp. paratuberculosis
ccggucguagucggccc

SEQ ID NO: 2999852 - RNA, 18 nt, Mycobacterium avium subsp. paratuberculosis
ccggucguagucggcccg

SEQ ID NO: 2999853 - RNA, 19 nt, Mycobacterium avium subsp. paratuberculosis
ccggucguagucggcccgc

SEQ ID NO: 2999854 - RNA, 22 nt, Mycobacterium avium subsp. paratuberculosis
ccggucguagucggcccgccgg

SEQ ID NO: 2999855 - RNA, 14 nt, Mycobacterium avium subsp. paratuberculosis
ccggucgucgagca

SEQ ID NO: 2999856 - RNA, 19 nt, Mycobacterium avium subsp. paratuberculosis
ccggucgucgagcaccggc

SEQ ID NO: 2999857 - RNA, 13 nt, Mycobacterium avium subsp. paratuberculosis
ccggucgucgccg

SEQ ID NO: 2999858 - RNA, 17 nt, Mycobacterium avium subsp. paratuberculosis
ccggucgucgccggaug

SEQ ID NO: 2999859 - RNA, 18 nt, Mycobacterium avium subsp. paratuberculosis
ccggucgugcgacuccug

SEQ ID NO: 2999860 - RNA, 20 nt, Mycobacterium avium subsp. paratuberculosis
ccggucgugcgacuccuggg

SEQ ID NO: 2999861 - RNA, 19 nt, Mycobacterium avium subsp. paratuberculosis
ccggucguuacgacucggc

SEQ ID NO: 2999862 - RNA, 17 nt, Mycobacterium avium subsp. paratuberculosis
ccggucguuggccuccu

SEQ ID NO: 2999863 - RNA, 19 nt, Mycobacterium avium subsp. paratuberculosis
ccggucuccaugucgucgg

SEQ ID NO: 2999864 - RNA, 21 nt, Mycobacterium avium subsp. paratuberculosis
ccggucucgaacacgccgucg

SEQ ID NO: 2999865 - RNA, 15 nt, Mycobacterium avium subsp. paratuberculosis
ccggucucgaccgcg

SEQ ID NO: 2999866 - RNA, 21 nt, Mycobacterium avium subsp. paratuberculosis
ccggucucgaccgcggcgccg

SEQ ID NO: 2999867 - RNA, 14 nt, Mycobacterium avium subsp. paratuberculosis
ccggucucggucgc

SEQ ID NO: 2999868 - RNA, 17 nt, Mycobacterium avium subsp. paratuberculosis
ccggucucggucgcggc

SEQ ID NO: 2999869 - RNA, 18 nt, Mycobacterium avium subsp. paratuberculosis
ccggucugaucgcccagc

SEQ ID NO: 2999870 - RNA, 15 nt, Mycobacterium avium subsp. paratuberculosis
ccggucugcggccgc

SEQ ID NO: 2999871 - RNA, 17 nt, Mycobacterium avium subsp. paratuberculosis
ccggucugcggccgcga

SEQ ID NO: 2999872 - RNA, 16 nt, Mycobacterium avium subsp. paratuberculosis
ccggucuucucggcca

SEQ ID NO: 2999873 - RNA, 17 nt, Mycobacterium avium subsp. paratuberculosis
ccggucuucucggccag

SEQ ID NO: 2999874 - RNA, 16 nt, Mycobacterium avium subsp. paratuberculosis
ccggucuuggacagca

SEQ ID NO: 2999875 - RNA, 19 nt, Mycobacterium avium subsp. paratuberculosis
ccggucuuggacagcagca

SEQ ID NO: 2999876 - RNA, 21 nt, Mycobacterium avium subsp. paratuberculosis
ccggucuuggacagcagcagc

SEQ ID NO: 2999877 - RNA, 21 nt, Mycobacterium avium subsp. paratuberculosis
ccggucuuguagucgaccacc

SEQ ID NO: 2999878 - RNA, 18 nt, Mycobacterium avium subsp. paratuberculosis
ccggugaaaccggcgccg

SEQ ID NO: 2999879 - RNA, 20 nt, Mycobacterium avium subsp. paratuberculosis
ccggugaaaccggcgccgaa

SEQ ID NO: 2999880 - RNA, 18 nt, Mycobacterium avium subsp. paratuberculosis
ccggugaagaucagcgcg

SEQ ID NO: 2999881 - RNA, 19 nt, Mycobacterium avium subsp. paratuberculosis
ccggugaagaucagcgcgu

SEQ ID NO: 2999882 - RNA, 18 nt, Mycobacterium avium subsp. paratuberculosis
ccggugaagaucgcccgc

SEQ ID NO: 2999883 - RNA, 20 nt, Mycobacterium avium subsp. paratuberculosis
ccggugaagaucgcccgccg

SEQ ID NO: 2999884 - RNA, 19 nt, Mycobacterium avium subsp. paratuberculosis
ccggugaagcgggacagca

SEQ ID NO: 2999885 - RNA, 20 nt, Mycobacterium avium subsp. paratuberculosis
ccggugaagcgggacagcaa

SEQ ID NO: 2999886 - RNA, 15 nt, Mycobacterium avium subsp. paratuberculosis
ccggugaccacgcug

SEQ ID NO: 2999887 - RNA, 18 nt, Mycobacterium avium subsp. paratuberculosis
ccggugaccccgucgaac

SEQ ID NO: 2999888 - RNA, 12 nt, Mycobacterium avium subsp. paratuberculosis
ccggugaccgcc

SEQ ID NO: 2999889 - RNA, 23 nt, Mycobacterium avium subsp. paratuberculosis
ccggugaccgccucgucgaaggu

SEQ ID NO: 2999890 - RNA, 12 nt, Mycobacterium avium subsp. paratuberculosis
ccggugaccgcg

SEQ ID NO: 2999891 - RNA, 15 nt, Mycobacterium avium subsp. paratuberculosis
ccggugaccgcgacg

SEQ ID NO: 2999892 - RNA, 16 nt, Mycobacterium avium subsp. paratuberculosis
ccggugaccucccgga

SEQ ID NO: 2999893 - RNA, 14 nt, Mycobacterium avium subsp. paratuberculosis
ccggugaccugcag

SEQ ID NO: 2999894 - RNA, 18 nt, Mycobacterium avium subsp. paratuberculosis
ccggugaccugcagcgcc

SEQ ID NO: 2999895 - RNA, 20 nt, Mycobacterium avium subsp. paratuberculosis
ccggugaccugcagcgccuu

SEQ ID NO: 2999896 - RNA, 15 nt, Mycobacterium avium subsp. paratuberculosis
ccggugacgaccggc

SEQ ID NO: 2999897 - RNA, 15 nt, Mycobacterium avium subsp. paratuberculosis
ccggugacggucagg

SEQ ID NO: 2999898 - RNA, 23 nt, Mycobacterium avium subsp. paratuberculosis
ccggugagcaccgggaacagcca

SEQ ID NO: 2999899 - RNA, 14 nt, Mycobacterium avium subsp. paratuberculosis
ccggugagcacgac

SEQ ID NO: 2999900 - RNA, 15 nt, Mycobacterium avium subsp. paratuberculosis
ccggugagcacgacc

SEQ ID NO: 2999901 - RNA, 17 nt, Mycobacterium avium subsp. paratuberculosis
ccggugagcacgaccgc

SEQ ID NO: 2999902 - RNA, 20 nt, Mycobacterium avium subsp. paratuberculosis
ccggugagcacgaccgccag

SEQ ID NO: 2999903 - RNA, 19 nt, Mycobacterium avium subsp. paratuberculosis
ccggugagccucagggcgc

SEQ ID NO: 2999904 - RNA, 22 nt, Mycobacterium avium subsp. paratuberculosis
ccggugagccucagggcgcgcu

SEQ ID NO: 2999905 - RNA, 13 nt, Mycobacterium avium subsp. paratuberculosis
ccggugagcggau

SEQ ID NO: 2999906 - RNA, 22 nt, Mycobacterium avium subsp. paratuberculosis
ccggugagcggauuggucgggc

SEQ ID NO: 2999907 - RNA, 18 nt, Mycobacterium avium subsp. paratuberculosis
ccggugagcgugucgcgc

SEQ ID NO: 2999908 - RNA, 23 nt, Mycobacterium avium subsp. paratuberculosis
ccggugauccacuccagcaccgg

SEQ ID NO: 2999909 - RNA, 15 nt, Mycobacterium avium subsp. paratuberculosis
ccggugaucgccgcc

SEQ ID NO: 2999910 - RNA, 18 nt, Mycobacterium avium subsp. paratuberculosis
ccggugaucgccgcccac

SEQ ID NO: 2999911 - RNA, 15 nt, Mycobacterium avium subsp. paratuberculosis
ccggugaucgcggcg

SEQ ID NO: 2999912 - RNA, 16 nt, Mycobacterium avium subsp. paratuberculosis
ccggugaucgcggcgc

SEQ ID NO: 2999913 - RNA, 21 nt, Mycobacterium avium subsp. paratuberculosis
ccggugaucgcggcgcugccg

SEQ ID NO: 2999914 - RNA, 12 nt, Mycobacterium avium subsp. paratuberculosis
ccggugaucggu

SEQ ID NO: 2999915 - RNA, 18 nt, Mycobacterium avium subsp. paratuberculosis
ccggugaugaacgcgccg

SEQ ID NO: 2999916 - RNA, 22 nt, Mycobacterium avium subsp. paratuberculosis
ccggugaugaacgcgccgucgu

SEQ ID NO: 2999917 - RNA, 18 nt, Mycobacterium avium subsp. paratuberculosis
ccggugaugacgucgccc

SEQ ID NO: 2999918 - RNA, 19 nt, Mycobacterium avium subsp. paratuberculosis
ccggugaugacgucgccca

SEQ ID NO: 2999919 - RNA, 16 nt, Mycobacterium avium subsp. paratuberculosis
ccggugaugccggcau

SEQ ID NO: 2999920 - RNA, 23 nt, Mycobacterium avium subsp. paratuberculosis
ccggugaugccggcauccucggc

SEQ ID NO: 2999921 - RNA, 23 nt, Mycobacterium avium subsp. paratuberculosis
ccggugauggugaucucgccgcg

SEQ ID NO: 2999922 - RNA, 18 nt, Mycobacterium avium subsp. paratuberculosis
ccggugauucgugcagug

SEQ ID NO: 2999923 - RNA, 20 nt, Mycobacterium avium subsp. paratuberculosis
ccggugcaccacgaugaagc

SEQ ID NO: 2999924 - RNA, 12 nt, Mycobacterium avium subsp. paratuberculosis
ccggugcaccgc

SEQ ID NO: 2999925 - RNA, 20 nt, Mycobacterium avium subsp. paratuberculosis
ccggugcacgagcgucgugc

SEQ ID NO: 2999926 - RNA, 16 nt, Mycobacterium avium subsp. paratuberculosis
ccggugcagaucgucc

SEQ ID NO: 2999927 - RNA, 16 nt, Mycobacterium avium subsp. paratuberculosis
ccggugcagcaccucg

SEQ ID NO: 2999928 - RNA, 19 nt, Mycobacterium avium subsp. paratuberculosis
ccggugcagcaccucgauc

SEQ ID NO: 2999929 - RNA, 13 nt, Mycobacterium avium subsp. paratuberculosis
ccggugccacgau

SEQ ID NO: 2999930 - RNA, 13 nt, Mycobacterium avium subsp. paratuberculosis
ccggugccgacga

SEQ ID NO: 2999931 - RNA, 16 nt, Mycobacterium avium subsp. paratuberculosis
ccggugccgacgauga

SEQ ID NO: 2999932 - RNA, 17 nt, Mycobacterium avium subsp. paratuberculosis
ccggugccgagcgcgcu

SEQ ID NO: 2999933 - RNA, 15 nt, Mycobacterium avium subsp. paratuberculosis
ccggugccgcagccg

SEQ ID NO: 2999934 - RNA, 17 nt, Mycobacterium avium subsp. paratuberculosis
ccggugccgcagccguc

SEQ ID NO: 2999935 - RNA, 18 nt, Mycobacterium avium subsp. paratuberculosis
ccggugccgcagccgucc

SEQ ID NO: 2999936 - RNA, 19 nt, Mycobacterium avium subsp. paratuberculosis
ccggugccgcagccguccc

SEQ ID NO: 2999937 - RNA, 13 nt, Mycobacterium avium subsp. paratuberculosis
ccggugccgcagu

SEQ ID NO: 2999938 - RNA, 19 nt, Mycobacterium avium subsp. paratuberculosis
ccggugccgcagugccggc

SEQ ID NO: 2999939 - RNA, 20 nt, Mycobacterium avium subsp. paratuberculosis
ccggugccgcagugccggcg

SEQ ID NO: 2999940 - RNA, 16 nt, Mycobacterium avium subsp. paratuberculosis
ccggugccgccggcgc

SEQ ID NO: 2999941 - RNA, 18 nt, Mycobacterium avium subsp. paratuberculosis
ccggugccgccggcgcau

SEQ ID NO: 2999942 - RNA, 13 nt, Mycobacterium avium subsp. paratuberculosis
ccggugccggccg

SEQ ID NO: 2999943 - RNA, 15 nt, Mycobacterium avium subsp. paratuberculosis
ccggugccguugauc

SEQ ID NO: 2999944 - RNA, 14 nt, Mycobacterium avium subsp. paratuberculosis
ccggugcgacgccg

SEQ ID NO: 2999945 - RNA, 15 nt, Mycobacterium avium subsp. paratuberculosis
ccggugcgacgccgc

SEQ ID NO: 2999946 - RNA, 18 nt, Mycobacterium avium subsp. paratuberculosis
ccggugcgacgccgcgca

SEQ ID NO: 2999947 - RNA, 13 nt, Mycobacterium avium subsp. paratuberculosis
ccggugcgagccg

SEQ ID NO: 2999948 - RNA, 15 nt, Mycobacterium avium subsp. paratuberculosis
ccggugcgccagcgu

SEQ ID NO: 2999949 - RNA, 17 nt, Mycobacterium avium subsp. paratuberculosis
ccggugcgccagcguga

SEQ ID NO: 2999950 - RNA, 13 nt, Mycobacterium avium subsp. paratuberculosis
ccggugcgcccgc

SEQ ID NO: 2999951 - RNA, 15 nt, Mycobacterium avium subsp. paratuberculosis
ccggugcgccgaccg

SEQ ID NO: 2999952 - RNA, 21 nt, Mycobacterium avium subsp. paratuberculosis
ccggugcgccgaccgcgaucg

SEQ ID NO: 2999953 - RNA, 19 nt, Mycobacterium avium subsp. paratuberculosis
ccggugcgcgcaccaggcc

SEQ ID NO: 2999954 - RNA, 21 nt, Mycobacterium avium subsp. paratuberculosis
ccggugcgcgcaccaggccga

SEQ ID NO: 2999955 - RNA, 17 nt, Mycobacterium avium subsp. paratuberculosis
ccggugcgcgucagccg

SEQ ID NO: 2999956 - RNA, 20 nt, Mycobacterium avium subsp. paratuberculosis
ccggugcgcgucagccgucg

SEQ ID NO: 2999957 - RNA, 13 nt, Mycobacterium avium subsp. paratuberculosis
ccggugcggccgc

SEQ ID NO: 2999958 - RNA, 21 nt, Mycobacterium avium subsp. paratuberculosis
ccggugcggcggugacgaugu

SEQ ID NO: 2999959 - RNA, 15 nt, Mycobacterium avium subsp. paratuberculosis
ccggugcggucccgg

SEQ ID NO: 2999960 - RNA, 18 nt, Mycobacterium avium subsp. paratuberculosis
ccggugcggucggcgucg

SEQ ID NO: 2999961 - RNA, 15 nt, Mycobacterium avium subsp. paratuberculosis
ccggugcguccgccg

SEQ ID NO: 2999962 - RNA, 12 nt, Mycobacterium avium subsp. paratuberculosis
ccggugcucccc

SEQ ID NO: 2999963 - RNA, 15 nt, Mycobacterium avium subsp. paratuberculosis
ccggugcucuccugc

SEQ ID NO: 2999964 - RNA, 16 nt, Mycobacterium avium subsp. paratuberculosis
ccggugcucuccugcu

SEQ ID NO: 2999965 - RNA, 17 nt, Mycobacterium avium subsp. paratuberculosis
ccggugcucuccugcuu

SEQ ID NO: 2999966 - RNA, 15 nt, Mycobacterium avium subsp. paratuberculosis
ccggugcugacccgg

SEQ ID NO: 2999967 - RNA, 17 nt, Mycobacterium avium subsp. paratuberculosis
ccggugcugacccgguc

SEQ ID NO: 2999968 - RNA, 22 nt, Mycobacterium avium subsp. paratuberculosis
ccggugcugacccggucgcggc

SEQ ID NO: 2999969 - RNA, 15 nt, Mycobacterium avium subsp. paratuberculosis
ccggugcugcucgag

SEQ ID NO: 2999970 - RNA, 14 nt, Mycobacterium avium subsp. paratuberculosis
ccggugcuguccac

SEQ ID NO: 2999971 - RNA, 21 nt, Mycobacterium avium subsp. paratuberculosis
ccgguggaaugcaucgcgauc

SEQ ID NO: 2999972 - RNA, 21 nt, Mycobacterium avium subsp. paratuberculosis
ccgguggaauucuggccgacc

SEQ ID NO: 2999973 - RNA, 23 nt, Mycobacterium avium subsp. paratuberculosis
ccgguggaauucuggccgaccgc

SEQ ID NO: 2999974 - RNA, 21 nt, Mycobacterium avium subsp. paratuberculosis
ccgguggacgaggugaccggc

SEQ ID NO: 2999975 - RNA, 22 nt, Mycobacterium avium subsp. paratuberculosis
ccgguggacgaggugaccggcg

SEQ ID NO: 2999976 - RNA, 19 nt, Mycobacterium avium subsp. paratuberculosis
ccgguggacgcgauggcgc

SEQ ID NO: 2999977 - RNA, 16 nt, Mycobacterium avium subsp. paratuberculosis
ccgguggacuccagca

SEQ ID NO: 2999978 - RNA, 23 nt, Mycobacterium avium subsp. paratuberculosis
ccgguggagauggccagcaccac

SEQ ID NO: 2999979 - RNA, 21 nt, Mycobacterium avium subsp. paratuberculosis
ccgguggauauuucgcggccg

SEQ ID NO: 2999980 - RNA, 19 nt, Mycobacterium avium subsp. paratuberculosis
ccgguggaugggcucgacc

SEQ ID NO: 2999981 - RNA, 16 nt, Mycobacterium avium subsp. paratuberculosis
ccgguggcagcccggc

SEQ ID NO: 2999982 - RNA, 19 nt, Mycobacterium avium subsp. paratuberculosis
ccgguggcagcccggcuaa

SEQ ID NO: 2999983 - RNA, 23 nt, Mycobacterium avium subsp. paratuberculosis
ccgguggccgaggguuccagcca

SEQ ID NO: 2999984 - RNA, 14 nt, Mycobacterium avium subsp. paratuberculosis
ccgguggccgccgg

SEQ ID NO: 2999985 - RNA, 13 nt, Mycobacterium avium subsp. paratuberculosis
ccgguggccgcga

SEQ ID NO: 2999986 - RNA, 15 nt, Mycobacterium avium subsp. paratuberculosis
ccgguggccgcgucg

SEQ ID NO: 2999987 - RNA, 16 nt, Mycobacterium avium subsp. paratuberculosis
ccgguggccgcgucga

SEQ ID NO: 2999988 - RNA, 21 nt, Mycobacterium avium subsp. paratuberculosis
ccgguggccgcgucgaccagc

SEQ ID NO: 2999989 - RNA, 13 nt, Mycobacterium avium subsp. paratuberculosis
ccgguggcggcca

SEQ ID NO: 2999990 - RNA, 15 nt, Mycobacterium avium subsp. paratuberculosis
ccgguggcggccacg

SEQ ID NO: 2999991 - RNA, 22 nt, Mycobacterium avium subsp. paratuberculosis
ccgguggcggccacgaucgcga

SEQ ID NO: 2999992 - RNA, 20 nt, Mycobacterium avium subsp. paratuberculosis
ccgguggcggccaggccggc

SEQ ID NO: 2999993 - RNA, 21 nt, Mycobacterium avium subsp. paratuberculosis
ccgguggcggccaggccggcg

SEQ ID NO: 2999994 - RNA, 14 nt, Mycobacterium avium subsp. paratuberculosis
ccgguggcggcgag

SEQ ID NO: 2999995 - RNA, 16 nt, Mycobacterium avium subsp. paratuberculosis
ccgguggcggcgagga

SEQ ID NO: 2999996 - RNA, 13 nt, Mycobacterium avium subsp. paratuberculosis
ccgguggcgucgg

SEQ ID NO: 2999997 - RNA, 23 nt, Mycobacterium avium subsp. paratuberculosis
ccggugggacugggcgccgccgg

SEQ ID NO: 2999998 - RNA, 20 nt, Mycobacterium avium subsp. paratuberculosis
ccggugggguuagggcguca

SEQ ID NO: 2999999 - RNA, 20 nt, Mycobacterium avium subsp. paratuberculosis
ccgguggucaacgcgcacau

SEQ ID NO: 3000000 - RNA, 18 nt, Mycobacterium avium subsp. paratuberculosis
ccgguggucccggucagc

SEQ ID NO: 3000001 - RNA, 17 nt, Mycobacterium avium subsp. paratuberculosis
ccgguggugucgacggu

SEQ ID NO: 3000002 - RNA, 15 nt, Mycobacterium avium subsp. paratuberculosis
ccgguguagaucggc

SEQ ID NO: 3000003 - RNA, 23 nt, Mycobacterium avium subsp. paratuberculosis
ccgguguaucccaucagugcggc

SEQ ID NO: 3000004 - RNA, 14 nt, Mycobacterium avium subsp. paratuberculosis
ccggugucacgcug

SEQ ID NO: 3000005 - RNA, 15 nt, Mycobacterium avium subsp. paratuberculosis
ccggugucacgcugg

SEQ ID NO: 3000006 - RNA, 16 nt, Mycobacterium avium subsp. paratuberculosis
ccggugucacgcuggc

SEQ ID NO: 3000007 - RNA, 16 nt, Mycobacterium avium subsp. paratuberculosis
ccgguguccacgucgc

SEQ ID NO: 3000008 - RNA, 18 nt, Mycobacterium avium subsp. paratuberculosis
ccgguguccacgucgccc

SEQ ID NO: 3000009 - RNA, 13 nt, Mycobacterium avium subsp. paratuberculosis
ccggugucgagcc

SEQ ID NO: 3000010 - RNA, 12 nt, Mycobacterium avium subsp. paratuberculosis
ccggugucggcg

SEQ ID NO: 3000011 - RNA, 21 nt, Mycobacterium avium subsp. paratuberculosis
ccggugucggggucgucgacg

SEQ ID NO: 3000012 - RNA, 22 nt, Mycobacterium avium subsp. paratuberculosis
ccggugucggggucgucgacgg

SEQ ID NO: 3000013 - RNA, 17 nt, Mycobacterium avium subsp. paratuberculosis
ccggugucugaccucgc

SEQ ID NO: 3000014 - RNA, 22 nt, Mycobacterium avium subsp. paratuberculosis
ccggugucugaccucgcgccgc

SEQ ID NO: 3000015 - RNA, 16 nt, Mycobacterium avium subsp. paratuberculosis
ccggugugaucgagca

SEQ ID NO: 3000016 - RNA, 21 nt, Mycobacterium avium subsp. paratuberculosis
ccggugugaucgagcaccagc

SEQ ID NO: 3000017 - RNA, 22 nt, Mycobacterium avium subsp. paratuberculosis
ccggugugcagccacccgucgg

SEQ ID NO: 3000018 - RNA, 19 nt, Mycobacterium avium subsp. paratuberculosis
ccggugugccuggcucccc

SEQ ID NO: 3000019 - RNA, 23 nt, Mycobacterium avium subsp. paratuberculosis
ccggugugccuggcuccccggcg

SEQ ID NO: 3000020 - RNA, 19 nt, Mycobacterium avium subsp. paratuberculosis
ccgguguucaagccggcgu

SEQ ID NO: 3000021 - RNA, 20 nt, Mycobacterium avium subsp. paratuberculosis
ccgguguugccgacggcgcc

SEQ ID NO: 3000022 - RNA, 13 nt, Mycobacterium avium subsp. paratuberculosis
ccgguuccaccgg

SEQ ID NO: 3000023 - RNA, 15 nt, Mycobacterium avium subsp. paratuberculosis
ccgguuccaccgggc

SEQ ID NO: 3000024 - RNA, 17 nt, Mycobacterium avium subsp. paratuberculosis
ccgguuccaccgggccg

SEQ ID NO: 3000025 - RNA, 19 nt, Mycobacterium avium subsp. paratuberculosis
ccgguuccaccgggccgcc

SEQ ID NO: 3000026 - RNA, 20 nt, Mycobacterium avium subsp. paratuberculosis
ccgguuccaccgggccgcca

SEQ ID NO: 3000027 - RNA, 22 nt, Mycobacterium avium subsp. paratuberculosis
ccgguuccaccgggccgccauc

SEQ ID NO: 3000028 - RNA, 17 nt, Mycobacterium avium subsp. paratuberculosis
ccgguuccacgauuccu

SEQ ID NO: 3000029 - RNA, 15 nt, Mycobacterium avium subsp. paratuberculosis
ccgguucccggcacc

SEQ ID NO: 3000030 - RNA, 16 nt, Mycobacterium avium subsp. paratuberculosis
ccgguucccgugcugg

SEQ ID NO: 3000031 - RNA, 18 nt, Mycobacterium avium subsp. paratuberculosis
ccgguuccgcgacaucgg

SEQ ID NO: 3000032 - RNA, 14 nt, Mycobacterium avium subsp. paratuberculosis
ccgguuccgggcga

SEQ ID NO: 3000033 - RNA, 15 nt, Mycobacterium avium subsp. paratuberculosis
ccgguuccgggcgac

SEQ ID NO: 3000034 - RNA, 14 nt, Mycobacterium avium subsp. paratuberculosis
ccgguucgaccggc

SEQ ID NO: 3000035 - RNA, 16 nt, Mycobacterium avium subsp. paratuberculosis
ccgguucggacacggc

SEQ ID NO: 3000036 - RNA, 20 nt, Mycobacterium avium subsp. paratuberculosis
ccgguucggacacggcgccg

SEQ ID NO: 3000037 - RNA, 13 nt, Mycobacterium avium subsp. paratuberculosis
ccgguucggcggc

SEQ ID NO: 3000038 - RNA, 14 nt, Mycobacterium avium subsp. paratuberculosis
ccgguucggcggca

SEQ ID NO: 3000039 - RNA, 15 nt, Mycobacterium avium subsp. paratuberculosis
ccgguucggcggcau

SEQ ID NO: 3000040 - RNA, 19 nt, Mycobacterium avium subsp. paratuberculosis
ccgguucgucaacgccccg

SEQ ID NO: 3000041 - RNA, 21 nt, Mycobacterium avium subsp. paratuberculosis
ccgguucgucaacgccccggu

SEQ ID NO: 3000042 - RNA, 17 nt, Mycobacterium avium subsp. paratuberculosis
ccgguucgucccgcgcg

SEQ ID NO: 3000043 - RNA, 18 nt, Mycobacterium avium subsp. paratuberculosis
ccgguucgucccgcgcgg

SEQ ID NO: 3000044 - RNA, 15 nt, Mycobacterium avium subsp. paratuberculosis
ccgguucgucguguc

SEQ ID NO: 3000045 - RNA, 20 nt, Mycobacterium avium subsp. paratuberculosis
ccgguucgucgugucguguu

SEQ ID NO: 3000046 - RNA, 17 nt, Mycobacterium avium subsp. paratuberculosis
ccgguugagugcgccgu

SEQ ID NO: 3000047 - RNA, 23 nt, Mycobacterium avium subsp. paratuberculosis
ccgguugagugcgccgugcagca

SEQ ID NO: 3000048 - RNA, 15 nt, Mycobacterium avium subsp. paratuberculosis
ccgguugaucacccg

SEQ ID NO: 3000049 - RNA, 16 nt, Mycobacterium avium subsp. paratuberculosis
ccgguugcaccgcgau

SEQ ID NO: 3000050 - RNA, 18 nt, Mycobacterium avium subsp. paratuberculosis
ccgguugcccggaagccg

SEQ ID NO: 3000051 - RNA, 15 nt, Mycobacterium avium subsp. paratuberculosis
ccgguugcggcagca

SEQ ID NO: 3000052 - RNA, 16 nt, Mycobacterium avium subsp. paratuberculosis
ccgguugcggcagcac

SEQ ID NO: 3000053 - RNA, 14 nt, Mycobacterium avium subsp. paratuberculosis
ccgguugcgggccg

SEQ ID NO: 3000054 - RNA, 15 nt, Mycobacterium avium subsp. paratuberculosis
ccgguugcgggccga

SEQ ID NO: 3000055 - RNA, 21 nt, Mycobacterium avium subsp. paratuberculosis
ccgguugcgguugccccaccc

SEQ ID NO: 3000056 - RNA, 14 nt, Mycobacterium avium subsp. paratuberculosis
ccgguuggccaggu

SEQ ID NO: 3000057 - RNA, 20 nt, Mycobacterium avium subsp. paratuberculosis
ccgguuggccagguggccgc

SEQ ID NO: 3000058 - RNA, 18 nt, Mycobacterium avium subsp. paratuberculosis
ccgguuuccaguccggcg

SEQ ID NO: 3000059 - RNA, 23 nt, Mycobacterium avium subsp. paratuberculosis
ccgguuuccaguccggcgcccgg

SEQ ID NO: 3000060 - RNA, 14 nt, Mycobacterium avium subsp. paratuberculosis
ccgguuugcgccgg

SEQ ID NO: 3000061 - RNA, 15 nt, Mycobacterium avium subsp. paratuberculosis
ccgguuugucggcgc

SEQ ID NO: 3000062 - RNA, 16 nt, Mycobacterium avium subsp. paratuberculosis
ccgguuugucggcgcc

SEQ ID NO: 3000063 - RNA, 16 nt, Mycobacterium avium subsp. paratuberculosis
ccguaacacgaucacc

SEQ ID NO: 3000064 - RNA, 15 nt, Mycobacterium avium subsp. paratuberculosis
ccguaacgaugccgc

SEQ ID NO: 3000065 - RNA, 23 nt, Mycobacterium avium subsp. paratuberculosis
ccguaaguggcgccgcggucgca

SEQ ID NO: 3000066 - RNA, 18 nt, Mycobacterium avium subsp. paratuberculosis
ccguacacggcggcgaag

SEQ ID NO: 3000067 - RNA, 20 nt, Mycobacterium avium subsp. paratuberculosis
ccguacagcugguccggccg

SEQ ID NO: 3000068 - RNA, 19 nt, Mycobacterium avium subsp. paratuberculosis
ccguacauggugaccagcg

SEQ ID NO: 3000069 - RNA, 21 nt, Mycobacterium avium subsp. paratuberculosis
ccguaccagcgcucgacgagg

SEQ ID NO: 3000070 - RNA, 18 nt, Mycobacterium avium subsp. paratuberculosis
ccguaccgaggaugaccg

SEQ ID NO: 3000071 - RNA, 18 nt, Mycobacterium avium subsp. paratuberculosis
ccguaccgauccgcgggc

SEQ ID NO: 3000072 - RNA, 13 nt, Mycobacterium avium subsp. paratuberculosis
ccguaccgcaaca

SEQ ID NO: 3000073 - RNA, 20 nt, Mycobacterium avium subsp. paratuberculosis
ccguaccgcuuggcccaccg

SEQ ID NO: 3000074 - RNA, 20 nt, Mycobacterium avium subsp. paratuberculosis
ccguacgcgccggccagccg

SEQ ID NO: 3000075 - RNA, 20 nt, Mycobacterium avium subsp. paratuberculosis
ccguacgcgguucgugcgca

SEQ ID NO: 3000076 - RNA, 22 nt, Mycobacterium avium subsp. paratuberculosis
ccguacggcccgaacaccguga

SEQ ID NO: 3000077 - RNA, 22 nt, Mycobacterium avium subsp. paratuberculosis
ccguacggguugccgucgacga

SEQ ID NO: 3000078 - RNA, 18 nt, Mycobacterium avium subsp. paratuberculosis
ccguacucgaugccguug

SEQ ID NO: 3000079 - RNA, 22 nt, Mycobacterium avium subsp. paratuberculosis
ccguacucgggugggggcgugg

SEQ ID NO: 3000080 - RNA, 20 nt, Mycobacterium avium subsp. paratuberculosis
ccguacuucucgaagaaggc

SEQ ID NO: 3000081 - RNA, 21 nt, Mycobacterium avium subsp. paratuberculosis
ccguagaacaguucgacguag

SEQ ID NO: 3000082 - RNA, 16 nt, Mycobacterium avium subsp. paratuberculosis
ccguagaauccgccgu

SEQ ID NO: 3000083 - RNA, 16 nt, Mycobacterium avium subsp. paratuberculosis
ccguagaccaccucga

SEQ ID NO: 3000084 - RNA, 13 nt, Mycobacterium avium subsp. paratuberculosis
ccguagaccagca

SEQ ID NO: 3000085 - RNA, 15 nt, Mycobacterium avium subsp. paratuberculosis
ccguagaccagcauc

SEQ ID NO: 3000086 - RNA, 13 nt, Mycobacterium avium subsp. paratuberculosis
ccguagaucacgc

SEQ ID NO: 3000087 - RNA, 21 nt, Mycobacterium avium subsp. paratuberculosis
ccguagaucacgccggugagc

SEQ ID NO: 3000088 - RNA, 17 nt, Mycobacterium avium subsp. paratuberculosis
ccguagaucucgcgccg

SEQ ID NO: 3000089 - RNA, 18 nt, Mycobacterium avium subsp. paratuberculosis
ccguagaucucgcgccgc

SEQ ID NO: 3000090 - RNA, 15 nt, Mycobacterium avium subsp. paratuberculosis
ccguagaugccggua

SEQ ID NO: 3000091 - RNA, 15 nt, Mycobacterium avium subsp. paratuberculosis
ccguagcccugcagg

SEQ ID NO: 3000092 - RNA, 18 nt, Mycobacterium avium subsp. paratuberculosis
ccguagccggcgguggcc

SEQ ID NO: 3000093 - RNA, 13 nt, Mycobacterium avium subsp. paratuberculosis
ccguagcgagcgc

SEQ ID NO: 3000094 - RNA, 16 nt, Mycobacterium avium subsp. paratuberculosis
ccguagcgcaacaccg

SEQ ID NO: 3000095 - RNA, 17 nt, Mycobacterium avium subsp. paratuberculosis
ccguagcgcaacaccga

SEQ ID NO: 3000096 - RNA, 20 nt, Mycobacterium avium subsp. paratuberculosis
ccguagcgcaacaccgaaag

SEQ ID NO: 3000097 - RNA, 23 nt, Mycobacterium avium subsp. paratuberculosis
ccguagcgcaugaugcccaggcc

SEQ ID NO: 3000098 - RNA, 15 nt, Mycobacterium avium subsp. paratuberculosis
ccguagcgcugggug

SEQ ID NO: 3000099 - RNA, 14 nt, Mycobacterium avium subsp. paratuberculosis
ccguagcggacgac

SEQ ID NO: 3000100 - RNA, 13 nt, Mycobacterium avium subsp. paratuberculosis
ccguagcggccca

SEQ ID NO: 3000101 - RNA, 17 nt, Mycobacterium avium subsp. paratuberculosis
ccguagcggcucgccac

SEQ ID NO: 3000102 - RNA, 22 nt, Mycobacterium avium subsp. paratuberculosis
ccguaggacaggaacgggccgg

SEQ ID NO: 3000103 - RNA, 14 nt, Mycobacterium avium subsp. paratuberculosis
ccguaggccgcgcu

SEQ ID NO: 3000104 - RNA, 21 nt, Mycobacterium avium subsp. paratuberculosis
ccguaggccgcgcugaacgcg

SEQ ID NO: 3000105 - RNA, 20 nt, Mycobacterium avium subsp. paratuberculosis
ccguagguugccccacacga

SEQ ID NO: 3000106 - RNA, 15 nt, Mycobacterium avium subsp. paratuberculosis
ccguagucacccggc

SEQ ID NO: 3000107 - RNA, 17 nt, Mycobacterium avium subsp. paratuberculosis
ccguagucacccggccc

SEQ ID NO: 3000108 - RNA, 20 nt, Mycobacterium avium subsp. paratuberculosis
ccguagucacccggcccccg

SEQ ID NO: 3000109 - RNA, 13 nt, Mycobacterium avium subsp. paratuberculosis
ccguagucggcgg

SEQ ID NO: 3000110 - RNA, 19 nt, Mycobacterium avium subsp. paratuberculosis
ccguaucggccccggccga

SEQ ID NO: 3000111 - RNA, 15 nt, Mycobacterium avium subsp. paratuberculosis
ccguauugccgucgg

SEQ ID NO: 3000112 - RNA, 19 nt, Mycobacterium avium subsp. paratuberculosis
ccguauuggguugcggugc

SEQ ID NO: 3000113 - RNA, 13 nt, Mycobacterium avium subsp. paratuberculosis
ccgucacaggccg

SEQ ID NO: 3000114 - RNA, 14 nt, Mycobacterium avium subsp. paratuberculosis
ccgucacaggccgc

SEQ ID NO: 3000115 - RNA, 17 nt, Mycobacterium avium subsp. paratuberculosis
ccgucacaggccgccug

SEQ ID NO: 3000116 - RNA, 16 nt, Mycobacterium avium subsp. paratuberculosis
ccgucacccccggcgc

SEQ ID NO: 3000117 - RNA, 20 nt, Mycobacterium avium subsp. paratuberculosis
ccgucacccccggcgcgacg

SEQ ID NO: 3000118 - RNA, 22 nt, Mycobacterium avium subsp. paratuberculosis
ccgucacccccggcgcgacggc

SEQ ID NO: 3000119 - RNA, 16 nt, Mycobacterium avium subsp. paratuberculosis
ccgucaccgacggcug

SEQ ID NO: 3000120 - RNA, 16 nt, Mycobacterium avium subsp. paratuberculosis
ccgucaccgccgcacc

SEQ ID NO: 3000121 - RNA, 21 nt, Mycobacterium avium subsp. paratuberculosis
ccgucaccgccgcaccgucgu

SEQ ID NO: 3000122 - RNA, 17 nt, Mycobacterium avium subsp. paratuberculosis
ccgucaccggccauccg

SEQ ID NO: 3000123 - RNA, 13 nt, Mycobacterium avium subsp. paratuberculosis
ccgucaccggcug

SEQ ID NO: 3000124 - RNA, 17 nt, Mycobacterium avium subsp. paratuberculosis
ccgucaccggcugcccg

SEQ ID NO: 3000125 - RNA, 19 nt, Mycobacterium avium subsp. paratuberculosis
ccgucaccggcugcccgac

SEQ ID NO: 3000126 - RNA, 21 nt, Mycobacterium avium subsp. paratuberculosis
ccgucaccuucacccccaccc

SEQ ID NO: 3000127 - RNA, 22 nt, Mycobacterium avium subsp. paratuberculosis
ccgucacgccguauucgccgac

SEQ ID NO: 3000128 - RNA, 12 nt, Mycobacterium avium subsp. paratuberculosis
ccgucacgcugg

SEQ ID NO: 3000129 - RNA, 16 nt, Mycobacterium avium subsp. paratuberculosis
ccgucacgcuggcgug

SEQ ID NO: 3000130 - RNA, 18 nt, Mycobacterium avium subsp. paratuberculosis
ccgucacgcuggcgugac

SEQ ID NO: 3000131 - RNA, 20 nt, Mycobacterium avium subsp. paratuberculosis
ccgucacgcuggcgugacgc

SEQ ID NO: 3000132 - RNA, 19 nt, Mycobacterium avium subsp. paratuberculosis
ccgucacggaucgcccacc

SEQ ID NO: 3000133 - RNA, 22 nt, Mycobacterium avium subsp. paratuberculosis
ccgucacggaucgcccacccgc

SEQ ID NO: 3000134 - RNA, 14 nt, Mycobacterium avium subsp. paratuberculosis
ccgucacggccguc

SEQ ID NO: 3000135 - RNA, 15 nt, Mycobacterium avium subsp. paratuberculosis
ccgucacggccgucc

SEQ ID NO: 3000136 - RNA, 16 nt, Mycobacterium avium subsp. paratuberculosis
ccgucacggccgucca

SEQ ID NO: 3000137 - RNA, 21 nt, Mycobacterium avium subsp. paratuberculosis
ccgucacggcugccgaccucg

SEQ ID NO: 3000138 - RNA, 21 nt, Mycobacterium avium subsp. paratuberculosis
ccgucacgucguugagcacac

SEQ ID NO: 3000139 - RNA, 18 nt, Mycobacterium avium subsp. paratuberculosis
ccgucacguucaccaccg

SEQ ID NO: 3000140 - RNA, 19 nt, Mycobacterium avium subsp. paratuberculosis
ccgucacugcacgcacggc

SEQ ID NO: 3000141 - RNA, 18 nt, Mycobacterium avium subsp. paratuberculosis
ccgucagcagggccucgc

SEQ ID NO: 3000142 - RNA, 15 nt, Mycobacterium avium subsp. paratuberculosis
ccgucagcgccgccc

SEQ ID NO: 3000143 - RNA, 16 nt, Mycobacterium avium subsp. paratuberculosis
ccgucagcgccgcccg

SEQ ID NO: 3000144 - RNA, 20 nt, Mycobacterium avium subsp. paratuberculosis
ccgucagcgucagcacguug

SEQ ID NO: 3000145 - RNA, 16 nt, Mycobacterium avium subsp. paratuberculosis
ccgucaggaacgccgg

SEQ ID NO: 3000146 - RNA, 22 nt, Mycobacterium avium subsp. paratuberculosis
ccgucaggccugguaggccgcc

SEQ ID NO: 3000147 - RNA, 23 nt, Mycobacterium avium subsp. paratuberculosis
ccgucaggccugguaggccgccu

SEQ ID NO: 3000148 - RNA, 23 nt, Mycobacterium avium subsp. paratuberculosis
ccgucagggugacguggcggccg

SEQ ID NO: 3000149 - RNA, 21 nt, Mycobacterium avium subsp. paratuberculosis
ccgucaggguggugcccccgc

SEQ ID NO: 3000150 - RNA, 22 nt, Mycobacterium avium subsp. paratuberculosis
ccgucagugcgcauucggcgac

SEQ ID NO: 3000151 - RNA, 23 nt, Mycobacterium avium subsp. paratuberculosis
ccgucagugcgcauucggcgacg

SEQ ID NO: 3000152 - RNA, 20 nt, Mycobacterium avium subsp. paratuberculosis
ccgucaucaccgccgagggc

SEQ ID NO: 3000153 - RNA, 22 nt, Mycobacterium avium subsp. paratuberculosis
ccgucaucaccgccgagggccc

SEQ ID NO: 3000154 - RNA, 23 nt, Mycobacterium avium subsp. paratuberculosis
ccgucauccccaucucgagcagg

SEQ ID NO: 3000155 - RNA, 14 nt, Mycobacterium avium subsp. paratuberculosis
ccgucaucgccgac

SEQ ID NO: 3000156 - RNA, 16 nt, Mycobacterium avium subsp. paratuberculosis
ccgucaucgccgacgg

SEQ ID NO: 3000157 - RNA, 19 nt, Mycobacterium avium subsp. paratuberculosis
ccgucaucgccgacgguga

SEQ ID NO: 3000158 - RNA, 13 nt, Mycobacterium avium subsp. paratuberculosis
ccgucaucgcggc

SEQ ID NO: 3000159 - RNA, 14 nt, Mycobacterium avium subsp. paratuberculosis
ccgucaucgcggcg

SEQ ID NO: 3000160 - RNA, 18 nt, Mycobacterium avium subsp. paratuberculosis
ccgucaucgugugggcgc

SEQ ID NO: 3000161 - RNA, 20 nt, Mycobacterium avium subsp. paratuberculosis
ccgucaucgugugggcgccc

SEQ ID NO: 3000162 - RNA, 21 nt, Mycobacterium avium subsp. paratuberculosis
ccgucaucgugugggcgcccg

SEQ ID NO: 3000163 - RNA, 22 nt, Mycobacterium avium subsp. paratuberculosis
ccgucaucgugugggcgcccgc

SEQ ID NO: 3000164 - RNA, 12 nt, Mycobacterium avium subsp. paratuberculosis
ccgucaucuccg

SEQ ID NO: 3000165 - RNA, 24 nt, Mycobacterium avium subsp. paratuberculosis
ccgucaucuccgacucgauguagc

SEQ ID NO: 3000166 - RNA, 18 nt, Mycobacterium avium subsp. paratuberculosis
ccgucaucucgguggugg

SEQ ID NO: 3000167 - RNA, 13 nt, Mycobacterium avium subsp. paratuberculosis
ccgucaugguguc

SEQ ID NO: 3000168 - RNA, 18 nt, Mycobacterium avium subsp. paratuberculosis
ccguccacagccggcggc

SEQ ID NO: 3000169 - RNA, 20 nt, Mycobacterium avium subsp. paratuberculosis
ccguccacagccggcggcug

SEQ ID NO: 3000170 - RNA, 21 nt, Mycobacterium avium subsp. paratuberculosis
ccguccaccaccaacccgguc

SEQ ID NO: 3000171 - RNA, 15 nt, Mycobacterium avium subsp. paratuberculosis
ccguccaccagaucg

SEQ ID NO: 3000172 - RNA, 12 nt, Mycobacterium avium subsp. paratuberculosis
ccguccacccgg

SEQ ID NO: 3000173 - RNA, 14 nt, Mycobacterium avium subsp. paratuberculosis
ccguccacccggcc

SEQ ID NO: 3000174 - RNA, 17 nt, Mycobacterium avium subsp. paratuberculosis
ccguccacccggcccac

SEQ ID NO: 3000175 - RNA, 21 nt, Mycobacterium avium subsp. paratuberculosis
ccguccacccggcccaccacc

SEQ ID NO: 3000176 - RNA, 12 nt, Mycobacterium avium subsp. paratuberculosis
ccguccaccggc

SEQ ID NO: 3000177 - RNA, 16 nt, Mycobacterium avium subsp. paratuberculosis
ccguccacggcggugg

SEQ ID NO: 3000178 - RNA, 19 nt, Mycobacterium avium subsp. paratuberculosis
ccguccagaucggccagcg

SEQ ID NO: 3000179 - RNA, 20 nt, Mycobacterium avium subsp. paratuberculosis
ccguccagaucggccagcgc

SEQ ID NO: 3000180 - RNA, 21 nt, Mycobacterium avium subsp. paratuberculosis
ccguccagaucggccagcgcg

SEQ ID NO: 3000181 - RNA, 22 nt, Mycobacterium avium subsp. paratuberculosis
ccguccagaucggccagcgcgg

SEQ ID NO: 3000182 - RNA, 18 nt, Mycobacterium avium subsp. paratuberculosis
ccguccagcaacgccgac

SEQ ID NO: 3000183 - RNA, 19 nt, Mycobacterium avium subsp. paratuberculosis
ccguccagcaacgccgaca

SEQ ID NO: 3000184 - RNA, 13 nt, Mycobacterium avium subsp. paratuberculosis
ccguccagcagca

SEQ ID NO: 3000185 - RNA, 22 nt, Mycobacterium avium subsp. paratuberculosis
ccguccagcagcagcgcgcggu

SEQ ID NO: 3000186 - RNA, 21 nt, Mycobacterium avium subsp. paratuberculosis
ccguccagccgugcggcacgc

SEQ ID NO: 3000187 - RNA, 13 nt, Mycobacterium avium subsp. paratuberculosis
ccguccagcgcau

SEQ ID NO: 3000188 - RNA, 14 nt, Mycobacterium avium subsp. paratuberculosis
ccguccagcgcaug

SEQ ID NO: 3000189 - RNA, 13 nt, Mycobacterium avium subsp. paratuberculosis
ccguccagcguca

SEQ ID NO: 3000190 - RNA, 14 nt, Mycobacterium avium subsp. paratuberculosis
ccguccagcgucug

SEQ ID NO: 3000191 - RNA, 23 nt, Mycobacterium avium subsp. paratuberculosis
ccguccagcgucuggcagccggc

SEQ ID NO: 3000192 - RNA, 13 nt, Mycobacterium avium subsp. paratuberculosis
ccguccagcgugu

SEQ ID NO: 3000193 - RNA, 18 nt, Mycobacterium avium subsp. paratuberculosis
ccguccaucgccgcgcac

SEQ ID NO: 3000194 - RNA, 13 nt, Mycobacterium avium subsp. paratuberculosis
ccgucccaccggc

SEQ ID NO: 3000195 - RNA, 21 nt, Mycobacterium avium subsp. paratuberculosis
ccgucccaggacaucaagugc

SEQ ID NO: 3000196 - RNA, 17 nt, Mycobacterium avium subsp. paratuberculosis
ccguccccaccaccgac

SEQ ID NO: 3000197 - RNA, 20 nt, Mycobacterium avium subsp. paratuberculosis
ccguccccaccaccgacagc

SEQ ID NO: 3000198 - RNA, 23 nt, Mycobacterium avium subsp. paratuberculosis
ccguccccaccaccgacagcacc

SEQ ID NO: 3000199 - RNA, 12 nt, Mycobacterium avium subsp. paratuberculosis
ccguccccaccg

SEQ ID NO: 3000200 - RNA, 14 nt, Mycobacterium avium subsp. paratuberculosis
ccguccccaccgau

SEQ ID NO: 3000201 - RNA, 17 nt, Mycobacterium avium subsp. paratuberculosis
ccgucccccgagcgggc

SEQ ID NO: 3000202 - RNA, 19 nt, Mycobacterium avium subsp. paratuberculosis
ccguccccgcgcggcucgc

SEQ ID NO: 3000203 - RNA, 13 nt, Mycobacterium avium subsp. paratuberculosis
ccgucccgccgac

SEQ ID NO: 3000204 - RNA, 15 nt, Mycobacterium avium subsp. paratuberculosis
ccgucccgccgacgg

SEQ ID NO: 3000205 - RNA, 12 nt, Mycobacterium avium subsp. paratuberculosis
ccgucccggacg

SEQ ID NO: 3000206 - RNA, 22 nt, Mycobacterium avium subsp. paratuberculosis
ccgucccgguugaccccggccc

SEQ ID NO: 3000207 - RNA, 17 nt, Mycobacterium avium subsp. paratuberculosis
ccgucccguccgacggc

SEQ ID NO: 3000208 - RNA, 20 nt, Mycobacterium avium subsp. paratuberculosis
ccgucccuguucgcgccggu

SEQ ID NO: 3000209 - RNA, 20 nt, Mycobacterium avium subsp. paratuberculosis
ccguccgaaaaacgcgucgc

SEQ ID NO: 3000210 - RNA, 18 nt, Mycobacterium avium subsp. paratuberculosis
ccguccgaaucguugagc

SEQ ID NO: 3000211 - RNA, 22 nt, Mycobacterium avium subsp. paratuberculosis
ccguccgaaucguugagcacca

SEQ ID NO: 3000212 - RNA, 23 nt, Mycobacterium avium subsp. paratuberculosis
ccguccgaaucguugagcaccac

SEQ ID NO: 3000213 - RNA, 22 nt, Mycobacterium avium subsp. paratuberculosis
ccguccgaccguugaccgacgc

SEQ ID NO: 3000214 - RNA, 15 nt, Mycobacterium avium subsp. paratuberculosis
ccguccgcaccgcga

SEQ ID NO: 3000215 - RNA, 16 nt, Mycobacterium avium subsp. paratuberculosis
ccguccgccccgcugc

SEQ ID NO: 3000216 - RNA, 12 nt, Mycobacterium avium subsp. paratuberculosis
ccguccgccggc

SEQ ID NO: 3000217 - RNA, 23 nt, Mycobacterium avium subsp. paratuberculosis
ccguccgccggcuggcgggcgau

SEQ ID NO: 3000218 - RNA, 14 nt, Mycobacterium avium subsp. paratuberculosis
ccguccgcgcccac

SEQ ID NO: 3000219 - RNA, 13 nt, Mycobacterium avium subsp. paratuberculosis
ccguccgcggcgg

SEQ ID NO: 3000220 - RNA, 14 nt, Mycobacterium avium subsp. paratuberculosis
ccguccgcggcggc

SEQ ID NO: 3000221 - RNA, 15 nt, Mycobacterium avium subsp. paratuberculosis
ccguccgcggcggcc

SEQ ID NO: 3000222 - RNA, 18 nt, Mycobacterium avium subsp. paratuberculosis
ccguccgcggcggccagg

SEQ ID NO: 3000223 - RNA, 19 nt, Mycobacterium avium subsp. paratuberculosis
ccguccggauagccgucgg

SEQ ID NO: 3000224 - RNA, 20 nt, Mycobacterium avium subsp. paratuberculosis
ccguccggauagccgucggc

SEQ ID NO: 3000225 - RNA, 13 nt, Mycobacterium avium subsp. paratuberculosis
ccguccggccggu

SEQ ID NO: 3000226 - RNA, 13 nt, Mycobacterium avium subsp. paratuberculosis
ccguccggcgaca

SEQ ID NO: 3000227 - RNA, 21 nt, Mycobacterium avium subsp. paratuberculosis
ccguccggcgacaugcgcagc

SEQ ID NO: 3000228 - RNA, 15 nt, Mycobacterium avium subsp. paratuberculosis
ccguccggcgccagc

SEQ ID NO: 3000229 - RNA, 14 nt, Mycobacterium avium subsp. paratuberculosis
ccguccggggccgg

SEQ ID NO: 3000230 - RNA, 23 nt, Mycobacterium avium subsp. paratuberculosis
ccguccgggguguaggcgucggc

SEQ ID NO: 3000231 - RNA, 18 nt, Mycobacterium avium subsp. paratuberculosis
ccguccgggucgcacagc

SEQ ID NO: 3000232 - RNA, 14 nt, Mycobacterium avium subsp. paratuberculosis
ccguccggguucga

SEQ ID NO: 3000233 - RNA, 22 nt, Mycobacterium avium subsp. paratuberculosis
ccguccggguucgacgccucgg

SEQ ID NO: 3000234 - RNA, 14 nt, Mycobacterium avium subsp. paratuberculosis
ccguccggucgcug

SEQ ID NO: 3000235 - RNA, 17 nt, Mycobacterium avium subsp. paratuberculosis
ccguccgguucggcggc

SEQ ID NO: 3000236 - RNA, 18 nt, Mycobacterium avium subsp. paratuberculosis
ccguccgguucggcggca

SEQ ID NO: 3000237 - RNA, 20 nt, Mycobacterium avium subsp. paratuberculosis
ccguccgguucggcggcaua

SEQ ID NO: 3000238 - RNA, 14 nt, Mycobacterium avium subsp. paratuberculosis
ccguccucggccgc

SEQ ID NO: 3000239 - RNA, 15 nt, Mycobacterium avium subsp. paratuberculosis
ccguccucggccgcc

SEQ ID NO: 3000240 - RNA, 21 nt, Mycobacterium avium subsp. paratuberculosis
ccguccucggccgccaccgcc

SEQ ID NO: 3000241 - RNA, 22 nt, Mycobacterium avium subsp. paratuberculosis
ccguccugagguauucgucgag

SEQ ID NO: 3000242 - RNA, 18 nt, Mycobacterium avium subsp. paratuberculosis
ccguccugggccuggcgc

SEQ ID NO: 3000243 - RNA, 15 nt, Mycobacterium avium subsp. paratuberculosis
ccguccuggucgucc

SEQ ID NO: 3000244 - RNA, 14 nt, Mycobacterium avium subsp. paratuberculosis
ccguccuuggccgc

SEQ ID NO: 3000245 - RNA, 16 nt, Mycobacterium avium subsp. paratuberculosis
ccguccuuggccgcca

SEQ ID NO: 3000246 - RNA, 15 nt, Mycobacterium avium subsp. paratuberculosis
ccguccuugggaagc

SEQ ID NO: 3000247 - RNA, 20 nt, Mycobacterium avium subsp. paratuberculosis
ccguccuuguaggugaucgu

SEQ ID NO: 3000248 - RNA, 15 nt, Mycobacterium avium subsp. paratuberculosis
ccguccuugucgcgc

SEQ ID NO: 3000249 - RNA, 21 nt, Mycobacterium avium subsp. paratuberculosis
ccguccuugucgcgcaccgcg

SEQ ID NO: 3000250 - RNA, 22 nt, Mycobacterium avium subsp. paratuberculosis
ccguccuugucgcgcaccgcgg

SEQ ID NO: 3000251 - RNA, 21 nt, Mycobacterium avium subsp. paratuberculosis
ccgucgaaaaacccggugccg

SEQ ID NO: 3000252 - RNA, 22 nt, Mycobacterium avium subsp. paratuberculosis
ccgucgaaaccgucuccggcgc

SEQ ID NO: 3000253 - RNA, 18 nt, Mycobacterium avium subsp. paratuberculosis
ccgucgaaacggcugcug

SEQ ID NO: 3000254 - RNA, 14 nt, Mycobacterium avium subsp. paratuberculosis
ccgucgaacagcgg

SEQ ID NO: 3000255 - RNA, 20 nt, Mycobacterium avium subsp. paratuberculosis
ccgucgaacagcgggcagag

SEQ ID NO: 3000256 - RNA, 19 nt, Mycobacterium avium subsp. paratuberculosis
ccgucgaacgagaaggcgg

SEQ ID NO: 3000257 - RNA, 17 nt, Mycobacterium avium subsp. paratuberculosis
ccgucgaacugcagccg

SEQ ID NO: 3000258 - RNA, 19 nt, Mycobacterium avium subsp. paratuberculosis
ccgucgaacugcagccggc

SEQ ID NO: 3000259 - RNA, 16 nt, Mycobacterium avium subsp. paratuberculosis
ccgucgaagagugcga

SEQ ID NO: 3000260 - RNA, 23 nt, Mycobacterium avium subsp. paratuberculosis
ccgucgaagaugaccugaucgag

SEQ ID NO: 3000261 - RNA, 17 nt, Mycobacterium avium subsp. paratuberculosis
ccgucgaaggccgggcu

SEQ ID NO: 3000262 - RNA, 21 nt, Mycobacterium avium subsp. paratuberculosis
ccgucgaauaggugaugucac

SEQ ID NO: 3000263 - RNA, 19 nt, Mycobacterium avium subsp. paratuberculosis
ccgucgaccaaugcgauca

SEQ ID NO: 3000264 - RNA, 12 nt, Mycobacterium avium subsp. paratuberculosis
ccgucgaccagc

SEQ ID NO: 3000265 - RNA, 19 nt, Mycobacterium avium subsp. paratuberculosis
ccgucgaccagcuugucga

SEQ ID NO: 3000266 - RNA, 15 nt, Mycobacterium avium subsp. paratuberculosis
ccgucgaccaggacg

SEQ ID NO: 3000267 - RNA, 20 nt, Mycobacterium avium subsp. paratuberculosis
ccgucgaccaggacgucggc

SEQ ID NO: 3000268 - RNA, 21 nt, Mycobacterium avium subsp. paratuberculosis
ccgucgaccaggacgucggcc

SEQ ID NO: 3000269 - RNA, 22 nt, Mycobacterium avium subsp. paratuberculosis
ccgucgaccaggacgucggccg

SEQ ID NO: 3000270 - RNA, 16 nt, Mycobacterium avium subsp. paratuberculosis
ccgucgaccccgccgg

SEQ ID NO: 3000271 - RNA, 17 nt, Mycobacterium avium subsp. paratuberculosis
ccgucgaccccgccggc

SEQ ID NO: 3000272 - RNA, 21 nt, Mycobacterium avium subsp. paratuberculosis
ccgucgacccguuccccggcc

SEQ ID NO: 3000273 - RNA, 22 nt, Mycobacterium avium subsp. paratuberculosis
ccgucgacccguuccccggccg

SEQ ID NO: 3000274 - RNA, 13 nt, Mycobacterium avium subsp. paratuberculosis
ccgucgaccgggu

SEQ ID NO: 3000275 - RNA, 16 nt, Mycobacterium avium subsp. paratuberculosis
ccgucgaccuccucga

SEQ ID NO: 3000276 - RNA, 21 nt, Mycobacterium avium subsp. paratuberculosis
ccgucgaccuccucgaccccg

SEQ ID NO: 3000277 - RNA, 12 nt, Mycobacterium avium subsp. paratuberculosis
ccgucgacgaac

SEQ ID NO: 3000278 - RNA, 14 nt, Mycobacterium avium subsp. paratuberculosis
ccgucgacgacggu

SEQ ID NO: 3000279 - RNA, 11 nt, Mycobacterium avium subsp. paratuberculosis
ccgucgacgcg

SEQ ID NO: 3000280 - RNA, 23 nt, Mycobacterium avium subsp. paratuberculosis
ccgucgacgcgugcgucaucgcg

SEQ ID NO: 3000281 - RNA, 13 nt, Mycobacterium avium subsp. paratuberculosis
ccgucgacgguga

SEQ ID NO: 3000282 - RNA, 16 nt, Mycobacterium avium subsp. paratuberculosis
ccgucgacucggcggu

SEQ ID NO: 3000283 - RNA, 19 nt, Mycobacterium avium subsp. paratuberculosis
ccgucgacucggcggugcc

SEQ ID NO: 3000284 - RNA, 21 nt, Mycobacterium avium subsp. paratuberculosis
ccgucgagcggcuugccgccg

SEQ ID NO: 3000285 - RNA, 22 nt, Mycobacterium avium subsp. paratuberculosis
ccgucgagcggcuugccgccgc

SEQ ID NO: 3000286 - RNA, 24 nt, Mycobacterium avium subsp. paratuberculosis
ccgucgagcggcuugccgccgcag

SEQ ID NO: 3000287 - RNA, 14 nt, Mycobacterium avium subsp. paratuberculosis
ccgucgagcgucac

SEQ ID NO: 3000288 - RNA, 17 nt, Mycobacterium avium subsp. paratuberculosis
ccgucgagcgucacgcc

SEQ ID NO: 3000289 - RNA, 20 nt, Mycobacterium avium subsp. paratuberculosis
ccgucgagcgucacgccgcg

SEQ ID NO: 3000290 - RNA, 22 nt, Mycobacterium avium subsp. paratuberculosis
ccgucgagcgucacgccgcgcc

SEQ ID NO: 3000291 - RNA, 19 nt, Mycobacterium avium subsp. paratuberculosis
ccgucgagcgucacgcugg

SEQ ID NO: 3000292 - RNA, 20 nt, Mycobacterium avium subsp. paratuberculosis
ccgucgagcgucacgcuggc

SEQ ID NO: 3000293 - RNA, 14 nt, Mycobacterium avium subsp. paratuberculosis
ccgucgagcgucau

SEQ ID NO: 3000294 - RNA, 21 nt, Mycobacterium avium subsp. paratuberculosis
ccgucgagcgucauuccgccg

SEQ ID NO: 3000295 - RNA, 23 nt, Mycobacterium avium subsp. paratuberculosis
ccgucgagcgucauuccgccgcg

SEQ ID NO: 3000296 - RNA, 18 nt, Mycobacterium avium subsp. paratuberculosis
ccgucgaggaauccgguc

SEQ ID NO: 3000297 - RNA, 19 nt, Mycobacterium avium subsp. paratuberculosis
ccgucgaguccguggucag

SEQ ID NO: 3000298 - RNA, 18 nt, Mycobacterium avium subsp. paratuberculosis
ccgucgagucggccaccg

SEQ ID NO: 3000299 - RNA, 12 nt, Mycobacterium avium subsp. paratuberculosis
ccgucgaucacc

SEQ ID NO: 3000300 - RNA, 19 nt, Mycobacterium avium subsp. paratuberculosis
ccgucgaucaccugcgggc

SEQ ID NO: 3000301 - RNA, 22 nt, Mycobacterium avium subsp. paratuberculosis
ccgucgaucccggacuccucgg

SEQ ID NO: 3000302 - RNA, 12 nt, Mycobacterium avium subsp. paratuberculosis
ccgucgaucgcc

SEQ ID NO: 3000303 - RNA, 16 nt, Mycobacterium avium subsp. paratuberculosis
ccgucgauggcgcggc

SEQ ID NO: 3000304 - RNA, 19 nt, Mycobacterium avium subsp. paratuberculosis
ccgucgauggcgcggccca

SEQ ID NO: 3000305 - RNA, 20 nt, Mycobacterium avium subsp. paratuberculosis
ccgucgauuucaaggggccg

SEQ ID NO: 3000306 - RNA, 22 nt, Mycobacterium avium subsp. paratuberculosis
ccgucgauuucaaggggccggg

SEQ ID NO: 3000307 - RNA, 18 nt, Mycobacterium avium subsp. paratuberculosis
ccgucgcaucagcucggc

SEQ ID NO: 3000308 - RNA, 12 nt, Mycobacterium avium subsp. paratuberculosis
ccgucgccacca

SEQ ID NO: 3000309 - RNA, 20 nt, Mycobacterium avium subsp. paratuberculosis
ccgucgccaccaccgcgccg

SEQ ID NO: 3000310 - RNA, 13 nt, Mycobacterium avium subsp. paratuberculosis
ccgucgccacgau

SEQ ID NO: 3000311 - RNA, 17 nt, Mycobacterium avium subsp. paratuberculosis
ccgucgccacgaucacc

SEQ ID NO: 3000312 - RNA, 15 nt, Mycobacterium avium subsp. paratuberculosis
ccgucgccccgcacc

SEQ ID NO: 3000313 - RNA, 16 nt, Mycobacterium avium subsp. paratuberculosis
ccgucgcccgcccagg

SEQ ID NO: 3000314 - RNA, 17 nt, Mycobacterium avium subsp. paratuberculosis
ccgucgcccgcccaggc

SEQ ID NO: 3000315 - RNA, 20 nt, Mycobacterium avium subsp. paratuberculosis
ccgucgcccgcccaggccgc

SEQ ID NO: 3000316 - RNA, 21 nt, Mycobacterium avium subsp. paratuberculosis
ccgucgcccgcccaggccgcc

SEQ ID NO: 3000317 - RNA, 23 nt, Mycobacterium avium subsp. paratuberculosis
ccgucgcccgcccaggccgccag

SEQ ID NO: 3000318 - RNA, 13 nt, Mycobacterium avium subsp. paratuberculosis
ccgucgccgacca

SEQ ID NO: 3000319 - RNA, 15 nt, Mycobacterium avium subsp. paratuberculosis
ccgucgccgaccagc

SEQ ID NO: 3000320 - RNA, 13 nt, Mycobacterium avium subsp. paratuberculosis
ccgucgccgauca

SEQ ID NO: 3000321 - RNA, 14 nt, Mycobacterium avium subsp. paratuberculosis
ccgucgccgcacgc

SEQ ID NO: 3000322 - RNA, 14 nt, Mycobacterium avium subsp. paratuberculosis
ccgucgccgccgug

SEQ ID NO: 3000323 - RNA, 12 nt, Mycobacterium avium subsp. paratuberculosis
ccgucgccggac

SEQ ID NO: 3000324 - RNA, 18 nt, Mycobacterium avium subsp. paratuberculosis
ccgucgccggcgcgcagc

SEQ ID NO: 3000325 - RNA, 15 nt, Mycobacterium avium subsp. paratuberculosis
ccgucgccgggcggg

SEQ ID NO: 3000326 - RNA, 22 nt, Mycobacterium avium subsp. paratuberculosis
ccgucgccgggcgggguggugg

SEQ ID NO: 3000327 - RNA, 12 nt, Mycobacterium avium subsp. paratuberculosis
ccgucgccgguc

SEQ ID NO: 3000328 - RNA, 17 nt, Mycobacterium avium subsp. paratuberculosis
ccgucgccgugcgucca

SEQ ID NO: 3000329 - RNA, 14 nt, Mycobacterium avium subsp. paratuberculosis
ccgucgcgaucaca

SEQ ID NO: 3000330 - RNA, 17 nt, Mycobacterium avium subsp. paratuberculosis
ccgucgcgaucgcgguc

SEQ ID NO: 3000331 - RNA, 14 nt, Mycobacterium avium subsp. paratuberculosis
ccgucgcgcaccac

SEQ ID NO: 3000332 - RNA, 19 nt, Mycobacterium avium subsp. paratuberculosis
ccgucgcgcaccaccucga

SEQ ID NO: 3000333 - RNA, 13 nt, Mycobacterium avium subsp. paratuberculosis
ccgucgcgcaccc

SEQ ID NO: 3000334 - RNA, 14 nt, Mycobacterium avium subsp. paratuberculosis
ccgucgcgcagccc

SEQ ID NO: 3000335 - RNA, 22 nt, Mycobacterium avium subsp. paratuberculosis
ccgucgcgccaggaccagcggg

SEQ ID NO: 3000336 - RNA, 17 nt, Mycobacterium avium subsp. paratuberculosis
ccgucgcggacccuggc

SEQ ID NO: 3000337 - RNA, 13 nt, Mycobacterium avium subsp. paratuberculosis
ccgucgcggcgcg

SEQ ID NO: 3000338 - RNA, 22 nt, Mycobacterium avium subsp. paratuberculosis
ccgucgcggcggugcgcagccg

SEQ ID NO: 3000339 - RNA, 14 nt, Mycobacterium avium subsp. paratuberculosis
ccgucgcgggagag

SEQ ID NO: 3000340 - RNA, 21 nt, Mycobacterium avium subsp. paratuberculosis
ccgucgcgggagagcgcgggc

SEQ ID NO: 3000341 - RNA, 22 nt, Mycobacterium avium subsp. paratuberculosis
ccgucgcgggagagcgcgggca

SEQ ID NO: 3000342 - RNA, 14 nt, Mycobacterium avium subsp. paratuberculosis
ccgucgcgggcguc

SEQ ID NO: 3000343 - RNA, 22 nt, Mycobacterium avium subsp. paratuberculosis
ccgucgcuguuggcgacggcgc

SEQ ID NO: 3000344 - RNA, 18 nt, Mycobacterium avium subsp. paratuberculosis
ccgucggaggacaacgcg

SEQ ID NO: 3000345 - RNA, 14 nt, Mycobacterium avium subsp. paratuberculosis
ccgucggcaacgcc

SEQ ID NO: 3000346 - RNA, 13 nt, Mycobacterium avium subsp. paratuberculosis
ccgucggcaguug

SEQ ID NO: 3000347 - RNA, 16 nt, Mycobacterium avium subsp. paratuberculosis
ccgucggcauccaccc

SEQ ID NO: 3000348 - RNA, 13 nt, Mycobacterium avium subsp. paratuberculosis
ccgucggccagca

SEQ ID NO: 3000349 - RNA, 15 nt, Mycobacterium avium subsp. paratuberculosis
ccgucggccagcagc

SEQ ID NO: 3000350 - RNA, 17 nt, Mycobacterium avium subsp. paratuberculosis
ccgucggccagcagcgc

SEQ ID NO: 3000351 - RNA, 20 nt, Mycobacterium avium subsp. paratuberculosis
ccgucggccaguucgccggu

SEQ ID NO: 3000352 - RNA, 16 nt, Mycobacterium avium subsp. paratuberculosis
ccgucggccaucagcc

SEQ ID NO: 3000353 - RNA, 17 nt, Mycobacterium avium subsp. paratuberculosis
ccgucggccaucagccg

SEQ ID NO: 3000354 - RNA, 14 nt, Mycobacterium avium subsp. paratuberculosis
ccgucggcccacgg

SEQ ID NO: 3000355 - RNA, 14 nt, Mycobacterium avium subsp. paratuberculosis
ccgucggcccgcca

SEQ ID NO: 3000356 - RNA, 13 nt, Mycobacterium avium subsp. paratuberculosis
ccgucggccgccg

SEQ ID NO: 3000357 - RNA, 15 nt, Mycobacterium avium subsp. paratuberculosis
ccgucggccgccgac

SEQ ID NO: 3000358 - RNA, 18 nt, Mycobacterium avium subsp. paratuberculosis
ccgucggccgccgacugu

SEQ ID NO: 3000359 - RNA, 19 nt, Mycobacterium avium subsp. paratuberculosis
ccgucggccuccagccggc

SEQ ID NO: 3000360 - RNA, 14 nt, Mycobacterium avium subsp. paratuberculosis
ccgucggccugcgc

SEQ ID NO: 3000361 - RNA, 12 nt, Mycobacterium avium subsp. paratuberculosis
ccgucggcgauc

SEQ ID NO: 3000362 - RNA, 16 nt, Mycobacterium avium subsp. paratuberculosis
ccgucggcgaucgccg

SEQ ID NO: 3000363 - RNA, 21 nt, Mycobacterium avium subsp. paratuberculosis
ccgucggcgaugcgguggucg

SEQ ID NO: 3000364 - RNA, 16 nt, Mycobacterium avium subsp. paratuberculosis
ccgucggcgaugguga

SEQ ID NO: 3000365 - RNA, 13 nt, Mycobacterium avium subsp. paratuberculosis
ccgucggcgcccg

SEQ ID NO: 3000366 - RNA, 16 nt, Mycobacterium avium subsp. paratuberculosis
ccgucggcgcccggca

SEQ ID NO: 3000367 - RNA, 17 nt, Mycobacterium avium subsp. paratuberculosis
ccgucggcgcccggcac

SEQ ID NO: 3000368 - RNA, 18 nt, Mycobacterium avium subsp. paratuberculosis
ccgucggcgcccggcacc

SEQ ID NO: 3000369 - RNA, 14 nt, Mycobacterium avium subsp. paratuberculosis
ccgucggcgccgcc

SEQ ID NO: 3000370 - RNA, 15 nt, Mycobacterium avium subsp. paratuberculosis
ccgucggcgccgccg

SEQ ID NO: 3000371 - RNA, 17 nt, Mycobacterium avium subsp. paratuberculosis
ccgucggcgcgaggcgg

SEQ ID NO: 3000372 - RNA, 20 nt, Mycobacterium avium subsp. paratuberculosis
ccgucggcgcgaggcgggua

SEQ ID NO: 3000373 - RNA, 13 nt, Mycobacterium avium subsp. paratuberculosis
ccgucggcgcggc

SEQ ID NO: 3000374 - RNA, 16 nt, Mycobacterium avium subsp. paratuberculosis
ccgucggcgcggccgg

SEQ ID NO: 3000375 - RNA, 11 nt, Mycobacterium avium subsp. paratuberculosis
ccgucggcggc

SEQ ID NO: 3000376 - RNA, 12 nt, Mycobacterium avium subsp. paratuberculosis
ccgucggcggcc

SEQ ID NO: 3000377 - RNA, 13 nt, Mycobacterium avium subsp. paratuberculosis
ccgucggcggccg

SEQ ID NO: 3000378 - RNA, 14 nt, Mycobacterium avium subsp. paratuberculosis
ccgucggcgggaug

SEQ ID NO: 3000379 - RNA, 12 nt, Mycobacterium avium subsp. paratuberculosis
ccgucggcgggg

SEQ ID NO: 3000380 - RNA, 23 nt, Mycobacterium avium subsp. paratuberculosis
ccgucggcgggggauccgccugc

SEQ ID NO: 3000381 - RNA, 15 nt, Mycobacterium avium subsp. paratuberculosis
ccgucggcgucgacg

SEQ ID NO: 3000382 - RNA, 16 nt, Mycobacterium avium subsp. paratuberculosis
ccgucggcgucgacga

SEQ ID NO: 3000383 - RNA, 17 nt, Mycobacterium avium subsp. paratuberculosis
ccgucggcgucgacgac

SEQ ID NO: 3000384 - RNA, 19 nt, Mycobacterium avium subsp. paratuberculosis
ccgucggcguucagcggca

SEQ ID NO: 3000385 - RNA, 20 nt, Mycobacterium avium subsp. paratuberculosis
ccgucggcguucagcggcac

SEQ ID NO: 3000386 - RNA, 22 nt, Mycobacterium avium subsp. paratuberculosis
ccgucggcguucagcggcaccg

SEQ ID NO: 3000387 - RNA, 17 nt, Mycobacterium avium subsp. paratuberculosis
ccgucggcuuccuccuc

SEQ ID NO: 3000388 - RNA, 18 nt, Mycobacterium avium subsp. paratuberculosis
ccgucggcuuccuccucg

SEQ ID NO: 3000389 - RNA, 20 nt, Mycobacterium avium subsp. paratuberculosis
ccgucggcuuccuccucggc

SEQ ID NO: 3000390 - RNA, 22 nt, Mycobacterium avium subsp. paratuberculosis
ccgucggcuuccuccucggcgc

SEQ ID NO: 3000391 - RNA, 19 nt, Mycobacterium avium subsp. paratuberculosis
ccgucgggacgcggcaggc

SEQ ID NO: 3000392 - RNA, 18 nt, Mycobacterium avium subsp. paratuberculosis
ccgucgggacggccagca

SEQ ID NO: 3000393 - RNA, 13 nt, Mycobacterium avium subsp. paratuberculosis
ccgucgggccguc

SEQ ID NO: 3000394 - RNA, 16 nt, Mycobacterium avium subsp. paratuberculosis
ccgucgggccguccgc

SEQ ID NO: 3000395 - RNA, 19 nt, Mycobacterium avium subsp. paratuberculosis
ccgucgggccguccgccgg

SEQ ID NO: 3000396 - RNA, 20 nt, Mycobacterium avium subsp. paratuberculosis
ccgucgggccguccgccggc

SEQ ID NO: 3000397 - RNA, 23 nt, Mycobacterium avium subsp. paratuberculosis
ccgucgggccguccgccggcugg

SEQ ID NO: 3000398 - RNA, 15 nt, Mycobacterium avium subsp. paratuberculosis
ccgucgggcgcggcg

SEQ ID NO: 3000399 - RNA, 17 nt, Mycobacterium avium subsp. paratuberculosis
ccgucgggcgcggcggc

SEQ ID NO: 3000400 - RNA, 19 nt, Mycobacterium avium subsp. paratuberculosis
ccgucgggcgggguggcca

SEQ ID NO: 3000401 - RNA, 22 nt, Mycobacterium avium subsp. paratuberculosis
ccgucggggaugccgaaccgcu

SEQ ID NO: 3000402 - RNA, 13 nt, Mycobacterium avium subsp. paratuberculosis
ccgucggggcccg

SEQ ID NO: 3000403 - RNA, 15 nt, Mycobacterium avium subsp. paratuberculosis
ccgucggggcccggc

SEQ ID NO: 3000404 - RNA, 16 nt, Mycobacterium avium subsp. paratuberculosis
ccgucggggcccggcc

SEQ ID NO: 3000405 - RNA, 17 nt, Mycobacterium avium subsp. paratuberculosis
ccgucggggcccggccc

SEQ ID NO: 3000406 - RNA, 22 nt, Mycobacterium avium subsp. paratuberculosis
ccgucggggcccggcccggcga

SEQ ID NO: 3000407 - RNA, 14 nt, Mycobacterium avium subsp. paratuberculosis
ccgucggggcugag

SEQ ID NO: 3000408 - RNA, 17 nt, Mycobacterium avium subsp. paratuberculosis
ccgucggggucgcgccg

SEQ ID NO: 3000409 - RNA, 19 nt, Mycobacterium avium subsp. paratuberculosis
ccgucggggucgcgccggu

SEQ ID NO: 3000410 - RNA, 15 nt, Mycobacterium avium subsp. paratuberculosis
ccgucggggugcgcc

SEQ ID NO: 3000411 - RNA, 16 nt, Mycobacterium avium subsp. paratuberculosis
ccgucggggugcgcca

SEQ ID NO: 3000412 - RNA, 23 nt, Mycobacterium avium subsp. paratuberculosis
ccgucggggugcgccaggcaggc

SEQ ID NO: 3000413 - RNA, 18 nt, Mycobacterium avium subsp. paratuberculosis
ccgucggggugcggucgg

SEQ ID NO: 3000414 - RNA, 21 nt, Mycobacterium avium subsp. paratuberculosis
ccgucggggugcggucggcga

SEQ ID NO: 3000415 - RNA, 23 nt, Mycobacterium avium subsp. paratuberculosis
ccgucggggugcggucggcgacg

SEQ ID NO: 3000416 - RNA, 15 nt, Mycobacterium avium subsp. paratuberculosis
ccgucgggucggcga

SEQ ID NO: 3000417 - RNA, 17 nt, Mycobacterium avium subsp. paratuberculosis
ccgucgggucggcgagc

SEQ ID NO: 3000418 - RNA, 18 nt, Mycobacterium avium subsp. paratuberculosis
ccgucgggucggcgagca

SEQ ID NO: 3000419 - RNA, 20 nt, Mycobacterium avium subsp. paratuberculosis
ccgucgggucggcgagcagc

SEQ ID NO: 3000420 - RNA, 16 nt, Mycobacterium avium subsp. paratuberculosis
ccgucgguaucgaggu

SEQ ID NO: 3000421 - RNA, 18 nt, Mycobacterium avium subsp. paratuberculosis
ccgucggucccgacgcgg

SEQ ID NO: 3000422 - RNA, 13 nt, Mycobacterium avium subsp. paratuberculosis
ccgucggucgggc

SEQ ID NO: 3000423 - RNA, 22 nt, Mycobacterium avium subsp. paratuberculosis
ccgucggucgggcagugcacga

SEQ ID NO: 3000424 - RNA, 20 nt, Mycobacterium avium subsp. paratuberculosis
ccgucggugaaguuggcggc

SEQ ID NO: 3000425 - RNA, 22 nt, Mycobacterium avium subsp. paratuberculosis
ccgucggugaaguuggcggcgg

SEQ ID NO: 3000426 - RNA, 20 nt, Mycobacterium avium subsp. paratuberculosis
ccgucggugcggggcggguu

SEQ ID NO: 3000427 - RNA, 23 nt, Mycobacterium avium subsp. paratuberculosis
ccgucggugcgguaggugccggc

SEQ ID NO: 3000428 - RNA, 14 nt, Mycobacterium avium subsp. paratuberculosis
ccgucgguggccgg

SEQ ID NO: 3000429 - RNA, 15 nt, Mycobacterium avium subsp. paratuberculosis
ccgucgguggccggu

SEQ ID NO: 3000430 - RNA, 13 nt, Mycobacterium avium subsp. paratuberculosis
ccgucgguggcgg

SEQ ID NO: 3000431 - RNA, 22 nt, Mycobacterium avium subsp. paratuberculosis
ccgucgguggcgguggggccga

SEQ ID NO: 3000432 - RNA, 14 nt, Mycobacterium avium subsp. paratuberculosis
ccgucggugggggc

SEQ ID NO: 3000433 - RNA, 21 nt, Mycobacterium avium subsp. paratuberculosis
ccgucggugggggccaggcgg

SEQ ID NO: 3000434 - RNA, 23 nt, Mycobacterium avium subsp. paratuberculosis
ccgucgguguagcgagugccggc

SEQ ID NO: 3000435 - RNA, 15 nt, Mycobacterium avium subsp. paratuberculosis
ccgucgguguccagg

SEQ ID NO: 3000436 - RNA, 22 nt, Mycobacterium avium subsp. paratuberculosis
ccgucgguuucggucgcgguga

SEQ ID NO: 3000437 - RNA, 24 nt, Mycobacterium avium subsp. paratuberculosis
ccgucgguuucggucgcggugauc

SEQ ID NO: 3000438 - RNA, 16 nt, Mycobacterium avium subsp. paratuberculosis
ccgucguacucgaccg

SEQ ID NO: 3000439 - RNA, 18 nt, Mycobacterium avium subsp. paratuberculosis
ccgucguacucgaccgcg

SEQ ID NO: 3000440 - RNA, 19 nt, Mycobacterium avium subsp. paratuberculosis
ccgucguacucgaccgcga

SEQ ID NO: 3000441 - RNA, 21 nt, Mycobacterium avium subsp. paratuberculosis
ccgucguacucgaccgcgacu

SEQ ID NO: 3000442 - RNA, 13 nt, Mycobacterium avium subsp. paratuberculosis
ccgucguagccgc

SEQ ID NO: 3000443 - RNA, 17 nt, Mycobacterium avium subsp. paratuberculosis
ccgucguauucgacggc

SEQ ID NO: 3000444 - RNA, 18 nt, Mycobacterium avium subsp. paratuberculosis
ccgucguauucgacggcg

SEQ ID NO: 3000445 - RNA, 19 nt, Mycobacterium avium subsp. paratuberculosis
ccgucguauucgacggcga

SEQ ID NO: 3000446 - RNA, 14 nt, Mycobacterium avium subsp. paratuberculosis
ccgucgucagccgg

SEQ ID NO: 3000447 - RNA, 18 nt, Mycobacterium avium subsp. paratuberculosis
ccgucguccacgcccagc

SEQ ID NO: 3000448 - RNA, 18 nt, Mycobacterium avium subsp. paratuberculosis
ccgucgucccggugauga

SEQ ID NO: 3000449 - RNA, 21 nt, Mycobacterium avium subsp. paratuberculosis
ccgucguccuugagcccccac

SEQ ID NO: 3000450 - RNA, 15 nt, Mycobacterium avium subsp. paratuberculosis
ccgucgucgagcacc

SEQ ID NO: 3000451 - RNA, 20 nt, Mycobacterium avium subsp. paratuberculosis
ccgucgucgagcaccacccg

SEQ ID NO: 3000452 - RNA, 21 nt, Mycobacterium avium subsp. paratuberculosis
ccgucgucgagcaccacccgg

SEQ ID NO: 3000453 - RNA, 23 nt, Mycobacterium avium subsp. paratuberculosis
ccgucgucgagcaccacccgggu

SEQ ID NO: 3000454 - RNA, 18 nt, Mycobacterium avium subsp. paratuberculosis
ccgucgucgagcgcucgc

SEQ ID NO: 3000455 - RNA, 13 nt, Mycobacterium avium subsp. paratuberculosis
ccgucgucgcacc

SEQ ID NO: 3000456 - RNA, 16 nt, Mycobacterium avium subsp. paratuberculosis
ccgucgucgcaccggc

SEQ ID NO: 3000457 - RNA, 14 nt, Mycobacterium avium subsp. paratuberculosis
ccgucgucgccgau

SEQ ID NO: 3000458 - RNA, 19 nt, Mycobacterium avium subsp. paratuberculosis
ccgucgucggacaccagca

SEQ ID NO: 3000459 - RNA, 15 nt, Mycobacterium avium subsp. paratuberculosis
ccgucgucggucagc

SEQ ID NO: 3000460 - RNA, 22 nt, Mycobacterium avium subsp. paratuberculosis
ccgucgucggucucuucgaccc

SEQ ID NO: 3000461 - RNA, 22 nt, Mycobacterium avium subsp. paratuberculosis
ccgucgucguccgcaaccgccg

SEQ ID NO: 3000462 - RNA, 23 nt, Mycobacterium avium subsp. paratuberculosis
ccgucgucguccgcaaccgccgg

SEQ ID NO: 3000463 - RNA, 13 nt, Mycobacterium avium subsp. paratuberculosis
ccgucgucgucgg

SEQ ID NO: 3000464 - RNA, 15 nt, Mycobacterium avium subsp. paratuberculosis
ccgucgucgucggcc

SEQ ID NO: 3000465 - RNA, 21 nt, Mycobacterium avium subsp. paratuberculosis
ccgucgucgucggccgggccg

SEQ ID NO: 3000466 - RNA, 21 nt, Mycobacterium avium subsp. paratuberculosis
ccgucgucgugcaccacgacg

SEQ ID NO: 3000467 - RNA, 17 nt, Mycobacterium avium subsp. paratuberculosis
ccgucgucguuguuggc

SEQ ID NO: 3000468 - RNA, 21 nt, Mycobacterium avium subsp. paratuberculosis
ccgucgucguuguuggcggcg

SEQ ID NO: 3000469 - RNA, 17 nt, Mycobacterium avium subsp. paratuberculosis
ccgucgugccagcgcag

SEQ ID NO: 3000470 - RNA, 13 nt, Mycobacterium avium subsp. paratuberculosis
ccgucgugcucgg

SEQ ID NO: 3000471 - RNA, 20 nt, Mycobacterium avium subsp. paratuberculosis
ccgucguggguauccgccgc

SEQ ID NO: 3000472 - RNA, 21 nt, Mycobacterium avium subsp. paratuberculosis
ccgucguggguauccgccgcc

SEQ ID NO: 3000473 - RNA, 17 nt, Mycobacterium avium subsp. paratuberculosis
ccgucgugguggccgcg

SEQ ID NO: 3000474 - RNA, 18 nt, Mycobacterium avium subsp. paratuberculosis
ccgucgugguggccgcga

SEQ ID NO: 3000475 - RNA, 20 nt, Mycobacterium avium subsp. paratuberculosis
ccgucguucuccauccgggc

SEQ ID NO: 3000476 - RNA, 20 nt, Mycobacterium avium subsp. paratuberculosis
ccgucguugaaggccugcag

SEQ ID NO: 3000477 - RNA, 22 nt, Mycobacterium avium subsp. paratuberculosis
ccgucguugacgcccuccuggc

SEQ ID NO: 3000478 - RNA, 21 nt, Mycobacterium avium subsp. paratuberculosis
ccgucguugcgggcggcgcgg

SEQ ID NO: 3000479 - RNA, 22 nt, Mycobacterium avium subsp. paratuberculosis
ccgucuagcggcguguuguagu

SEQ ID NO: 3000480 - RNA, 21 nt, Mycobacterium avium subsp. paratuberculosis
ccgucucaggaauuugcggcc

SEQ ID NO: 3000481 - RNA, 22 nt, Mycobacterium avium subsp. paratuberculosis
ccgucucaggaauuugcggccc

SEQ ID NO: 3000482 - RNA, 23 nt, Mycobacterium avium subsp. paratuberculosis
ccgucucaggaauuugcggcccg

SEQ ID NO: 3000483 - RNA, 17 nt, Mycobacterium avium subsp. paratuberculosis
ccgucuccggcguaucu

SEQ ID NO: 3000484 - RNA, 17 nt, Mycobacterium avium subsp. paratuberculosis
ccgucucgaccacccgg

SEQ ID NO: 3000485 - RNA, 20 nt, Mycobacterium avium subsp. paratuberculosis
ccgucucgaccacccggcgg

SEQ ID NO: 3000486 - RNA, 16 nt, Mycobacterium avium subsp. paratuberculosis
ccgucucgacccgggc

SEQ ID NO: 3000487 - RNA, 17 nt, Mycobacterium avium subsp. paratuberculosis
ccgucucgacccgggcc

SEQ ID NO: 3000488 - RNA, 15 nt, Mycobacterium avium subsp. paratuberculosis
ccgucucgagccggc

SEQ ID NO: 3000489 - RNA, 18 nt, Mycobacterium avium subsp. paratuberculosis
ccgucucgagccggcgca

SEQ ID NO: 3000490 - RNA, 19 nt, Mycobacterium avium subsp. paratuberculosis
ccgucucgagcuuccgccg

SEQ ID NO: 3000491 - RNA, 21 nt, Mycobacterium avium subsp. paratuberculosis
ccgucucgagcuuccgccgag

SEQ ID NO: 3000492 - RNA, 12 nt, Mycobacterium avium subsp. paratuberculosis
ccgucucgccgu

SEQ ID NO: 3000493 - RNA, 18 nt, Mycobacterium avium subsp. paratuberculosis
ccgucucggcgugcucgg

SEQ ID NO: 3000494 - RNA, 16 nt, Mycobacterium avium subsp. paratuberculosis
ccgucucgucggccgc

SEQ ID NO: 3000495 - RNA, 18 nt, Mycobacterium avium subsp. paratuberculosis
ccgucucgucggccgcga

SEQ ID NO: 3000496 - RNA, 15 nt, Mycobacterium avium subsp. paratuberculosis
ccgucugcgccguca

SEQ ID NO: 3000497 - RNA, 16 nt, Mycobacterium avium subsp. paratuberculosis
ccgucugcgccgucac

SEQ ID NO: 3000498 - RNA, 20 nt, Mycobacterium avium subsp. paratuberculosis
ccgucugcgccgucaccggc

SEQ ID NO: 3000499 - RNA, 23 nt, Mycobacterium avium subsp. paratuberculosis
ccgucugcgccgucaccggcugc

SEQ ID NO: 3000500 - RNA, 14 nt, Mycobacterium avium subsp. paratuberculosis
ccgucugcuggccc

SEQ ID NO: 3000501 - RNA, 18 nt, Mycobacterium avium subsp. paratuberculosis
ccgucuuccgggccaccg

SEQ ID NO: 3000502 - RNA, 17 nt, Mycobacterium avium subsp. paratuberculosis
ccgucuucggggccgcc

SEQ ID NO: 3000503 - RNA, 20 nt, Mycobacterium avium subsp. paratuberculosis
ccgucuucggggccgccguc

SEQ ID NO: 3000504 - RNA, 21 nt, Mycobacterium avium subsp. paratuberculosis
ccgucuucggggccgccgucg

SEQ ID NO: 3000505 - RNA, 17 nt, Mycobacterium avium subsp. paratuberculosis
ccgucuucuucagccgc

SEQ ID NO: 3000506 - RNA, 18 nt, Mycobacterium avium subsp. paratuberculosis
ccgucuucuucagccgca

SEQ ID NO: 3000507 - RNA, 15 nt, Mycobacterium avium subsp. paratuberculosis
ccgucuugcccggcg

SEQ ID NO: 3000508 - RNA, 14 nt, Mycobacterium avium subsp. paratuberculosis
ccgucuuggccagg

SEQ ID NO: 3000509 - RNA, 17 nt, Mycobacterium avium subsp. paratuberculosis
ccgucuuggucucgccg

SEQ ID NO: 3000510 - RNA, 19 nt, Mycobacterium avium subsp. paratuberculosis
ccgucuuggucucgccgau

SEQ ID NO: 3000511 - RNA, 20 nt, Mycobacterium avium subsp. paratuberculosis
ccgucuuggucucgccgauc

SEQ ID NO: 3000512 - RNA, 18 nt, Mycobacterium avium subsp. paratuberculosis
ccgucuuguuggucagcc

SEQ ID NO: 3000513 - RNA, 13 nt, Mycobacterium avium subsp. paratuberculosis
ccgugaaccggcg

SEQ ID NO: 3000514 - RNA, 15 nt, Mycobacterium avium subsp. paratuberculosis
ccgugaaccggcguu

SEQ ID NO: 3000515 - RNA, 18 nt, Mycobacterium avium subsp. paratuberculosis
ccgugaacugugcggugc

SEQ ID NO: 3000516 - RNA, 13 nt, Mycobacterium avium subsp. paratuberculosis
ccgugaccccgga

SEQ ID NO: 3000517 - RNA, 21 nt, Mycobacterium avium subsp. paratuberculosis
ccgugacccgccgugaccggc

SEQ ID NO: 3000518 - RNA, 14 nt, Mycobacterium avium subsp. paratuberculosis
ccgugaccggcgau

SEQ ID NO: 3000519 - RNA, 14 nt, Mycobacterium avium subsp. paratuberculosis
ccgugacgccgauc

SEQ ID NO: 3000520 - RNA, 14 nt, Mycobacterium avium subsp. paratuberculosis
ccgugacggcaucg

SEQ ID NO: 3000521 - RNA, 16 nt, Mycobacterium avium subsp. paratuberculosis
ccgugacggcaucggc

SEQ ID NO: 3000522 - RNA, 13 nt, Mycobacterium avium subsp. paratuberculosis
ccgugacggugcg

SEQ ID NO: 3000523 - RNA, 19 nt, Mycobacterium avium subsp. paratuberculosis
ccgugagauccagcagcca

SEQ ID NO: 3000524 - RNA, 14 nt, Mycobacterium avium subsp. paratuberculosis
ccgugaggcccggc

SEQ ID NO: 3000525 - RNA, 15 nt, Mycobacterium avium subsp. paratuberculosis
ccgugaggcccggcg

SEQ ID NO: 3000526 - RNA, 17 nt, Mycobacterium avium subsp. paratuberculosis
ccgugaggcccggcgug

SEQ ID NO: 3000527 - RNA, 18 nt, Mycobacterium avium subsp. paratuberculosis
ccgugaggcccggcgugg

SEQ ID NO: 3000528 - RNA, 21 nt, Mycobacterium avium subsp. paratuberculosis
ccgugaguguugaagccgcgg

SEQ ID NO: 3000529 - RNA, 13 nt, Mycobacterium avium subsp. paratuberculosis
ccgugaucgccac

SEQ ID NO: 3000530 - RNA, 15 nt, Mycobacterium avium subsp. paratuberculosis
ccgugaucgccacca

SEQ ID NO: 3000531 - RNA, 18 nt, Mycobacterium avium subsp. paratuberculosis
ccgugaucgccaccacca

SEQ ID NO: 3000532 - RNA, 23 nt, Mycobacterium avium subsp. paratuberculosis
ccgugaucgccacggcggugucg

SEQ ID NO: 3000533 - RNA, 17 nt, Mycobacterium avium subsp. paratuberculosis
ccgugaucggccagcca

SEQ ID NO: 3000534 - RNA, 21 nt, Mycobacterium avium subsp. paratuberculosis
ccgugaucucgugccgcaccc

SEQ ID NO: 3000535 - RNA, 18 nt, Mycobacterium avium subsp. paratuberculosis
ccgugaucuggugggcgg

SEQ ID NO: 3000536 - RNA, 22 nt, Mycobacterium avium subsp. paratuberculosis
ccgugaucuggugggcgggcac

SEQ ID NO: 3000537 - RNA, 13 nt, Mycobacterium avium subsp. paratuberculosis
ccgugaugccggg

SEQ ID NO: 3000538 - RNA, 14 nt, Mycobacterium avium subsp. paratuberculosis
ccgugaugcgccgg

SEQ ID NO: 3000539 - RNA, 16 nt, Mycobacterium avium subsp. paratuberculosis
ccgugaugcgccggcg

SEQ ID NO: 3000540 - RNA, 17 nt, Mycobacterium avium subsp. paratuberculosis
ccgugaugcgccggcgg

SEQ ID NO: 3000541 - RNA, 17 nt, Mycobacterium avium subsp. paratuberculosis
ccgugcaccgucgccgg

SEQ ID NO: 3000542 - RNA, 18 nt, Mycobacterium avium subsp. paratuberculosis
ccgugcaccgucgccggc

SEQ ID NO: 3000543 - RNA, 20 nt, Mycobacterium avium subsp. paratuberculosis
ccgugcaccgucgccggcgg

SEQ ID NO: 3000544 - RNA, 16 nt, Mycobacterium avium subsp. paratuberculosis
ccgugcacgaucgcgg

SEQ ID NO: 3000545 - RNA, 16 nt, Mycobacterium avium subsp. paratuberculosis
ccgugcacgccgucgu

SEQ ID NO: 3000546 - RNA, 14 nt, Mycobacterium avium subsp. paratuberculosis
ccgugcacggccaa

SEQ ID NO: 3000547 - RNA, 16 nt, Mycobacterium avium subsp. paratuberculosis
ccgugcagaacagcac

SEQ ID NO: 3000548 - RNA, 18 nt, Mycobacterium avium subsp. paratuberculosis
ccgugcagaacagcacga

SEQ ID NO: 3000549 - RNA, 21 nt, Mycobacterium avium subsp. paratuberculosis
ccgugcagcaccucgaagccg

SEQ ID NO: 3000550 - RNA, 14 nt, Mycobacterium avium subsp. paratuberculosis
ccgugcagcacgcc

SEQ ID NO: 3000551 - RNA, 17 nt, Mycobacterium avium subsp. paratuberculosis
ccgugcagccgggccug

SEQ ID NO: 3000552 - RNA, 21 nt, Mycobacterium avium subsp. paratuberculosis
ccgugcagccgggccugcagc

SEQ ID NO: 3000553 - RNA, 12 nt, Mycobacterium avium subsp. paratuberculosis
ccgugcagcgcc

SEQ ID NO: 3000554 - RNA, 16 nt, Mycobacterium avium subsp. paratuberculosis
ccgugcagcgcccagc

SEQ ID NO: 3000555 - RNA, 19 nt, Mycobacterium avium subsp. paratuberculosis
ccgugcagcgcccagccga

SEQ ID NO: 3000556 - RNA, 21 nt, Mycobacterium avium subsp. paratuberculosis
ccgugcaggaugaccgcgucg

SEQ ID NO: 3000557 - RNA, 22 nt, Mycobacterium avium subsp. paratuberculosis
ccgugcaggaugaccgcgucgg

SEQ ID NO: 3000558 - RNA, 16 nt, Mycobacterium avium subsp. paratuberculosis
ccgugcauccagccgu

SEQ ID NO: 3000559 - RNA, 21 nt, Mycobacterium avium subsp. paratuberculosis
ccgugcauguagguggcgacc

SEQ ID NO: 3000560 - RNA, 16 nt, Mycobacterium avium subsp. paratuberculosis
ccgugccacggccgcg

SEQ ID NO: 3000561 - RNA, 17 nt, Mycobacterium avium subsp. paratuberculosis
ccgugccacggccgcgg

SEQ ID NO: 3000562 - RNA, 15 nt, Mycobacterium avium subsp. paratuberculosis
ccgugccagccggcc

SEQ ID NO: 3000563 - RNA, 19 nt, Mycobacterium avium subsp. paratuberculosis
ccgugccagccggccgcug

SEQ ID NO: 3000564 - RNA, 19 nt, Mycobacterium avium subsp. paratuberculosis
ccgugcccaacacgccccg

SEQ ID NO: 3000565 - RNA, 12 nt, Mycobacterium avium subsp. paratuberculosis
ccgugcccacca

SEQ ID NO: 3000566 - RNA, 17 nt, Mycobacterium avium subsp. paratuberculosis
ccgugcccaccagccgg

SEQ ID NO: 3000567 - RNA, 19 nt, Mycobacterium avium subsp. paratuberculosis
ccgugcccaccagccggcc

SEQ ID NO: 3000568 - RNA, 15 nt, Mycobacterium avium subsp. paratuberculosis
ccgugccccagguag

SEQ ID NO: 3000569 - RNA, 16 nt, Mycobacterium avium subsp. paratuberculosis
ccgugccccaggucgg

SEQ ID NO: 3000570 - RNA, 16 nt, Mycobacterium avium subsp. paratuberculosis
ccgugcccgagccgau

SEQ ID NO: 3000571 - RNA, 17 nt, Mycobacterium avium subsp. paratuberculosis
ccgugcccggcgcccug

SEQ ID NO: 3000572 - RNA, 19 nt, Mycobacterium avium subsp. paratuberculosis
ccgugccgaugccggccug

SEQ ID NO: 3000573 - RNA, 21 nt, Mycobacterium avium subsp. paratuberculosis
ccgugccgauggccaccgggc

SEQ ID NO: 3000574 - RNA, 12 nt, Mycobacterium avium subsp. paratuberculosis
ccgugccgcgcg

SEQ ID NO: 3000575 - RNA, 14 nt, Mycobacterium avium subsp. paratuberculosis
ccgugccgcgcggc

SEQ ID NO: 3000576 - RNA, 16 nt, Mycobacterium avium subsp. paratuberculosis
ccgugccgcgcggcga

SEQ ID NO: 3000577 - RNA, 17 nt, Mycobacterium avium subsp. paratuberculosis
ccgugccgcgcggcgau

SEQ ID NO: 3000578 - RNA, 22 nt, Mycobacterium avium subsp. paratuberculosis
ccgugccgcgcggcgauggccg

SEQ ID NO: 3000579 - RNA, 17 nt, Mycobacterium avium subsp. paratuberculosis
ccgugccggaccgcgcg

SEQ ID NO: 3000580 - RNA, 23 nt, Mycobacterium avium subsp. paratuberculosis
ccgugccgguggaacaguucggu

SEQ ID NO: 3000581 - RNA, 12 nt, Mycobacterium avium subsp. paratuberculosis
ccgugccgucgc

SEQ ID NO: 3000582 - RNA, 16 nt, Mycobacterium avium subsp. paratuberculosis
ccgugccgucgcgggc

SEQ ID NO: 3000583 - RNA, 15 nt, Mycobacterium avium subsp. paratuberculosis
ccgugccgucggcgu

SEQ ID NO: 3000584 - RNA, 16 nt, Mycobacterium avium subsp. paratuberculosis
ccgugccgucggcguc

SEQ ID NO: 3000585 - RNA, 19 nt, Mycobacterium avium subsp. paratuberculosis
ccgugccgucggcgucgac

SEQ ID NO: 3000586 - RNA, 22 nt, Mycobacterium avium subsp. paratuberculosis
ccgugccucgccacugggcguc

SEQ ID NO: 3000587 - RNA, 20 nt, Mycobacterium avium subsp. paratuberculosis
ccgugccuuacgccgggguc

SEQ ID NO: 3000588 - RNA, 19 nt, Mycobacterium avium subsp. paratuberculosis
ccgugcgacuugguggcca

SEQ ID NO: 3000589 - RNA, 21 nt, Mycobacterium avium subsp. paratuberculosis
ccgugcgacuugguggccagc

SEQ ID NO: 3000590 - RNA, 22 nt, Mycobacterium avium subsp. paratuberculosis
ccgugcgacuugguggccagca

SEQ ID NO: 3000591 - RNA, 17 nt, Mycobacterium avium subsp. paratuberculosis
ccgugcgccgcccacac

SEQ ID NO: 3000592 - RNA, 21 nt, Mycobacterium avium subsp. paratuberculosis
ccgugcgccgcccacaccgac

SEQ ID NO: 3000593 - RNA, 15 nt, Mycobacterium avium subsp. paratuberculosis
ccgugcgccucgauc

SEQ ID NO: 3000594 - RNA, 16 nt, Mycobacterium avium subsp. paratuberculosis
ccgugcgcgcgcaccu

SEQ ID NO: 3000595 - RNA, 16 nt, Mycobacterium avium subsp. paratuberculosis
ccgugcgcgcuggugc

SEQ ID NO: 3000596 - RNA, 16 nt, Mycobacterium avium subsp. paratuberculosis
ccgugcgcggcgacca

SEQ ID NO: 3000597 - RNA, 22 nt, Mycobacterium avium subsp. paratuberculosis
ccgugcgcggcgaccaccucgg

SEQ ID NO: 3000598 - RNA, 12 nt, Mycobacterium avium subsp. paratuberculosis
ccgugcgcgucg

SEQ ID NO: 3000599 - RNA, 15 nt, Mycobacterium avium subsp. paratuberculosis
ccgugcgcgucgaca

SEQ ID NO: 3000600 - RNA, 21 nt, Mycobacterium avium subsp. paratuberculosis
ccgugcggagaucgugcugug

SEQ ID NO: 3000601 - RNA, 22 nt, Mycobacterium avium subsp. paratuberculosis
ccgugcggcguucggugcccgg

SEQ ID NO: 3000602 - RNA, 16 nt, Mycobacterium avium subsp. paratuberculosis
ccgugcggggccucgu

SEQ ID NO: 3000603 - RNA, 21 nt, Mycobacterium avium subsp. paratuberculosis
ccgugcggggccucgucgccg

SEQ ID NO: 3000604 - RNA, 14 nt, Mycobacterium avium subsp. paratuberculosis
ccgugcucggcggc

SEQ ID NO: 3000605 - RNA, 21 nt, Mycobacterium avium subsp. paratuberculosis
ccgugcugccggaacgagccg

SEQ ID NO: 3000606 - RNA, 16 nt, Mycobacterium avium subsp. paratuberculosis
ccgugcugccggccgg

SEQ ID NO: 3000607 - RNA, 17 nt, Mycobacterium avium subsp. paratuberculosis
ccgugcugccggccggc

SEQ ID NO: 3000608 - RNA, 18 nt, Mycobacterium avium subsp. paratuberculosis
ccgugcugccggccggca

SEQ ID NO: 3000609 - RNA, 15 nt, Mycobacterium avium subsp. paratuberculosis
ccgugcuggccacca

SEQ ID NO: 3000610 - RNA, 18 nt, Mycobacterium avium subsp. paratuberculosis
ccgugcuggccaccacgg

SEQ ID NO: 3000611 - RNA, 15 nt, Mycobacterium avium subsp. paratuberculosis
ccgugcuguacgaca

SEQ ID NO: 3000612 - RNA, 19 nt, Mycobacterium avium subsp. paratuberculosis
ccgugcuuccauucacggu

SEQ ID NO: 3000613 - RNA, 14 nt, Mycobacterium avium subsp. paratuberculosis
ccgugcuuggcggc

SEQ ID NO: 3000614 - RNA, 22 nt, Mycobacterium avium subsp. paratuberculosis
ccgugcuuggcggcgcacucca

SEQ ID NO: 3000615 - RNA, 19 nt, Mycobacterium avium subsp. paratuberculosis
ccguggaagauguugccgc

SEQ ID NO: 3000616 - RNA, 15 nt, Mycobacterium avium subsp. paratuberculosis
ccguggaagucgccg

SEQ ID NO: 3000617 - RNA, 19 nt, Mycobacterium avium subsp. paratuberculosis
ccguggaagucgccguccg

SEQ ID NO: 3000618 - RNA, 13 nt, Mycobacterium avium subsp. paratuberculosis
ccguggacccgcc

SEQ ID NO: 3000619 - RNA, 18 nt, Mycobacterium avium subsp. paratuberculosis
ccguggacccgccccgac

SEQ ID NO: 3000620 - RNA, 13 nt, Mycobacterium avium subsp. paratuberculosis
ccguggacggcga

SEQ ID NO: 3000621 - RNA, 16 nt, Mycobacterium avium subsp. paratuberculosis
ccguggacggcgagcg

SEQ ID NO: 3000622 - RNA, 18 nt, Mycobacterium avium subsp. paratuberculosis
ccguggacggcgagcggc

SEQ ID NO: 3000623 - RNA, 21 nt, Mycobacterium avium subsp. paratuberculosis
ccguggacggcgagcggcccu

SEQ ID NO: 3000624 - RNA, 14 nt, Mycobacterium avium subsp. paratuberculosis
ccguggagacgucc

SEQ ID NO: 3000625 - RNA, 17 nt, Mycobacterium avium subsp. paratuberculosis
ccguggaucaucccgac

SEQ ID NO: 3000626 - RNA, 11 nt, Mycobacterium avium subsp. paratuberculosis
ccguggcaggc

SEQ ID NO: 3000627 - RNA, 19 nt, Mycobacterium avium subsp. paratuberculosis
ccguggcaggcacgagcga

SEQ ID NO: 3000628 - RNA, 13 nt, Mycobacterium avium subsp. paratuberculosis
ccguggcaggcga

SEQ ID NO: 3000629 - RNA, 19 nt, Mycobacterium avium subsp. paratuberculosis
ccguggcaggcgauggugc

SEQ ID NO: 3000630 - RNA, 17 nt, Mycobacterium avium subsp. paratuberculosis
ccguggcagggccagca

SEQ ID NO: 3000631 - RNA, 18 nt, Mycobacterium avium subsp. paratuberculosis
ccguggcagggccagcag

SEQ ID NO: 3000632 - RNA, 13 nt, Mycobacterium avium subsp. paratuberculosis
ccguggccagcgc

SEQ ID NO: 3000633 - RNA, 16 nt, Mycobacterium avium subsp. paratuberculosis
ccguggccagcgccag

SEQ ID NO: 3000634 - RNA, 21 nt, Mycobacterium avium subsp. paratuberculosis
ccguggcccacgggaugcggc

SEQ ID NO: 3000635 - RNA, 14 nt, Mycobacterium avium subsp. paratuberculosis
ccguggccccacgg

SEQ ID NO: 3000636 - RNA, 18 nt, Mycobacterium avium subsp. paratuberculosis
ccguggccccacgggcca

SEQ ID NO: 3000637 - RNA, 16 nt, Mycobacterium avium subsp. paratuberculosis
ccguggcccgcccagc

SEQ ID NO: 3000638 - RNA, 17 nt, Mycobacterium avium subsp. paratuberculosis
ccguggcccgcccagcg

SEQ ID NO: 3000639 - RNA, 22 nt, Mycobacterium avium subsp. paratuberculosis
ccguggcccgcccagcgcagca

SEQ ID NO: 3000640 - RNA, 15 nt, Mycobacterium avium subsp. paratuberculosis
ccguggcccggucgg

SEQ ID NO: 3000641 - RNA, 13 nt, Mycobacterium avium subsp. paratuberculosis
ccguggcggcccg

SEQ ID NO: 3000642 - RNA, 19 nt, Mycobacterium avium subsp. paratuberculosis
ccguggcggcccgaccagc

SEQ ID NO: 3000643 - RNA, 12 nt, Mycobacterium avium subsp. paratuberculosis
ccguggcggcgg

SEQ ID NO: 3000644 - RNA, 16 nt, Mycobacterium avium subsp. paratuberculosis
ccguggcggcgggcca

SEQ ID NO: 3000645 - RNA, 19 nt, Mycobacterium avium subsp. paratuberculosis
ccguggcggcgggccagcu

SEQ ID NO: 3000646 - RNA, 23 nt, Mycobacterium avium subsp. paratuberculosis
ccguggcggcggugucgcccagc

SEQ ID NO: 3000647 - RNA, 22 nt, Mycobacterium avium subsp. paratuberculosis
ccguggcgggggagccgugcag

SEQ ID NO: 3000648 - RNA, 19 nt, Mycobacterium avium subsp. paratuberculosis
ccguggcugaccacgcucc

SEQ ID NO: 3000649 - RNA, 14 nt, Mycobacterium avium subsp. paratuberculosis
ccgugggccgaccg

SEQ ID NO: 3000650 - RNA, 15 nt, Mycobacterium avium subsp. paratuberculosis
ccgugggccgaccgg

SEQ ID NO: 3000651 - RNA, 19 nt, Mycobacterium avium subsp. paratuberculosis
ccgugggccgaccggccgg

SEQ ID NO: 3000652 - RNA, 19 nt, Mycobacterium avium subsp. paratuberculosis
ccgugggugccgacgagcu

SEQ ID NO: 3000653 - RNA, 22 nt, Mycobacterium avium subsp. paratuberculosis
ccgugggugucggcgaaggugc

SEQ ID NO: 3000654 - RNA, 15 nt, Mycobacterium avium subsp. paratuberculosis
ccgugguagacgccg

SEQ ID NO: 3000655 - RNA, 19 nt, Mycobacterium avium subsp. paratuberculosis
ccguggucaacggcaccga

SEQ ID NO: 3000656 - RNA, 22 nt, Mycobacterium avium subsp. paratuberculosis
ccguggucaggggugggcgacg

SEQ ID NO: 3000657 - RNA, 15 nt, Mycobacterium avium subsp. paratuberculosis
ccgugguccagccgg

SEQ ID NO: 3000658 - RNA, 18 nt, Mycobacterium avium subsp. paratuberculosis
ccguggucggcagcaccg

SEQ ID NO: 3000659 - RNA, 13 nt, Mycobacterium avium subsp. paratuberculosis
ccguggucggcga

SEQ ID NO: 3000660 - RNA, 14 nt, Mycobacterium avium subsp. paratuberculosis
ccguggucggcgaa

SEQ ID NO: 3000661 - RNA, 16 nt, Mycobacterium avium subsp. paratuberculosis
ccguggucggcgaacg

SEQ ID NO: 3000662 - RNA, 22 nt, Mycobacterium avium subsp. paratuberculosis
ccguggucggcgaugcgcacca

SEQ ID NO: 3000663 - RNA, 13 nt, Mycobacterium avium subsp. paratuberculosis
ccguggucggugc

SEQ ID NO: 3000664 - RNA, 21 nt, Mycobacterium avium subsp. paratuberculosis
ccguggucggugcccugugag

SEQ ID NO: 3000665 - RNA, 14 nt, Mycobacterium avium subsp. paratuberculosis
ccguggugacccgg

SEQ ID NO: 3000666 - RNA, 16 nt, Mycobacterium avium subsp. paratuberculosis
ccguggugacccggac

SEQ ID NO: 3000667 - RNA, 19 nt, Mycobacterium avium subsp. paratuberculosis
ccguggugacccggaccgg

SEQ ID NO: 3000668 - RNA, 13 nt, Mycobacterium avium subsp. paratuberculosis
ccgugguggcggc

SEQ ID NO: 3000669 - RNA, 16 nt, Mycobacterium avium subsp. paratuberculosis
ccgugguggcggcgaa

SEQ ID NO: 3000670 - RNA, 18 nt, Mycobacterium avium subsp. paratuberculosis
ccguggugggcgaacagc

SEQ ID NO: 3000671 - RNA, 23 nt, Mycobacterium avium subsp. paratuberculosis
ccguggugggcgaacagcagcac

SEQ ID NO: 3000672 - RNA, 12 nt, Mycobacterium avium subsp. paratuberculosis
ccguggugucgg

SEQ ID NO: 3000673 - RNA, 13 nt, Mycobacterium avium subsp. paratuberculosis
ccguggugucgga

SEQ ID NO: 3000674 - RNA, 20 nt, Mycobacterium avium subsp. paratuberculosis
ccgugguuggcgaucagggc

SEQ ID NO: 3000675 - RNA, 22 nt, Mycobacterium avium subsp. paratuberculosis
ccguguagccgaccgacccggc

SEQ ID NO: 3000676 - RNA, 23 nt, Mycobacterium avium subsp. paratuberculosis
ccguguagccgaccgacccggcc

SEQ ID NO: 3000677 - RNA, 21 nt, Mycobacterium avium subsp. paratuberculosis
ccguguccaauucucagacga

SEQ ID NO: 3000678 - RNA, 12 nt, Mycobacterium avium subsp. paratuberculosis
ccgugucggcgg

SEQ ID NO: 3000679 - RNA, 14 nt, Mycobacterium avium subsp. paratuberculosis
ccgugucggcgggc

SEQ ID NO: 3000680 - RNA, 12 nt, Mycobacterium avium subsp. paratuberculosis
ccgugucgucgc

SEQ ID NO: 3000681 - RNA, 20 nt, Mycobacterium avium subsp. paratuberculosis
ccgugucgucgcugacgccg

SEQ ID NO: 3000682 - RNA, 15 nt, Mycobacterium avium subsp. paratuberculosis
ccgugugccagcccg

SEQ ID NO: 3000683 - RNA, 20 nt, Mycobacterium avium subsp. paratuberculosis
ccgugugcgcaucggcgacg

SEQ ID NO: 3000684 - RNA, 17 nt, Mycobacterium avium subsp. paratuberculosis
ccguguucaccagcggg

SEQ ID NO: 3000685 - RNA, 23 nt, Mycobacterium avium subsp. paratuberculosis
ccguucaacggccaaccgcccgg

SEQ ID NO: 3000686 - RNA, 18 nt, Mycobacterium avium subsp. paratuberculosis
ccguucauuaucccgcac

SEQ ID NO: 3000687 - RNA, 21 nt, Mycobacterium avium subsp. paratuberculosis
ccguucauuaucccgcaccgc

SEQ ID NO: 3000688 - RNA, 13 nt, Mycobacterium avium subsp. paratuberculosis
ccguuccaagcga

SEQ ID NO: 3000689 - RNA, 12 nt, Mycobacterium avium subsp. paratuberculosis
ccguuccagccg

SEQ ID NO: 3000690 - RNA, 15 nt, Mycobacterium avium subsp. paratuberculosis
ccguuccagccggcc

SEQ ID NO: 3000691 - RNA, 15 nt, Mycobacterium avium subsp. paratuberculosis
ccguuccccggccga

SEQ ID NO: 3000692 - RNA, 16 nt, Mycobacterium avium subsp. paratuberculosis
ccguuccccggccgac

SEQ ID NO: 3000693 - RNA, 19 nt, Mycobacterium avium subsp. paratuberculosis
ccguuccccggccgacguc

SEQ ID NO: 3000694 - RNA, 14 nt, Mycobacterium avium subsp. paratuberculosis
ccguucccgacagc

SEQ ID NO: 3000695 - RNA, 13 nt, Mycobacterium avium subsp. paratuberculosis
ccguuccucgacg

SEQ ID NO: 3000696 - RNA, 19 nt, Mycobacterium avium subsp. paratuberculosis
ccguucgagcgccggacgc

SEQ ID NO: 3000697 - RNA, 19 nt, Mycobacterium avium subsp. paratuberculosis
ccguucgccgacagcagcu

SEQ ID NO: 3000698 - RNA, 19 nt, Mycobacterium avium subsp. paratuberculosis
ccguucgccggccagcacg

SEQ ID NO: 3000699 - RNA, 21 nt, Mycobacterium avium subsp. paratuberculosis
ccguucgccgguaccgccggc

SEQ ID NO: 3000700 - RNA, 19 nt, Mycobacterium avium subsp. paratuberculosis
ccguucgcgcacggcgcgc

SEQ ID NO: 3000701 - RNA, 13 nt, Mycobacterium avium subsp. paratuberculosis
ccguucgcgccga

SEQ ID NO: 3000702 - RNA, 14 nt, Mycobacterium avium subsp. paratuberculosis
ccguucgcgccgag

SEQ ID NO: 3000703 - RNA, 13 nt, Mycobacterium avium subsp. paratuberculosis
ccguucgcgccgu

SEQ ID NO: 3000704 - RNA, 16 nt, Mycobacterium avium subsp. paratuberculosis
ccguucgcugcccucg

SEQ ID NO: 3000705 - RNA, 18 nt, Mycobacterium avium subsp. paratuberculosis
ccguucggccagcgccgc

SEQ ID NO: 3000706 - RNA, 13 nt, Mycobacterium avium subsp. paratuberculosis
ccguucgguggcc

SEQ ID NO: 3000707 - RNA, 17 nt, Mycobacterium avium subsp. paratuberculosis
ccguucgucgucgcgca

SEQ ID NO: 3000708 - RNA, 22 nt, Mycobacterium avium subsp. paratuberculosis
ccguucuccgaggcguccuccu

SEQ ID NO: 3000709 - RNA, 19 nt, Mycobacterium avium subsp. paratuberculosis
ccguucucgcgcaggucac

SEQ ID NO: 3000710 - RNA, 22 nt, Mycobacterium avium subsp. paratuberculosis
ccguucuuguggaacaucucca

SEQ ID NO: 3000711 - RNA, 17 nt, Mycobacterium avium subsp. paratuberculosis
ccguugacaccgggugc

SEQ ID NO: 3000712 - RNA, 14 nt, Mycobacterium avium subsp. paratuberculosis
ccguugaccgacgc

SEQ ID NO: 3000713 - RNA, 17 nt, Mycobacterium avium subsp. paratuberculosis
ccguugaccgcggcgau

SEQ ID NO: 3000714 - RNA, 14 nt, Mycobacterium avium subsp. paratuberculosis
ccguugaccggccg

SEQ ID NO: 3000715 - RNA, 15 nt, Mycobacterium avium subsp. paratuberculosis
ccguugaccggccgg

SEQ ID NO: 3000716 - RNA, 16 nt, Mycobacterium avium subsp. paratuberculosis
ccguugaccggccggu

SEQ ID NO: 3000717 - RNA, 15 nt, Mycobacterium avium subsp. paratuberculosis
ccguugaccggugcg

SEQ ID NO: 3000718 - RNA, 14 nt, Mycobacterium avium subsp. paratuberculosis
ccguugacgaccuu

SEQ ID NO: 3000719 - RNA, 22 nt, Mycobacterium avium subsp. paratuberculosis
ccguugacgaccuugucgcgca

SEQ ID NO: 3000720 - RNA, 13 nt, Mycobacterium avium subsp. paratuberculosis
ccguugacgccca

SEQ ID NO: 3000721 - RNA, 16 nt, Mycobacterium avium subsp. paratuberculosis
ccguugagcaccgcga

SEQ ID NO: 3000722 - RNA, 16 nt, Mycobacterium avium subsp. paratuberculosis
ccguugaucgagcacc

SEQ ID NO: 3000723 - RNA, 22 nt, Mycobacterium avium subsp. paratuberculosis
ccguugaugaagaccuggccgg

SEQ ID NO: 3000724 - RNA, 21 nt, Mycobacterium avium subsp. paratuberculosis
ccguugaugcgcaccgcggcg

SEQ ID NO: 3000725 - RNA, 15 nt, Mycobacterium avium subsp. paratuberculosis
ccguugauugcgccc

SEQ ID NO: 3000726 - RNA, 17 nt, Mycobacterium avium subsp. paratuberculosis
ccguugauugcgcccgc

SEQ ID NO: 3000727 - RNA, 19 nt, Mycobacterium avium subsp. paratuberculosis
ccguugauugcgcccgccg

SEQ ID NO: 3000728 - RNA, 22 nt, Mycobacterium avium subsp. paratuberculosis
ccguugcagcacaacggccuuc

SEQ ID NO: 3000729 - RNA, 15 nt, Mycobacterium avium subsp. paratuberculosis
ccguugccaggccgc

SEQ ID NO: 3000730 - RNA, 18 nt, Mycobacterium avium subsp. paratuberculosis
ccguugccaggccgcgag

SEQ ID NO: 3000731 - RNA, 18 nt, Mycobacterium avium subsp. paratuberculosis
ccguugcccgaucagccg

SEQ ID NO: 3000732 - RNA, 14 nt, Mycobacterium avium subsp. paratuberculosis
ccguugccgccgcg

SEQ ID NO: 3000733 - RNA, 15 nt, Mycobacterium avium subsp. paratuberculosis
ccguugccgccgcgc

SEQ ID NO: 3000734 - RNA, 16 nt, Mycobacterium avium subsp. paratuberculosis
ccguugccgccggcgc

SEQ ID NO: 3000735 - RNA, 19 nt, Mycobacterium avium subsp. paratuberculosis
ccguugccgccggcgcccu

SEQ ID NO: 3000736 - RNA, 21 nt, Mycobacterium avium subsp. paratuberculosis
ccguugccggucccguugauc

SEQ ID NO: 3000737 - RNA, 20 nt, Mycobacterium avium subsp. paratuberculosis
ccguugcgagucaucgccac

SEQ ID NO: 3000738 - RNA, 15 nt, Mycobacterium avium subsp. paratuberculosis
ccguugcgccagcgg

SEQ ID NO: 3000739 - RNA, 17 nt, Mycobacterium avium subsp. paratuberculosis
ccguugcggcccacggu

SEQ ID NO: 3000740 - RNA, 20 nt, Mycobacterium avium subsp. paratuberculosis
ccguugcugcguucggcgau

SEQ ID NO: 3000741 - RNA, 21 nt, Mycobacterium avium subsp. paratuberculosis
ccguugcugcguucggcgauc

SEQ ID NO: 3000742 - RNA, 19 nt, Mycobacterium avium subsp. paratuberculosis
ccguuggaggugaucgcca

SEQ ID NO: 3000743 - RNA, 19 nt, Mycobacterium avium subsp. paratuberculosis
ccguuggccugcgcgaccu

SEQ ID NO: 3000744 - RNA, 13 nt, Mycobacterium avium subsp. paratuberculosis
ccguuggcgccgg

SEQ ID NO: 3000745 - RNA, 15 nt, Mycobacterium avium subsp. paratuberculosis
ccguuggcguggaug

SEQ ID NO: 3000746 - RNA, 16 nt, Mycobacterium avium subsp. paratuberculosis
ccguugggcagcucgg

SEQ ID NO: 3000747 - RNA, 12 nt, Mycobacterium avium subsp. paratuberculosis
ccguugggccag

SEQ ID NO: 3000748 - RNA, 16 nt, Mycobacterium avium subsp. paratuberculosis
ccguugggccagaacg

SEQ ID NO: 3000749 - RNA, 18 nt, Mycobacterium avium subsp. paratuberculosis
ccguugggggcgccgcgg

SEQ ID NO: 3000750 - RNA, 22 nt, Mycobacterium avium subsp. paratuberculosis
ccguugggguccucgauggcgg

SEQ ID NO: 3000751 - RNA, 23 nt, Mycobacterium avium subsp. paratuberculosis
ccguugggguccucgauggcggc

SEQ ID NO: 3000752 - RNA, 17 nt, Mycobacterium avium subsp. paratuberculosis
ccguuggucuguggucg

SEQ ID NO: 3000753 - RNA, 16 nt, Mycobacterium avium subsp. paratuberculosis
ccguuggugcgguguc

SEQ ID NO: 3000754 - RNA, 16 nt, Mycobacterium avium subsp. paratuberculosis
ccguuguaggccgcgc

SEQ ID NO: 3000755 - RNA, 13 nt, Mycobacterium avium subsp. paratuberculosis
ccguugucgagca

SEQ ID NO: 3000756 - RNA, 13 nt, Mycobacterium avium subsp. paratuberculosis
ccguugucgaggu

SEQ ID NO: 3000757 - RNA, 19 nt, Mycobacterium avium subsp. paratuberculosis
ccguugucucggcgccguc

SEQ ID NO: 3000758 - RNA, 15 nt, Mycobacterium avium subsp. paratuberculosis
ccguugugcaccauc

SEQ ID NO: 3000759 - RNA, 18 nt, Mycobacterium avium subsp. paratuberculosis
ccguugugccaccgccga

SEQ ID NO: 3000760 - RNA, 17 nt, Mycobacterium avium subsp. paratuberculosis
ccguuguggccacccuc

SEQ ID NO: 3000761 - RNA, 22 nt, Mycobacterium avium subsp. paratuberculosis
ccguuguugagcguggcagcgg

SEQ ID NO: 3000762 - RNA, 17 nt, Mycobacterium avium subsp. paratuberculosis
ccguuguugucgugguc

SEQ ID NO: 3000763 - RNA, 18 nt, Mycobacterium avium subsp. paratuberculosis
ccguuguugucguggucg

SEQ ID NO: 3000764 - RNA, 19 nt, Mycobacterium avium subsp. paratuberculosis
ccguuguugucguggucgc

SEQ ID NO: 3000765 - RNA, 16 nt, Mycobacterium avium subsp. paratuberculosis
ccguuucagcagcgcg

SEQ ID NO: 3000766 - RNA, 21 nt, Mycobacterium avium subsp. paratuberculosis
ccguuuccggugcucccccgg

SEQ ID NO: 3000767 - RNA, 16 nt, Mycobacterium avium subsp. paratuberculosis
ccguuuggcgccgccc

SEQ ID NO: 3000768 - RNA, 17 nt, Mycobacterium avium subsp. paratuberculosis
ccguuuggcgccgccca

SEQ ID NO: 3000769 - RNA, 16 nt, Mycobacterium avium subsp. paratuberculosis
ccguuuucggcgcgca

SEQ ID NO: 3000770 - RNA, 18 nt, Mycobacterium avium subsp. paratuberculosis
ccuaaucgccccaggcgg

SEQ ID NO: 3000771 - RNA, 20 nt, Mycobacterium avium subsp. paratuberculosis
ccuacaggugccggcggcgc

SEQ ID NO: 3000772 - RNA, 18 nt, Mycobacterium avium subsp. paratuberculosis
ccuacccguccagcgcga

SEQ ID NO: 3000773 - RNA, 17 nt, Mycobacterium avium subsp. paratuberculosis
ccuaccgccgagcguga

SEQ ID NO: 3000774 - RNA, 17 nt, Mycobacterium avium subsp. paratuberculosis
ccuaccggcucggcccg

SEQ ID NO: 3000775 - RNA, 18 nt, Mycobacterium avium subsp. paratuberculosis
ccuaccggcucggcccgg

SEQ ID NO: 3000776 - RNA, 21 nt, Mycobacterium avium subsp. paratuberculosis
ccuaccggguggccagcacca

SEQ ID NO: 3000777 - RNA, 21 nt, Mycobacterium avium subsp. paratuberculosis
ccuacgccguggccugcgacu

SEQ ID NO: 3000778 - RNA, 14 nt, Mycobacterium avium subsp. paratuberculosis
ccuacggcgccggu

SEQ ID NO: 3000779 - RNA, 22 nt, Mycobacterium avium subsp. paratuberculosis
ccuacgggcgcaccgcgcgcca

SEQ ID NO: 3000780 - RNA, 22 nt, Mycobacterium avium subsp. paratuberculosis
ccuacuugcggccgcgacgcgc

SEQ ID NO: 3000781 - RNA, 21 nt, Mycobacterium avium subsp. paratuberculosis
ccuacuugcguugcgcggcgg

SEQ ID NO: 3000782 - RNA, 17 nt, Mycobacterium avium subsp. paratuberculosis
ccuagccuuggccgcag

SEQ ID NO: 3000783 - RNA, 21 nt, Mycobacterium avium subsp. paratuberculosis
ccuagccuuggccgcaggcgg

SEQ ID NO: 3000784 - RNA, 14 nt, Mycobacterium avium subsp. paratuberculosis
ccuagcgugccguc

SEQ ID NO: 3000785 - RNA, 19 nt, Mycobacterium avium subsp. paratuberculosis
ccuagcgugccguccagcu

SEQ ID NO: 3000786 - RNA, 14 nt, Mycobacterium avium subsp. paratuberculosis
ccuaggacgccgcc

SEQ ID NO: 3000787 - RNA, 13 nt, Mycobacterium avium subsp. paratuberculosis
ccuaggcgucguc

SEQ ID NO: 3000788 - RNA, 14 nt, Mycobacterium avium subsp. paratuberculosis
ccuaggggagcagc

SEQ ID NO: 3000789 - RNA, 12 nt, Mycobacterium avium subsp. paratuberculosis
ccuagucgacgc

SEQ ID NO: 3000790 - RNA, 21 nt, Mycobacterium avium subsp. paratuberculosis
ccuagucgacgccgaugguga

SEQ ID NO: 3000791 - RNA, 19 nt, Mycobacterium avium subsp. paratuberculosis
ccuagugccgggggccgag

SEQ ID NO: 3000792 - RNA, 12 nt, Mycobacterium avium subsp. paratuberculosis
ccuaugccgcgu

SEQ ID NO: 3000793 - RNA, 15 nt, Mycobacterium avium subsp. paratuberculosis
ccuauggcaucgcca

SEQ ID NO: 3000794 - RNA, 18 nt, Mycobacterium avium subsp. paratuberculosis
ccuaugucggugcggcgg

SEQ ID NO: 3000795 - RNA, 13 nt, Mycobacterium avium subsp. paratuberculosis
ccucacaccucgc

SEQ ID NO: 3000796 - RNA, 14 nt, Mycobacterium avium subsp. paratuberculosis
ccucacaccucgcu

SEQ ID NO: 3000797 - RNA, 22 nt, Mycobacterium avium subsp. paratuberculosis
ccucacaccucgcuacgcgagc

SEQ ID NO: 3000798 - RNA, 22 nt, Mycobacterium avium subsp. paratuberculosis
ccucacagcgacaacgggccgc

SEQ ID NO: 3000799 - RNA, 23 nt, Mycobacterium avium subsp. paratuberculosis
ccucacagcgacaacgggccgcc

SEQ ID NO: 3000800 - RNA, 15 nt, Mycobacterium avium subsp. paratuberculosis
ccucaccccagcgcg

SEQ ID NO: 3000801 - RNA, 21 nt, Mycobacterium avium subsp. paratuberculosis
ccucaccccagcgcgaccagu

SEQ ID NO: 3000802 - RNA, 22 nt, Mycobacterium avium subsp. paratuberculosis
ccucaccccgcuugcgcagcgu

SEQ ID NO: 3000803 - RNA, 23 nt, Mycobacterium avium subsp. paratuberculosis
ccucaccgaauuugaaaaugucc

SEQ ID NO: 3000804 - RNA, 20 nt, Mycobacterium avium subsp. paratuberculosis
ccucaccugcguugcggcac

SEQ ID NO: 3000805 - RNA, 13 nt, Mycobacterium avium subsp. paratuberculosis
ccucacggucggc

SEQ ID NO: 3000806 - RNA, 15 nt, Mycobacterium avium subsp. paratuberculosis
ccucacggucggcgu

SEQ ID NO: 3000807 - RNA, 16 nt, Mycobacterium avium subsp. paratuberculosis
ccucacggucggcguc

SEQ ID NO: 3000808 - RNA, 18 nt, Mycobacterium avium subsp. paratuberculosis
ccucacggucggcgucca

SEQ ID NO: 3000809 - RNA, 24 nt, Mycobacterium avium subsp. paratuberculosis
ccucacggucggcguccagcgcgg

SEQ ID NO: 3000810 - RNA, 17 nt, Mycobacterium avium subsp. paratuberculosis
ccucacuccagcggcgg

SEQ ID NO: 3000811 - RNA, 20 nt, Mycobacterium avium subsp. paratuberculosis
ccucagaccauggcgcggcg

SEQ ID NO: 3000812 - RNA, 21 nt, Mycobacterium avium subsp. paratuberculosis
ccucagaccauggcgcggcgg

SEQ ID NO: 3000813 - RNA, 23 nt, Mycobacterium avium subsp. paratuberculosis
ccucagaccauggcgcggcggcc

SEQ ID NO: 3000814 - RNA, 18 nt, Mycobacterium avium subsp. paratuberculosis
ccucagcagcugcuggcg

SEQ ID NO: 3000815 - RNA, 14 nt, Mycobacterium avium subsp. paratuberculosis
ccucagcccggcag

SEQ ID NO: 3000816 - RNA, 21 nt, Mycobacterium avium subsp. paratuberculosis
ccucagccggcggugcgucga

SEQ ID NO: 3000817 - RNA, 14 nt, Mycobacterium avium subsp. paratuberculosis
ccucagcgcgcaac

SEQ ID NO: 3000818 - RNA, 19 nt, Mycobacterium avium subsp. paratuberculosis
ccucaggcguccagcaccu

SEQ ID NO: 3000819 - RNA, 21 nt, Mycobacterium avium subsp. paratuberculosis
ccucaggcgucggucagcagg

SEQ ID NO: 3000820 - RNA, 18 nt, Mycobacterium avium subsp. paratuberculosis
ccucaggcugacgccacg

SEQ ID NO: 3000821 - RNA, 15 nt, Mycobacterium avium subsp. paratuberculosis
ccucagggcgcgcug

SEQ ID NO: 3000822 - RNA, 20 nt, Mycobacterium avium subsp. paratuberculosis
ccucagguggacagaugcca

SEQ ID NO: 3000823 - RNA, 14 nt, Mycobacterium avium subsp. paratuberculosis
ccucaguccgcccc

SEQ ID NO: 3000824 - RNA, 15 nt, Mycobacterium avium subsp. paratuberculosis
ccucaguccgccccg

SEQ ID NO: 3000825 - RNA, 16 nt, Mycobacterium avium subsp. paratuberculosis
ccucauagccggccgc

SEQ ID NO: 3000826 - RNA, 17 nt, Mycobacterium avium subsp. paratuberculosis
ccucauagccggccgcg

SEQ ID NO: 3000827 - RNA, 17 nt, Mycobacterium avium subsp. paratuberculosis
ccucauaggcguacacc

SEQ ID NO: 3000828 - RNA, 16 nt, Mycobacterium avium subsp. paratuberculosis
ccucaucgcccagccg

SEQ ID NO: 3000829 - RNA, 14 nt, Mycobacterium avium subsp. paratuberculosis
ccucaucgucgacc

SEQ ID NO: 3000830 - RNA, 17 nt, Mycobacterium avium subsp. paratuberculosis
ccucaucgucgacccgg

SEQ ID NO: 3000831 - RNA, 19 nt, Mycobacterium avium subsp. paratuberculosis
ccucaucgucgacccggcc

SEQ ID NO: 3000832 - RNA, 22 nt, Mycobacterium avium subsp. paratuberculosis
ccuccaaagcggcuaagccggc

SEQ ID NO: 3000833 - RNA, 19 nt, Mycobacterium avium subsp. paratuberculosis
ccuccaacccaaccugugc

SEQ ID NO: 3000834 - RNA, 21 nt, Mycobacterium avium subsp. paratuberculosis
ccuccaacccaaccugugcca

SEQ ID NO: 3000835 - RNA, 15 nt, Mycobacterium avium subsp. paratuberculosis
ccuccaacggcacca

SEQ ID NO: 3000836 - RNA, 16 nt, Mycobacterium avium subsp. paratuberculosis
ccuccaacggcaccac

SEQ ID NO: 3000837 - RNA, 17 nt, Mycobacterium avium subsp. paratuberculosis
ccuccaacggcaccacc

SEQ ID NO: 3000838 - RNA, 14 nt, Mycobacterium avium subsp. paratuberculosis
ccuccaacggccgc

SEQ ID NO: 3000839 - RNA, 15 nt, Mycobacterium avium subsp. paratuberculosis
ccuccaacggccgca

SEQ ID NO: 3000840 - RNA, 14 nt, Mycobacterium avium subsp. paratuberculosis
ccuccaaugcgccc

SEQ ID NO: 3000841 - RNA, 12 nt, Mycobacterium avium subsp. paratuberculosis
ccuccaccacca

SEQ ID NO: 3000842 - RNA, 23 nt, Mycobacterium avium subsp. paratuberculosis
ccuccaccaccaugucguugacg

SEQ ID NO: 3000843 - RNA, 12 nt, Mycobacterium avium subsp. paratuberculosis
ccuccaccagcg

SEQ ID NO: 3000844 - RNA, 12 nt, Mycobacterium avium subsp. paratuberculosis
ccuccaccggca

SEQ ID NO: 3000845 - RNA, 13 nt, Mycobacterium avium subsp. paratuberculosis
ccuccaccggcaa

SEQ ID NO: 3000846 - RNA, 21 nt, Mycobacterium avium subsp. paratuberculosis
ccuccaccggcaaucgggacg

SEQ ID NO: 3000847 - RNA, 23 nt, Mycobacterium avium subsp. paratuberculosis
ccuccacgacuucacaggccgcc

SEQ ID NO: 3000848 - RNA, 23 nt, Mycobacterium avium subsp. paratuberculosis
ccuccacggugcgcaccgacauc

SEQ ID NO: 3000849 - RNA, 18 nt, Mycobacterium avium subsp. paratuberculosis
ccuccacgucaccgacgc

SEQ ID NO: 3000850 - RNA, 11 nt, Mycobacterium avium subsp. paratuberculosis
ccuccagcacg

SEQ ID NO: 3000851 - RNA, 18 nt, Mycobacterium avium subsp. paratuberculosis
ccuccagcacgucggggu

SEQ ID NO: 3000852 - RNA, 20 nt, Mycobacterium avium subsp. paratuberculosis
ccuccagcacgucggggugg

SEQ ID NO: 3000853 - RNA, 13 nt, Mycobacterium avium subsp. paratuberculosis
ccuccagcccgga

SEQ ID NO: 3000854 - RNA, 20 nt, Mycobacterium avium subsp. paratuberculosis
ccuccagcccggaaucgucg

SEQ ID NO: 3000855 - RNA, 22 nt, Mycobacterium avium subsp. paratuberculosis
ccuccagcccggaaucgucggc

SEQ ID NO: 3000856 - RNA, 14 nt, Mycobacterium avium subsp. paratuberculosis
ccuccagccgccgg

SEQ ID NO: 3000857 - RNA, 19 nt, Mycobacterium avium subsp. paratuberculosis
ccuccagccgccgguccag

SEQ ID NO: 3000858 - RNA, 16 nt, Mycobacterium avium subsp. paratuberculosis
ccuccagccgcgcggc

SEQ ID NO: 3000859 - RNA, 20 nt, Mycobacterium avium subsp. paratuberculosis
ccuccagccgcgcggccgcc

SEQ ID NO: 3000860 - RNA, 10 nt, Mycobacterium avium subsp. paratuberculosis
ccuccagcgg

SEQ ID NO: 3000861 - RNA, 15 nt, Mycobacterium avium subsp. paratuberculosis
ccuccagcugguuga

SEQ ID NO: 3000862 - RNA, 21 nt, Mycobacterium avium subsp. paratuberculosis
ccuccagcuguugacgggccg

SEQ ID NO: 3000863 - RNA, 23 nt, Mycobacterium avium subsp. paratuberculosis
ccuccaggaagaacccggcgugc

SEQ ID NO: 3000864 - RNA, 20 nt, Mycobacterium avium subsp. paratuberculosis
ccuccaggcaugggaucagc

SEQ ID NO: 3000865 - RNA, 21 nt, Mycobacterium avium subsp. paratuberculosis
ccuccaggcugaaucccuccg

SEQ ID NO: 3000866 - RNA, 23 nt, Mycobacterium avium subsp. paratuberculosis
ccuccagguagacgaugcccagc

SEQ ID NO: 3000867 - RNA, 23 nt, Mycobacterium avium subsp. paratuberculosis
ccuccagguucgccgcccagaug

SEQ ID NO: 3000868 - RNA, 23 nt, Mycobacterium avium subsp. paratuberculosis
ccuccaguugcgaccccgccguc

SEQ ID NO: 3000869 - RNA, 13 nt, Mycobacterium avium subsp. paratuberculosis
ccucccaccacgg

SEQ ID NO: 3000870 - RNA, 16 nt, Mycobacterium avium subsp. paratuberculosis
ccucccaccacggccg

SEQ ID NO: 3000871 - RNA, 12 nt, Mycobacterium avium subsp. paratuberculosis
ccucccagcgcc

SEQ ID NO: 3000872 - RNA, 13 nt, Mycobacterium avium subsp. paratuberculosis
ccucccagcgccc

SEQ ID NO: 3000873 - RNA, 13 nt, Mycobacterium avium subsp. paratuberculosis
ccuccccauccgc

SEQ ID NO: 3000874 - RNA, 21 nt, Mycobacterium avium subsp. paratuberculosis
ccuccccauccgcggccaccg

SEQ ID NO: 3000875 - RNA, 14 nt, Mycobacterium avium subsp. paratuberculosis
ccucccccacccgc

SEQ ID NO: 3000876 - RNA, 19 nt, Mycobacterium avium subsp. paratuberculosis
ccucccccgacgccgacac

SEQ ID NO: 3000877 - RNA, 17 nt, Mycobacterium avium subsp. paratuberculosis
ccuccccgcuggcgccg

SEQ ID NO: 3000878 - RNA, 23 nt, Mycobacterium avium subsp. paratuberculosis
ccuccccgcuggcgccggcgucc

SEQ ID NO: 3000879 - RNA, 14 nt, Mycobacterium avium subsp. paratuberculosis
ccuccccggccagc

SEQ ID NO: 3000880 - RNA, 17 nt, Mycobacterium avium subsp. paratuberculosis
ccucccggaccaccagg

SEQ ID NO: 3000881 - RNA, 12 nt, Mycobacterium avium subsp. paratuberculosis
ccucccggccga

SEQ ID NO: 3000882 - RNA, 13 nt, Mycobacterium avium subsp. paratuberculosis
ccucccggccgac

SEQ ID NO: 3000883 - RNA, 11 nt, Mycobacterium avium subsp. paratuberculosis
ccucccggcgc

SEQ ID NO: 3000884 - RNA, 12 nt, Mycobacterium avium subsp. paratuberculosis
ccucccggcgcc

SEQ ID NO: 3000885 - RNA, 21 nt, Mycobacterium avium subsp. paratuberculosis
ccucccggcgccacgccgcga

SEQ ID NO: 3000886 - RNA, 13 nt, Mycobacterium avium subsp. paratuberculosis
ccuccgaauccag

SEQ ID NO: 3000887 - RNA, 20 nt, Mycobacterium avium subsp. paratuberculosis
ccuccgaauccagcgcgccg

SEQ ID NO: 3000888 - RNA, 14 nt, Mycobacterium avium subsp. paratuberculosis
ccuccgacagcccc

SEQ ID NO: 3000889 - RNA, 15 nt, Mycobacterium avium subsp. paratuberculosis
ccuccgacagccccc

SEQ ID NO: 3000890 - RNA, 14 nt, Mycobacterium avium subsp. paratuberculosis
ccuccgacagccgc

SEQ ID NO: 3000891 - RNA, 19 nt, Mycobacterium avium subsp. paratuberculosis
ccuccgacagccgcaccgg

SEQ ID NO: 3000892 - RNA, 16 nt, Mycobacterium avium subsp. paratuberculosis
ccuccgaccagccggu

SEQ ID NO: 3000893 - RNA, 19 nt, Mycobacterium avium subsp. paratuberculosis
ccuccgacuuacggcguga

SEQ ID NO: 3000894 - RNA, 18 nt, Mycobacterium avium subsp. paratuberculosis
ccuccgccaccuccuccg

SEQ ID NO: 3000895 - RNA, 16 nt, Mycobacterium avium subsp. paratuberculosis
ccuccgccgccccguc

SEQ ID NO: 3000896 - RNA, 13 nt, Mycobacterium avium subsp. paratuberculosis
ccuccgcgaucag

SEQ ID NO: 3000897 - RNA, 15 nt, Mycobacterium avium subsp. paratuberculosis
ccuccgcgaucagcu

SEQ ID NO: 3000898 - RNA, 15 nt, Mycobacterium avium subsp. paratuberculosis
ccuccgcgcgcggcc

SEQ ID NO: 3000899 - RNA, 12 nt, Mycobacterium avium subsp. paratuberculosis
ccuccgcggcgc

SEQ ID NO: 3000900 - RNA, 13 nt, Mycobacterium avium subsp. paratuberculosis
ccuccgcggcgcc

SEQ ID NO: 3000901 - RNA, 16 nt, Mycobacterium avium subsp. paratuberculosis
ccuccgcggcgccgua

SEQ ID NO: 3000902 - RNA, 16 nt, Mycobacterium avium subsp. paratuberculosis
ccuccggagaucgccc

SEQ ID NO: 3000903 - RNA, 19 nt, Mycobacterium avium subsp. paratuberculosis
ccuccggagaucgccccgg

SEQ ID NO: 3000904 - RNA, 16 nt, Mycobacterium avium subsp. paratuberculosis
ccuccggagugacguc

SEQ ID NO: 3000905 - RNA, 22 nt, Mycobacterium avium subsp. paratuberculosis
ccuccggauggcggucgcgcca

SEQ ID NO: 3000906 - RNA, 22 nt, Mycobacterium avium subsp. paratuberculosis
ccuccggcaggccgcggccguc

SEQ ID NO: 3000907 - RNA, 23 nt, Mycobacterium avium subsp. paratuberculosis
ccuccggcaguacgcgccggccu

SEQ ID NO: 3000908 - RNA, 14 nt, Mycobacterium avium subsp. paratuberculosis
ccuccggcccgauc

SEQ ID NO: 3000909 - RNA, 12 nt, Mycobacterium avium subsp. paratuberculosis
ccuccggcgccu

SEQ ID NO: 3000910 - RNA, 12 nt, Mycobacterium avium subsp. paratuberculosis
ccuccggcggca

SEQ ID NO: 3000911 - RNA, 19 nt, Mycobacterium avium subsp. paratuberculosis
ccuccgggaaggcggccgc

SEQ ID NO: 3000912 - RNA, 20 nt, Mycobacterium avium subsp. paratuberculosis
ccuccgggaaggcggccgcg

SEQ ID NO: 3000913 - RNA, 21 nt, Mycobacterium avium subsp. paratuberculosis
ccuccgggaaggcggccgcga

SEQ ID NO: 3000914 - RNA, 23 nt, Mycobacterium avium subsp. paratuberculosis
ccuccgggcggcaccgcugccgg

SEQ ID NO: 3000915 - RNA, 18 nt, Mycobacterium avium subsp. paratuberculosis
ccuccgggcugaccucgc

SEQ ID NO: 3000916 - RNA, 18 nt, Mycobacterium avium subsp. paratuberculosis
ccuccgggcugccguaga

SEQ ID NO: 3000917 - RNA, 16 nt, Mycobacterium avium subsp. paratuberculosis
ccuccgguccgggcug

SEQ ID NO: 3000918 - RNA, 17 nt, Mycobacterium avium subsp. paratuberculosis
ccuccgguccgggcugc

SEQ ID NO: 3000919 - RNA, 17 nt, Mycobacterium avium subsp. paratuberculosis
ccuccgguuugcgccgg

SEQ ID NO: 3000920 - RNA, 14 nt, Mycobacterium avium subsp. paratuberculosis
ccuccgucgccuuc

SEQ ID NO: 3000921 - RNA, 15 nt, Mycobacterium avium subsp. paratuberculosis
ccuccgugccgaugg

SEQ ID NO: 3000922 - RNA, 21 nt, Mycobacterium avium subsp. paratuberculosis
ccuccgugcuggccggguugg

SEQ ID NO: 3000923 - RNA, 17 nt, Mycobacterium avium subsp. paratuberculosis
ccuccucgaccccgaag

SEQ ID NO: 3000924 - RNA, 19 nt, Mycobacterium avium subsp. paratuberculosis
ccuccucgaugucgguggu

SEQ ID NO: 3000925 - RNA, 15 nt, Mycobacterium avium subsp. paratuberculosis
ccuccucggccagcc

SEQ ID NO: 3000926 - RNA, 18 nt, Mycobacterium avium subsp. paratuberculosis
ccuccucggccagcccca

SEQ ID NO: 3000927 - RNA, 15 nt, Mycobacterium avium subsp. paratuberculosis
ccuccucguccgcgg

SEQ ID NO: 3000928 - RNA, 17 nt, Mycobacterium avium subsp. paratuberculosis
ccuccucguccgcggcg

SEQ ID NO: 3000929 - RNA, 20 nt, Mycobacterium avium subsp. paratuberculosis
ccuccucguccgcggcggcg

SEQ ID NO: 3000930 - RNA, 19 nt, Mycobacterium avium subsp. paratuberculosis
ccuccucuucgcugccgcc

SEQ ID NO: 3000931 - RNA, 20 nt, Mycobacterium avium subsp. paratuberculosis
ccuccucuucgcugccgccg

SEQ ID NO: 3000932 - RNA, 19 nt, Mycobacterium avium subsp. paratuberculosis
ccuccugcaaggcccccgc

SEQ ID NO: 3000933 - RNA, 13 nt, Mycobacterium avium subsp. paratuberculosis
ccuccugcacccg

SEQ ID NO: 3000934 - RNA, 12 nt, Mycobacterium avium subsp. paratuberculosis
ccuccuggguga

SEQ ID NO: 3000935 - RNA, 23 nt, Mycobacterium avium subsp. paratuberculosis
ccuccugggugagcggcgcgucc

SEQ ID NO: 3000936 - RNA, 23 nt, Mycobacterium avium subsp. paratuberculosis
ccucgaacacaucguggcgcauc

SEQ ID NO: 3000937 - RNA, 17 nt, Mycobacterium avium subsp. paratuberculosis
ccucgaacaccgcaccg

SEQ ID NO: 3000938 - RNA, 19 nt, Mycobacterium avium subsp. paratuberculosis
ccucgaacaccgcaccggu

SEQ ID NO: 3000939 - RNA, 12 nt, Mycobacterium avium subsp. paratuberculosis
ccucgaacaggc

SEQ ID NO: 3000940 - RNA, 16 nt, Mycobacterium avium subsp. paratuberculosis
ccucgaacaggcuggc

SEQ ID NO: 3000941 - RNA, 21 nt, Mycobacterium avium subsp. paratuberculosis
ccucgaacaggcuggccagcu

SEQ ID NO: 3000942 - RNA, 23 nt, Mycobacterium avium subsp. paratuberculosis
ccucgaacaggcuggccagcucg

SEQ ID NO: 3000943 - RNA, 12 nt, Mycobacterium avium subsp. paratuberculosis
ccucgaacuuga

SEQ ID NO: 3000944 - RNA, 16 nt, Mycobacterium avium subsp. paratuberculosis
ccucgaacuugaccgg

SEQ ID NO: 3000945 - RNA, 15 nt, Mycobacterium avium subsp. paratuberculosis
ccucgaagaacgcgu

SEQ ID NO: 3000946 - RNA, 16 nt, Mycobacterium avium subsp. paratuberculosis
ccucgaagauggucgc

SEQ ID NO: 3000947 - RNA, 19 nt, Mycobacterium avium subsp. paratuberculosis
ccucgaagauggucgcgcc

SEQ ID NO: 3000948 - RNA, 20 nt, Mycobacterium avium subsp. paratuberculosis
ccucgaagcagccuucuugg

SEQ ID NO: 3000949 - RNA, 21 nt, Mycobacterium avium subsp. paratuberculosis
ccucgaagcagccuucuuggc

SEQ ID NO: 3000950 - RNA, 17 nt, Mycobacterium avium subsp. paratuberculosis
ccucgaagccgaucgcg

SEQ ID NO: 3000951 - RNA, 13 nt, Mycobacterium avium subsp. paratuberculosis
ccucgaagcugga

SEQ ID NO: 3000952 - RNA, 14 nt, Mycobacterium avium subsp. paratuberculosis
ccucgaagggcgcc

SEQ ID NO: 3000953 - RNA, 17 nt, Mycobacterium avium subsp. paratuberculosis
ccucgaagggcgccagc

SEQ ID NO: 3000954 - RNA, 19 nt, Mycobacterium avium subsp. paratuberculosis
ccucgaagggcgccagccg

SEQ ID NO: 3000955 - RNA, 19 nt, Mycobacterium avium subsp. paratuberculosis
ccucgaaguagagccgcug

SEQ ID NO: 3000956 - RNA, 19 nt, Mycobacterium avium subsp. paratuberculosis
ccucgaagucgccggccuc

SEQ ID NO: 3000957 - RNA, 15 nt, Mycobacterium avium subsp. paratuberculosis
ccucgaauccgcggg

SEQ ID NO: 3000958 - RNA, 18 nt, Mycobacterium avium subsp. paratuberculosis
ccucgaauccgcgggcgu

SEQ ID NO: 3000959 - RNA, 22 nt, Mycobacterium avium subsp. paratuberculosis
ccucgaauccgcgggcguggcg

SEQ ID NO: 3000960 - RNA, 14 nt, Mycobacterium avium subsp. paratuberculosis
ccucgacaccggug

SEQ ID NO: 3000961 - RNA, 18 nt, Mycobacterium avium subsp. paratuberculosis
ccucgacacgggccgcgc

SEQ ID NO: 3000962 - RNA, 18 nt, Mycobacterium avium subsp. paratuberculosis
ccucgaccaccucuucgc

SEQ ID NO: 3000963 - RNA, 22 nt, Mycobacterium avium subsp. paratuberculosis
ccucgaccaccucuucgcgguc

SEQ ID NO: 3000964 - RNA, 15 nt, Mycobacterium avium subsp. paratuberculosis
ccucgaccacgcaca

SEQ ID NO: 3000965 - RNA, 18 nt, Mycobacterium avium subsp. paratuberculosis
ccucgaccacgcacacca

SEQ ID NO: 3000966 - RNA, 16 nt, Mycobacterium avium subsp. paratuberculosis
ccucgaccagcaccgc

SEQ ID NO: 3000967 - RNA, 19 nt, Mycobacterium avium subsp. paratuberculosis
ccucgaccagcaccgcauc

SEQ ID NO: 3000968 - RNA, 14 nt, Mycobacterium avium subsp. paratuberculosis
ccucgaccagccgg

SEQ ID NO: 3000969 - RNA, 14 nt, Mycobacterium avium subsp. paratuberculosis
ccucgaccagcgcg

SEQ ID NO: 3000970 - RNA, 17 nt, Mycobacterium avium subsp. paratuberculosis
ccucgaccagcgcgccg

SEQ ID NO: 3000971 - RNA, 21 nt, Mycobacterium avium subsp. paratuberculosis
ccucgaccaggcuuggcccgc

SEQ ID NO: 3000972 - RNA, 17 nt, Mycobacterium avium subsp. paratuberculosis
ccucgacccguuccggc

SEQ ID NO: 3000973 - RNA, 20 nt, Mycobacterium avium subsp. paratuberculosis
ccucgacccguuccggcgag

SEQ ID NO: 3000974 - RNA, 19 nt, Mycobacterium avium subsp. paratuberculosis
ccucgaccucuucggcgcc

SEQ ID NO: 3000975 - RNA, 10 nt, Mycobacterium avium subsp. paratuberculosis
ccucgacgaa

SEQ ID NO: 3000976 - RNA, 16 nt, Mycobacterium avium subsp. paratuberculosis
ccucgacgaacgcggc

SEQ ID NO: 3000977 - RNA, 17 nt, Mycobacterium avium subsp. paratuberculosis
ccucgacgaacgcggcg

SEQ ID NO: 3000978 - RNA, 15 nt, Mycobacterium avium subsp. paratuberculosis
ccucgacgccgcgca

SEQ ID NO: 3000979 - RNA, 16 nt, Mycobacterium avium subsp. paratuberculosis
ccucgacgccgcgcac

SEQ ID NO: 3000980 - RNA, 16 nt, Mycobacterium avium subsp. paratuberculosis
ccucgacgccgggcag

SEQ ID NO: 3000981 - RNA, 13 nt, Mycobacterium avium subsp. paratuberculosis
ccucgacggcgaa

SEQ ID NO: 3000982 - RNA, 20 nt, Mycobacterium avium subsp. paratuberculosis
ccucgacggcgaagccggcg

SEQ ID NO: 3000983 - RNA, 15 nt, Mycobacterium avium subsp. paratuberculosis
ccucgacggcguggu

SEQ ID NO: 3000984 - RNA, 23 nt, Mycobacterium avium subsp. paratuberculosis
ccucgacggugcugccguugggc

SEQ ID NO: 3000985 - RNA, 17 nt, Mycobacterium avium subsp. paratuberculosis
ccucgacguaggccaga

SEQ ID NO: 3000986 - RNA, 23 nt, Mycobacterium avium subsp. paratuberculosis
ccucgacguaggccagaucuccg

SEQ ID NO: 3000987 - RNA, 18 nt, Mycobacterium avium subsp. paratuberculosis
ccucgacguaggugagca

SEQ ID NO: 3000988 - RNA, 23 nt, Mycobacterium avium subsp. paratuberculosis
ccucgacguaggugagcaacgcc

SEQ ID NO: 3000989 - RNA, 20 nt, Mycobacterium avium subsp. paratuberculosis
ccucgacguccaggccggcg

SEQ ID NO: 3000990 - RNA, 19 nt, Mycobacterium avium subsp. paratuberculosis
ccucgagauucugcagccg

SEQ ID NO: 3000991 - RNA, 16 nt, Mycobacterium avium subsp. paratuberculosis
ccucgagcaaccgcac

SEQ ID NO: 3000992 - RNA, 20 nt, Mycobacterium avium subsp. paratuberculosis
ccucgagcaaccgcaccuug

SEQ ID NO: 3000993 - RNA, 14 nt, Mycobacterium avium subsp. paratuberculosis
ccucgagcaacggc

SEQ ID NO: 3000994 - RNA, 15 nt, Mycobacterium avium subsp. paratuberculosis
ccucgagcaccacgg

SEQ ID NO: 3000995 - RNA, 19 nt, Mycobacterium avium subsp. paratuberculosis
ccucgagcaccacggcccg

SEQ ID NO: 3000996 - RNA, 14 nt, Mycobacterium avium subsp. paratuberculosis
ccucgagcaccggc

SEQ ID NO: 3000997 - RNA, 15 nt, Mycobacterium avium subsp. paratuberculosis
ccucgagcaccggcg

SEQ ID NO: 3000998 - RNA, 18 nt, Mycobacterium avium subsp. paratuberculosis
ccucgagcaccggcggca

SEQ ID NO: 3000999 - RNA, 21 nt, Mycobacterium avium subsp. paratuberculosis
ccucgagcaccggcggcagcg

SEQ ID NO: 3001000 - RNA, 16 nt, Mycobacterium avium subsp. paratuberculosis
ccucgagcacgcccug

SEQ ID NO: 3001001 - RNA, 22 nt, Mycobacterium avium subsp. paratuberculosis
ccucgagcacgcccugcggcug

SEQ ID NO: 3001002 - RNA, 20 nt, Mycobacterium avium subsp. paratuberculosis
ccucgagcacucgcgggacg

SEQ ID NO: 3001003 - RNA, 13 nt, Mycobacterium avium subsp. paratuberculosis
ccucgagcagcgc

SEQ ID NO: 3001004 - RNA, 18 nt, Mycobacterium avium subsp. paratuberculosis
ccucgagcaucucgaacc

SEQ ID NO: 3001005 - RNA, 21 nt, Mycobacterium avium subsp. paratuberculosis
ccucgagccauaaaccggccg

SEQ ID NO: 3001006 - RNA, 22 nt, Mycobacterium avium subsp. paratuberculosis
ccucgagccauaaaccggccgg

SEQ ID NO: 3001007 - RNA, 17 nt, Mycobacterium avium subsp. paratuberculosis
ccucgagccguuugaug

SEQ ID NO: 3001008 - RNA, 22 nt, Mycobacterium avium subsp. paratuberculosis
ccucgagccguuugaugccguc

SEQ ID NO: 3001009 - RNA, 24 nt, Mycobacterium avium subsp. paratuberculosis
ccucgagccguuugaugccguccg

SEQ ID NO: 3001010 - RNA, 12 nt, Mycobacterium avium subsp. paratuberculosis
ccucgagcgccc

SEQ ID NO: 3001011 - RNA, 13 nt, Mycobacterium avium subsp. paratuberculosis
ccucgagcgcguc

SEQ ID NO: 3001012 - RNA, 20 nt, Mycobacterium avium subsp. paratuberculosis
ccucgagcgcgucgaccagc

SEQ ID NO: 3001013 - RNA, 18 nt, Mycobacterium avium subsp. paratuberculosis
ccucgagcgucacgcugg

SEQ ID NO: 3001014 - RNA, 19 nt, Mycobacterium avium subsp. paratuberculosis
ccucgagcugcacgggcgu

SEQ ID NO: 3001015 - RNA, 13 nt, Mycobacterium avium subsp. paratuberculosis
ccucgagcuugcc

SEQ ID NO: 3001016 - RNA, 16 nt, Mycobacterium avium subsp. paratuberculosis
ccucgagcuugccguc

SEQ ID NO: 3001017 - RNA, 18 nt, Mycobacterium avium subsp. paratuberculosis
ccucgagcuugccgucgu

SEQ ID NO: 3001018 - RNA, 18 nt, Mycobacterium avium subsp. paratuberculosis
ccucgaggaucgcggcca

SEQ ID NO: 3001019 - RNA, 21 nt, Mycobacterium avium subsp. paratuberculosis
ccucgaggaucgcggccacgc

SEQ ID NO: 3001020 - RNA, 22 nt, Mycobacterium avium subsp. paratuberculosis
ccucgaguacucgguguagagc

SEQ ID NO: 3001021 - RNA, 20 nt, Mycobacterium avium subsp. paratuberculosis
ccucgagugccugcgcccac

SEQ ID NO: 3001022 - RNA, 19 nt, Mycobacterium avium subsp. paratuberculosis
ccucgauaauggcggccgc

SEQ ID NO: 3001023 - RNA, 16 nt, Mycobacterium avium subsp. paratuberculosis
ccucgaucaacgccgg

SEQ ID NO: 3001024 - RNA, 20 nt, Mycobacterium avium subsp. paratuberculosis
ccucgaucaacgccgggucg

SEQ ID NO: 3001025 - RNA, 16 nt, Mycobacterium avium subsp. paratuberculosis
ccucgaucaccgacag

SEQ ID NO: 3001026 - RNA, 16 nt, Mycobacterium avium subsp. paratuberculosis
ccucgaucaccgggcg

SEQ ID NO: 3001027 - RNA, 20 nt, Mycobacterium avium subsp. paratuberculosis
ccucgaucaccgggcggccg

SEQ ID NO: 3001028 - RNA, 18 nt, Mycobacterium avium subsp. paratuberculosis
ccucgaucagagcgggcc

SEQ ID NO: 3001029 - RNA, 18 nt, Mycobacterium avium subsp. paratuberculosis
ccucgaucagccacaccg

SEQ ID NO: 3001030 - RNA, 13 nt, Mycobacterium avium subsp. paratuberculosis
ccucgaucagcgg

SEQ ID NO: 3001031 - RNA, 18 nt, Mycobacterium avium subsp. paratuberculosis
ccucgaucaucaccaccg

SEQ ID NO: 3001032 - RNA, 13 nt, Mycobacterium avium subsp. paratuberculosis
ccucgaucaucgc

SEQ ID NO: 3001033 - RNA, 18 nt, Mycobacterium avium subsp. paratuberculosis
ccucgaucaucgcgucgg

SEQ ID NO: 3001034 - RNA, 21 nt, Mycobacterium avium subsp. paratuberculosis
ccucgaucaucgcgucggugu

SEQ ID NO: 3001035 - RNA, 23 nt, Mycobacterium avium subsp. paratuberculosis
ccucgaucaucgcgucggugucg

SEQ ID NO: 3001036 - RNA, 20 nt, Mycobacterium avium subsp. paratuberculosis
ccucgauccgguccagcccg

SEQ ID NO: 3001037 - RNA, 18 nt, Mycobacterium avium subsp. paratuberculosis
ccucgaucgacaccucgg

SEQ ID NO: 3001038 - RNA, 16 nt, Mycobacterium avium subsp. paratuberculosis
ccucgaucgaggagau

SEQ ID NO: 3001039 - RNA, 15 nt, Mycobacterium avium subsp. paratuberculosis
ccucgaucgcgacca

SEQ ID NO: 3001040 - RNA, 23 nt, Mycobacterium avium subsp. paratuberculosis
ccucgaucgcgaccaccggccga

SEQ ID NO: 3001041 - RNA, 19 nt, Mycobacterium avium subsp. paratuberculosis
ccucgaucugguucaccgc

SEQ ID NO: 3001042 - RNA, 14 nt, Mycobacterium avium subsp. paratuberculosis
ccucgaugacgccg

SEQ ID NO: 3001043 - RNA, 15 nt, Mycobacterium avium subsp. paratuberculosis
ccucgaugacgccgg

SEQ ID NO: 3001044 - RNA, 19 nt, Mycobacterium avium subsp. paratuberculosis
ccucgaugacgccggacag

SEQ ID NO: 3001045 - RNA, 16 nt, Mycobacterium avium subsp. paratuberculosis
ccucgaugccgaccga

SEQ ID NO: 3001046 - RNA, 19 nt, Mycobacterium avium subsp. paratuberculosis
ccucgaugccgaccgacag

SEQ ID NO: 3001047 - RNA, 21 nt, Mycobacterium avium subsp. paratuberculosis
ccucgaugccgugccggugga

SEQ ID NO: 3001048 - RNA, 21 nt, Mycobacterium avium subsp. paratuberculosis
ccucgaugcgcaccgugccgc

SEQ ID NO: 3001049 - RNA, 14 nt, Mycobacterium avium subsp. paratuberculosis
ccucgaugcggccg

SEQ ID NO: 3001050 - RNA, 16 nt, Mycobacterium avium subsp. paratuberculosis
ccucgaugcggccguc

SEQ ID NO: 3001051 - RNA, 14 nt, Mycobacterium avium subsp. paratuberculosis
ccucgauggcccgc

SEQ ID NO: 3001052 - RNA, 15 nt, Mycobacterium avium subsp. paratuberculosis
ccucgauggcccgcu

SEQ ID NO: 3001053 - RNA, 16 nt, Mycobacterium avium subsp. paratuberculosis
ccucgauggcggcggc

SEQ ID NO: 3001054 - RNA, 20 nt, Mycobacterium avium subsp. paratuberculosis
ccucgauggcggcggcugcc

SEQ ID NO: 3001055 - RNA, 18 nt, Mycobacterium avium subsp. paratuberculosis
ccucgauggguucuucga

SEQ ID NO: 3001056 - RNA, 15 nt, Mycobacterium avium subsp. paratuberculosis
ccucgaugucggugg

SEQ ID NO: 3001057 - RNA, 20 nt, Mycobacterium avium subsp. paratuberculosis
ccucgaugucgucgaugaac

SEQ ID NO: 3001058 - RNA, 15 nt, Mycobacterium avium subsp. paratuberculosis
ccucgcacagcuugu

SEQ ID NO: 3001059 - RNA, 17 nt, Mycobacterium avium subsp. paratuberculosis
ccucgcacagcuugucc

SEQ ID NO: 3001060 - RNA, 20 nt, Mycobacterium avium subsp. paratuberculosis
ccucgccagccccaccggcc

SEQ ID NO: 3001061 - RNA, 15 nt, Mycobacterium avium subsp. paratuberculosis
ccucgcccagcgccg

SEQ ID NO: 3001062 - RNA, 17 nt, Mycobacterium avium subsp. paratuberculosis
ccucgcccagcgccgcg

SEQ ID NO: 3001063 - RNA, 24 nt, Mycobacterium avium subsp. paratuberculosis
ccucgccccggaugaccagggugg

SEQ ID NO: 3001064 - RNA, 14 nt, Mycobacterium avium subsp. paratuberculosis
ccucgcccgccgcg

SEQ ID NO: 3001065 - RNA, 15 nt, Mycobacterium avium subsp. paratuberculosis
ccucgcccgccgcga

SEQ ID NO: 3001066 - RNA, 17 nt, Mycobacterium avium subsp. paratuberculosis
ccucgcccgggugcugc

SEQ ID NO: 3001067 - RNA, 17 nt, Mycobacterium avium subsp. paratuberculosis
ccucgcccugcagccgg

SEQ ID NO: 3001068 - RNA, 15 nt, Mycobacterium avium subsp. paratuberculosis
ccucgcccugcagcg

SEQ ID NO: 3001069 - RNA, 16 nt, Mycobacterium avium subsp. paratuberculosis
ccucgcccugcagcgc

SEQ ID NO: 3001070 - RNA, 18 nt, Mycobacterium avium subsp. paratuberculosis
ccucgccgaaccggggcc

SEQ ID NO: 3001071 - RNA, 15 nt, Mycobacterium avium subsp. paratuberculosis
ccucgccgaccuugg

SEQ ID NO: 3001072 - RNA, 22 nt, Mycobacterium avium subsp. paratuberculosis
ccucgccgacgguguccgcggg

SEQ ID NO: 3001073 - RNA, 21 nt, Mycobacterium avium subsp. paratuberculosis
ccucgccgacgucccagcaca

SEQ ID NO: 3001074 - RNA, 19 nt, Mycobacterium avium subsp. paratuberculosis
ccucgccgaucucgaccag

SEQ ID NO: 3001075 - RNA, 21 nt, Mycobacterium avium subsp. paratuberculosis
ccucgccgaucucgaccagcg

SEQ ID NO: 3001076 - RNA, 14 nt, Mycobacterium avium subsp. paratuberculosis
ccucgccgcgccag

SEQ ID NO: 3001077 - RNA, 15 nt, Mycobacterium avium subsp. paratuberculosis
ccucgccgcgggcca

SEQ ID NO: 3001078 - RNA, 13 nt, Mycobacterium avium subsp. paratuberculosis
ccucgccggccgg

SEQ ID NO: 3001079 - RNA, 14 nt, Mycobacterium avium subsp. paratuberculosis
ccucgccggccggg

SEQ ID NO: 3001080 - RNA, 15 nt, Mycobacterium avium subsp. paratuberculosis
ccucgccggccgggc

SEQ ID NO: 3001081 - RNA, 13 nt, Mycobacterium avium subsp. paratuberculosis
ccucgccggcgcc

SEQ ID NO: 3001082 - RNA, 19 nt, Mycobacterium avium subsp. paratuberculosis
ccucgccggcgccgggcgg

SEQ ID NO: 3001083 - RNA, 20 nt, Mycobacterium avium subsp. paratuberculosis
ccucgccggcgccgggcggg

SEQ ID NO: 3001084 - RNA, 22 nt, Mycobacterium avium subsp. paratuberculosis
ccucgccggcgccgggcgggcg

SEQ ID NO: 3001085 - RNA, 13 nt, Mycobacterium avium subsp. paratuberculosis
ccucgccggcggc

SEQ ID NO: 3001086 - RNA, 14 nt, Mycobacterium avium subsp. paratuberculosis
ccucgccggcggcg

SEQ ID NO: 3001087 - RNA, 17 nt, Mycobacterium avium subsp. paratuberculosis
ccucgccgggcccgcuc

SEQ ID NO: 3001088 - RNA, 13 nt, Mycobacterium avium subsp. paratuberculosis
ccucgccgggcgu

SEQ ID NO: 3001089 - RNA, 14 nt, Mycobacterium avium subsp. paratuberculosis
ccucgccgggcguc

SEQ ID NO: 3001090 - RNA, 20 nt, Mycobacterium avium subsp. paratuberculosis
ccucgccgggcgucacucug

SEQ ID NO: 3001091 - RNA, 16 nt, Mycobacterium avium subsp. paratuberculosis
ccucgccggucagcgc

SEQ ID NO: 3001092 - RNA, 12 nt, Mycobacterium avium subsp. paratuberculosis
ccucgccgucga

SEQ ID NO: 3001093 - RNA, 19 nt, Mycobacterium avium subsp. paratuberculosis
ccucgccguugccggcccg

SEQ ID NO: 3001094 - RNA, 21 nt, Mycobacterium avium subsp. paratuberculosis
ccucgccguugccggcccgca

SEQ ID NO: 3001095 - RNA, 14 nt, Mycobacterium avium subsp. paratuberculosis
ccucgccuccagca

SEQ ID NO: 3001096 - RNA, 23 nt, Mycobacterium avium subsp. paratuberculosis
ccucgccugucggucguacgucu

SEQ ID NO: 3001097 - RNA, 23 nt, Mycobacterium avium subsp. paratuberculosis
ccucgcgcaaugccgccgcgacg

SEQ ID NO: 3001098 - RNA, 18 nt, Mycobacterium avium subsp. paratuberculosis
ccucgcgcaccggcugcc

SEQ ID NO: 3001099 - RNA, 21 nt, Mycobacterium avium subsp. paratuberculosis
ccucgcgcaccggcugcccca

SEQ ID NO: 3001100 - RNA, 15 nt, Mycobacterium avium subsp. paratuberculosis
ccucgcgcagggcca

SEQ ID NO: 3001101 - RNA, 14 nt, Mycobacterium avium subsp. paratuberculosis
ccucgcgcccggcg

SEQ ID NO: 3001102 - RNA, 15 nt, Mycobacterium avium subsp. paratuberculosis
ccucgcgcccggcgc

SEQ ID NO: 3001103 - RNA, 17 nt, Mycobacterium avium subsp. paratuberculosis
ccucgcgcccggcgccg

SEQ ID NO: 3001104 - RNA, 13 nt, Mycobacterium avium subsp. paratuberculosis
ccucgcgccgcca

SEQ ID NO: 3001105 - RNA, 16 nt, Mycobacterium avium subsp. paratuberculosis
ccucgcgccgccacgc

SEQ ID NO: 3001106 - RNA, 17 nt, Mycobacterium avium subsp. paratuberculosis
ccucgcgccgccacgcg

SEQ ID NO: 3001107 - RNA, 23 nt, Mycobacterium avium subsp. paratuberculosis
ccucgcgccgccacgcggcgcgc

SEQ ID NO: 3001108 - RNA, 14 nt, Mycobacterium avium subsp. paratuberculosis
ccucgcgcggcacc

SEQ ID NO: 3001109 - RNA, 14 nt, Mycobacterium avium subsp. paratuberculosis
ccucgcgcggggcg

SEQ ID NO: 3001110 - RNA, 16 nt, Mycobacterium avium subsp. paratuberculosis
ccucgcgcggggcggc

SEQ ID NO: 3001111 - RNA, 17 nt, Mycobacterium avium subsp. paratuberculosis
ccucgcgcggggcggcc

SEQ ID NO: 3001112 - RNA, 21 nt, Mycobacterium avium subsp. paratuberculosis
ccucgcgcggggcggccgccg

SEQ ID NO: 3001113 - RNA, 12 nt, Mycobacterium avium subsp. paratuberculosis
ccucgcgcguca

SEQ ID NO: 3001114 - RNA, 18 nt, Mycobacterium avium subsp. paratuberculosis
ccucgcgcgucacgcugg

SEQ ID NO: 3001115 - RNA, 14 nt, Mycobacterium avium subsp. paratuberculosis
ccucgcggcagccu

SEQ ID NO: 3001116 - RNA, 13 nt, Mycobacterium avium subsp. paratuberculosis
ccucgcggcggcg

SEQ ID NO: 3001117 - RNA, 20 nt, Mycobacterium avium subsp. paratuberculosis
ccucgcggcggcgucggcgu

SEQ ID NO: 3001118 - RNA, 22 nt, Mycobacterium avium subsp. paratuberculosis
ccucgcggcggcgucggcgucc

SEQ ID NO: 3001119 - RNA, 13 nt, Mycobacterium avium subsp. paratuberculosis
ccucgcggcgguc

SEQ ID NO: 3001120 - RNA, 20 nt, Mycobacterium avium subsp. paratuberculosis
ccucgcgggcgaucuccagc

SEQ ID NO: 3001121 - RNA, 22 nt, Mycobacterium avium subsp. paratuberculosis
ccucgcgggugcuggucagcau

SEQ ID NO: 3001122 - RNA, 21 nt, Mycobacterium avium subsp. paratuberculosis
ccucgcgguugcggguggcgg

SEQ ID NO: 3001123 - RNA, 22 nt, Mycobacterium avium subsp. paratuberculosis
ccucgcucaacccgucgcgggu

SEQ ID NO: 3001124 - RNA, 13 nt, Mycobacterium avium subsp. paratuberculosis
ccucgcugaccuc

SEQ ID NO: 3001125 - RNA, 18 nt, Mycobacterium avium subsp. paratuberculosis
ccucgcugaucuucugga

SEQ ID NO: 3001126 - RNA, 13 nt, Mycobacterium avium subsp. paratuberculosis
ccucgcugccggc

SEQ ID NO: 3001127 - RNA, 15 nt, Mycobacterium avium subsp. paratuberculosis
ccucgcugccggccg

SEQ ID NO: 3001128 - RNA, 16 nt, Mycobacterium avium subsp. paratuberculosis
ccucgcugccggccgg

SEQ ID NO: 3001129 - RNA, 12 nt, Mycobacterium avium subsp. paratuberculosis
ccucgcuguccu

SEQ ID NO: 3001130 - RNA, 20 nt, Mycobacterium avium subsp. paratuberculosis
ccucgcuguccugccgggcg

SEQ ID NO: 3001131 - RNA, 24 nt, Mycobacterium avium subsp. paratuberculosis
ccucggacccgaugaucgagcacg

SEQ ID NO: 3001132 - RNA, 15 nt, Mycobacterium avium subsp. paratuberculosis
ccucggacucgucgc

SEQ ID NO: 3001133 - RNA, 20 nt, Mycobacterium avium subsp. paratuberculosis
ccucggagaugauggccgcg

SEQ ID NO: 3001134 - RNA, 13 nt, Mycobacterium avium subsp. paratuberculosis
ccucggaggccac

SEQ ID NO: 3001135 - RNA, 18 nt, Mycobacterium avium subsp. paratuberculosis
ccucggaggccaccgcgc

SEQ ID NO: 3001136 - RNA, 20 nt, Mycobacterium avium subsp. paratuberculosis
ccucggaggccaccgcgccg

SEQ ID NO: 3001137 - RNA, 21 nt, Mycobacterium avium subsp. paratuberculosis
ccucggaggccaccgcgccgu

SEQ ID NO: 3001138 - RNA, 22 nt, Mycobacterium avium subsp. paratuberculosis
ccucggaggccaccgcgccguc

SEQ ID NO: 3001139 - RNA, 15 nt, Mycobacterium avium subsp. paratuberculosis
ccucggaggugccgc

SEQ ID NO: 3001140 - RNA, 16 nt, Mycobacterium avium subsp. paratuberculosis
ccucggaggugccgcg

SEQ ID NO: 3001141 - RNA, 18 nt, Mycobacterium avium subsp. paratuberculosis
ccucggaggugccgcgcg

SEQ ID NO: 3001142 - RNA, 19 nt, Mycobacterium avium subsp. paratuberculosis
ccucggaggugccgcgcgg

SEQ ID NO: 3001143 - RNA, 17 nt, Mycobacterium avium subsp. paratuberculosis
ccucggcaccgugccgc

SEQ ID NO: 3001144 - RNA, 18 nt, Mycobacterium avium subsp. paratuberculosis
ccucggcaccgugccgcg

SEQ ID NO: 3001145 - RNA, 20 nt, Mycobacterium avium subsp. paratuberculosis
ccucggcaccgugccgcgcg

SEQ ID NO: 3001146 - RNA, 14 nt, Mycobacterium avium subsp. paratuberculosis
ccucggccaccacc

SEQ ID NO: 3001147 - RNA, 22 nt, Mycobacterium avium subsp. paratuberculosis
ccucggccaccagaugccgggc

SEQ ID NO: 3001148 - RNA, 12 nt, Mycobacterium avium subsp. paratuberculosis
ccucggccagca

SEQ ID NO: 3001149 - RNA, 15 nt, Mycobacterium avium subsp. paratuberculosis
ccucggccagcacca

SEQ ID NO: 3001150 - RNA, 22 nt, Mycobacterium avium subsp. paratuberculosis
ccucggccagcaccagcagccg

SEQ ID NO: 3001151 - RNA, 13 nt, Mycobacterium avium subsp. paratuberculosis
ccucggccagcca

SEQ ID NO: 3001152 - RNA, 20 nt, Mycobacterium avium subsp. paratuberculosis
ccucggccagccccaccacc

SEQ ID NO: 3001153 - RNA, 21 nt, Mycobacterium avium subsp. paratuberculosis
ccucggccagccccaccaccg

SEQ ID NO: 3001154 - RNA, 14 nt, Mycobacterium avium subsp. paratuberculosis
ccucggccagcgcc

SEQ ID NO: 3001155 - RNA, 18 nt, Mycobacterium avium subsp. paratuberculosis
ccucggccagcguguugc

SEQ ID NO: 3001156 - RNA, 19 nt, Mycobacterium avium subsp. paratuberculosis
ccucggccagcucaccggc

SEQ ID NO: 3001157 - RNA, 21 nt, Mycobacterium avium subsp. paratuberculosis
ccucggccagcucaccggcca

SEQ ID NO: 3001158 - RNA, 12 nt, Mycobacterium avium subsp. paratuberculosis
ccucggccaggu

SEQ ID NO: 3001159 - RNA, 20 nt, Mycobacterium avium subsp. paratuberculosis
ccucggccccaaaagccuug

SEQ ID NO: 3001160 - RNA, 13 nt, Mycobacterium avium subsp. paratuberculosis
ccucggccgccac

SEQ ID NO: 3001161 - RNA, 14 nt, Mycobacterium avium subsp. paratuberculosis
ccucggccgccacc

SEQ ID NO: 3001162 - RNA, 20 nt, Mycobacterium avium subsp. paratuberculosis
ccucggccgccaccgccauc

SEQ ID NO: 3001163 - RNA, 16 nt, Mycobacterium avium subsp. paratuberculosis
ccucggccggguccug

SEQ ID NO: 3001164 - RNA, 22 nt, Mycobacterium avium subsp. paratuberculosis
ccucggccggguccuggaaggc

SEQ ID NO: 3001165 - RNA, 19 nt, Mycobacterium avium subsp. paratuberculosis
ccucggccguaccggcgua

SEQ ID NO: 3001166 - RNA, 21 nt, Mycobacterium avium subsp. paratuberculosis
ccucggccucgucgacgucgg

SEQ ID NO: 3001167 - RNA, 18 nt, Mycobacterium avium subsp. paratuberculosis
ccucggccugcgcccggc

SEQ ID NO: 3001168 - RNA, 17 nt, Mycobacterium avium subsp. paratuberculosis
ccucggccuugaccacg

SEQ ID NO: 3001169 - RNA, 18 nt, Mycobacterium avium subsp. paratuberculosis
ccucggccuugccgcugu

SEQ ID NO: 3001170 - RNA, 15 nt, Mycobacterium avium subsp. paratuberculosis
ccucggcgaccacgu

SEQ ID NO: 3001171 - RNA, 14 nt, Mycobacterium avium subsp. paratuberculosis
ccucggcgaccagc

SEQ ID NO: 3001172 - RNA, 18 nt, Mycobacterium avium subsp. paratuberculosis
ccucggcgacgauggcca

SEQ ID NO: 3001173 - RNA, 23 nt, Mycobacterium avium subsp. paratuberculosis
ccucggcgacgauggccaggccc

SEQ ID NO: 3001174 - RNA, 20 nt, Mycobacterium avium subsp. paratuberculosis
ccucggcgagccgcucccgc

SEQ ID NO: 3001175 - RNA, 19 nt, Mycobacterium avium subsp. paratuberculosis
ccucggcgagcgaggccau

SEQ ID NO: 3001176 - RNA, 11 nt, Mycobacterium avium subsp. paratuberculosis
ccucggcgauc

SEQ ID NO: 3001177 - RNA, 16 nt, Mycobacterium avium subsp. paratuberculosis
ccucggcgaucggccg

SEQ ID NO: 3001178 - RNA, 17 nt, Mycobacterium avium subsp. paratuberculosis
ccucggcgaugccgagg

SEQ ID NO: 3001179 - RNA, 12 nt, Mycobacterium avium subsp. paratuberculosis
ccucggcgaugu

SEQ ID NO: 3001180 - RNA, 20 nt, Mycobacterium avium subsp. paratuberculosis
ccucggcgcggaugacgugc

SEQ ID NO: 3001181 - RNA, 18 nt, Mycobacterium avium subsp. paratuberculosis
ccucggcgcucgccgcgc

SEQ ID NO: 3001182 - RNA, 20 nt, Mycobacterium avium subsp. paratuberculosis
ccucggcgcucgccgcgcgg

SEQ ID NO: 3001183 - RNA, 22 nt, Mycobacterium avium subsp. paratuberculosis
ccucggcgcucgccgcgcggcc

SEQ ID NO: 3001184 - RNA, 16 nt, Mycobacterium avium subsp. paratuberculosis
ccucggcgcugcccgc

SEQ ID NO: 3001185 - RNA, 20 nt, Mycobacterium avium subsp. paratuberculosis
ccucggcgcugcccgccgcg

SEQ ID NO: 3001186 - RNA, 21 nt, Mycobacterium avium subsp. paratuberculosis
ccucggcgcugcccgccgcgg

SEQ ID NO: 3001187 - RNA, 14 nt, Mycobacterium avium subsp. paratuberculosis
ccucggcggcaccg

SEQ ID NO: 3001188 - RNA, 17 nt, Mycobacterium avium subsp. paratuberculosis
ccucggcggcaccgccc

SEQ ID NO: 3001189 - RNA, 19 nt, Mycobacterium avium subsp. paratuberculosis
ccucggcggcaccgcccgg

SEQ ID NO: 3001190 - RNA, 14 nt, Mycobacterium avium subsp. paratuberculosis
ccucggcggccagc

SEQ ID NO: 3001191 - RNA, 17 nt, Mycobacterium avium subsp. paratuberculosis
ccucggcggccagcgcg

SEQ ID NO: 3001192 - RNA, 13 nt, Mycobacterium avium subsp. paratuberculosis
ccucggcggcccc

SEQ ID NO: 3001193 - RNA, 13 nt, Mycobacterium avium subsp. paratuberculosis
ccucggcggccgc

SEQ ID NO: 3001194 - RNA, 16 nt, Mycobacterium avium subsp. paratuberculosis
ccucggcggccgggau

SEQ ID NO: 3001195 - RNA, 17 nt, Mycobacterium avium subsp. paratuberculosis
ccucggcggccgggaug

SEQ ID NO: 3001196 - RNA, 13 nt, Mycobacterium avium subsp. paratuberculosis
ccucggcggccuc

SEQ ID NO: 3001197 - RNA, 15 nt, Mycobacterium avium subsp. paratuberculosis
ccucggcggcggcgc

SEQ ID NO: 3001198 - RNA, 17 nt, Mycobacterium avium subsp. paratuberculosis
ccucggcggcggcgcgc

SEQ ID NO: 3001199 - RNA, 18 nt, Mycobacterium avium subsp. paratuberculosis
ccucggcggcggcgcgcc

SEQ ID NO: 3001200 - RNA, 19 nt, Mycobacterium avium subsp. paratuberculosis
ccucggcggcggcgcgccg

SEQ ID NO: 3001201 - RNA, 22 nt, Mycobacterium avium subsp. paratuberculosis
ccucggcggcggcgcgccggcc

SEQ ID NO: 3001202 - RNA, 23 nt, Mycobacterium avium subsp. paratuberculosis
ccucggcgggaucggaccgcacc

SEQ ID NO: 3001203 - RNA, 18 nt, Mycobacterium avium subsp. paratuberculosis
ccucggcgggccgcccgg

SEQ ID NO: 3001204 - RNA, 21 nt, Mycobacterium avium subsp. paratuberculosis
ccucggcgggccgcccggcgc

SEQ ID NO: 3001205 - RNA, 23 nt, Mycobacterium avium subsp. paratuberculosis
ccucggcgggccgcccggcgcgc

SEQ ID NO: 3001206 - RNA, 21 nt, Mycobacterium avium subsp. paratuberculosis
ccucggcguagaggugcagcg

SEQ ID NO: 3001207 - RNA, 15 nt, Mycobacterium avium subsp. paratuberculosis
ccucggcgucccguc

SEQ ID NO: 3001208 - RNA, 16 nt, Mycobacterium avium subsp. paratuberculosis
ccucggcgucggcgcg

SEQ ID NO: 3001209 - RNA, 21 nt, Mycobacterium avium subsp. paratuberculosis
ccucggcgucggcgcgugcca

SEQ ID NO: 3001210 - RNA, 18 nt, Mycobacterium avium subsp. paratuberculosis
ccucggcguggcaggcga

SEQ ID NO: 3001211 - RNA, 11 nt, Mycobacterium avium subsp. paratuberculosis
ccucgggcacg

SEQ ID NO: 3001212 - RNA, 13 nt, Mycobacterium avium subsp. paratuberculosis
ccucgggcacguc

SEQ ID NO: 3001213 - RNA, 19 nt, Mycobacterium avium subsp. paratuberculosis
ccucgggcacguccagccc

SEQ ID NO: 3001214 - RNA, 21 nt, Mycobacterium avium subsp. paratuberculosis
ccucgggcacguccagcccgc

SEQ ID NO: 3001215 - RNA, 18 nt, Mycobacterium avium subsp. paratuberculosis
ccucgggcauuggcagcu

SEQ ID NO: 3001216 - RNA, 13 nt, Mycobacterium avium subsp. paratuberculosis
ccucgggccggca

SEQ ID NO: 3001217 - RNA, 14 nt, Mycobacterium avium subsp. paratuberculosis
ccucgggccggcag

SEQ ID NO: 3001218 - RNA, 17 nt, Mycobacterium avium subsp. paratuberculosis
ccucgggccggcagccg

SEQ ID NO: 3001219 - RNA, 15 nt, Mycobacterium avium subsp. paratuberculosis
ccucgggccgggcgg

SEQ ID NO: 3001220 - RNA, 16 nt, Mycobacterium avium subsp. paratuberculosis
ccucggggaucgccag

SEQ ID NO: 3001221 - RNA, 22 nt, Mycobacterium avium subsp. paratuberculosis
ccucggggcguggcggaagcgc

SEQ ID NO: 3001222 - RNA, 15 nt, Mycobacterium avium subsp. paratuberculosis
ccucggggcucacca

SEQ ID NO: 3001223 - RNA, 18 nt, Mycobacterium avium subsp. paratuberculosis
ccucggggcugcgcggcu

SEQ ID NO: 3001224 - RNA, 22 nt, Mycobacterium avium subsp. paratuberculosis
ccucggggcugcgcggcuugcu

SEQ ID NO: 3001225 - RNA, 24 nt, Mycobacterium avium subsp. paratuberculosis
ccucgggggugaaggcggccaccg

SEQ ID NO: 3001226 - RNA, 19 nt, Mycobacterium avium subsp. paratuberculosis
ccucgggguacucggcggc

SEQ ID NO: 3001227 - RNA, 15 nt, Mycobacterium avium subsp. paratuberculosis
ccucgggguagccgg

SEQ ID NO: 3001228 - RNA, 19 nt, Mycobacterium avium subsp. paratuberculosis
ccucgggguagccggcccg

SEQ ID NO: 3001229 - RNA, 20 nt, Mycobacterium avium subsp. paratuberculosis
ccucgggguagccggcccgc

SEQ ID NO: 3001230 - RNA, 14 nt, Mycobacterium avium subsp. paratuberculosis
ccucggggugguga

SEQ ID NO: 3001231 - RNA, 21 nt, Mycobacterium avium subsp. paratuberculosis
ccucggguguaggcccgauca

SEQ ID NO: 3001232 - RNA, 13 nt, Mycobacterium avium subsp. paratuberculosis
ccucggucacggu

SEQ ID NO: 3001233 - RNA, 20 nt, Mycobacterium avium subsp. paratuberculosis
ccucggucagguagccgagg

SEQ ID NO: 3001234 - RNA, 14 nt, Mycobacterium avium subsp. paratuberculosis
ccucggucgccgaa

SEQ ID NO: 3001235 - RNA, 18 nt, Mycobacterium avium subsp. paratuberculosis
ccucggucgcgugaccgg

SEQ ID NO: 3001236 - RNA, 22 nt, Mycobacterium avium subsp. paratuberculosis
ccucggucgcgugaccggcggu

SEQ ID NO: 3001237 - RNA, 23 nt, Mycobacterium avium subsp. paratuberculosis
ccucggugaagccgcggacggcg

SEQ ID NO: 3001238 - RNA, 14 nt, Mycobacterium avium subsp. paratuberculosis
ccucggugaccucg

SEQ ID NO: 3001239 - RNA, 15 nt, Mycobacterium avium subsp. paratuberculosis
ccucggugaccucga

SEQ ID NO: 3001240 - RNA, 14 nt, Mycobacterium avium subsp. paratuberculosis
ccucggugagcagc

SEQ ID NO: 3001241 - RNA, 15 nt, Mycobacterium avium subsp. paratuberculosis
ccucggugagcagcu

SEQ ID NO: 3001242 - RNA, 14 nt, Mycobacterium avium subsp. paratuberculosis
ccucggugaucuca

SEQ ID NO: 3001243 - RNA, 21 nt, Mycobacterium avium subsp. paratuberculosis
ccucggugaugucgacgucgu

SEQ ID NO: 3001244 - RNA, 19 nt, Mycobacterium avium subsp. paratuberculosis
ccucggugcggaacaccgc

SEQ ID NO: 3001245 - RNA, 22 nt, Mycobacterium avium subsp. paratuberculosis
ccucggugcggaacaccgccuu

SEQ ID NO: 3001246 - RNA, 22 nt, Mycobacterium avium subsp. paratuberculosis
ccucggugcucuugacggccgc

SEQ ID NO: 3001247 - RNA, 13 nt, Mycobacterium avium subsp. paratuberculosis
ccucgguggccuc

SEQ ID NO: 3001248 - RNA, 16 nt, Mycobacterium avium subsp. paratuberculosis
ccucgguggucgacga

SEQ ID NO: 3001249 - RNA, 21 nt, Mycobacterium avium subsp. paratuberculosis
ccucggugucgaggucgucgg

SEQ ID NO: 3001250 - RNA, 20 nt, Mycobacterium avium subsp. paratuberculosis
ccucgguucugcagcgagau

SEQ ID NO: 3001251 - RNA, 22 nt, Mycobacterium avium subsp. paratuberculosis
ccucgguuucgaacugggucug

SEQ ID NO: 3001252 - RNA, 19 nt, Mycobacterium avium subsp. paratuberculosis
ccucguagacgaagcggcc

SEQ ID NO: 3001253 - RNA, 23 nt, Mycobacterium avium subsp. paratuberculosis
ccucguagacgaagcggccgggg

SEQ ID NO: 3001254 - RNA, 15 nt, Mycobacterium avium subsp. paratuberculosis
ccucguagcggccgc

SEQ ID NO: 3001255 - RNA, 17 nt, Mycobacterium avium subsp. paratuberculosis
ccucguagcggccgcac

SEQ ID NO: 3001256 - RNA, 21 nt, Mycobacterium avium subsp. paratuberculosis
ccucgucaccgugggcggcgc

SEQ ID NO: 3001257 - RNA, 22 nt, Mycobacterium avium subsp. paratuberculosis
ccucguccgacagcgccugccc

SEQ ID NO: 3001258 - RNA, 16 nt, Mycobacterium avium subsp. paratuberculosis
ccucguccgcggcggc

SEQ ID NO: 3001259 - RNA, 22 nt, Mycobacterium avium subsp. paratuberculosis
ccucgucgaagccgaucaccgg

SEQ ID NO: 3001260 - RNA, 16 nt, Mycobacterium avium subsp. paratuberculosis
ccucgucgaccagggc

SEQ ID NO: 3001261 - RNA, 14 nt, Mycobacterium avium subsp. paratuberculosis
ccucgucgaccgcg

SEQ ID NO: 3001262 - RNA, 15 nt, Mycobacterium avium subsp. paratuberculosis
ccucgucgaccgcgg

SEQ ID NO: 3001263 - RNA, 18 nt, Mycobacterium avium subsp. paratuberculosis
ccucgucgaccgcggccu

SEQ ID NO: 3001264 - RNA, 15 nt, Mycobacterium avium subsp. paratuberculosis
ccucgucgacggcgg

SEQ ID NO: 3001265 - RNA, 14 nt, Mycobacterium avium subsp. paratuberculosis
ccucgucgagcagc

SEQ ID NO: 3001266 - RNA, 18 nt, Mycobacterium avium subsp. paratuberculosis
ccucgucgagcagcgccc

SEQ ID NO: 3001267 - RNA, 19 nt, Mycobacterium avium subsp. paratuberculosis
ccucgucgagcagcgcccg

SEQ ID NO: 3001268 - RNA, 21 nt, Mycobacterium avium subsp. paratuberculosis
ccucgucgagcagcgcccggc

SEQ ID NO: 3001269 - RNA, 12 nt, Mycobacterium avium subsp. paratuberculosis
ccucgucgagcc

SEQ ID NO: 3001270 - RNA, 15 nt, Mycobacterium avium subsp. paratuberculosis
ccucgucgagccggg

SEQ ID NO: 3001271 - RNA, 16 nt, Mycobacterium avium subsp. paratuberculosis
ccucgucgagccgggc

SEQ ID NO: 3001272 - RNA, 18 nt, Mycobacterium avium subsp. paratuberculosis
ccucgucgagccgggccc

SEQ ID NO: 3001273 - RNA, 12 nt, Mycobacterium avium subsp. paratuberculosis
ccucgucgagcu

SEQ ID NO: 3001274 - RNA, 16 nt, Mycobacterium avium subsp. paratuberculosis
ccucgucgagcuccau

SEQ ID NO: 3001275 - RNA, 11 nt, Mycobacterium avium subsp. paratuberculosis
ccucgucgaug

SEQ ID NO: 3001276 - RNA, 19 nt, Mycobacterium avium subsp. paratuberculosis
ccucgucgaugucggcggc

SEQ ID NO: 3001277 - RNA, 13 nt, Mycobacterium avium subsp. paratuberculosis
ccucgucgccauc

SEQ ID NO: 3001278 - RNA, 15 nt, Mycobacterium avium subsp. paratuberculosis
ccucgucgccgcggu

SEQ ID NO: 3001279 - RNA, 15 nt, Mycobacterium avium subsp. paratuberculosis
ccucgucgccgucgg

SEQ ID NO: 3001280 - RNA, 18 nt, Mycobacterium avium subsp. paratuberculosis
ccucgucgccgucggggu

SEQ ID NO: 3001281 - RNA, 21 nt, Mycobacterium avium subsp. paratuberculosis
ccucgucgcuaccucaccacg

SEQ ID NO: 3001282 - RNA, 23 nt, Mycobacterium avium subsp. paratuberculosis
ccucgucggaggcgucgacgcgc

SEQ ID NO: 3001283 - RNA, 13 nt, Mycobacterium avium subsp. paratuberculosis
ccucgucggcgaa

SEQ ID NO: 3001284 - RNA, 15 nt, Mycobacterium avium subsp. paratuberculosis
ccucgucggcgagca

SEQ ID NO: 3001285 - RNA, 23 nt, Mycobacterium avium subsp. paratuberculosis
ccucgucggcgagcagcagcgcg

SEQ ID NO: 3001286 - RNA, 21 nt, Mycobacterium avium subsp. paratuberculosis
ccucgucggcgagcagcugca

SEQ ID NO: 3001287 - RNA, 12 nt, Mycobacterium avium subsp. paratuberculosis
ccucgucggcgc

SEQ ID NO: 3001288 - RNA, 14 nt, Mycobacterium avium subsp. paratuberculosis
ccucgucggcgccg

SEQ ID NO: 3001289 - RNA, 17 nt, Mycobacterium avium subsp. paratuberculosis
ccucgucggcggcgacg

SEQ ID NO: 3001290 - RNA, 21 nt, Mycobacterium avium subsp. paratuberculosis
ccucgucggcggcgacggcga

SEQ ID NO: 3001291 - RNA, 21 nt, Mycobacterium avium subsp. paratuberculosis
ccucgucgggcgccagcccgc

SEQ ID NO: 3001292 - RNA, 23 nt, Mycobacterium avium subsp. paratuberculosis
ccucgucgggcgccagcccgccc

SEQ ID NO: 3001293 - RNA, 13 nt, Mycobacterium avium subsp. paratuberculosis
ccucgucggggaa

SEQ ID NO: 3001294 - RNA, 15 nt, Mycobacterium avium subsp. paratuberculosis
ccucgucgguccagg

SEQ ID NO: 3001295 - RNA, 18 nt, Mycobacterium avium subsp. paratuberculosis
ccucgucgguccaggugg

SEQ ID NO: 3001296 - RNA, 19 nt, Mycobacterium avium subsp. paratuberculosis
ccucgucuuccgcggcggc

SEQ ID NO: 3001297 - RNA, 19 nt, Mycobacterium avium subsp. paratuberculosis
ccucgugcguagcggcccg

SEQ ID NO: 3001298 - RNA, 22 nt, Mycobacterium avium subsp. paratuberculosis
ccucguggaaaucgagcgcgcu

SEQ ID NO: 3001299 - RNA, 17 nt, Mycobacterium avium subsp. paratuberculosis
ccucguucuggcccgcc

SEQ ID NO: 3001300 - RNA, 23 nt, Mycobacterium avium subsp. paratuberculosis
ccucucagcgcugucgcgggccc

SEQ ID NO: 3001301 - RNA, 22 nt, Mycobacterium avium subsp. paratuberculosis
ccucucgaagcgacaaaggagg

SEQ ID NO: 3001302 - RNA, 15 nt, Mycobacterium avium subsp. paratuberculosis
ccucucggcgccguc

SEQ ID NO: 3001303 - RNA, 20 nt, Mycobacterium avium subsp. paratuberculosis
ccucucgggaaacgcgucgc

SEQ ID NO: 3001304 - RNA, 13 nt, Mycobacterium avium subsp. paratuberculosis
ccucugccacggc

SEQ ID NO: 3001305 - RNA, 15 nt, Mycobacterium avium subsp. paratuberculosis
ccucugccacggcgg

SEQ ID NO: 3001306 - RNA, 17 nt, Mycobacterium avium subsp. paratuberculosis
ccucugccagaucugua

SEQ ID NO: 3001307 - RNA, 20 nt, Mycobacterium avium subsp. paratuberculosis
ccucugcgaccacccggacg

SEQ ID NO: 3001308 - RNA, 18 nt, Mycobacterium avium subsp. paratuberculosis
ccucuucgaaagccaccc

SEQ ID NO: 3001309 - RNA, 21 nt, Mycobacterium avium subsp. paratuberculosis
ccucuucgcggauccgggccg

SEQ ID NO: 3001310 - RNA, 22 nt, Mycobacterium avium subsp. paratuberculosis
ccucuucgcggauccgggccgc

SEQ ID NO: 3001311 - RNA, 17 nt, Mycobacterium avium subsp. paratuberculosis
ccucuucgcugccgccg

SEQ ID NO: 3001312 - RNA, 18 nt, Mycobacterium avium subsp. paratuberculosis
ccucuucgcuggacagcc

SEQ ID NO: 3001313 - RNA, 24 nt, Mycobacterium avium subsp. paratuberculosis
ccucuucgcuggacagccacagcu

SEQ ID NO: 3001314 - RNA, 13 nt, Mycobacterium avium subsp. paratuberculosis
ccucuucggcgcc

SEQ ID NO: 3001315 - RNA, 18 nt, Mycobacterium avium subsp. paratuberculosis
ccucuucggcgccggcau

SEQ ID NO: 3001316 - RNA, 20 nt, Mycobacterium avium subsp. paratuberculosis
ccucuucggcgccggcaucc

SEQ ID NO: 3001317 - RNA, 14 nt, Mycobacterium avium subsp. paratuberculosis
ccucuucggcgcgc

SEQ ID NO: 3001318 - RNA, 21 nt, Mycobacterium avium subsp. paratuberculosis
ccucuucggggguggccagcu

SEQ ID NO: 3001319 - RNA, 15 nt, Mycobacterium avium subsp. paratuberculosis
ccugaaccagcucgu

SEQ ID NO: 3001320 - RNA, 18 nt, Mycobacterium avium subsp. paratuberculosis
ccugaaccgcgcacucga

SEQ ID NO: 3001321 - RNA, 16 nt, Mycobacterium avium subsp. paratuberculosis
ccugaacggccgcgca

SEQ ID NO: 3001322 - RNA, 21 nt, Mycobacterium avium subsp. paratuberculosis
ccugacacagcaccggcgucg

SEQ ID NO: 3001323 - RNA, 22 nt, Mycobacterium avium subsp. paratuberculosis
ccugacacagcaccggcgucga

SEQ ID NO: 3001324 - RNA, 23 nt, Mycobacterium avium subsp. paratuberculosis
ccugacacagcaccggcgucgac

SEQ ID NO: 3001325 - RNA, 16 nt, Mycobacterium avium subsp. paratuberculosis
ccugacagacccgauc

SEQ ID NO: 3001326 - RNA, 17 nt, Mycobacterium avium subsp. paratuberculosis
ccugacagacccgaucg

SEQ ID NO: 3001327 - RNA, 13 nt, Mycobacterium avium subsp. paratuberculosis
ccugaccaaggac

SEQ ID NO: 3001328 - RNA, 12 nt, Mycobacterium avium subsp. paratuberculosis
ccugaccagcgg

SEQ ID NO: 3001329 - RNA, 18 nt, Mycobacterium avium subsp. paratuberculosis
ccugaccagcggcgcgcc

SEQ ID NO: 3001330 - RNA, 19 nt, Mycobacterium avium subsp. paratuberculosis
ccugaccagcggcgcgccg

SEQ ID NO: 3001331 - RNA, 21 nt, Mycobacterium avium subsp. paratuberculosis
ccugaccagcggcgcgccggg

SEQ ID NO: 3001332 - RNA, 14 nt, Mycobacterium avium subsp. paratuberculosis
ccugacccggccgu

SEQ ID NO: 3001333 - RNA, 11 nt, Mycobacterium avium subsp. paratuberculosis
ccugaccgcgg

SEQ ID NO: 3001334 - RNA, 15 nt, Mycobacterium avium subsp. paratuberculosis
ccugaccgcgggccc

SEQ ID NO: 3001335 - RNA, 19 nt, Mycobacterium avium subsp. paratuberculosis
ccugaccgcgggcccgccg

SEQ ID NO: 3001336 - RNA, 14 nt, Mycobacterium avium subsp. paratuberculosis
ccugaccgcgggug

SEQ ID NO: 3001337 - RNA, 15 nt, Mycobacterium avium subsp. paratuberculosis
ccugaccgucggcca

SEQ ID NO: 3001338 - RNA, 16 nt, Mycobacterium avium subsp. paratuberculosis
ccugaccgugcuuggc

SEQ ID NO: 3001339 - RNA, 15 nt, Mycobacterium avium subsp. paratuberculosis
ccugacgcaccucgc

SEQ ID NO: 3001340 - RNA, 15 nt, Mycobacterium avium subsp. paratuberculosis
ccugacgcaucacca

SEQ ID NO: 3001341 - RNA, 20 nt, Mycobacterium avium subsp. paratuberculosis
ccugacgcaucaccacgcug

SEQ ID NO: 3001342 - RNA, 17 nt, Mycobacterium avium subsp. paratuberculosis
ccugacgcucggucgcc

SEQ ID NO: 3001343 - RNA, 19 nt, Mycobacterium avium subsp. paratuberculosis
ccugacugagucaagccgg

SEQ ID NO: 3001344 - RNA, 22 nt, Mycobacterium avium subsp. paratuberculosis
ccugacugagucaagccggcau

SEQ ID NO: 3001345 - RNA, 14 nt, Mycobacterium avium subsp. paratuberculosis
ccugagacgacgcc

SEQ ID NO: 3001346 - RNA, 18 nt, Mycobacterium avium subsp. paratuberculosis
ccugagacgacgccacca

SEQ ID NO: 3001347 - RNA, 12 nt, Mycobacterium avium subsp. paratuberculosis
ccugagccgccg

SEQ ID NO: 3001348 - RNA, 13 nt, Mycobacterium avium subsp. paratuberculosis
ccugagccgccgg

SEQ ID NO: 3001349 - RNA, 17 nt, Mycobacterium avium subsp. paratuberculosis
ccugagcuuuucgucgg

SEQ ID NO: 3001350 - RNA, 19 nt, Mycobacterium avium subsp. paratuberculosis
ccugagcuuuucgucggug

SEQ ID NO: 3001351 - RNA, 20 nt, Mycobacterium avium subsp. paratuberculosis
ccugagcuuuucgucggugc

SEQ ID NO: 3001352 - RNA, 22 nt, Mycobacterium avium subsp. paratuberculosis
ccugaggcccggugagccucag

SEQ ID NO: 3001353 - RNA, 19 nt, Mycobacterium avium subsp. paratuberculosis
ccugagggugucggcgauc

SEQ ID NO: 3001354 - RNA, 20 nt, Mycobacterium avium subsp. paratuberculosis
ccugagggugucggcgaucc

SEQ ID NO: 3001355 - RNA, 15 nt, Mycobacterium avium subsp. paratuberculosis
ccugauacgacgucc

SEQ ID NO: 3001356 - RNA, 19 nt, Mycobacterium avium subsp. paratuberculosis
ccugauacgacguccgggc

SEQ ID NO: 3001357 - RNA, 23 nt, Mycobacterium avium subsp. paratuberculosis
ccugauacgacguccgggccgcc

SEQ ID NO: 3001358 - RNA, 13 nt, Mycobacterium avium subsp. paratuberculosis
ccugauccgcggu

SEQ ID NO: 3001359 - RNA, 20 nt, Mycobacterium avium subsp. paratuberculosis
ccugaucgaguuccgcgucg

SEQ ID NO: 3001360 - RNA, 22 nt, Mycobacterium avium subsp. paratuberculosis
ccugaucgaguuccgcgucggc

SEQ ID NO: 3001361 - RNA, 17 nt, Mycobacterium avium subsp. paratuberculosis
ccugaucgaugccgugg

SEQ ID NO: 3001362 - RNA, 14 nt, Mycobacterium avium subsp. paratuberculosis
ccugaucgcggcga

SEQ ID NO: 3001363 - RNA, 16 nt, Mycobacterium avium subsp. paratuberculosis
ccugaucgcggcgagc

SEQ ID NO: 3001364 - RNA, 20 nt, Mycobacterium avium subsp. paratuberculosis
ccugaucgcggcgagcagcg

SEQ ID NO: 3001365 - RNA, 22 nt, Mycobacterium avium subsp. paratuberculosis
ccugaucgcggcgagcagcgcg

SEQ ID NO: 3001366 - RNA, 23 nt, Mycobacterium avium subsp. paratuberculosis
ccugaucgcggcgagcagcgcga

SEQ ID NO: 3001367 - RNA, 21 nt, Mycobacterium avium subsp. paratuberculosis
ccugaucuucgagacacgcgc

SEQ ID NO: 3001368 - RNA, 14 nt, Mycobacterium avium subsp. paratuberculosis
ccugaucuugcugg

SEQ ID NO: 3001369 - RNA, 22 nt, Mycobacterium avium subsp. paratuberculosis
ccugcaacuggucgugcagcac

SEQ ID NO: 3001370 - RNA, 21 nt, Mycobacterium avium subsp. paratuberculosis
ccugcaaggcccccgccucgc

SEQ ID NO: 3001371 - RNA, 13 nt, Mycobacterium avium subsp. paratuberculosis
ccugcaccaccac

SEQ ID NO: 3001372 - RNA, 16 nt, Mycobacterium avium subsp. paratuberculosis
ccugcaccaccacacc

SEQ ID NO: 3001373 - RNA, 21 nt, Mycobacterium avium subsp. paratuberculosis
ccugcaccaccacacccagcg

SEQ ID NO: 3001374 - RNA, 23 nt, Mycobacterium avium subsp. paratuberculosis
ccugcaccaccacacccagcgcc

SEQ ID NO: 3001375 - RNA, 13 nt, Mycobacterium avium subsp. paratuberculosis
ccugcaccacgaa

SEQ ID NO: 3001376 - RNA, 15 nt, Mycobacterium avium subsp. paratuberculosis
ccugcacccagccgu

SEQ ID NO: 3001377 - RNA, 14 nt, Mycobacterium avium subsp. paratuberculosis
ccugcacccagguc

SEQ ID NO: 3001378 - RNA, 14 nt, Mycobacterium avium subsp. paratuberculosis
ccugcaccgacugc

SEQ ID NO: 3001379 - RNA, 15 nt, Mycobacterium avium subsp. paratuberculosis
ccugcaccggcgacg

SEQ ID NO: 3001380 - RNA, 21 nt, Mycobacterium avium subsp. paratuberculosis
ccugcaccggcgacggcgguu

SEQ ID NO: 3001381 - RNA, 15 nt, Mycobacterium avium subsp. paratuberculosis
ccugcaccuggguga

SEQ ID NO: 3001382 - RNA, 12 nt, Mycobacterium avium subsp. paratuberculosis
ccugcaccuugc

SEQ ID NO: 3001383 - RNA, 19 nt, Mycobacterium avium subsp. paratuberculosis
ccugcaccuugcccgucgc

SEQ ID NO: 3001384 - RNA, 23 nt, Mycobacterium avium subsp. paratuberculosis
ccugcacgaaauaaccgcgcggc

SEQ ID NO: 3001385 - RNA, 21 nt, Mycobacterium avium subsp. paratuberculosis
ccugcacgaagucgaccgcgg

SEQ ID NO: 3001386 - RNA, 22 nt, Mycobacterium avium subsp. paratuberculosis
ccugcacgaagucgaccgcggc

SEQ ID NO: 3001387 - RNA, 19 nt, Mycobacterium avium subsp. paratuberculosis
ccugcacgaucucggcggu

SEQ ID NO: 3001388 - RNA, 21 nt, Mycobacterium avium subsp. paratuberculosis
ccugcacgcugaagcacaccg

SEQ ID NO: 3001389 - RNA, 14 nt, Mycobacterium avium subsp. paratuberculosis
ccugcacggggacg

SEQ ID NO: 3001390 - RNA, 19 nt, Mycobacterium avium subsp. paratuberculosis
ccugcacggggacgucguc

SEQ ID NO: 3001391 - RNA, 15 nt, Mycobacterium avium subsp. paratuberculosis
ccugcacggugccgc

SEQ ID NO: 3001392 - RNA, 13 nt, Mycobacterium avium subsp. paratuberculosis
ccugcacggugcg

SEQ ID NO: 3001393 - RNA, 12 nt, Mycobacterium avium subsp. paratuberculosis
ccugcacgucgg

SEQ ID NO: 3001394 - RNA, 18 nt, Mycobacterium avium subsp. paratuberculosis
ccugcacuaccccgucga

SEQ ID NO: 3001395 - RNA, 13 nt, Mycobacterium avium subsp. paratuberculosis
ccugcagcaccag

SEQ ID NO: 3001396 - RNA, 14 nt, Mycobacterium avium subsp. paratuberculosis
ccugcagcaccagg

SEQ ID NO: 3001397 - RNA, 21 nt, Mycobacterium avium subsp. paratuberculosis
ccugcagcaccaggcccucgc

SEQ ID NO: 3001398 - RNA, 14 nt, Mycobacterium avium subsp. paratuberculosis
ccugcagcaccgaa

SEQ ID NO: 3001399 - RNA, 16 nt, Mycobacterium avium subsp. paratuberculosis
ccugcagccgccgcgc

SEQ ID NO: 3001400 - RNA, 23 nt, Mycobacterium avium subsp. paratuberculosis
ccugcagccgccgcgccaccgag

SEQ ID NO: 3001401 - RNA, 16 nt, Mycobacterium avium subsp. paratuberculosis
ccugcagccggguggc

SEQ ID NO: 3001402 - RNA, 15 nt, Mycobacterium avium subsp. paratuberculosis
ccugcagccggucgg

SEQ ID NO: 3001403 - RNA, 20 nt, Mycobacterium avium subsp. paratuberculosis
ccugcagcgccguccgcacc

SEQ ID NO: 3001404 - RNA, 13 nt, Mycobacterium avium subsp. paratuberculosis
ccugcagcgccuu

SEQ ID NO: 3001405 - RNA, 19 nt, Mycobacterium avium subsp. paratuberculosis
ccugcagcgccuugaccgc

SEQ ID NO: 3001406 - RNA, 13 nt, Mycobacterium avium subsp. paratuberculosis
ccugcagcgcggu

SEQ ID NO: 3001407 - RNA, 23 nt, Mycobacterium avium subsp. paratuberculosis
ccugcagcgcggucaucgucauc

SEQ ID NO: 3001408 - RNA, 14 nt, Mycobacterium avium subsp. paratuberculosis
ccugcagcucgccg

SEQ ID NO: 3001409 - RNA, 16 nt, Mycobacterium avium subsp. paratuberculosis
ccugcagcucgccggc

SEQ ID NO: 3001410 - RNA, 12 nt, Mycobacterium avium subsp. paratuberculosis
ccugcagcucgg

SEQ ID NO: 3001411 - RNA, 14 nt, Mycobacterium avium subsp. paratuberculosis
ccugcagcucggug

SEQ ID NO: 3001412 - RNA, 16 nt, Mycobacterium avium subsp. paratuberculosis
ccugcagcucggugcg

SEQ ID NO: 3001413 - RNA, 19 nt, Mycobacterium avium subsp. paratuberculosis
ccugcagcucggugcgcac

SEQ ID NO: 3001414 - RNA, 23 nt, Mycobacterium avium subsp. paratuberculosis
ccugcagcucggugcgcaccccg

SEQ ID NO: 3001415 - RNA, 12 nt, Mycobacterium avium subsp. paratuberculosis
ccugcagcuggc

SEQ ID NO: 3001416 - RNA, 13 nt, Mycobacterium avium subsp. paratuberculosis
ccugcagcuggcg

SEQ ID NO: 3001417 - RNA, 22 nt, Mycobacterium avium subsp. paratuberculosis
ccugcagcuggcgaauccgggc

SEQ ID NO: 3001418 - RNA, 22 nt, Mycobacterium avium subsp. paratuberculosis
ccugcaggaucagcacuucaug

SEQ ID NO: 3001419 - RNA, 17 nt, Mycobacterium avium subsp. paratuberculosis
ccugcagguagguggcc

SEQ ID NO: 3001420 - RNA, 15 nt, Mycobacterium avium subsp. paratuberculosis
ccugcaggucgcggu

SEQ ID NO: 3001421 - RNA, 18 nt, Mycobacterium avium subsp. paratuberculosis
ccugcaggucgcgguggg

SEQ ID NO: 3001422 - RNA, 21 nt, Mycobacterium avium subsp. paratuberculosis
ccugcaggucgcggugggcgc

SEQ ID NO: 3001423 - RNA, 20 nt, Mycobacterium avium subsp. paratuberculosis
ccugcagguucugcacgugg

SEQ ID NO: 3001424 - RNA, 20 nt, Mycobacterium avium subsp. paratuberculosis
ccugcaucucgacccgggcc

SEQ ID NO: 3001425 - RNA, 14 nt, Mycobacterium avium subsp. paratuberculosis
ccugccacagcgac

SEQ ID NO: 3001426 - RNA, 15 nt, Mycobacterium avium subsp. paratuberculosis
ccugccacagcgaca

SEQ ID NO: 3001427 - RNA, 13 nt, Mycobacterium avium subsp. paratuberculosis
ccugccaccgcga

SEQ ID NO: 3001428 - RNA, 12 nt, Mycobacterium avium subsp. paratuberculosis
ccugccagcggc

SEQ ID NO: 3001429 - RNA, 13 nt, Mycobacterium avium subsp. paratuberculosis
ccugcccagcggc

SEQ ID NO: 3001430 - RNA, 16 nt, Mycobacterium avium subsp. paratuberculosis
ccugcccagcggcacg

SEQ ID NO: 3001431 - RNA, 14 nt, Mycobacterium avium subsp. paratuberculosis
ccugccccacacgc

SEQ ID NO: 3001432 - RNA, 20 nt, Mycobacterium avium subsp. paratuberculosis
ccugccccacacgcucggcg

SEQ ID NO: 3001433 - RNA, 14 nt, Mycobacterium avium subsp. paratuberculosis
ccugccccacggcc

SEQ ID NO: 3001434 - RNA, 12 nt, Mycobacterium avium subsp. paratuberculosis
ccugcccgccgc

SEQ ID NO: 3001435 - RNA, 17 nt, Mycobacterium avium subsp. paratuberculosis
ccugcccgcgcaggccc

SEQ ID NO: 3001436 - RNA, 18 nt, Mycobacterium avium subsp. paratuberculosis
ccugcccggagaaaccgu

SEQ ID NO: 3001437 - RNA, 21 nt, Mycobacterium avium subsp. paratuberculosis
ccugcccggcccccugcucag

SEQ ID NO: 3001438 - RNA, 13 nt, Mycobacterium avium subsp. paratuberculosis
ccugcccggcggu

SEQ ID NO: 3001439 - RNA, 14 nt, Mycobacterium avium subsp. paratuberculosis
ccugcccggcggug

SEQ ID NO: 3001440 - RNA, 21 nt, Mycobacterium avium subsp. paratuberculosis
ccugcccgggcccgauggcgg

SEQ ID NO: 3001441 - RNA, 14 nt, Mycobacterium avium subsp. paratuberculosis
ccugcccgggcgcc

SEQ ID NO: 3001442 - RNA, 14 nt, Mycobacterium avium subsp. paratuberculosis
ccugcccggucugc

SEQ ID NO: 3001443 - RNA, 20 nt, Mycobacterium avium subsp. paratuberculosis
ccugcccggucugcggccgc

SEQ ID NO: 3001444 - RNA, 21 nt, Mycobacterium avium subsp. paratuberculosis
ccugcccggucugcggccgcg

SEQ ID NO: 3001445 - RNA, 16 nt, Mycobacterium avium subsp. paratuberculosis
ccugcccgucgggcgc

SEQ ID NO: 3001446 - RNA, 20 nt, Mycobacterium avium subsp. paratuberculosis
ccugcccgucgggcgcggcg

SEQ ID NO: 3001447 - RNA, 15 nt, Mycobacterium avium subsp. paratuberculosis
ccugccgcaacgggc

SEQ ID NO: 3001448 - RNA, 18 nt, Mycobacterium avium subsp. paratuberculosis
ccugccgcaacgggccgc

SEQ ID NO: 3001449 - RNA, 20 nt, Mycobacterium avium subsp. paratuberculosis
ccugccgcaacgggccgcag

SEQ ID NO: 3001450 - RNA, 17 nt, Mycobacterium avium subsp. paratuberculosis
ccugccgcacaccgucu

SEQ ID NO: 3001451 - RNA, 14 nt, Mycobacterium avium subsp. paratuberculosis
ccugccgccaccgc

SEQ ID NO: 3001452 - RNA, 17 nt, Mycobacterium avium subsp. paratuberculosis
ccugccgccaccgcgaa

SEQ ID NO: 3001453 - RNA, 14 nt, Mycobacterium avium subsp. paratuberculosis
ccugccggaugccg

SEQ ID NO: 3001454 - RNA, 21 nt, Mycobacterium avium subsp. paratuberculosis
ccugccggaugccgcgcggcg

SEQ ID NO: 3001455 - RNA, 12 nt, Mycobacterium avium subsp. paratuberculosis
ccugccggccgc

SEQ ID NO: 3001456 - RNA, 14 nt, Mycobacterium avium subsp. paratuberculosis
ccugccggccgccg

SEQ ID NO: 3001457 - RNA, 15 nt, Mycobacterium avium subsp. paratuberculosis
ccugccggccgccgc

SEQ ID NO: 3001458 - RNA, 13 nt, Mycobacterium avium subsp. paratuberculosis
ccugccggcgauc

SEQ ID NO: 3001459 - RNA, 16 nt, Mycobacterium avium subsp. paratuberculosis
ccugccggcgaucacc

SEQ ID NO: 3001460 - RNA, 14 nt, Mycobacterium avium subsp. paratuberculosis
ccugccggcgccgg

SEQ ID NO: 3001461 - RNA, 15 nt, Mycobacterium avium subsp. paratuberculosis
ccugccggcgccgga

SEQ ID NO: 3001462 - RNA, 20 nt, Mycobacterium avium subsp. paratuberculosis
ccugccgucaccggccaucc

SEQ ID NO: 3001463 - RNA, 21 nt, Mycobacterium avium subsp. paratuberculosis
ccugccgucaccggccauccg

SEQ ID NO: 3001464 - RNA, 23 nt, Mycobacterium avium subsp. paratuberculosis
ccugccgucgacgaccaccacca

SEQ ID NO: 3001465 - RNA, 22 nt, Mycobacterium avium subsp. paratuberculosis
ccugccguucggccagcgccgc

SEQ ID NO: 3001466 - RNA, 16 nt, Mycobacterium avium subsp. paratuberculosis
ccugcgaccgccgccg

SEQ ID NO: 3001467 - RNA, 17 nt, Mycobacterium avium subsp. paratuberculosis
ccugcgacggcagcacc

SEQ ID NO: 3001468 - RNA, 19 nt, Mycobacterium avium subsp. paratuberculosis
ccugcgacggcagcaccuc

SEQ ID NO: 3001469 - RNA, 21 nt, Mycobacterium avium subsp. paratuberculosis
ccugcgacuucuacggcgggc

SEQ ID NO: 3001470 - RNA, 16 nt, Mycobacterium avium subsp. paratuberculosis
ccugcgagcacacccu

SEQ ID NO: 3001471 - RNA, 20 nt, Mycobacterium avium subsp. paratuberculosis
ccugcgagcacacccucacc

SEQ ID NO: 3001472 - RNA, 18 nt, Mycobacterium avium subsp. paratuberculosis
ccugcgagcccgggaacg

SEQ ID NO: 3001473 - RNA, 14 nt, Mycobacterium avium subsp. paratuberculosis
ccugcgcaccgcgg

SEQ ID NO: 3001474 - RNA, 14 nt, Mycobacterium avium subsp. paratuberculosis
ccugcgccagcagc

SEQ ID NO: 3001475 - RNA, 21 nt, Mycobacterium avium subsp. paratuberculosis
ccugcgccagcagcagcgcgg

SEQ ID NO: 3001476 - RNA, 17 nt, Mycobacterium avium subsp. paratuberculosis
ccugcgcccacaggucc

SEQ ID NO: 3001477 - RNA, 12 nt, Mycobacterium avium subsp. paratuberculosis
ccugcgccgccg

SEQ ID NO: 3001478 - RNA, 14 nt, Mycobacterium avium subsp. paratuberculosis
ccugcgccgcggug

SEQ ID NO: 3001479 - RNA, 16 nt, Mycobacterium avium subsp. paratuberculosis
ccugcgccgcggugcg

SEQ ID NO: 3001480 - RNA, 23 nt, Mycobacterium avium subsp. paratuberculosis
ccugcgccuuggccucgguggcg

SEQ ID NO: 3001481 - RNA, 14 nt, Mycobacterium avium subsp. paratuberculosis
ccugcgcgaaaggc

SEQ ID NO: 3001482 - RNA, 20 nt, Mycobacterium avium subsp. paratuberculosis
ccugcgcgaaaggcccaccg

SEQ ID NO: 3001483 - RNA, 19 nt, Mycobacterium avium subsp. paratuberculosis
ccugcgcgacgcugauggc

SEQ ID NO: 3001484 - RNA, 15 nt, Mycobacterium avium subsp. paratuberculosis
ccugcgcgaucgccg

SEQ ID NO: 3001485 - RNA, 18 nt, Mycobacterium avium subsp. paratuberculosis
ccugcgcgcccugcuggg

SEQ ID NO: 3001486 - RNA, 13 nt, Mycobacterium avium subsp. paratuberculosis
ccugcgcgccgau

SEQ ID NO: 3001487 - RNA, 21 nt, Mycobacterium avium subsp. paratuberculosis
ccugcgcgccgauguggccgg

SEQ ID NO: 3001488 - RNA, 20 nt, Mycobacterium avium subsp. paratuberculosis
ccugcgcggaaguggaccgc

SEQ ID NO: 3001489 - RNA, 22 nt, Mycobacterium avium subsp. paratuberculosis
ccugcgcggccgcgucggcggc

SEQ ID NO: 3001490 - RNA, 18 nt, Mycobacterium avium subsp. paratuberculosis
ccugcgcggccugcagca

SEQ ID NO: 3001491 - RNA, 14 nt, Mycobacterium avium subsp. paratuberculosis
ccugcgcggcgaug

SEQ ID NO: 3001492 - RNA, 18 nt, Mycobacterium avium subsp. paratuberculosis
ccugcgcgggcgcggaca

SEQ ID NO: 3001493 - RNA, 13 nt, Mycobacterium avium subsp. paratuberculosis
ccugcgcgucguc

SEQ ID NO: 3001494 - RNA, 15 nt, Mycobacterium avium subsp. paratuberculosis
ccugcgcgucgucgc

SEQ ID NO: 3001495 - RNA, 18 nt, Mycobacterium avium subsp. paratuberculosis
ccugcgcgucgucgcccg

SEQ ID NO: 3001496 - RNA, 20 nt, Mycobacterium avium subsp. paratuberculosis
ccugcgcgucgucgcccgaa

SEQ ID NO: 3001497 - RNA, 15 nt, Mycobacterium avium subsp. paratuberculosis
ccugcgcugcggcca

SEQ ID NO: 3001498 - RNA, 17 nt, Mycobacterium avium subsp. paratuberculosis
ccugcggcaacagcacc

SEQ ID NO: 3001499 - RNA, 19 nt, Mycobacterium avium subsp. paratuberculosis
ccugcggcaacagcaccag

SEQ ID NO: 3001500 - RNA, 23 nt, Mycobacterium avium subsp. paratuberculosis
ccugcggcaacagcaccagcacc

SEQ ID NO: 3001501 - RNA, 14 nt, Mycobacterium avium subsp. paratuberculosis
ccugcggcaccucg

SEQ ID NO: 3001502 - RNA, 23 nt, Mycobacterium avium subsp. paratuberculosis
ccugcggcaccucggccuugacc

SEQ ID NO: 3001503 - RNA, 21 nt, Mycobacterium avium subsp. paratuberculosis
ccugcggcagguaggcgccgc

SEQ ID NO: 3001504 - RNA, 20 nt, Mycobacterium avium subsp. paratuberculosis
ccugcggcaggucggccagc

SEQ ID NO: 3001505 - RNA, 18 nt, Mycobacterium avium subsp. paratuberculosis
ccugcggccagugccggg

SEQ ID NO: 3001506 - RNA, 19 nt, Mycobacterium avium subsp. paratuberculosis
ccugcggccagugccgggc

SEQ ID NO: 3001507 - RNA, 16 nt, Mycobacterium avium subsp. paratuberculosis
ccugcggcccagcgua

SEQ ID NO: 3001508 - RNA, 13 nt, Mycobacterium avium subsp. paratuberculosis
ccugcggccccug

SEQ ID NO: 3001509 - RNA, 14 nt, Mycobacterium avium subsp. paratuberculosis
ccugcggccccugc

SEQ ID NO: 3001510 - RNA, 17 nt, Mycobacterium avium subsp. paratuberculosis
ccugcggcccgucgccg

SEQ ID NO: 3001511 - RNA, 18 nt, Mycobacterium avium subsp. paratuberculosis
ccugcggcccgucgccgu

SEQ ID NO: 3001512 - RNA, 13 nt, Mycobacterium avium subsp. paratuberculosis
ccugcggcgcggc

SEQ ID NO: 3001513 - RNA, 22 nt, Mycobacterium avium subsp. paratuberculosis
ccugcggcgcggccaccccggu

SEQ ID NO: 3001514 - RNA, 13 nt, Mycobacterium avium subsp. paratuberculosis
ccugcggcggcag

SEQ ID NO: 3001515 - RNA, 15 nt, Mycobacterium avium subsp. paratuberculosis
ccugcggcggcaguc

SEQ ID NO: 3001516 - RNA, 22 nt, Mycobacterium avium subsp. paratuberculosis
ccugcggcggcagucgcagcag

SEQ ID NO: 3001517 - RNA, 18 nt, Mycobacterium avium subsp. paratuberculosis
ccugcggcucgucggcga

SEQ ID NO: 3001518 - RNA, 20 nt, Mycobacterium avium subsp. paratuberculosis
ccugcggcugguagaugccg

SEQ ID NO: 3001519 - RNA, 17 nt, Mycobacterium avium subsp. paratuberculosis
ccugcgggaacagcggg

SEQ ID NO: 3001520 - RNA, 18 nt, Mycobacterium avium subsp. paratuberculosis
ccugcgggcccaccgcgc

SEQ ID NO: 3001521 - RNA, 13 nt, Mycobacterium avium subsp. paratuberculosis
ccugcgggcccag

SEQ ID NO: 3001522 - RNA, 14 nt, Mycobacterium avium subsp. paratuberculosis
ccugcgggcccagc

SEQ ID NO: 3001523 - RNA, 15 nt, Mycobacterium avium subsp. paratuberculosis
ccugcgggcccagcu

SEQ ID NO: 3001524 - RNA, 22 nt, Mycobacterium avium subsp. paratuberculosis
ccugcgggcccagcucggugcg

SEQ ID NO: 3001525 - RNA, 12 nt, Mycobacterium avium subsp. paratuberculosis
ccugcgggcgcc

SEQ ID NO: 3001526 - RNA, 18 nt, Mycobacterium avium subsp. paratuberculosis
ccugcgggcgccggcugc

SEQ ID NO: 3001527 - RNA, 19 nt, Mycobacterium avium subsp. paratuberculosis
ccugcggggugucgaccca

SEQ ID NO: 3001528 - RNA, 21 nt, Mycobacterium avium subsp. paratuberculosis
ccugcggggugucgacccagg

SEQ ID NO: 3001529 - RNA, 23 nt, Mycobacterium avium subsp. paratuberculosis
ccugcggggugucgacccagguc

SEQ ID NO: 3001530 - RNA, 19 nt, Mycobacterium avium subsp. paratuberculosis
ccugcggguucuggccgug

SEQ ID NO: 3001531 - RNA, 15 nt, Mycobacterium avium subsp. paratuberculosis
ccugcggugaugcgc

SEQ ID NO: 3001532 - RNA, 17 nt, Mycobacterium avium subsp. paratuberculosis
ccugcggugaugcgcgg

SEQ ID NO: 3001533 - RNA, 19 nt, Mycobacterium avium subsp. paratuberculosis
ccugcggugaugcgcggcg

SEQ ID NO: 3001534 - RNA, 20 nt, Mycobacterium avium subsp. paratuberculosis
ccugcggugaugcgcggcga

SEQ ID NO: 3001535 - RNA, 22 nt, Mycobacterium avium subsp. paratuberculosis
ccugcggugaugcgcggcgacg

SEQ ID NO: 3001536 - RNA, 14 nt, Mycobacterium avium subsp. paratuberculosis
ccugcggugggcgc

SEQ ID NO: 3001537 - RNA, 17 nt, Mycobacterium avium subsp. paratuberculosis
ccugcgguucgggcccc

SEQ ID NO: 3001538 - RNA, 19 nt, Mycobacterium avium subsp. paratuberculosis
ccugcgucacuccucgauc

SEQ ID NO: 3001539 - RNA, 15 nt, Mycobacterium avium subsp. paratuberculosis
ccugcguccgauacc

SEQ ID NO: 3001540 - RNA, 18 nt, Mycobacterium avium subsp. paratuberculosis
ccugcguccgauaccagc

SEQ ID NO: 3001541 - RNA, 21 nt, Mycobacterium avium subsp. paratuberculosis
ccugcguccgauaccagccgc

SEQ ID NO: 3001542 - RNA, 16 nt, Mycobacterium avium subsp. paratuberculosis
ccugcguccggcccgg

SEQ ID NO: 3001543 - RNA, 17 nt, Mycobacterium avium subsp. paratuberculosis
ccugcguccggcccggc

SEQ ID NO: 3001544 - RNA, 18 nt, Mycobacterium avium subsp. paratuberculosis
ccugcguccggcccggcg

SEQ ID NO: 3001545 - RNA, 19 nt, Mycobacterium avium subsp. paratuberculosis
ccugcguccggcccggcgu

SEQ ID NO: 3001546 - RNA, 15 nt, Mycobacterium avium subsp. paratuberculosis
ccugcgucugcuugu

SEQ ID NO: 3001547 - RNA, 14 nt, Mycobacterium avium subsp. paratuberculosis
ccugcucaccgagc

SEQ ID NO: 3001548 - RNA, 18 nt, Mycobacterium avium subsp. paratuberculosis
ccugcucagcggccaucg

SEQ ID NO: 3001549 - RNA, 12 nt, Mycobacterium avium subsp. paratuberculosis
ccugcuccagcg

SEQ ID NO: 3001550 - RNA, 22 nt, Mycobacterium avium subsp. paratuberculosis
ccugcuccucgaaccucgcggc

SEQ ID NO: 3001551 - RNA, 23 nt, Mycobacterium avium subsp. paratuberculosis
ccugcucgaugcgcgccagcagc

SEQ ID NO: 3001552 - RNA, 22 nt, Mycobacterium avium subsp. paratuberculosis
ccugcucgcagauggucgggac

SEQ ID NO: 3001553 - RNA, 17 nt, Mycobacterium avium subsp. paratuberculosis
ccugcucgcgggccacc

SEQ ID NO: 3001554 - RNA, 20 nt, Mycobacterium avium subsp. paratuberculosis
ccugcucgcgggccaccgcg

SEQ ID NO: 3001555 - RNA, 18 nt, Mycobacterium avium subsp. paratuberculosis
ccugcucgcuugccagcc

SEQ ID NO: 3001556 - RNA, 20 nt, Mycobacterium avium subsp. paratuberculosis
ccugcucgcuugccagccgg

SEQ ID NO: 3001557 - RNA, 22 nt, Mycobacterium avium subsp. paratuberculosis
ccugcucgcuugccagccgggc

SEQ ID NO: 3001558 - RNA, 14 nt, Mycobacterium avium subsp. paratuberculosis
ccugcucggccagc

SEQ ID NO: 3001559 - RNA, 19 nt, Mycobacterium avium subsp. paratuberculosis
ccugcucggccagcgggug

SEQ ID NO: 3001560 - RNA, 19 nt, Mycobacterium avium subsp. paratuberculosis
ccugcucgucgacgcugac

SEQ ID NO: 3001561 - RNA, 22 nt, Mycobacterium avium subsp. paratuberculosis
ccugcucgucgacgcugaccgu

SEQ ID NO: 3001562 - RNA, 19 nt, Mycobacterium avium subsp. paratuberculosis
ccugcucgucggggcagcc

SEQ ID NO: 3001563 - RNA, 17 nt, Mycobacterium avium subsp. paratuberculosis
ccugcucuucgcgcgcg

SEQ ID NO: 3001564 - RNA, 20 nt, Mycobacterium avium subsp. paratuberculosis
ccugcucuucgcgcgcggcg

SEQ ID NO: 3001565 - RNA, 23 nt, Mycobacterium avium subsp. paratuberculosis
ccugcucuucgcgcgcggcgugg

SEQ ID NO: 3001566 - RNA, 14 nt, Mycobacterium avium subsp. paratuberculosis
ccugcugcucgucg

SEQ ID NO: 3001567 - RNA, 22 nt, Mycobacterium avium subsp. paratuberculosis
ccugcugcucgucgcgggcgcc

SEQ ID NO: 3001568 - RNA, 15 nt, Mycobacterium avium subsp. paratuberculosis
ccugcuggccgggcu

SEQ ID NO: 3001569 - RNA, 13 nt, Mycobacterium avium subsp. paratuberculosis
ccugcuggcgcug

SEQ ID NO: 3001570 - RNA, 18 nt, Mycobacterium avium subsp. paratuberculosis
ccugcuggcguucgccga

SEQ ID NO: 3001571 - RNA, 15 nt, Mycobacterium avium subsp. paratuberculosis
ccugcugggcggcac

SEQ ID NO: 3001572 - RNA, 16 nt, Mycobacterium avium subsp. paratuberculosis
ccugcugggcggcacc

SEQ ID NO: 3001573 - RNA, 16 nt, Mycobacterium avium subsp. paratuberculosis
ccugcugggcgggcag

SEQ ID NO: 3001574 - RNA, 18 nt, Mycobacterium avium subsp. paratuberculosis
ccugcugggcgggcagcc

SEQ ID NO: 3001575 - RNA, 21 nt, Mycobacterium avium subsp. paratuberculosis
ccugcugggcgggcagccgcu

SEQ ID NO: 3001576 - RNA, 12 nt, Mycobacterium avium subsp. paratuberculosis
ccugcuuccagg

SEQ ID NO: 3001577 - RNA, 18 nt, Mycobacterium avium subsp. paratuberculosis
ccugcuucuggaugcggu

SEQ ID NO: 3001578 - RNA, 14 nt, Mycobacterium avium subsp. paratuberculosis
ccugcuugaccgcc

SEQ ID NO: 3001579 - RNA, 18 nt, Mycobacterium avium subsp. paratuberculosis
ccugcuugaccgccagac

SEQ ID NO: 3001580 - RNA, 15 nt, Mycobacterium avium subsp. paratuberculosis
ccugcuugaccgcga

SEQ ID NO: 3001581 - RNA, 15 nt, Mycobacterium avium subsp. paratuberculosis
ccugcuugaccgugg

SEQ ID NO: 3001582 - RNA, 14 nt, Mycobacterium avium subsp. paratuberculosis
ccugcuugagcccg

SEQ ID NO: 3001583 - RNA, 17 nt, Mycobacterium avium subsp. paratuberculosis
ccugcuugagcccgucg

SEQ ID NO: 3001584 - RNA, 20 nt, Mycobacterium avium subsp. paratuberculosis
ccugcuugagcccgucgacg

SEQ ID NO: 3001585 - RNA, 22 nt, Mycobacterium avium subsp. paratuberculosis
ccugcuugaugaugccggccgc

SEQ ID NO: 3001586 - RNA, 16 nt, Mycobacterium avium subsp. paratuberculosis
ccugcuuggcggccug

SEQ ID NO: 3001587 - RNA, 22 nt, Mycobacterium avium subsp. paratuberculosis
ccugcuuggcggccugcgccag

SEQ ID NO: 3001588 - RNA, 21 nt, Mycobacterium avium subsp. paratuberculosis
ccugcuugggcagcagcucga

SEQ ID NO: 3001589 - RNA, 17 nt, Mycobacterium avium subsp. paratuberculosis
ccugcuuggucgccugc

SEQ ID NO: 3001590 - RNA, 19 nt, Mycobacterium avium subsp. paratuberculosis
ccugcuuggucuccggccc

SEQ ID NO: 3001591 - RNA, 21 nt, Mycobacterium avium subsp. paratuberculosis
ccugcuuggucuccggccccg

SEQ ID NO: 3001592 - RNA, 20 nt, Mycobacterium avium subsp. paratuberculosis
ccugcuuguugagggugacg

SEQ ID NO: 3001593 - RNA, 17 nt, Mycobacterium avium subsp. paratuberculosis
ccugcuuuucggccgag

SEQ ID NO: 3001594 - RNA, 22 nt, Mycobacterium avium subsp. paratuberculosis
ccugcuuuucggccgagucgac

SEQ ID NO: 3001595 - RNA, 19 nt, Mycobacterium avium subsp. paratuberculosis
ccuggaaaccccucagccg

SEQ ID NO: 3001596 - RNA, 20 nt, Mycobacterium avium subsp. paratuberculosis
ccuggaaaccccucagccgg

SEQ ID NO: 3001597 - RNA, 12 nt, Mycobacterium avium subsp. paratuberculosis
ccuggaaccggg

SEQ ID NO: 3001598 - RNA, 14 nt, Mycobacterium avium subsp. paratuberculosis
ccuggaacuuguug

SEQ ID NO: 3001599 - RNA, 17 nt, Mycobacterium avium subsp. paratuberculosis
ccuggaagcgcaucgcc

SEQ ID NO: 3001600 - RNA, 16 nt, Mycobacterium avium subsp. paratuberculosis
ccuggaaggacgucag

SEQ ID NO: 3001601 - RNA, 21 nt, Mycobacterium avium subsp. paratuberculosis
ccuggaaggacgucaggccgg

SEQ ID NO: 3001602 - RNA, 20 nt, Mycobacterium avium subsp. paratuberculosis
ccuggacgacgucgaugugc

SEQ ID NO: 3001603 - RNA, 18 nt, Mycobacterium avium subsp. paratuberculosis
ccuggacgaguggucggc

SEQ ID NO: 3001604 - RNA, 22 nt, Mycobacterium avium subsp. paratuberculosis
ccuggacgaguggucggccgcc

SEQ ID NO: 3001605 - RNA, 15 nt, Mycobacterium avium subsp. paratuberculosis
ccuggacgccgcacg

SEQ ID NO: 3001606 - RNA, 22 nt, Mycobacterium avium subsp. paratuberculosis
ccuggacgccgcacgcgaccgc

SEQ ID NO: 3001607 - RNA, 22 nt, Mycobacterium avium subsp. paratuberculosis
ccuggacgguuucaccgccguc

SEQ ID NO: 3001608 - RNA, 16 nt, Mycobacterium avium subsp. paratuberculosis
ccuggagcggguccgc

SEQ ID NO: 3001609 - RNA, 20 nt, Mycobacterium avium subsp. paratuberculosis
ccuggagcggguccgccccg

SEQ ID NO: 3001610 - RNA, 23 nt, Mycobacterium avium subsp. paratuberculosis
ccuggaggccaacgagcgcgccg

SEQ ID NO: 3001611 - RNA, 14 nt, Mycobacterium avium subsp. paratuberculosis
ccuggauauccagc

SEQ ID NO: 3001612 - RNA, 14 nt, Mycobacterium avium subsp. paratuberculosis
ccuggaucagccag

SEQ ID NO: 3001613 - RNA, 19 nt, Mycobacterium avium subsp. paratuberculosis
ccuggaucagccaguugau

SEQ ID NO: 3001614 - RNA, 21 nt, Mycobacterium avium subsp. paratuberculosis
ccuggaucccgaacugccgcg

SEQ ID NO: 3001615 - RNA, 18 nt, Mycobacterium avium subsp. paratuberculosis
ccuggaucgcgccuuggg

SEQ ID NO: 3001616 - RNA, 21 nt, Mycobacterium avium subsp. paratuberculosis
ccuggaucgcgccuugggcca

SEQ ID NO: 3001617 - RNA, 16 nt, Mycobacterium avium subsp. paratuberculosis
ccuggaugaacagcac

SEQ ID NO: 3001618 - RNA, 23 nt, Mycobacterium avium subsp. paratuberculosis
ccuggaugaacagcacgugcccg

SEQ ID NO: 3001619 - RNA, 14 nt, Mycobacterium avium subsp. paratuberculosis
ccuggaugccgccc

SEQ ID NO: 3001620 - RNA, 15 nt, Mycobacterium avium subsp. paratuberculosis
ccuggaugucacggu

SEQ ID NO: 3001621 - RNA, 20 nt, Mycobacterium avium subsp. paratuberculosis
ccuggaugucacgguccagg

SEQ ID NO: 3001622 - RNA, 18 nt, Mycobacterium avium subsp. paratuberculosis
ccuggcacgacgccgccg

SEQ ID NO: 3001623 - RNA, 20 nt, Mycobacterium avium subsp. paratuberculosis
ccuggcagcauccgccgacg

SEQ ID NO: 3001624 - RNA, 17 nt, Mycobacterium avium subsp. paratuberculosis
ccuggcaggugagccgg

SEQ ID NO: 3001625 - RNA, 16 nt, Mycobacterium avium subsp. paratuberculosis
ccuggcauccgucggc

SEQ ID NO: 3001626 - RNA, 20 nt, Mycobacterium avium subsp. paratuberculosis
ccuggcauccgucggccuug

SEQ ID NO: 3001627 - RNA, 11 nt, Mycobacterium avium subsp. paratuberculosis
ccuggccacca

SEQ ID NO: 3001628 - RNA, 15 nt, Mycobacterium avium subsp. paratuberculosis
ccuggccaccagcag

SEQ ID NO: 3001629 - RNA, 17 nt, Mycobacterium avium subsp. paratuberculosis
ccuggccaccagcagca

SEQ ID NO: 3001630 - RNA, 14 nt, Mycobacterium avium subsp. paratuberculosis
ccuggccaccucga

SEQ ID NO: 3001631 - RNA, 15 nt, Mycobacterium avium subsp. paratuberculosis
ccuggccacgugguc

SEQ ID NO: 3001632 - RNA, 17 nt, Mycobacterium avium subsp. paratuberculosis
ccuggccacguggucgc

SEQ ID NO: 3001633 - RNA, 23 nt, Mycobacterium avium subsp. paratuberculosis
ccuggcccagacaggccggccgc

SEQ ID NO: 3001634 - RNA, 16 nt, Mycobacterium avium subsp. paratuberculosis
ccuggcccagccgcgu

SEQ ID NO: 3001635 - RNA, 22 nt, Mycobacterium avium subsp. paratuberculosis
ccuggccccagaaccgcucggc

SEQ ID NO: 3001636 - RNA, 23 nt, Mycobacterium avium subsp. paratuberculosis
ccuggccccagaaccgcucggcg

SEQ ID NO: 3001637 - RNA, 17 nt, Mycobacterium avium subsp. paratuberculosis
ccuggcccccgccccag

SEQ ID NO: 3001638 - RNA, 18 nt, Mycobacterium avium subsp. paratuberculosis
ccuggcccccgccccagc

SEQ ID NO: 3001639 - RNA, 14 nt, Mycobacterium avium subsp. paratuberculosis
ccuggcccuugacc

SEQ ID NO: 3001640 - RNA, 17 nt, Mycobacterium avium subsp. paratuberculosis
ccuggccgauggucagc

SEQ ID NO: 3001641 - RNA, 21 nt, Mycobacterium avium subsp. paratuberculosis
ccuggccgauggucagcugcc

SEQ ID NO: 3001642 - RNA, 12 nt, Mycobacterium avium subsp. paratuberculosis
ccuggccgccgg

SEQ ID NO: 3001643 - RNA, 13 nt, Mycobacterium avium subsp. paratuberculosis
ccuggccgccgug

SEQ ID NO: 3001644 - RNA, 12 nt, Mycobacterium avium subsp. paratuberculosis
ccuggccggcca

SEQ ID NO: 3001645 - RNA, 15 nt, Mycobacterium avium subsp. paratuberculosis
ccuggccggccaucu

SEQ ID NO: 3001646 - RNA, 13 nt, Mycobacterium avium subsp. paratuberculosis
ccuggccggccuc

SEQ ID NO: 3001647 - RNA, 14 nt, Mycobacterium avium subsp. paratuberculosis
ccuggccgucgcgg

SEQ ID NO: 3001648 - RNA, 18 nt, Mycobacterium avium subsp. paratuberculosis
ccuggccguucaggucga

SEQ ID NO: 3001649 - RNA, 14 nt, Mycobacterium avium subsp. paratuberculosis
ccuggccuggucgg

SEQ ID NO: 3001650 - RNA, 15 nt, Mycobacterium avium subsp. paratuberculosis
ccuggcgaaccgcgg

SEQ ID NO: 3001651 - RNA, 20 nt, Mycobacterium avium subsp. paratuberculosis
ccuggcgaaccgcggcggca

SEQ ID NO: 3001652 - RNA, 19 nt, Mycobacterium avium subsp. paratuberculosis
ccuggcgcaccgccgcggg

SEQ ID NO: 3001653 - RNA, 17 nt, Mycobacterium avium subsp. paratuberculosis
ccuggcgcagcaccgac

SEQ ID NO: 3001654 - RNA, 16 nt, Mycobacterium avium subsp. paratuberculosis
ccuggcgcgcaacgcu

SEQ ID NO: 3001655 - RNA, 22 nt, Mycobacterium avium subsp. paratuberculosis
ccuggcgcgcaacgcuuucggg

SEQ ID NO: 3001656 - RNA, 18 nt, Mycobacterium avium subsp. paratuberculosis
ccuggcgcuggugcagca

SEQ ID NO: 3001657 - RNA, 17 nt, Mycobacterium avium subsp. paratuberculosis
ccuggcggaaggccgcg

SEQ ID NO: 3001658 - RNA, 19 nt, Mycobacterium avium subsp. paratuberculosis
ccuggcggaaggccgcgcg

SEQ ID NO: 3001659 - RNA, 18 nt, Mycobacterium avium subsp. paratuberculosis
ccuggcgggccagcuugu

SEQ ID NO: 3001660 - RNA, 22 nt, Mycobacterium avium subsp. paratuberculosis
ccuggcgggcggcccgcacggc

SEQ ID NO: 3001661 - RNA, 23 nt, Mycobacterium avium subsp. paratuberculosis
ccuggcggguacagccgcagggu

SEQ ID NO: 3001662 - RNA, 14 nt, Mycobacterium avium subsp. paratuberculosis
ccuggcuccccggc

SEQ ID NO: 3001663 - RNA, 21 nt, Mycobacterium avium subsp. paratuberculosis
ccuggcuccccggcgaucucg

SEQ ID NO: 3001664 - RNA, 15 nt, Mycobacterium avium subsp. paratuberculosis
ccuggcugacggcgu

SEQ ID NO: 3001665 - RNA, 16 nt, Mycobacterium avium subsp. paratuberculosis
ccuggcugacggcguc

SEQ ID NO: 3001666 - RNA, 17 nt, Mycobacterium avium subsp. paratuberculosis
ccuggcugacggcgucg

SEQ ID NO: 3001667 - RNA, 18 nt, Mycobacterium avium subsp. paratuberculosis
ccuggcugccugguuggu

SEQ ID NO: 3001668 - RNA, 15 nt, Mycobacterium avium subsp. paratuberculosis
ccuggcuguagcggu

SEQ ID NO: 3001669 - RNA, 23 nt, Mycobacterium avium subsp. paratuberculosis
ccuggcuguagcggucgugcggg

SEQ ID NO: 3001670 - RNA, 20 nt, Mycobacterium avium subsp. paratuberculosis
ccugggacagccggucgacg

SEQ ID NO: 3001671 - RNA, 15 nt, Mycobacterium avium subsp. paratuberculosis
ccugggacagcgaga

SEQ ID NO: 3001672 - RNA, 13 nt, Mycobacterium avium subsp. paratuberculosis
ccugggauugccg

SEQ ID NO: 3001673 - RNA, 13 nt, Mycobacterium avium subsp. paratuberculosis
ccugggcaauggc

SEQ ID NO: 3001674 - RNA, 17 nt, Mycobacterium avium subsp. paratuberculosis
ccugggcaauggccgcg

SEQ ID NO: 3001675 - RNA, 17 nt, Mycobacterium avium subsp. paratuberculosis
ccugggccuccggcggc

SEQ ID NO: 3001676 - RNA, 16 nt, Mycobacterium avium subsp. paratuberculosis
ccugggccucguccag

SEQ ID NO: 3001677 - RNA, 18 nt, Mycobacterium avium subsp. paratuberculosis
ccugggccucguccaggg

SEQ ID NO: 3001678 - RNA, 21 nt, Mycobacterium avium subsp. paratuberculosis
ccugggcggccaccgcgcccc

SEQ ID NO: 3001679 - RNA, 19 nt, Mycobacterium avium subsp. paratuberculosis
ccugggcggcgacacgccg

SEQ ID NO: 3001680 - RNA, 22 nt, Mycobacterium avium subsp. paratuberculosis
ccugggcggcgacacgccgacg

SEQ ID NO: 3001681 - RNA, 12 nt, Mycobacterium avium subsp. paratuberculosis
ccugggcgucga

SEQ ID NO: 3001682 - RNA, 14 nt, Mycobacterium avium subsp. paratuberculosis
ccugggcgucgucg

SEQ ID NO: 3001683 - RNA, 17 nt, Mycobacterium avium subsp. paratuberculosis
ccuggggcagaucgucg

SEQ ID NO: 3001684 - RNA, 19 nt, Mycobacterium avium subsp. paratuberculosis
ccuggggcagaucgucggc

SEQ ID NO: 3001685 - RNA, 15 nt, Mycobacterium avium subsp. paratuberculosis
ccugggggucgguga

SEQ ID NO: 3001686 - RNA, 21 nt, Mycobacterium avium subsp. paratuberculosis
ccugggggucggugaccagcc

SEQ ID NO: 3001687 - RNA, 19 nt, Mycobacterium avium subsp. paratuberculosis
ccuggguaagccaggucac

SEQ ID NO: 3001688 - RNA, 15 nt, Mycobacterium avium subsp. paratuberculosis
ccugggucaucaccu

SEQ ID NO: 3001689 - RNA, 16 nt, Mycobacterium avium subsp. paratuberculosis
ccugggucaucaccuu

SEQ ID NO: 3001690 - RNA, 20 nt, Mycobacterium avium subsp. paratuberculosis
ccugggucucgggaucgccg

SEQ ID NO: 3001691 - RNA, 15 nt, Mycobacterium avium subsp. paratuberculosis
ccugggugagcggcg

SEQ ID NO: 3001692 - RNA, 20 nt, Mycobacterium avium subsp. paratuberculosis
ccugggugaguucgucggcg

SEQ ID NO: 3001693 - RNA, 19 nt, Mycobacterium avium subsp. paratuberculosis
ccugggugaucuuggugaa

SEQ ID NO: 3001694 - RNA, 16 nt, Mycobacterium avium subsp. paratuberculosis
ccugggugcgcggcgc

SEQ ID NO: 3001695 - RNA, 18 nt, Mycobacterium avium subsp. paratuberculosis
ccugggugcgcggcgccg

SEQ ID NO: 3001696 - RNA, 15 nt, Mycobacterium avium subsp. paratuberculosis
ccugguacagcaccg

SEQ ID NO: 3001697 - RNA, 17 nt, Mycobacterium avium subsp. paratuberculosis
ccugguacagcaccgcc

SEQ ID NO: 3001698 - RNA, 19 nt, Mycobacterium avium subsp. paratuberculosis
ccugguacagcaccgccgc

SEQ ID NO: 3001699 - RNA, 16 nt, Mycobacterium avium subsp. paratuberculosis
ccugguaccccagcaa

SEQ ID NO: 3001700 - RNA, 21 nt, Mycobacterium avium subsp. paratuberculosis
ccugguaccccagcaaaaccc

SEQ ID NO: 3001701 - RNA, 15 nt, Mycobacterium avium subsp. paratuberculosis
ccugguacgcgccgu

SEQ ID NO: 3001702 - RNA, 16 nt, Mycobacterium avium subsp. paratuberculosis
ccugguacgcgccguc

SEQ ID NO: 3001703 - RNA, 20 nt, Mycobacterium avium subsp. paratuberculosis
ccugguacgcgccgucgucg

SEQ ID NO: 3001704 - RNA, 15 nt, Mycobacterium avium subsp. paratuberculosis
ccugguagcugagca

SEQ ID NO: 3001705 - RNA, 14 nt, Mycobacterium avium subsp. paratuberculosis
ccugguaggccgcc

SEQ ID NO: 3001706 - RNA, 17 nt, Mycobacterium avium subsp. paratuberculosis
ccugguagggguccucc

SEQ ID NO: 3001707 - RNA, 19 nt, Mycobacterium avium subsp. paratuberculosis
ccugguagggguccuccag

SEQ ID NO: 3001708 - RNA, 16 nt, Mycobacterium avium subsp. paratuberculosis
ccuggucaaggugcug

SEQ ID NO: 3001709 - RNA, 15 nt, Mycobacterium avium subsp. paratuberculosis
ccugguccaccgcgg

SEQ ID NO: 3001710 - RNA, 20 nt, Mycobacterium avium subsp. paratuberculosis
ccugguccaccgcggcggcc

SEQ ID NO: 3001711 - RNA, 11 nt, Mycobacterium avium subsp. paratuberculosis
ccugguccggc

SEQ ID NO: 3001712 - RNA, 18 nt, Mycobacterium avium subsp. paratuberculosis
ccugguccggcgcccgau

SEQ ID NO: 3001713 - RNA, 18 nt, Mycobacterium avium subsp. paratuberculosis
ccugguccucccgggugg

SEQ ID NO: 3001714 - RNA, 19 nt, Mycobacterium avium subsp. paratuberculosis
ccugguccucccggguggg

SEQ ID NO: 3001715 - RNA, 16 nt, Mycobacterium avium subsp. paratuberculosis
ccugguccucgauccg

SEQ ID NO: 3001716 - RNA, 20 nt, Mycobacterium avium subsp. paratuberculosis
ccugguccuuaaucgggacg

SEQ ID NO: 3001717 - RNA, 20 nt, Mycobacterium avium subsp. paratuberculosis
ccuggucgaacagcacgccg

SEQ ID NO: 3001718 - RNA, 24 nt, Mycobacterium avium subsp. paratuberculosis
ccuggucgaacagcacgccggccg

SEQ ID NO: 3001719 - RNA, 20 nt, Mycobacterium avium subsp. paratuberculosis
ccuggucgcuuucggugacc

SEQ ID NO: 3001720 - RNA, 16 nt, Mycobacterium avium subsp. paratuberculosis
ccuggucggccagggc

SEQ ID NO: 3001721 - RNA, 13 nt, Mycobacterium avium subsp. paratuberculosis
ccuggucggccgg

SEQ ID NO: 3001722 - RNA, 14 nt, Mycobacterium avium subsp. paratuberculosis
ccuggucggccggc

SEQ ID NO: 3001723 - RNA, 22 nt, Mycobacterium avium subsp. paratuberculosis
ccuggucggccggcaggccgcc

SEQ ID NO: 3001724 - RNA, 12 nt, Mycobacterium avium subsp. paratuberculosis
ccuggucggcga

SEQ ID NO: 3001725 - RNA, 22 nt, Mycobacterium avium subsp. paratuberculosis
ccuggucgggguggaucgccca

SEQ ID NO: 3001726 - RNA, 14 nt, Mycobacterium avium subsp. paratuberculosis
ccuggucggucagc

SEQ ID NO: 3001727 - RNA, 17 nt, Mycobacterium avium subsp. paratuberculosis
ccuggucggucagcucg

SEQ ID NO: 3001728 - RNA, 22 nt, Mycobacterium avium subsp. paratuberculosis
ccuggucggucagcucgaaggu

SEQ ID NO: 3001729 - RNA, 15 nt, Mycobacterium avium subsp. paratuberculosis
ccuggucgucccagg

SEQ ID NO: 3001730 - RNA, 14 nt, Mycobacterium avium subsp. paratuberculosis
ccuggugaccgacg

SEQ ID NO: 3001731 - RNA, 20 nt, Mycobacterium avium subsp. paratuberculosis
ccuggugaccgacgacguga

SEQ ID NO: 3001732 - RNA, 20 nt, Mycobacterium avium subsp. paratuberculosis
ccuggugaugaaucgucccg

SEQ ID NO: 3001733 - RNA, 13 nt, Mycobacterium avium subsp. paratuberculosis
ccuggugcucgcg

SEQ ID NO: 3001734 - RNA, 15 nt, Mycobacterium avium subsp. paratuberculosis
ccuggugcucgcgcu

SEQ ID NO: 3001735 - RNA, 17 nt, Mycobacterium avium subsp. paratuberculosis
ccuggugcucgcgcucg

SEQ ID NO: 3001736 - RNA, 18 nt, Mycobacterium avium subsp. paratuberculosis
ccuggugcucgcgcucgu

SEQ ID NO: 3001737 - RNA, 18 nt, Mycobacterium avium subsp. paratuberculosis
ccugguugaacggcaccc

SEQ ID NO: 3001738 - RNA, 16 nt, Mycobacterium avium subsp. paratuberculosis
ccugguugacaccacc

SEQ ID NO: 3001739 - RNA, 18 nt, Mycobacterium avium subsp. paratuberculosis
ccugguugacaccaccga

SEQ ID NO: 3001740 - RNA, 18 nt, Mycobacterium avium subsp. paratuberculosis
ccugguugaggaucugca

SEQ ID NO: 3001741 - RNA, 17 nt, Mycobacterium avium subsp. paratuberculosis
ccugguugagugccguc

SEQ ID NO: 3001742 - RNA, 14 nt, Mycobacterium avium subsp. paratuberculosis
ccugguugccgccc

SEQ ID NO: 3001743 - RNA, 21 nt, Mycobacterium avium subsp. paratuberculosis
ccugguugccgcccucggccg

SEQ ID NO: 3001744 - RNA, 23 nt, Mycobacterium avium subsp. paratuberculosis
ccugguugccgcccucggccgua

SEQ ID NO: 3001745 - RNA, 14 nt, Mycobacterium avium subsp. paratuberculosis
ccugguuucaggug

SEQ ID NO: 3001746 - RNA, 18 nt, Mycobacterium avium subsp. paratuberculosis
ccuguagggcgagcucgu

SEQ ID NO: 3001747 - RNA, 18 nt, Mycobacterium avium subsp. paratuberculosis
ccugucaacgagacaccc

SEQ ID NO: 3001748 - RNA, 21 nt, Mycobacterium avium subsp. paratuberculosis
ccugucaacgagacacccucg

SEQ ID NO: 3001749 - RNA, 14 nt, Mycobacterium avium subsp. paratuberculosis
ccuguccgaucacc

SEQ ID NO: 3001750 - RNA, 15 nt, Mycobacterium avium subsp. paratuberculosis
ccuguccgaucaccg

SEQ ID NO: 3001751 - RNA, 13 nt, Mycobacterium avium subsp. paratuberculosis
ccuguccgggucg

SEQ ID NO: 3001752 - RNA, 14 nt, Mycobacterium avium subsp. paratuberculosis
ccuguccggucuuc

SEQ ID NO: 3001753 - RNA, 15 nt, Mycobacterium avium subsp. paratuberculosis
ccugugaggcaccga

SEQ ID NO: 3001754 - RNA, 18 nt, Mycobacterium avium subsp. paratuberculosis
ccugugcaccgugcugug

SEQ ID NO: 3001755 - RNA, 15 nt, Mycobacterium avium subsp. paratuberculosis
ccugugcgacggcgu

SEQ ID NO: 3001756 - RNA, 17 nt, Mycobacterium avium subsp. paratuberculosis
ccugugcgacggcgucg

SEQ ID NO: 3001757 - RNA, 19 nt, Mycobacterium avium subsp. paratuberculosis
ccugugcgacggcgucggc

SEQ ID NO: 3001758 - RNA, 20 nt, Mycobacterium avium subsp. paratuberculosis
ccugugcgacggcgucggcg

SEQ ID NO: 3001759 - RNA, 15 nt, Mycobacterium avium subsp. paratuberculosis
ccugugcgccccacg

SEQ ID NO: 3001760 - RNA, 18 nt, Mycobacterium avium subsp. paratuberculosis
ccugugguuuucgaaacc

SEQ ID NO: 3001761 - RNA, 23 nt, Mycobacterium avium subsp. paratuberculosis
ccuguuccccggcgggcucgccg

SEQ ID NO: 3001762 - RNA, 15 nt, Mycobacterium avium subsp. paratuberculosis
ccuguucgccgucgc

SEQ ID NO: 3001763 - RNA, 16 nt, Mycobacterium avium subsp. paratuberculosis
ccuguucgccgucgcg

SEQ ID NO: 3001764 - RNA, 15 nt, Mycobacterium avium subsp. paratuberculosis
ccuguuggcccugcu

SEQ ID NO: 3001765 - RNA, 18 nt, Mycobacterium avium subsp. paratuberculosis
ccuguugguagcccagga

SEQ ID NO: 3001766 - RNA, 20 nt, Mycobacterium avium subsp. paratuberculosis
ccuguuugcaggcgaucucg

SEQ ID NO: 3001767 - RNA, 22 nt, Mycobacterium avium subsp. paratuberculosis
ccuuacaaagccggucuugggc

SEQ ID NO: 3001768 - RNA, 15 nt, Mycobacterium avium subsp. paratuberculosis
ccuuacgccgacguc

SEQ ID NO: 3001769 - RNA, 18 nt, Mycobacterium avium subsp. paratuberculosis
ccuucaacuugcgcgacg

SEQ ID NO: 3001770 - RNA, 19 nt, Mycobacterium avium subsp. paratuberculosis
ccuucaccagggugccccg

SEQ ID NO: 3001771 - RNA, 18 nt, Mycobacterium avium subsp. paratuberculosis
ccuucaccgaccagcugu

SEQ ID NO: 3001772 - RNA, 14 nt, Mycobacterium avium subsp. paratuberculosis
ccuucaccgcgccg

SEQ ID NO: 3001773 - RNA, 20 nt, Mycobacterium avium subsp. paratuberculosis
ccuucaccgcgccgguccgg

SEQ ID NO: 3001774 - RNA, 18 nt, Mycobacterium avium subsp. paratuberculosis
ccuucacgaccggcagca

SEQ ID NO: 3001775 - RNA, 19 nt, Mycobacterium avium subsp. paratuberculosis
ccuucacgcuggccuccag

SEQ ID NO: 3001776 - RNA, 22 nt, Mycobacterium avium subsp. paratuberculosis
ccuucacgcuggccuccagcuu

SEQ ID NO: 3001777 - RNA, 14 nt, Mycobacterium avium subsp. paratuberculosis
ccuucagccagauc

SEQ ID NO: 3001778 - RNA, 14 nt, Mycobacterium avium subsp. paratuberculosis
ccuucagcgggcgc

SEQ ID NO: 3001779 - RNA, 22 nt, Mycobacterium avium subsp. paratuberculosis
ccuucagcgggcgcagcucguc

SEQ ID NO: 3001780 - RNA, 11 nt, Mycobacterium avium subsp. paratuberculosis
ccuucaucacc

SEQ ID NO: 3001781 - RNA, 14 nt, Mycobacterium avium subsp. paratuberculosis
ccuucaucaccgcc

SEQ ID NO: 3001782 - RNA, 16 nt, Mycobacterium avium subsp. paratuberculosis
ccuucaucaccgcccc

SEQ ID NO: 3001783 - RNA, 15 nt, Mycobacterium avium subsp. paratuberculosis
ccuucaucagcaccg

SEQ ID NO: 3001784 - RNA, 21 nt, Mycobacterium avium subsp. paratuberculosis
ccuucaucgccgucgccaccg

SEQ ID NO: 3001785 - RNA, 14 nt, Mycobacterium avium subsp. paratuberculosis
ccuuccaccaccgc

SEQ ID NO: 3001786 - RNA, 20 nt, Mycobacterium avium subsp. paratuberculosis
ccuuccaccaccgcggcgcc

SEQ ID NO: 3001787 - RNA, 23 nt, Mycobacterium avium subsp. paratuberculosis
ccuuccaccaccgcggcgccguc

SEQ ID NO: 3001788 - RNA, 19 nt, Mycobacterium avium subsp. paratuberculosis
ccuuccacgaccuggcggg

SEQ ID NO: 3001789 - RNA, 13 nt, Mycobacterium avium subsp. paratuberculosis
ccuuccccggcgg

SEQ ID NO: 3001790 - RNA, 18 nt, Mycobacterium avium subsp. paratuberculosis
ccuuccgaggccgcugac

SEQ ID NO: 3001791 - RNA, 22 nt, Mycobacterium avium subsp. paratuberculosis
ccuucgaacgcgacgaagcggu

SEQ ID NO: 3001792 - RNA, 22 nt, Mycobacterium avium subsp. paratuberculosis
ccuucgaaugcgaugagcucgc

SEQ ID NO: 3001793 - RNA, 18 nt, Mycobacterium avium subsp. paratuberculosis
ccuucgacccgguggccc

SEQ ID NO: 3001794 - RNA, 22 nt, Mycobacterium avium subsp. paratuberculosis
ccuucgacggccggcccugcac

SEQ ID NO: 3001795 - RNA, 15 nt, Mycobacterium avium subsp. paratuberculosis
ccuucgagccgccgc

SEQ ID NO: 3001796 - RNA, 16 nt, Mycobacterium avium subsp. paratuberculosis
ccuucgagccgccgcc

SEQ ID NO: 3001797 - RNA, 18 nt, Mycobacterium avium subsp. paratuberculosis
ccuucgagccgccgccgg

SEQ ID NO: 3001798 - RNA, 15 nt, Mycobacterium avium subsp. paratuberculosis
ccuucgaugucgccg

SEQ ID NO: 3001799 - RNA, 22 nt, Mycobacterium avium subsp. paratuberculosis
ccuucgaugucgccggcgaccg

SEQ ID NO: 3001800 - RNA, 16 nt, Mycobacterium avium subsp. paratuberculosis
ccuucgccucguucga

SEQ ID NO: 3001801 - RNA, 14 nt, Mycobacterium avium subsp. paratuberculosis
ccuucgcgaucacg

SEQ ID NO: 3001802 - RNA, 16 nt, Mycobacterium avium subsp. paratuberculosis
ccuucgcggucggcaa

SEQ ID NO: 3001803 - RNA, 22 nt, Mycobacterium avium subsp. paratuberculosis
ccuucgcggucggcaacccgac

SEQ ID NO: 3001804 - RNA, 15 nt, Mycobacterium avium subsp. paratuberculosis
ccuucggccggcagc

SEQ ID NO: 3001805 - RNA, 16 nt, Mycobacterium avium subsp. paratuberculosis
ccuucggcgccagccc

SEQ ID NO: 3001806 - RNA, 17 nt, Mycobacterium avium subsp. paratuberculosis
ccuucggcgccagcccg

SEQ ID NO: 3001807 - RNA, 19 nt, Mycobacterium avium subsp. paratuberculosis
ccuucgggguggucaccgg

SEQ ID NO: 3001808 - RNA, 21 nt, Mycobacterium avium subsp. paratuberculosis
ccuucguagauaagcggauug

SEQ ID NO: 3001809 - RNA, 18 nt, Mycobacterium avium subsp. paratuberculosis
ccuucucccgcggcagcc

SEQ ID NO: 3001810 - RNA, 19 nt, Mycobacterium avium subsp. paratuberculosis
ccuucuccgccgggcugag

SEQ ID NO: 3001811 - RNA, 22 nt, Mycobacterium avium subsp. paratuberculosis
ccuucucgaaccggggcaccac

SEQ ID NO: 3001812 - RNA, 21 nt, Mycobacterium avium subsp. paratuberculosis
ccuucucgggcaaucacauug

SEQ ID NO: 3001813 - RNA, 13 nt, Mycobacterium avium subsp. paratuberculosis
ccuucugaucggg

SEQ ID NO: 3001814 - RNA, 19 nt, Mycobacterium avium subsp. paratuberculosis
ccuucuggaagccuggcac

SEQ ID NO: 3001815 - RNA, 12 nt, Mycobacterium avium subsp. paratuberculosis
ccuucuucgccg

SEQ ID NO: 3001816 - RNA, 20 nt, Mycobacterium avium subsp. paratuberculosis
ccuucuucgccgcagccuuc

SEQ ID NO: 3001817 - RNA, 21 nt, Mycobacterium avium subsp. paratuberculosis
ccuucuucgccgcagccuucu

SEQ ID NO: 3001818 - RNA, 18 nt, Mycobacterium avium subsp. paratuberculosis
ccuucuucgccggggccu

SEQ ID NO: 3001819 - RNA, 18 nt, Mycobacterium avium subsp. paratuberculosis
ccuucuugaacagcgccg

SEQ ID NO: 3001820 - RNA, 20 nt, Mycobacterium avium subsp. paratuberculosis
ccuucuugaacagcgccgga

SEQ ID NO: 3001821 - RNA, 21 nt, Mycobacterium avium subsp. paratuberculosis
ccuucuugaacagcgccggac

SEQ ID NO: 3001822 - RNA, 16 nt, Mycobacterium avium subsp. paratuberculosis
ccuucuugaccgcagc

SEQ ID NO: 3001823 - RNA, 21 nt, Mycobacterium avium subsp. paratuberculosis
ccuucuugaccgcagccuucu

SEQ ID NO: 3001824 - RNA, 22 nt, Mycobacterium avium subsp. paratuberculosis
ccuucuugaccgcagccuucuu

SEQ ID NO: 3001825 - RNA, 11 nt, Mycobacterium avium subsp. paratuberculosis
ccuucuuggcc

SEQ ID NO: 3001826 - RNA, 16 nt, Mycobacterium avium subsp. paratuberculosis
ccuucuuggccggagc

SEQ ID NO: 3001827 - RNA, 21 nt, Mycobacterium avium subsp. paratuberculosis
ccuucuuggccggagccuucu

SEQ ID NO: 3001828 - RNA, 21 nt, Mycobacterium avium subsp. paratuberculosis
ccuucuuggcggcggccuucu

SEQ ID NO: 3001829 - RNA, 22 nt, Mycobacterium avium subsp. paratuberculosis
ccuucuuggcggcggccuucuu

SEQ ID NO: 3001830 - RNA, 21 nt, Mycobacterium avium subsp. paratuberculosis
ccuucuuggcgggcgccuucu

SEQ ID NO: 3001831 - RNA, 22 nt, Mycobacterium avium subsp. paratuberculosis
ccuucuuggcgggcgccuucuu

SEQ ID NO: 3001832 - RNA, 16 nt, Mycobacterium avium subsp. paratuberculosis
ccuucuugggcucgcg

SEQ ID NO: 3001833 - RNA, 15 nt, Mycobacterium avium subsp. paratuberculosis
ccuugaacggcacca

SEQ ID NO: 3001834 - RNA, 12 nt, Mycobacterium avium subsp. paratuberculosis
ccuugaccaccg

SEQ ID NO: 3001835 - RNA, 16 nt, Mycobacterium avium subsp. paratuberculosis
ccuugaccaccgagcc

SEQ ID NO: 3001836 - RNA, 16 nt, Mycobacterium avium subsp. paratuberculosis
ccuugaccacggugcg

SEQ ID NO: 3001837 - RNA, 12 nt, Mycobacterium avium subsp. paratuberculosis
ccuugaccagcu

SEQ ID NO: 3001838 - RNA, 13 nt, Mycobacterium avium subsp. paratuberculosis
ccuugacccggcc

SEQ ID NO: 3001839 - RNA, 14 nt, Mycobacterium avium subsp. paratuberculosis
ccuugacccggccg

SEQ ID NO: 3001840 - RNA, 21 nt, Mycobacterium avium subsp. paratuberculosis
ccuugaccgccuuggccacgu

SEQ ID NO: 3001841 - RNA, 20 nt, Mycobacterium avium subsp. paratuberculosis
ccuugacguacuggcgccgg

SEQ ID NO: 3001842 - RNA, 22 nt, Mycobacterium avium subsp. paratuberculosis
ccuugacgucggguccgaccag

SEQ ID NO: 3001843 - RNA, 13 nt, Mycobacterium avium subsp. paratuberculosis
ccuugagcaccgc

SEQ ID NO: 3001844 - RNA, 22 nt, Mycobacterium avium subsp. paratuberculosis
ccuugagcacggugaucagcag

SEQ ID NO: 3001845 - RNA, 23 nt, Mycobacterium avium subsp. paratuberculosis
ccuugagcacggugaucagcagc

SEQ ID NO: 3001846 - RNA, 17 nt, Mycobacterium avium subsp. paratuberculosis
ccuugagccgccgcggc

SEQ ID NO: 3001847 - RNA, 22 nt, Mycobacterium avium subsp. paratuberculosis
ccuugagccgguccgacggcug

SEQ ID NO: 3001848 - RNA, 15 nt, Mycobacterium avium subsp. paratuberculosis
ccuugagccggucgu

SEQ ID NO: 3001849 - RNA, 14 nt, Mycobacterium avium subsp. paratuberculosis
ccuugagcucggcc

SEQ ID NO: 3001850 - RNA, 16 nt, Mycobacterium avium subsp. paratuberculosis
ccuugagcuucccggc

SEQ ID NO: 3001851 - RNA, 22 nt, Mycobacterium avium subsp. paratuberculosis
ccuugagguagucgcgcagcug

SEQ ID NO: 3001852 - RNA, 16 nt, Mycobacterium avium subsp. paratuberculosis
ccuugauccggccgcg

SEQ ID NO: 3001853 - RNA, 16 nt, Mycobacterium avium subsp. paratuberculosis
ccuugauccgggcgcc

SEQ ID NO: 3001854 - RNA, 16 nt, Mycobacterium avium subsp. paratuberculosis
ccuugaucuuggccug

SEQ ID NO: 3001855 - RNA, 18 nt, Mycobacterium avium subsp. paratuberculosis
ccuugaucuuggccuggg

SEQ ID NO: 3001856 - RNA, 20 nt, Mycobacterium avium subsp. paratuberculosis
ccuugaucuuggccugggcc

SEQ ID NO: 3001857 - RNA, 16 nt, Mycobacterium avium subsp. paratuberculosis
ccuugcagcacaccgg

SEQ ID NO: 3001858 - RNA, 19 nt, Mycobacterium avium subsp. paratuberculosis
ccuugcagcccgcguccag

SEQ ID NO: 3001859 - RNA, 20 nt, Mycobacterium avium subsp. paratuberculosis
ccuugcagcccgcguccagc

SEQ ID NO: 3001860 - RNA, 16 nt, Mycobacterium avium subsp. paratuberculosis
ccuugcagcccgcuga

SEQ ID NO: 3001861 - RNA, 14 nt, Mycobacterium avium subsp. paratuberculosis
ccuugcccaggugc

SEQ ID NO: 3001862 - RNA, 15 nt, Mycobacterium avium subsp. paratuberculosis
ccuugccccaccacc

SEQ ID NO: 3001863 - RNA, 19 nt, Mycobacterium avium subsp. paratuberculosis
ccuugcccggacgaugccg

SEQ ID NO: 3001864 - RNA, 15 nt, Mycobacterium avium subsp. paratuberculosis
ccuugcccggcucgg

SEQ ID NO: 3001865 - RNA, 20 nt, Mycobacterium avium subsp. paratuberculosis
ccuugccgaucagcgucagc

SEQ ID NO: 3001866 - RNA, 17 nt, Mycobacterium avium subsp. paratuberculosis
ccuugccgaugccggcg

SEQ ID NO: 3001867 - RNA, 18 nt, Mycobacterium avium subsp. paratuberculosis
ccuugccgaugccggcgu

SEQ ID NO: 3001868 - RNA, 12 nt, Mycobacterium avium subsp. paratuberculosis
ccuugccggcgg

SEQ ID NO: 3001869 - RNA, 14 nt, Mycobacterium avium subsp. paratuberculosis
ccuugccggcggcg

SEQ ID NO: 3001870 - RNA, 18 nt, Mycobacterium avium subsp. paratuberculosis
ccuugccggcggcgggcu

SEQ ID NO: 3001871 - RNA, 15 nt, Mycobacterium avium subsp. paratuberculosis
ccuugccgucgagca

SEQ ID NO: 3001872 - RNA, 15 nt, Mycobacterium avium subsp. paratuberculosis
ccuugcgagccggag

SEQ ID NO: 3001873 - RNA, 15 nt, Mycobacterium avium subsp. paratuberculosis
ccuugcgcagcagca

SEQ ID NO: 3001874 - RNA, 21 nt, Mycobacterium avium subsp. paratuberculosis
ccuugcgcagcagcaggucgg

SEQ ID NO: 3001875 - RNA, 22 nt, Mycobacterium avium subsp. paratuberculosis
ccuugcgcagcagcaggucggc

SEQ ID NO: 3001876 - RNA, 16 nt, Mycobacterium avium subsp. paratuberculosis
ccuugcgccccggcgg

SEQ ID NO: 3001877 - RNA, 18 nt, Mycobacterium avium subsp. paratuberculosis
ccuugcgcccguagcggc

SEQ ID NO: 3001878 - RNA, 13 nt, Mycobacterium avium subsp. paratuberculosis
ccuugcgccgcuu

SEQ ID NO: 3001879 - RNA, 13 nt, Mycobacterium avium subsp. paratuberculosis
ccuugcgcgccgc

SEQ ID NO: 3001880 - RNA, 22 nt, Mycobacterium avium subsp. paratuberculosis
ccuugcgcgggucgccgggcag

SEQ ID NO: 3001881 - RNA, 16 nt, Mycobacterium avium subsp. paratuberculosis
ccuugcggaugcgggc

SEQ ID NO: 3001882 - RNA, 18 nt, Mycobacterium avium subsp. paratuberculosis
ccuugcggaugcgggcca

SEQ ID NO: 3001883 - RNA, 14 nt, Mycobacterium avium subsp. paratuberculosis
ccuugcggccgccg

SEQ ID NO: 3001884 - RNA, 15 nt, Mycobacterium avium subsp. paratuberculosis
ccuugcggccggcgg

SEQ ID NO: 3001885 - RNA, 16 nt, Mycobacterium avium subsp. paratuberculosis
ccuugcggccggcggc

SEQ ID NO: 3001886 - RNA, 17 nt, Mycobacterium avium subsp. paratuberculosis
ccuugcggccggcggcg

SEQ ID NO: 3001887 - RNA, 15 nt, Mycobacterium avium subsp. paratuberculosis
ccuugcucgccgcgu

SEQ ID NO: 3001888 - RNA, 19 nt, Mycobacterium avium subsp. paratuberculosis
ccuugcugacgccgcggug

SEQ ID NO: 3001889 - RNA, 17 nt, Mycobacterium avium subsp. paratuberculosis
ccuugcugagccggccc

SEQ ID NO: 3001890 - RNA, 19 nt, Mycobacterium avium subsp. paratuberculosis
ccuugcugagccggcccug

SEQ ID NO: 3001891 - RNA, 17 nt, Mycobacterium avium subsp. paratuberculosis
ccuugcugcccagggcg

SEQ ID NO: 3001892 - RNA, 17 nt, Mycobacterium avium subsp. paratuberculosis
ccuugcuggcggccuuc

SEQ ID NO: 3001893 - RNA, 21 nt, Mycobacterium avium subsp. paratuberculosis
ccuugcuggcggccuucuugg

SEQ ID NO: 3001894 - RNA, 19 nt, Mycobacterium avium subsp. paratuberculosis
ccuuggacgaaacccggcg

SEQ ID NO: 3001895 - RNA, 20 nt, Mycobacterium avium subsp. paratuberculosis
ccuuggacgaaacccggcgg

SEQ ID NO: 3001896 - RNA, 21 nt, Mycobacterium avium subsp. paratuberculosis
ccuuggacgaaacccggcgga

SEQ ID NO: 3001897 - RNA, 15 nt, Mycobacterium avium subsp. paratuberculosis
ccuuggccaacgcgu

SEQ ID NO: 3001898 - RNA, 22 nt, Mycobacterium avium subsp. paratuberculosis
ccuuggccagcagugccaccac

SEQ ID NO: 3001899 - RNA, 23 nt, Mycobacterium avium subsp. paratuberculosis
ccuuggccagcagugccaccacc

SEQ ID NO: 3001900 - RNA, 18 nt, Mycobacterium avium subsp. paratuberculosis
ccuuggcccgcgcggccg

SEQ ID NO: 3001901 - RNA, 20 nt, Mycobacterium avium subsp. paratuberculosis
ccuuggcccgcgcggccgcc

SEQ ID NO: 3001902 - RNA, 16 nt, Mycobacterium avium subsp. paratuberculosis
ccuuggcccgggcguc

SEQ ID NO: 3001903 - RNA, 17 nt, Mycobacterium avium subsp. paratuberculosis
ccuuggccgccagcacc

SEQ ID NO: 3001904 - RNA, 23 nt, Mycobacterium avium subsp. paratuberculosis
ccuuggccggugcgccgaccgcg

SEQ ID NO: 3001905 - RNA, 17 nt, Mycobacterium avium subsp. paratuberculosis
ccuuggcgcccagcgug

SEQ ID NO: 3001906 - RNA, 17 nt, Mycobacterium avium subsp. paratuberculosis
ccuuggcggccaccauc

SEQ ID NO: 3001907 - RNA, 15 nt, Mycobacterium avium subsp. paratuberculosis
ccuuggcggccacga

SEQ ID NO: 3001908 - RNA, 14 nt, Mycobacterium avium subsp. paratuberculosis
ccuuggcggcggcc

SEQ ID NO: 3001909 - RNA, 16 nt, Mycobacterium avium subsp. paratuberculosis
ccuuggcggcggccag

SEQ ID NO: 3001910 - RNA, 14 nt, Mycobacterium avium subsp. paratuberculosis
ccuuggcguccaug

SEQ ID NO: 3001911 - RNA, 20 nt, Mycobacterium avium subsp. paratuberculosis
ccuugggcauccgcucgccg

SEQ ID NO: 3001912 - RNA, 22 nt, Mycobacterium avium subsp. paratuberculosis
ccuugggcauccgcucgccgcg

SEQ ID NO: 3001913 - RNA, 18 nt, Mycobacterium avium subsp. paratuberculosis
ccuuggggcugaccucgc

SEQ ID NO: 3001914 - RNA, 17 nt, Mycobacterium avium subsp. paratuberculosis
ccuuggucacaaagccc

SEQ ID NO: 3001915 - RNA, 20 nt, Mycobacterium avium subsp. paratuberculosis
ccuuggucagcucccggcag

SEQ ID NO: 3001916 - RNA, 14 nt, Mycobacterium avium subsp. paratuberculosis
ccuuggucgcggcc

SEQ ID NO: 3001917 - RNA, 17 nt, Mycobacterium avium subsp. paratuberculosis
ccuuggucgcggccuuc

SEQ ID NO: 3001918 - RNA, 16 nt, Mycobacterium avium subsp. paratuberculosis
ccuuggugacggccuc

SEQ ID NO: 3001919 - RNA, 17 nt, Mycobacterium avium subsp. paratuberculosis
ccuuggugagcaccgcg

SEQ ID NO: 3001920 - RNA, 20 nt, Mycobacterium avium subsp. paratuberculosis
ccuuggugaugggcagcgcc

SEQ ID NO: 3001921 - RNA, 21 nt, Mycobacterium avium subsp. paratuberculosis
ccuuggugaugggcagcgccc

SEQ ID NO: 3001922 - RNA, 13 nt, Mycobacterium avium subsp. paratuberculosis
ccuugguggccgc

SEQ ID NO: 3001923 - RNA, 18 nt, Mycobacterium avium subsp. paratuberculosis
ccuugguggccgcggccg

SEQ ID NO: 3001924 - RNA, 21 nt, Mycobacterium avium subsp. paratuberculosis
ccuugguggccgcggccgccu

SEQ ID NO: 3001925 - RNA, 15 nt, Mycobacterium avium subsp. paratuberculosis
ccuuggugucggcga

SEQ ID NO: 3001926 - RNA, 17 nt, Mycobacterium avium subsp. paratuberculosis
ccuuguaggucaucagc

SEQ ID NO: 3001927 - RNA, 18 nt, Mycobacterium avium subsp. paratuberculosis
ccuuguccaggauccccg

SEQ ID NO: 3001928 - RNA, 22 nt, Mycobacterium avium subsp. paratuberculosis
ccuugucgcgcaccgcggcggg

SEQ ID NO: 3001929 - RNA, 13 nt, Mycobacterium avium subsp. paratuberculosis
ccuugucgcugac

SEQ ID NO: 3001930 - RNA, 16 nt, Mycobacterium avium subsp. paratuberculosis
ccuugucgcuggcgua

SEQ ID NO: 3001931 - RNA, 15 nt, Mycobacterium avium subsp. paratuberculosis
ccuugucggcgagcu

SEQ ID NO: 3001932 - RNA, 23 nt, Mycobacterium avium subsp. paratuberculosis
ccuugucguccucgaucaccgac

SEQ ID NO: 3001933 - RNA, 19 nt, Mycobacterium avium subsp. paratuberculosis
ccuuguggcccaggccggc

SEQ ID NO: 3001934 - RNA, 18 nt, Mycobacterium avium subsp. paratuberculosis
ccuuguugugacacagcc

SEQ ID NO: 3001935 - RNA, 17 nt, Mycobacterium avium subsp. paratuberculosis
ccuuugcuguucgucga

SEQ ID NO: 3001936 - RNA, 18 nt, Mycobacterium avium subsp. paratuberculosis
ccuuuggucgaacacuuc

SEQ ID NO: 3001937 - RNA, 13 nt, Mycobacterium avium subsp. paratuberculosis
ccuuuugcacccg

SEQ ID NO: 3001938 - RNA, 15 nt, Mycobacterium avium subsp. paratuberculosis
cgaaaaaacggcggc

SEQ ID NO: 3001939 - RNA, 18 nt, Mycobacterium avium subsp. paratuberculosis
cgaaaaacgcgacggccc

SEQ ID NO: 3001940 - RNA, 14 nt, Mycobacterium avium subsp. paratuberculosis
cgaaaaacgcgucg

SEQ ID NO: 3001941 - RNA, 22 nt, Mycobacterium avium subsp. paratuberculosis
cgaaaauaccgccggccgcgcg

SEQ ID NO: 3001942 - RNA, 14 nt, Mycobacterium avium subsp. paratuberculosis
cgaaaccaacaccc

SEQ ID NO: 3001943 - RNA, 17 nt, Mycobacterium avium subsp. paratuberculosis
cgaaacccaggaacacg

SEQ ID NO: 3001944 - RNA, 18 nt, Mycobacterium avium subsp. paratuberculosis
cgaaacccccgggaugcc

SEQ ID NO: 3001945 - RNA, 12 nt, Mycobacterium avium subsp. paratuberculosis
cgaaacccggcg

SEQ ID NO: 3001946 - RNA, 17 nt, Mycobacterium avium subsp. paratuberculosis
cgaaaccgcguggcgca

SEQ ID NO: 3001947 - RNA, 14 nt, Mycobacterium avium subsp. paratuberculosis
cgaaaccgucgacc

SEQ ID NO: 3001948 - RNA, 18 nt, Mycobacterium avium subsp. paratuberculosis
cgaaaccgucuccggcgc

SEQ ID NO: 3001949 - RNA, 23 nt, Mycobacterium avium subsp. paratuberculosis
cgaaaccguggaagucgccgucc

SEQ ID NO: 3001950 - RNA, 13 nt, Mycobacterium avium subsp. paratuberculosis
cgaaacgccgcgc

SEQ ID NO: 3001951 - RNA, 23 nt, Mycobacterium avium subsp. paratuberculosis
cgaaacgccgcgcucgugcugcu

SEQ ID NO: 3001952 - RNA, 18 nt, Mycobacterium avium subsp. paratuberculosis
cgaaacggugcccgcagc

SEQ ID NO: 3001953 - RNA, 20 nt, Mycobacterium avium subsp. paratuberculosis
cgaaacggugcccgcagcau

SEQ ID NO: 3001954 - RNA, 15 nt, Mycobacterium avium subsp. paratuberculosis
cgaaacucaccgcgu

SEQ ID NO: 3001955 - RNA, 20 nt, Mycobacterium avium subsp. paratuberculosis
cgaaacucguugccagccgg

SEQ ID NO: 3001956 - RNA, 20 nt, Mycobacterium avium subsp. paratuberculosis
cgaaacugaccuucucccgc

SEQ ID NO: 3001957 - RNA, 12 nt, Mycobacterium avium subsp. paratuberculosis
cgaaacugggag

SEQ ID NO: 3001958 - RNA, 17 nt, Mycobacterium avium subsp. paratuberculosis
cgaaagcacccgacacg

SEQ ID NO: 3001959 - RNA, 20 nt, Mycobacterium avium subsp. paratuberculosis
cgaaagcacccgacacgccg

SEQ ID NO: 3001960 - RNA, 18 nt, Mycobacterium avium subsp. paratuberculosis
cgaaagcagcaacggcgg

SEQ ID NO: 3001961 - RNA, 20 nt, Mycobacterium avium subsp. paratuberculosis
cgaaagcagcaacggcggcg

SEQ ID NO: 3001962 - RNA, 20 nt, Mycobacterium avium subsp. paratuberculosis
cgaaagccacccgcgccucc

SEQ ID NO: 3001963 - RNA, 18 nt, Mycobacterium avium subsp. paratuberculosis
cgaaagccuccgcgauca

SEQ ID NO: 3001964 - RNA, 21 nt, Mycobacterium avium subsp. paratuberculosis
cgaaagguuuucccggccgcc

SEQ ID NO: 3001965 - RNA, 19 nt, Mycobacterium avium subsp. paratuberculosis
cgaaagugcaacugccgac

SEQ ID NO: 3001966 - RNA, 20 nt, Mycobacterium avium subsp. paratuberculosis
cgaaagugcaacugccgacg

SEQ ID NO: 3001967 - RNA, 20 nt, Mycobacterium avium subsp. paratuberculosis
cgaaagugcaacuggcaacg

SEQ ID NO: 3001968 - RNA, 19 nt, Mycobacterium avium subsp. paratuberculosis
cgaaagugcuacugccgac

SEQ ID NO: 3001969 - RNA, 15 nt, Mycobacterium avium subsp. paratuberculosis
cgaaauaaccgcgcg

SEQ ID NO: 3001970 - RNA, 18 nt, Mycobacterium avium subsp. paratuberculosis
cgaaauaaccgcgcggcg

SEQ ID NO: 3001971 - RNA, 14 nt, Mycobacterium avium subsp. paratuberculosis
cgaaauagcggcgc

SEQ ID NO: 3001972 - RNA, 15 nt, Mycobacterium avium subsp. paratuberculosis
cgaaauagcggcgca

SEQ ID NO: 3001973 - RNA, 19 nt, Mycobacterium avium subsp. paratuberculosis
cgaaaucaacgcgccgaac

SEQ ID NO: 3001974 - RNA, 18 nt, Mycobacterium avium subsp. paratuberculosis
cgaaauccacgaugccgg

SEQ ID NO: 3001975 - RNA, 22 nt, Mycobacterium avium subsp. paratuberculosis
cgaaauccacgaugccgggcac

SEQ ID NO: 3001976 - RNA, 13 nt, Mycobacterium avium subsp. paratuberculosis
cgaaaucgcgggc

SEQ ID NO: 3001977 - RNA, 23 nt, Mycobacterium avium subsp. paratuberculosis
cgaaaucggguccagcgccgagc

SEQ ID NO: 3001978 - RNA, 17 nt, Mycobacterium avium subsp. paratuberculosis
cgaaaucggugaagccg

SEQ ID NO: 3001979 - RNA, 21 nt, Mycobacterium avium subsp. paratuberculosis
cgaaaucgucgggcaccagca

SEQ ID NO: 3001980 - RNA, 17 nt, Mycobacterium avium subsp. paratuberculosis
cgaaaucuucgccguca

SEQ ID NO: 3001981 - RNA, 13 nt, Mycobacterium avium subsp. paratuberculosis
cgaaaugaccgcg

SEQ ID NO: 3001982 - RNA, 14 nt, Mycobacterium avium subsp. paratuberculosis
cgaacaacagggcc

SEQ ID NO: 3001983 - RNA, 17 nt, Mycobacterium avium subsp. paratuberculosis
cgaacaacagggccgcg

SEQ ID NO: 3001984 - RNA, 22 nt, Mycobacterium avium subsp. paratuberculosis
cgaacaacagggccgcgcgggc

SEQ ID NO: 3001985 - RNA, 20 nt, Mycobacterium avium subsp. paratuberculosis
cgaacaacgcggugaccgcg

SEQ ID NO: 3001986 - RNA, 18 nt, Mycobacterium avium subsp. paratuberculosis
cgaacaacggcggaccgg

SEQ ID NO: 3001987 - RNA, 21 nt, Mycobacterium avium subsp. paratuberculosis
cgaacaacggcggaccggcgg

SEQ ID NO: 3001988 - RNA, 23 nt, Mycobacterium avium subsp. paratuberculosis
cgaacaacggcggaccggcggcc

SEQ ID NO: 3001989 - RNA, 22 nt, Mycobacterium avium subsp. paratuberculosis
cgaacaauuccucugcgcgcca

SEQ ID NO: 3001990 - RNA, 15 nt, Mycobacterium avium subsp. paratuberculosis
cgaacaccaccggca

SEQ ID NO: 3001991 - RNA, 20 nt, Mycobacterium avium subsp. paratuberculosis
cgaacaccaccggcaaccgc

SEQ ID NO: 3001992 - RNA, 21 nt, Mycobacterium avium subsp. paratuberculosis
cgaacaccacgguccccgcgc

SEQ ID NO: 3001993 - RNA, 19 nt, Mycobacterium avium subsp. paratuberculosis
cgaacaccacguagccgac

SEQ ID NO: 3001994 - RNA, 14 nt, Mycobacterium avium subsp. paratuberculosis
cgaacaccagcacc

SEQ ID NO: 3001995 - RNA, 15 nt, Mycobacterium avium subsp. paratuberculosis
cgaacaccagcaccc

SEQ ID NO: 3001996 - RNA, 12 nt, Mycobacterium avium subsp. paratuberculosis
cgaacaccagcc

SEQ ID NO: 3001997 - RNA, 22 nt, Mycobacterium avium subsp. paratuberculosis
cgaacacccagaugcccagcgg

SEQ ID NO: 3001998 - RNA, 13 nt, Mycobacterium avium subsp. paratuberculosis
cgaacacccggcu

SEQ ID NO: 3001999 - RNA, 16 nt, Mycobacterium avium subsp. paratuberculosis
cgaacaccgcaccggu

SEQ ID NO: 3002000 - RNA, 15 nt, Mycobacterium avium subsp. paratuberculosis
cgaacaccggcagcg

SEQ ID NO: 3002001 - RNA, 16 nt, Mycobacterium avium subsp. paratuberculosis
cgaacaccggcagcgc

SEQ ID NO: 3002002 - RNA, 17 nt, Mycobacterium avium subsp. paratuberculosis
cgaacaccggcagcgcc

SEQ ID NO: 3002003 - RNA, 21 nt, Mycobacterium avium subsp. paratuberculosis
cgaacaccggcagcgccacca

SEQ ID NO: 3002004 - RNA, 15 nt, Mycobacterium avium subsp. paratuberculosis
cgaacaccggcgcga

SEQ ID NO: 3002005 - RNA, 16 nt, Mycobacterium avium subsp. paratuberculosis
cgaacaccggcgcgac

SEQ ID NO: 3002006 - RNA, 18 nt, Mycobacterium avium subsp. paratuberculosis
cgaacaccggcgcgacca

SEQ ID NO: 3002007 - RNA, 14 nt, Mycobacterium avium subsp. paratuberculosis
cgaacaccggcgga

SEQ ID NO: 3002008 - RNA, 21 nt, Mycobacterium avium subsp. paratuberculosis
cgaacaccgucaucguguggg

SEQ ID NO: 3002009 - RNA, 15 nt, Mycobacterium avium subsp. paratuberculosis
cgaacaccgucgagg

SEQ ID NO: 3002010 - RNA, 17 nt, Mycobacterium avium subsp. paratuberculosis
cgaacaccgugccguca

SEQ ID NO: 3002011 - RNA, 18 nt, Mycobacterium avium subsp. paratuberculosis
cgaacaccgugccgucac

SEQ ID NO: 3002012 - RNA, 14 nt, Mycobacterium avium subsp. paratuberculosis
cgaacaccucggcg

SEQ ID NO: 3002013 - RNA, 16 nt, Mycobacterium avium subsp. paratuberculosis
cgaacaccucggcgau

SEQ ID NO: 3002014 - RNA, 19 nt, Mycobacterium avium subsp. paratuberculosis
cgaacaccucggcgaugcc

SEQ ID NO: 3002015 - RNA, 12 nt, Mycobacterium avium subsp. paratuberculosis
cgaacaccugcg

SEQ ID NO: 3002016 - RNA, 15 nt, Mycobacterium avium subsp. paratuberculosis
cgaacaccugcggcg

SEQ ID NO: 3002017 - RNA, 16 nt, Mycobacterium avium subsp. paratuberculosis
cgaacaccugcggcgg

SEQ ID NO: 3002018 - RNA, 18 nt, Mycobacterium avium subsp. paratuberculosis
cgaacaccugcggcggca

SEQ ID NO: 3002019 - RNA, 16 nt, Mycobacterium avium subsp. paratuberculosis
cgaacacggcgcugag

SEQ ID NO: 3002020 - RNA, 19 nt, Mycobacterium avium subsp. paratuberculosis
cgaacacggcgcugagcga

SEQ ID NO: 3002021 - RNA, 17 nt, Mycobacterium avium subsp. paratuberculosis
cgaacacgggcggcagg

SEQ ID NO: 3002022 - RNA, 20 nt, Mycobacterium avium subsp. paratuberculosis
cgaacacgggcggcagggcc

SEQ ID NO: 3002023 - RNA, 17 nt, Mycobacterium avium subsp. paratuberculosis
cgaacacguacagcggc

SEQ ID NO: 3002024 - RNA, 14 nt, Mycobacterium avium subsp. paratuberculosis
cgaacacgucggcc

SEQ ID NO: 3002025 - RNA, 20 nt, Mycobacterium avium subsp. paratuberculosis
cgaacacgucggccagcgcg

SEQ ID NO: 3002026 - RNA, 21 nt, Mycobacterium avium subsp. paratuberculosis
cgaacacgucggccagcgcgu

SEQ ID NO: 3002027 - RNA, 18 nt, Mycobacterium avium subsp. paratuberculosis
cgaacacgugcagcucgg

SEQ ID NO: 3002028 - RNA, 21 nt, Mycobacterium avium subsp. paratuberculosis
cgaacacguugcgcaucagcg

SEQ ID NO: 3002029 - RNA, 22 nt, Mycobacterium avium subsp. paratuberculosis
cgaacacguugcgcaucagcgc

SEQ ID NO: 3002030 - RNA, 13 nt, Mycobacterium avium subsp. paratuberculosis
cgaacagcaccgc

SEQ ID NO: 3002031 - RNA, 20 nt, Mycobacterium avium subsp. paratuberculosis
cgaacagcaccgccacggcg

SEQ ID NO: 3002032 - RNA, 12 nt, Mycobacterium avium subsp. paratuberculosis
cgaacagcacgc

SEQ ID NO: 3002033 - RNA, 12 nt, Mycobacterium avium subsp. paratuberculosis
cgaacagcagca

SEQ ID NO: 3002034 - RNA, 13 nt, Mycobacterium avium subsp. paratuberculosis
cgaacagcagcac

SEQ ID NO: 3002035 - RNA, 17 nt, Mycobacterium avium subsp. paratuberculosis
cgaacagcagcgaaccc

SEQ ID NO: 3002036 - RNA, 21 nt, Mycobacterium avium subsp. paratuberculosis
cgaacagcagcgcgccgacca

SEQ ID NO: 3002037 - RNA, 22 nt, Mycobacterium avium subsp. paratuberculosis
cgaacagcagcgcgccgaccac

SEQ ID NO: 3002038 - RNA, 15 nt, Mycobacterium avium subsp. paratuberculosis
cgaacagcagcggga

SEQ ID NO: 3002039 - RNA, 13 nt, Mycobacterium avium subsp. paratuberculosis
cgaacagccgacc

SEQ ID NO: 3002040 - RNA, 13 nt, Mycobacterium avium subsp. paratuberculosis
cgaacagccgggc

SEQ ID NO: 3002041 - RNA, 22 nt, Mycobacterium avium subsp. paratuberculosis
cgaacagccgggccgcccgcgc

SEQ ID NO: 3002042 - RNA, 20 nt, Mycobacterium avium subsp. paratuberculosis
cgaacagccgggcggccggg

SEQ ID NO: 3002043 - RNA, 13 nt, Mycobacterium avium subsp. paratuberculosis
cgaacagccgguc

SEQ ID NO: 3002044 - RNA, 14 nt, Mycobacterium avium subsp. paratuberculosis
cgaacagccggucc

SEQ ID NO: 3002045 - RNA, 18 nt, Mycobacterium avium subsp. paratuberculosis
cgaacagcgacgucugcg

SEQ ID NO: 3002046 - RNA, 14 nt, Mycobacterium avium subsp. paratuberculosis
cgaacagcgccgac

SEQ ID NO: 3002047 - RNA, 17 nt, Mycobacterium avium subsp. paratuberculosis
cgaacagcgcgcccgac

SEQ ID NO: 3002048 - RNA, 14 nt, Mycobacterium avium subsp. paratuberculosis
cgaacagcgcggcc

SEQ ID NO: 3002049 - RNA, 12 nt, Mycobacterium avium subsp. paratuberculosis
cgaacagcgggc

SEQ ID NO: 3002050 - RNA, 20 nt, Mycobacterium avium subsp. paratuberculosis
cgaacagcgggcagagcugc

SEQ ID NO: 3002051 - RNA, 14 nt, Mycobacterium avium subsp. paratuberculosis
cgaacagcggggug

SEQ ID NO: 3002052 - RNA, 17 nt, Mycobacterium avium subsp. paratuberculosis
cgaacagcucgaccagc

SEQ ID NO: 3002053 - RNA, 17 nt, Mycobacterium avium subsp. paratuberculosis
cgaacagcuugccgauc

SEQ ID NO: 3002054 - RNA, 12 nt, Mycobacterium avium subsp. paratuberculosis
cgaacaggaugc

SEQ ID NO: 3002055 - RNA, 18 nt, Mycobacterium avium subsp. paratuberculosis
cgaacaggaugcggguga

SEQ ID NO: 3002056 - RNA, 23 nt, Mycobacterium avium subsp. paratuberculosis
cgaacaggaugcgggugaugccg

SEQ ID NO: 3002057 - RNA, 21 nt, Mycobacterium avium subsp. paratuberculosis
cgaacaggcccugcugcagcg

SEQ ID NO: 3002058 - RNA, 19 nt, Mycobacterium avium subsp. paratuberculosis
cgaacagggcgacggcggc

SEQ ID NO: 3002059 - RNA, 15 nt, Mycobacterium avium subsp. paratuberculosis
cgaacagggcggcgg

SEQ ID NO: 3002060 - RNA, 16 nt, Mycobacterium avium subsp. paratuberculosis
cgaacagggcggcggg

SEQ ID NO: 3002061 - RNA, 19 nt, Mycobacterium avium subsp. paratuberculosis
cgaacagggcggcgggccc

SEQ ID NO: 3002062 - RNA, 20 nt, Mycobacterium avium subsp. paratuberculosis
cgaacagggcggcgggcccg

SEQ ID NO: 3002063 - RNA, 22 nt, Mycobacterium avium subsp. paratuberculosis
cgaacagggugacgauccacag

SEQ ID NO: 3002064 - RNA, 23 nt, Mycobacterium avium subsp. paratuberculosis
cgaacagggugacgauccacagc

SEQ ID NO: 3002065 - RNA, 11 nt, Mycobacterium avium subsp. paratuberculosis
cgaacaggucc

SEQ ID NO: 3002066 - RNA, 15 nt, Mycobacterium avium subsp. paratuberculosis
cgaacagguccgcga

SEQ ID NO: 3002067 - RNA, 20 nt, Mycobacterium avium subsp. paratuberculosis
cgaacagguccuugcccagc

SEQ ID NO: 3002068 - RNA, 21 nt, Mycobacterium avium subsp. paratuberculosis
cgaacagguuugagcgugccg

SEQ ID NO: 3002069 - RNA, 19 nt, Mycobacterium avium subsp. paratuberculosis
cgaacagugcacugccgac

SEQ ID NO: 3002070 - RNA, 20 nt, Mycobacterium avium subsp. paratuberculosis
cgaacagugcacugccgacc

SEQ ID NO: 3002071 - RNA, 16 nt, Mycobacterium avium subsp. paratuberculosis
cgaacaucacccggcg

SEQ ID NO: 3002072 - RNA, 19 nt, Mycobacterium avium subsp. paratuberculosis
cgaacaucacccggcggca

SEQ ID NO: 3002073 - RNA, 22 nt, Mycobacterium avium subsp. paratuberculosis
cgaacaucgagcccaccgcgcc

SEQ ID NO: 3002074 - RNA, 15 nt, Mycobacterium avium subsp. paratuberculosis
cgaacaucgccagca

SEQ ID NO: 3002075 - RNA, 14 nt, Mycobacterium avium subsp. paratuberculosis
cgaacaucgccucg

SEQ ID NO: 3002076 - RNA, 17 nt, Mycobacterium avium subsp. paratuberculosis
cgaacaucgccucggcc

SEQ ID NO: 3002077 - RNA, 18 nt, Mycobacterium avium subsp. paratuberculosis
cgaacaucgccucggccg

SEQ ID NO: 3002078 - RNA, 17 nt, Mycobacterium avium subsp. paratuberculosis
cgaacaucuugggguuu

SEQ ID NO: 3002079 - RNA, 15 nt, Mycobacterium avium subsp. paratuberculosis
cgaacauggcggcca

SEQ ID NO: 3002080 - RNA, 17 nt, Mycobacterium avium subsp. paratuberculosis
cgaacauggucgcccac

SEQ ID NO: 3002081 - RNA, 22 nt, Mycobacterium avium subsp. paratuberculosis
cgaacaugguggucgaacuggc

SEQ ID NO: 3002082 - RNA, 18 nt, Mycobacterium avium subsp. paratuberculosis
cgaaccacgcggcggcgg

SEQ ID NO: 3002083 - RNA, 17 nt, Mycobacterium avium subsp. paratuberculosis
cgaaccacgggucgcug

SEQ ID NO: 3002084 - RNA, 17 nt, Mycobacterium avium subsp. paratuberculosis
cgaaccagcaugcgcca

SEQ ID NO: 3002085 - RNA, 19 nt, Mycobacterium avium subsp. paratuberculosis
cgaaccagcaugcgccaga

SEQ ID NO: 3002086 - RNA, 21 nt, Mycobacterium avium subsp. paratuberculosis
cgaaccaggcgccggccagca

SEQ ID NO: 3002087 - RNA, 23 nt, Mycobacterium avium subsp. paratuberculosis
cgaaccaggcgccggccagcacg

SEQ ID NO: 3002088 - RNA, 18 nt, Mycobacterium avium subsp. paratuberculosis
cgaaccagggcagccagc

SEQ ID NO: 3002089 - RNA, 15 nt, Mycobacterium avium subsp. paratuberculosis
cgaaccaguucgcca

SEQ ID NO: 3002090 - RNA, 18 nt, Mycobacterium avium subsp. paratuberculosis
cgaaccaguucgccacca

SEQ ID NO: 3002091 - RNA, 20 nt, Mycobacterium avium subsp. paratuberculosis
cgaaccaguucgccaccacg

SEQ ID NO: 3002092 - RNA, 14 nt, Mycobacterium avium subsp. paratuberculosis
cgaacccaccagcg

SEQ ID NO: 3002093 - RNA, 15 nt, Mycobacterium avium subsp. paratuberculosis
cgaacccaccagcgc

SEQ ID NO: 3002094 - RNA, 17 nt, Mycobacterium avium subsp. paratuberculosis
cgaacccaccagcgccu

SEQ ID NO: 3002095 - RNA, 13 nt, Mycobacterium avium subsp. paratuberculosis
cgaacccagcgcc

SEQ ID NO: 3002096 - RNA, 16 nt, Mycobacterium avium subsp. paratuberculosis
cgaacccagcgccucg

SEQ ID NO: 3002097 - RNA, 17 nt, Mycobacterium avium subsp. paratuberculosis
cgaaccccacguaggcg

SEQ ID NO: 3002098 - RNA, 20 nt, Mycobacterium avium subsp. paratuberculosis
cgaacccgaaaagcaccagg

SEQ ID NO: 3002099 - RNA, 17 nt, Mycobacterium avium subsp. paratuberculosis
cgaacccgaccccggcg

SEQ ID NO: 3002100 - RNA, 19 nt, Mycobacterium avium subsp. paratuberculosis
cgaacccgagcaccccggc

SEQ ID NO: 3002101 - RNA, 17 nt, Mycobacterium avium subsp. paratuberculosis
cgaacccgccagggcga

SEQ ID NO: 3002102 - RNA, 23 nt, Mycobacterium avium subsp. paratuberculosis
cgaacccgcccucgccccggaug

SEQ ID NO: 3002103 - RNA, 15 nt, Mycobacterium avium subsp. paratuberculosis
cgaacccgccgcggc

SEQ ID NO: 3002104 - RNA, 18 nt, Mycobacterium avium subsp. paratuberculosis
cgaacccgccgcggccga

SEQ ID NO: 3002105 - RNA, 20 nt, Mycobacterium avium subsp. paratuberculosis
cgaacccgccgcggccgaac

SEQ ID NO: 3002106 - RNA, 14 nt, Mycobacterium avium subsp. paratuberculosis
cgaacccggcgccc

SEQ ID NO: 3002107 - RNA, 12 nt, Mycobacterium avium subsp. paratuberculosis
cgaacccggcgg

SEQ ID NO: 3002108 - RNA, 17 nt, Mycobacterium avium subsp. paratuberculosis
cgaacccggcggccccg

SEQ ID NO: 3002109 - RNA, 19 nt, Mycobacterium avium subsp. paratuberculosis
cgaacccggcggccccggu

SEQ ID NO: 3002110 - RNA, 12 nt, Mycobacterium avium subsp. paratuberculosis
cgaacccgggcg

SEQ ID NO: 3002111 - RNA, 18 nt, Mycobacterium avium subsp. paratuberculosis
cgaaccgaucaccggcag

SEQ ID NO: 3002112 - RNA, 17 nt, Mycobacterium avium subsp. paratuberculosis
cgaaccgcagccggauc

SEQ ID NO: 3002113 - RNA, 15 nt, Mycobacterium avium subsp. paratuberculosis
cgaaccgccacacgu

SEQ ID NO: 3002114 - RNA, 13 nt, Mycobacterium avium subsp. paratuberculosis
cgaaccgccccgc

SEQ ID NO: 3002115 - RNA, 15 nt, Mycobacterium avium subsp. paratuberculosis
cgaaccgccccgcgc

SEQ ID NO: 3002116 - RNA, 14 nt, Mycobacterium avium subsp. paratuberculosis
cgaaccgcccgccc

SEQ ID NO: 3002117 - RNA, 17 nt, Mycobacterium avium subsp. paratuberculosis
cgaaccgcccgcccggc

SEQ ID NO: 3002118 - RNA, 23 nt, Mycobacterium avium subsp. paratuberculosis
cgaaccgcccgcccggcacgaac

SEQ ID NO: 3002119 - RNA, 13 nt, Mycobacterium avium subsp. paratuberculosis
cgaaccgccgcac

SEQ ID NO: 3002120 - RNA, 21 nt, Mycobacterium avium subsp. paratuberculosis
cgaaccgccgcacccagcggg

SEQ ID NO: 3002121 - RNA, 12 nt, Mycobacterium avium subsp. paratuberculosis
cgaaccgccgcg

SEQ ID NO: 3002122 - RNA, 13 nt, Mycobacterium avium subsp. paratuberculosis
cgaaccgccgcgc

SEQ ID NO: 3002123 - RNA, 20 nt, Mycobacterium avium subsp. paratuberculosis
cgaaccgccgcgcucgcacc

SEQ ID NO: 3002124 - RNA, 19 nt, Mycobacterium avium subsp. paratuberculosis
cgaaccgcgagcgcgcggu

SEQ ID NO: 3002125 - RNA, 12 nt, Mycobacterium avium subsp. paratuberculosis
cgaaccgcggcg

SEQ ID NO: 3002126 - RNA, 13 nt, Mycobacterium avium subsp. paratuberculosis
cgaaccgcggcgg

SEQ ID NO: 3002127 - RNA, 21 nt, Mycobacterium avium subsp. paratuberculosis
cgaaccgcggcggcagcagcc

SEQ ID NO: 3002128 - RNA, 22 nt, Mycobacterium avium subsp. paratuberculosis
cgaaccgcggcggcagcagccc

SEQ ID NO: 3002129 - RNA, 15 nt, Mycobacterium avium subsp. paratuberculosis
cgaaccgcguccacg

SEQ ID NO: 3002130 - RNA, 17 nt, Mycobacterium avium subsp. paratuberculosis
cgaaccgcucgaacacc

SEQ ID NO: 3002131 - RNA, 14 nt, Mycobacterium avium subsp. paratuberculosis
cgaaccgcucgucg

SEQ ID NO: 3002132 - RNA, 16 nt, Mycobacterium avium subsp. paratuberculosis
cgaaccgcucgucggg

SEQ ID NO: 3002133 - RNA, 18 nt, Mycobacterium avium subsp. paratuberculosis
cgaaccgcugcaaccggu

SEQ ID NO: 3002134 - RNA, 20 nt, Mycobacterium avium subsp. paratuberculosis
cgaaccgcuugcccagcccc

SEQ ID NO: 3002135 - RNA, 17 nt, Mycobacterium avium subsp. paratuberculosis
cgaaccggaucaugucg

SEQ ID NO: 3002136 - RNA, 13 nt, Mycobacterium avium subsp. paratuberculosis
cgaaccggcgggg

SEQ ID NO: 3002137 - RNA, 21 nt, Mycobacterium avium subsp. paratuberculosis
cgaaccgggacagccgcgccg

SEQ ID NO: 3002138 - RNA, 17 nt, Mycobacterium avium subsp. paratuberculosis
cgaaccgggccaggaug

SEQ ID NO: 3002139 - RNA, 18 nt, Mycobacterium avium subsp. paratuberculosis
cgaaccgggccaggauga

SEQ ID NO: 3002140 - RNA, 21 nt, Mycobacterium avium subsp. paratuberculosis
cgaaccgggccaggaugaccg

SEQ ID NO: 3002141 - RNA, 18 nt, Mycobacterium avium subsp. paratuberculosis
cgaaccgggcgcgcagau

SEQ ID NO: 3002142 - RNA, 13 nt, Mycobacterium avium subsp. paratuberculosis
cgaaccgggcggu

SEQ ID NO: 3002143 - RNA, 15 nt, Mycobacterium avium subsp. paratuberculosis
cgaaccgggcgguga

SEQ ID NO: 3002144 - RNA, 17 nt, Mycobacterium avium subsp. paratuberculosis
cgaaccggggcaccacg

SEQ ID NO: 3002145 - RNA, 23 nt, Mycobacterium avium subsp. paratuberculosis
cgaaccggggccgcaccugaucg

SEQ ID NO: 3002146 - RNA, 19 nt, Mycobacterium avium subsp. paratuberculosis
cgaaccgggugacgaccau

SEQ ID NO: 3002147 - RNA, 18 nt, Mycobacterium avium subsp. paratuberculosis
cgaaccgguugcgggccg

SEQ ID NO: 3002148 - RNA, 19 nt, Mycobacterium avium subsp. paratuberculosis
cgaaccgguugcgggccga

SEQ ID NO: 3002149 - RNA, 17 nt, Mycobacterium avium subsp. paratuberculosis
cgaaccgugcacgaucg

SEQ ID NO: 3002150 - RNA, 17 nt, Mycobacterium avium subsp. paratuberculosis
cgaaccguucgucgucg

SEQ ID NO: 3002151 - RNA, 22 nt, Mycobacterium avium subsp. paratuberculosis
cgaaccucgagauucugcagcc

SEQ ID NO: 3002152 - RNA, 14 nt, Mycobacterium avium subsp. paratuberculosis
cgaaccucgcggcg

SEQ ID NO: 3002153 - RNA, 18 nt, Mycobacterium avium subsp. paratuberculosis
cgaaccucgcggcggcgu

SEQ ID NO: 3002154 - RNA, 20 nt, Mycobacterium avium subsp. paratuberculosis
cgaaccucgcggcggcgucg

SEQ ID NO: 3002155 - RNA, 18 nt, Mycobacterium avium subsp. paratuberculosis
cgaaccuggcugccuggu

SEQ ID NO: 3002156 - RNA, 21 nt, Mycobacterium avium subsp. paratuberculosis
cgaaccuggcugccugguugg

SEQ ID NO: 3002157 - RNA, 14 nt, Mycobacterium avium subsp. paratuberculosis
cgaacgacagcagg

SEQ ID NO: 3002158 - RNA, 14 nt, Mycobacterium avium subsp. paratuberculosis
cgaacgacgaccuc

SEQ ID NO: 3002159 - RNA, 23 nt, Mycobacterium avium subsp. paratuberculosis
cgaacgacgcggcacgccgcucg

SEQ ID NO: 3002160 - RNA, 16 nt, Mycobacterium avium subsp. paratuberculosis
cgaacgacgucgaggu

SEQ ID NO: 3002161 - RNA, 20 nt, Mycobacterium avium subsp. paratuberculosis
cgaacgacguguucaacgcg

SEQ ID NO: 3002162 - RNA, 17 nt, Mycobacterium avium subsp. paratuberculosis
cgaacgagaaggcggcg

SEQ ID NO: 3002163 - RNA, 18 nt, Mycobacterium avium subsp. paratuberculosis
cgaacgagaaggcggcgu

SEQ ID NO: 3002164 - RNA, 19 nt, Mycobacterium avium subsp. paratuberculosis
cgaacgagaaggcggcguc

SEQ ID NO: 3002165 - RNA, 19 nt, Mycobacterium avium subsp. paratuberculosis
cgaacgaggccgacgugga

SEQ ID NO: 3002166 - RNA, 16 nt, Mycobacterium avium subsp. paratuberculosis
cgaacgaguugccccg

SEQ ID NO: 3002167 - RNA, 15 nt, Mycobacterium avium subsp. paratuberculosis
cgaacgauggugugc

SEQ ID NO: 3002168 - RNA, 23 nt, Mycobacterium avium subsp. paratuberculosis
cgaacgcaacagggccaccgcgu

SEQ ID NO: 3002169 - RNA, 15 nt, Mycobacterium avium subsp. paratuberculosis
cgaacgcaccaccgc

SEQ ID NO: 3002170 - RNA, 17 nt, Mycobacterium avium subsp. paratuberculosis
cgaacgcaccaccgcgg

SEQ ID NO: 3002171 - RNA, 19 nt, Mycobacterium avium subsp. paratuberculosis
cgaacgcaccaccgcggug

SEQ ID NO: 3002172 - RNA, 20 nt, Mycobacterium avium subsp. paratuberculosis
cgaacgcaccaccgcgguga

SEQ ID NO: 3002173 - RNA, 14 nt, Mycobacterium avium subsp. paratuberculosis
cgaacgccaccacg

SEQ ID NO: 3002174 - RNA, 20 nt, Mycobacterium avium subsp. paratuberculosis
cgaacgccaccacggcgucg

SEQ ID NO: 3002175 - RNA, 21 nt, Mycobacterium avium subsp. paratuberculosis
cgaacgccaccacggcgucgc

SEQ ID NO: 3002176 - RNA, 14 nt, Mycobacterium avium subsp. paratuberculosis
cgaacgccaccuuc

SEQ ID NO: 3002177 - RNA, 18 nt, Mycobacterium avium subsp. paratuberculosis
cgaacgccaccuucaccg

SEQ ID NO: 3002178 - RNA, 19 nt, Mycobacterium avium subsp. paratuberculosis
cgaacgccaccuucaccgc

SEQ ID NO: 3002179 - RNA, 23 nt, Mycobacterium avium subsp. paratuberculosis
cgaacgccaccuucaccgcgccg

SEQ ID NO: 3002180 - RNA, 15 nt, Mycobacterium avium subsp. paratuberculosis
cgaacgccagcagcu

SEQ ID NO: 3002181 - RNA, 14 nt, Mycobacterium avium subsp. paratuberculosis
cgaacgccagcgcc

SEQ ID NO: 3002182 - RNA, 17 nt, Mycobacterium avium subsp. paratuberculosis
cgaacgccagcgccgca

SEQ ID NO: 3002183 - RNA, 19 nt, Mycobacterium avium subsp. paratuberculosis
cgaacgccagcgccgcaac

SEQ ID NO: 3002184 - RNA, 15 nt, Mycobacterium avium subsp. paratuberculosis
cgaacgcccgcacca

SEQ ID NO: 3002185 - RNA, 16 nt, Mycobacterium avium subsp. paratuberculosis
cgaacgcccgcaccac

SEQ ID NO: 3002186 - RNA, 18 nt, Mycobacterium avium subsp. paratuberculosis
cgaacgcccgcaccacga

SEQ ID NO: 3002187 - RNA, 15 nt, Mycobacterium avium subsp. paratuberculosis
cgaacgcccggucga

SEQ ID NO: 3002188 - RNA, 15 nt, Mycobacterium avium subsp. paratuberculosis
cgaacgccgaggugc

SEQ ID NO: 3002189 - RNA, 19 nt, Mycobacterium avium subsp. paratuberculosis
cgaacgccgaggugcaaca

SEQ ID NO: 3002190 - RNA, 20 nt, Mycobacterium avium subsp. paratuberculosis
cgaacgccucggcgagccgc

SEQ ID NO: 3002191 - RNA, 19 nt, Mycobacterium avium subsp. paratuberculosis
cgaacgccucgguggucga

SEQ ID NO: 3002192 - RNA, 14 nt, Mycobacterium avium subsp. paratuberculosis
cgaacgcgaccugc

SEQ ID NO: 3002193 - RNA, 21 nt, Mycobacterium avium subsp. paratuberculosis
cgaacgcgacgaucagcagcc

SEQ ID NO: 3002194 - RNA, 21 nt, Mycobacterium avium subsp. paratuberculosis
cgaacgcgaugugccacuucg

SEQ ID NO: 3002195 - RNA, 16 nt, Mycobacterium avium subsp. paratuberculosis
cgaacgcgccccgccg

SEQ ID NO: 3002196 - RNA, 21 nt, Mycobacterium avium subsp. paratuberculosis
cgaacgcgccccgccgggauc

SEQ ID NO: 3002197 - RNA, 15 nt, Mycobacterium avium subsp. paratuberculosis
cgaacgcgccgaucg

SEQ ID NO: 3002198 - RNA, 21 nt, Mycobacterium avium subsp. paratuberculosis
cgaacgcgccgaucgagacga

SEQ ID NO: 3002199 - RNA, 16 nt, Mycobacterium avium subsp. paratuberculosis
cgaacgcgccgcccac

SEQ ID NO: 3002200 - RNA, 14 nt, Mycobacterium avium subsp. paratuberculosis
cgaacgcgccgccg

SEQ ID NO: 3002201 - RNA, 13 nt, Mycobacterium avium subsp. paratuberculosis
cgaacgcgccggu

SEQ ID NO: 3002202 - RNA, 16 nt, Mycobacterium avium subsp. paratuberculosis
cgaacgcgccggugac

SEQ ID NO: 3002203 - RNA, 14 nt, Mycobacterium avium subsp. paratuberculosis
cgaacgcgcggucg

SEQ ID NO: 3002204 - RNA, 15 nt, Mycobacterium avium subsp. paratuberculosis
cgaacgcgcgucggu

SEQ ID NO: 3002205 - RNA, 14 nt, Mycobacterium avium subsp. paratuberculosis
cgaacgcgcugucg

SEQ ID NO: 3002206 - RNA, 14 nt, Mycobacterium avium subsp. paratuberculosis
cgaacgcggccagc

SEQ ID NO: 3002207 - RNA, 17 nt, Mycobacterium avium subsp. paratuberculosis
cgaacgcggccagcggg

SEQ ID NO: 3002208 - RNA, 18 nt, Mycobacterium avium subsp. paratuberculosis
cgaacgcggccagcgggc

SEQ ID NO: 3002209 - RNA, 12 nt, Mycobacterium avium subsp. paratuberculosis
cgaacgcggccg

SEQ ID NO: 3002210 - RNA, 15 nt, Mycobacterium avium subsp. paratuberculosis
cgaacgcggccgcca

SEQ ID NO: 3002211 - RNA, 16 nt, Mycobacterium avium subsp. paratuberculosis
cgaacgcggccgccag

SEQ ID NO: 3002212 - RNA, 19 nt, Mycobacterium avium subsp. paratuberculosis
cgaacgcggccgccagcgc

SEQ ID NO: 3002213 - RNA, 17 nt, Mycobacterium avium subsp. paratuberculosis
cgaacgcggccgccauc

SEQ ID NO: 3002214 - RNA, 18 nt, Mycobacterium avium subsp. paratuberculosis
cgaacgcggccgccaucg

SEQ ID NO: 3002215 - RNA, 20 nt, Mycobacterium avium subsp. paratuberculosis
cgaacgcggccgccaucgau

SEQ ID NO: 3002216 - RNA, 17 nt, Mycobacterium avium subsp. paratuberculosis
cgaacgcggcgaacacc

SEQ ID NO: 3002217 - RNA, 16 nt, Mycobacterium avium subsp. paratuberculosis
cgaacgcggcgaagca

SEQ ID NO: 3002218 - RNA, 12 nt, Mycobacterium avium subsp. paratuberculosis
cgaacgcggcgc

SEQ ID NO: 3002219 - RNA, 15 nt, Mycobacterium avium subsp. paratuberculosis
cgaacgcggcgccga

SEQ ID NO: 3002220 - RNA, 16 nt, Mycobacterium avium subsp. paratuberculosis
cgaacgcggcgccgac

SEQ ID NO: 3002221 - RNA, 17 nt, Mycobacterium avium subsp. paratuberculosis
cgaacgcggcgccgacg

SEQ ID NO: 3002222 - RNA, 13 nt, Mycobacterium avium subsp. paratuberculosis
cgaacgcggcuga

SEQ ID NO: 3002223 - RNA, 15 nt, Mycobacterium avium subsp. paratuberculosis
cgaacgcggcugauc

SEQ ID NO: 3002224 - RNA, 12 nt, Mycobacterium avium subsp. paratuberculosis
cgaacgcgguga

SEQ ID NO: 3002225 - RNA, 14 nt, Mycobacterium avium subsp. paratuberculosis
cgaacgcggugagc

SEQ ID NO: 3002226 - RNA, 20 nt, Mycobacterium avium subsp. paratuberculosis
cgaacgcgguuuugaugccg

SEQ ID NO: 3002227 - RNA, 20 nt, Mycobacterium avium subsp. paratuberculosis
cgaacgcguacacggcccgc

SEQ ID NO: 3002228 - RNA, 14 nt, Mycobacterium avium subsp. paratuberculosis
cgaacgcgucccgg

SEQ ID NO: 3002229 - RNA, 18 nt, Mycobacterium avium subsp. paratuberculosis
cgaacgcguucgucggcg

SEQ ID NO: 3002230 - RNA, 23 nt, Mycobacterium avium subsp. paratuberculosis
cgaacgcguucgucggcgcgucg

SEQ ID NO: 3002231 - RNA, 15 nt, Mycobacterium avium subsp. paratuberculosis
cgaacgcugccaggc

SEQ ID NO: 3002232 - RNA, 17 nt, Mycobacterium avium subsp. paratuberculosis
cgaacggaccgggcggg

SEQ ID NO: 3002233 - RNA, 22 nt, Mycobacterium avium subsp. paratuberculosis
cgaacggcaaccugggcggcgg

SEQ ID NO: 3002234 - RNA, 18 nt, Mycobacterium avium subsp. paratuberculosis
cgaacggcaacggcggcg

SEQ ID NO: 3002235 - RNA, 13 nt, Mycobacterium avium subsp. paratuberculosis
cgaacggcaccuc

SEQ ID NO: 3002236 - RNA, 15 nt, Mycobacterium avium subsp. paratuberculosis
cgaacggcaccucga

SEQ ID NO: 3002237 - RNA, 20 nt, Mycobacterium avium subsp. paratuberculosis
cgaacggcaccucgaucacc

SEQ ID NO: 3002238 - RNA, 14 nt, Mycobacterium avium subsp. paratuberculosis
cgaacggcaugucg

SEQ ID NO: 3002239 - RNA, 22 nt, Mycobacterium avium subsp. paratuberculosis
cgaacggccaguccaggccgcc

SEQ ID NO: 3002240 - RNA, 18 nt, Mycobacterium avium subsp. paratuberculosis
cgaacggcccgccgccgg

SEQ ID NO: 3002241 - RNA, 22 nt, Mycobacterium avium subsp. paratuberculosis
cgaacggcccggucuugccggc

SEQ ID NO: 3002242 - RNA, 15 nt, Mycobacterium avium subsp. paratuberculosis
cgaacggccgcgaug

SEQ ID NO: 3002243 - RNA, 12 nt, Mycobacterium avium subsp. paratuberculosis
cgaacggcgcga

SEQ ID NO: 3002244 - RNA, 16 nt, Mycobacterium avium subsp. paratuberculosis
cgaacggcgcgaaccg

SEQ ID NO: 3002245 - RNA, 17 nt, Mycobacterium avium subsp. paratuberculosis
cgaacggcgcgaaccgg

SEQ ID NO: 3002246 - RNA, 22 nt, Mycobacterium avium subsp. paratuberculosis
cgaacggcgcgaaccgggccag

SEQ ID NO: 3002247 - RNA, 23 nt, Mycobacterium avium subsp. paratuberculosis
cgaacggcggauccagguggggc

SEQ ID NO: 3002248 - RNA, 22 nt, Mycobacterium avium subsp. paratuberculosis
cgaacggcgucuggccggagcg

SEQ ID NO: 3002249 - RNA, 23 nt, Mycobacterium avium subsp. paratuberculosis
cgaacggcgucuggccggagcgg

SEQ ID NO: 3002250 - RNA, 14 nt, Mycobacterium avium subsp. paratuberculosis
cgaacgggccgggc

SEQ ID NO: 3002251 - RNA, 16 nt, Mycobacterium avium subsp. paratuberculosis
cgaacgggccgggcac

SEQ ID NO: 3002252 - RNA, 18 nt, Mycobacterium avium subsp. paratuberculosis
cgaacgggccgggcaccg

SEQ ID NO: 3002253 - RNA, 21 nt, Mycobacterium avium subsp. paratuberculosis
cgaacgggccgggcaccgcgc

SEQ ID NO: 3002254 - RNA, 15 nt, Mycobacterium avium subsp. paratuberculosis
cgaacgggcuggcca

SEQ ID NO: 3002255 - RNA, 21 nt, Mycobacterium avium subsp. paratuberculosis
cgaacggguaggugcccgggu

SEQ ID NO: 3002256 - RNA, 23 nt, Mycobacterium avium subsp. paratuberculosis
cgaacggguaggugcccgggucg

SEQ ID NO: 3002257 - RNA, 17 nt, Mycobacterium avium subsp. paratuberculosis
cgaacggguccuugccg

SEQ ID NO: 3002258 - RNA, 20 nt, Mycobacterium avium subsp. paratuberculosis
cgaacggguccuugccggcg

SEQ ID NO: 3002259 - RNA, 22 nt, Mycobacterium avium subsp. paratuberculosis
cgaacggguccuugccggcggc

SEQ ID NO: 3002260 - RNA, 23 nt, Mycobacterium avium subsp. paratuberculosis
cgaacggguccuugccggcggcg

SEQ ID NO: 3002261 - RNA, 17 nt, Mycobacterium avium subsp. paratuberculosis
cgaacgggucggcgacc

SEQ ID NO: 3002262 - RNA, 18 nt, Mycobacterium avium subsp. paratuberculosis
cgaacgggucggcgacca

SEQ ID NO: 3002263 - RNA, 14 nt, Mycobacterium avium subsp. paratuberculosis
cgaacgggucgggg

SEQ ID NO: 3002264 - RNA, 21 nt, Mycobacterium avium subsp. paratuberculosis
cgaacgggugaccggcggcca

SEQ ID NO: 3002265 - RNA, 23 nt, Mycobacterium avium subsp. paratuberculosis
cgaacgggugaccggcggccagc

SEQ ID NO: 3002266 - RNA, 17 nt, Mycobacterium avium subsp. paratuberculosis
cgaacgggugcggcgcu

SEQ ID NO: 3002267 - RNA, 21 nt, Mycobacterium avium subsp. paratuberculosis
cgaacgguucgggaaccuggc

SEQ ID NO: 3002268 - RNA, 19 nt, Mycobacterium avium subsp. paratuberculosis
cgaacgucaccaacaugau

SEQ ID NO: 3002269 - RNA, 15 nt, Mycobacterium avium subsp. paratuberculosis
cgaacgucacggcga

SEQ ID NO: 3002270 - RNA, 21 nt, Mycobacterium avium subsp. paratuberculosis
cgaacgucacggcgaggaugg

SEQ ID NO: 3002271 - RNA, 17 nt, Mycobacterium avium subsp. paratuberculosis
cgaacgucaggccgugc

SEQ ID NO: 3002272 - RNA, 16 nt, Mycobacterium avium subsp. paratuberculosis
cgaacgucgagcgcgg

SEQ ID NO: 3002273 - RNA, 17 nt, Mycobacterium avium subsp. paratuberculosis
cgaacgucgagcgcggc

SEQ ID NO: 3002274 - RNA, 18 nt, Mycobacterium avium subsp. paratuberculosis
cgaacgucgagcgcggcc

SEQ ID NO: 3002275 - RNA, 21 nt, Mycobacterium avium subsp. paratuberculosis
cgaacgucgaugucacguuga

SEQ ID NO: 3002276 - RNA, 13 nt, Mycobacterium avium subsp. paratuberculosis
cgaacgucggguc

SEQ ID NO: 3002277 - RNA, 16 nt, Mycobacterium avium subsp. paratuberculosis
cgaacgucucgcggga

SEQ ID NO: 3002278 - RNA, 15 nt, Mycobacterium avium subsp. paratuberculosis
cgaacgugcagcuuc

SEQ ID NO: 3002279 - RNA, 14 nt, Mycobacterium avium subsp. paratuberculosis
cgaacgugcgcggc

SEQ ID NO: 3002280 - RNA, 15 nt, Mycobacterium avium subsp. paratuberculosis
cgaacgugcgcggcg

SEQ ID NO: 3002281 - RNA, 22 nt, Mycobacterium avium subsp. paratuberculosis
cgaacuacuucgucagcagcga

SEQ ID NO: 3002282 - RNA, 17 nt, Mycobacterium avium subsp. paratuberculosis
cgaacucaccgguggcc

SEQ ID NO: 3002283 - RNA, 21 nt, Mycobacterium avium subsp. paratuberculosis
cgaacucauggcgugcucgga

SEQ ID NO: 3002284 - RNA, 19 nt, Mycobacterium avium subsp. paratuberculosis
cgaacuccacccugccgac

SEQ ID NO: 3002285 - RNA, 22 nt, Mycobacterium avium subsp. paratuberculosis
cgaacuccauccgccgucgacc

SEQ ID NO: 3002286 - RNA, 14 nt, Mycobacterium avium subsp. paratuberculosis
cgaacuccgccgaa

SEQ ID NO: 3002287 - RNA, 18 nt, Mycobacterium avium subsp. paratuberculosis
cgaacuccgccgaaccga

SEQ ID NO: 3002288 - RNA, 13 nt, Mycobacterium avium subsp. paratuberculosis
cgaacuccgcgcg

SEQ ID NO: 3002289 - RNA, 21 nt, Mycobacterium avium subsp. paratuberculosis
cgaacuccgcgcgcggcacgg

SEQ ID NO: 3002290 - RNA, 18 nt, Mycobacterium avium subsp. paratuberculosis
cgaacuccuugacccggc

SEQ ID NO: 3002291 - RNA, 21 nt, Mycobacterium avium subsp. paratuberculosis
cgaacuccuugacccggccca

SEQ ID NO: 3002292 - RNA, 23 nt, Mycobacterium avium subsp. paratuberculosis
cgaacuccuugacccggcccauc

SEQ ID NO: 3002293 - RNA, 13 nt, Mycobacterium avium subsp. paratuberculosis
cgaacucgcggcg

SEQ ID NO: 3002294 - RNA, 16 nt, Mycobacterium avium subsp. paratuberculosis
cgaacucgcggcgggu

SEQ ID NO: 3002295 - RNA, 18 nt, Mycobacterium avium subsp. paratuberculosis
cgaacucgcggcggguca

SEQ ID NO: 3002296 - RNA, 17 nt, Mycobacterium avium subsp. paratuberculosis
cgaacucggcgccgccg

SEQ ID NO: 3002297 - RNA, 18 nt, Mycobacterium avium subsp. paratuberculosis
cgaacucggcgccgccgg

SEQ ID NO: 3002298 - RNA, 15 nt, Mycobacterium avium subsp. paratuberculosis
cgaacucgggcccga

SEQ ID NO: 3002299 - RNA, 14 nt, Mycobacterium avium subsp. paratuberculosis
cgaacucgucgacg

SEQ ID NO: 3002300 - RNA, 18 nt, Mycobacterium avium subsp. paratuberculosis
cgaacucgucgacgccca

SEQ ID NO: 3002301 - RNA, 21 nt, Mycobacterium avium subsp. paratuberculosis
cgaacucgucgacgcccaccu

SEQ ID NO: 3002302 - RNA, 13 nt, Mycobacterium avium subsp. paratuberculosis
cgaacucgucgau

SEQ ID NO: 3002303 - RNA, 14 nt, Mycobacterium avium subsp. paratuberculosis
cgaacucgucgaug

SEQ ID NO: 3002304 - RNA, 20 nt, Mycobacterium avium subsp. paratuberculosis
cgaacucucccaggacagcu

SEQ ID NO: 3002305 - RNA, 16 nt, Mycobacterium avium subsp. paratuberculosis
cgaacugcaccagcac

SEQ ID NO: 3002306 - RNA, 17 nt, Mycobacterium avium subsp. paratuberculosis
cgaacugcaccagcacg

SEQ ID NO: 3002307 - RNA, 18 nt, Mycobacterium avium subsp. paratuberculosis
cgaacugcaccagcacga

SEQ ID NO: 3002308 - RNA, 18 nt, Mycobacterium avium subsp. paratuberculosis
cgaacugcagccggccaa

SEQ ID NO: 3002309 - RNA, 21 nt, Mycobacterium avium subsp. paratuberculosis
cgaacugcaucauguccaggu

SEQ ID NO: 3002310 - RNA, 16 nt, Mycobacterium avium subsp. paratuberculosis
cgaacugccgaugcug

SEQ ID NO: 3002311 - RNA, 23 nt, Mycobacterium avium subsp. paratuberculosis
cgaacugccgaugcugagcgggu

SEQ ID NO: 3002312 - RNA, 14 nt, Mycobacterium avium subsp. paratuberculosis
cgaacugccggcau

SEQ ID NO: 3002313 - RNA, 23 nt, Mycobacterium avium subsp. paratuberculosis
cgaacugccggcauaggccagca

SEQ ID NO: 3002314 - RNA, 19 nt, Mycobacterium avium subsp. paratuberculosis
cgaacugcuugaucagguc

SEQ ID NO: 3002315 - RNA, 20 nt, Mycobacterium avium subsp. paratuberculosis
cgaacugggugccccgccgu

SEQ ID NO: 3002316 - RNA, 21 nt, Mycobacterium avium subsp. paratuberculosis
cgaacugguuguagucgucga

SEQ ID NO: 3002317 - RNA, 14 nt, Mycobacterium avium subsp. paratuberculosis
cgaacuucagcgcg

SEQ ID NO: 3002318 - RNA, 17 nt, Mycobacterium avium subsp. paratuberculosis
cgaacuucagcgcgucg

SEQ ID NO: 3002319 - RNA, 16 nt, Mycobacterium avium subsp. paratuberculosis
cgaacuugaccgggcu

SEQ ID NO: 3002320 - RNA, 17 nt, Mycobacterium avium subsp. paratuberculosis
cgaacuugaucaccgcg

SEQ ID NO: 3002321 - RNA, 21 nt, Mycobacterium avium subsp. paratuberculosis
cgaagaaccgcaacaccagca

SEQ ID NO: 3002322 - RNA, 17 nt, Mycobacterium avium subsp. paratuberculosis
cgaagaacgacgccacc

SEQ ID NO: 3002323 - RNA, 16 nt, Mycobacterium avium subsp. paratuberculosis
cgaagaacucagccga

SEQ ID NO: 3002324 - RNA, 23 nt, Mycobacterium avium subsp. paratuberculosis
cgaagaacuggcugagcaccggg

SEQ ID NO: 3002325 - RNA, 23 nt, Mycobacterium avium subsp. paratuberculosis
cgaagaacuugucgucgucggcg

SEQ ID NO: 3002326 - RNA, 22 nt, Mycobacterium avium subsp. paratuberculosis
cgaagaagauguugcggcggcc

SEQ ID NO: 3002327 - RNA, 15 nt, Mycobacterium avium subsp. paratuberculosis
cgaagaagcggccga

SEQ ID NO: 3002328 - RNA, 16 nt, Mycobacterium avium subsp. paratuberculosis
cgaagaagcggccgac

SEQ ID NO: 3002329 - RNA, 20 nt, Mycobacterium avium subsp. paratuberculosis
cgaagaagcggccgacgaac

SEQ ID NO: 3002330 - RNA, 16 nt, Mycobacterium avium subsp. paratuberculosis
cgaagaaggcgugcga

SEQ ID NO: 3002331 - RNA, 19 nt, Mycobacterium avium subsp. paratuberculosis
cgaagaaggcuccgccgau

SEQ ID NO: 3002332 - RNA, 18 nt, Mycobacterium avium subsp. paratuberculosis
cgaagaccacgaacugcg

SEQ ID NO: 3002333 - RNA, 20 nt, Mycobacterium avium subsp. paratuberculosis
cgaagaccagcgugucgccg

SEQ ID NO: 3002334 - RNA, 17 nt, Mycobacterium avium subsp. paratuberculosis
cgaagacccgaaacugg

SEQ ID NO: 3002335 - RNA, 15 nt, Mycobacterium avium subsp. paratuberculosis
cgaagaccgggccga

SEQ ID NO: 3002336 - RNA, 21 nt, Mycobacterium avium subsp. paratuberculosis
cgaagaccggugcgcgcacca

SEQ ID NO: 3002337 - RNA, 23 nt, Mycobacterium avium subsp. paratuberculosis
cgaagacgaugaaaccccagccg

SEQ ID NO: 3002338 - RNA, 16 nt, Mycobacterium avium subsp. paratuberculosis
cgaagacgucggcgcg

SEQ ID NO: 3002339 - RNA, 21 nt, Mycobacterium avium subsp. paratuberculosis
cgaagagcuggucgcccacca

SEQ ID NO: 3002340 - RNA, 19 nt, Mycobacterium avium subsp. paratuberculosis
cgaagaggugcucgacggc

SEQ ID NO: 3002341 - RNA, 13 nt, Mycobacterium avium subsp. paratuberculosis
cgaagaucaccgc

SEQ ID NO: 3002342 - RNA, 17 nt, Mycobacterium avium subsp. paratuberculosis
cgaagaucaccgcgacg

SEQ ID NO: 3002343 - RNA, 17 nt, Mycobacterium avium subsp. paratuberculosis
cgaagaucaccgcgucg

SEQ ID NO: 3002344 - RNA, 14 nt, Mycobacterium avium subsp. paratuberculosis
cgaagaucagcgcg

SEQ ID NO: 3002345 - RNA, 17 nt, Mycobacterium avium subsp. paratuberculosis
cgaagaucuccgggaac

SEQ ID NO: 3002346 - RNA, 16 nt, Mycobacterium avium subsp. paratuberculosis
cgaagaugaucagcgc

SEQ ID NO: 3002347 - RNA, 18 nt, Mycobacterium avium subsp. paratuberculosis
cgaagaugaucagcgcgc

SEQ ID NO: 3002348 - RNA, 20 nt, Mycobacterium avium subsp. paratuberculosis
cgaagaugaucagcgcgccc

SEQ ID NO: 3002349 - RNA, 12 nt, Mycobacterium avium subsp. paratuberculosis
cgaagaugcgcc

SEQ ID NO: 3002350 - RNA, 15 nt, Mycobacterium avium subsp. paratuberculosis
cgaagaugcgcccgg

SEQ ID NO: 3002351 - RNA, 14 nt, Mycobacterium avium subsp. paratuberculosis
cgaagauggccagc

SEQ ID NO: 3002352 - RNA, 16 nt, Mycobacterium avium subsp. paratuberculosis
cgaagauggccagcgc

SEQ ID NO: 3002353 - RNA, 17 nt, Mycobacterium avium subsp. paratuberculosis
cgaagauggccagcgcg

SEQ ID NO: 3002354 - RNA, 21 nt, Mycobacterium avium subsp. paratuberculosis
cgaagauggccagcgcggcgu

SEQ ID NO: 3002355 - RNA, 15 nt, Mycobacterium avium subsp. paratuberculosis
cgaagauggccagga

SEQ ID NO: 3002356 - RNA, 16 nt, Mycobacterium avium subsp. paratuberculosis
cgaagauggccaggaa

SEQ ID NO: 3002357 - RNA, 15 nt, Mycobacterium avium subsp. paratuberculosis
cgaagauggcgugcc

SEQ ID NO: 3002358 - RNA, 17 nt, Mycobacterium avium subsp. paratuberculosis
cgaagauggucgcgccg

SEQ ID NO: 3002359 - RNA, 18 nt, Mycobacterium avium subsp. paratuberculosis
cgaagauggucgcgccgc

SEQ ID NO: 3002360 - RNA, 22 nt, Mycobacterium avium subsp. paratuberculosis
cgaagauggucgcgccgcggcg

SEQ ID NO: 3002361 - RNA, 15 nt, Mycobacterium avium subsp. paratuberculosis
cgaagaugucgcggc

SEQ ID NO: 3002362 - RNA, 15 nt, Mycobacterium avium subsp. paratuberculosis
cgaagaugucggugc

SEQ ID NO: 3002363 - RNA, 18 nt, Mycobacterium avium subsp. paratuberculosis
cgaagaugucggugccga

SEQ ID NO: 3002364 - RNA, 18 nt, Mycobacterium avium subsp. paratuberculosis
cgaagcacgaccacaccc

SEQ ID NO: 3002365 - RNA, 20 nt, Mycobacterium avium subsp. paratuberculosis
cgaagcacgaccacacccgc

SEQ ID NO: 3002366 - RNA, 19 nt, Mycobacterium avium subsp. paratuberculosis
cgaagcagaacuucuccgc

SEQ ID NO: 3002367 - RNA, 17 nt, Mycobacterium avium subsp. paratuberculosis
cgaagcagccuucuugg

SEQ ID NO: 3002368 - RNA, 19 nt, Mycobacterium avium subsp. paratuberculosis
cgaagcagccuucuuggcg

SEQ ID NO: 3002369 - RNA, 13 nt, Mycobacterium avium subsp. paratuberculosis
cgaagcagcucgc

SEQ ID NO: 3002370 - RNA, 24 nt, Mycobacterium avium subsp. paratuberculosis
cgaagcagcucgcguagcgaggug

SEQ ID NO: 3002371 - RNA, 10 nt, Mycobacterium avium subsp. paratuberculosis
cgaagcccau

SEQ ID NO: 3002372 - RNA, 13 nt, Mycobacterium avium subsp. paratuberculosis
cgaagcccgcagc

SEQ ID NO: 3002373 - RNA, 20 nt, Mycobacterium avium subsp. paratuberculosis
cgaagcccgcagcgaacgcg

SEQ ID NO: 3002374 - RNA, 15 nt, Mycobacterium avium subsp. paratuberculosis
cgaagcccgccguca

SEQ ID NO: 3002375 - RNA, 11 nt, Mycobacterium avium subsp. paratuberculosis
cgaagccgaag

SEQ ID NO: 3002376 - RNA, 15 nt, Mycobacterium avium subsp. paratuberculosis
cgaagccgacaccgg

SEQ ID NO: 3002377 - RNA, 20 nt, Mycobacterium avium subsp. paratuberculosis
cgaagccgacaccggguccc

SEQ ID NO: 3002378 - RNA, 14 nt, Mycobacterium avium subsp. paratuberculosis
cgaagccgacgucc

SEQ ID NO: 3002379 - RNA, 16 nt, Mycobacterium avium subsp. paratuberculosis
cgaagccgacgucgac

SEQ ID NO: 3002380 - RNA, 18 nt, Mycobacterium avium subsp. paratuberculosis
cgaagccgacgucgacca

SEQ ID NO: 3002381 - RNA, 19 nt, Mycobacterium avium subsp. paratuberculosis
cgaagccgaucaccggcgc

SEQ ID NO: 3002382 - RNA, 21 nt, Mycobacterium avium subsp. paratuberculosis
cgaagccgaucaccggcgcgu

SEQ ID NO: 3002383 - RNA, 13 nt, Mycobacterium avium subsp. paratuberculosis
cgaagccgccgcc

SEQ ID NO: 3002384 - RNA, 21 nt, Mycobacterium avium subsp. paratuberculosis
cgaagccgccgcccucgguga

SEQ ID NO: 3002385 - RNA, 14 nt, Mycobacterium avium subsp. paratuberculosis
cgaagccgccgucc

SEQ ID NO: 3002386 - RNA, 20 nt, Mycobacterium avium subsp. paratuberculosis
cgaagccgccguccccgcgc

SEQ ID NO: 3002387 - RNA, 23 nt, Mycobacterium avium subsp. paratuberculosis
cgaagccgccguccccgcgcggc

SEQ ID NO: 3002388 - RNA, 14 nt, Mycobacterium avium subsp. paratuberculosis
cgaagccggccccg

SEQ ID NO: 3002389 - RNA, 17 nt, Mycobacterium avium subsp. paratuberculosis
cgaagccggccccgccc

SEQ ID NO: 3002390 - RNA, 20 nt, Mycobacterium avium subsp. paratuberculosis
cgaagccggccccgcccggg

SEQ ID NO: 3002391 - RNA, 23 nt, Mycobacterium avium subsp. paratuberculosis
cgaagccggccccgcccggggcg

SEQ ID NO: 3002392 - RNA, 13 nt, Mycobacterium avium subsp. paratuberculosis
cgaagccggcgca

SEQ ID NO: 3002393 - RNA, 16 nt, Mycobacterium avium subsp. paratuberculosis
cgaagccggugcccau

SEQ ID NO: 3002394 - RNA, 17 nt, Mycobacterium avium subsp. paratuberculosis
cgaagccggugcccauc

SEQ ID NO: 3002395 - RNA, 13 nt, Mycobacterium avium subsp. paratuberculosis
cgaagccgucgac

SEQ ID NO: 3002396 - RNA, 15 nt, Mycobacterium avium subsp. paratuberculosis
cgaagccgugacccg

SEQ ID NO: 3002397 - RNA, 21 nt, Mycobacterium avium subsp. paratuberculosis
cgaagccgugacccgccguga

SEQ ID NO: 3002398 - RNA, 20 nt, Mycobacterium avium subsp. paratuberculosis
cgaagccguggcaggcacga

SEQ ID NO: 3002399 - RNA, 15 nt, Mycobacterium avium subsp. paratuberculosis
cgaagcgaggcgcca

SEQ ID NO: 3002400 - RNA, 14 nt, Mycobacterium avium subsp. paratuberculosis
cgaagcgcagcacc

SEQ ID NO: 3002401 - RNA, 15 nt, Mycobacterium avium subsp. paratuberculosis
cgaagcgcagcaccu

SEQ ID NO: 3002402 - RNA, 13 nt, Mycobacterium avium subsp. paratuberculosis
cgaagcgcagcag

SEQ ID NO: 3002403 - RNA, 14 nt, Mycobacterium avium subsp. paratuberculosis
cgaagcgcagcguc

SEQ ID NO: 3002404 - RNA, 15 nt, Mycobacterium avium subsp. paratuberculosis
cgaagcgcagcgucu

SEQ ID NO: 3002405 - RNA, 12 nt, Mycobacterium avium subsp. paratuberculosis
cgaagcgccgca

SEQ ID NO: 3002406 - RNA, 15 nt, Mycobacterium avium subsp. paratuberculosis
cgaagcgccgcaugc

SEQ ID NO: 3002407 - RNA, 13 nt, Mycobacterium avium subsp. paratuberculosis
cgaagcgcgaugc

SEQ ID NO: 3002408 - RNA, 21 nt, Mycobacterium avium subsp. paratuberculosis
cgaagcgcgaugcggcucacc

SEQ ID NO: 3002409 - RNA, 19 nt, Mycobacterium avium subsp. paratuberculosis
cgaagcgcuaacaaaagcc

SEQ ID NO: 3002410 - RNA, 16 nt, Mycobacterium avium subsp. paratuberculosis
cgaagcggccggggag

SEQ ID NO: 3002411 - RNA, 21 nt, Mycobacterium avium subsp. paratuberculosis
cgaagcggccggggaguucgc

SEQ ID NO: 3002412 - RNA, 17 nt, Mycobacterium avium subsp. paratuberculosis
cgaagcgggacugcagc

SEQ ID NO: 3002413 - RNA, 18 nt, Mycobacterium avium subsp. paratuberculosis
cgaagcgggacugcagcg

SEQ ID NO: 3002414 - RNA, 19 nt, Mycobacterium avium subsp. paratuberculosis
cgaagcgggacugcagcgc

SEQ ID NO: 3002415 - RNA, 21 nt, Mycobacterium avium subsp. paratuberculosis
cgaagcgggacugcagcgcgg

SEQ ID NO: 3002416 - RNA, 14 nt, Mycobacterium avium subsp. paratuberculosis
cgaagcgggcggcg

SEQ ID NO: 3002417 - RNA, 15 nt, Mycobacterium avium subsp. paratuberculosis
cgaagcgggcggcga

SEQ ID NO: 3002418 - RNA, 18 nt, Mycobacterium avium subsp. paratuberculosis
cgaagcgggcggcgaaca

SEQ ID NO: 3002419 - RNA, 21 nt, Mycobacterium avium subsp. paratuberculosis
cgaagcgggcggcgaacacca

SEQ ID NO: 3002420 - RNA, 16 nt, Mycobacterium avium subsp. paratuberculosis
cgaagcgggucgggga

SEQ ID NO: 3002421 - RNA, 17 nt, Mycobacterium avium subsp. paratuberculosis
cgaagcggugcaccacc

SEQ ID NO: 3002422 - RNA, 22 nt, Mycobacterium avium subsp. paratuberculosis
cgaagcguuucagcaacccgaa

SEQ ID NO: 3002423 - RNA, 15 nt, Mycobacterium avium subsp. paratuberculosis
cgaagcucaucaccg

SEQ ID NO: 3002424 - RNA, 20 nt, Mycobacterium avium subsp. paratuberculosis
cgaagcucaucaccggcgcg

SEQ ID NO: 3002425 - RNA, 23 nt, Mycobacterium avium subsp. paratuberculosis
cgaagcucaucaccggcgcgccg

SEQ ID NO: 3002426 - RNA, 15 nt, Mycobacterium avium subsp. paratuberculosis
cgaagcugagguggc

SEQ ID NO: 3002427 - RNA, 16 nt, Mycobacterium avium subsp. paratuberculosis
cgaagcugcgcagccg

SEQ ID NO: 3002428 - RNA, 18 nt, Mycobacterium avium subsp. paratuberculosis
cgaagcugcgcagccgug

SEQ ID NO: 3002429 - RNA, 20 nt, Mycobacterium avium subsp. paratuberculosis
cgaagcuggcgaacagcaga

SEQ ID NO: 3002430 - RNA, 16 nt, Mycobacterium avium subsp. paratuberculosis
cgaagcugucgccgag

SEQ ID NO: 3002431 - RNA, 15 nt, Mycobacterium avium subsp. paratuberculosis
cgaaggccagcgaua

SEQ ID NO: 3002432 - RNA, 16 nt, Mycobacterium avium subsp. paratuberculosis
cgaaggccaggugcac

SEQ ID NO: 3002433 - RNA, 20 nt, Mycobacterium avium subsp. paratuberculosis
cgaaggccaggugcacgccg

SEQ ID NO: 3002434 - RNA, 13 nt, Mycobacterium avium subsp. paratuberculosis
cgaaggccgccgg

SEQ ID NO: 3002435 - RNA, 15 nt, Mycobacterium avium subsp. paratuberculosis
cgaaggccgggucgg

SEQ ID NO: 3002436 - RNA, 19 nt, Mycobacterium avium subsp. paratuberculosis
cgaaggccuggaacaccca

SEQ ID NO: 3002437 - RNA, 14 nt, Mycobacterium avium subsp. paratuberculosis
cgaaggcgcgcagg

SEQ ID NO: 3002438 - RNA, 13 nt, Mycobacterium avium subsp. paratuberculosis
cgaaggcggccgc

SEQ ID NO: 3002439 - RNA, 15 nt, Mycobacterium avium subsp. paratuberculosis
cgaaggcggccgcga

SEQ ID NO: 3002440 - RNA, 16 nt, Mycobacterium avium subsp. paratuberculosis
cgaaggcggccgcgag

SEQ ID NO: 3002441 - RNA, 15 nt, Mycobacterium avium subsp. paratuberculosis
cgaaggcggcgccgg

SEQ ID NO: 3002442 - RNA, 16 nt, Mycobacterium avium subsp. paratuberculosis
cgaaggcggcgccggc

SEQ ID NO: 3002443 - RNA, 17 nt, Mycobacterium avium subsp. paratuberculosis
cgaaggcggcgccggcc

SEQ ID NO: 3002444 - RNA, 12 nt, Mycobacterium avium subsp. paratuberculosis
cgaaggcggcgu

SEQ ID NO: 3002445 - RNA, 18 nt, Mycobacterium avium subsp. paratuberculosis
cgaaggcggcgucgaugu

SEQ ID NO: 3002446 - RNA, 21 nt, Mycobacterium avium subsp. paratuberculosis
cgaaggcggcgucgaugucgc

SEQ ID NO: 3002447 - RNA, 19 nt, Mycobacterium avium subsp. paratuberculosis
cgaaggcgugcucgaucgc

SEQ ID NO: 3002448 - RNA, 20 nt, Mycobacterium avium subsp. paratuberculosis
cgaaggcguuggagccgacc

SEQ ID NO: 3002449 - RNA, 21 nt, Mycobacterium avium subsp. paratuberculosis
cgaaggcguuggagccgacca

SEQ ID NO: 3002450 - RNA, 17 nt, Mycobacterium avium subsp. paratuberculosis
cgaaggcucgccacgcg

SEQ ID NO: 3002451 - RNA, 17 nt, Mycobacterium avium subsp. paratuberculosis
cgaagggaaaggcagca

SEQ ID NO: 3002452 - RNA, 20 nt, Mycobacterium avium subsp. paratuberculosis
cgaagggaaaggcagcagcc

SEQ ID NO: 3002453 - RNA, 23 nt, Mycobacterium avium subsp. paratuberculosis
cgaagggcaucgggucguagagc

SEQ ID NO: 3002454 - RNA, 16 nt, Mycobacterium avium subsp. paratuberculosis
cgaagggcgccagccg

SEQ ID NO: 3002455 - RNA, 14 nt, Mycobacterium avium subsp. paratuberculosis
cgaagggucggucg

SEQ ID NO: 3002456 - RNA, 15 nt, Mycobacterium avium subsp. paratuberculosis
cgaaggucugcagca

SEQ ID NO: 3002457 - RNA, 17 nt, Mycobacterium avium subsp. paratuberculosis
cgaaggucugcagcagc

SEQ ID NO: 3002458 - RNA, 18 nt, Mycobacterium avium subsp. paratuberculosis
cgaaggucugcagcagcc

SEQ ID NO: 3002459 - RNA, 13 nt, Mycobacterium avium subsp. paratuberculosis
cgaaggugaucuu

SEQ ID NO: 3002460 - RNA, 15 nt, Mycobacterium avium subsp. paratuberculosis
cgaaggugcccgcau

SEQ ID NO: 3002461 - RNA, 19 nt, Mycobacterium avium subsp. paratuberculosis
cgaaggugccgcgaugccc

SEQ ID NO: 3002462 - RNA, 18 nt, Mycobacterium avium subsp. paratuberculosis
cgaaggugcgcacgaacg

SEQ ID NO: 3002463 - RNA, 16 nt, Mycobacterium avium subsp. paratuberculosis
cgaaggugggcagcgc

SEQ ID NO: 3002464 - RNA, 20 nt, Mycobacterium avium subsp. paratuberculosis
cgaaggugggcagcgccacc

SEQ ID NO: 3002465 - RNA, 12 nt, Mycobacterium avium subsp. paratuberculosis
cgaagguggugg

SEQ ID NO: 3002466 - RNA, 20 nt, Mycobacterium avium subsp. paratuberculosis
cgaagguguccucgagcugc

SEQ ID NO: 3002467 - RNA, 22 nt, Mycobacterium avium subsp. paratuberculosis
cgaagguguccucgagcugcac

SEQ ID NO: 3002468 - RNA, 15 nt, Mycobacterium avium subsp. paratuberculosis
cgaaguacgccgucu

SEQ ID NO: 3002469 - RNA, 22 nt, Mycobacterium avium subsp. paratuberculosis
cgaaguagagccgcugcacgcg

SEQ ID NO: 3002470 - RNA, 17 nt, Mycobacterium avium subsp. paratuberculosis
cgaaguagccggcgauc

SEQ ID NO: 3002471 - RNA, 23 nt, Mycobacterium avium subsp. paratuberculosis
cgaaguaguagcuguuggccagc

SEQ ID NO: 3002472 - RNA, 15 nt, Mycobacterium avium subsp. paratuberculosis
cgaaguagucggcgu

SEQ ID NO: 3002473 - RNA, 20 nt, Mycobacterium avium subsp. paratuberculosis
cgaaguauccggucagcgcc

SEQ ID NO: 3002474 - RNA, 13 nt, Mycobacterium avium subsp. paratuberculosis
cgaagucaucacc

SEQ ID NO: 3002475 - RNA, 14 nt, Mycobacterium avium subsp. paratuberculosis
cgaagucaucaccg

SEQ ID NO: 3002476 - RNA, 20 nt, Mycobacterium avium subsp. paratuberculosis
cgaagucaucgagaugccgg

SEQ ID NO: 3002477 - RNA, 20 nt, Mycobacterium avium subsp. paratuberculosis
cgaaguccgacgagucgacg

SEQ ID NO: 3002478 - RNA, 16 nt, Mycobacterium avium subsp. paratuberculosis
cgaaguccgccagggu

SEQ ID NO: 3002479 - RNA, 14 nt, Mycobacterium avium subsp. paratuberculosis
cgaaguccugcgcc

SEQ ID NO: 3002480 - RNA, 15 nt, Mycobacterium avium subsp. paratuberculosis
cgaaguccugcgccg

SEQ ID NO: 3002481 - RNA, 21 nt, Mycobacterium avium subsp. paratuberculosis
cgaaguccugcgccgcggugc

SEQ ID NO: 3002482 - RNA, 17 nt, Mycobacterium avium subsp. paratuberculosis
cgaagucgacggcggug

SEQ ID NO: 3002483 - RNA, 13 nt, Mycobacterium avium subsp. paratuberculosis
cgaagucgauccc

SEQ ID NO: 3002484 - RNA, 17 nt, Mycobacterium avium subsp. paratuberculosis
cgaagucgccgcccggg

SEQ ID NO: 3002485 - RNA, 15 nt, Mycobacterium avium subsp. paratuberculosis
cgaagucgccggcca

SEQ ID NO: 3002486 - RNA, 21 nt, Mycobacterium avium subsp. paratuberculosis
cgaagucgcugaggcugcggg

SEQ ID NO: 3002487 - RNA, 16 nt, Mycobacterium avium subsp. paratuberculosis
cgaagucggucagcgu

SEQ ID NO: 3002488 - RNA, 18 nt, Mycobacterium avium subsp. paratuberculosis
cgaagucggucagcgucg

SEQ ID NO: 3002489 - RNA, 13 nt, Mycobacterium avium subsp. paratuberculosis
cgaagugacgccg

SEQ ID NO: 3002490 - RNA, 15 nt, Mycobacterium avium subsp. paratuberculosis
cgaagugacgccgcu

SEQ ID NO: 3002491 - RNA, 21 nt, Mycobacterium avium subsp. paratuberculosis
cgaagugacgccgcucggcca

SEQ ID NO: 3002492 - RNA, 18 nt, Mycobacterium avium subsp. paratuberculosis
cgaagugaugcuguuacc

SEQ ID NO: 3002493 - RNA, 18 nt, Mycobacterium avium subsp. paratuberculosis
cgaagugcccggcgccgg

SEQ ID NO: 3002494 - RNA, 13 nt, Mycobacterium avium subsp. paratuberculosis
cgaagugcucgag

SEQ ID NO: 3002495 - RNA, 22 nt, Mycobacterium avium subsp. paratuberculosis
cgaagugcucgagcacaucggc

SEQ ID NO: 3002496 - RNA, 17 nt, Mycobacterium avium subsp. paratuberculosis
cgaaguucgacacggug

SEQ ID NO: 3002497 - RNA, 21 nt, Mycobacterium avium subsp. paratuberculosis
cgaaguugcgguugacguccg

SEQ ID NO: 3002498 - RNA, 16 nt, Mycobacterium avium subsp. paratuberculosis
cgaaguuggcgucggg

SEQ ID NO: 3002499 - RNA, 21 nt, Mycobacterium avium subsp. paratuberculosis
cgaaguuggcgucgggcaccu

SEQ ID NO: 3002500 - RNA, 21 nt, Mycobacterium avium subsp. paratuberculosis
cgaauacaccguccagcucag

SEQ ID NO: 3002501 - RNA, 18 nt, Mycobacterium avium subsp. paratuberculosis
cgaauacaccugccgcac

SEQ ID NO: 3002502 - RNA, 19 nt, Mycobacterium avium subsp. paratuberculosis
cgaauacaccugccgcaca

SEQ ID NO: 3002503 - RNA, 15 nt, Mycobacterium avium subsp. paratuberculosis
cgaauaccagggcga

SEQ ID NO: 3002504 - RNA, 18 nt, Mycobacterium avium subsp. paratuberculosis
cgaauacccuucggccgg

SEQ ID NO: 3002505 - RNA, 22 nt, Mycobacterium avium subsp. paratuberculosis
cgaaucagcagcuugaucgccg

SEQ ID NO: 3002506 - RNA, 20 nt, Mycobacterium avium subsp. paratuberculosis
cgaaucaucguggcgcgacg

SEQ ID NO: 3002507 - RNA, 23 nt, Mycobacterium avium subsp. paratuberculosis
cgaauccaaggagaaggccgcgc

SEQ ID NO: 3002508 - RNA, 16 nt, Mycobacterium avium subsp. paratuberculosis
cgaauccagcgcgccg

SEQ ID NO: 3002509 - RNA, 18 nt, Mycobacterium avium subsp. paratuberculosis
cgaaucccggccucgugc

SEQ ID NO: 3002510 - RNA, 20 nt, Mycobacterium avium subsp. paratuberculosis
cgaauccgauugcggcgcag

SEQ ID NO: 3002511 - RNA, 13 nt, Mycobacterium avium subsp. paratuberculosis
cgaauccgcgggc

SEQ ID NO: 3002512 - RNA, 18 nt, Mycobacterium avium subsp. paratuberculosis
cgaauccggccggagacc

SEQ ID NO: 3002513 - RNA, 13 nt, Mycobacterium avium subsp. paratuberculosis
cgaauccggcggg

SEQ ID NO: 3002514 - RNA, 15 nt, Mycobacterium avium subsp. paratuberculosis
cgaauccggcgggga

SEQ ID NO: 3002515 - RNA, 15 nt, Mycobacterium avium subsp. paratuberculosis
cgaauccgggcaugc

SEQ ID NO: 3002516 - RNA, 17 nt, Mycobacterium avium subsp. paratuberculosis
cgaauccgggugucgac

SEQ ID NO: 3002517 - RNA, 22 nt, Mycobacterium avium subsp. paratuberculosis
cgaauccggucaacgccgcgcg

SEQ ID NO: 3002518 - RNA, 12 nt, Mycobacterium avium subsp. paratuberculosis
cgaauccgguga

SEQ ID NO: 3002519 - RNA, 18 nt, Mycobacterium avium subsp. paratuberculosis
cgaauccggugaccgccu

SEQ ID NO: 3002520 - RNA, 21 nt, Mycobacterium avium subsp. paratuberculosis
cgaaucgagccgccugcgcgc

SEQ ID NO: 3002521 - RNA, 23 nt, Mycobacterium avium subsp. paratuberculosis
cgaaucgagccgccugcgcgccg

SEQ ID NO: 3002522 - RNA, 14 nt, Mycobacterium avium subsp. paratuberculosis
cgaaucggucgacc

SEQ ID NO: 3002523 - RNA, 15 nt, Mycobacterium avium subsp. paratuberculosis
cgaaucgucgccguc

SEQ ID NO: 3002524 - RNA, 14 nt, Mycobacterium avium subsp. paratuberculosis
cgaaucgucggcga

SEQ ID NO: 3002525 - RNA, 16 nt, Mycobacterium avium subsp. paratuberculosis
cgaaucgucggcgaug

SEQ ID NO: 3002526 - RNA, 17 nt, Mycobacterium avium subsp. paratuberculosis
cgaaucgucggcgaugg

SEQ ID NO: 3002527 - RNA, 18 nt, Mycobacterium avium subsp. paratuberculosis
cgaaucguugagcaccac

SEQ ID NO: 3002528 - RNA, 15 nt, Mycobacterium avium subsp. paratuberculosis
cgaaucugucgaugg

SEQ ID NO: 3002529 - RNA, 18 nt, Mycobacterium avium subsp. paratuberculosis
cgaaugcagcggcuccga

SEQ ID NO: 3002530 - RNA, 19 nt, Mycobacterium avium subsp. paratuberculosis
cgaaugccugacgggaguc

SEQ ID NO: 3002531 - RNA, 17 nt, Mycobacterium avium subsp. paratuberculosis
cgaaugcgaugagcucg

SEQ ID NO: 3002532 - RNA, 22 nt, Mycobacterium avium subsp. paratuberculosis
cgaauguccuugacguacuggc

SEQ ID NO: 3002533 - RNA, 15 nt, Mycobacterium avium subsp. paratuberculosis
cgaaugucgaccacc

SEQ ID NO: 3002534 - RNA, 18 nt, Mycobacterium avium subsp. paratuberculosis
cgaaugucgaccaccggg

SEQ ID NO: 3002535 - RNA, 16 nt, Mycobacterium avium subsp. paratuberculosis
cgaauuccucagcgcc

SEQ ID NO: 3002536 - RNA, 17 nt, Mycobacterium avium subsp. paratuberculosis
cgaauuccucagcgccc

SEQ ID NO: 3002537 - RNA, 20 nt, Mycobacterium avium subsp. paratuberculosis
cgaauucggagaccaggucg

SEQ ID NO: 3002538 - RNA, 15 nt, Mycobacterium avium subsp. paratuberculosis
cgaauucgguggcga

SEQ ID NO: 3002539 - RNA, 22 nt, Mycobacterium avium subsp. paratuberculosis
cgaauugccgguggugcggccc

SEQ ID NO: 3002540 - RNA, 14 nt, Mycobacterium avium subsp. paratuberculosis
cgaauugcgcugca

SEQ ID NO: 3002541 - RNA, 19 nt, Mycobacterium avium subsp. paratuberculosis
cgaauugcgcugcaccgca

SEQ ID NO: 3002542 - RNA, 20 nt, Mycobacterium avium subsp. paratuberculosis
cgaauugcuuacgcaucgcc

SEQ ID NO: 3002543 - RNA, 15 nt, Mycobacterium avium subsp. paratuberculosis
cgaauuguggcggcc

SEQ ID NO: 3002544 - RNA, 22 nt, Mycobacterium avium subsp. paratuberculosis
cgacaaaggaggggcgcggcau

SEQ ID NO: 3002545 - RNA, 14 nt, Mycobacterium avium subsp. paratuberculosis
cgacaacagcacga

SEQ ID NO: 3002546 - RNA, 15 nt, Mycobacterium avium subsp. paratuberculosis
cgacaacagcgccga

SEQ ID NO: 3002547 - RNA, 12 nt, Mycobacterium avium subsp. paratuberculosis
cgacaacaggcg

SEQ ID NO: 3002548 - RNA, 14 nt, Mycobacterium avium subsp. paratuberculosis
cgacaacauccgcg

SEQ ID NO: 3002549 - RNA, 23 nt, Mycobacterium avium subsp. paratuberculosis
cgacaaccguugaggcgagccga

SEQ ID NO: 3002550 - RNA, 14 nt, Mycobacterium avium subsp. paratuberculosis
cgacaacgacagca

SEQ ID NO: 3002551 - RNA, 15 nt, Mycobacterium avium subsp. paratuberculosis
cgacaacgacagcac

SEQ ID NO: 3002552 - RNA, 15 nt, Mycobacterium avium subsp. paratuberculosis
cgacaacggccccca

SEQ ID NO: 3002553 - RNA, 14 nt, Mycobacterium avium subsp. paratuberculosis
cgacaacgggccgc

SEQ ID NO: 3002554 - RNA, 16 nt, Mycobacterium avium subsp. paratuberculosis
cgacaacgggccgccu

SEQ ID NO: 3002555 - RNA, 23 nt, Mycobacterium avium subsp. paratuberculosis
cgacaacguggugugcaccagcg

SEQ ID NO: 3002556 - RNA, 16 nt, Mycobacterium avium subsp. paratuberculosis
cgacaagcagauucga

SEQ ID NO: 3002557 - RNA, 21 nt, Mycobacterium avium subsp. paratuberculosis
cgacaagggccgggcgcuggc

SEQ ID NO: 3002558 - RNA, 19 nt, Mycobacterium avium subsp. paratuberculosis
cgacaccaccacgaacugg

SEQ ID NO: 3002559 - RNA, 14 nt, Mycobacterium avium subsp. paratuberculosis
cgacaccaccgcgc

SEQ ID NO: 3002560 - RNA, 15 nt, Mycobacterium avium subsp. paratuberculosis
cgacaccaccgcgcg

SEQ ID NO: 3002561 - RNA, 16 nt, Mycobacterium avium subsp. paratuberculosis
cgacaccaccgcgcgc

SEQ ID NO: 3002562 - RNA, 14 nt, Mycobacterium avium subsp. paratuberculosis
cgacaccaccggcc

SEQ ID NO: 3002563 - RNA, 15 nt, Mycobacterium avium subsp. paratuberculosis
cgacaccaccggccg

SEQ ID NO: 3002564 - RNA, 18 nt, Mycobacterium avium subsp. paratuberculosis
cgacaccaccggccgccc

SEQ ID NO: 3002565 - RNA, 19 nt, Mycobacterium avium subsp. paratuberculosis
cgacaccaccggccgcccg

SEQ ID NO: 3002566 - RNA, 13 nt, Mycobacterium avium subsp. paratuberculosis
cgacaccaccgug

SEQ ID NO: 3002567 - RNA, 16 nt, Mycobacterium avium subsp. paratuberculosis
cgacaccacggugaac

SEQ ID NO: 3002568 - RNA, 11 nt, Mycobacterium avium subsp. paratuberculosis
cgacaccagcg

SEQ ID NO: 3002569 - RNA, 13 nt, Mycobacterium avium subsp. paratuberculosis
cgacaccagcgcg

SEQ ID NO: 3002570 - RNA, 17 nt, Mycobacterium avium subsp. paratuberculosis
cgacaccagcgcgcacg

SEQ ID NO: 3002571 - RNA, 19 nt, Mycobacterium avium subsp. paratuberculosis
cgacaccagcgcgcacgcg

SEQ ID NO: 3002572 - RNA, 13 nt, Mycobacterium avium subsp. paratuberculosis
cgacaccagcguc

SEQ ID NO: 3002573 - RNA, 14 nt, Mycobacterium avium subsp. paratuberculosis
cgacaccagcgucg

SEQ ID NO: 3002574 - RNA, 15 nt, Mycobacterium avium subsp. paratuberculosis
cgacaccagcgucgc

SEQ ID NO: 3002575 - RNA, 13 nt, Mycobacterium avium subsp. paratuberculosis
cgacacccagcgg

SEQ ID NO: 3002576 - RNA, 14 nt, Mycobacterium avium subsp. paratuberculosis
cgacacccagcggc

SEQ ID NO: 3002577 - RNA, 17 nt, Mycobacterium avium subsp. paratuberculosis
cgacacccagcggcgcg

SEQ ID NO: 3002578 - RNA, 20 nt, Mycobacterium avium subsp. paratuberculosis
cgacacccagcggcgcggcc

SEQ ID NO: 3002579 - RNA, 21 nt, Mycobacterium avium subsp. paratuberculosis
cgacacccagcggcgcggccg

SEQ ID NO: 3002580 - RNA, 15 nt, Mycobacterium avium subsp. paratuberculosis
cgacaccccacaccg

SEQ ID NO: 3002581 - RNA, 23 nt, Mycobacterium avium subsp. paratuberculosis
cgacaccccacaccguccgaccg

SEQ ID NO: 3002582 - RNA, 19 nt, Mycobacterium avium subsp. paratuberculosis
cgacaccccgaugccgaac

SEQ ID NO: 3002583 - RNA, 17 nt, Mycobacterium avium subsp. paratuberculosis
cgacaccccgcucggcc

SEQ ID NO: 3002584 - RNA, 18 nt, Mycobacterium avium subsp. paratuberculosis
cgacaccccgcucggcca

SEQ ID NO: 3002585 - RNA, 19 nt, Mycobacterium avium subsp. paratuberculosis
cgacaccccgcucggccag

SEQ ID NO: 3002586 - RNA, 23 nt, Mycobacterium avium subsp. paratuberculosis
cgacaccccgcucggccagcgcg

SEQ ID NO: 3002587 - RNA, 14 nt, Mycobacterium avium subsp. paratuberculosis
cgacacccgcgacg

SEQ ID NO: 3002588 - RNA, 13 nt, Mycobacterium avium subsp. paratuberculosis
cgacacccgggcg

SEQ ID NO: 3002589 - RNA, 18 nt, Mycobacterium avium subsp. paratuberculosis
cgacacccuucaucagca

SEQ ID NO: 3002590 - RNA, 22 nt, Mycobacterium avium subsp. paratuberculosis
cgacaccgaacccaccagcgcc

SEQ ID NO: 3002591 - RNA, 15 nt, Mycobacterium avium subsp. paratuberculosis
cgacaccgacgacca

SEQ ID NO: 3002592 - RNA, 15 nt, Mycobacterium avium subsp. paratuberculosis
cgacaccgcacggcc

SEQ ID NO: 3002593 - RNA, 17 nt, Mycobacterium avium subsp. paratuberculosis
cgacaccgcacggccca

SEQ ID NO: 3002594 - RNA, 15 nt, Mycobacterium avium subsp. paratuberculosis
cgacaccgcauggcc

SEQ ID NO: 3002595 - RNA, 19 nt, Mycobacterium avium subsp. paratuberculosis
cgacaccgcauggccggcg

SEQ ID NO: 3002596 - RNA, 20 nt, Mycobacterium avium subsp. paratuberculosis
cgacaccgcauggccggcga

SEQ ID NO: 3002597 - RNA, 12 nt, Mycobacterium avium subsp. paratuberculosis
cgacaccgccag

SEQ ID NO: 3002598 - RNA, 13 nt, Mycobacterium avium subsp. paratuberculosis
cgacaccgccagc

SEQ ID NO: 3002599 - RNA, 17 nt, Mycobacterium avium subsp. paratuberculosis
cgacaccgccagcagcg

SEQ ID NO: 3002600 - RNA, 19 nt, Mycobacterium avium subsp. paratuberculosis
cgacaccgccagcagcgcc

SEQ ID NO: 3002601 - RNA, 20 nt, Mycobacterium avium subsp. paratuberculosis
cgacaccgccagcagcgccg

SEQ ID NO: 3002602 - RNA, 11 nt, Mycobacterium avium subsp. paratuberculosis
cgacaccgccc

SEQ ID NO: 3002603 - RNA, 17 nt, Mycobacterium avium subsp. paratuberculosis
cgacaccgccccgccgc

SEQ ID NO: 3002604 - RNA, 18 nt, Mycobacterium avium subsp. paratuberculosis
cgacaccgccccgccgcg

SEQ ID NO: 3002605 - RNA, 19 nt, Mycobacterium avium subsp. paratuberculosis
cgacaccgccccgccgcgc

SEQ ID NO: 3002606 - RNA, 21 nt, Mycobacterium avium subsp. paratuberculosis
cgacaccgccccgccgcgccg

SEQ ID NO: 3002607 - RNA, 22 nt, Mycobacterium avium subsp. paratuberculosis
cgacaccgccccgccgcgccgg

SEQ ID NO: 3002608 - RNA, 14 nt, Mycobacterium avium subsp. paratuberculosis
cgacaccgccuucg

SEQ ID NO: 3002609 - RNA, 19 nt, Mycobacterium avium subsp. paratuberculosis
cgacaccgccuucgacggc

SEQ ID NO: 3002610 - RNA, 13 nt, Mycobacterium avium subsp. paratuberculosis
cgacaccgcggcg

SEQ ID NO: 3002611 - RNA, 16 nt, Mycobacterium avium subsp. paratuberculosis
cgacaccgcggcgacg

SEQ ID NO: 3002612 - RNA, 20 nt, Mycobacterium avium subsp. paratuberculosis
cgacaccgcggcgacgucgu

SEQ ID NO: 3002613 - RNA, 22 nt, Mycobacterium avium subsp. paratuberculosis
cgacaccgcggcgacgucgugc

SEQ ID NO: 3002614 - RNA, 16 nt, Mycobacterium avium subsp. paratuberculosis
cgacaccgcguccuuc

SEQ ID NO: 3002615 - RNA, 19 nt, Mycobacterium avium subsp. paratuberculosis
cgacaccgcguccuucucc

SEQ ID NO: 3002616 - RNA, 13 nt, Mycobacterium avium subsp. paratuberculosis
cgacaccggacug

SEQ ID NO: 3002617 - RNA, 18 nt, Mycobacterium avium subsp. paratuberculosis
cgacaccggccgggacgg

SEQ ID NO: 3002618 - RNA, 12 nt, Mycobacterium avium subsp. paratuberculosis
cgacaccggcgg

SEQ ID NO: 3002619 - RNA, 13 nt, Mycobacterium avium subsp. paratuberculosis
cgacaccggcgug

SEQ ID NO: 3002620 - RNA, 23 nt, Mycobacterium avium subsp. paratuberculosis
cgacaccggcgugaugacggcgg

SEQ ID NO: 3002621 - RNA, 22 nt, Mycobacterium avium subsp. paratuberculosis
cgacaccgggucccccgccgac

SEQ ID NO: 3002622 - RNA, 23 nt, Mycobacterium avium subsp. paratuberculosis
cgacaccgggucccccgccgacc

SEQ ID NO: 3002623 - RNA, 16 nt, Mycobacterium avium subsp. paratuberculosis
cgacaccgguggcguu

SEQ ID NO: 3002624 - RNA, 23 nt, Mycobacterium avium subsp. paratuberculosis
cgacaccgguggcguugcgggcg

SEQ ID NO: 3002625 - RNA, 17 nt, Mycobacterium avium subsp. paratuberculosis
cgacaccgucgccguga

SEQ ID NO: 3002626 - RNA, 15 nt, Mycobacterium avium subsp. paratuberculosis
cgacaccgugguggc

SEQ ID NO: 3002627 - RNA, 17 nt, Mycobacterium avium subsp. paratuberculosis
cgacaccucacacugaa

SEQ ID NO: 3002628 - RNA, 13 nt, Mycobacterium avium subsp. paratuberculosis
cgacaccucgccg

SEQ ID NO: 3002629 - RNA, 15 nt, Mycobacterium avium subsp. paratuberculosis
cgacacgaucggcau

SEQ ID NO: 3002630 - RNA, 20 nt, Mycobacterium avium subsp. paratuberculosis
cgacacgaucggcaugacgc

SEQ ID NO: 3002631 - RNA, 23 nt, Mycobacterium avium subsp. paratuberculosis
cgacacgauguugaugucgcgcg

SEQ ID NO: 3002632 - RNA, 11 nt, Mycobacterium avium subsp. paratuberculosis
cgacacgccga

SEQ ID NO: 3002633 - RNA, 13 nt, Mycobacterium avium subsp. paratuberculosis
cgacacgccgacg

SEQ ID NO: 3002634 - RNA, 23 nt, Mycobacterium avium subsp. paratuberculosis
cgacacgccgacgauccgcgccc

SEQ ID NO: 3002635 - RNA, 14 nt, Mycobacterium avium subsp. paratuberculosis
cgacacgccgaucg

SEQ ID NO: 3002636 - RNA, 17 nt, Mycobacterium avium subsp. paratuberculosis
cgacacgccgaucggga

SEQ ID NO: 3002637 - RNA, 21 nt, Mycobacterium avium subsp. paratuberculosis
cgacacggaaaccgcugcggc

SEQ ID NO: 3002638 - RNA, 15 nt, Mycobacterium avium subsp. paratuberculosis
cgacacgggccgcgc

SEQ ID NO: 3002639 - RNA, 16 nt, Mycobacterium avium subsp. paratuberculosis
cgacacgggccgcgcc

SEQ ID NO: 3002640 - RNA, 23 nt, Mycobacterium avium subsp. paratuberculosis
cgacacgggccgcgccgaggcgc

SEQ ID NO: 3002641 - RNA, 13 nt, Mycobacterium avium subsp. paratuberculosis
cgacacggugaac

SEQ ID NO: 3002642 - RNA, 20 nt, Mycobacterium avium subsp. paratuberculosis
cgacacggugaacgucgauc

SEQ ID NO: 3002643 - RNA, 17 nt, Mycobacterium avium subsp. paratuberculosis
cgacacguaggccgccu

SEQ ID NO: 3002644 - RNA, 20 nt, Mycobacterium avium subsp. paratuberculosis
cgacacguaggccgccugcc

SEQ ID NO: 3002645 - RNA, 21 nt, Mycobacterium avium subsp. paratuberculosis
cgacacguaggccgccugccc

SEQ ID NO: 3002646 - RNA, 19 nt, Mycobacterium avium subsp. paratuberculosis
cgacacguccagcucucga

SEQ ID NO: 3002647 - RNA, 21 nt, Mycobacterium avium subsp. paratuberculosis
cgacacgucgacacgccggcc

SEQ ID NO: 3002648 - RNA, 18 nt, Mycobacterium avium subsp. paratuberculosis
cgacacguggaccgagcg

SEQ ID NO: 3002649 - RNA, 22 nt, Mycobacterium avium subsp. paratuberculosis
cgacacguggaccgagcgcgcg

SEQ ID NO: 3002650 - RNA, 12 nt, Mycobacterium avium subsp. paratuberculosis
cgacagacccga

SEQ ID NO: 3002651 - RNA, 19 nt, Mycobacterium avium subsp. paratuberculosis
cgacagauacuucgucgaa

SEQ ID NO: 3002652 - RNA, 20 nt, Mycobacterium avium subsp. paratuberculosis
cgacagauacuucgucgaac

SEQ ID NO: 3002653 - RNA, 12 nt, Mycobacterium avium subsp. paratuberculosis
cgacagcaacgc

SEQ ID NO: 3002654 - RNA, 15 nt, Mycobacterium avium subsp. paratuberculosis
cgacagcacccaggu

SEQ ID NO: 3002655 - RNA, 12 nt, Mycobacterium avium subsp. paratuberculosis
cgacagcacccg

SEQ ID NO: 3002656 - RNA, 14 nt, Mycobacterium avium subsp. paratuberculosis
cgacagcacccgcu

SEQ ID NO: 3002657 - RNA, 21 nt, Mycobacterium avium subsp. paratuberculosis
cgacagcacccgcugcagccg

SEQ ID NO: 3002658 - RNA, 15 nt, Mycobacterium avium subsp. paratuberculosis
cgacagcacccggcc

SEQ ID NO: 3002659 - RNA, 16 nt, Mycobacterium avium subsp. paratuberculosis
cgacagcaccucgccc

SEQ ID NO: 3002660 - RNA, 15 nt, Mycobacterium avium subsp. paratuberculosis
cgacagcacgccggg

SEQ ID NO: 3002661 - RNA, 16 nt, Mycobacterium avium subsp. paratuberculosis
cgacagcacgccgggc

SEQ ID NO: 3002662 - RNA, 13 nt, Mycobacterium avium subsp. paratuberculosis
cgacagcacgggc

SEQ ID NO: 3002663 - RNA, 15 nt, Mycobacterium avium subsp. paratuberculosis
cgacagcacgggcgg

SEQ ID NO: 3002664 - RNA, 14 nt, Mycobacterium avium subsp. paratuberculosis
cgacagcagcgugg

SEQ ID NO: 3002665 - RNA, 14 nt, Mycobacterium avium subsp. paratuberculosis
cgacagcaggaucu

SEQ ID NO: 3002666 - RNA, 23 nt, Mycobacterium avium subsp. paratuberculosis
cgacagcaggaucuccggccggu

SEQ ID NO: 3002667 - RNA, 22 nt, Mycobacterium avium subsp. paratuberculosis
cgacagccaaacagguuggcgc

SEQ ID NO: 3002668 - RNA, 19 nt, Mycobacterium avium subsp. paratuberculosis
cgacagcccccgcagcccg

SEQ ID NO: 3002669 - RNA, 13 nt, Mycobacterium avium subsp. paratuberculosis
cgacagccgcacc

SEQ ID NO: 3002670 - RNA, 15 nt, Mycobacterium avium subsp. paratuberculosis
cgacagccgcaccgg

SEQ ID NO: 3002671 - RNA, 16 nt, Mycobacterium avium subsp. paratuberculosis
cgacagccgcaccggc

SEQ ID NO: 3002672 - RNA, 17 nt, Mycobacterium avium subsp. paratuberculosis
cgacagccgcaccggcg

SEQ ID NO: 3002673 - RNA, 18 nt, Mycobacterium avium subsp. paratuberculosis
cgacagccgcaccggcgc

SEQ ID NO: 3002674 - RNA, 20 nt, Mycobacterium avium subsp. paratuberculosis
cgacagccgcaccggcgccg

SEQ ID NO: 3002675 - RNA, 16 nt, Mycobacterium avium subsp. paratuberculosis
cgacagccgcccggcg

SEQ ID NO: 3002676 - RNA, 17 nt, Mycobacterium avium subsp. paratuberculosis
cgacagccgcccggcgc

SEQ ID NO: 3002677 - RNA, 18 nt, Mycobacterium avium subsp. paratuberculosis
cgacagccggacgggauc

SEQ ID NO: 3002678 - RNA, 21 nt, Mycobacterium avium subsp. paratuberculosis
cgacagccgggaaucgagggc

SEQ ID NO: 3002679 - RNA, 14 nt, Mycobacterium avium subsp. paratuberculosis
cgacagccggucgc

SEQ ID NO: 3002680 - RNA, 16 nt, Mycobacterium avium subsp. paratuberculosis
cgacagccggucgcgc

SEQ ID NO: 3002681 - RNA, 19 nt, Mycobacterium avium subsp. paratuberculosis
cgacagccggucgcgcauc

SEQ ID NO: 3002682 - RNA, 20 nt, Mycobacterium avium subsp. paratuberculosis
cgacagccggucgcgcaucg

SEQ ID NO: 3002683 - RNA, 18 nt, Mycobacterium avium subsp. paratuberculosis
cgacagccugaccgcggg

SEQ ID NO: 3002684 - RNA, 20 nt, Mycobacterium avium subsp. paratuberculosis
cgacagccugaccgcgggug

SEQ ID NO: 3002685 - RNA, 21 nt, Mycobacterium avium subsp. paratuberculosis
cgacagccugaccgcggguga

SEQ ID NO: 3002686 - RNA, 12 nt, Mycobacterium avium subsp. paratuberculosis
cgacagcgacgg

SEQ ID NO: 3002687 - RNA, 17 nt, Mycobacterium avium subsp. paratuberculosis
cgacagcgacgggccgg

SEQ ID NO: 3002688 - RNA, 21 nt, Mycobacterium avium subsp. paratuberculosis
cgacagcgacgggccgggcac

SEQ ID NO: 3002689 - RNA, 14 nt, Mycobacterium avium subsp. paratuberculosis
cgacagcgccugcc

SEQ ID NO: 3002690 - RNA, 18 nt, Mycobacterium avium subsp. paratuberculosis
cgacagcgcguacagguc

SEQ ID NO: 3002691 - RNA, 15 nt, Mycobacterium avium subsp. paratuberculosis
cgacagcgcgucggc

SEQ ID NO: 3002692 - RNA, 16 nt, Mycobacterium avium subsp. paratuberculosis
cgacagcgcgucggcc

SEQ ID NO: 3002693 - RNA, 17 nt, Mycobacterium avium subsp. paratuberculosis
cgacagcgcgucggcca

SEQ ID NO: 3002694 - RNA, 18 nt, Mycobacterium avium subsp. paratuberculosis
cgacagcgcgucggccag

SEQ ID NO: 3002695 - RNA, 19 nt, Mycobacterium avium subsp. paratuberculosis
cgacagcgcgucggccagc

SEQ ID NO: 3002696 - RNA, 22 nt, Mycobacterium avium subsp. paratuberculosis
cgacagcgcgucggccagcgcg

SEQ ID NO: 3002697 - RNA, 21 nt, Mycobacterium avium subsp. paratuberculosis
cgacagcggccuaugcgcccg

SEQ ID NO: 3002698 - RNA, 13 nt, Mycobacterium avium subsp. paratuberculosis
cgacagcgucguc

SEQ ID NO: 3002699 - RNA, 15 nt, Mycobacterium avium subsp. paratuberculosis
cgacagcgucgucca

SEQ ID NO: 3002700 - RNA, 22 nt, Mycobacterium avium subsp. paratuberculosis
cgacagcgucguccaugcccgc

SEQ ID NO: 3002701 - RNA, 15 nt, Mycobacterium avium subsp. paratuberculosis
cgacagcuccaacag

SEQ ID NO: 3002702 - RNA, 18 nt, Mycobacterium avium subsp. paratuberculosis
cgacagcuccaacagccg

SEQ ID NO: 3002703 - RNA, 15 nt, Mycobacterium avium subsp. paratuberculosis
cgacagcucgcgcug

SEQ ID NO: 3002704 - RNA, 16 nt, Mycobacterium avium subsp. paratuberculosis
cgacagcucgcgcuga

SEQ ID NO: 3002705 - RNA, 16 nt, Mycobacterium avium subsp. paratuberculosis
cgacagcugagcagcc

SEQ ID NO: 3002706 - RNA, 17 nt, Mycobacterium avium subsp. paratuberculosis
cgacagcugagcagccc

SEQ ID NO: 3002707 - RNA, 19 nt, Mycobacterium avium subsp. paratuberculosis
cgacagcugagcagcccga

SEQ ID NO: 3002708 - RNA, 21 nt, Mycobacterium avium subsp. paratuberculosis
cgacagcugagcagcccgacc

SEQ ID NO: 3002709 - RNA, 22 nt, Mycobacterium avium subsp. paratuberculosis
cgacagcuugauguugccgugc

SEQ ID NO: 3002710 - RNA, 14 nt, Mycobacterium avium subsp. paratuberculosis
cgacaggaugcugg

SEQ ID NO: 3002711 - RNA, 22 nt, Mycobacterium avium subsp. paratuberculosis
cgacaggaugcuggggucggcc

SEQ ID NO: 3002712 - RNA, 23 nt, Mycobacterium avium subsp. paratuberculosis
cgacaggaugcuggggucggcca

SEQ ID NO: 3002713 - RNA, 15 nt, Mycobacterium avium subsp. paratuberculosis
cgacaggcagcccgg

SEQ ID NO: 3002714 - RNA, 14 nt, Mycobacterium avium subsp. paratuberculosis
cgacaggcccaccc

SEQ ID NO: 3002715 - RNA, 14 nt, Mycobacterium avium subsp. paratuberculosis
cgacagggagccga

SEQ ID NO: 3002716 - RNA, 15 nt, Mycobacterium avium subsp. paratuberculosis
cgacagggagccgac

SEQ ID NO: 3002717 - RNA, 16 nt, Mycobacterium avium subsp. paratuberculosis
cgacagggagccgacg

SEQ ID NO: 3002718 - RNA, 18 nt, Mycobacterium avium subsp. paratuberculosis
cgacagggagccgacgaa

SEQ ID NO: 3002719 - RNA, 17 nt, Mycobacterium avium subsp. paratuberculosis
cgacagggccagcgcca

SEQ ID NO: 3002720 - RNA, 22 nt, Mycobacterium avium subsp. paratuberculosis
cgacagggugccaaggucgccg

SEQ ID NO: 3002721 - RNA, 13 nt, Mycobacterium avium subsp. paratuberculosis
cgacagguagcag

SEQ ID NO: 3002722 - RNA, 19 nt, Mycobacterium avium subsp. paratuberculosis
cgacagguagcaggcgcgc

SEQ ID NO: 3002723 - RNA, 23 nt, Mycobacterium avium subsp. paratuberculosis
cgacagguagcaggcgcgcagca

SEQ ID NO: 3002724 - RNA, 14 nt, Mycobacterium avium subsp. paratuberculosis
cgacaggucgaagg

SEQ ID NO: 3002725 - RNA, 20 nt, Mycobacterium avium subsp. paratuberculosis
cgacaggucgaagggcaucg

SEQ ID NO: 3002726 - RNA, 18 nt, Mycobacterium avium subsp. paratuberculosis
cgacaggucgagcaccag

SEQ ID NO: 3002727 - RNA, 23 nt, Mycobacterium avium subsp. paratuberculosis
cgacaggucggcggucgcggugc

SEQ ID NO: 3002728 - RNA, 20 nt, Mycobacterium avium subsp. paratuberculosis
cgacagguucuuggcggccu

SEQ ID NO: 3002729 - RNA, 21 nt, Mycobacterium avium subsp. paratuberculosis
cgacagguucuuggcggccug

SEQ ID NO: 3002730 - RNA, 15 nt, Mycobacterium avium subsp. paratuberculosis
cgacagucccgcguu

SEQ ID NO: 3002731 - RNA, 14 nt, Mycobacterium avium subsp. paratuberculosis
cgacaguccgaccg

SEQ ID NO: 3002732 - RNA, 16 nt, Mycobacterium avium subsp. paratuberculosis
cgacaguccgaccgcg

SEQ ID NO: 3002733 - RNA, 17 nt, Mycobacterium avium subsp. paratuberculosis
cgacaguccgaccgcgu

SEQ ID NO: 3002734 - RNA, 13 nt, Mycobacterium avium subsp. paratuberculosis
cgacagucgcggg

SEQ ID NO: 3002735 - RNA, 17 nt, Mycobacterium avium subsp. paratuberculosis
cgacagucgcgggcagc

SEQ ID NO: 3002736 - RNA, 19 nt, Mycobacterium avium subsp. paratuberculosis
cgacagucgcgggcagccg

SEQ ID NO: 3002737 - RNA, 21 nt, Mycobacterium avium subsp. paratuberculosis
cgacagucgcgggcagccggc

SEQ ID NO: 3002738 - RNA, 23 nt, Mycobacterium avium subsp. paratuberculosis
cgacagucgcgggcggggcgccg

SEQ ID NO: 3002739 - RNA, 15 nt, Mycobacterium avium subsp. paratuberculosis
cgacaguucggcgcg

SEQ ID NO: 3002740 - RNA, 16 nt, Mycobacterium avium subsp. paratuberculosis
cgacaguucggcgcgc

SEQ ID NO: 3002741 - RNA, 21 nt, Mycobacterium avium subsp. paratuberculosis
cgacaucaccaaccgcucggc

SEQ ID NO: 3002742 - RNA, 15 nt, Mycobacterium avium subsp. paratuberculosis
cgacaucaccaccgc

SEQ ID NO: 3002743 - RNA, 18 nt, Mycobacterium avium subsp. paratuberculosis
cgacaucaccaccgccgg

SEQ ID NO: 3002744 - RNA, 14 nt, Mycobacterium avium subsp. paratuberculosis
cgacaucaccgcgg

SEQ ID NO: 3002745 - RNA, 16 nt, Mycobacterium avium subsp. paratuberculosis
cgacaucaccgcgggc

SEQ ID NO: 3002746 - RNA, 21 nt, Mycobacterium avium subsp. paratuberculosis
cgacaucaccgcgggcgcgcc

SEQ ID NO: 3002747 - RNA, 22 nt, Mycobacterium avium subsp. paratuberculosis
cgacaucaccgcgggcgcgccg

SEQ ID NO: 3002748 - RNA, 19 nt, Mycobacterium avium subsp. paratuberculosis
cgacaucacgaacgcguuc

SEQ ID NO: 3002749 - RNA, 18 nt, Mycobacterium avium subsp. paratuberculosis
cgacaucagaucgccgac

SEQ ID NO: 3002750 - RNA, 19 nt, Mycobacterium avium subsp. paratuberculosis
cgacaucagaucgccgacg

SEQ ID NO: 3002751 - RNA, 18 nt, Mycobacterium avium subsp. paratuberculosis
cgacauccaggaccgcgc

SEQ ID NO: 3002752 - RNA, 20 nt, Mycobacterium avium subsp. paratuberculosis
cgacauccaggaccgcgcgc

SEQ ID NO: 3002753 - RNA, 15 nt, Mycobacterium avium subsp. paratuberculosis
cgacauccuggguug

SEQ ID NO: 3002754 - RNA, 19 nt, Mycobacterium avium subsp. paratuberculosis
cgacaucgaaugcagcggc

SEQ ID NO: 3002755 - RNA, 23 nt, Mycobacterium avium subsp. paratuberculosis
cgacaucgaaugcagcggcuccg

SEQ ID NO: 3002756 - RNA, 19 nt, Mycobacterium avium subsp. paratuberculosis
cgacaucgccaucagcagc

SEQ ID NO: 3002757 - RNA, 22 nt, Mycobacterium avium subsp. paratuberculosis
cgacaucgccaucagcagcgcc

SEQ ID NO: 3002758 - RNA, 17 nt, Mycobacterium avium subsp. paratuberculosis
cgacaucgcccggucca

SEQ ID NO: 3002759 - RNA, 11 nt, Mycobacterium avium subsp. paratuberculosis
cgacaucgccg

SEQ ID NO: 3002760 - RNA, 12 nt, Mycobacterium avium subsp. paratuberculosis
cgacaucgccga

SEQ ID NO: 3002761 - RNA, 13 nt, Mycobacterium avium subsp. paratuberculosis
cgacaucgccgcg

SEQ ID NO: 3002762 - RNA, 14 nt, Mycobacterium avium subsp. paratuberculosis
cgacaucgccgcgg

SEQ ID NO: 3002763 - RNA, 15 nt, Mycobacterium avium subsp. paratuberculosis
cgacaucgccgcggc

SEQ ID NO: 3002764 - RNA, 16 nt, Mycobacterium avium subsp. paratuberculosis
cgacaucgccgcggcc

SEQ ID NO: 3002765 - RNA, 13 nt, Mycobacterium avium subsp. paratuberculosis
cgacaucgccggc

SEQ ID NO: 3002766 - RNA, 14 nt, Mycobacterium avium subsp. paratuberculosis
cgacaucgccggcg

SEQ ID NO: 3002767 - RNA, 15 nt, Mycobacterium avium subsp. paratuberculosis
cgacaucgccggcga

SEQ ID NO: 3002768 - RNA, 13 nt, Mycobacterium avium subsp. paratuberculosis
cgacaucgcggcg

SEQ ID NO: 3002769 - RNA, 14 nt, Mycobacterium avium subsp. paratuberculosis
cgacaucgcggcga

SEQ ID NO: 3002770 - RNA, 19 nt, Mycobacterium avium subsp. paratuberculosis
cgacaucggccgccuugau

SEQ ID NO: 3002771 - RNA, 15 nt, Mycobacterium avium subsp. paratuberculosis
cgacaucggcgccga

SEQ ID NO: 3002772 - RNA, 16 nt, Mycobacterium avium subsp. paratuberculosis
cgacaucggcgccgac

SEQ ID NO: 3002773 - RNA, 17 nt, Mycobacterium avium subsp. paratuberculosis
cgacaucggcgccgacg

SEQ ID NO: 3002774 - RNA, 18 nt, Mycobacterium avium subsp. paratuberculosis
cgacaucggcgccgacgg

SEQ ID NO: 3002775 - RNA, 14 nt, Mycobacterium avium subsp. paratuberculosis
cgacaucggugacc

SEQ ID NO: 3002776 - RNA, 19 nt, Mycobacterium avium subsp. paratuberculosis
cgacaucggugaccgucgc

SEQ ID NO: 3002777 - RNA, 21 nt, Mycobacterium avium subsp. paratuberculosis
cgacaucggugaccgucgccg

SEQ ID NO: 3002778 - RNA, 22 nt, Mycobacterium avium subsp. paratuberculosis
cgacaucggugaccgucgccga

SEQ ID NO: 3002779 - RNA, 14 nt, Mycobacterium avium subsp. paratuberculosis
cgacaucgucggcu

SEQ ID NO: 3002780 - RNA, 17 nt, Mycobacterium avium subsp. paratuberculosis
cgacaucucccggucga

SEQ ID NO: 3002781 - RNA, 12 nt, Mycobacterium avium subsp. paratuberculosis
cgacaucucgac

SEQ ID NO: 3002782 - RNA, 17 nt, Mycobacterium avium subsp. paratuberculosis
cgacaucucgacgguga

SEQ ID NO: 3002783 - RNA, 19 nt, Mycobacterium avium subsp. paratuberculosis
cgacaucucgacggugacc

SEQ ID NO: 3002784 - RNA, 14 nt, Mycobacterium avium subsp. paratuberculosis
cgacaucucgguga

SEQ ID NO: 3002785 - RNA, 15 nt, Mycobacterium avium subsp. paratuberculosis
cgacaucucggugag

SEQ ID NO: 3002786 - RNA, 21 nt, Mycobacterium avium subsp. paratuberculosis
cgacaucucggugaggugggc

SEQ ID NO: 3002787 - RNA, 21 nt, Mycobacterium avium subsp. paratuberculosis
cgacaucugccgggcggcgac

SEQ ID NO: 3002788 - RNA, 17 nt, Mycobacterium avium subsp. paratuberculosis
cgacaugaccaccgcgu

SEQ ID NO: 3002789 - RNA, 20 nt, Mycobacterium avium subsp. paratuberculosis
cgacaugaccaccgcgucgg

SEQ ID NO: 3002790 - RNA, 23 nt, Mycobacterium avium subsp. paratuberculosis
cgacaugcccgcggugcagucgg

SEQ ID NO: 3002791 - RNA, 14 nt, Mycobacterium avium subsp. paratuberculosis
cgacaugcccggcg

SEQ ID NO: 3002792 - RNA, 17 nt, Mycobacterium avium subsp. paratuberculosis
cgacaugcccggcgacg

SEQ ID NO: 3002793 - RNA, 19 nt, Mycobacterium avium subsp. paratuberculosis
cgacaugcccggcgacggc

SEQ ID NO: 3002794 - RNA, 20 nt, Mycobacterium avium subsp. paratuberculosis
cgacaugcccggcgacggcg

SEQ ID NO: 3002795 - RNA, 22 nt, Mycobacterium avium subsp. paratuberculosis
cgacaugcccggcgacggcgcc

SEQ ID NO: 3002796 - RNA, 23 nt, Mycobacterium avium subsp. paratuberculosis
cgacaugcugggcuaccagcccc

SEQ ID NO: 3002797 - RNA, 20 nt, Mycobacterium avium subsp. paratuberculosis
cgacaugcuguuccagacgu

SEQ ID NO: 3002798 - RNA, 15 nt, Mycobacterium avium subsp. paratuberculosis
cgacauggacgcggc

SEQ ID NO: 3002799 - RNA, 14 nt, Mycobacterium avium subsp. paratuberculosis
cgacauggccagca

SEQ ID NO: 3002800 - RNA, 15 nt, Mycobacterium avium subsp. paratuberculosis
cgacauggccagcac

SEQ ID NO: 3002801 - RNA, 17 nt, Mycobacterium avium subsp. paratuberculosis
cgacauggccagcacca

SEQ ID NO: 3002802 - RNA, 16 nt, Mycobacterium avium subsp. paratuberculosis
cgacauggucgggcgc

SEQ ID NO: 3002803 - RNA, 20 nt, Mycobacterium avium subsp. paratuberculosis
cgacauggucgggcgcacca

SEQ ID NO: 3002804 - RNA, 23 nt, Mycobacterium avium subsp. paratuberculosis
cgacauguccgggauggacgacg

SEQ ID NO: 3002805 - RNA, 16 nt, Mycobacterium avium subsp. paratuberculosis
cgacaugucgccgggc

SEQ ID NO: 3002806 - RNA, 15 nt, Mycobacterium avium subsp. paratuberculosis
cgacauuggccgcgc

SEQ ID NO: 3002807 - RNA, 16 nt, Mycobacterium avium subsp. paratuberculosis
cgacauuggccgcgcg

SEQ ID NO: 3002808 - RNA, 17 nt, Mycobacterium avium subsp. paratuberculosis
cgaccaaacgcagcguc

SEQ ID NO: 3002809 - RNA, 21 nt, Mycobacterium avium subsp. paratuberculosis
cgaccaacgccaugggcaucg

SEQ ID NO: 3002810 - RNA, 17 nt, Mycobacterium avium subsp. paratuberculosis
cgaccaacgggcggcgg

SEQ ID NO: 3002811 - RNA, 20 nt, Mycobacterium avium subsp. paratuberculosis
cgaccaacgggcggcggauc

SEQ ID NO: 3002812 - RNA, 21 nt, Mycobacterium avium subsp. paratuberculosis
cgaccaacgggcggcggauca

SEQ ID NO: 3002813 - RNA, 17 nt, Mycobacterium avium subsp. paratuberculosis
cgaccaacuccaccgcc

SEQ ID NO: 3002814 - RNA, 18 nt, Mycobacterium avium subsp. paratuberculosis
cgaccaacuccaccgccc

SEQ ID NO: 3002815 - RNA, 20 nt, Mycobacterium avium subsp. paratuberculosis
cgaccaacuccaccgcccgg

SEQ ID NO: 3002816 - RNA, 22 nt, Mycobacterium avium subsp. paratuberculosis
cgaccaagaaccaacugagcgc

SEQ ID NO: 3002817 - RNA, 21 nt, Mycobacterium avium subsp. paratuberculosis
cgaccaagacggugggcccgc

SEQ ID NO: 3002818 - RNA, 22 nt, Mycobacterium avium subsp. paratuberculosis
cgaccaagacggugggcccgcc

SEQ ID NO: 3002819 - RNA, 23 nt, Mycobacterium avium subsp. paratuberculosis
cgaccaagacggugggcccgccg

SEQ ID NO: 3002820 - RNA, 21 nt, Mycobacterium avium subsp. paratuberculosis
cgaccaauugcgagcaggccg

SEQ ID NO: 3002821 - RNA, 16 nt, Mycobacterium avium subsp. paratuberculosis
cgaccacacccgcacg

SEQ ID NO: 3002822 - RNA, 17 nt, Mycobacterium avium subsp. paratuberculosis
cgaccacacccgcacgc

SEQ ID NO: 3002823 - RNA, 18 nt, Mycobacterium avium subsp. paratuberculosis
cgaccacacccgcacgcu

SEQ ID NO: 3002824 - RNA, 16 nt, Mycobacterium avium subsp. paratuberculosis
cgaccacaccgccggc

SEQ ID NO: 3002825 - RNA, 17 nt, Mycobacterium avium subsp. paratuberculosis
cgaccacaccgccggcc

SEQ ID NO: 3002826 - RNA, 18 nt, Mycobacterium avium subsp. paratuberculosis
cgaccacaccgccggcca

SEQ ID NO: 3002827 - RNA, 21 nt, Mycobacterium avium subsp. paratuberculosis
cgaccacaccgccggccacgu

SEQ ID NO: 3002828 - RNA, 14 nt, Mycobacterium avium subsp. paratuberculosis
cgaccacaccggcg

SEQ ID NO: 3002829 - RNA, 15 nt, Mycobacterium avium subsp. paratuberculosis
cgaccacaccggcgc

SEQ ID NO: 3002830 - RNA, 14 nt, Mycobacterium avium subsp. paratuberculosis
cgaccacaccgucg

SEQ ID NO: 3002831 - RNA, 17 nt, Mycobacterium avium subsp. paratuberculosis
cgaccacaccgucgacg

SEQ ID NO: 3002832 - RNA, 13 nt, Mycobacterium avium subsp. paratuberculosis
cgaccacagcgcc

SEQ ID NO: 3002833 - RNA, 14 nt, Mycobacterium avium subsp. paratuberculosis
cgaccacagcgccu

SEQ ID NO: 3002834 - RNA, 19 nt, Mycobacterium avium subsp. paratuberculosis
cgaccacagcgccucgucg

SEQ ID NO: 3002835 - RNA, 12 nt, Mycobacterium avium subsp. paratuberculosis
cgaccaccaccg

SEQ ID NO: 3002836 - RNA, 18 nt, Mycobacterium avium subsp. paratuberculosis
cgaccaccacgaccagug

SEQ ID NO: 3002837 - RNA, 19 nt, Mycobacterium avium subsp. paratuberculosis
cgaccaccacggccgcagc

SEQ ID NO: 3002838 - RNA, 21 nt, Mycobacterium avium subsp. paratuberculosis
cgaccaccacggccgcagcgg

SEQ ID NO: 3002839 - RNA, 13 nt, Mycobacterium avium subsp. paratuberculosis
cgaccaccagccg

SEQ ID NO: 3002840 - RNA, 17 nt, Mycobacterium avium subsp. paratuberculosis
cgaccaccaggagcacc

SEQ ID NO: 3002841 - RNA, 20 nt, Mycobacterium avium subsp. paratuberculosis
cgaccacccccagcccgccg

SEQ ID NO: 3002842 - RNA, 21 nt, Mycobacterium avium subsp. paratuberculosis
cgaccacccccagcccgccgg

SEQ ID NO: 3002843 - RNA, 22 nt, Mycobacterium avium subsp. paratuberculosis
cgaccacccccagcccgccggg

SEQ ID NO: 3002844 - RNA, 15 nt, Mycobacterium avium subsp. paratuberculosis
cgaccacccgcagcu

SEQ ID NO: 3002845 - RNA, 15 nt, Mycobacterium avium subsp. paratuberculosis
cgaccacccggacga

SEQ ID NO: 3002846 - RNA, 20 nt, Mycobacterium avium subsp. paratuberculosis
cgaccacccggacgaugacc

SEQ ID NO: 3002847 - RNA, 16 nt, Mycobacterium avium subsp. paratuberculosis
cgaccacccggcgggc

SEQ ID NO: 3002848 - RNA, 14 nt, Mycobacterium avium subsp. paratuberculosis
cgaccaccgccggc

SEQ ID NO: 3002849 - RNA, 17 nt, Mycobacterium avium subsp. paratuberculosis
cgaccaccgccggcccg

SEQ ID NO: 3002850 - RNA, 18 nt, Mycobacterium avium subsp. paratuberculosis
cgaccaccgccggcccgg

SEQ ID NO: 3002851 - RNA, 19 nt, Mycobacterium avium subsp. paratuberculosis
cgaccaccgccggcccggc

SEQ ID NO: 3002852 - RNA, 22 nt, Mycobacterium avium subsp. paratuberculosis
cgaccaccgccggcccggcguu

SEQ ID NO: 3002853 - RNA, 12 nt, Mycobacterium avium subsp. paratuberculosis
cgaccaccgggu

SEQ ID NO: 3002854 - RNA, 20 nt, Mycobacterium avium subsp. paratuberculosis
cgaccaccggguagcccgcg

SEQ ID NO: 3002855 - RNA, 19 nt, Mycobacterium avium subsp. paratuberculosis
cgaccaccucaccugcguu

SEQ ID NO: 3002856 - RNA, 17 nt, Mycobacterium avium subsp. paratuberculosis
cgaccaccuccccgcgg

SEQ ID NO: 3002857 - RNA, 19 nt, Mycobacterium avium subsp. paratuberculosis
cgaccaccuccccgcggug

SEQ ID NO: 3002858 - RNA, 20 nt, Mycobacterium avium subsp. paratuberculosis
cgaccaccuccccgcggugc

SEQ ID NO: 3002859 - RNA, 21 nt, Mycobacterium avium subsp. paratuberculosis
cgaccaccuccccgcggugcc

SEQ ID NO: 3002860 - RNA, 22 nt, Mycobacterium avium subsp. paratuberculosis
cgaccaccuccccgcggugccg

SEQ ID NO: 3002861 - RNA, 14 nt, Mycobacterium avium subsp. paratuberculosis
cgaccaccucggcg

SEQ ID NO: 3002862 - RNA, 18 nt, Mycobacterium avium subsp. paratuberculosis
cgaccacgaacaccggcg

SEQ ID NO: 3002863 - RNA, 19 nt, Mycobacterium avium subsp. paratuberculosis
cgaccacgaacaccggcgc

SEQ ID NO: 3002864 - RNA, 23 nt, Mycobacterium avium subsp. paratuberculosis
cgaccacgaucgucuggccguug

SEQ ID NO: 3002865 - RNA, 15 nt, Mycobacterium avium subsp. paratuberculosis
cgaccacgcacacca

SEQ ID NO: 3002866 - RNA, 16 nt, Mycobacterium avium subsp. paratuberculosis
cgaccacgcacaccac

SEQ ID NO: 3002867 - RNA, 13 nt, Mycobacterium avium subsp. paratuberculosis
cgaccacgccgcg

SEQ ID NO: 3002868 - RNA, 16 nt, Mycobacterium avium subsp. paratuberculosis
cgaccacgccgcgcuu

SEQ ID NO: 3002869 - RNA, 14 nt, Mycobacterium avium subsp. paratuberculosis
cgaccacgccgcgg

SEQ ID NO: 3002870 - RNA, 23 nt, Mycobacterium avium subsp. paratuberculosis
cgaccacgccgcggucgcugacc

SEQ ID NO: 3002871 - RNA, 13 nt, Mycobacterium avium subsp. paratuberculosis
cgaccacgcgcca

SEQ ID NO: 3002872 - RNA, 23 nt, Mycobacterium avium subsp. paratuberculosis
cgaccacggccccagccgccgcg

SEQ ID NO: 3002873 - RNA, 15 nt, Mycobacterium avium subsp. paratuberculosis
cgaccacggccgguc

SEQ ID NO: 3002874 - RNA, 16 nt, Mycobacterium avium subsp. paratuberculosis
cgaccacggccggucc

SEQ ID NO: 3002875 - RNA, 20 nt, Mycobacterium avium subsp. paratuberculosis
cgaccagauaggccagcgcg

SEQ ID NO: 3002876 - RNA, 21 nt, Mycobacterium avium subsp. paratuberculosis
cgaccagauaggccagcgcgu

SEQ ID NO: 3002877 - RNA, 15 nt, Mycobacterium avium subsp. paratuberculosis
cgaccagauugcggc

SEQ ID NO: 3002878 - RNA, 18 nt, Mycobacterium avium subsp. paratuberculosis
cgaccagauugcggcacc

SEQ ID NO: 3002879 - RNA, 15 nt, Mycobacterium avium subsp. paratuberculosis
cgaccagcacccggg

SEQ ID NO: 3002880 - RNA, 16 nt, Mycobacterium avium subsp. paratuberculosis
cgaccagcacccgggc

SEQ ID NO: 3002881 - RNA, 17 nt, Mycobacterium avium subsp. paratuberculosis
cgaccagcacccgggcc

SEQ ID NO: 3002882 - RNA, 15 nt, Mycobacterium avium subsp. paratuberculosis
cgaccagcaccgcau

SEQ ID NO: 3002883 - RNA, 15 nt, Mycobacterium avium subsp. paratuberculosis
cgaccagcaccgcgg

SEQ ID NO: 3002884 - RNA, 20 nt, Mycobacterium avium subsp. paratuberculosis
cgaccagcaggacgcgcccg

SEQ ID NO: 3002885 - RNA, 23 nt, Mycobacterium avium subsp. paratuberculosis
cgaccagcaggacgcgcccggcg

SEQ ID NO: 3002886 - RNA, 13 nt, Mycobacterium avium subsp. paratuberculosis
cgaccagcccccg

SEQ ID NO: 3002887 - RNA, 16 nt, Mycobacterium avium subsp. paratuberculosis
cgaccagcccccgcgg

SEQ ID NO: 3002888 - RNA, 19 nt, Mycobacterium avium subsp. paratuberculosis
cgaccagcccccgcggguc

SEQ ID NO: 3002889 - RNA, 18 nt, Mycobacterium avium subsp. paratuberculosis
cgaccagccccucgacca

SEQ ID NO: 3002890 - RNA, 19 nt, Mycobacterium avium subsp. paratuberculosis
cgaccagccccucgaccac

SEQ ID NO: 3002891 - RNA, 21 nt, Mycobacterium avium subsp. paratuberculosis
cgaccagccccucgaccaccu

SEQ ID NO: 3002892 - RNA, 15 nt, Mycobacterium avium subsp. paratuberculosis
cgaccagcccggccg

SEQ ID NO: 3002893 - RNA, 16 nt, Mycobacterium avium subsp. paratuberculosis
cgaccagcccggccgc

SEQ ID NO: 3002894 - RNA, 18 nt, Mycobacterium avium subsp. paratuberculosis
cgaccagcccggccgccg

SEQ ID NO: 3002895 - RNA, 19 nt, Mycobacterium avium subsp. paratuberculosis
cgaccagcccggccgccga

SEQ ID NO: 3002896 - RNA, 23 nt, Mycobacterium avium subsp. paratuberculosis
cgaccagccgaaguuggcgucgg

SEQ ID NO: 3002897 - RNA, 16 nt, Mycobacterium avium subsp. paratuberculosis
cgaccagccgaggcgc

SEQ ID NO: 3002898 - RNA, 13 nt, Mycobacterium avium subsp. paratuberculosis
cgaccagccgcau

SEQ ID NO: 3002899 - RNA, 17 nt, Mycobacterium avium subsp. paratuberculosis
cgaccagccgguaggcc

SEQ ID NO: 3002900 - RNA, 20 nt, Mycobacterium avium subsp. paratuberculosis
cgaccagccgguaggccugc

SEQ ID NO: 3002901 - RNA, 14 nt, Mycobacterium avium subsp. paratuberculosis
cgaccagccggucu

SEQ ID NO: 3002902 - RNA, 19 nt, Mycobacterium avium subsp. paratuberculosis
cgaccagcgagcccagcug

SEQ ID NO: 3002903 - RNA, 13 nt, Mycobacterium avium subsp. paratuberculosis
cgaccagcgccga

SEQ ID NO: 3002904 - RNA, 19 nt, Mycobacterium avium subsp. paratuberculosis
cgaccagcgccgagaccag

SEQ ID NO: 3002905 - RNA, 11 nt, Mycobacterium avium subsp. paratuberculosis
cgaccagcgcg

SEQ ID NO: 3002906 - RNA, 14 nt, Mycobacterium avium subsp. paratuberculosis
cgaccagcgcgauc

SEQ ID NO: 3002907 - RNA, 14 nt, Mycobacterium avium subsp. paratuberculosis
cgaccagcgcgccg

SEQ ID NO: 3002908 - RNA, 17 nt, Mycobacterium avium subsp. paratuberculosis
cgaccagcgcgccgccc

SEQ ID NO: 3002909 - RNA, 15 nt, Mycobacterium avium subsp. paratuberculosis
cgaccagcgcgccgg

SEQ ID NO: 3002910 - RNA, 16 nt, Mycobacterium avium subsp. paratuberculosis
cgaccagcgcgccggc

SEQ ID NO: 3002911 - RNA, 18 nt, Mycobacterium avium subsp. paratuberculosis
cgaccagcgcgccggcca

SEQ ID NO: 3002912 - RNA, 22 nt, Mycobacterium avium subsp. paratuberculosis
cgaccagcgcgccggccagcag

SEQ ID NO: 3002913 - RNA, 23 nt, Mycobacterium avium subsp. paratuberculosis
cgaccagcgcgccggccagcagc

SEQ ID NO: 3002914 - RNA, 12 nt, Mycobacterium avium subsp. paratuberculosis
cgaccagcgcgu

SEQ ID NO: 3002915 - RNA, 15 nt, Mycobacterium avium subsp. paratuberculosis
cgaccagcggcagca

SEQ ID NO: 3002916 - RNA, 19 nt, Mycobacterium avium subsp. paratuberculosis
cgaccagcggcagcagcac

SEQ ID NO: 3002917 - RNA, 17 nt, Mycobacterium avium subsp. paratuberculosis
cgaccagcggcccaccg

SEQ ID NO: 3002918 - RNA, 21 nt, Mycobacterium avium subsp. paratuberculosis
cgaccagcggcccaccgcgac

SEQ ID NO: 3002919 - RNA, 22 nt, Mycobacterium avium subsp. paratuberculosis
cgaccagcggcccaccgcgacc

SEQ ID NO: 3002920 - RNA, 14 nt, Mycobacterium avium subsp. paratuberculosis
cgaccagcgggccg

SEQ ID NO: 3002921 - RNA, 18 nt, Mycobacterium avium subsp. paratuberculosis
cgaccagcgggccgacag

SEQ ID NO: 3002922 - RNA, 19 nt, Mycobacterium avium subsp. paratuberculosis
cgaccagcgggccgacagc

SEQ ID NO: 3002923 - RNA, 14 nt, Mycobacterium avium subsp. paratuberculosis
cgaccagcgggcug

SEQ ID NO: 3002924 - RNA, 22 nt, Mycobacterium avium subsp. paratuberculosis
cgaccagcgggcugucggcgcc

SEQ ID NO: 3002925 - RNA, 18 nt, Mycobacterium avium subsp. paratuberculosis
cgaccagcggucgggugc

SEQ ID NO: 3002926 - RNA, 22 nt, Mycobacterium avium subsp. paratuberculosis
cgaccagcggucgggugcgcuc

SEQ ID NO: 3002927 - RNA, 16 nt, Mycobacterium avium subsp. paratuberculosis
cgaccagcuccuggaa

SEQ ID NO: 3002928 - RNA, 23 nt, Mycobacterium avium subsp. paratuberculosis
cgaccagcugauuguugacggug

SEQ ID NO: 3002929 - RNA, 20 nt, Mycobacterium avium subsp. paratuberculosis
cgaccagcuugucgaucucu

SEQ ID NO: 3002930 - RNA, 17 nt, Mycobacterium avium subsp. paratuberculosis
cgaccaggaacacggcu

SEQ ID NO: 3002931 - RNA, 20 nt, Mycobacterium avium subsp. paratuberculosis
cgaccaggaaguacaccacc

SEQ ID NO: 3002932 - RNA, 15 nt, Mycobacterium avium subsp. paratuberculosis
cgaccaggacgucgg

SEQ ID NO: 3002933 - RNA, 17 nt, Mycobacterium avium subsp. paratuberculosis
cgaccaggacgucggcc

SEQ ID NO: 3002934 - RNA, 13 nt, Mycobacterium avium subsp. paratuberculosis
cgaccaggaugcc

SEQ ID NO: 3002935 - RNA, 17 nt, Mycobacterium avium subsp. paratuberculosis
cgaccaggcccagcgga

SEQ ID NO: 3002936 - RNA, 12 nt, Mycobacterium avium subsp. paratuberculosis
cgaccaggcuca

SEQ ID NO: 3002937 - RNA, 18 nt, Mycobacterium avium subsp. paratuberculosis
cgaccaggcuuggcccgc

SEQ ID NO: 3002938 - RNA, 20 nt, Mycobacterium avium subsp. paratuberculosis
cgaccaggcuuggcccgccg

SEQ ID NO: 3002939 - RNA, 23 nt, Mycobacterium avium subsp. paratuberculosis
cgaccagggcgaucaccgcggcc

SEQ ID NO: 3002940 - RNA, 18 nt, Mycobacterium avium subsp. paratuberculosis
cgaccaggguuucaugca

SEQ ID NO: 3002941 - RNA, 19 nt, Mycobacterium avium subsp. paratuberculosis
cgaccaggguuugggcgug

SEQ ID NO: 3002942 - RNA, 17 nt, Mycobacterium avium subsp. paratuberculosis
cgaccagguaggcgccc

SEQ ID NO: 3002943 - RNA, 20 nt, Mycobacterium avium subsp. paratuberculosis
cgaccagguaggcgcccugc

SEQ ID NO: 3002944 - RNA, 17 nt, Mycobacterium avium subsp. paratuberculosis
cgaccagguccaccccg

SEQ ID NO: 3002945 - RNA, 19 nt, Mycobacterium avium subsp. paratuberculosis
cgaccagguccaccccgcc

SEQ ID NO: 3002946 - RNA, 20 nt, Mycobacterium avium subsp. paratuberculosis
cgaccagguccgguucgacc

SEQ ID NO: 3002947 - RNA, 16 nt, Mycobacterium avium subsp. paratuberculosis
cgaccaguaccgggcc

SEQ ID NO: 3002948 - RNA, 18 nt, Mycobacterium avium subsp. paratuberculosis
cgaccaguaccgggccug

SEQ ID NO: 3002949 - RNA, 17 nt, Mycobacterium avium subsp. paratuberculosis
cgaccaguaggccagca

SEQ ID NO: 3002950 - RNA, 18 nt, Mycobacterium avium subsp. paratuberculosis
cgaccaguaggccagcau

SEQ ID NO: 3002951 - RNA, 17 nt, Mycobacterium avium subsp. paratuberculosis
cgaccagugcccggcca

SEQ ID NO: 3002952 - RNA, 17 nt, Mycobacterium avium subsp. paratuberculosis
cgaccaguuccacaccg

SEQ ID NO: 3002953 - RNA, 22 nt, Mycobacterium avium subsp. paratuberculosis
cgaccaguucgcccuggccgcg

SEQ ID NO: 3002954 - RNA, 16 nt, Mycobacterium avium subsp. paratuberculosis
cgaccaucagcccggu

SEQ ID NO: 3002955 - RNA, 18 nt, Mycobacterium avium subsp. paratuberculosis
cgaccaucagcccgguga

SEQ ID NO: 3002956 - RNA, 16 nt, Mycobacterium avium subsp. paratuberculosis
cgaccaucagcgcccg

SEQ ID NO: 3002957 - RNA, 21 nt, Mycobacterium avium subsp. paratuberculosis
cgaccaucagcgcccgggugg

SEQ ID NO: 3002958 - RNA, 20 nt, Mycobacterium avium subsp. paratuberculosis
cgaccaucauggccucccca

SEQ ID NO: 3002959 - RNA, 16 nt, Mycobacterium avium subsp. paratuberculosis
cgaccauccacucggg

SEQ ID NO: 3002960 - RNA, 17 nt, Mycobacterium avium subsp. paratuberculosis
cgaccauccacucgggc

SEQ ID NO: 3002961 - RNA, 15 nt, Mycobacterium avium subsp. paratuberculosis
cgaccaucugccggc

SEQ ID NO: 3002962 - RNA, 18 nt, Mycobacterium avium subsp. paratuberculosis
cgaccaucugccggcgcu

SEQ ID NO: 3002963 - RNA, 15 nt, Mycobacterium avium subsp. paratuberculosis
cgaccaugcccagca

SEQ ID NO: 3002964 - RNA, 16 nt, Mycobacterium avium subsp. paratuberculosis
cgaccaugcccagcag

SEQ ID NO: 3002965 - RNA, 20 nt, Mycobacterium avium subsp. paratuberculosis
cgaccaugcccagcaguccg

SEQ ID NO: 3002966 - RNA, 15 nt, Mycobacterium avium subsp. paratuberculosis
cgaccaugcccggcg

SEQ ID NO: 3002967 - RNA, 16 nt, Mycobacterium avium subsp. paratuberculosis
cgaccaugcccggcgc

SEQ ID NO: 3002968 - RNA, 13 nt, Mycobacterium avium subsp. paratuberculosis
cgaccaugccgcg

SEQ ID NO: 3002969 - RNA, 18 nt, Mycobacterium avium subsp. paratuberculosis
cgaccaugccgcgggcca

SEQ ID NO: 3002970 - RNA, 14 nt, Mycobacterium avium subsp. paratuberculosis
cgaccaugccguag

SEQ ID NO: 3002971 - RNA, 17 nt, Mycobacterium avium subsp. paratuberculosis
cgaccaugccguagcgg

SEQ ID NO: 3002972 - RNA, 15 nt, Mycobacterium avium subsp. paratuberculosis
cgaccaugucggcga

SEQ ID NO: 3002973 - RNA, 16 nt, Mycobacterium avium subsp. paratuberculosis
cgaccaugucggcgac

SEQ ID NO: 3002974 - RNA, 16 nt, Mycobacterium avium subsp. paratuberculosis
cgacccaccgucgaag

SEQ ID NO: 3002975 - RNA, 15 nt, Mycobacterium avium subsp. paratuberculosis
cgacccaggccgccg

SEQ ID NO: 3002976 - RNA, 16 nt, Mycobacterium avium subsp. paratuberculosis
cgacccaggccgccgc

SEQ ID NO: 3002977 - RNA, 19 nt, Mycobacterium avium subsp. paratuberculosis
cgacccaggccgccgccac

SEQ ID NO: 3002978 - RNA, 20 nt, Mycobacterium avium subsp. paratuberculosis
cgacccaggccgccgccacc

SEQ ID NO: 3002979 - RNA, 14 nt, Mycobacterium avium subsp. paratuberculosis
cgacccccaccgcg

SEQ ID NO: 3002980 - RNA, 15 nt, Mycobacterium avium subsp. paratuberculosis
cgacccccaccgcga

SEQ ID NO: 3002981 - RNA, 18 nt, Mycobacterium avium subsp. paratuberculosis
cgacccccaccgcgacac

SEQ ID NO: 3002982 - RNA, 14 nt, Mycobacterium avium subsp. paratuberculosis
cgacccccgccgcg

SEQ ID NO: 3002983 - RNA, 18 nt, Mycobacterium avium subsp. paratuberculosis
cgacccccgccgcgucgg

SEQ ID NO: 3002984 - RNA, 14 nt, Mycobacterium avium subsp. paratuberculosis
cgaccccgaaggcg

SEQ ID NO: 3002985 - RNA, 24 nt, Mycobacterium avium subsp. paratuberculosis
cgaccccgaaggcguuggagccga

SEQ ID NO: 3002986 - RNA, 14 nt, Mycobacterium avium subsp. paratuberculosis
cgaccccgaugcgc

SEQ ID NO: 3002987 - RNA, 16 nt, Mycobacterium avium subsp. paratuberculosis
cgaccccgaugcgcuc

SEQ ID NO: 3002988 - RNA, 20 nt, Mycobacterium avium subsp. paratuberculosis
cgaccccgaugcgcucgccg

SEQ ID NO: 3002989 - RNA, 14 nt, Mycobacterium avium subsp. paratuberculosis
cgaccccgccagca

SEQ ID NO: 3002990 - RNA, 13 nt, Mycobacterium avium subsp. paratuberculosis
cgaccccgcccac

SEQ ID NO: 3002991 - RNA, 13 nt, Mycobacterium avium subsp. paratuberculosis
cgaccccgccggc

SEQ ID NO: 3002992 - RNA, 15 nt, Mycobacterium avium subsp. paratuberculosis
cgaccccgccggccc

SEQ ID NO: 3002993 - RNA, 16 nt, Mycobacterium avium subsp. paratuberculosis
cgaccccgccggcccg

SEQ ID NO: 3002994 - RNA, 14 nt, Mycobacterium avium subsp. paratuberculosis
cgaccccgccgucg

SEQ ID NO: 3002995 - RNA, 17 nt, Mycobacterium avium subsp. paratuberculosis
cgaccccgccgucgacg

SEQ ID NO: 3002996 - RNA, 18 nt, Mycobacterium avium subsp. paratuberculosis
cgaccccgccgucgacgc

SEQ ID NO: 3002997 - RNA, 13 nt, Mycobacterium avium subsp. paratuberculosis
cgaccccggcgag

SEQ ID NO: 3002998 - RNA, 13 nt, Mycobacterium avium subsp. paratuberculosis
cgaccccggcggc

SEQ ID NO: 3002999 - RNA, 17 nt, Mycobacterium avium subsp. paratuberculosis
cgaccccggcggcaccg

SEQ ID NO: 3003000 - RNA, 19 nt, Mycobacterium avium subsp. paratuberculosis
cgaccccggcggcaccgcc

SEQ ID NO: 3003001 - RNA, 20 nt, Mycobacterium avium subsp. paratuberculosis
cgaccccggcggcaccgccg

SEQ ID NO: 3003002 - RNA, 22 nt, Mycobacterium avium subsp. paratuberculosis
cgaccccggcggcaccgccgcg

SEQ ID NO: 3003003 - RNA, 17 nt, Mycobacterium avium subsp. paratuberculosis
cgaccccguucgccgac

SEQ ID NO: 3003004 - RNA, 20 nt, Mycobacterium avium subsp. paratuberculosis
cgaccccguucgccgacagc

SEQ ID NO: 3003005 - RNA, 22 nt, Mycobacterium avium subsp. paratuberculosis
cgaccccuacgggcgcaccgcg

SEQ ID NO: 3003006 - RNA, 23 nt, Mycobacterium avium subsp. paratuberculosis
cgaccccuacgggcgcaccgcgc

SEQ ID NO: 3003007 - RNA, 13 nt, Mycobacterium avium subsp. paratuberculosis
cgaccccucggcg

SEQ ID NO: 3003008 - RNA, 15 nt, Mycobacterium avium subsp. paratuberculosis
cgaccccucggcggc

SEQ ID NO: 3003009 - RNA, 16 nt, Mycobacterium avium subsp. paratuberculosis
cgaccccucggcggcc

SEQ ID NO: 3003010 - RNA, 19 nt, Mycobacterium avium subsp. paratuberculosis
cgaccccucggcggccguc

SEQ ID NO: 3003011 - RNA, 20 nt, Mycobacterium avium subsp. paratuberculosis
cgaccccucggcggccgucg

SEQ ID NO: 3003012 - RNA, 16 nt, Mycobacterium avium subsp. paratuberculosis
cgacccgaaccggauc

SEQ ID NO: 3003013 - RNA, 20 nt, Mycobacterium avium subsp. paratuberculosis
cgacccgaacuucagcgcgu

SEQ ID NO: 3003014 - RNA, 21 nt, Mycobacterium avium subsp. paratuberculosis
cgacccgaacuucagcgcguc

SEQ ID NO: 3003015 - RNA, 22 nt, Mycobacterium avium subsp. paratuberculosis
cgacccgaacuucagcgcgucg

SEQ ID NO: 3003016 - RNA, 18 nt, Mycobacterium avium subsp. paratuberculosis
cgacccgaagccaggugu

SEQ ID NO: 3003017 - RNA, 14 nt, Mycobacterium avium subsp. paratuberculosis
cgacccgaagccca

SEQ ID NO: 3003018 - RNA, 19 nt, Mycobacterium avium subsp. paratuberculosis
cgacccgagagcugcugcc

SEQ ID NO: 3003019 - RNA, 16 nt, Mycobacterium avium subsp. paratuberculosis
cgacccgauccagacg

SEQ ID NO: 3003020 - RNA, 17 nt, Mycobacterium avium subsp. paratuberculosis
cgacccgauccagacgg

SEQ ID NO: 3003021 - RNA, 15 nt, Mycobacterium avium subsp. paratuberculosis
cgacccgcaccaccg

SEQ ID NO: 3003022 - RNA, 16 nt, Mycobacterium avium subsp. paratuberculosis
cgacccgcaccaccgc

SEQ ID NO: 3003023 - RNA, 21 nt, Mycobacterium avium subsp. paratuberculosis
cgacccgcaccaccgcccgga

SEQ ID NO: 3003024 - RNA, 18 nt, Mycobacterium avium subsp. paratuberculosis
cgacccgcacgaugccgc

SEQ ID NO: 3003025 - RNA, 22 nt, Mycobacterium avium subsp. paratuberculosis
cgacccgcacgaugccgcgcuc

SEQ ID NO: 3003026 - RNA, 17 nt, Mycobacterium avium subsp. paratuberculosis
cgacccgcauccgccgg

SEQ ID NO: 3003027 - RNA, 18 nt, Mycobacterium avium subsp. paratuberculosis
cgacccgcauccgccggg

SEQ ID NO: 3003028 - RNA, 20 nt, Mycobacterium avium subsp. paratuberculosis
cgacccgcauccgccgggcg

SEQ ID NO: 3003029 - RNA, 22 nt, Mycobacterium avium subsp. paratuberculosis
cgacccgcauccgccgggcggc

SEQ ID NO: 3003030 - RNA, 13 nt, Mycobacterium avium subsp. paratuberculosis
cgacccgcccgcc

SEQ ID NO: 3003031 - RNA, 15 nt, Mycobacterium avium subsp. paratuberculosis
cgacccgcccgccgg

SEQ ID NO: 3003032 - RNA, 16 nt, Mycobacterium avium subsp. paratuberculosis
cgacccgcccgccggg

SEQ ID NO: 3003033 - RNA, 19 nt, Mycobacterium avium subsp. paratuberculosis
cgacccgcccgccgggcac

SEQ ID NO: 3003034 - RNA, 14 nt, Mycobacterium avium subsp. paratuberculosis
cgacccgccgcagc

SEQ ID NO: 3003035 - RNA, 12 nt, Mycobacterium avium subsp. paratuberculosis
cgacccgccgug

SEQ ID NO: 3003036 - RNA, 13 nt, Mycobacterium avium subsp. paratuberculosis
cgacccgccuacu

SEQ ID NO: 3003037 - RNA, 12 nt, Mycobacterium avium subsp. paratuberculosis
cgacccgcggcg

SEQ ID NO: 3003038 - RNA, 14 nt, Mycobacterium avium subsp. paratuberculosis
cgacccgcggcgcc

SEQ ID NO: 3003039 - RNA, 19 nt, Mycobacterium avium subsp. paratuberculosis
cgacccgcggcgccgcggc

SEQ ID NO: 3003040 - RNA, 20 nt, Mycobacterium avium subsp. paratuberculosis
cgacccgcggcgccgcggcg

SEQ ID NO: 3003041 - RNA, 18 nt, Mycobacterium avium subsp. paratuberculosis
cgacccgcucgacgcgca

SEQ ID NO: 3003042 - RNA, 18 nt, Mycobacterium avium subsp. paratuberculosis
cgacccgcuucgcccggc

SEQ ID NO: 3003043 - RNA, 19 nt, Mycobacterium avium subsp. paratuberculosis
cgacccgcuucgcccggcu

SEQ ID NO: 3003044 - RNA, 19 nt, Mycobacterium avium subsp. paratuberculosis
cgacccggaugauguucuc

SEQ ID NO: 3003045 - RNA, 13 nt, Mycobacterium avium subsp. paratuberculosis
cgacccggccagc

SEQ ID NO: 3003046 - RNA, 14 nt, Mycobacterium avium subsp. paratuberculosis
cgacccggccagcg

SEQ ID NO: 3003047 - RNA, 15 nt, Mycobacterium avium subsp. paratuberculosis
cgacccggccagcgg

SEQ ID NO: 3003048 - RNA, 16 nt, Mycobacterium avium subsp. paratuberculosis
cgacccggccagcggc

SEQ ID NO: 3003049 - RNA, 17 nt, Mycobacterium avium subsp. paratuberculosis
cgacccggccagcggca

SEQ ID NO: 3003050 - RNA, 23 nt, Mycobacterium avium subsp. paratuberculosis
cgacccggccagcggcagcggcg

SEQ ID NO: 3003051 - RNA, 14 nt, Mycobacterium avium subsp. paratuberculosis
cgacccggccgagc

SEQ ID NO: 3003052 - RNA, 16 nt, Mycobacterium avium subsp. paratuberculosis
cgacccggccgagcgc

SEQ ID NO: 3003053 - RNA, 20 nt, Mycobacterium avium subsp. paratuberculosis
cgacccggccgagcgcgccg

SEQ ID NO: 3003054 - RNA, 22 nt, Mycobacterium avium subsp. paratuberculosis
cgacccggccgagcgcgccgag

SEQ ID NO: 3003055 - RNA, 21 nt, Mycobacterium avium subsp. paratuberculosis
cgacccggcguaguucgucga

SEQ ID NO: 3003056 - RNA, 18 nt, Mycobacterium avium subsp. paratuberculosis
cgacccggcucuccaucu

SEQ ID NO: 3003057 - RNA, 12 nt, Mycobacterium avium subsp. paratuberculosis
cgacccgggcca

SEQ ID NO: 3003058 - RNA, 23 nt, Mycobacterium avium subsp. paratuberculosis
cgacccgggccagguucgcgccg

SEQ ID NO: 3003059 - RNA, 13 nt, Mycobacterium avium subsp. paratuberculosis
cgacccgggccgc

SEQ ID NO: 3003060 - RNA, 15 nt, Mycobacterium avium subsp. paratuberculosis
cgacccgggccgcca

SEQ ID NO: 3003061 - RNA, 17 nt, Mycobacterium avium subsp. paratuberculosis
cgacccgggccgccacg

SEQ ID NO: 3003062 - RNA, 20 nt, Mycobacterium avium subsp. paratuberculosis
cgacccgggccgccacggcg

SEQ ID NO: 3003063 - RNA, 22 nt, Mycobacterium avium subsp. paratuberculosis
cgacccgggccgccacggcgcc

SEQ ID NO: 3003064 - RNA, 21 nt, Mycobacterium avium subsp. paratuberculosis
cgacccgggcuagacgcgcac

SEQ ID NO: 3003065 - RNA, 17 nt, Mycobacterium avium subsp. paratuberculosis
cgacccgguagcgcagc

SEQ ID NO: 3003066 - RNA, 23 nt, Mycobacterium avium subsp. paratuberculosis
cgacccgguagcgcagcaccagg

SEQ ID NO: 3003067 - RNA, 19 nt, Mycobacterium avium subsp. paratuberculosis
cgacccggucagcucgccg

SEQ ID NO: 3003068 - RNA, 23 nt, Mycobacterium avium subsp. paratuberculosis
cgacccggucagcucgccguccg

SEQ ID NO: 3003069 - RNA, 16 nt, Mycobacterium avium subsp. paratuberculosis
cgacccgguggcccgg

SEQ ID NO: 3003070 - RNA, 22 nt, Mycobacterium avium subsp. paratuberculosis
cgacccgguggcccggucgucg

SEQ ID NO: 3003071 - RNA, 17 nt, Mycobacterium avium subsp. paratuberculosis
cgacccguccagcagca

SEQ ID NO: 3003072 - RNA, 20 nt, Mycobacterium avium subsp. paratuberculosis
cgacccguccagcagcaugu

SEQ ID NO: 3003073 - RNA, 17 nt, Mycobacterium avium subsp. paratuberculosis
cgacccguccagcgugu

SEQ ID NO: 3003074 - RNA, 13 nt, Mycobacterium avium subsp. paratuberculosis
cgacccgucgggg

SEQ ID NO: 3003075 - RNA, 22 nt, Mycobacterium avium subsp. paratuberculosis
cgacccgucggggugcgccagg

SEQ ID NO: 3003076 - RNA, 16 nt, Mycobacterium avium subsp. paratuberculosis
cgacccguuccccggc

SEQ ID NO: 3003077 - RNA, 19 nt, Mycobacterium avium subsp. paratuberculosis
cgacccguuccccggccga

SEQ ID NO: 3003078 - RNA, 15 nt, Mycobacterium avium subsp. paratuberculosis
cgacccguuccggcg

SEQ ID NO: 3003079 - RNA, 17 nt, Mycobacterium avium subsp. paratuberculosis
cgacccguuccggcgag

SEQ ID NO: 3003080 - RNA, 16 nt, Mycobacterium avium subsp. paratuberculosis
cgacccguucuugugg

SEQ ID NO: 3003081 - RNA, 17 nt, Mycobacterium avium subsp. paratuberculosis
cgacccugcguccggcc

SEQ ID NO: 3003082 - RNA, 18 nt, Mycobacterium avium subsp. paratuberculosis
cgacccugcguccggccc

SEQ ID NO: 3003083 - RNA, 19 nt, Mycobacterium avium subsp. paratuberculosis
cgacccugcguccggcccg

SEQ ID NO: 3003084 - RNA, 21 nt, Mycobacterium avium subsp. paratuberculosis
cgacccugcguccggcccggc

SEQ ID NO: 3003085 - RNA, 20 nt, Mycobacterium avium subsp. paratuberculosis
cgacccuuccggaacgacgc

SEQ ID NO: 3003086 - RNA, 21 nt, Mycobacterium avium subsp. paratuberculosis
cgacccuuccggaacgacgcg

SEQ ID NO: 3003087 - RNA, 19 nt, Mycobacterium avium subsp. paratuberculosis
cgaccgacaguucggcgcg

SEQ ID NO: 3003088 - RNA, 21 nt, Mycobacterium avium subsp. paratuberculosis
cgaccgacaguucggcgcgca

SEQ ID NO: 3003089 - RNA, 16 nt, Mycobacterium avium subsp. paratuberculosis
cgaccgacccggccag

SEQ ID NO: 3003090 - RNA, 19 nt, Mycobacterium avium subsp. paratuberculosis
cgaccgacccggccagcgg

SEQ ID NO: 3003091 - RNA, 14 nt, Mycobacterium avium subsp. paratuberculosis
cgaccgacgcccgg

SEQ ID NO: 3003092 - RNA, 15 nt, Mycobacterium avium subsp. paratuberculosis
cgaccgacgcccggc

SEQ ID NO: 3003093 - RNA, 15 nt, Mycobacterium avium subsp. paratuberculosis
cgaccgacgcgguca

SEQ ID NO: 3003094 - RNA, 17 nt, Mycobacterium avium subsp. paratuberculosis
cgaccgacgcggucacc

SEQ ID NO: 3003095 - RNA, 18 nt, Mycobacterium avium subsp. paratuberculosis
cgaccgacgcggucaccg

SEQ ID NO: 3003096 - RNA, 20 nt, Mycobacterium avium subsp. paratuberculosis
cgaccgacgcggucaccggc

SEQ ID NO: 3003097 - RNA, 23 nt, Mycobacterium avium subsp. paratuberculosis
cgaccgacgcggucaccggcucg

SEQ ID NO: 3003098 - RNA, 16 nt, Mycobacterium avium subsp. paratuberculosis
cgaccgagggcgcggg

SEQ ID NO: 3003099 - RNA, 15 nt, Mycobacterium avium subsp. paratuberculosis
cgaccgaggucgacg

SEQ ID NO: 3003100 - RNA, 16 nt, Mycobacterium avium subsp. paratuberculosis
cgaccgaggucgacgc

SEQ ID NO: 3003101 - RNA, 17 nt, Mycobacterium avium subsp. paratuberculosis
cgaccgaggucgacgcc

SEQ ID NO: 3003102 - RNA, 19 nt, Mycobacterium avium subsp. paratuberculosis
cgaccgaggucgacgcccc

SEQ ID NO: 3003103 - RNA, 12 nt, Mycobacterium avium subsp. paratuberculosis
cgaccgaucagc

SEQ ID NO: 3003104 - RNA, 19 nt, Mycobacterium avium subsp. paratuberculosis
cgaccgcaagugcggucag

SEQ ID NO: 3003105 - RNA, 17 nt, Mycobacterium avium subsp. paratuberculosis
cgaccgcaccgaccagc

SEQ ID NO: 3003106 - RNA, 20 nt, Mycobacterium avium subsp. paratuberculosis
cgaccgcaccgaccagcggg

SEQ ID NO: 3003107 - RNA, 21 nt, Mycobacterium avium subsp. paratuberculosis
cgaccgcaccgaccagcggga

SEQ ID NO: 3003108 - RNA, 14 nt, Mycobacterium avium subsp. paratuberculosis
cgaccgcaggucga

SEQ ID NO: 3003109 - RNA, 12 nt, Mycobacterium avium subsp. paratuberculosis
cgaccgccacca

SEQ ID NO: 3003110 - RNA, 18 nt, Mycobacterium avium subsp. paratuberculosis
cgaccgccaccacccggc

SEQ ID NO: 3003111 - RNA, 15 nt, Mycobacterium avium subsp. paratuberculosis
cgaccgccaccucga

SEQ ID NO: 3003112 - RNA, 17 nt, Mycobacterium avium subsp. paratuberculosis
cgaccgccaccucgagc

SEQ ID NO: 3003113 - RNA, 22 nt, Mycobacterium avium subsp. paratuberculosis
cgaccgccaccucgagcucacc

SEQ ID NO: 3003114 - RNA, 15 nt, Mycobacterium avium subsp. paratuberculosis
cgaccgccagcagca

SEQ ID NO: 3003115 - RNA, 19 nt, Mycobacterium avium subsp. paratuberculosis
cgaccgccagcagcagccg

SEQ ID NO: 3003116 - RNA, 22 nt, Mycobacterium avium subsp. paratuberculosis
cgaccgccagcagcagccgcgc

SEQ ID NO: 3003117 - RNA, 13 nt, Mycobacterium avium subsp. paratuberculosis
cgaccgccccgcc

SEQ ID NO: 3003118 - RNA, 18 nt, Mycobacterium avium subsp. paratuberculosis
cgaccgccccgccggugu

SEQ ID NO: 3003119 - RNA, 22 nt, Mycobacterium avium subsp. paratuberculosis
cgaccgcccgggccaggcgcgc

SEQ ID NO: 3003120 - RNA, 14 nt, Mycobacterium avium subsp. paratuberculosis
cgaccgcccggggc

SEQ ID NO: 3003121 - RNA, 19 nt, Mycobacterium avium subsp. paratuberculosis
cgaccgcccggggcgcgga

SEQ ID NO: 3003122 - RNA, 21 nt, Mycobacterium avium subsp. paratuberculosis
cgaccgcccggggcgcggacc

SEQ ID NO: 3003123 - RNA, 16 nt, Mycobacterium avium subsp. paratuberculosis
cgaccgccgagcgggc

SEQ ID NO: 3003124 - RNA, 13 nt, Mycobacterium avium subsp. paratuberculosis
cgaccgccgccgc

SEQ ID NO: 3003125 - RNA, 13 nt, Mycobacterium avium subsp. paratuberculosis
cgaccgccgcgaa

SEQ ID NO: 3003126 - RNA, 14 nt, Mycobacterium avium subsp. paratuberculosis
cgaccgccgcgaac

SEQ ID NO: 3003127 - RNA, 21 nt, Mycobacterium avium subsp. paratuberculosis
cgaccgccgcgaacgggucgg

SEQ ID NO: 3003128 - RNA, 18 nt, Mycobacterium avium subsp. paratuberculosis
cgaccgccgcggccgccu

SEQ ID NO: 3003129 - RNA, 14 nt, Mycobacterium avium subsp. paratuberculosis
cgaccgccgcgucg

SEQ ID NO: 3003130 - RNA, 23 nt, Mycobacterium avium subsp. paratuberculosis
cgaccgccgcuagaccgauggcg

SEQ ID NO: 3003131 - RNA, 16 nt, Mycobacterium avium subsp. paratuberculosis
cgaccgccggacacca

SEQ ID NO: 3003132 - RNA, 19 nt, Mycobacterium avium subsp. paratuberculosis
cgaccgccggacaccaccg

SEQ ID NO: 3003133 - RNA, 14 nt, Mycobacterium avium subsp. paratuberculosis
cgaccgccgguggg

SEQ ID NO: 3003134 - RNA, 17 nt, Mycobacterium avium subsp. paratuberculosis
cgaccgccgguggggug

SEQ ID NO: 3003135 - RNA, 21 nt, Mycobacterium avium subsp. paratuberculosis
cgaccgccucggauuccgcgg

SEQ ID NO: 3003136 - RNA, 15 nt, Mycobacterium avium subsp. paratuberculosis
cgaccgccucgucgg

SEQ ID NO: 3003137 - RNA, 17 nt, Mycobacterium avium subsp. paratuberculosis
cgaccgccuugucggcg

SEQ ID NO: 3003138 - RNA, 18 nt, Mycobacterium avium subsp. paratuberculosis
cgaccgccuugucggcga

SEQ ID NO: 3003139 - RNA, 19 nt, Mycobacterium avium subsp. paratuberculosis
cgaccgccuugucggcgau

SEQ ID NO: 3003140 - RNA, 23 nt, Mycobacterium avium subsp. paratuberculosis
cgaccgccuugucggcgaugucg

SEQ ID NO: 3003141 - RNA, 14 nt, Mycobacterium avium subsp. paratuberculosis
cgaccgcgacgauc

SEQ ID NO: 3003142 - RNA, 15 nt, Mycobacterium avium subsp. paratuberculosis
cgaccgcgacggcgc

SEQ ID NO: 3003143 - RNA, 18 nt, Mycobacterium avium subsp. paratuberculosis
cgaccgcgacggcgcccg

SEQ ID NO: 3003144 - RNA, 15 nt, Mycobacterium avium subsp. paratuberculosis
cgaccgcgacguggc

SEQ ID NO: 3003145 - RNA, 11 nt, Mycobacterium avium subsp. paratuberculosis
cgaccgcgauc

SEQ ID NO: 3003146 - RNA, 23 nt, Mycobacterium avium subsp. paratuberculosis
cgaccgcgaucagggccgcggcc

SEQ ID NO: 3003147 - RNA, 13 nt, Mycobacterium avium subsp. paratuberculosis
cgaccgcgaugcg

SEQ ID NO: 3003148 - RNA, 18 nt, Mycobacterium avium subsp. paratuberculosis
cgaccgcgaugcgacacc

SEQ ID NO: 3003149 - RNA, 20 nt, Mycobacterium avium subsp. paratuberculosis
cgaccgcgaugcgacaccgc

SEQ ID NO: 3003150 - RNA, 21 nt, Mycobacterium avium subsp. paratuberculosis
cgaccgcgaugcgacaccgcg

SEQ ID NO: 3003151 - RNA, 18 nt, Mycobacterium avium subsp. paratuberculosis
cgaccgcgaugguggcgu

SEQ ID NO: 3003152 - RNA, 20 nt, Mycobacterium avium subsp. paratuberculosis
cgaccgcgaugguggcguca

SEQ ID NO: 3003153 - RNA, 16 nt, Mycobacterium avium subsp. paratuberculosis
cgaccgcgcaccggcg

SEQ ID NO: 3003154 - RNA, 17 nt, Mycobacterium avium subsp. paratuberculosis
cgaccgcgcaccggcgc

SEQ ID NO: 3003155 - RNA, 18 nt, Mycobacterium avium subsp. paratuberculosis
cgaccgcgcaccggcgcu

SEQ ID NO: 3003156 - RNA, 12 nt, Mycobacterium avium subsp. paratuberculosis
cgaccgcgcagg

SEQ ID NO: 3003157 - RNA, 15 nt, Mycobacterium avium subsp. paratuberculosis
cgaccgcgcaggcgg

SEQ ID NO: 3003158 - RNA, 18 nt, Mycobacterium avium subsp. paratuberculosis
cgaccgcgcaggcggcga

SEQ ID NO: 3003159 - RNA, 15 nt, Mycobacterium avium subsp. paratuberculosis
cgaccgcgccgaaca

SEQ ID NO: 3003160 - RNA, 13 nt, Mycobacterium avium subsp. paratuberculosis
cgaccgcgccggg

SEQ ID NO: 3003161 - RNA, 15 nt, Mycobacterium avium subsp. paratuberculosis
cgaccgcgcgcggcg

SEQ ID NO: 3003162 - RNA, 18 nt, Mycobacterium avium subsp. paratuberculosis
cgaccgcgcgcggcgccg

SEQ ID NO: 3003163 - RNA, 20 nt, Mycobacterium avium subsp. paratuberculosis
cgaccgcgcgcggcgccgcg

SEQ ID NO: 3003164 - RNA, 14 nt, Mycobacterium avium subsp. paratuberculosis
cgaccgcgcggcga

SEQ ID NO: 3003165 - RNA, 20 nt, Mycobacterium avium subsp. paratuberculosis
cgaccgcggaugacgggugc

SEQ ID NO: 3003166 - RNA, 14 nt, Mycobacterium avium subsp. paratuberculosis
cgaccgcggccgcg

SEQ ID NO: 3003167 - RNA, 16 nt, Mycobacterium avium subsp. paratuberculosis
cgaccgcggccgcgac

SEQ ID NO: 3003168 - RNA, 18 nt, Mycobacterium avium subsp. paratuberculosis
cgaccgcggccgcgacgg

SEQ ID NO: 3003169 - RNA, 13 nt, Mycobacterium avium subsp. paratuberculosis
cgaccgcggccug

SEQ ID NO: 3003170 - RNA, 20 nt, Mycobacterium avium subsp. paratuberculosis
cgaccgcggccugggugacc

SEQ ID NO: 3003171 - RNA, 12 nt, Mycobacterium avium subsp. paratuberculosis
cgaccgcggcga

SEQ ID NO: 3003172 - RNA, 15 nt, Mycobacterium avium subsp. paratuberculosis
cgaccgcggcgccga

SEQ ID NO: 3003173 - RNA, 22 nt, Mycobacterium avium subsp. paratuberculosis
cgaccgcggcgccgauggcgaa

SEQ ID NO: 3003174 - RNA, 16 nt, Mycobacterium avium subsp. paratuberculosis
cgaccgcggcuccggc

SEQ ID NO: 3003175 - RNA, 17 nt, Mycobacterium avium subsp. paratuberculosis
cgaccgcggcuccggcc

SEQ ID NO: 3003176 - RNA, 18 nt, Mycobacterium avium subsp. paratuberculosis
cgaccgcggcuccggccg

SEQ ID NO: 3003177 - RNA, 17 nt, Mycobacterium avium subsp. paratuberculosis
cgaccgcggucgcggcg

SEQ ID NO: 3003178 - RNA, 19 nt, Mycobacterium avium subsp. paratuberculosis
cgaccgcguacagggcguc

SEQ ID NO: 3003179 - RNA, 23 nt, Mycobacterium avium subsp. paratuberculosis
cgaccgcguagucguugucggcg

SEQ ID NO: 3003180 - RNA, 19 nt, Mycobacterium avium subsp. paratuberculosis
cgaccgcguccgaggcggu

SEQ ID NO: 3003181 - RNA, 13 nt, Mycobacterium avium subsp. paratuberculosis
cgaccgcgucgac

SEQ ID NO: 3003182 - RNA, 17 nt, Mycobacterium avium subsp. paratuberculosis
cgaccgcgucgacggcg

SEQ ID NO: 3003183 - RNA, 19 nt, Mycobacterium avium subsp. paratuberculosis
cgaccgcgucgacggcgug

SEQ ID NO: 3003184 - RNA, 21 nt, Mycobacterium avium subsp. paratuberculosis
cgaccgcgucgacggcgugga

SEQ ID NO: 3003185 - RNA, 14 nt, Mycobacterium avium subsp. paratuberculosis
cgaccgcgugucgg

SEQ ID NO: 3003186 - RNA, 21 nt, Mycobacterium avium subsp. paratuberculosis
cgaccgcgugucggcacacca

SEQ ID NO: 3003187 - RNA, 23 nt, Mycobacterium avium subsp. paratuberculosis
cgaccggacgaacaucgagccca

SEQ ID NO: 3003188 - RNA, 15 nt, Mycobacterium avium subsp. paratuberculosis
cgaccggagccgucu

SEQ ID NO: 3003189 - RNA, 16 nt, Mycobacterium avium subsp. paratuberculosis
cgaccggaugaugccg

SEQ ID NO: 3003190 - RNA, 16 nt, Mycobacterium avium subsp. paratuberculosis
cgaccggcaccagcag

SEQ ID NO: 3003191 - RNA, 14 nt, Mycobacterium avium subsp. paratuberculosis
cgaccggcagcacc

SEQ ID NO: 3003192 - RNA, 15 nt, Mycobacterium avium subsp. paratuberculosis
cgaccggcagcaccg

SEQ ID NO: 3003193 - RNA, 15 nt, Mycobacterium avium subsp. paratuberculosis
cgaccggcagccgcg

SEQ ID NO: 3003194 - RNA, 17 nt, Mycobacterium avium subsp. paratuberculosis
cgaccggcagccgcgcc

SEQ ID NO: 3003195 - RNA, 21 nt, Mycobacterium avium subsp. paratuberculosis
cgaccggcagccgcgcccacc

SEQ ID NO: 3003196 - RNA, 12 nt, Mycobacterium avium subsp. paratuberculosis
cgaccggccauc

SEQ ID NO: 3003197 - RNA, 20 nt, Mycobacterium avium subsp. paratuberculosis
cgaccggccaucuccugcac

SEQ ID NO: 3003198 - RNA, 24 nt, Mycobacterium avium subsp. paratuberculosis
cgaccggccaucuccugcacgcgc

SEQ ID NO: 3003199 - RNA, 15 nt, Mycobacterium avium subsp. paratuberculosis
cgaccggccccaacg

SEQ ID NO: 3003200 - RNA, 16 nt, Mycobacterium avium subsp. paratuberculosis
cgaccggcccgaacac

SEQ ID NO: 3003201 - RNA, 14 nt, Mycobacterium avium subsp. paratuberculosis
cgaccggcucagcc

SEQ ID NO: 3003202 - RNA, 15 nt, Mycobacterium avium subsp. paratuberculosis
cgaccggcucagccc

SEQ ID NO: 3003203 - RNA, 18 nt, Mycobacterium avium subsp. paratuberculosis
cgaccggcucagcccggc

SEQ ID NO: 3003204 - RNA, 21 nt, Mycobacterium avium subsp. paratuberculosis
cgaccggcucagcccggcgcu

SEQ ID NO: 3003205 - RNA, 23 nt, Mycobacterium avium subsp. paratuberculosis
cgaccggcucagcccggcgcuca

SEQ ID NO: 3003206 - RNA, 18 nt, Mycobacterium avium subsp. paratuberculosis
cgaccggcucucagccgg

SEQ ID NO: 3003207 - RNA, 19 nt, Mycobacterium avium subsp. paratuberculosis
cgaccggcucucagccgga

SEQ ID NO: 3003208 - RNA, 15 nt, Mycobacterium avium subsp. paratuberculosis
cgaccgggcgcuccg

SEQ ID NO: 3003209 - RNA, 17 nt, Mycobacterium avium subsp. paratuberculosis
cgaccgggcgcuccguu

SEQ ID NO: 3003210 - RNA, 18 nt, Mycobacterium avium subsp. paratuberculosis
cgaccggggcgccccgcu

SEQ ID NO: 3003211 - RNA, 15 nt, Mycobacterium avium subsp. paratuberculosis
cgaccgggucugcca

SEQ ID NO: 3003212 - RNA, 19 nt, Mycobacterium avium subsp. paratuberculosis
cgaccgggucugccacgcc

SEQ ID NO: 3003213 - RNA, 15 nt, Mycobacterium avium subsp. paratuberculosis
cgaccgggugaacga

SEQ ID NO: 3003214 - RNA, 18 nt, Mycobacterium avium subsp. paratuberculosis
cgaccgggugaacgaggc

SEQ ID NO: 3003215 - RNA, 22 nt, Mycobacterium avium subsp. paratuberculosis
cgaccgggugaacgaggccgcg

SEQ ID NO: 3003216 - RNA, 13 nt, Mycobacterium avium subsp. paratuberculosis
cgaccggguuggc

SEQ ID NO: 3003217 - RNA, 15 nt, Mycobacterium avium subsp. paratuberculosis
cgaccgguccgccgc

SEQ ID NO: 3003218 - RNA, 17 nt, Mycobacterium avium subsp. paratuberculosis
cgaccgguccgccgccg

SEQ ID NO: 3003219 - RNA, 20 nt, Mycobacterium avium subsp. paratuberculosis
cgaccgguccgccgccggcg

SEQ ID NO: 3003220 - RNA, 19 nt, Mycobacterium avium subsp. paratuberculosis
cgaccgguccgcgguucga

SEQ ID NO: 3003221 - RNA, 19 nt, Mycobacterium avium subsp. paratuberculosis
cgaccggucucgaccgcgg

SEQ ID NO: 3003222 - RNA, 22 nt, Mycobacterium avium subsp. paratuberculosis
cgaccggucucgaccgcggcgc

SEQ ID NO: 3003223 - RNA, 24 nt, Mycobacterium avium subsp. paratuberculosis
cgaccggucucgaccgcggcgccg

SEQ ID NO: 3003224 - RNA, 15 nt, Mycobacterium avium subsp. paratuberculosis
cgaccgguugcccgg

SEQ ID NO: 3003225 - RNA, 18 nt, Mycobacterium avium subsp. paratuberculosis
cgaccguagccggucggc

SEQ ID NO: 3003226 - RNA, 19 nt, Mycobacterium avium subsp. paratuberculosis
cgaccguagccggucggcc

SEQ ID NO: 3003227 - RNA, 22 nt, Mycobacterium avium subsp. paratuberculosis
cgaccguagccggucggcccgc

SEQ ID NO: 3003228 - RNA, 16 nt, Mycobacterium avium subsp. paratuberculosis
cgaccgucacgcuggc

SEQ ID NO: 3003229 - RNA, 17 nt, Mycobacterium avium subsp. paratuberculosis
cgaccgucagcagggcc

SEQ ID NO: 3003230 - RNA, 23 nt, Mycobacterium avium subsp. paratuberculosis
cgaccgucagcagggccucgccg

SEQ ID NO: 3003231 - RNA, 20 nt, Mycobacterium avium subsp. paratuberculosis
cgaccgucgggacggccagc

SEQ ID NO: 3003232 - RNA, 15 nt, Mycobacterium avium subsp. paratuberculosis
cgaccgucuucuuca

SEQ ID NO: 3003233 - RNA, 22 nt, Mycobacterium avium subsp. paratuberculosis
cgaccgucuucuucagccgcag

SEQ ID NO: 3003234 - RNA, 17 nt, Mycobacterium avium subsp. paratuberculosis
cgaccgugaggcccggc

SEQ ID NO: 3003235 - RNA, 15 nt, Mycobacterium avium subsp. paratuberculosis
cgaccgugcccacca

SEQ ID NO: 3003236 - RNA, 18 nt, Mycobacterium avium subsp. paratuberculosis
cgaccgugcccaccagcc

SEQ ID NO: 3003237 - RNA, 19 nt, Mycobacterium avium subsp. paratuberculosis
cgaccgugcccaccagccg

SEQ ID NO: 3003238 - RNA, 22 nt, Mycobacterium avium subsp. paratuberculosis
cgaccgugcccaccagccggcc

SEQ ID NO: 3003239 - RNA, 23 nt, Mycobacterium avium subsp. paratuberculosis
cgaccgugcccaccagccggccg

SEQ ID NO: 3003240 - RNA, 17 nt, Mycobacterium avium subsp. paratuberculosis
cgaccguugaccgacgc

SEQ ID NO: 3003241 - RNA, 14 nt, Mycobacterium avium subsp. paratuberculosis
cgaccuccacccgc

SEQ ID NO: 3003242 - RNA, 23 nt, Mycobacterium avium subsp. paratuberculosis
cgaccuccacccgcuccucgcag

SEQ ID NO: 3003243 - RNA, 15 nt, Mycobacterium avium subsp. paratuberculosis
cgaccucccccgacg

SEQ ID NO: 3003244 - RNA, 21 nt, Mycobacterium avium subsp. paratuberculosis
cgaccucccccgacgccgaca

SEQ ID NO: 3003245 - RNA, 22 nt, Mycobacterium avium subsp. paratuberculosis
cgaccucccccgacgccgacac

SEQ ID NO: 3003246 - RNA, 16 nt, Mycobacterium avium subsp. paratuberculosis
cgaccuccucgacccc

SEQ ID NO: 3003247 - RNA, 23 nt, Mycobacterium avium subsp. paratuberculosis
cgaccuccucgaccccgaaggcg

SEQ ID NO: 3003248 - RNA, 22 nt, Mycobacterium avium subsp. paratuberculosis
cgaccuccugcaaggcccccgc

SEQ ID NO: 3003249 - RNA, 24 nt, Mycobacterium avium subsp. paratuberculosis
cgaccucgaacacaucguggcgca

SEQ ID NO: 3003250 - RNA, 23 nt, Mycobacterium avium subsp. paratuberculosis
cgaccucgaagaagagggcguga

SEQ ID NO: 3003251 - RNA, 23 nt, Mycobacterium avium subsp. paratuberculosis
cgaccucgagcgucacgcuggcg

SEQ ID NO: 3003252 - RNA, 12 nt, Mycobacterium avium subsp. paratuberculosis
cgaccucgaggc

SEQ ID NO: 3003253 - RNA, 14 nt, Mycobacterium avium subsp. paratuberculosis
cgaccucgaugcgc

SEQ ID NO: 3003254 - RNA, 19 nt, Mycobacterium avium subsp. paratuberculosis
cgaccucgaugcgcagggc

SEQ ID NO: 3003255 - RNA, 21 nt, Mycobacterium avium subsp. paratuberculosis
cgaccucgaugcgcagggcgg

SEQ ID NO: 3003256 - RNA, 16 nt, Mycobacterium avium subsp. paratuberculosis
cgaccucgcccgccgc

SEQ ID NO: 3003257 - RNA, 17 nt, Mycobacterium avium subsp. paratuberculosis
cgaccucgcccgccgcg

SEQ ID NO: 3003258 - RNA, 12 nt, Mycobacterium avium subsp. paratuberculosis
cgaccucgccga

SEQ ID NO: 3003259 - RNA, 22 nt, Mycobacterium avium subsp. paratuberculosis
cgaccucgccgacgucccagca

SEQ ID NO: 3003260 - RNA, 13 nt, Mycobacterium avium subsp. paratuberculosis
cgaccucgcgcgu

SEQ ID NO: 3003261 - RNA, 14 nt, Mycobacterium avium subsp. paratuberculosis
cgaccucgcgcguc

SEQ ID NO: 3003262 - RNA, 23 nt, Mycobacterium avium subsp. paratuberculosis
cgaccucgcgcgucacgcuggcg

SEQ ID NO: 3003263 - RNA, 14 nt, Mycobacterium avium subsp. paratuberculosis
cgaccucggccacc

SEQ ID NO: 3003264 - RNA, 15 nt, Mycobacterium avium subsp. paratuberculosis
cgaccucggccacca

SEQ ID NO: 3003265 - RNA, 17 nt, Mycobacterium avium subsp. paratuberculosis
cgaccucggccaccacc

SEQ ID NO: 3003266 - RNA, 18 nt, Mycobacterium avium subsp. paratuberculosis
cgaccucggccagcgugu

SEQ ID NO: 3003267 - RNA, 14 nt, Mycobacterium avium subsp. paratuberculosis
cgaccucggcgacc

SEQ ID NO: 3003268 - RNA, 15 nt, Mycobacterium avium subsp. paratuberculosis
cgaccucggcgacca

SEQ ID NO: 3003269 - RNA, 17 nt, Mycobacterium avium subsp. paratuberculosis
cgaccucggcgaccagc

SEQ ID NO: 3003270 - RNA, 19 nt, Mycobacterium avium subsp. paratuberculosis
cgaccucggcgaccagcga

SEQ ID NO: 3003271 - RNA, 17 nt, Mycobacterium avium subsp. paratuberculosis
cgaccucggcggccagc

SEQ ID NO: 3003272 - RNA, 14 nt, Mycobacterium avium subsp. paratuberculosis
cgaccucggggaug

SEQ ID NO: 3003273 - RNA, 20 nt, Mycobacterium avium subsp. paratuberculosis
cgaccucggggucggccgga

SEQ ID NO: 3003274 - RNA, 17 nt, Mycobacterium avium subsp. paratuberculosis
cgaccucggguguaggc

SEQ ID NO: 3003275 - RNA, 23 nt, Mycobacterium avium subsp. paratuberculosis
cgaccucggguguaggcccgauc

SEQ ID NO: 3003276 - RNA, 14 nt, Mycobacterium avium subsp. paratuberculosis
cgaccucggugaug

SEQ ID NO: 3003277 - RNA, 14 nt, Mycobacterium avium subsp. paratuberculosis
cgaccucgguggug

SEQ ID NO: 3003278 - RNA, 18 nt, Mycobacterium avium subsp. paratuberculosis
cgaccucgguggugcuga

SEQ ID NO: 3003279 - RNA, 14 nt, Mycobacterium avium subsp. paratuberculosis
cgaccucgucgacg

SEQ ID NO: 3003280 - RNA, 15 nt, Mycobacterium avium subsp. paratuberculosis
cgaccucgucgacgg

SEQ ID NO: 3003281 - RNA, 18 nt, Mycobacterium avium subsp. paratuberculosis
cgaccucgucgacggcgg

SEQ ID NO: 3003282 - RNA, 20 nt, Mycobacterium avium subsp. paratuberculosis
cgaccucgucgacggcggcg

SEQ ID NO: 3003283 - RNA, 23 nt, Mycobacterium avium subsp. paratuberculosis
cgaccucgucgacggcggcgucc

SEQ ID NO: 3003284 - RNA, 17 nt, Mycobacterium avium subsp. paratuberculosis
cgaccucgucggcggcg

SEQ ID NO: 3003285 - RNA, 18 nt, Mycobacterium avium subsp. paratuberculosis
cgaccucgucggcggcga

SEQ ID NO: 3003286 - RNA, 20 nt, Mycobacterium avium subsp. paratuberculosis
cgaccucgucggcggcgacg

SEQ ID NO: 3003287 - RNA, 21 nt, Mycobacterium avium subsp. paratuberculosis
cgaccucgucggcggcgacgg

SEQ ID NO: 3003288 - RNA, 22 nt, Mycobacterium avium subsp. paratuberculosis
cgaccucgucggcggcgacggc

SEQ ID NO: 3003289 - RNA, 17 nt, Mycobacterium avium subsp. paratuberculosis
cgaccucgucggcggug

SEQ ID NO: 3003290 - RNA, 19 nt, Mycobacterium avium subsp. paratuberculosis
cgaccucgucggcggugcc

SEQ ID NO: 3003291 - RNA, 21 nt, Mycobacterium avium subsp. paratuberculosis
cgaccucgucggcggugccga

SEQ ID NO: 3003292 - RNA, 23 nt, Mycobacterium avium subsp. paratuberculosis
cgaccucuucgcuggacagccac

SEQ ID NO: 3003293 - RNA, 17 nt, Mycobacterium avium subsp. paratuberculosis
cgaccucuucggcgccg

SEQ ID NO: 3003294 - RNA, 22 nt, Mycobacterium avium subsp. paratuberculosis
cgaccucuucggcgccggcauc

SEQ ID NO: 3003295 - RNA, 23 nt, Mycobacterium avium subsp. paratuberculosis
cgaccucuucggcgccggcaucc

SEQ ID NO: 3003296 - RNA, 17 nt, Mycobacterium avium subsp. paratuberculosis
cgaccugaacgcgcagu

SEQ ID NO: 3003297 - RNA, 21 nt, Mycobacterium avium subsp. paratuberculosis
cgaccugaacgcgcaguggac

SEQ ID NO: 3003298 - RNA, 22 nt, Mycobacterium avium subsp. paratuberculosis
cgaccugauuucaucgcggcga

SEQ ID NO: 3003299 - RNA, 16 nt, Mycobacterium avium subsp. paratuberculosis
cgaccugcaucucgac

SEQ ID NO: 3003300 - RNA, 20 nt, Mycobacterium avium subsp. paratuberculosis
cgaccugcaucucgacccgg

SEQ ID NO: 3003301 - RNA, 22 nt, Mycobacterium avium subsp. paratuberculosis
cgaccugcaucucgacccgggc

SEQ ID NO: 3003302 - RNA, 13 nt, Mycobacterium avium subsp. paratuberculosis
cgaccugcccggg

SEQ ID NO: 3003303 - RNA, 14 nt, Mycobacterium avium subsp. paratuberculosis
cgaccugcccgggc

SEQ ID NO: 3003304 - RNA, 15 nt, Mycobacterium avium subsp. paratuberculosis
cgaccugcccgggcc

SEQ ID NO: 3003305 - RNA, 20 nt, Mycobacterium avium subsp. paratuberculosis
cgaccugcgcgacggcgcug

SEQ ID NO: 3003306 - RNA, 18 nt, Mycobacterium avium subsp. paratuberculosis
cgaccugcggcucgucgg

SEQ ID NO: 3003307 - RNA, 21 nt, Mycobacterium avium subsp. paratuberculosis
cgaccugcggcucgucggcga

SEQ ID NO: 3003308 - RNA, 12 nt, Mycobacterium avium subsp. paratuberculosis
cgaccugcgggc

SEQ ID NO: 3003309 - RNA, 20 nt, Mycobacterium avium subsp. paratuberculosis
cgaccugcgggcccaccgcg

SEQ ID NO: 3003310 - RNA, 21 nt, Mycobacterium avium subsp. paratuberculosis
cgaccugcgggcccaccgcgc

SEQ ID NO: 3003311 - RNA, 15 nt, Mycobacterium avium subsp. paratuberculosis
cgaccugcgggugca

SEQ ID NO: 3003312 - RNA, 16 nt, Mycobacterium avium subsp. paratuberculosis
cgaccugcucgucggu

SEQ ID NO: 3003313 - RNA, 17 nt, Mycobacterium avium subsp. paratuberculosis
cgaccugcucgucggug

SEQ ID NO: 3003314 - RNA, 18 nt, Mycobacterium avium subsp. paratuberculosis
cgaccugcucgucgguga

SEQ ID NO: 3003315 - RNA, 20 nt, Mycobacterium avium subsp. paratuberculosis
cgaccugcuuggcggccugc

SEQ ID NO: 3003316 - RNA, 22 nt, Mycobacterium avium subsp. paratuberculosis
cgaccugcuuggcggccugcgc

SEQ ID NO: 3003317 - RNA, 15 nt, Mycobacterium avium subsp. paratuberculosis
cgaccuggacgccgc

SEQ ID NO: 3003318 - RNA, 21 nt, Mycobacterium avium subsp. paratuberculosis
cgaccuggacgccgcacgcga

SEQ ID NO: 3003319 - RNA, 14 nt, Mycobacterium avium subsp. paratuberculosis
cgaccuggcggccg

SEQ ID NO: 3003320 - RNA, 16 nt, Mycobacterium avium subsp. paratuberculosis
cgaccuggcgggccag

SEQ ID NO: 3003321 - RNA, 20 nt, Mycobacterium avium subsp. paratuberculosis
cgaccugggcgccgucgccg

SEQ ID NO: 3003322 - RNA, 23 nt, Mycobacterium avium subsp. paratuberculosis
cgaccugggcgccgucgccgacg

SEQ ID NO: 3003323 - RNA, 15 nt, Mycobacterium avium subsp. paratuberculosis
cgaccugggcggcca

SEQ ID NO: 3003324 - RNA, 17 nt, Mycobacterium avium subsp. paratuberculosis
cgaccugggcggccacc

SEQ ID NO: 3003325 - RNA, 19 nt, Mycobacterium avium subsp. paratuberculosis
cgaccugggcggccaccgc

SEQ ID NO: 3003326 - RNA, 20 nt, Mycobacterium avium subsp. paratuberculosis
cgaccugggucaucaccuug

SEQ ID NO: 3003327 - RNA, 17 nt, Mycobacterium avium subsp. paratuberculosis
cgaccugguccaccgcg

SEQ ID NO: 3003328 - RNA, 19 nt, Mycobacterium avium subsp. paratuberculosis
cgaccugguccaccgcggc

SEQ ID NO: 3003329 - RNA, 20 nt, Mycobacterium avium subsp. paratuberculosis
cgaccugguccaccgcggcg

SEQ ID NO: 3003330 - RNA, 18 nt, Mycobacterium avium subsp. paratuberculosis
cgaccuggucgccgaacg

SEQ ID NO: 3003331 - RNA, 21 nt, Mycobacterium avium subsp. paratuberculosis
cgaccuggucgccgccgucca

SEQ ID NO: 3003332 - RNA, 19 nt, Mycobacterium avium subsp. paratuberculosis
cgaccugguugacaccacc

SEQ ID NO: 3003333 - RNA, 21 nt, Mycobacterium avium subsp. paratuberculosis
cgaccugguugacaccaccga

SEQ ID NO: 3003334 - RNA, 19 nt, Mycobacterium avium subsp. paratuberculosis
cgaccuguccgaucaccgu

SEQ ID NO: 3003335 - RNA, 20 nt, Mycobacterium avium subsp. paratuberculosis
cgaccuguuuggccagccag

SEQ ID NO: 3003336 - RNA, 13 nt, Mycobacterium avium subsp. paratuberculosis
cgaccuucgagcc

SEQ ID NO: 3003337 - RNA, 18 nt, Mycobacterium avium subsp. paratuberculosis
cgaccuucgagccgccgc

SEQ ID NO: 3003338 - RNA, 21 nt, Mycobacterium avium subsp. paratuberculosis
cgaccuucggagacguggcgg

SEQ ID NO: 3003339 - RNA, 18 nt, Mycobacterium avium subsp. paratuberculosis
cgaccuucugcugcacgu

SEQ ID NO: 3003340 - RNA, 20 nt, Mycobacterium avium subsp. paratuberculosis
cgaccuucugcugcacgucc

SEQ ID NO: 3003341 - RNA, 18 nt, Mycobacterium avium subsp. paratuberculosis
cgaccuugcagcccgcgu

SEQ ID NO: 3003342 - RNA, 21 nt, Mycobacterium avium subsp. paratuberculosis
cgaccuugcagcccgcgucca

SEQ ID NO: 3003343 - RNA, 16 nt, Mycobacterium avium subsp. paratuberculosis
cgaccuugcgcagccg

SEQ ID NO: 3003344 - RNA, 20 nt, Mycobacterium avium subsp. paratuberculosis
cgaccuugcgcagccggcag

SEQ ID NO: 3003345 - RNA, 18 nt, Mycobacterium avium subsp. paratuberculosis
cgaccuuggggucaccgu

SEQ ID NO: 3003346 - RNA, 22 nt, Mycobacterium avium subsp. paratuberculosis
cgaccuugucgcgcacccgcac

SEQ ID NO: 3003347 - RNA, 16 nt, Mycobacterium avium subsp. paratuberculosis
cgaccuuuugcccggc

SEQ ID NO: 3003348 - RNA, 21 nt, Mycobacterium avium subsp. paratuberculosis
cgaccuuuugcccggcgaugg

SEQ ID NO: 3003349 - RNA, 16 nt, Mycobacterium avium subsp. paratuberculosis
cgacgaaaucgucggg

SEQ ID NO: 3003350 - RNA, 18 nt, Mycobacterium avium subsp. paratuberculosis
cgacgaaaucgucgggca

SEQ ID NO: 3003351 - RNA, 20 nt, Mycobacterium avium subsp. paratuberculosis
cgacgaaaucgucgggcacc

SEQ ID NO: 3003352 - RNA, 18 nt, Mycobacterium avium subsp. paratuberculosis
cgacgaaaucgucgggcc

SEQ ID NO: 3003353 - RNA, 19 nt, Mycobacterium avium subsp. paratuberculosis
cgacgaaaucgucgggccg

SEQ ID NO: 3003354 - RNA, 20 nt, Mycobacterium avium subsp. paratuberculosis
cgacgaaaucgucgggccgg

SEQ ID NO: 3003355 - RNA, 13 nt, Mycobacterium avium subsp. paratuberculosis
cgacgaacaccac

SEQ ID NO: 3003356 - RNA, 14 nt, Mycobacterium avium subsp. paratuberculosis
cgacgaacaccacc

SEQ ID NO: 3003357 - RNA, 15 nt, Mycobacterium avium subsp. paratuberculosis
cgacgaacaccaccg

SEQ ID NO: 3003358 - RNA, 17 nt, Mycobacterium avium subsp. paratuberculosis
cgacgaacaccaccggc

SEQ ID NO: 3003359 - RNA, 18 nt, Mycobacterium avium subsp. paratuberculosis
cgacgaacagcaccgcca

SEQ ID NO: 3003360 - RNA, 22 nt, Mycobacterium avium subsp. paratuberculosis
cgacgaacagcaccgccacggc

SEQ ID NO: 3003361 - RNA, 17 nt, Mycobacterium avium subsp. paratuberculosis
cgacgaaccgccacacg

SEQ ID NO: 3003362 - RNA, 21 nt, Mycobacterium avium subsp. paratuberculosis
cgacgaaccgugcacgaucgc

SEQ ID NO: 3003363 - RNA, 13 nt, Mycobacterium avium subsp. paratuberculosis
cgacgaacgccgg

SEQ ID NO: 3003364 - RNA, 20 nt, Mycobacterium avium subsp. paratuberculosis
cgacgaacgccggcaucagc

SEQ ID NO: 3003365 - RNA, 14 nt, Mycobacterium avium subsp. paratuberculosis
cgacgaacgcggcg

SEQ ID NO: 3003366 - RNA, 20 nt, Mycobacterium avium subsp. paratuberculosis
cgacgaacgcggcggaggcc

SEQ ID NO: 3003367 - RNA, 14 nt, Mycobacterium avium subsp. paratuberculosis
cgacgaacgcggug

SEQ ID NO: 3003368 - RNA, 20 nt, Mycobacterium avium subsp. paratuberculosis
cgacgaacgcuuccagcacc

SEQ ID NO: 3003369 - RNA, 22 nt, Mycobacterium avium subsp. paratuberculosis
cgacgaacuccgagccggugga

SEQ ID NO: 3003370 - RNA, 19 nt, Mycobacterium avium subsp. paratuberculosis
cgacgaacuccgcgcgcgg

SEQ ID NO: 3003371 - RNA, 14 nt, Mycobacterium avium subsp. paratuberculosis
cgacgaacugccgu

SEQ ID NO: 3003372 - RNA, 18 nt, Mycobacterium avium subsp. paratuberculosis
cgacgaagaucccgcugg

SEQ ID NO: 3003373 - RNA, 21 nt, Mycobacterium avium subsp. paratuberculosis
cgacgaagaucccgcuggcca

SEQ ID NO: 3003374 - RNA, 17 nt, Mycobacterium avium subsp. paratuberculosis
cgacgaagaugcgcccg

SEQ ID NO: 3003375 - RNA, 23 nt, Mycobacterium avium subsp. paratuberculosis
cgacgaagauggcgugccacagc

SEQ ID NO: 3003376 - RNA, 16 nt, Mycobacterium avium subsp. paratuberculosis
cgacgaagcagcucgc

SEQ ID NO: 3003377 - RNA, 13 nt, Mycobacterium avium subsp. paratuberculosis
cgacgaagccgcc

SEQ ID NO: 3003378 - RNA, 21 nt, Mycobacterium avium subsp. paratuberculosis
cgacgaagccgccgcccucgg

SEQ ID NO: 3003379 - RNA, 13 nt, Mycobacterium avium subsp. paratuberculosis
cgacgaagccggu

SEQ ID NO: 3003380 - RNA, 15 nt, Mycobacterium avium subsp. paratuberculosis
cgacgaagcggucgc

SEQ ID NO: 3003381 - RNA, 17 nt, Mycobacterium avium subsp. paratuberculosis
cgacgaagcggucgcgg

SEQ ID NO: 3003382 - RNA, 14 nt, Mycobacterium avium subsp. paratuberculosis
cgacgaagucgacg

SEQ ID NO: 3003383 - RNA, 15 nt, Mycobacterium avium subsp. paratuberculosis
cgacgaagucgacgg

SEQ ID NO: 3003384 - RNA, 16 nt, Mycobacterium avium subsp. paratuberculosis
cgacgaagucgacggc

SEQ ID NO: 3003385 - RNA, 18 nt, Mycobacterium avium subsp. paratuberculosis
cgacgaagucgacggcgg

SEQ ID NO: 3003386 - RNA, 19 nt, Mycobacterium avium subsp. paratuberculosis
cgacgaagucgacggcggu

SEQ ID NO: 3003387 - RNA, 22 nt, Mycobacterium avium subsp. paratuberculosis
cgacgaagucggucagcgucgc

SEQ ID NO: 3003388 - RNA, 24 nt, Mycobacterium avium subsp. paratuberculosis
cgacgaagucggucagcgucgccg

SEQ ID NO: 3003389 - RNA, 14 nt, Mycobacterium avium subsp. paratuberculosis
cgacgaaucccgcc

SEQ ID NO: 3003390 - RNA, 15 nt, Mycobacterium avium subsp. paratuberculosis
cgacgaauccgguga

SEQ ID NO: 3003391 - RNA, 20 nt, Mycobacterium avium subsp. paratuberculosis
cgacgacacccuucaucagc

SEQ ID NO: 3003392 - RNA, 23 nt, Mycobacterium avium subsp. paratuberculosis
cgacgacacccuucaucagcacc

SEQ ID NO: 3003393 - RNA, 19 nt, Mycobacterium avium subsp. paratuberculosis
cgacgacaggucgagcacc

SEQ ID NO: 3003394 - RNA, 13 nt, Mycobacterium avium subsp. paratuberculosis
cgacgaccaccag

SEQ ID NO: 3003395 - RNA, 19 nt, Mycobacterium avium subsp. paratuberculosis
cgacgaccaccaggagcac

SEQ ID NO: 3003396 - RNA, 23 nt, Mycobacterium avium subsp. paratuberculosis
cgacgaccaccaggagcaccugc

SEQ ID NO: 3003397 - RNA, 15 nt, Mycobacterium avium subsp. paratuberculosis
cgacgaccaucagcg

SEQ ID NO: 3003398 - RNA, 20 nt, Mycobacterium avium subsp. paratuberculosis
cgacgaccaucagcgcccgg

SEQ ID NO: 3003399 - RNA, 14 nt, Mycobacterium avium subsp. paratuberculosis
cgacgacccguagg

SEQ ID NO: 3003400 - RNA, 22 nt, Mycobacterium avium subsp. paratuberculosis
cgacgaccgcaccgaccagcgg

SEQ ID NO: 3003401 - RNA, 18 nt, Mycobacterium avium subsp. paratuberculosis
cgacgaccgcgacggcgc

SEQ ID NO: 3003402 - RNA, 21 nt, Mycobacterium avium subsp. paratuberculosis
cgacgaccgcgacggcgcccg

SEQ ID NO: 3003403 - RNA, 15 nt, Mycobacterium avium subsp. paratuberculosis
cgacgaccgcguccg

SEQ ID NO: 3003404 - RNA, 14 nt, Mycobacterium avium subsp. paratuberculosis
cgacgaccgucauc

SEQ ID NO: 3003405 - RNA, 18 nt, Mycobacterium avium subsp. paratuberculosis
cgacgaccucccccgacg

SEQ ID NO: 3003406 - RNA, 19 nt, Mycobacterium avium subsp. paratuberculosis
cgacgaccucccccgacgc

SEQ ID NO: 3003407 - RNA, 20 nt, Mycobacterium avium subsp. paratuberculosis
cgacgaccucccccgacgcc

SEQ ID NO: 3003408 - RNA, 22 nt, Mycobacterium avium subsp. paratuberculosis
cgacgaccucccccgacgccga

SEQ ID NO: 3003409 - RNA, 20 nt, Mycobacterium avium subsp. paratuberculosis
cgacgaccucgcccgccgcg

SEQ ID NO: 3003410 - RNA, 15 nt, Mycobacterium avium subsp. paratuberculosis
cgacgaccucgccga

SEQ ID NO: 3003411 - RNA, 16 nt, Mycobacterium avium subsp. paratuberculosis
cgacgaccucgccgac

SEQ ID NO: 3003412 - RNA, 17 nt, Mycobacterium avium subsp. paratuberculosis
cgacgaccucgucgucg

SEQ ID NO: 3003413 - RNA, 19 nt, Mycobacterium avium subsp. paratuberculosis
cgacgacgaaucccgccuc

SEQ ID NO: 3003414 - RNA, 13 nt, Mycobacterium avium subsp. paratuberculosis
cgacgacgccagc

SEQ ID NO: 3003415 - RNA, 15 nt, Mycobacterium avium subsp. paratuberculosis
cgacgacgccagcug

SEQ ID NO: 3003416 - RNA, 12 nt, Mycobacterium avium subsp. paratuberculosis
cgacgacgccga

SEQ ID NO: 3003417 - RNA, 13 nt, Mycobacterium avium subsp. paratuberculosis
cgacgacgccgau

SEQ ID NO: 3003418 - RNA, 14 nt, Mycobacterium avium subsp. paratuberculosis
cgacgacgccgauc

SEQ ID NO: 3003419 - RNA, 12 nt, Mycobacterium avium subsp. paratuberculosis
cgacgacgccgu

SEQ ID NO: 3003420 - RNA, 15 nt, Mycobacterium avium subsp. paratuberculosis
cgacgacgcggucgu

SEQ ID NO: 3003421 - RNA, 20 nt, Mycobacterium avium subsp. paratuberculosis
cgacgacgcggucgucgucg

SEQ ID NO: 3003422 - RNA, 19 nt, Mycobacterium avium subsp. paratuberculosis
cgacgacggcgaacgucga

SEQ ID NO: 3003423 - RNA, 12 nt, Mycobacterium avium subsp. paratuberculosis
cgacgacggcgc

SEQ ID NO: 3003424 - RNA, 13 nt, Mycobacterium avium subsp. paratuberculosis
cgacgacggcgcc

SEQ ID NO: 3003425 - RNA, 14 nt, Mycobacterium avium subsp. paratuberculosis
cgacgacggcgccg

SEQ ID NO: 3003426 - RNA, 15 nt, Mycobacterium avium subsp. paratuberculosis
cgacgacggcgccgc

SEQ ID NO: 3003427 - RNA, 18 nt, Mycobacterium avium subsp. paratuberculosis
cgacgacggcgccgcguc

SEQ ID NO: 3003428 - RNA, 23 nt, Mycobacterium avium subsp. paratuberculosis
cgacgacggcgccgcgucggacc

SEQ ID NO: 3003429 - RNA, 19 nt, Mycobacterium avium subsp. paratuberculosis
cgacgacggucuucccgcc

SEQ ID NO: 3003430 - RNA, 21 nt, Mycobacterium avium subsp. paratuberculosis
cgacgacggucuucccgccgc

SEQ ID NO: 3003431 - RNA, 22 nt, Mycobacterium avium subsp. paratuberculosis
cgacgacggucuucccgccgcc

SEQ ID NO: 3003432 - RNA, 17 nt, Mycobacterium avium subsp. paratuberculosis
cgacgacgucgacgacc

SEQ ID NO: 3003433 - RNA, 16 nt, Mycobacterium avium subsp. paratuberculosis
cgacgacgucgcgcag

SEQ ID NO: 3003434 - RNA, 13 nt, Mycobacterium avium subsp. paratuberculosis
cgacgacgucguc

SEQ ID NO: 3003435 - RNA, 14 nt, Mycobacterium avium subsp. paratuberculosis
cgacgacgucgucg

SEQ ID NO: 3003436 - RNA, 18 nt, Mycobacterium avium subsp. paratuberculosis
cgacgacguugcgggcca

SEQ ID NO: 3003437 - RNA, 21 nt, Mycobacterium avium subsp. paratuberculosis
cgacgacguugcgggccaggu

SEQ ID NO: 3003438 - RNA, 23 nt, Mycobacterium avium subsp. paratuberculosis
cgacgacguugcgggccaggucg

SEQ ID NO: 3003439 - RNA, 21 nt, Mycobacterium avium subsp. paratuberculosis
cgacgacugggugcgcgggcg

SEQ ID NO: 3003440 - RNA, 18 nt, Mycobacterium avium subsp. paratuberculosis
cgacgacuucggccucgg

SEQ ID NO: 3003441 - RNA, 16 nt, Mycobacterium avium subsp. paratuberculosis
cgacgagagcggaucg

SEQ ID NO: 3003442 - RNA, 17 nt, Mycobacterium avium subsp. paratuberculosis
cgacgagagcggaucgg

SEQ ID NO: 3003443 - RNA, 19 nt, Mycobacterium avium subsp. paratuberculosis
cgacgagagcggaucggcg

SEQ ID NO: 3003444 - RNA, 23 nt, Mycobacterium avium subsp. paratuberculosis
cgacgagagcggaucggcggcga

SEQ ID NO: 3003445 - RNA, 17 nt, Mycobacterium avium subsp. paratuberculosis
cgacgagaucagcacca

SEQ ID NO: 3003446 - RNA, 19 nt, Mycobacterium avium subsp. paratuberculosis
cgacgagaucagcaccagg

SEQ ID NO: 3003447 - RNA, 21 nt, Mycobacterium avium subsp. paratuberculosis
cgacgagcaggcugaucucgg

SEQ ID NO: 3003448 - RNA, 14 nt, Mycobacterium avium subsp. paratuberculosis
cgacgagcccgccg

SEQ ID NO: 3003449 - RNA, 15 nt, Mycobacterium avium subsp. paratuberculosis
cgacgagcccgccgg

SEQ ID NO: 3003450 - RNA, 19 nt, Mycobacterium avium subsp. paratuberculosis
cgacgagcccgccggcggg

SEQ ID NO: 3003451 - RNA, 22 nt, Mycobacterium avium subsp. paratuberculosis
cgacgagcccgccggcggguug

SEQ ID NO: 3003452 - RNA, 13 nt, Mycobacterium avium subsp. paratuberculosis
cgacgagcccgcg

SEQ ID NO: 3003453 - RNA, 14 nt, Mycobacterium avium subsp. paratuberculosis
cgacgagcccgcgc

SEQ ID NO: 3003454 - RNA, 15 nt, Mycobacterium avium subsp. paratuberculosis
cgacgagcccgcgcc

SEQ ID NO: 3003455 - RNA, 13 nt, Mycobacterium avium subsp. paratuberculosis
cgacgagccgacg

SEQ ID NO: 3003456 - RNA, 14 nt, Mycobacterium avium subsp. paratuberculosis
cgacgagccgacgu

SEQ ID NO: 3003457 - RNA, 20 nt, Mycobacterium avium subsp. paratuberculosis
cgacgagccgacguaaccgu

SEQ ID NO: 3003458 - RNA, 14 nt, Mycobacterium avium subsp. paratuberculosis
cgacgagccgggcc

SEQ ID NO: 3003459 - RNA, 15 nt, Mycobacterium avium subsp. paratuberculosis
cgacgagccgggcca

SEQ ID NO: 3003460 - RNA, 13 nt, Mycobacterium avium subsp. paratuberculosis
cgacgagccgucg

SEQ ID NO: 3003461 - RNA, 15 nt, Mycobacterium avium subsp. paratuberculosis
cgacgagcgggccga

SEQ ID NO: 3003462 - RNA, 18 nt, Mycobacterium avium subsp. paratuberculosis
cgacgagcgggccgauca

SEQ ID NO: 3003463 - RNA, 16 nt, Mycobacterium avium subsp. paratuberculosis
cgacgagcucgccgcu

SEQ ID NO: 3003464 - RNA, 17 nt, Mycobacterium avium subsp. paratuberculosis
cgacgagcucgccgcug

SEQ ID NO: 3003465 - RNA, 14 nt, Mycobacterium avium subsp. paratuberculosis
cgacgaggcgggcg

SEQ ID NO: 3003466 - RNA, 18 nt, Mycobacterium avium subsp. paratuberculosis
cgacgaggcgggcgaucu

SEQ ID NO: 3003467 - RNA, 19 nt, Mycobacterium avium subsp. paratuberculosis
cgacgaggcgggcgaucuc

SEQ ID NO: 3003468 - RNA, 16 nt, Mycobacterium avium subsp. paratuberculosis
cgacgaggugaugccg

SEQ ID NO: 3003469 - RNA, 21 nt, Mycobacterium avium subsp. paratuberculosis
cgacgaggugaugccguccag

SEQ ID NO: 3003470 - RNA, 22 nt, Mycobacterium avium subsp. paratuberculosis
cgacgaggugaugccguccagc

SEQ ID NO: 3003471 - RNA, 21 nt, Mycobacterium avium subsp. paratuberculosis
cgacgagguugucccgggcga

SEQ ID NO: 3003472 - RNA, 19 nt, Mycobacterium avium subsp. paratuberculosis
cgacgaguuccucgugcgu

SEQ ID NO: 3003473 - RNA, 20 nt, Mycobacterium avium subsp. paratuberculosis
cgacgauacgugcucccgcc

SEQ ID NO: 3003474 - RNA, 23 nt, Mycobacterium avium subsp. paratuberculosis
cgacgauacgugcucccgccgag

SEQ ID NO: 3003475 - RNA, 18 nt, Mycobacterium avium subsp. paratuberculosis
cgacgauaucggccgcgg

SEQ ID NO: 3003476 - RNA, 21 nt, Mycobacterium avium subsp. paratuberculosis
cgacgauaucggccgcggggc

SEQ ID NO: 3003477 - RNA, 15 nt, Mycobacterium avium subsp. paratuberculosis
cgacgaucagcacgu

SEQ ID NO: 3003478 - RNA, 21 nt, Mycobacterium avium subsp. paratuberculosis
cgacgaucagcacgucgcggc

SEQ ID NO: 3003479 - RNA, 16 nt, Mycobacterium avium subsp. paratuberculosis
cgacgaucagcagccg

SEQ ID NO: 3003480 - RNA, 19 nt, Mycobacterium avium subsp. paratuberculosis
cgacgaucagcagccgggc

SEQ ID NO: 3003481 - RNA, 15 nt, Mycobacterium avium subsp. paratuberculosis
cgacgaucccggcga

SEQ ID NO: 3003482 - RNA, 16 nt, Mycobacterium avium subsp. paratuberculosis
cgacgaucccggcgag

SEQ ID NO: 3003483 - RNA, 19 nt, Mycobacterium avium subsp. paratuberculosis
cgacgaucccggcgagcac

SEQ ID NO: 3003484 - RNA, 15 nt, Mycobacterium avium subsp. paratuberculosis
cgacgauccgcgccg

SEQ ID NO: 3003485 - RNA, 16 nt, Mycobacterium avium subsp. paratuberculosis
cgacgauccgcgccgc

SEQ ID NO: 3003486 - RNA, 20 nt, Mycobacterium avium subsp. paratuberculosis
cgacgauccgcgccgcgaug

SEQ ID NO: 3003487 - RNA, 15 nt, Mycobacterium avium subsp. paratuberculosis
cgacgauccgggccg

SEQ ID NO: 3003488 - RNA, 18 nt, Mycobacterium avium subsp. paratuberculosis
cgacgauccgggccgguc

SEQ ID NO: 3003489 - RNA, 19 nt, Mycobacterium avium subsp. paratuberculosis
cgacgauccgggccggucg

SEQ ID NO: 3003490 - RNA, 20 nt, Mycobacterium avium subsp. paratuberculosis
cgacgauccgggccggucgg

SEQ ID NO: 3003491 - RNA, 21 nt, Mycobacterium avium subsp. paratuberculosis
cgacgauccgggccggucggu

SEQ ID NO: 3003492 - RNA, 14 nt, Mycobacterium avium subsp. paratuberculosis
cgacgauccgggcg

SEQ ID NO: 3003493 - RNA, 15 nt, Mycobacterium avium subsp. paratuberculosis
cgacgaucgcgacgg

SEQ ID NO: 3003494 - RNA, 13 nt, Mycobacterium avium subsp. paratuberculosis
cgacgaucgcgcc

SEQ ID NO: 3003495 - RNA, 15 nt, Mycobacterium avium subsp. paratuberculosis
cgacgaucgcgccgg

SEQ ID NO: 3003496 - RNA, 18 nt, Mycobacterium avium subsp. paratuberculosis
cgacgaucgcgccggccg

SEQ ID NO: 3003497 - RNA, 22 nt, Mycobacterium avium subsp. paratuberculosis
cgacgaucgcgccggccgccgc

SEQ ID NO: 3003498 - RNA, 18 nt, Mycobacterium avium subsp. paratuberculosis
cgacgaucuugccgaaca

SEQ ID NO: 3003499 - RNA, 19 nt, Mycobacterium avium subsp. paratuberculosis
cgacgaugaaauccgggac

SEQ ID NO: 3003500 - RNA, 13 nt, Mycobacterium avium subsp. paratuberculosis
cgacgaugaacag

SEQ ID NO: 3003501 - RNA, 20 nt, Mycobacterium avium subsp. paratuberculosis
cgacgaugaacagucggccg

SEQ ID NO: 3003502 - RNA, 21 nt, Mycobacterium avium subsp. paratuberculosis
cgacgaugaacagucggccgg

SEQ ID NO: 3003503 - RNA, 17 nt, Mycobacterium avium subsp. paratuberculosis
cgacgaugaagacccgc

SEQ ID NO: 3003504 - RNA, 18 nt, Mycobacterium avium subsp. paratuberculosis
cgacgaugaagacccgcc

SEQ ID NO: 3003505 - RNA, 17 nt, Mycobacterium avium subsp. paratuberculosis
cgacgaugagggccagc

SEQ ID NO: 3003506 - RNA, 15 nt, Mycobacterium avium subsp. paratuberculosis
cgacgaugccggccg

SEQ ID NO: 3003507 - RNA, 16 nt, Mycobacterium avium subsp. paratuberculosis
cgacgaugccggccgg

SEQ ID NO: 3003508 - RNA, 17 nt, Mycobacterium avium subsp. paratuberculosis
cgacgaugccggccggg

SEQ ID NO: 3003509 - RNA, 15 nt, Mycobacterium avium subsp. paratuberculosis
cgacgaugccggcgu

SEQ ID NO: 3003510 - RNA, 17 nt, Mycobacterium avium subsp. paratuberculosis
cgacgaugccggcgucg

SEQ ID NO: 3003511 - RNA, 15 nt, Mycobacterium avium subsp. paratuberculosis
cgacgaugcggggcg

SEQ ID NO: 3003512 - RNA, 14 nt, Mycobacterium avium subsp. paratuberculosis
cgacgaugcugucg

SEQ ID NO: 3003513 - RNA, 12 nt, Mycobacterium avium subsp. paratuberculosis
cgacgauggccc

SEQ ID NO: 3003514 - RNA, 22 nt, Mycobacterium avium subsp. paratuberculosis
cgacgauggcccggaccgccgc

SEQ ID NO: 3003515 - RNA, 23 nt, Mycobacterium avium subsp. paratuberculosis
cgacgauggcccggaccgccgcg

SEQ ID NO: 3003516 - RNA, 18 nt, Mycobacterium avium subsp. paratuberculosis
cgacgauggcccgggcca

SEQ ID NO: 3003517 - RNA, 20 nt, Mycobacterium avium subsp. paratuberculosis
cgacgauggcccgggccaca

SEQ ID NO: 3003518 - RNA, 17 nt, Mycobacterium avium subsp. paratuberculosis
cgacgauggcguccacc

SEQ ID NO: 3003519 - RNA, 18 nt, Mycobacterium avium subsp. paratuberculosis
cgacgauggucuggauga

SEQ ID NO: 3003520 - RNA, 23 nt, Mycobacterium avium subsp. paratuberculosis
cgacgaugucgaaacccaggaac

SEQ ID NO: 3003521 - RNA, 20 nt, Mycobacterium avium subsp. paratuberculosis
cgacgaugucgacccgcggc

SEQ ID NO: 3003522 - RNA, 24 nt, Mycobacterium avium subsp. paratuberculosis
cgacgaugucgacccgcggcgccg

SEQ ID NO: 3003523 - RNA, 14 nt, Mycobacterium avium subsp. paratuberculosis
cgacgaugucgacg

SEQ ID NO: 3003524 - RNA, 16 nt, Mycobacterium avium subsp. paratuberculosis
cgacgaugucgacgcc

SEQ ID NO: 3003525 - RNA, 12 nt, Mycobacterium avium subsp. paratuberculosis
cgacgaugucgg

SEQ ID NO: 3003526 - RNA, 17 nt, Mycobacterium avium subsp. paratuberculosis
cgacgauguuggcgacg

SEQ ID NO: 3003527 - RNA, 19 nt, Mycobacterium avium subsp. paratuberculosis
cgacgauguuggcgacgac

SEQ ID NO: 3003528 - RNA, 17 nt, Mycobacterium avium subsp. paratuberculosis
cgacgauugucggggcc

SEQ ID NO: 3003529 - RNA, 22 nt, Mycobacterium avium subsp. paratuberculosis
cgacgauugucggggccgcacu

SEQ ID NO: 3003530 - RNA, 13 nt, Mycobacterium avium subsp. paratuberculosis
cgacgcaccacga

SEQ ID NO: 3003531 - RNA, 17 nt, Mycobacterium avium subsp. paratuberculosis
cgacgcaccacgagcag

SEQ ID NO: 3003532 - RNA, 18 nt, Mycobacterium avium subsp. paratuberculosis
cgacgcaccacgagcagc

SEQ ID NO: 3003533 - RNA, 19 nt, Mycobacterium avium subsp. paratuberculosis
cgacgcaccacgagcagcc

SEQ ID NO: 3003534 - RNA, 23 nt, Mycobacterium avium subsp. paratuberculosis
cgacgcaccacgagcagccgauc

SEQ ID NO: 3003535 - RNA, 14 nt, Mycobacterium avium subsp. paratuberculosis
cgacgcaccucggc

SEQ ID NO: 3003536 - RNA, 17 nt, Mycobacterium avium subsp. paratuberculosis
cgacgcaccucggccgg

SEQ ID NO: 3003537 - RNA, 21 nt, Mycobacterium avium subsp. paratuberculosis
cgacgcacgaaaccgcguggc

SEQ ID NO: 3003538 - RNA, 23 nt, Mycobacterium avium subsp. paratuberculosis
cgacgcacgaaaccgcguggcgc

SEQ ID NO: 3003539 - RNA, 13 nt, Mycobacterium avium subsp. paratuberculosis
cgacgcacgccgg

SEQ ID NO: 3003540 - RNA, 15 nt, Mycobacterium avium subsp. paratuberculosis
cgacgcacgccggcg

SEQ ID NO: 3003541 - RNA, 16 nt, Mycobacterium avium subsp. paratuberculosis
cgacgcacgccggcgg

SEQ ID NO: 3003542 - RNA, 17 nt, Mycobacterium avium subsp. paratuberculosis
cgacgcacgccggcggg

SEQ ID NO: 3003543 - RNA, 18 nt, Mycobacterium avium subsp. paratuberculosis
cgacgcacgccggcgggg

SEQ ID NO: 3003544 - RNA, 16 nt, Mycobacterium avium subsp. paratuberculosis
cgacgcauguccgccg

SEQ ID NO: 3003545 - RNA, 19 nt, Mycobacterium avium subsp. paratuberculosis
cgacgcauguccgccguca

SEQ ID NO: 3003546 - RNA, 21 nt, Mycobacterium avium subsp. paratuberculosis
cgacgcauguccgccgucauc

SEQ ID NO: 3003547 - RNA, 20 nt, Mycobacterium avium subsp. paratuberculosis
cgacgcauucgcugugaugg

SEQ ID NO: 3003548 - RNA, 22 nt, Mycobacterium avium subsp. paratuberculosis
cgacgccaacaacuacgagcag

SEQ ID NO: 3003549 - RNA, 23 nt, Mycobacterium avium subsp. paratuberculosis
cgacgccaacaacuacgagcagc

SEQ ID NO: 3003550 - RNA, 14 nt, Mycobacterium avium subsp. paratuberculosis
cgacgccaccgcga

SEQ ID NO: 3003551 - RNA, 14 nt, Mycobacterium avium subsp. paratuberculosis
cgacgccacgucgu

SEQ ID NO: 3003552 - RNA, 19 nt, Mycobacterium avium subsp. paratuberculosis
cgacgccagaaccggcaac

SEQ ID NO: 3003553 - RNA, 20 nt, Mycobacterium avium subsp. paratuberculosis
cgacgccagaaccggcaaca

SEQ ID NO: 3003554 - RNA, 15 nt, Mycobacterium avium subsp. paratuberculosis
cgacgccagcaccuu

SEQ ID NO: 3003555 - RNA, 13 nt, Mycobacterium avium subsp. paratuberculosis
cgacgccagcacg

SEQ ID NO: 3003556 - RNA, 14 nt, Mycobacterium avium subsp. paratuberculosis
cgacgccagcacgu

SEQ ID NO: 3003557 - RNA, 20 nt, Mycobacterium avium subsp. paratuberculosis
cgacgccagcacguggccgg

SEQ ID NO: 3003558 - RNA, 13 nt, Mycobacterium avium subsp. paratuberculosis
cgacgccagcggc

SEQ ID NO: 3003559 - RNA, 18 nt, Mycobacterium avium subsp. paratuberculosis
cgacgccagcggcagcgc

SEQ ID NO: 3003560 - RNA, 20 nt, Mycobacterium avium subsp. paratuberculosis
cgacgccagcggcagcgcca

SEQ ID NO: 3003561 - RNA, 22 nt, Mycobacterium avium subsp. paratuberculosis
cgacgccagcggcagcgccagc

SEQ ID NO: 3003562 - RNA, 12 nt, Mycobacterium avium subsp. paratuberculosis
cgacgccagcug

SEQ ID NO: 3003563 - RNA, 13 nt, Mycobacterium avium subsp. paratuberculosis
cgacgccagcugc

SEQ ID NO: 3003564 - RNA, 18 nt, Mycobacterium avium subsp. paratuberculosis
cgacgccagcugccgcga

SEQ ID NO: 3003565 - RNA, 19 nt, Mycobacterium avium subsp. paratuberculosis
cgacgccagcugccgcgac

SEQ ID NO: 3003566 - RNA, 22 nt, Mycobacterium avium subsp. paratuberculosis
cgacgccaguucgucggccguc

SEQ ID NO: 3003567 - RNA, 16 nt, Mycobacterium avium subsp. paratuberculosis
cgacgccaugggccca

SEQ ID NO: 3003568 - RNA, 18 nt, Mycobacterium avium subsp. paratuberculosis
cgacgccaugggcccagc

SEQ ID NO: 3003569 - RNA, 15 nt, Mycobacterium avium subsp. paratuberculosis
cgacgccaugucgau

SEQ ID NO: 3003570 - RNA, 22 nt, Mycobacterium avium subsp. paratuberculosis
cgacgccaugucgaugucgacg

SEQ ID NO: 3003571 - RNA, 16 nt, Mycobacterium avium subsp. paratuberculosis
cgacgcccacagcgcc

SEQ ID NO: 3003572 - RNA, 17 nt, Mycobacterium avium subsp. paratuberculosis
cgacgcccacagcgcca

SEQ ID NO: 3003573 - RNA, 19 nt, Mycobacterium avium subsp. paratuberculosis
cgacgcccacagcgccagc

SEQ ID NO: 3003574 - RNA, 14 nt, Mycobacterium avium subsp. paratuberculosis
cgacgcccaccugg

SEQ ID NO: 3003575 - RNA, 15 nt, Mycobacterium avium subsp. paratuberculosis
cgacgcccacuggua

SEQ ID NO: 3003576 - RNA, 13 nt, Mycobacterium avium subsp. paratuberculosis
cgacgcccagcac

SEQ ID NO: 3003577 - RNA, 14 nt, Mycobacterium avium subsp. paratuberculosis
cgacgcccagcacc

SEQ ID NO: 3003578 - RNA, 15 nt, Mycobacterium avium subsp. paratuberculosis
cgacgcccagcaccg

SEQ ID NO: 3003579 - RNA, 19 nt, Mycobacterium avium subsp. paratuberculosis
cgacgcccagcaccgaguu

SEQ ID NO: 3003580 - RNA, 16 nt, Mycobacterium avium subsp. paratuberculosis
cgacgcccagcgcggc

SEQ ID NO: 3003581 - RNA, 17 nt, Mycobacterium avium subsp. paratuberculosis
cgacgcccagcgcggcg

SEQ ID NO: 3003582 - RNA, 16 nt, Mycobacterium avium subsp. paratuberculosis
cgacgcccaggugcac

SEQ ID NO: 3003583 - RNA, 20 nt, Mycobacterium avium subsp. paratuberculosis
cgacgcccaggugcacccga

SEQ ID NO: 3003584 - RNA, 17 nt, Mycobacterium avium subsp. paratuberculosis
cgacgccccgcgccucg

SEQ ID NO: 3003585 - RNA, 12 nt, Mycobacterium avium subsp. paratuberculosis
cgacgcccggcu

SEQ ID NO: 3003586 - RNA, 15 nt, Mycobacterium avium subsp. paratuberculosis
cgacgcccggcuucg

SEQ ID NO: 3003587 - RNA, 19 nt, Mycobacterium avium subsp. paratuberculosis
cgacgcccggcuucgccgc

SEQ ID NO: 3003588 - RNA, 21 nt, Mycobacterium avium subsp. paratuberculosis
cgacgcccggcuucgccgccg

SEQ ID NO: 3003589 - RNA, 22 nt, Mycobacterium avium subsp. paratuberculosis
cgacgcccggcuucgccgccgc

SEQ ID NO: 3003590 - RNA, 19 nt, Mycobacterium avium subsp. paratuberculosis
cgacgcccugccacagcga

SEQ ID NO: 3003591 - RNA, 20 nt, Mycobacterium avium subsp. paratuberculosis
cgacgcccugccacagcgac

SEQ ID NO: 3003592 - RNA, 21 nt, Mycobacterium avium subsp. paratuberculosis
cgacgcccugccacagcgaca

SEQ ID NO: 3003593 - RNA, 15 nt, Mycobacterium avium subsp. paratuberculosis
cgacgcccuuggcgc

SEQ ID NO: 3003594 - RNA, 19 nt, Mycobacterium avium subsp. paratuberculosis
cgacgcccuuggcgcccag

SEQ ID NO: 3003595 - RNA, 20 nt, Mycobacterium avium subsp. paratuberculosis
cgacgcccuuggcgcccagc

SEQ ID NO: 3003596 - RNA, 23 nt, Mycobacterium avium subsp. paratuberculosis
cgacgcccuuggcgcccagcgug

SEQ ID NO: 3003597 - RNA, 24 nt, Mycobacterium avium subsp. paratuberculosis
cgacgcccuuggcgcccagcgugg

SEQ ID NO: 3003598 - RNA, 13 nt, Mycobacterium avium subsp. paratuberculosis
cgacgccgaacug

SEQ ID NO: 3003599 - RNA, 14 nt, Mycobacterium avium subsp. paratuberculosis
cgacgccgaacugc

SEQ ID NO: 3003600 - RNA, 19 nt, Mycobacterium avium subsp. paratuberculosis
cgacgccgaacugccggac

SEQ ID NO: 3003601 - RNA, 22 nt, Mycobacterium avium subsp. paratuberculosis
cgacgccgaacugccggaccag

SEQ ID NO: 3003602 - RNA, 18 nt, Mycobacterium avium subsp. paratuberculosis
cgacgccgaagaucagcg

SEQ ID NO: 3003603 - RNA, 20 nt, Mycobacterium avium subsp. paratuberculosis
cgacgccgaagaucagcgcg

SEQ ID NO: 3003604 - RNA, 21 nt, Mycobacterium avium subsp. paratuberculosis
cgacgccgaagaucagcgcgu

SEQ ID NO: 3003605 - RNA, 13 nt, Mycobacterium avium subsp. paratuberculosis
cgacgccgacacc

SEQ ID NO: 3003606 - RNA, 14 nt, Mycobacterium avium subsp. paratuberculosis
cgacgccgacacca

SEQ ID NO: 3003607 - RNA, 17 nt, Mycobacterium avium subsp. paratuberculosis
cgacgccgacaccagcg

SEQ ID NO: 3003608 - RNA, 19 nt, Mycobacterium avium subsp. paratuberculosis
cgacgccgacaccagcgcg

SEQ ID NO: 3003609 - RNA, 22 nt, Mycobacterium avium subsp. paratuberculosis
cgacgccgacaccagcgcgcac

SEQ ID NO: 3003610 - RNA, 14 nt, Mycobacterium avium subsp. paratuberculosis
cgacgccgacaucg

SEQ ID NO: 3003611 - RNA, 16 nt, Mycobacterium avium subsp. paratuberculosis
cgacgccgaccgcggu

SEQ ID NO: 3003612 - RNA, 18 nt, Mycobacterium avium subsp. paratuberculosis
cgacgccgaccgcggucg

SEQ ID NO: 3003613 - RNA, 22 nt, Mycobacterium avium subsp. paratuberculosis
cgacgccgaccgcggucgcggc

SEQ ID NO: 3003614 - RNA, 11 nt, Mycobacterium avium subsp. paratuberculosis
cgacgccgacg

SEQ ID NO: 3003615 - RNA, 17 nt, Mycobacterium avium subsp. paratuberculosis
cgacgccgacgcccagc

SEQ ID NO: 3003616 - RNA, 16 nt, Mycobacterium avium subsp. paratuberculosis
cgacgccgacggcaau

SEQ ID NO: 3003617 - RNA, 19 nt, Mycobacterium avium subsp. paratuberculosis
cgacgccgaguaacucggc

SEQ ID NO: 3003618 - RNA, 17 nt, Mycobacterium avium subsp. paratuberculosis
cgacgccgauccgcagc

SEQ ID NO: 3003619 - RNA, 17 nt, Mycobacterium avium subsp. paratuberculosis
cgacgccgauggugacc

SEQ ID NO: 3003620 - RNA, 20 nt, Mycobacterium avium subsp. paratuberculosis
cgacgccgauggugaccucg

SEQ ID NO: 3003621 - RNA, 23 nt, Mycobacterium avium subsp. paratuberculosis
cgacgccgauggugaccucgguc

SEQ ID NO: 3003622 - RNA, 18 nt, Mycobacterium avium subsp. paratuberculosis
cgacgccgccgccgagcu

SEQ ID NO: 3003623 - RNA, 23 nt, Mycobacterium avium subsp. paratuberculosis
cgacgccgccgccgagcucggcc

SEQ ID NO: 3003624 - RNA, 15 nt, Mycobacterium avium subsp. paratuberculosis
cgacgccgccgucgu

SEQ ID NO: 3003625 - RNA, 11 nt, Mycobacterium avium subsp. paratuberculosis
cgacgccgcgc

SEQ ID NO: 3003626 - RNA, 22 nt, Mycobacterium avium subsp. paratuberculosis
cgacgccgcgcaccccgaaccg

SEQ ID NO: 3003627 - RNA, 13 nt, Mycobacterium avium subsp. paratuberculosis
cgacgccgcgcag

SEQ ID NO: 3003628 - RNA, 14 nt, Mycobacterium avium subsp. paratuberculosis
cgacgccgcgcagc

SEQ ID NO: 3003629 - RNA, 16 nt, Mycobacterium avium subsp. paratuberculosis
cgacgccgcgcagcgg

SEQ ID NO: 3003630 - RNA, 15 nt, Mycobacterium avium subsp. paratuberculosis
cgacgccgcgcuggc

SEQ ID NO: 3003631 - RNA, 18 nt, Mycobacterium avium subsp. paratuberculosis
cgacgccgcgcuggccgg

SEQ ID NO: 3003632 - RNA, 20 nt, Mycobacterium avium subsp. paratuberculosis
cgacgccgcgcuggccgggu

SEQ ID NO: 3003633 - RNA, 13 nt, Mycobacterium avium subsp. paratuberculosis
cgacgccgcggaa

SEQ ID NO: 3003634 - RNA, 15 nt, Mycobacterium avium subsp. paratuberculosis
cgacgccgcggaagc

SEQ ID NO: 3003635 - RNA, 20 nt, Mycobacterium avium subsp. paratuberculosis
cgacgccgcggaagccccag

SEQ ID NO: 3003636 - RNA, 13 nt, Mycobacterium avium subsp. paratuberculosis
cgacgccgcggug

SEQ ID NO: 3003637 - RNA, 16 nt, Mycobacterium avium subsp. paratuberculosis
cgacgccgcgguggcc

SEQ ID NO: 3003638 - RNA, 14 nt, Mycobacterium avium subsp. paratuberculosis
cgacgccgcugccg

SEQ ID NO: 3003639 - RNA, 16 nt, Mycobacterium avium subsp. paratuberculosis
cgacgccgcugccggg

SEQ ID NO: 3003640 - RNA, 17 nt, Mycobacterium avium subsp. paratuberculosis
cgacgccgcugccgggg

SEQ ID NO: 3003641 - RNA, 22 nt, Mycobacterium avium subsp. paratuberculosis
cgacgccggccaccaacagguc

SEQ ID NO: 3003642 - RNA, 17 nt, Mycobacterium avium subsp. paratuberculosis
cgacgccggcgaggcgg

SEQ ID NO: 3003643 - RNA, 21 nt, Mycobacterium avium subsp. paratuberculosis
cgacgccggcgaggcggucgg

SEQ ID NO: 3003644 - RNA, 13 nt, Mycobacterium avium subsp. paratuberculosis
cgacgccgggcag

SEQ ID NO: 3003645 - RNA, 15 nt, Mycobacterium avium subsp. paratuberculosis
cgacgccgggcagcg

SEQ ID NO: 3003646 - RNA, 16 nt, Mycobacterium avium subsp. paratuberculosis
cgacgccgggcagcgc

SEQ ID NO: 3003647 - RNA, 13 nt, Mycobacterium avium subsp. paratuberculosis
cgacgccgggcgc

SEQ ID NO: 3003648 - RNA, 12 nt, Mycobacterium avium subsp. paratuberculosis
cgacgccgggcu

SEQ ID NO: 3003649 - RNA, 13 nt, Mycobacterium avium subsp. paratuberculosis
cgacgccgggcuc

SEQ ID NO: 3003650 - RNA, 14 nt, Mycobacterium avium subsp. paratuberculosis
cgacgccgggcucg

SEQ ID NO: 3003651 - RNA, 20 nt, Mycobacterium avium subsp. paratuberculosis
cgacgccggugaaaccggcg

SEQ ID NO: 3003652 - RNA, 22 nt, Mycobacterium avium subsp. paratuberculosis
cgacgccggugaaaccggcgcc

SEQ ID NO: 3003653 - RNA, 14 nt, Mycobacterium avium subsp. paratuberculosis
cgacgccguagauc

SEQ ID NO: 3003654 - RNA, 20 nt, Mycobacterium avium subsp. paratuberculosis
cgacgccgucacggaucgcc

SEQ ID NO: 3003655 - RNA, 18 nt, Mycobacterium avium subsp. paratuberculosis
cgacgccgucauccccau

SEQ ID NO: 3003656 - RNA, 13 nt, Mycobacterium avium subsp. paratuberculosis
cgacgccgucgag

SEQ ID NO: 3003657 - RNA, 21 nt, Mycobacterium avium subsp. paratuberculosis
cgacgccgucgagccugguga

SEQ ID NO: 3003658 - RNA, 16 nt, Mycobacterium avium subsp. paratuberculosis
cgacgccgucgaugac

SEQ ID NO: 3003659 - RNA, 22 nt, Mycobacterium avium subsp. paratuberculosis
cgacgccgucgaugacgcgcuu

SEQ ID NO: 3003660 - RNA, 12 nt, Mycobacterium avium subsp. paratuberculosis
cgacgccgucgg

SEQ ID NO: 3003661 - RNA, 17 nt, Mycobacterium avium subsp. paratuberculosis
cgacgccgugguccagc

SEQ ID NO: 3003662 - RNA, 20 nt, Mycobacterium avium subsp. paratuberculosis
cgacgccgugguccagccgg

SEQ ID NO: 3003663 - RNA, 23 nt, Mycobacterium avium subsp. paratuberculosis
cgacgccgugguccagccggucg

SEQ ID NO: 3003664 - RNA, 22 nt, Mycobacterium avium subsp. paratuberculosis
cgacgccuccacauacgcggcg

SEQ ID NO: 3003665 - RNA, 13 nt, Mycobacterium avium subsp. paratuberculosis
cgacgccugcgcg

SEQ ID NO: 3003666 - RNA, 17 nt, Mycobacterium avium subsp. paratuberculosis
cgacgccugcgcgaaca

SEQ ID NO: 3003667 - RNA, 20 nt, Mycobacterium avium subsp. paratuberculosis
cgacgccugcgcgaacagcg

SEQ ID NO: 3003668 - RNA, 14 nt, Mycobacterium avium subsp. paratuberculosis
cgacgcgaccggcc

SEQ ID NO: 3003669 - RNA, 12 nt, Mycobacterium avium subsp. paratuberculosis
cgacgcgacgcg

SEQ ID NO: 3003670 - RNA, 17 nt, Mycobacterium avium subsp. paratuberculosis
cgacgcgacgcgcucgg

SEQ ID NO: 3003671 - RNA, 19 nt, Mycobacterium avium subsp. paratuberculosis
cgacgcgacgcgcucggcg

SEQ ID NO: 3003672 - RNA, 14 nt, Mycobacterium avium subsp. paratuberculosis
cgacgcgacggucg

SEQ ID NO: 3003673 - RNA, 20 nt, Mycobacterium avium subsp. paratuberculosis
cgacgcgcacccgggaccgg

SEQ ID NO: 3003674 - RNA, 18 nt, Mycobacterium avium subsp. paratuberculosis
cgacgcgccacgccccgg

SEQ ID NO: 3003675 - RNA, 19 nt, Mycobacterium avium subsp. paratuberculosis
cgacgcgccacgccccggc

SEQ ID NO: 3003676 - RNA, 12 nt, Mycobacterium avium subsp. paratuberculosis
cgacgcgccgca

SEQ ID NO: 3003677 - RNA, 16 nt, Mycobacterium avium subsp. paratuberculosis
cgacgcgccgcacugc

SEQ ID NO: 3003678 - RNA, 14 nt, Mycobacterium avium subsp. paratuberculosis
cgacgcgccgucgg

SEQ ID NO: 3003679 - RNA, 17 nt, Mycobacterium avium subsp. paratuberculosis
cgacgcgccgucggccc

SEQ ID NO: 3003680 - RNA, 18 nt, Mycobacterium avium subsp. paratuberculosis
cgacgcgccgucggccca

SEQ ID NO: 3003681 - RNA, 23 nt, Mycobacterium avium subsp. paratuberculosis
cgacgcgcggucgucuucuuggc

SEQ ID NO: 3003682 - RNA, 16 nt, Mycobacterium avium subsp. paratuberculosis
cgacgcgcucagcccc

SEQ ID NO: 3003683 - RNA, 14 nt, Mycobacterium avium subsp. paratuberculosis
cgacgcgcucggcg

SEQ ID NO: 3003684 - RNA, 18 nt, Mycobacterium avium subsp. paratuberculosis
cgacgcgcucggcgaccg

SEQ ID NO: 3003685 - RNA, 20 nt, Mycobacterium avium subsp. paratuberculosis
cgacgcgcucggcgaccgcc

SEQ ID NO: 3003686 - RNA, 12 nt, Mycobacterium avium subsp. paratuberculosis
cgacgcgcugcg

SEQ ID NO: 3003687 - RNA, 21 nt, Mycobacterium avium subsp. paratuberculosis
cgacgcgcugcgcgccgcccu

SEQ ID NO: 3003688 - RNA, 19 nt, Mycobacterium avium subsp. paratuberculosis
cgacgcgcugcuugacccg

SEQ ID NO: 3003689 - RNA, 12 nt, Mycobacterium avium subsp. paratuberculosis
cgacgcggcacg

SEQ ID NO: 3003690 - RNA, 14 nt, Mycobacterium avium subsp. paratuberculosis
cgacgcggcacgcc

SEQ ID NO: 3003691 - RNA, 15 nt, Mycobacterium avium subsp. paratuberculosis
cgacgcggcacgccg

SEQ ID NO: 3003692 - RNA, 23 nt, Mycobacterium avium subsp. paratuberculosis
cgacgcggcacgccgcucgucgg

SEQ ID NO: 3003693 - RNA, 13 nt, Mycobacterium avium subsp. paratuberculosis
cgacgcggccucg

SEQ ID NO: 3003694 - RNA, 13 nt, Mycobacterium avium subsp. paratuberculosis
cgacgcggcgacc

SEQ ID NO: 3003695 - RNA, 15 nt, Mycobacterium avium subsp. paratuberculosis
cgacgcggcgaccac

SEQ ID NO: 3003696 - RNA, 17 nt, Mycobacterium avium subsp. paratuberculosis
cgacgcggcgaccacca

SEQ ID NO: 3003697 - RNA, 13 nt, Mycobacterium avium subsp. paratuberculosis
cgacgcggcgauc

SEQ ID NO: 3003698 - RNA, 14 nt, Mycobacterium avium subsp. paratuberculosis
cgacgcggcgaucu

SEQ ID NO: 3003699 - RNA, 14 nt, Mycobacterium avium subsp. paratuberculosis
cgacgcggcgcgac

SEQ ID NO: 3003700 - RNA, 18 nt, Mycobacterium avium subsp. paratuberculosis
cgacgcggcgcgacaccg

SEQ ID NO: 3003701 - RNA, 15 nt, Mycobacterium avium subsp. paratuberculosis
cgacgcggcgcgcga

SEQ ID NO: 3003702 - RNA, 21 nt, Mycobacterium avium subsp. paratuberculosis
cgacgcggcgcgcgauggaca

SEQ ID NO: 3003703 - RNA, 20 nt, Mycobacterium avium subsp. paratuberculosis
cgacgcggcggccgacagcg

SEQ ID NO: 3003704 - RNA, 22 nt, Mycobacterium avium subsp. paratuberculosis
cgacgcggcggccgacagcgcg

SEQ ID NO: 3003705 - RNA, 13 nt, Mycobacterium avium subsp. paratuberculosis
cgacgcggcggga

SEQ ID NO: 3003706 - RNA, 14 nt, Mycobacterium avium subsp. paratuberculosis
cgacgcggcgggaa

SEQ ID NO: 3003707 - RNA, 21 nt, Mycobacterium avium subsp. paratuberculosis
cgacgcgggauugccgagcac

SEQ ID NO: 3003708 - RNA, 22 nt, Mycobacterium avium subsp. paratuberculosis
cgacgcgggauugccgagcacc

SEQ ID NO: 3003709 - RNA, 22 nt, Mycobacterium avium subsp. paratuberculosis
cgacgcgggcgacgucaacuuc

SEQ ID NO: 3003710 - RNA, 15 nt, Mycobacterium avium subsp. paratuberculosis
cgacgcggggcggcg

SEQ ID NO: 3003711 - RNA, 17 nt, Mycobacterium avium subsp. paratuberculosis
cgacgcggggcggcggc

SEQ ID NO: 3003712 - RNA, 21 nt, Mycobacterium avium subsp. paratuberculosis
cgacgcggggcggcggcgccg

SEQ ID NO: 3003713 - RNA, 16 nt, Mycobacterium avium subsp. paratuberculosis
cgacgcggucaccggc

SEQ ID NO: 3003714 - RNA, 16 nt, Mycobacterium avium subsp. paratuberculosis
cgacgcggucugcggu

SEQ ID NO: 3003715 - RNA, 20 nt, Mycobacterium avium subsp. paratuberculosis
cgacgcggugacaugcccgg

SEQ ID NO: 3003716 - RNA, 22 nt, Mycobacterium avium subsp. paratuberculosis
cgacgcggugacaugcccgggc

SEQ ID NO: 3003717 - RNA, 19 nt, Mycobacterium avium subsp. paratuberculosis
cgacgcggugagcgcgccg

SEQ ID NO: 3003718 - RNA, 21 nt, Mycobacterium avium subsp. paratuberculosis
cgacgcggugagcgcgccggc

SEQ ID NO: 3003719 - RNA, 14 nt, Mycobacterium avium subsp. paratuberculosis
cgacgcgguggcgu

SEQ ID NO: 3003720 - RNA, 12 nt, Mycobacterium avium subsp. paratuberculosis
cgacgcgucgac

SEQ ID NO: 3003721 - RNA, 15 nt, Mycobacterium avium subsp. paratuberculosis
cgacgcgucgacagu

SEQ ID NO: 3003722 - RNA, 13 nt, Mycobacterium avium subsp. paratuberculosis
cgacgcgucgcgg

SEQ ID NO: 3003723 - RNA, 14 nt, Mycobacterium avium subsp. paratuberculosis
cgacgcgucgcggc

SEQ ID NO: 3003724 - RNA, 16 nt, Mycobacterium avium subsp. paratuberculosis
cgacgcgucgcggcgg

SEQ ID NO: 3003725 - RNA, 16 nt, Mycobacterium avium subsp. paratuberculosis
cgacgcgugcgucauc

SEQ ID NO: 3003726 - RNA, 20 nt, Mycobacterium avium subsp. paratuberculosis
cgacgcguuguugcucggcg

SEQ ID NO: 3003727 - RNA, 23 nt, Mycobacterium avium subsp. paratuberculosis
cgacgcguuguugcucggcggcc

SEQ ID NO: 3003728 - RNA, 20 nt, Mycobacterium avium subsp. paratuberculosis
cgacgcucgccaccccgcgc

SEQ ID NO: 3003729 - RNA, 15 nt, Mycobacterium avium subsp. paratuberculosis
cgacgcucggcgaug

SEQ ID NO: 3003730 - RNA, 13 nt, Mycobacterium avium subsp. paratuberculosis
cgacgcugaacag

SEQ ID NO: 3003731 - RNA, 20 nt, Mycobacterium avium subsp. paratuberculosis
cgacgcugaagaagaugggc

SEQ ID NO: 3003732 - RNA, 16 nt, Mycobacterium avium subsp. paratuberculosis
cgacgcugaccagcug

SEQ ID NO: 3003733 - RNA, 14 nt, Mycobacterium avium subsp. paratuberculosis
cgacgcugagcacc

SEQ ID NO: 3003734 - RNA, 15 nt, Mycobacterium avium subsp. paratuberculosis
cgacgcugagcaccc

SEQ ID NO: 3003735 - RNA, 16 nt, Mycobacterium avium subsp. paratuberculosis
cgacgcugagcacccg

SEQ ID NO: 3003736 - RNA, 18 nt, Mycobacterium avium subsp. paratuberculosis
cgacgcugagcacccgcc

SEQ ID NO: 3003737 - RNA, 23 nt, Mycobacterium avium subsp. paratuberculosis
cgacgcugagccgcucgucgagu

SEQ ID NO: 3003738 - RNA, 18 nt, Mycobacterium avium subsp. paratuberculosis
cgacgcugagcgccaggc

SEQ ID NO: 3003739 - RNA, 20 nt, Mycobacterium avium subsp. paratuberculosis
cgacgcugagcgccaggcca

SEQ ID NO: 3003740 - RNA, 22 nt, Mycobacterium avium subsp. paratuberculosis
cgacgcugcagguggcccacac

SEQ ID NO: 3003741 - RNA, 15 nt, Mycobacterium avium subsp. paratuberculosis
cgacgcugccggggc

SEQ ID NO: 3003742 - RNA, 20 nt, Mycobacterium avium subsp. paratuberculosis
cgacgcugccgguggucccg

SEQ ID NO: 3003743 - RNA, 15 nt, Mycobacterium avium subsp. paratuberculosis
cgacgcuggccgaga

SEQ ID NO: 3003744 - RNA, 21 nt, Mycobacterium avium subsp. paratuberculosis
cgacgcuggccgagagccggu

SEQ ID NO: 3003745 - RNA, 18 nt, Mycobacterium avium subsp. paratuberculosis
cgacgcugugcgccuugc

SEQ ID NO: 3003746 - RNA, 19 nt, Mycobacterium avium subsp. paratuberculosis
cgacgcugugcgccuugcc

SEQ ID NO: 3003747 - RNA, 20 nt, Mycobacterium avium subsp. paratuberculosis
cgacgcugugcgccuugccg

SEQ ID NO: 3003748 - RNA, 17 nt, Mycobacterium avium subsp. paratuberculosis
cgacgcugugcucggga

SEQ ID NO: 3003749 - RNA, 16 nt, Mycobacterium avium subsp. paratuberculosis
cgacgcuucguggacg

SEQ ID NO: 3003750 - RNA, 22 nt, Mycobacterium avium subsp. paratuberculosis
cgacgcuucguggacgaacgcg

SEQ ID NO: 3003751 - RNA, 21 nt, Mycobacterium avium subsp. paratuberculosis
cgacggaagccgagcggucca

SEQ ID NO: 3003752 - RNA, 17 nt, Mycobacterium avium subsp. paratuberculosis
cgacggagacgaccagg

SEQ ID NO: 3003753 - RNA, 14 nt, Mycobacterium avium subsp. paratuberculosis
cgacggagacgacg

SEQ ID NO: 3003754 - RNA, 16 nt, Mycobacterium avium subsp. paratuberculosis
cgacggagacgacgac

SEQ ID NO: 3003755 - RNA, 13 nt, Mycobacterium avium subsp. paratuberculosis
cgacggagccgag

SEQ ID NO: 3003756 - RNA, 19 nt, Mycobacterium avium subsp. paratuberculosis
cgacggagccgagcaccag

SEQ ID NO: 3003757 - RNA, 16 nt, Mycobacterium avium subsp. paratuberculosis
cgacggagucgucggc

SEQ ID NO: 3003758 - RNA, 17 nt, Mycobacterium avium subsp. paratuberculosis
cgacggagucgucggcg

SEQ ID NO: 3003759 - RNA, 23 nt, Mycobacterium avium subsp. paratuberculosis
cgacggauaacucuacugcugcg

SEQ ID NO: 3003760 - RNA, 16 nt, Mycobacterium avium subsp. paratuberculosis
cgacggaucgcccugg

SEQ ID NO: 3003761 - RNA, 13 nt, Mycobacterium avium subsp. paratuberculosis
cgacggaucggcc

SEQ ID NO: 3003762 - RNA, 18 nt, Mycobacterium avium subsp. paratuberculosis
cgacggaucggccgcguc

SEQ ID NO: 3003763 - RNA, 20 nt, Mycobacterium avium subsp. paratuberculosis
cgacggaucggccgcgucgg

SEQ ID NO: 3003764 - RNA, 23 nt, Mycobacterium avium subsp. paratuberculosis
cgacggaucggccgcgucgggca

SEQ ID NO: 3003765 - RNA, 13 nt, Mycobacterium avium subsp. paratuberculosis
cgacggaucugcu

SEQ ID NO: 3003766 - RNA, 14 nt, Mycobacterium avium subsp. paratuberculosis
cgacggcaauccgg

SEQ ID NO: 3003767 - RNA, 17 nt, Mycobacterium avium subsp. paratuberculosis
cgacggcaauccggccc

SEQ ID NO: 3003768 - RNA, 18 nt, Mycobacterium avium subsp. paratuberculosis
cgacggcaauccggcccc

SEQ ID NO: 3003769 - RNA, 21 nt, Mycobacterium avium subsp. paratuberculosis
cgacggcaauccggccccgcu

SEQ ID NO: 3003770 - RNA, 22 nt, Mycobacterium avium subsp. paratuberculosis
cgacggcaauccggccccgcug

SEQ ID NO: 3003771 - RNA, 14 nt, Mycobacterium avium subsp. paratuberculosis
cgacggcacccggc

SEQ ID NO: 3003772 - RNA, 17 nt, Mycobacterium avium subsp. paratuberculosis
cgacggcacccggcccu

SEQ ID NO: 3003773 - RNA, 15 nt, Mycobacterium avium subsp. paratuberculosis
cgacggcaccgccgg

SEQ ID NO: 3003774 - RNA, 17 nt, Mycobacterium avium subsp. paratuberculosis
cgacggcaccgccggcg

SEQ ID NO: 3003775 - RNA, 19 nt, Mycobacterium avium subsp. paratuberculosis
cgacggcaccgccggcggc

SEQ ID NO: 3003776 - RNA, 13 nt, Mycobacterium avium subsp. paratuberculosis
cgacggcagcacc

SEQ ID NO: 3003777 - RNA, 15 nt, Mycobacterium avium subsp. paratuberculosis
cgacggcagcaccgc

SEQ ID NO: 3003778 - RNA, 19 nt, Mycobacterium avium subsp. paratuberculosis
cgacggcagcaccgccgac

SEQ ID NO: 3003779 - RNA, 20 nt, Mycobacterium avium subsp. paratuberculosis
cgacggcagcaccgccgaca

SEQ ID NO: 3003780 - RNA, 22 nt, Mycobacterium avium subsp. paratuberculosis
cgacggcagcaccgccgacauc

SEQ ID NO: 3003781 - RNA, 21 nt, Mycobacterium avium subsp. paratuberculosis
cgacggcagcaccucgcgcag

SEQ ID NO: 3003782 - RNA, 13 nt, Mycobacterium avium subsp. paratuberculosis
cgacggcagcgcg

SEQ ID NO: 3003783 - RNA, 16 nt, Mycobacterium avium subsp. paratuberculosis
cgacggcagcgcgauc

SEQ ID NO: 3003784 - RNA, 18 nt, Mycobacterium avium subsp. paratuberculosis
cgacggcagcgcgauccg

SEQ ID NO: 3003785 - RNA, 13 nt, Mycobacterium avium subsp. paratuberculosis
cgacggcagcggc

SEQ ID NO: 3003786 - RNA, 19 nt, Mycobacterium avium subsp. paratuberculosis
cgacggcagcggcaccaac

SEQ ID NO: 3003787 - RNA, 18 nt, Mycobacterium avium subsp. paratuberculosis
cgacggcaggucggugcg

SEQ ID NO: 3003788 - RNA, 21 nt, Mycobacterium avium subsp. paratuberculosis
cgacggcaggucggugcgcgg

SEQ ID NO: 3003789 - RNA, 15 nt, Mycobacterium avium subsp. paratuberculosis
cgacggccaccgcga

SEQ ID NO: 3003790 - RNA, 17 nt, Mycobacterium avium subsp. paratuberculosis
cgacggccaccgcgacg

SEQ ID NO: 3003791 - RNA, 21 nt, Mycobacterium avium subsp. paratuberculosis
cgacggccaccgcgacgcugc

SEQ ID NO: 3003792 - RNA, 23 nt, Mycobacterium avium subsp. paratuberculosis
cgacggccaccgcgacgcugccg

SEQ ID NO: 3003793 - RNA, 14 nt, Mycobacterium avium subsp. paratuberculosis
cgacggccagcagg

SEQ ID NO: 3003794 - RNA, 17 nt, Mycobacterium avium subsp. paratuberculosis
cgacggccagcgcggcg

SEQ ID NO: 3003795 - RNA, 18 nt, Mycobacterium avium subsp. paratuberculosis
cgacggccagcgcggcgg

SEQ ID NO: 3003796 - RNA, 12 nt, Mycobacterium avium subsp. paratuberculosis
cgacggccagcu

SEQ ID NO: 3003797 - RNA, 13 nt, Mycobacterium avium subsp. paratuberculosis
cgacggccagcug

SEQ ID NO: 3003798 - RNA, 14 nt, Mycobacterium avium subsp. paratuberculosis
cgacggccagcuga

SEQ ID NO: 3003799 - RNA, 22 nt, Mycobacterium avium subsp. paratuberculosis
cgacggccccccgggcaccagc

SEQ ID NO: 3003800 - RNA, 12 nt, Mycobacterium avium subsp. paratuberculosis
cgacggcccgcc

SEQ ID NO: 3003801 - RNA, 14 nt, Mycobacterium avium subsp. paratuberculosis
cgacggcccgccgg

SEQ ID NO: 3003802 - RNA, 16 nt, Mycobacterium avium subsp. paratuberculosis
cgacggcccgccggag

SEQ ID NO: 3003803 - RNA, 19 nt, Mycobacterium avium subsp. paratuberculosis
cgacggcccgccggagccg

SEQ ID NO: 3003804 - RNA, 22 nt, Mycobacterium avium subsp. paratuberculosis
cgacggcccgccggagccgauc

SEQ ID NO: 3003805 - RNA, 16 nt, Mycobacterium avium subsp. paratuberculosis
cgacggccgcacccca

SEQ ID NO: 3003806 - RNA, 23 nt, Mycobacterium avium subsp. paratuberculosis
cgacggccgccgauuccggccgg

SEQ ID NO: 3003807 - RNA, 15 nt, Mycobacterium avium subsp. paratuberculosis
cgacggccgccgcga

SEQ ID NO: 3003808 - RNA, 17 nt, Mycobacterium avium subsp. paratuberculosis
cgacggccgccgcgacg

SEQ ID NO: 3003809 - RNA, 18 nt, Mycobacterium avium subsp. paratuberculosis
cgacggccgccgcgacgc

SEQ ID NO: 3003810 - RNA, 14 nt, Mycobacterium avium subsp. paratuberculosis
cgacggccgcgccg

SEQ ID NO: 3003811 - RNA, 18 nt, Mycobacterium avium subsp. paratuberculosis
cgacggccgcgccgaaca

SEQ ID NO: 3003812 - RNA, 17 nt, Mycobacterium avium subsp. paratuberculosis
cgacggccgcgccguug

SEQ ID NO: 3003813 - RNA, 12 nt, Mycobacterium avium subsp. paratuberculosis
cgacggccggcg

SEQ ID NO: 3003814 - RNA, 13 nt, Mycobacterium avium subsp. paratuberculosis
cgacggccggcgu

SEQ ID NO: 3003815 - RNA, 15 nt, Mycobacterium avium subsp. paratuberculosis
cgacggccggcguca

SEQ ID NO: 3003816 - RNA, 23 nt, Mycobacterium avium subsp. paratuberculosis
cgacggccggcgucacucuggcg

SEQ ID NO: 3003817 - RNA, 19 nt, Mycobacterium avium subsp. paratuberculosis
cgacggccggggccagcac

SEQ ID NO: 3003818 - RNA, 14 nt, Mycobacterium avium subsp. paratuberculosis
cgacggccggguca

SEQ ID NO: 3003819 - RNA, 14 nt, Mycobacterium avium subsp. paratuberculosis
cgacggccguccgg

SEQ ID NO: 3003820 - RNA, 17 nt, Mycobacterium avium subsp. paratuberculosis
cgacggccguccggucg

SEQ ID NO: 3003821 - RNA, 21 nt, Mycobacterium avium subsp. paratuberculosis
cgacggccucgccgucgcgau

SEQ ID NO: 3003822 - RNA, 20 nt, Mycobacterium avium subsp. paratuberculosis
cgacggccucguggaaaucg

SEQ ID NO: 3003823 - RNA, 15 nt, Mycobacterium avium subsp. paratuberculosis
cgacggccugcacgu

SEQ ID NO: 3003824 - RNA, 19 nt, Mycobacterium avium subsp. paratuberculosis
cgacggcgaacgucgaugu

SEQ ID NO: 3003825 - RNA, 17 nt, Mycobacterium avium subsp. paratuberculosis
cgacggcgaagccggcg

SEQ ID NO: 3003826 - RNA, 18 nt, Mycobacterium avium subsp. paratuberculosis
cgacggcgaagccggcgu

SEQ ID NO: 3003827 - RNA, 14 nt, Mycobacterium avium subsp. paratuberculosis
cgacggcgaccaca

SEQ ID NO: 3003828 - RNA, 20 nt, Mycobacterium avium subsp. paratuberculosis
cgacggcgaccauccacucg

SEQ ID NO: 3003829 - RNA, 22 nt, Mycobacterium avium subsp. paratuberculosis
cgacggcgaccauccacucggg

SEQ ID NO: 3003830 - RNA, 11 nt, Mycobacterium avium subsp. paratuberculosis
cgacggcgacg

SEQ ID NO: 3003831 - RNA, 14 nt, Mycobacterium avium subsp. paratuberculosis
cgacggcgacgacc

SEQ ID NO: 3003832 - RNA, 15 nt, Mycobacterium avium subsp. paratuberculosis
cgacggcgacgaccg

SEQ ID NO: 3003833 - RNA, 15 nt, Mycobacterium avium subsp. paratuberculosis
cgacggcgacggcca

SEQ ID NO: 3003834 - RNA, 18 nt, Mycobacterium avium subsp. paratuberculosis
cgacggcgacggcguccg

SEQ ID NO: 3003835 - RNA, 18 nt, Mycobacterium avium subsp. paratuberculosis
cgacggcgagccgggccg

SEQ ID NO: 3003836 - RNA, 20 nt, Mycobacterium avium subsp. paratuberculosis
cgacggcgaguucgaugacg

SEQ ID NO: 3003837 - RNA, 12 nt, Mycobacterium avium subsp. paratuberculosis
cgacggcgccgc

SEQ ID NO: 3003838 - RNA, 13 nt, Mycobacterium avium subsp. paratuberculosis
cgacggcgccgcc

SEQ ID NO: 3003839 - RNA, 15 nt, Mycobacterium avium subsp. paratuberculosis
cgacggcgccgcccg

SEQ ID NO: 3003840 - RNA, 16 nt, Mycobacterium avium subsp. paratuberculosis
cgacggcgccgcccgg

SEQ ID NO: 3003841 - RNA, 17 nt, Mycobacterium avium subsp. paratuberculosis
cgacggcgccgcccggg

SEQ ID NO: 3003842 - RNA, 19 nt, Mycobacterium avium subsp. paratuberculosis
cgacggcgccgcccgggcc

SEQ ID NO: 3003843 - RNA, 14 nt, Mycobacterium avium subsp. paratuberculosis
cgacggcgccgcgg

SEQ ID NO: 3003844 - RNA, 15 nt, Mycobacterium avium subsp. paratuberculosis
cgacggcgccgcguc

SEQ ID NO: 3003845 - RNA, 17 nt, Mycobacterium avium subsp. paratuberculosis
cgacggcgccgcgucgg

SEQ ID NO: 3003846 - RNA, 12 nt, Mycobacterium avium subsp. paratuberculosis
cgacggcgccgg

SEQ ID NO: 3003847 - RNA, 13 nt, Mycobacterium avium subsp. paratuberculosis
cgacggcgccggu

SEQ ID NO: 3003848 - RNA, 13 nt, Mycobacterium avium subsp. paratuberculosis
cgacggcgccuga

SEQ ID NO: 3003849 - RNA, 14 nt, Mycobacterium avium subsp. paratuberculosis
cgacggcgccugau

SEQ ID NO: 3003850 - RNA, 23 nt, Mycobacterium avium subsp. paratuberculosis
cgacggcgccugauccgcgguca

SEQ ID NO: 3003851 - RNA, 12 nt, Mycobacterium avium subsp. paratuberculosis
cgacggcgcgcc

SEQ ID NO: 3003852 - RNA, 13 nt, Mycobacterium avium subsp. paratuberculosis
cgacggcgcgccc

SEQ ID NO: 3003853 - RNA, 15 nt, Mycobacterium avium subsp. paratuberculosis
cgacggcgcgcccga

SEQ ID NO: 3003854 - RNA, 20 nt, Mycobacterium avium subsp. paratuberculosis
cgacggcgcgcccgacgaug

SEQ ID NO: 3003855 - RNA, 21 nt, Mycobacterium avium subsp. paratuberculosis
cgacggcgcgcccgacgaugc

SEQ ID NO: 3003856 - RNA, 22 nt, Mycobacterium avium subsp. paratuberculosis
cgacggcgcgcccgacgaugcg

SEQ ID NO: 3003857 - RNA, 13 nt, Mycobacterium avium subsp. paratuberculosis
cgacggcgcguga

SEQ ID NO: 3003858 - RNA, 15 nt, Mycobacterium avium subsp. paratuberculosis
cgacggcgcgugauc

SEQ ID NO: 3003859 - RNA, 19 nt, Mycobacterium avium subsp. paratuberculosis
cgacggcgcucaccggcgu

SEQ ID NO: 3003860 - RNA, 20 nt, Mycobacterium avium subsp. paratuberculosis
cgacggcgcucaccggcgug

SEQ ID NO: 3003861 - RNA, 21 nt, Mycobacterium avium subsp. paratuberculosis
cgacggcgcucaccggcgugg

SEQ ID NO: 3003862 - RNA, 19 nt, Mycobacterium avium subsp. paratuberculosis
cgacggcgcuggccgcggc

SEQ ID NO: 3003863 - RNA, 17 nt, Mycobacterium avium subsp. paratuberculosis
cgacggcggcgaagacg

SEQ ID NO: 3003864 - RNA, 22 nt, Mycobacterium avium subsp. paratuberculosis
cgacggcggcgaagacgucggc

SEQ ID NO: 3003865 - RNA, 14 nt, Mycobacterium avium subsp. paratuberculosis
cgacggcggggaug

SEQ ID NO: 3003866 - RNA, 14 nt, Mycobacterium avium subsp. paratuberculosis
cgacggcggggugc

SEQ ID NO: 3003867 - RNA, 15 nt, Mycobacterium avium subsp. paratuberculosis
cgacggcggggugcg

SEQ ID NO: 3003868 - RNA, 16 nt, Mycobacterium avium subsp. paratuberculosis
cgacggcggggugcgc

SEQ ID NO: 3003869 - RNA, 19 nt, Mycobacterium avium subsp. paratuberculosis
cgacggcggggugcgcggc

SEQ ID NO: 3003870 - RNA, 18 nt, Mycobacterium avium subsp. paratuberculosis
cgacggcgguucgaagcg

SEQ ID NO: 3003871 - RNA, 17 nt, Mycobacterium avium subsp. paratuberculosis
cgacggcguccagcugc

SEQ ID NO: 3003872 - RNA, 13 nt, Mycobacterium avium subsp. paratuberculosis
cgacggcguccgg

SEQ ID NO: 3003873 - RNA, 14 nt, Mycobacterium avium subsp. paratuberculosis
cgacggcguccggg

SEQ ID NO: 3003874 - RNA, 17 nt, Mycobacterium avium subsp. paratuberculosis
cgacggcguccgggcgc

SEQ ID NO: 3003875 - RNA, 13 nt, Mycobacterium avium subsp. paratuberculosis
cgacggcgucggc

SEQ ID NO: 3003876 - RNA, 15 nt, Mycobacterium avium subsp. paratuberculosis
cgacggcgucggcgg

SEQ ID NO: 3003877 - RNA, 18 nt, Mycobacterium avium subsp. paratuberculosis
cgacggcguggaacacgc

SEQ ID NO: 3003878 - RNA, 20 nt, Mycobacterium avium subsp. paratuberculosis
cgacggcguggaacacgccc

SEQ ID NO: 3003879 - RNA, 22 nt, Mycobacterium avium subsp. paratuberculosis
cgacggcguggaacacgcccag

SEQ ID NO: 3003880 - RNA, 17 nt, Mycobacterium avium subsp. paratuberculosis
cgacggcguggucggcg

SEQ ID NO: 3003881 - RNA, 18 nt, Mycobacterium avium subsp. paratuberculosis
cgacggcguggucggcga

SEQ ID NO: 3003882 - RNA, 19 nt, Mycobacterium avium subsp. paratuberculosis
cgacggcguugcuggcgcg

SEQ ID NO: 3003883 - RNA, 20 nt, Mycobacterium avium subsp. paratuberculosis
cgacggcguugcuggcgcga

SEQ ID NO: 3003884 - RNA, 21 nt, Mycobacterium avium subsp. paratuberculosis
cgacggcuaccugaccagcgg

SEQ ID NO: 3003885 - RNA, 22 nt, Mycobacterium avium subsp. paratuberculosis
cgacggcuccuaugucggugcg

SEQ ID NO: 3003886 - RNA, 19 nt, Mycobacterium avium subsp. paratuberculosis
cgacggcucuucgcggcgg

SEQ ID NO: 3003887 - RNA, 18 nt, Mycobacterium avium subsp. paratuberculosis
cgacggcugcccggcccg

SEQ ID NO: 3003888 - RNA, 21 nt, Mycobacterium avium subsp. paratuberculosis
cgacggcugcgguuggccggc

SEQ ID NO: 3003889 - RNA, 21 nt, Mycobacterium avium subsp. paratuberculosis
cgacggcuggaaucccgccuc

SEQ ID NO: 3003890 - RNA, 15 nt, Mycobacterium avium subsp. paratuberculosis
cgacggcuggguggc

SEQ ID NO: 3003891 - RNA, 19 nt, Mycobacterium avium subsp. paratuberculosis
cgacggcuggguggcgaaa

SEQ ID NO: 3003892 - RNA, 16 nt, Mycobacterium avium subsp. paratuberculosis
cgacgggaacucggcc

SEQ ID NO: 3003893 - RNA, 17 nt, Mycobacterium avium subsp. paratuberculosis
cgacgggauaguccggc

SEQ ID NO: 3003894 - RNA, 20 nt, Mycobacterium avium subsp. paratuberculosis
cgacgggauaguccggcaug

SEQ ID NO: 3003895 - RNA, 17 nt, Mycobacterium avium subsp. paratuberculosis
cgacgggcacccgcgcg

SEQ ID NO: 3003896 - RNA, 14 nt, Mycobacterium avium subsp. paratuberculosis
cgacgggcagggug

SEQ ID NO: 3003897 - RNA, 18 nt, Mycobacterium avium subsp. paratuberculosis
cgacgggcaugccgucgg

SEQ ID NO: 3003898 - RNA, 22 nt, Mycobacterium avium subsp. paratuberculosis
cgacgggcaugccgucggcgcc

SEQ ID NO: 3003899 - RNA, 16 nt, Mycobacterium avium subsp. paratuberculosis
cgacgggccaccagcg

SEQ ID NO: 3003900 - RNA, 17 nt, Mycobacterium avium subsp. paratuberculosis
cgacgggcccagcgcga

SEQ ID NO: 3003901 - RNA, 13 nt, Mycobacterium avium subsp. paratuberculosis
cgacgggccgggc

SEQ ID NO: 3003902 - RNA, 22 nt, Mycobacterium avium subsp. paratuberculosis
cgacgggccgggcacgucgacg

SEQ ID NO: 3003903 - RNA, 23 nt, Mycobacterium avium subsp. paratuberculosis
cgacgggccgggcacgucgacgc

SEQ ID NO: 3003904 - RNA, 13 nt, Mycobacterium avium subsp. paratuberculosis
cgacgggcguccg

SEQ ID NO: 3003905 - RNA, 14 nt, Mycobacterium avium subsp. paratuberculosis
cgacgggcguccga

SEQ ID NO: 3003906 - RNA, 15 nt, Mycobacterium avium subsp. paratuberculosis
cgacgggcgugccgg

SEQ ID NO: 3003907 - RNA, 18 nt, Mycobacterium avium subsp. paratuberculosis
cgacgggcgugccggcgg

SEQ ID NO: 3003908 - RNA, 22 nt, Mycobacterium avium subsp. paratuberculosis
cgacgggcguguagccugcggc

SEQ ID NO: 3003909 - RNA, 13 nt, Mycobacterium avium subsp. paratuberculosis
cgacgggcucggc

SEQ ID NO: 3003910 - RNA, 14 nt, Mycobacterium avium subsp. paratuberculosis
cgacgggcugcugc

SEQ ID NO: 3003911 - RNA, 15 nt, Mycobacterium avium subsp. paratuberculosis
cgacgggcugcugca

SEQ ID NO: 3003912 - RNA, 18 nt, Mycobacterium avium subsp. paratuberculosis
cgacgggcugcugcacgu

SEQ ID NO: 3003913 - RNA, 22 nt, Mycobacterium avium subsp. paratuberculosis
cgacgggcugucccggccgcga

SEQ ID NO: 3003914 - RNA, 18 nt, Mycobacterium avium subsp. paratuberculosis
cgacggggaacucgguga

SEQ ID NO: 3003915 - RNA, 23 nt, Mycobacterium avium subsp. paratuberculosis
cgacggggaacucggugaugccg

SEQ ID NO: 3003916 - RNA, 15 nt, Mycobacterium avium subsp. paratuberculosis
cgacggggucggaca

SEQ ID NO: 3003917 - RNA, 16 nt, Mycobacterium avium subsp. paratuberculosis
cgacggggucggacag

SEQ ID NO: 3003918 - RNA, 18 nt, Mycobacterium avium subsp. paratuberculosis
cgacggguugcggaucgg

SEQ ID NO: 3003919 - RNA, 23 nt, Mycobacterium avium subsp. paratuberculosis
cgacggguugcggaucggugcag

SEQ ID NO: 3003920 - RNA, 15 nt, Mycobacterium avium subsp. paratuberculosis
cgacggucaccggca

SEQ ID NO: 3003921 - RNA, 17 nt, Mycobacterium avium subsp. paratuberculosis
cgacggucaccggcagg

SEQ ID NO: 3003922 - RNA, 12 nt, Mycobacterium avium subsp. paratuberculosis
cgacggucacgc

SEQ ID NO: 3003923 - RNA, 14 nt, Mycobacterium avium subsp. paratuberculosis
cgacggucacgcug

SEQ ID NO: 3003924 - RNA, 15 nt, Mycobacterium avium subsp. paratuberculosis
cgacggucacgcugg

SEQ ID NO: 3003925 - RNA, 20 nt, Mycobacterium avium subsp. paratuberculosis
cgacggucacgcuggcguga

SEQ ID NO: 3003926 - RNA, 16 nt, Mycobacterium avium subsp. paratuberculosis
cgacggucacggccgc

SEQ ID NO: 3003927 - RNA, 17 nt, Mycobacterium avium subsp. paratuberculosis
cgacggucacggccgcc

SEQ ID NO: 3003928 - RNA, 18 nt, Mycobacterium avium subsp. paratuberculosis
cgacggucagcacgcuga

SEQ ID NO: 3003929 - RNA, 17 nt, Mycobacterium avium subsp. paratuberculosis
cgacggucaguccgggu

SEQ ID NO: 3003930 - RNA, 12 nt, Mycobacterium avium subsp. paratuberculosis
cgacggucgcca

SEQ ID NO: 3003931 - RNA, 14 nt, Mycobacterium avium subsp. paratuberculosis
cgacggucgccacc

SEQ ID NO: 3003932 - RNA, 15 nt, Mycobacterium avium subsp. paratuberculosis
cgacggucgccacca

SEQ ID NO: 3003933 - RNA, 15 nt, Mycobacterium avium subsp. paratuberculosis
cgacggucgugcugg

SEQ ID NO: 3003934 - RNA, 23 nt, Mycobacterium avium subsp. paratuberculosis
cgacggucgugcugggccgggcg

SEQ ID NO: 3003935 - RNA, 18 nt, Mycobacterium avium subsp. paratuberculosis
cgacggucuucccgccgc

SEQ ID NO: 3003936 - RNA, 20 nt, Mycobacterium avium subsp. paratuberculosis
cgacggucuucccgccgccg

SEQ ID NO: 3003937 - RNA, 22 nt, Mycobacterium avium subsp. paratuberculosis
cgacggucuucccgccgccguc

SEQ ID NO: 3003938 - RNA, 13 nt, Mycobacterium avium subsp. paratuberculosis
cgacggugaccgg

SEQ ID NO: 3003939 - RNA, 16 nt, Mycobacterium avium subsp. paratuberculosis
cgacggugaccggcuc

SEQ ID NO: 3003940 - RNA, 21 nt, Mycobacterium avium subsp. paratuberculosis
cgacggugaccucgucgggcg

SEQ ID NO: 3003941 - RNA, 23 nt, Mycobacterium avium subsp. paratuberculosis
cgacggugaccucgucgggcgcc

SEQ ID NO: 3003942 - RNA, 19 nt, Mycobacterium avium subsp. paratuberculosis
cgacggugagcaacaccgg

SEQ ID NO: 3003943 - RNA, 17 nt, Mycobacterium avium subsp. paratuberculosis
cgacggugagcaccgcc

SEQ ID NO: 3003944 - RNA, 18 nt, Mycobacterium avium subsp. paratuberculosis
cgacggugagcaccgccg

SEQ ID NO: 3003945 - RNA, 17 nt, Mycobacterium avium subsp. paratuberculosis
cgacggugaucaggguc

SEQ ID NO: 3003946 - RNA, 18 nt, Mycobacterium avium subsp. paratuberculosis
cgacggugaugucgccgg

SEQ ID NO: 3003947 - RNA, 15 nt, Mycobacterium avium subsp. paratuberculosis
cgacggugcaugcgc

SEQ ID NO: 3003948 - RNA, 12 nt, Mycobacterium avium subsp. paratuberculosis
cgacggugcgcc

SEQ ID NO: 3003949 - RNA, 14 nt, Mycobacterium avium subsp. paratuberculosis
cgacggugcgcccg

SEQ ID NO: 3003950 - RNA, 15 nt, Mycobacterium avium subsp. paratuberculosis
cgacggugcgcccgu

SEQ ID NO: 3003951 - RNA, 17 nt, Mycobacterium avium subsp. paratuberculosis
cgacggugcgcccgucg

SEQ ID NO: 3003952 - RNA, 23 nt, Mycobacterium avium subsp. paratuberculosis
cgacggugcugccguugggcacg

SEQ ID NO: 3003953 - RNA, 17 nt, Mycobacterium avium subsp. paratuberculosis
cgacgguggagcggccc

SEQ ID NO: 3003954 - RNA, 21 nt, Mycobacterium avium subsp. paratuberculosis
cgacgguggagcggcccagcu

SEQ ID NO: 3003955 - RNA, 23 nt, Mycobacterium avium subsp. paratuberculosis
cgacgguggagcggcccagcucg

SEQ ID NO: 3003956 - RNA, 15 nt, Mycobacterium avium subsp. paratuberculosis
cgacgguggccccca

SEQ ID NO: 3003957 - RNA, 17 nt, Mycobacterium avium subsp. paratuberculosis
cgacgguggccucggcg

SEQ ID NO: 3003958 - RNA, 22 nt, Mycobacterium avium subsp. paratuberculosis
cgacgguggccucggcgcugcc

SEQ ID NO: 3003959 - RNA, 15 nt, Mycobacterium avium subsp. paratuberculosis
cgacgguggcggcga

SEQ ID NO: 3003960 - RNA, 17 nt, Mycobacterium avium subsp. paratuberculosis
cgacgguggcggcgaug

SEQ ID NO: 3003961 - RNA, 20 nt, Mycobacterium avium subsp. paratuberculosis
cgacgguggcggcgaugucg

SEQ ID NO: 3003962 - RNA, 16 nt, Mycobacterium avium subsp. paratuberculosis
cgacgguggcgggccg

SEQ ID NO: 3003963 - RNA, 20 nt, Mycobacterium avium subsp. paratuberculosis
cgacgguggcgggccgccgg

SEQ ID NO: 3003964 - RNA, 18 nt, Mycobacterium avium subsp. paratuberculosis
cgacgguguaggacgccg

SEQ ID NO: 3003965 - RNA, 19 nt, Mycobacterium avium subsp. paratuberculosis
cgacgguguaggacgccgu

SEQ ID NO: 3003966 - RNA, 14 nt, Mycobacterium avium subsp. paratuberculosis
cgacgguguccgcg

SEQ ID NO: 3003967 - RNA, 17 nt, Mycobacterium avium subsp. paratuberculosis
cgacgguguccgcggcg

SEQ ID NO: 3003968 - RNA, 16 nt, Mycobacterium avium subsp. paratuberculosis
cgacgguguccgcggg

SEQ ID NO: 3003969 - RNA, 15 nt, Mycobacterium avium subsp. paratuberculosis
cgacggugucguaga

SEQ ID NO: 3003970 - RNA, 20 nt, Mycobacterium avium subsp. paratuberculosis
cgacggugucguagacgacg

SEQ ID NO: 3003971 - RNA, 21 nt, Mycobacterium avium subsp. paratuberculosis
cgacggugucguagacgacgu

SEQ ID NO: 3003972 - RNA, 18 nt, Mycobacterium avium subsp. paratuberculosis
cgacgguuguucagcccg

SEQ ID NO: 3003973 - RNA, 22 nt, Mycobacterium avium subsp. paratuberculosis
cgacgguuguucagcccgguca

SEQ ID NO: 3003974 - RNA, 20 nt, Mycobacterium avium subsp. paratuberculosis
cgacgguuugcccggcgaug

SEQ ID NO: 3003975 - RNA, 21 nt, Mycobacterium avium subsp. paratuberculosis
cgacgguuugcccggcgaugu

SEQ ID NO: 3003976 - RNA, 21 nt, Mycobacterium avium subsp. paratuberculosis
cgacguaaccguacggcccga

SEQ ID NO: 3003977 - RNA, 22 nt, Mycobacterium avium subsp. paratuberculosis
cgacguaaccguacggcccgaa

SEQ ID NO: 3003978 - RNA, 20 nt, Mycobacterium avium subsp. paratuberculosis
cgacguacagcgagccgucg

SEQ ID NO: 3003979 - RNA, 23 nt, Mycobacterium avium subsp. paratuberculosis
cgacguacagcgagccgucgacc

SEQ ID NO: 3003980 - RNA, 17 nt, Mycobacterium avium subsp. paratuberculosis
cgacguacaucagcucg

SEQ ID NO: 3003981 - RNA, 18 nt, Mycobacterium avium subsp. paratuberculosis
cgacguacaucagcucgu

SEQ ID NO: 3003982 - RNA, 14 nt, Mycobacterium avium subsp. paratuberculosis
cgacguacccccgc

SEQ ID NO: 3003983 - RNA, 17 nt, Mycobacterium avium subsp. paratuberculosis
cgacguacccccgcacg

SEQ ID NO: 3003984 - RNA, 16 nt, Mycobacterium avium subsp. paratuberculosis
cgacguagacgagccg

SEQ ID NO: 3003985 - RNA, 15 nt, Mycobacterium avium subsp. paratuberculosis
cgacguagcccgccg

SEQ ID NO: 3003986 - RNA, 16 nt, Mycobacterium avium subsp. paratuberculosis
cgacguagcccgccga

SEQ ID NO: 3003987 - RNA, 14 nt, Mycobacterium avium subsp. paratuberculosis
cgacguaggacagc

SEQ ID NO: 3003988 - RNA, 17 nt, Mycobacterium avium subsp. paratuberculosis
cgacguaggacagcacc

SEQ ID NO: 3003989 - RNA, 14 nt, Mycobacterium avium subsp. paratuberculosis
cgacguaggccaga

SEQ ID NO: 3003990 - RNA, 16 nt, Mycobacterium avium subsp. paratuberculosis
cgacguaggccagauc

SEQ ID NO: 3003991 - RNA, 20 nt, Mycobacterium avium subsp. paratuberculosis
cgacguaggugagcaacgcc

SEQ ID NO: 3003992 - RNA, 15 nt, Mycobacterium avium subsp. paratuberculosis
cgacguaguccggcc

SEQ ID NO: 3003993 - RNA, 18 nt, Mycobacterium avium subsp. paratuberculosis
cgacguagucgcgcacca

SEQ ID NO: 3003994 - RNA, 14 nt, Mycobacterium avium subsp. paratuberculosis
cgacgucaacaccg

SEQ ID NO: 3003995 - RNA, 15 nt, Mycobacterium avium subsp. paratuberculosis
cgacgucaacaccgu

SEQ ID NO: 3003996 - RNA, 16 nt, Mycobacterium avium subsp. paratuberculosis
cgacgucaacaccgug

SEQ ID NO: 3003997 - RNA, 21 nt, Mycobacterium avium subsp. paratuberculosis
cgacgucaacaccguggugga

SEQ ID NO: 3003998 - RNA, 13 nt, Mycobacterium avium subsp. paratuberculosis
cgacgucaccacc

SEQ ID NO: 3003999 - RNA, 14 nt, Mycobacterium avium subsp. paratuberculosis
cgacgucaccaccg

SEQ ID NO: 3004000 - RNA, 16 nt, Mycobacterium avium subsp. paratuberculosis
cgacgucaccaccggg

SEQ ID NO: 3004001 - RNA, 21 nt, Mycobacterium avium subsp. paratuberculosis
cgacgucaccaccgggucguc

SEQ ID NO: 3004002 - RNA, 15 nt, Mycobacterium avium subsp. paratuberculosis
cgacgucacgacggu

SEQ ID NO: 3004003 - RNA, 17 nt, Mycobacterium avium subsp. paratuberculosis
cgacgucacgacgguca

SEQ ID NO: 3004004 - RNA, 21 nt, Mycobacterium avium subsp. paratuberculosis
cgacgucacgacggucacggc

SEQ ID NO: 3004005 - RNA, 18 nt, Mycobacterium avium subsp. paratuberculosis
cgacgucagcucccccga

SEQ ID NO: 3004006 - RNA, 23 nt, Mycobacterium avium subsp. paratuberculosis
cgacgucagcucccccgacaccg

SEQ ID NO: 3004007 - RNA, 23 nt, Mycobacterium avium subsp. paratuberculosis
cgacgucaggguggccucgucgg

SEQ ID NO: 3004008 - RNA, 22 nt, Mycobacterium avium subsp. paratuberculosis
cgacgucaggucgaccggcucg

SEQ ID NO: 3004009 - RNA, 17 nt, Mycobacterium avium subsp. paratuberculosis
cgacgucauccggcugc

SEQ ID NO: 3004010 - RNA, 18 nt, Mycobacterium avium subsp. paratuberculosis
cgacgucauccggcugcc

SEQ ID NO: 3004011 - RNA, 22 nt, Mycobacterium avium subsp. paratuberculosis
cgacguccaccggauggcgccc

SEQ ID NO: 3004012 - RNA, 17 nt, Mycobacterium avium subsp. paratuberculosis
cgacguccaggccggcg

SEQ ID NO: 3004013 - RNA, 18 nt, Mycobacterium avium subsp. paratuberculosis
cgacguccaggccggcgc

SEQ ID NO: 3004014 - RNA, 23 nt, Mycobacterium avium subsp. paratuberculosis
cgacguccaucgggaccgcgggc

SEQ ID NO: 3004015 - RNA, 13 nt, Mycobacterium avium subsp. paratuberculosis
cgacguccgggcc

SEQ ID NO: 3004016 - RNA, 15 nt, Mycobacterium avium subsp. paratuberculosis
cgacguccgggccgc

SEQ ID NO: 3004017 - RNA, 16 nt, Mycobacterium avium subsp. paratuberculosis
cgacguccgggccgcc

SEQ ID NO: 3004018 - RNA, 18 nt, Mycobacterium avium subsp. paratuberculosis
cgacguccgggccgccuc

SEQ ID NO: 3004019 - RNA, 19 nt, Mycobacterium avium subsp. paratuberculosis
cgacguccgggccgccucg

SEQ ID NO: 3004020 - RNA, 17 nt, Mycobacterium avium subsp. paratuberculosis
cgacguccucgacgauc

SEQ ID NO: 3004021 - RNA, 20 nt, Mycobacterium avium subsp. paratuberculosis
cgacguccucgacgaucagc

SEQ ID NO: 3004022 - RNA, 24 nt, Mycobacterium avium subsp. paratuberculosis
cgacguccucgacgaucagcacgu

SEQ ID NO: 3004023 - RNA, 16 nt, Mycobacterium avium subsp. paratuberculosis
cgacguccucgaugcc

SEQ ID NO: 3004024 - RNA, 19 nt, Mycobacterium avium subsp. paratuberculosis
cgacguccucgaugccgac

SEQ ID NO: 3004025 - RNA, 14 nt, Mycobacterium avium subsp. paratuberculosis
cgacguccucgccc

SEQ ID NO: 3004026 - RNA, 20 nt, Mycobacterium avium subsp. paratuberculosis
cgacguccuggaucgcgcag

SEQ ID NO: 3004027 - RNA, 14 nt, Mycobacterium avium subsp. paratuberculosis
cgacguccugguug

SEQ ID NO: 3004028 - RNA, 17 nt, Mycobacterium avium subsp. paratuberculosis
cgacguccuugaucagc

SEQ ID NO: 3004029 - RNA, 20 nt, Mycobacterium avium subsp. paratuberculosis
cgacguccuugaucagcaug

SEQ ID NO: 3004030 - RNA, 12 nt, Mycobacterium avium subsp. paratuberculosis
cgacgucgaacg

SEQ ID NO: 3004031 - RNA, 21 nt, Mycobacterium avium subsp. paratuberculosis
cgacgucgaagggucggucga

SEQ ID NO: 3004032 - RNA, 23 nt, Mycobacterium avium subsp. paratuberculosis
cgacgucgaccagguaggcgccc

SEQ ID NO: 3004033 - RNA, 19 nt, Mycobacterium avium subsp. paratuberculosis
cgacgucgaccgcgacgac

SEQ ID NO: 3004034 - RNA, 15 nt, Mycobacterium avium subsp. paratuberculosis
cgacgucgaccgcgc

SEQ ID NO: 3004035 - RNA, 17 nt, Mycobacterium avium subsp. paratuberculosis
cgacgucgaccgcgccg

SEQ ID NO: 3004036 - RNA, 18 nt, Mycobacterium avium subsp. paratuberculosis
cgacgucgaccgcgccgg

SEQ ID NO: 3004037 - RNA, 22 nt, Mycobacterium avium subsp. paratuberculosis
cgacgucgaccgcgccggggug

SEQ ID NO: 3004038 - RNA, 12 nt, Mycobacterium avium subsp. paratuberculosis
cgacgucgacgg

SEQ ID NO: 3004039 - RNA, 13 nt, Mycobacterium avium subsp. paratuberculosis
cgacgucgacggc

SEQ ID NO: 3004040 - RNA, 18 nt, Mycobacterium avium subsp. paratuberculosis
cgacgucgacggcagcgc

SEQ ID NO: 3004041 - RNA, 19 nt, Mycobacterium avium subsp. paratuberculosis
cgacgucgacggcagcgcu

SEQ ID NO: 3004042 - RNA, 14 nt, Mycobacterium avium subsp. paratuberculosis
cgacgucgacgucg

SEQ ID NO: 3004043 - RNA, 13 nt, Mycobacterium avium subsp. paratuberculosis
cgacgucgacuga

SEQ ID NO: 3004044 - RNA, 21 nt, Mycobacterium avium subsp. paratuberculosis
cgacgucgagaaaggccagca

SEQ ID NO: 3004045 - RNA, 17 nt, Mycobacterium avium subsp. paratuberculosis
cgacgucgagccagcgg

SEQ ID NO: 3004046 - RNA, 16 nt, Mycobacterium avium subsp. paratuberculosis
cgacgucgagggcgcc

SEQ ID NO: 3004047 - RNA, 17 nt, Mycobacterium avium subsp. paratuberculosis
cgacgucgagggcgccg

SEQ ID NO: 3004048 - RNA, 18 nt, Mycobacterium avium subsp. paratuberculosis
cgacgucgagggcgccgu

SEQ ID NO: 3004049 - RNA, 20 nt, Mycobacterium avium subsp. paratuberculosis
cgacgucgagggcgccguug

SEQ ID NO: 3004050 - RNA, 23 nt, Mycobacterium avium subsp. paratuberculosis
cgacgucgaugugcucggggcag

SEQ ID NO: 3004051 - RNA, 13 nt, Mycobacterium avium subsp. paratuberculosis
cgacgucgccacc

SEQ ID NO: 3004052 - RNA, 14 nt, Mycobacterium avium subsp. paratuberculosis
cgacgucgccacca

SEQ ID NO: 3004053 - RNA, 18 nt, Mycobacterium avium subsp. paratuberculosis
cgacgucgccaccagacc

SEQ ID NO: 3004054 - RNA, 21 nt, Mycobacterium avium subsp. paratuberculosis
cgacgucgccggccugcccgc

SEQ ID NO: 3004055 - RNA, 13 nt, Mycobacterium avium subsp. paratuberculosis
cgacgucgcgcag

SEQ ID NO: 3004056 - RNA, 16 nt, Mycobacterium avium subsp. paratuberculosis
cgacgucggacgcggc

SEQ ID NO: 3004057 - RNA, 18 nt, Mycobacterium avium subsp. paratuberculosis
cgacgucggacgcggccg

SEQ ID NO: 3004058 - RNA, 21 nt, Mycobacterium avium subsp. paratuberculosis
cgacgucggacgcggccgagc

SEQ ID NO: 3004059 - RNA, 15 nt, Mycobacterium avium subsp. paratuberculosis
cgacgucggagauca

SEQ ID NO: 3004060 - RNA, 14 nt, Mycobacterium avium subsp. paratuberculosis
cgacgucggcguca

SEQ ID NO: 3004061 - RNA, 16 nt, Mycobacterium avium subsp. paratuberculosis
cgacgucggcgucauc

SEQ ID NO: 3004062 - RNA, 15 nt, Mycobacterium avium subsp. paratuberculosis
cgacgucgggcacgg

SEQ ID NO: 3004063 - RNA, 18 nt, Mycobacterium avium subsp. paratuberculosis
cgacgucgggcacgguca

SEQ ID NO: 3004064 - RNA, 23 nt, Mycobacterium avium subsp. paratuberculosis
cgacgucggugaaauagcgcagc

SEQ ID NO: 3004065 - RNA, 21 nt, Mycobacterium avium subsp. paratuberculosis
cgacgucgguguagucggcga

SEQ ID NO: 3004066 - RNA, 24 nt, Mycobacterium avium subsp. paratuberculosis
cgacgucgguguagucggcgaucg

SEQ ID NO: 3004067 - RNA, 14 nt, Mycobacterium avium subsp. paratuberculosis
cgacgucguagagc

SEQ ID NO: 3004068 - RNA, 12 nt, Mycobacterium avium subsp. paratuberculosis
cgacgucgucga

SEQ ID NO: 3004069 - RNA, 13 nt, Mycobacterium avium subsp. paratuberculosis
cgacgucgucgac

SEQ ID NO: 3004070 - RNA, 15 nt, Mycobacterium avium subsp. paratuberculosis
cgacgucgucgaccc

SEQ ID NO: 3004071 - RNA, 14 nt, Mycobacterium avium subsp. paratuberculosis
cgacgucgucgaug

SEQ ID NO: 3004072 - RNA, 15 nt, Mycobacterium avium subsp. paratuberculosis
cgacgucgucgaugc

SEQ ID NO: 3004073 - RNA, 18 nt, Mycobacterium avium subsp. paratuberculosis
cgacgucgucgcccaccc

SEQ ID NO: 3004074 - RNA, 21 nt, Mycobacterium avium subsp. paratuberculosis
cgacgucgucgcccacccgcc

SEQ ID NO: 3004075 - RNA, 16 nt, Mycobacterium avium subsp. paratuberculosis
cgacgucgugcacgcc

SEQ ID NO: 3004076 - RNA, 17 nt, Mycobacterium avium subsp. paratuberculosis
cgacgucgugcacgccg

SEQ ID NO: 3004077 - RNA, 21 nt, Mycobacterium avium subsp. paratuberculosis
cgacgucgugcacgccguggc

SEQ ID NO: 3004078 - RNA, 17 nt, Mycobacterium avium subsp. paratuberculosis
cgacgucgugggcgauc

SEQ ID NO: 3004079 - RNA, 23 nt, Mycobacterium avium subsp. paratuberculosis
cgacgucgugggcgauccgcagg

SEQ ID NO: 3004080 - RNA, 16 nt, Mycobacterium avium subsp. paratuberculosis
cgacgucugcggcucg

SEQ ID NO: 3004081 - RNA, 20 nt, Mycobacterium avium subsp. paratuberculosis
cgacgucugcggcucggcgc

SEQ ID NO: 3004082 - RNA, 22 nt, Mycobacterium avium subsp. paratuberculosis
cgacgucugcggcucggcgcug

SEQ ID NO: 3004083 - RNA, 18 nt, Mycobacterium avium subsp. paratuberculosis
cgacgucugggccgccga

SEQ ID NO: 3004084 - RNA, 20 nt, Mycobacterium avium subsp. paratuberculosis
cgacgucugggccgccgagc

SEQ ID NO: 3004085 - RNA, 22 nt, Mycobacterium avium subsp. paratuberculosis
cgacgucugggccgccgagcag

SEQ ID NO: 3004086 - RNA, 20 nt, Mycobacterium avium subsp. paratuberculosis
cgacgucugguuggccggcg

SEQ ID NO: 3004087 - RNA, 22 nt, Mycobacterium avium subsp. paratuberculosis
cgacgucugguuggccggcggg

SEQ ID NO: 3004088 - RNA, 23 nt, Mycobacterium avium subsp. paratuberculosis
cgacgugacgaccuggucgccgc

SEQ ID NO: 3004089 - RNA, 20 nt, Mycobacterium avium subsp. paratuberculosis
cgacgugauaguggucgucg

SEQ ID NO: 3004090 - RNA, 15 nt, Mycobacterium avium subsp. paratuberculosis
cgacgugaucggcgg

SEQ ID NO: 3004091 - RNA, 19 nt, Mycobacterium avium subsp. paratuberculosis
cgacgugaucggcggccug

SEQ ID NO: 3004092 - RNA, 20 nt, Mycobacterium avium subsp. paratuberculosis
cgacgugaucggcggccugc

SEQ ID NO: 3004093 - RNA, 23 nt, Mycobacterium avium subsp. paratuberculosis
cgacgugaucggcggccugcggc

SEQ ID NO: 3004094 - RNA, 16 nt, Mycobacterium avium subsp. paratuberculosis
cgacgugaucuggucg

SEQ ID NO: 3004095 - RNA, 20 nt, Mycobacterium avium subsp. paratuberculosis
cgacgugaucuggucggcca

SEQ ID NO: 3004096 - RNA, 22 nt, Mycobacterium avium subsp. paratuberculosis
cgacgugaucuggucggccagc

SEQ ID NO: 3004097 - RNA, 24 nt, Mycobacterium avium subsp. paratuberculosis
cgacgugaucuggucggccagcgc

SEQ ID NO: 3004098 - RNA, 13 nt, Mycobacterium avium subsp. paratuberculosis
cgacgugaugcac

SEQ ID NO: 3004099 - RNA, 20 nt, Mycobacterium avium subsp. paratuberculosis
cgacgugauggucgucgugg

SEQ ID NO: 3004100 - RNA, 21 nt, Mycobacterium avium subsp. paratuberculosis
cgacgugauggucgucguggu

SEQ ID NO: 3004101 - RNA, 12 nt, Mycobacterium avium subsp. paratuberculosis
cgacgugcagcg

SEQ ID NO: 3004102 - RNA, 14 nt, Mycobacterium avium subsp. paratuberculosis
cgacgugcagcgcc

SEQ ID NO: 3004103 - RNA, 18 nt, Mycobacterium avium subsp. paratuberculosis
cgacgugcagcgccagca

SEQ ID NO: 3004104 - RNA, 21 nt, Mycobacterium avium subsp. paratuberculosis
cgacgugcagcgccagcaccg

SEQ ID NO: 3004105 - RNA, 14 nt, Mycobacterium avium subsp. paratuberculosis
cgacgugcccgauc

SEQ ID NO: 3004106 - RNA, 23 nt, Mycobacterium avium subsp. paratuberculosis
cgacgugcccgaucucgucggug

SEQ ID NO: 3004107 - RNA, 16 nt, Mycobacterium avium subsp. paratuberculosis
cgacgugcccuucccc

SEQ ID NO: 3004108 - RNA, 19 nt, Mycobacterium avium subsp. paratuberculosis
cgacgugcccuuccccggc

SEQ ID NO: 3004109 - RNA, 23 nt, Mycobacterium avium subsp. paratuberculosis
cgacgugcccuuccccggcggcc

SEQ ID NO: 3004110 - RNA, 17 nt, Mycobacterium avium subsp. paratuberculosis
cgacgugccggcgaugg

SEQ ID NO: 3004111 - RNA, 16 nt, Mycobacterium avium subsp. paratuberculosis
cgacgugccguugacg

SEQ ID NO: 3004112 - RNA, 13 nt, Mycobacterium avium subsp. paratuberculosis
cgacgugcgcggc

SEQ ID NO: 3004113 - RNA, 22 nt, Mycobacterium avium subsp. paratuberculosis
cgacgugcucaugucaaugccg

SEQ ID NO: 3004114 - RNA, 14 nt, Mycobacterium avium subsp. paratuberculosis
cgacgugcucggcg

SEQ ID NO: 3004115 - RNA, 18 nt, Mycobacterium avium subsp. paratuberculosis
cgacgugcucggcggccg

SEQ ID NO: 3004116 - RNA, 20 nt, Mycobacterium avium subsp. paratuberculosis
cgacgugcuuggccagcucg

SEQ ID NO: 3004117 - RNA, 16 nt, Mycobacterium avium subsp. paratuberculosis
cgacgugggcggccac

SEQ ID NO: 3004118 - RNA, 17 nt, Mycobacterium avium subsp. paratuberculosis
cgacgugggcggccacc

SEQ ID NO: 3004119 - RNA, 17 nt, Mycobacterium avium subsp. paratuberculosis
cgacguggugcaccgcc

SEQ ID NO: 3004120 - RNA, 20 nt, Mycobacterium avium subsp. paratuberculosis
cgacgugguggaugaugccg

SEQ ID NO: 3004121 - RNA, 21 nt, Mycobacterium avium subsp. paratuberculosis
cgacgugguggaugaugccgg

SEQ ID NO: 3004122 - RNA, 22 nt, Mycobacterium avium subsp. paratuberculosis
cgacgugucgucgucgccgccg

SEQ ID NO: 3004123 - RNA, 17 nt, Mycobacterium avium subsp. paratuberculosis
cgacguguucaacgcgc

SEQ ID NO: 3004124 - RNA, 19 nt, Mycobacterium avium subsp. paratuberculosis
cgacguguucaacgcgccg

SEQ ID NO: 3004125 - RNA, 15 nt, Mycobacterium avium subsp. paratuberculosis
cgacguucgagucgg

SEQ ID NO: 3004126 - RNA, 18 nt, Mycobacterium avium subsp. paratuberculosis
cgacguucgagucggcca

SEQ ID NO: 3004127 - RNA, 20 nt, Mycobacterium avium subsp. paratuberculosis
cgacguucgagucggccacg

SEQ ID NO: 3004128 - RNA, 21 nt, Mycobacterium avium subsp. paratuberculosis
cgacguucgagucggccacgu

SEQ ID NO: 3004129 - RNA, 21 nt, Mycobacterium avium subsp. paratuberculosis
cgacguucgauugcaccaccg

SEQ ID NO: 3004130 - RNA, 15 nt, Mycobacterium avium subsp. paratuberculosis
cgacguucgccgcca

SEQ ID NO: 3004131 - RNA, 18 nt, Mycobacterium avium subsp. paratuberculosis
cgacguucgccgccagca

SEQ ID NO: 3004132 - RNA, 13 nt, Mycobacterium avium subsp. paratuberculosis
cgacguucggcgg

SEQ ID NO: 3004133 - RNA, 14 nt, Mycobacterium avium subsp. paratuberculosis
cgacguucggcggg

SEQ ID NO: 3004134 - RNA, 17 nt, Mycobacterium avium subsp. paratuberculosis
cgacguucggcgggcag

SEQ ID NO: 3004135 - RNA, 20 nt, Mycobacterium avium subsp. paratuberculosis
cgacguucggcgggcaggcc

SEQ ID NO: 3004136 - RNA, 15 nt, Mycobacterium avium subsp. paratuberculosis
cgacguugccgcugg

SEQ ID NO: 3004137 - RNA, 16 nt, Mycobacterium avium subsp. paratuberculosis
cgacguugcgggccag

SEQ ID NO: 3004138 - RNA, 18 nt, Mycobacterium avium subsp. paratuberculosis
cgacguugcgggccaggu

SEQ ID NO: 3004139 - RNA, 15 nt, Mycobacterium avium subsp. paratuberculosis
cgacguuggccagca

SEQ ID NO: 3004140 - RNA, 20 nt, Mycobacterium avium subsp. paratuberculosis
cgacguuggccagcaccgcg

SEQ ID NO: 3004141 - RNA, 21 nt, Mycobacterium avium subsp. paratuberculosis
cgacguuggccagcaccgcgg

SEQ ID NO: 3004142 - RNA, 15 nt, Mycobacterium avium subsp. paratuberculosis
cgacuagcgcggcgg

SEQ ID NO: 3004143 - RNA, 17 nt, Mycobacterium avium subsp. paratuberculosis
cgacuagcgcggcggcc

SEQ ID NO: 3004144 - RNA, 16 nt, Mycobacterium avium subsp. paratuberculosis
cgacuccaccaccugg

SEQ ID NO: 3004145 - RNA, 19 nt, Mycobacterium avium subsp. paratuberculosis
cgacuccaccaccuggccg

SEQ ID NO: 3004146 - RNA, 23 nt, Mycobacterium avium subsp. paratuberculosis
cgacuccaccaccuggccggcca

SEQ ID NO: 3004147 - RNA, 14 nt, Mycobacterium avium subsp. paratuberculosis
cgacuccagcaccg

SEQ ID NO: 3004148 - RNA, 15 nt, Mycobacterium avium subsp. paratuberculosis
cgacuccagcaccgg

SEQ ID NO: 3004149 - RNA, 17 nt, Mycobacterium avium subsp. paratuberculosis
cgacuccagcaccggcg

SEQ ID NO: 3004150 - RNA, 15 nt, Mycobacterium avium subsp. paratuberculosis
cgacuccagcagcgc

SEQ ID NO: 3004151 - RNA, 16 nt, Mycobacterium avium subsp. paratuberculosis
cgacuccagcagcgcc

SEQ ID NO: 3004152 - RNA, 19 nt, Mycobacterium avium subsp. paratuberculosis
cgacuccagcagcgccagc

SEQ ID NO: 3004153 - RNA, 22 nt, Mycobacterium avium subsp. paratuberculosis
cgacuccagcagcgccagcacc

SEQ ID NO: 3004154 - RNA, 23 nt, Mycobacterium avium subsp. paratuberculosis
cgacuccagcagcgccagcaccg

SEQ ID NO: 3004155 - RNA, 22 nt, Mycobacterium avium subsp. paratuberculosis
cgacuccagcagcgccuugccg

SEQ ID NO: 3004156 - RNA, 16 nt, Mycobacterium avium subsp. paratuberculosis
cgacuccagcgcgauc

SEQ ID NO: 3004157 - RNA, 16 nt, Mycobacterium avium subsp. paratuberculosis
cgacuccccgcccggc

SEQ ID NO: 3004158 - RNA, 19 nt, Mycobacterium avium subsp. paratuberculosis
cgacuccccgcccggcaac

SEQ ID NO: 3004159 - RNA, 23 nt, Mycobacterium avium subsp. paratuberculosis
cgacuccccgcccggcaacacgu

SEQ ID NO: 3004160 - RNA, 14 nt, Mycobacterium avium subsp. paratuberculosis
cgacuccggcgaca

SEQ ID NO: 3004161 - RNA, 12 nt, Mycobacterium avium subsp. paratuberculosis
cgacuccggcgc

SEQ ID NO: 3004162 - RNA, 23 nt, Mycobacterium avium subsp. paratuberculosis
cgacuccggcgccggucagcggc

SEQ ID NO: 3004163 - RNA, 14 nt, Mycobacterium avium subsp. paratuberculosis
cgacuccucacacc

SEQ ID NO: 3004164 - RNA, 16 nt, Mycobacterium avium subsp. paratuberculosis
cgacuccucacaccuc

SEQ ID NO: 3004165 - RNA, 18 nt, Mycobacterium avium subsp. paratuberculosis
cgacuccucacaccucgc

SEQ ID NO: 3004166 - RNA, 22 nt, Mycobacterium avium subsp. paratuberculosis
cgacuccucacaccucgcuacg

SEQ ID NO: 3004167 - RNA, 13 nt, Mycobacterium avium subsp. paratuberculosis
cgacuccuccggc

SEQ ID NO: 3004168 - RNA, 22 nt, Mycobacterium avium subsp. paratuberculosis
cgacuccugcaggcccucgacg

SEQ ID NO: 3004169 - RNA, 21 nt, Mycobacterium avium subsp. paratuberculosis
cgacuccuggguaagccaggu

SEQ ID NO: 3004170 - RNA, 17 nt, Mycobacterium avium subsp. paratuberculosis
cgacuccugguccucga

SEQ ID NO: 3004171 - RNA, 19 nt, Mycobacterium avium subsp. paratuberculosis
cgacuccugguccucgauc

SEQ ID NO: 3004172 - RNA, 13 nt, Mycobacterium avium subsp. paratuberculosis
cgacucgaccccg

SEQ ID NO: 3004173 - RNA, 14 nt, Mycobacterium avium subsp. paratuberculosis
cgacucgaccccgc

SEQ ID NO: 3004174 - RNA, 18 nt, Mycobacterium avium subsp. paratuberculosis
cgacucgaccccgcccag

SEQ ID NO: 3004175 - RNA, 21 nt, Mycobacterium avium subsp. paratuberculosis
cgacucgauguagccgggcuc

SEQ ID NO: 3004176 - RNA, 17 nt, Mycobacterium avium subsp. paratuberculosis
cgacucgcaggugccgg

SEQ ID NO: 3004177 - RNA, 21 nt, Mycobacterium avium subsp. paratuberculosis
cgacucgcaggugccggugac

SEQ ID NO: 3004178 - RNA, 23 nt, Mycobacterium avium subsp. paratuberculosis
cgacucgcaggugccggugacgg

SEQ ID NO: 3004179 - RNA, 16 nt, Mycobacterium avium subsp. paratuberculosis
cgacucggccuccgcg

SEQ ID NO: 3004180 - RNA, 20 nt, Mycobacterium avium subsp. paratuberculosis
cgacucggccuccgcgcgcg

SEQ ID NO: 3004181 - RNA, 13 nt, Mycobacterium avium subsp. paratuberculosis
cgacucggcggug

SEQ ID NO: 3004182 - RNA, 14 nt, Mycobacterium avium subsp. paratuberculosis
cgacucggugucgc

SEQ ID NO: 3004183 - RNA, 17 nt, Mycobacterium avium subsp. paratuberculosis
cgacucguucgacgccg

SEQ ID NO: 3004184 - RNA, 14 nt, Mycobacterium avium subsp. paratuberculosis
cgacucguuggccg

SEQ ID NO: 3004185 - RNA, 16 nt, Mycobacterium avium subsp. paratuberculosis
cgacucguuggccggc

SEQ ID NO: 3004186 - RNA, 15 nt, Mycobacterium avium subsp. paratuberculosis
cgacucugcacucag

SEQ ID NO: 3004187 - RNA, 14 nt, Mycobacterium avium subsp. paratuberculosis
cgacucuuccagga

SEQ ID NO: 3004188 - RNA, 16 nt, Mycobacterium avium subsp. paratuberculosis
cgacucuuccaggaca

SEQ ID NO: 3004189 - RNA, 22 nt, Mycobacterium avium subsp. paratuberculosis
cgacugaucgacgagccgggcc

SEQ ID NO: 3004190 - RNA, 13 nt, Mycobacterium avium subsp. paratuberculosis
cgacugcacccga

SEQ ID NO: 3004191 - RNA, 22 nt, Mycobacterium avium subsp. paratuberculosis
cgacugcacccgaacggaccgg

SEQ ID NO: 3004192 - RNA, 14 nt, Mycobacterium avium subsp. paratuberculosis
cgacugcacccggg

SEQ ID NO: 3004193 - RNA, 23 nt, Mycobacterium avium subsp. paratuberculosis
cgacugcaggaacaaccgcagcg

SEQ ID NO: 3004194 - RNA, 17 nt, Mycobacterium avium subsp. paratuberculosis
cgacugcaggugacgga

SEQ ID NO: 3004195 - RNA, 12 nt, Mycobacterium avium subsp. paratuberculosis
cgacugccccgc

SEQ ID NO: 3004196 - RNA, 16 nt, Mycobacterium avium subsp. paratuberculosis
cgacugcgcggccggc

SEQ ID NO: 3004197 - RNA, 17 nt, Mycobacterium avium subsp. paratuberculosis
cgacugcgcggccggcg

SEQ ID NO: 3004198 - RNA, 20 nt, Mycobacterium avium subsp. paratuberculosis
cgacugcgugcugggcaccg

SEQ ID NO: 3004199 - RNA, 23 nt, Mycobacterium avium subsp. paratuberculosis
cgacuggaccaccaugauguagc

SEQ ID NO: 3004200 - RNA, 14 nt, Mycobacterium avium subsp. paratuberculosis
cgacuggaucaucg

SEQ ID NO: 3004201 - RNA, 15 nt, Mycobacterium avium subsp. paratuberculosis
cgacuggaucaucga

SEQ ID NO: 3004202 - RNA, 15 nt, Mycobacterium avium subsp. paratuberculosis
cgacuggcccucgga

SEQ ID NO: 3004203 - RNA, 15 nt, Mycobacterium avium subsp. paratuberculosis
cgacuggcggcggcg

SEQ ID NO: 3004204 - RNA, 16 nt, Mycobacterium avium subsp. paratuberculosis
cgacugggcgcccacc

SEQ ID NO: 3004205 - RNA, 17 nt, Mycobacterium avium subsp. paratuberculosis
cgacuguccaggccgag

SEQ ID NO: 3004206 - RNA, 17 nt, Mycobacterium avium subsp. paratuberculosis
cgacugucggcgccccg

SEQ ID NO: 3004207 - RNA, 20 nt, Mycobacterium avium subsp. paratuberculosis
cgacugucggcgccccgccc

SEQ ID NO: 3004208 - RNA, 14 nt, Mycobacterium avium subsp. paratuberculosis
cgacugucggcucg

SEQ ID NO: 3004209 - RNA, 16 nt, Mycobacterium avium subsp. paratuberculosis
cgacugucggcucgcc

SEQ ID NO: 3004210 - RNA, 22 nt, Mycobacterium avium subsp. paratuberculosis
cgacuguuugaugccgucggug

SEQ ID NO: 3004211 - RNA, 18 nt, Mycobacterium avium subsp. paratuberculosis
cgacuucacaggccgccu

SEQ ID NO: 3004212 - RNA, 15 nt, Mycobacterium avium subsp. paratuberculosis
cgacuucccaguccg

SEQ ID NO: 3004213 - RNA, 18 nt, Mycobacterium avium subsp. paratuberculosis
cgacuucccaguccggcc

SEQ ID NO: 3004214 - RNA, 19 nt, Mycobacterium avium subsp. paratuberculosis
cgacuucccaguccggcca

SEQ ID NO: 3004215 - RNA, 20 nt, Mycobacterium avium subsp. paratuberculosis
cgacuucccaguccggccag

SEQ ID NO: 3004216 - RNA, 21 nt, Mycobacterium avium subsp. paratuberculosis
cgacuucccaguccggccagc

SEQ ID NO: 3004217 - RNA, 13 nt, Mycobacterium avium subsp. paratuberculosis
cgacuucggcucg

SEQ ID NO: 3004218 - RNA, 18 nt, Mycobacterium avium subsp. paratuberculosis
cgacuucggcucggcgac

SEQ ID NO: 3004219 - RNA, 16 nt, Mycobacterium avium subsp. paratuberculosis
cgacuucguugguggu

SEQ ID NO: 3004220 - RNA, 21 nt, Mycobacterium avium subsp. paratuberculosis
cgacuucguugguggucgacg

SEQ ID NO: 3004221 - RNA, 16 nt, Mycobacterium avium subsp. paratuberculosis
cgacuucuacggcggg

SEQ ID NO: 3004222 - RNA, 20 nt, Mycobacterium avium subsp. paratuberculosis
cgacuucuacggcgggccgg

SEQ ID NO: 3004223 - RNA, 14 nt, Mycobacterium avium subsp. paratuberculosis
cgacuucuucgccg

SEQ ID NO: 3004224 - RNA, 19 nt, Mycobacterium avium subsp. paratuberculosis
cgacuugaccagcagcugg

SEQ ID NO: 3004225 - RNA, 15 nt, Mycobacterium avium subsp. paratuberculosis
cgacuugaucgcggc

SEQ ID NO: 3004226 - RNA, 17 nt, Mycobacterium avium subsp. paratuberculosis
cgacuugaucgcggcgu

SEQ ID NO: 3004227 - RNA, 17 nt, Mycobacterium avium subsp. paratuberculosis
cgacuugccgccgcaca

SEQ ID NO: 3004228 - RNA, 13 nt, Mycobacterium avium subsp. paratuberculosis
cgacuugcgcgcc

SEQ ID NO: 3004229 - RNA, 14 nt, Mycobacterium avium subsp. paratuberculosis
cgacuugcgcgccg

SEQ ID NO: 3004230 - RNA, 19 nt, Mycobacterium avium subsp. paratuberculosis
cgacuugcgcgccgugacg

SEQ ID NO: 3004231 - RNA, 18 nt, Mycobacterium avium subsp. paratuberculosis
cgacuuggucagcccgcg

SEQ ID NO: 3004232 - RNA, 19 nt, Mycobacterium avium subsp. paratuberculosis
cgacuuggucagcccgcgc

SEQ ID NO: 3004233 - RNA, 23 nt, Mycobacterium avium subsp. paratuberculosis
cgacuuggucagcccgcgcaccg

SEQ ID NO: 3004234 - RNA, 18 nt, Mycobacterium avium subsp. paratuberculosis
cgacuuggugccaugccg

SEQ ID NO: 3004235 - RNA, 17 nt, Mycobacterium avium subsp. paratuberculosis
cgacuugguggccagca

SEQ ID NO: 3004236 - RNA, 20 nt, Mycobacterium avium subsp. paratuberculosis
cgacuugguggccagcacca

SEQ ID NO: 3004237 - RNA, 15 nt, Mycobacterium avium subsp. paratuberculosis
cgagaaaagcggcga

SEQ ID NO: 3004238 - RNA, 17 nt, Mycobacterium avium subsp. paratuberculosis
cgagaaaagcggcgaaa

SEQ ID NO: 3004239 - RNA, 20 nt, Mycobacterium avium subsp. paratuberculosis
cgagaaaaucgcccgcgaaa

SEQ ID NO: 3004240 - RNA, 17 nt, Mycobacterium avium subsp. paratuberculosis
cgagaaaggccagcacg

SEQ ID NO: 3004241 - RNA, 16 nt, Mycobacterium avium subsp. paratuberculosis
cgagaacagaugccgg

SEQ ID NO: 3004242 - RNA, 18 nt, Mycobacterium avium subsp. paratuberculosis
cgagaacagaugccggug

SEQ ID NO: 3004243 - RNA, 22 nt, Mycobacterium avium subsp. paratuberculosis
cgagaacaggccgagcgcgcug

SEQ ID NO: 3004244 - RNA, 14 nt, Mycobacterium avium subsp. paratuberculosis
cgagaaccggcgca

SEQ ID NO: 3004245 - RNA, 22 nt, Mycobacterium avium subsp. paratuberculosis
cgagaagaccugguugccgccc

SEQ ID NO: 3004246 - RNA, 14 nt, Mycobacterium avium subsp. paratuberculosis
cgagaaggcggcgu

SEQ ID NO: 3004247 - RNA, 17 nt, Mycobacterium avium subsp. paratuberculosis
cgagaaggcggcgucga

SEQ ID NO: 3004248 - RNA, 14 nt, Mycobacterium avium subsp. paratuberculosis
cgagaagggccgcc

SEQ ID NO: 3004249 - RNA, 16 nt, Mycobacterium avium subsp. paratuberculosis
cgagaagggccgccgc

SEQ ID NO: 3004250 - RNA, 17 nt, Mycobacterium avium subsp. paratuberculosis
cgagaagucgcucagcg

SEQ ID NO: 3004251 - RNA, 18 nt, Mycobacterium avium subsp. paratuberculosis
cgagacacccucgcgcag

SEQ ID NO: 3004252 - RNA, 13 nt, Mycobacterium avium subsp. paratuberculosis
cgagacaccgucg

SEQ ID NO: 3004253 - RNA, 15 nt, Mycobacterium avium subsp. paratuberculosis
cgagacaccgucgcg

SEQ ID NO: 3004254 - RNA, 22 nt, Mycobacterium avium subsp. paratuberculosis
cgagacacgcgccggcgcgggc

SEQ ID NO: 3004255 - RNA, 15 nt, Mycobacterium avium subsp. paratuberculosis
cgagaccgucggugc

SEQ ID NO: 3004256 - RNA, 14 nt, Mycobacterium avium subsp. paratuberculosis
cgagaccucccggc

SEQ ID NO: 3004257 - RNA, 19 nt, Mycobacterium avium subsp. paratuberculosis
cgagaccucccggcgccac

SEQ ID NO: 3004258 - RNA, 15 nt, Mycobacterium avium subsp. paratuberculosis
cgagacgaccaggau

SEQ ID NO: 3004259 - RNA, 16 nt, Mycobacterium avium subsp. paratuberculosis
cgagacgagccgccgc

SEQ ID NO: 3004260 - RNA, 17 nt, Mycobacterium avium subsp. paratuberculosis
cgagacgagccgccgcg

SEQ ID NO: 3004261 - RNA, 16 nt, Mycobacterium avium subsp. paratuberculosis
cgagacgaugcggucc

SEQ ID NO: 3004262 - RNA, 17 nt, Mycobacterium avium subsp. paratuberculosis
cgagacgaugcggucca

SEQ ID NO: 3004263 - RNA, 11 nt, Mycobacterium avium subsp. paratuberculosis
cgagacggcgu

SEQ ID NO: 3004264 - RNA, 13 nt, Mycobacterium avium subsp. paratuberculosis
cgagacggcgugg

SEQ ID NO: 3004265 - RNA, 18 nt, Mycobacterium avium subsp. paratuberculosis
cgagacguaagccauggc

SEQ ID NO: 3004266 - RNA, 13 nt, Mycobacterium avium subsp. paratuberculosis
cgagacgucggcg

SEQ ID NO: 3004267 - RNA, 14 nt, Mycobacterium avium subsp. paratuberculosis
cgagacgucggcgu

SEQ ID NO: 3004268 - RNA, 21 nt, Mycobacterium avium subsp. paratuberculosis
cgagacgugguggugcggacg

SEQ ID NO: 3004269 - RNA, 20 nt, Mycobacterium avium subsp. paratuberculosis
cgagacugaugguggcgcgc

SEQ ID NO: 3004270 - RNA, 23 nt, Mycobacterium avium subsp. paratuberculosis
cgagacugcacagugcgucgccc

SEQ ID NO: 3004271 - RNA, 13 nt, Mycobacterium avium subsp. paratuberculosis
cgagagcgcgucg

SEQ ID NO: 3004272 - RNA, 16 nt, Mycobacterium avium subsp. paratuberculosis
cgagagcgcgucgacg

SEQ ID NO: 3004273 - RNA, 19 nt, Mycobacterium avium subsp. paratuberculosis
cgagagcgcgucgacgcgg

SEQ ID NO: 3004274 - RNA, 20 nt, Mycobacterium avium subsp. paratuberculosis
cgagagcgcgucgacgcggu

SEQ ID NO: 3004275 - RNA, 20 nt, Mycobacterium avium subsp. paratuberculosis
cgagagcggaucggcggcga

SEQ ID NO: 3004276 - RNA, 14 nt, Mycobacterium avium subsp. paratuberculosis
cgagagcugcugcc

SEQ ID NO: 3004277 - RNA, 21 nt, Mycobacterium avium subsp. paratuberculosis
cgagagcugcugccgccgcag

SEQ ID NO: 3004278 - RNA, 22 nt, Mycobacterium avium subsp. paratuberculosis
cgagaguaucgccacgccgacc

SEQ ID NO: 3004279 - RNA, 20 nt, Mycobacterium avium subsp. paratuberculosis
cgagaguccgccgccgggcc

SEQ ID NO: 3004280 - RNA, 18 nt, Mycobacterium avium subsp. paratuberculosis
cgagagucgcuggcgcgc

SEQ ID NO: 3004281 - RNA, 22 nt, Mycobacterium avium subsp. paratuberculosis
cgagagugcaacuagcgacggc

SEQ ID NO: 3004282 - RNA, 15 nt, Mycobacterium avium subsp. paratuberculosis
cgagaguuugcccuc

SEQ ID NO: 3004283 - RNA, 21 nt, Mycobacterium avium subsp. paratuberculosis
cgagaguuugcccucgucgac

SEQ ID NO: 3004284 - RNA, 16 nt, Mycobacterium avium subsp. paratuberculosis
cgagaucaacaccgcg

SEQ ID NO: 3004285 - RNA, 17 nt, Mycobacterium avium subsp. paratuberculosis
cgagaucaacaccgcgc

SEQ ID NO: 3004286 - RNA, 15 nt, Mycobacterium avium subsp. paratuberculosis
cgagaucaccggcuu

SEQ ID NO: 3004287 - RNA, 23 nt, Mycobacterium avium subsp. paratuberculosis
cgagaucaccggcuuggcgguga

SEQ ID NO: 3004288 - RNA, 14 nt, Mycobacterium avium subsp. paratuberculosis
cgagaucagcacca

SEQ ID NO: 3004289 - RNA, 15 nt, Mycobacterium avium subsp. paratuberculosis
cgagaucagcaccag

SEQ ID NO: 3004290 - RNA, 19 nt, Mycobacterium avium subsp. paratuberculosis
cgagaucagcaccaggugg

SEQ ID NO: 3004291 - RNA, 21 nt, Mycobacterium avium subsp. paratuberculosis
cgagaucagcaccagguggcc

SEQ ID NO: 3004292 - RNA, 19 nt, Mycobacterium avium subsp. paratuberculosis
cgagaucagcgccaugcug

SEQ ID NO: 3004293 - RNA, 20 nt, Mycobacterium avium subsp. paratuberculosis
cgagaucagggcgcgcaccg

SEQ ID NO: 3004294 - RNA, 22 nt, Mycobacterium avium subsp. paratuberculosis
cgagaucagggcgcgcaccggu

SEQ ID NO: 3004295 - RNA, 19 nt, Mycobacterium avium subsp. paratuberculosis
cgagaucaugccggcgaac

SEQ ID NO: 3004296 - RNA, 22 nt, Mycobacterium avium subsp. paratuberculosis
cgagaucaugccggcgaacucg

SEQ ID NO: 3004297 - RNA, 15 nt, Mycobacterium avium subsp. paratuberculosis
cgagauccaccgcgc

SEQ ID NO: 3004298 - RNA, 20 nt, Mycobacterium avium subsp. paratuberculosis
cgagauccaccgcgcggcca

SEQ ID NO: 3004299 - RNA, 17 nt, Mycobacterium avium subsp. paratuberculosis
cgagaucccgguucccg

SEQ ID NO: 3004300 - RNA, 20 nt, Mycobacterium avium subsp. paratuberculosis
cgagaucccgguucccggca

SEQ ID NO: 3004301 - RNA, 23 nt, Mycobacterium avium subsp. paratuberculosis
cgagaucccgguucccggcacca

SEQ ID NO: 3004302 - RNA, 15 nt, Mycobacterium avium subsp. paratuberculosis
cgagaucgacgcuga

SEQ ID NO: 3004303 - RNA, 19 nt, Mycobacterium avium subsp. paratuberculosis
cgagaucgcgggcugcggc

SEQ ID NO: 3004304 - RNA, 22 nt, Mycobacterium avium subsp. paratuberculosis
cgagaucgcgggcugcggcgag

SEQ ID NO: 3004305 - RNA, 13 nt, Mycobacterium avium subsp. paratuberculosis
cgagaucgcggug

SEQ ID NO: 3004306 - RNA, 19 nt, Mycobacterium avium subsp. paratuberculosis
cgagaucgcgguggcgccc

SEQ ID NO: 3004307 - RNA, 17 nt, Mycobacterium avium subsp. paratuberculosis
cgagaucggcagaccgg

SEQ ID NO: 3004308 - RNA, 22 nt, Mycobacterium avium subsp. paratuberculosis
cgagaucggggccuugacuccc

SEQ ID NO: 3004309 - RNA, 12 nt, Mycobacterium avium subsp. paratuberculosis
cgagaucgucgu

SEQ ID NO: 3004310 - RNA, 15 nt, Mycobacterium avium subsp. paratuberculosis
cgagaugaucagccg

SEQ ID NO: 3004311 - RNA, 14 nt, Mycobacterium avium subsp. paratuberculosis
cgagaugcccaccc

SEQ ID NO: 3004312 - RNA, 18 nt, Mycobacterium avium subsp. paratuberculosis
cgagaugcccacccgcuc

SEQ ID NO: 3004313 - RNA, 23 nt, Mycobacterium avium subsp. paratuberculosis
cgagaugcccacccgcucggcga

SEQ ID NO: 3004314 - RNA, 17 nt, Mycobacterium avium subsp. paratuberculosis
cgagaugccccaggcga

SEQ ID NO: 3004315 - RNA, 15 nt, Mycobacterium avium subsp. paratuberculosis
cgagaugcguucggc

SEQ ID NO: 3004316 - RNA, 16 nt, Mycobacterium avium subsp. paratuberculosis
cgagaugcguucggcc

SEQ ID NO: 3004317 - RNA, 18 nt, Mycobacterium avium subsp. paratuberculosis
cgagaugcguucggccgc

SEQ ID NO: 3004318 - RNA, 19 nt, Mycobacterium avium subsp. paratuberculosis
cgagaugcguucggccgca

SEQ ID NO: 3004319 - RNA, 14 nt, Mycobacterium avium subsp. paratuberculosis
cgagaugcugugga

SEQ ID NO: 3004320 - RNA, 15 nt, Mycobacterium avium subsp. paratuberculosis
cgagauggacagcac

SEQ ID NO: 3004321 - RNA, 14 nt, Mycobacterium avium subsp. paratuberculosis
cgagauggccacca

SEQ ID NO: 3004322 - RNA, 18 nt, Mycobacterium avium subsp. paratuberculosis
cgagauggccaccaucag

SEQ ID NO: 3004323 - RNA, 14 nt, Mycobacterium avium subsp. paratuberculosis
cgagauggcgauca

SEQ ID NO: 3004324 - RNA, 20 nt, Mycobacterium avium subsp. paratuberculosis
cgagauggggugaugcgucc

SEQ ID NO: 3004325 - RNA, 20 nt, Mycobacterium avium subsp. paratuberculosis
cgagauguaguccuccgucg

SEQ ID NO: 3004326 - RNA, 22 nt, Mycobacterium avium subsp. paratuberculosis
cgagauguaguccuccgucgcc

SEQ ID NO: 3004327 - RNA, 17 nt, Mycobacterium avium subsp. paratuberculosis
cgagauguaucugcgga

SEQ ID NO: 3004328 - RNA, 20 nt, Mycobacterium avium subsp. paratuberculosis
cgagauguaucugcggacca

SEQ ID NO: 3004329 - RNA, 15 nt, Mycobacterium avium subsp. paratuberculosis
cgagauucugcagcc

SEQ ID NO: 3004330 - RNA, 20 nt, Mycobacterium avium subsp. paratuberculosis
cgagauucugcagccgcacu

SEQ ID NO: 3004331 - RNA, 18 nt, Mycobacterium avium subsp. paratuberculosis
cgagauuggacgacacca

SEQ ID NO: 3004332 - RNA, 23 nt, Mycobacterium avium subsp. paratuberculosis
cgagauuggacgacaccacgguc

SEQ ID NO: 3004333 - RNA, 22 nt, Mycobacterium avium subsp. paratuberculosis
cgagauuggccucggcgcgggc

SEQ ID NO: 3004334 - RNA, 14 nt, Mycobacterium avium subsp. paratuberculosis
cgagcaacaccacc

SEQ ID NO: 3004335 - RNA, 15 nt, Mycobacterium avium subsp. paratuberculosis
cgagcaacaccaccu

SEQ ID NO: 3004336 - RNA, 13 nt, Mycobacterium avium subsp. paratuberculosis
cgagcaacagccc

SEQ ID NO: 3004337 - RNA, 15 nt, Mycobacterium avium subsp. paratuberculosis
cgagcaacagcccga

SEQ ID NO: 3004338 - RNA, 16 nt, Mycobacterium avium subsp. paratuberculosis
cgagcaacagcccgac

SEQ ID NO: 3004339 - RNA, 14 nt, Mycobacterium avium subsp. paratuberculosis
cgagcaacggccgc

SEQ ID NO: 3004340 - RNA, 16 nt, Mycobacterium avium subsp. paratuberculosis
cgagcaacggccgcag

SEQ ID NO: 3004341 - RNA, 17 nt, Mycobacterium avium subsp. paratuberculosis
cgagcaacggccgcagc

SEQ ID NO: 3004342 - RNA, 19 nt, Mycobacterium avium subsp. paratuberculosis
cgagcaacggccgcagcga

SEQ ID NO: 3004343 - RNA, 18 nt, Mycobacterium avium subsp. paratuberculosis
cgagcaacugggugagca

SEQ ID NO: 3004344 - RNA, 15 nt, Mycobacterium avium subsp. paratuberculosis
cgagcaaggcgagca

SEQ ID NO: 3004345 - RNA, 19 nt, Mycobacterium avium subsp. paratuberculosis
cgagcacacccucaccccg

SEQ ID NO: 3004346 - RNA, 20 nt, Mycobacterium avium subsp. paratuberculosis
cgagcacaccgucgcccgcc

SEQ ID NO: 3004347 - RNA, 13 nt, Mycobacterium avium subsp. paratuberculosis
cgagcacagcggc

SEQ ID NO: 3004348 - RNA, 18 nt, Mycobacterium avium subsp. paratuberculosis
cgagcacagcggcggaug

SEQ ID NO: 3004349 - RNA, 17 nt, Mycobacterium avium subsp. paratuberculosis
cgagcacaggaacgcga

SEQ ID NO: 3004350 - RNA, 19 nt, Mycobacterium avium subsp. paratuberculosis
cgagcacaggaacgcgacg

SEQ ID NO: 3004351 - RNA, 12 nt, Mycobacterium avium subsp. paratuberculosis
cgagcacaucgg

SEQ ID NO: 3004352 - RNA, 12 nt, Mycobacterium avium subsp. paratuberculosis
cgagcaccacca

SEQ ID NO: 3004353 - RNA, 13 nt, Mycobacterium avium subsp. paratuberculosis
cgagcaccaccag

SEQ ID NO: 3004354 - RNA, 21 nt, Mycobacterium avium subsp. paratuberculosis
cgagcaccaccaggcccacca

SEQ ID NO: 3004355 - RNA, 12 nt, Mycobacterium avium subsp. paratuberculosis
cgagcaccaccc

SEQ ID NO: 3004356 - RNA, 13 nt, Mycobacterium avium subsp. paratuberculosis
cgagcaccacccg

SEQ ID NO: 3004357 - RNA, 16 nt, Mycobacterium avium subsp. paratuberculosis
cgagcaccacccgggu

SEQ ID NO: 3004358 - RNA, 17 nt, Mycobacterium avium subsp. paratuberculosis
cgagcaccacccgggug

SEQ ID NO: 3004359 - RNA, 21 nt, Mycobacterium avium subsp. paratuberculosis
cgagcaccacggcccgcgccc

SEQ ID NO: 3004360 - RNA, 14 nt, Mycobacterium avium subsp. paratuberculosis
cgagcaccagcgga

SEQ ID NO: 3004361 - RNA, 13 nt, Mycobacterium avium subsp. paratuberculosis
cgagcaccagcgu

SEQ ID NO: 3004362 - RNA, 14 nt, Mycobacterium avium subsp. paratuberculosis
cgagcaccagcguc

SEQ ID NO: 3004363 - RNA, 18 nt, Mycobacterium avium subsp. paratuberculosis
cgagcaccagcgucgacg

SEQ ID NO: 3004364 - RNA, 19 nt, Mycobacterium avium subsp. paratuberculosis
cgagcaccaggcgcaccag

SEQ ID NO: 3004365 - RNA, 23 nt, Mycobacterium avium subsp. paratuberculosis
cgagcaccaggucguugccggug

SEQ ID NO: 3004366 - RNA, 18 nt, Mycobacterium avium subsp. paratuberculosis
cgagcacccagaaacacc

SEQ ID NO: 3004367 - RNA, 20 nt, Mycobacterium avium subsp. paratuberculosis
cgagcacccagaaacaccau

SEQ ID NO: 3004368 - RNA, 14 nt, Mycobacterium avium subsp. paratuberculosis
cgagcaccccggcg

SEQ ID NO: 3004369 - RNA, 15 nt, Mycobacterium avium subsp. paratuberculosis
cgagcaccccggcgg

SEQ ID NO: 3004370 - RNA, 16 nt, Mycobacterium avium subsp. paratuberculosis
cgagcaccccggcggc

SEQ ID NO: 3004371 - RNA, 18 nt, Mycobacterium avium subsp. paratuberculosis
cgagcaccccggcggccg

SEQ ID NO: 3004372 - RNA, 23 nt, Mycobacterium avium subsp. paratuberculosis
cgagcaccccggcggccgcgucg

SEQ ID NO: 3004373 - RNA, 16 nt, Mycobacterium avium subsp. paratuberculosis
cgagcaccccgucgag

SEQ ID NO: 3004374 - RNA, 20 nt, Mycobacterium avium subsp. paratuberculosis
cgagcaccccgucgagcagc

SEQ ID NO: 3004375 - RNA, 21 nt, Mycobacterium avium subsp. paratuberculosis
cgagcaccccgucgagcagcc

SEQ ID NO: 3004376 - RNA, 16 nt, Mycobacterium avium subsp. paratuberculosis
cgagcacccggauggu

SEQ ID NO: 3004377 - RNA, 13 nt, Mycobacterium avium subsp. paratuberculosis
cgagcacccggcg

SEQ ID NO: 3004378 - RNA, 14 nt, Mycobacterium avium subsp. paratuberculosis
cgagcacccggcgg

SEQ ID NO: 3004379 - RNA, 17 nt, Mycobacterium avium subsp. paratuberculosis
cgagcacccggcgggga

SEQ ID NO: 3004380 - RNA, 12 nt, Mycobacterium avium subsp. paratuberculosis
cgagcaccgcga

SEQ ID NO: 3004381 - RNA, 14 nt, Mycobacterium avium subsp. paratuberculosis
cgagcaccgcgacc

SEQ ID NO: 3004382 - RNA, 13 nt, Mycobacterium avium subsp. paratuberculosis
cgagcaccgcgau

SEQ ID NO: 3004383 - RNA, 14 nt, Mycobacterium avium subsp. paratuberculosis
cgagcaccgcgauc

SEQ ID NO: 3004384 - RNA, 20 nt, Mycobacterium avium subsp. paratuberculosis
cgagcaccgcgaucaccgag

SEQ ID NO: 3004385 - RNA, 18 nt, Mycobacterium avium subsp. paratuberculosis
cgagcaccgcgaucgccg

SEQ ID NO: 3004386 - RNA, 21 nt, Mycobacterium avium subsp. paratuberculosis
cgagcaccgcgaucgccgacg

SEQ ID NO: 3004387 - RNA, 17 nt, Mycobacterium avium subsp. paratuberculosis
cgagcaccgcguccgcg

SEQ ID NO: 3004388 - RNA, 14 nt, Mycobacterium avium subsp. paratuberculosis
cgagcaccggcagc

SEQ ID NO: 3004389 - RNA, 18 nt, Mycobacterium avium subsp. paratuberculosis
cgagcaccggcagcaccg

SEQ ID NO: 3004390 - RNA, 22 nt, Mycobacterium avium subsp. paratuberculosis
cgagcaccggcagccgcagcga

SEQ ID NO: 3004391 - RNA, 13 nt, Mycobacterium avium subsp. paratuberculosis
cgagcaccggcgg

SEQ ID NO: 3004392 - RNA, 17 nt, Mycobacterium avium subsp. paratuberculosis
cgagcaccggcggcagc

SEQ ID NO: 3004393 - RNA, 12 nt, Mycobacterium avium subsp. paratuberculosis
cgagcaccggcu

SEQ ID NO: 3004394 - RNA, 15 nt, Mycobacterium avium subsp. paratuberculosis
cgagcaccggcuggu

SEQ ID NO: 3004395 - RNA, 14 nt, Mycobacterium avium subsp. paratuberculosis
cgagcaccgggccg

SEQ ID NO: 3004396 - RNA, 15 nt, Mycobacterium avium subsp. paratuberculosis
cgagcaccgggccga

SEQ ID NO: 3004397 - RNA, 20 nt, Mycobacterium avium subsp. paratuberculosis
cgagcaccgggccgaaggcg

SEQ ID NO: 3004398 - RNA, 22 nt, Mycobacterium avium subsp. paratuberculosis
cgagcaccgggccgaaggcggc

SEQ ID NO: 3004399 - RNA, 13 nt, Mycobacterium avium subsp. paratuberculosis
cgagcaccgggcg

SEQ ID NO: 3004400 - RNA, 14 nt, Mycobacterium avium subsp. paratuberculosis
cgagcaccgggcgu

SEQ ID NO: 3004401 - RNA, 15 nt, Mycobacterium avium subsp. paratuberculosis
cgagcaccgggcguc

SEQ ID NO: 3004402 - RNA, 20 nt, Mycobacterium avium subsp. paratuberculosis
cgagcaccgggcgucggggc

SEQ ID NO: 3004403 - RNA, 14 nt, Mycobacterium avium subsp. paratuberculosis
cgagcaccgggcug

SEQ ID NO: 3004404 - RNA, 14 nt, Mycobacterium avium subsp. paratuberculosis
cgagcaccgugccg

SEQ ID NO: 3004405 - RNA, 17 nt, Mycobacterium avium subsp. paratuberculosis
cgagcaccgugccgucg

SEQ ID NO: 3004406 - RNA, 18 nt, Mycobacterium avium subsp. paratuberculosis
cgagcaccgugccgucgg

SEQ ID NO: 3004407 - RNA, 20 nt, Mycobacterium avium subsp. paratuberculosis
cgagcaccgugccgucggcg

SEQ ID NO: 3004408 - RNA, 18 nt, Mycobacterium avium subsp. paratuberculosis
cgagcaccuccgacauca

SEQ ID NO: 3004409 - RNA, 22 nt, Mycobacterium avium subsp. paratuberculosis
cgagcaccuccgacaucaggcc

SEQ ID NO: 3004410 - RNA, 16 nt, Mycobacterium avium subsp. paratuberculosis
cgagcaccucgucgcc

SEQ ID NO: 3004411 - RNA, 20 nt, Mycobacterium avium subsp. paratuberculosis
cgagcaccucgucgccgucg

SEQ ID NO: 3004412 - RNA, 21 nt, Mycobacterium avium subsp. paratuberculosis
cgagcaccuggagcggguccg

SEQ ID NO: 3004413 - RNA, 23 nt, Mycobacterium avium subsp. paratuberculosis
cgagcaccuggagcggguccgcc

SEQ ID NO: 3004414 - RNA, 21 nt, Mycobacterium avium subsp. paratuberculosis
cgagcaccuggccguucaggu

SEQ ID NO: 3004415 - RNA, 14 nt, Mycobacterium avium subsp. paratuberculosis
cgagcacgaacgcg

SEQ ID NO: 3004416 - RNA, 16 nt, Mycobacterium avium subsp. paratuberculosis
cgagcacgaacgcggc

SEQ ID NO: 3004417 - RNA, 21 nt, Mycobacterium avium subsp. paratuberculosis
cgagcacgaacgcggccgcca

SEQ ID NO: 3004418 - RNA, 23 nt, Mycobacterium avium subsp. paratuberculosis
cgagcacgaacgcggccgccauc

SEQ ID NO: 3004419 - RNA, 19 nt, Mycobacterium avium subsp. paratuberculosis
cgagcacgcagccgcgccc

SEQ ID NO: 3004420 - RNA, 21 nt, Mycobacterium avium subsp. paratuberculosis
cgagcacgcccugcggcuggg

SEQ ID NO: 3004421 - RNA, 13 nt, Mycobacterium avium subsp. paratuberculosis
cgagcacgccgcc

SEQ ID NO: 3004422 - RNA, 14 nt, Mycobacterium avium subsp. paratuberculosis
cgagcacgccgccg

SEQ ID NO: 3004423 - RNA, 15 nt, Mycobacterium avium subsp. paratuberculosis
cgagcacgccgccgg

SEQ ID NO: 3004424 - RNA, 12 nt, Mycobacterium avium subsp. paratuberculosis
cgagcacgcggc

SEQ ID NO: 3004425 - RNA, 14 nt, Mycobacterium avium subsp. paratuberculosis
cgagcacgcggccg

SEQ ID NO: 3004426 - RNA, 16 nt, Mycobacterium avium subsp. paratuberculosis
cgagcacgcggccgcg

SEQ ID NO: 3004427 - RNA, 16 nt, Mycobacterium avium subsp. paratuberculosis
cgagcacggcucgucc

SEQ ID NO: 3004428 - RNA, 12 nt, Mycobacterium avium subsp. paratuberculosis
cgagcacgucga

SEQ ID NO: 3004429 - RNA, 13 nt, Mycobacterium avium subsp. paratuberculosis
cgagcacgucgag

SEQ ID NO: 3004430 - RNA, 19 nt, Mycobacterium avium subsp. paratuberculosis
cgagcacgucgagcaccgc

SEQ ID NO: 3004431 - RNA, 21 nt, Mycobacterium avium subsp. paratuberculosis
cgagcacgucgagcaccgcgu

SEQ ID NO: 3004432 - RNA, 23 nt, Mycobacterium avium subsp. paratuberculosis
cgagcacgucgagcaccgcgucc

SEQ ID NO: 3004433 - RNA, 22 nt, Mycobacterium avium subsp. paratuberculosis
cgagcacgugggucaaccggua

SEQ ID NO: 3004434 - RNA, 17 nt, Mycobacterium avium subsp. paratuberculosis
cgagcacucgcgggacg

SEQ ID NO: 3004435 - RNA, 22 nt, Mycobacterium avium subsp. paratuberculosis
cgagcacucgcgggacggcggc

SEQ ID NO: 3004436 - RNA, 13 nt, Mycobacterium avium subsp. paratuberculosis
cgagcagacacaa

SEQ ID NO: 3004437 - RNA, 15 nt, Mycobacterium avium subsp. paratuberculosis
cgagcagacacaaaa

SEQ ID NO: 3004438 - RNA, 20 nt, Mycobacterium avium subsp. paratuberculosis
cgagcagacacaaaagcacc

SEQ ID NO: 3004439 - RNA, 21 nt, Mycobacterium avium subsp. paratuberculosis
cgagcagacacaaaagcaccc

SEQ ID NO: 3004440 - RNA, 20 nt, Mycobacterium avium subsp. paratuberculosis
cgagcagacacaaaagcgcc

SEQ ID NO: 3004441 - RNA, 21 nt, Mycobacterium avium subsp. paratuberculosis
cgagcagacacaaaagcgccc

SEQ ID NO: 3004442 - RNA, 22 nt, Mycobacterium avium subsp. paratuberculosis
cgagcagacacaaaagcgcccg

SEQ ID NO: 3004443 - RNA, 14 nt, Mycobacterium avium subsp. paratuberculosis
cgagcagacccgcc

SEQ ID NO: 3004444 - RNA, 15 nt, Mycobacterium avium subsp. paratuberculosis
cgagcagacccgccg

SEQ ID NO: 3004445 - RNA, 18 nt, Mycobacterium avium subsp. paratuberculosis
cgagcagacccgccgcgg

SEQ ID NO: 3004446 - RNA, 14 nt, Mycobacterium avium subsp. paratuberculosis
cgagcagacgcaaa

SEQ ID NO: 3004447 - RNA, 20 nt, Mycobacterium avium subsp. paratuberculosis
cgagcagacgcaaaaacccc

SEQ ID NO: 3004448 - RNA, 18 nt, Mycobacterium avium subsp. paratuberculosis
cgagcagacgcgaaagca

SEQ ID NO: 3004449 - RNA, 20 nt, Mycobacterium avium subsp. paratuberculosis
cgagcagacgcgaaagcacc

SEQ ID NO: 3004450 - RNA, 22 nt, Mycobacterium avium subsp. paratuberculosis
cgagcagacgcgaaagcacccg

SEQ ID NO: 3004451 - RNA, 20 nt, Mycobacterium avium subsp. paratuberculosis
cgagcagacgugaaaucccc

SEQ ID NO: 3004452 - RNA, 22 nt, Mycobacterium avium subsp. paratuberculosis
cgagcagagcuacggacgcauc

SEQ ID NO: 3004453 - RNA, 19 nt, Mycobacterium avium subsp. paratuberculosis
cgagcagaucacguugauc

SEQ ID NO: 3004454 - RNA, 20 nt, Mycobacterium avium subsp. paratuberculosis
cgagcagaucgggucccaga

SEQ ID NO: 3004455 - RNA, 14 nt, Mycobacterium avium subsp. paratuberculosis
cgagcagcaccacc

SEQ ID NO: 3004456 - RNA, 15 nt, Mycobacterium avium subsp. paratuberculosis
cgagcagcaccaccc

SEQ ID NO: 3004457 - RNA, 16 nt, Mycobacterium avium subsp. paratuberculosis
cgagcagcaccacccg

SEQ ID NO: 3004458 - RNA, 17 nt, Mycobacterium avium subsp. paratuberculosis
cgagcagcaccacccgc

SEQ ID NO: 3004459 - RNA, 16 nt, Mycobacterium avium subsp. paratuberculosis
cgagcagcaccgcgac

SEQ ID NO: 3004460 - RNA, 18 nt, Mycobacterium avium subsp. paratuberculosis
cgagcagcaccgcgaccc

SEQ ID NO: 3004461 - RNA, 20 nt, Mycobacterium avium subsp. paratuberculosis
cgagcagcaccgcgacccag

SEQ ID NO: 3004462 - RNA, 13 nt, Mycobacterium avium subsp. paratuberculosis
cgagcagcagccg

SEQ ID NO: 3004463 - RNA, 18 nt, Mycobacterium avium subsp. paratuberculosis
cgagcagcagccgcagcg

SEQ ID NO: 3004464 - RNA, 20 nt, Mycobacterium avium subsp. paratuberculosis
cgagcagcagccgcagcggc

SEQ ID NO: 3004465 - RNA, 21 nt, Mycobacterium avium subsp. paratuberculosis
cgagcagcagccgcagcggcg

SEQ ID NO: 3004466 - RNA, 16 nt, Mycobacterium avium subsp. paratuberculosis
cgagcagcagccgccg

SEQ ID NO: 3004467 - RNA, 13 nt, Mycobacterium avium subsp. paratuberculosis
cgagcagcagcgc

SEQ ID NO: 3004468 - RNA, 14 nt, Mycobacterium avium subsp. paratuberculosis
cgagcagcagcgcg

SEQ ID NO: 3004469 - RNA, 17 nt, Mycobacterium avium subsp. paratuberculosis
cgagcagcagcgcggug

SEQ ID NO: 3004470 - RNA, 23 nt, Mycobacterium avium subsp. paratuberculosis
cgagcagcagcgcggugccgacc

SEQ ID NO: 3004471 - RNA, 13 nt, Mycobacterium avium subsp. paratuberculosis
cgagcagcccggc

SEQ ID NO: 3004472 - RNA, 15 nt, Mycobacterium avium subsp. paratuberculosis
cgagcagcccggcga

SEQ ID NO: 3004473 - RNA, 20 nt, Mycobacterium avium subsp. paratuberculosis
cgagcagcccggcgaacacc

SEQ ID NO: 3004474 - RNA, 23 nt, Mycobacterium avium subsp. paratuberculosis
cgagcagcccggcgaacaccacg

SEQ ID NO: 3004475 - RNA, 18 nt, Mycobacterium avium subsp. paratuberculosis
cgagcagccgaucuggcg

SEQ ID NO: 3004476 - RNA, 21 nt, Mycobacterium avium subsp. paratuberculosis
cgagcagccgaucuggcgggc

SEQ ID NO: 3004477 - RNA, 14 nt, Mycobacterium avium subsp. paratuberculosis
cgagcagccgcaac

SEQ ID NO: 3004478 - RNA, 17 nt, Mycobacterium avium subsp. paratuberculosis
cgagcagccgcaacacg

SEQ ID NO: 3004479 - RNA, 19 nt, Mycobacterium avium subsp. paratuberculosis
cgagcagccgcaaccaaaa

SEQ ID NO: 3004480 - RNA, 17 nt, Mycobacterium avium subsp. paratuberculosis
cgagcagccgcgccggg

SEQ ID NO: 3004481 - RNA, 18 nt, Mycobacterium avium subsp. paratuberculosis
cgagcagccgcgccgggc

SEQ ID NO: 3004482 - RNA, 20 nt, Mycobacterium avium subsp. paratuberculosis
cgagcagccgcgccgggcgg

SEQ ID NO: 3004483 - RNA, 21 nt, Mycobacterium avium subsp. paratuberculosis
cgagcagccgcgccgggcgga

SEQ ID NO: 3004484 - RNA, 11 nt, Mycobacterium avium subsp. paratuberculosis
cgagcagccgg

SEQ ID NO: 3004485 - RNA, 18 nt, Mycobacterium avium subsp. paratuberculosis
cgagcagccgggccagca

SEQ ID NO: 3004486 - RNA, 15 nt, Mycobacterium avium subsp. paratuberculosis
cgagcagccgggugc

SEQ ID NO: 3004487 - RNA, 18 nt, Mycobacterium avium subsp. paratuberculosis
cgagcagccgguccaugu

SEQ ID NO: 3004488 - RNA, 14 nt, Mycobacterium avium subsp. paratuberculosis
cgagcagcgcccgg

SEQ ID NO: 3004489 - RNA, 20 nt, Mycobacterium avium subsp. paratuberculosis
cgagcagcgcccggcgaucg

SEQ ID NO: 3004490 - RNA, 17 nt, Mycobacterium avium subsp. paratuberculosis
cgagcagcgcccgggug

SEQ ID NO: 3004491 - RNA, 12 nt, Mycobacterium avium subsp. paratuberculosis
cgagcagcgcga

SEQ ID NO: 3004492 - RNA, 19 nt, Mycobacterium avium subsp. paratuberculosis
cgagcagcgcgaugccggc

SEQ ID NO: 3004493 - RNA, 12 nt, Mycobacterium avium subsp. paratuberculosis
cgagcagcgcgc

SEQ ID NO: 3004494 - RNA, 14 nt, Mycobacterium avium subsp. paratuberculosis
cgagcagcggggug

SEQ ID NO: 3004495 - RNA, 14 nt, Mycobacterium avium subsp. paratuberculosis
cgagcagcgggucg

SEQ ID NO: 3004496 - RNA, 16 nt, Mycobacterium avium subsp. paratuberculosis
cgagcagcgggucguc

SEQ ID NO: 3004497 - RNA, 18 nt, Mycobacterium avium subsp. paratuberculosis
cgagcagcgggucgucgg

SEQ ID NO: 3004498 - RNA, 19 nt, Mycobacterium avium subsp. paratuberculosis
cgagcagcgggucgucggg

SEQ ID NO: 3004499 - RNA, 12 nt, Mycobacterium avium subsp. paratuberculosis
cgagcagcgugc

SEQ ID NO: 3004500 - RNA, 21 nt, Mycobacterium avium subsp. paratuberculosis
cgagcagcgugcugacgucgu

SEQ ID NO: 3004501 - RNA, 23 nt, Mycobacterium avium subsp. paratuberculosis
cgagcagcgugcugacgucgucg

SEQ ID NO: 3004502 - RNA, 17 nt, Mycobacterium avium subsp. paratuberculosis
cgagcagcucagccgcc

SEQ ID NO: 3004503 - RNA, 18 nt, Mycobacterium avium subsp. paratuberculosis
cgagcagcucagccgccu

SEQ ID NO: 3004504 - RNA, 20 nt, Mycobacterium avium subsp. paratuberculosis
cgagcagcucgacaucggcc

SEQ ID NO: 3004505 - RNA, 14 nt, Mycobacterium avium subsp. paratuberculosis
cgagcagcucggcg

SEQ ID NO: 3004506 - RNA, 17 nt, Mycobacterium avium subsp. paratuberculosis
cgagcagcucggcggcc

SEQ ID NO: 3004507 - RNA, 19 nt, Mycobacterium avium subsp. paratuberculosis
cgagcagcucggcggccug

SEQ ID NO: 3004508 - RNA, 17 nt, Mycobacterium avium subsp. paratuberculosis
cgagcagcugcagcguc

SEQ ID NO: 3004509 - RNA, 19 nt, Mycobacterium avium subsp. paratuberculosis
cgagcagcugcagcgucgg

SEQ ID NO: 3004510 - RNA, 23 nt, Mycobacterium avium subsp. paratuberculosis
cgagcagcugggacagcgucacc

SEQ ID NO: 3004511 - RNA, 16 nt, Mycobacterium avium subsp. paratuberculosis
cgagcaggaacagaca

SEQ ID NO: 3004512 - RNA, 21 nt, Mycobacterium avium subsp. paratuberculosis
cgagcaggaacagacacagca

SEQ ID NO: 3004513 - RNA, 17 nt, Mycobacterium avium subsp. paratuberculosis
cgagcaggccgaggcca

SEQ ID NO: 3004514 - RNA, 14 nt, Mycobacterium avium subsp. paratuberculosis
cgagcaggcugauc

SEQ ID NO: 3004515 - RNA, 20 nt, Mycobacterium avium subsp. paratuberculosis
cgagcaggcugaucucggcg

SEQ ID NO: 3004516 - RNA, 14 nt, Mycobacterium avium subsp. paratuberculosis
cgagcagggcgggc

SEQ ID NO: 3004517 - RNA, 17 nt, Mycobacterium avium subsp. paratuberculosis
cgagcagggcgggcagg

SEQ ID NO: 3004518 - RNA, 17 nt, Mycobacterium avium subsp. paratuberculosis
cgagcagggugacgcga

SEQ ID NO: 3004519 - RNA, 20 nt, Mycobacterium avium subsp. paratuberculosis
cgagcagguucuccucccag

SEQ ID NO: 3004520 - RNA, 17 nt, Mycobacterium avium subsp. paratuberculosis
cgagcaguagacgccgc

SEQ ID NO: 3004521 - RNA, 18 nt, Mycobacterium avium subsp. paratuberculosis
cgagcaguagacgccgcc

SEQ ID NO: 3004522 - RNA, 22 nt, Mycobacterium avium subsp. paratuberculosis
cgagcaguugcgcguugcgcgg

SEQ ID NO: 3004523 - RNA, 13 nt, Mycobacterium avium subsp. paratuberculosis
cgagcaucacgaa

SEQ ID NO: 3004524 - RNA, 14 nt, Mycobacterium avium subsp. paratuberculosis
cgagcaucagcugc

SEQ ID NO: 3004525 - RNA, 22 nt, Mycobacterium avium subsp. paratuberculosis
cgagcaucagcugccguccggg

SEQ ID NO: 3004526 - RNA, 13 nt, Mycobacterium avium subsp. paratuberculosis
cgagcauccggcg

SEQ ID NO: 3004527 - RNA, 15 nt, Mycobacterium avium subsp. paratuberculosis
cgagcauccggcgca

SEQ ID NO: 3004528 - RNA, 20 nt, Mycobacterium avium subsp. paratuberculosis
cgagcauccggcgcacggcg

SEQ ID NO: 3004529 - RNA, 15 nt, Mycobacterium avium subsp. paratuberculosis
cgagcauccggugcc

SEQ ID NO: 3004530 - RNA, 18 nt, Mycobacterium avium subsp. paratuberculosis
cgagcauccggugccgag

SEQ ID NO: 3004531 - RNA, 20 nt, Mycobacterium avium subsp. paratuberculosis
cgagcauccggugccgagcg

SEQ ID NO: 3004532 - RNA, 15 nt, Mycobacterium avium subsp. paratuberculosis
cgagcaucgccgagc

SEQ ID NO: 3004533 - RNA, 16 nt, Mycobacterium avium subsp. paratuberculosis
cgagcaucgccgagcg

SEQ ID NO: 3004534 - RNA, 17 nt, Mycobacterium avium subsp. paratuberculosis
cgagcaucgccgagcgc

SEQ ID NO: 3004535 - RNA, 18 nt, Mycobacterium avium subsp. paratuberculosis
cgagcaucgccgagcgca

SEQ ID NO: 3004536 - RNA, 20 nt, Mycobacterium avium subsp. paratuberculosis
cgagcaucggguugccggcg

SEQ ID NO: 3004537 - RNA, 22 nt, Mycobacterium avium subsp. paratuberculosis
cgagcaucggguugccggcggc

SEQ ID NO: 3004538 - RNA, 16 nt, Mycobacterium avium subsp. paratuberculosis
cgagcaucuccagccg

SEQ ID NO: 3004539 - RNA, 18 nt, Mycobacterium avium subsp. paratuberculosis
cgagcaucuccagccggc

SEQ ID NO: 3004540 - RNA, 20 nt, Mycobacterium avium subsp. paratuberculosis
cgagcaucuccagccggcga

SEQ ID NO: 3004541 - RNA, 21 nt, Mycobacterium avium subsp. paratuberculosis
cgagcaucucggugccgucga

SEQ ID NO: 3004542 - RNA, 24 nt, Mycobacterium avium subsp. paratuberculosis
cgagcaucucggugccgucgaucg

SEQ ID NO: 3004543 - RNA, 18 nt, Mycobacterium avium subsp. paratuberculosis
cgagcauuucgcgcacgu

SEQ ID NO: 3004544 - RNA, 20 nt, Mycobacterium avium subsp. paratuberculosis
cgagcauuucgcgcacgucg

SEQ ID NO: 3004545 - RNA, 21 nt, Mycobacterium avium subsp. paratuberculosis
cgagcauuucgcgcacgucga

SEQ ID NO: 3004546 - RNA, 18 nt, Mycobacterium avium subsp. paratuberculosis
cgagccaccacugcgccg

SEQ ID NO: 3004547 - RNA, 22 nt, Mycobacterium avium subsp. paratuberculosis
cgagccaccacugcgccgucau

SEQ ID NO: 3004548 - RNA, 23 nt, Mycobacterium avium subsp. paratuberculosis
cgagccaccacugcgccgucauc

SEQ ID NO: 3004549 - RNA, 13 nt, Mycobacterium avium subsp. paratuberculosis
cgagccaccucga

SEQ ID NO: 3004550 - RNA, 21 nt, Mycobacterium avium subsp. paratuberculosis
cgagccaccucgaucagcggc

SEQ ID NO: 3004551 - RNA, 15 nt, Mycobacterium avium subsp. paratuberculosis
cgagccagcgggccg

SEQ ID NO: 3004552 - RNA, 16 nt, Mycobacterium avium subsp. paratuberculosis
cgagccagcgggccga

SEQ ID NO: 3004553 - RNA, 18 nt, Mycobacterium avium subsp. paratuberculosis
cgagccagcugcgcgucg

SEQ ID NO: 3004554 - RNA, 20 nt, Mycobacterium avium subsp. paratuberculosis
cgagccauaaaccggccggc

SEQ ID NO: 3004555 - RNA, 22 nt, Mycobacterium avium subsp. paratuberculosis
cgagccauaaaccggccggcgc

SEQ ID NO: 3004556 - RNA, 23 nt, Mycobacterium avium subsp. paratuberculosis
cgagccauaaaccggccggcgcg

SEQ ID NO: 3004557 - RNA, 22 nt, Mycobacterium avium subsp. paratuberculosis
cgagcccaccgcgcccagcccc

SEQ ID NO: 3004558 - RNA, 13 nt, Mycobacterium avium subsp. paratuberculosis
cgagcccagccgu

SEQ ID NO: 3004559 - RNA, 15 nt, Mycobacterium avium subsp. paratuberculosis
cgagcccagccgucg

SEQ ID NO: 3004560 - RNA, 13 nt, Mycobacterium avium subsp. paratuberculosis
cgagcccagcugc

SEQ ID NO: 3004561 - RNA, 15 nt, Mycobacterium avium subsp. paratuberculosis
cgagcccagcugcgc

SEQ ID NO: 3004562 - RNA, 18 nt, Mycobacterium avium subsp. paratuberculosis
cgagccccaguucgauca

SEQ ID NO: 3004563 - RNA, 14 nt, Mycobacterium avium subsp. paratuberculosis
cgagcccgacggca

SEQ ID NO: 3004564 - RNA, 16 nt, Mycobacterium avium subsp. paratuberculosis
cgagcccgacggcagc

SEQ ID NO: 3004565 - RNA, 18 nt, Mycobacterium avium subsp. paratuberculosis
cgagcccgacggcagcac

SEQ ID NO: 3004566 - RNA, 19 nt, Mycobacterium avium subsp. paratuberculosis
cgagcccgacggcagcacc

SEQ ID NO: 3004567 - RNA, 15 nt, Mycobacterium avium subsp. paratuberculosis
cgagcccgaucugau

SEQ ID NO: 3004568 - RNA, 20 nt, Mycobacterium avium subsp. paratuberculosis
cgagcccgcaaaucagccga

SEQ ID NO: 3004569 - RNA, 12 nt, Mycobacterium avium subsp. paratuberculosis
cgagcccgccgg

SEQ ID NO: 3004570 - RNA, 13 nt, Mycobacterium avium subsp. paratuberculosis
cgagcccgccggc

SEQ ID NO: 3004571 - RNA, 16 nt, Mycobacterium avium subsp. paratuberculosis
cgagcccgccggcggg

SEQ ID NO: 3004572 - RNA, 14 nt, Mycobacterium avium subsp. paratuberculosis
cgagcccgcgccca

SEQ ID NO: 3004573 - RNA, 14 nt, Mycobacterium avium subsp. paratuberculosis
cgagcccggccagu

SEQ ID NO: 3004574 - RNA, 15 nt, Mycobacterium avium subsp. paratuberculosis
cgagcccggccaguc

SEQ ID NO: 3004575 - RNA, 23 nt, Mycobacterium avium subsp. paratuberculosis
cgagcccggccaguccggcagca

SEQ ID NO: 3004576 - RNA, 13 nt, Mycobacterium avium subsp. paratuberculosis
cgagcccggcgac

SEQ ID NO: 3004577 - RNA, 14 nt, Mycobacterium avium subsp. paratuberculosis
cgagcccggcgacg

SEQ ID NO: 3004578 - RNA, 17 nt, Mycobacterium avium subsp. paratuberculosis
cgagcccggcgacgucg

SEQ ID NO: 3004579 - RNA, 20 nt, Mycobacterium avium subsp. paratuberculosis
cgagcccggcgacgucgucg

SEQ ID NO: 3004580 - RNA, 17 nt, Mycobacterium avium subsp. paratuberculosis
cgagcccugcgccagca

SEQ ID NO: 3004581 - RNA, 19 nt, Mycobacterium avium subsp. paratuberculosis
cgagcccuucgcggugugc

SEQ ID NO: 3004582 - RNA, 23 nt, Mycobacterium avium subsp. paratuberculosis
cgagcccuucgcggugugcggca

SEQ ID NO: 3004583 - RNA, 17 nt, Mycobacterium avium subsp. paratuberculosis
cgagcccuuugcgcugc

SEQ ID NO: 3004584 - RNA, 22 nt, Mycobacterium avium subsp. paratuberculosis
cgagcccuuugcgcugcccgau

SEQ ID NO: 3004585 - RNA, 22 nt, Mycobacterium avium subsp. paratuberculosis
cgagccgaaacggugcccgcag

SEQ ID NO: 3004586 - RNA, 18 nt, Mycobacterium avium subsp. paratuberculosis
cgagccgacagucgcggg

SEQ ID NO: 3004587 - RNA, 23 nt, Mycobacterium avium subsp. paratuberculosis
cgagccgacagucgcgggcgagc

SEQ ID NO: 3004588 - RNA, 14 nt, Mycobacterium avium subsp. paratuberculosis
cgagccgagcaccg

SEQ ID NO: 3004589 - RNA, 15 nt, Mycobacterium avium subsp. paratuberculosis
cgagccgagcaccgg

SEQ ID NO: 3004590 - RNA, 17 nt, Mycobacterium avium subsp. paratuberculosis
cgagccgagcaccggca

SEQ ID NO: 3004591 - RNA, 19 nt, Mycobacterium avium subsp. paratuberculosis
cgagccgagcaccggcagc

SEQ ID NO: 3004592 - RNA, 20 nt, Mycobacterium avium subsp. paratuberculosis
cgagccgagcaccggcagca

SEQ ID NO: 3004593 - RNA, 22 nt, Mycobacterium avium subsp. paratuberculosis
cgagccgagcaccggcagcacc

SEQ ID NO: 3004594 - RNA, 23 nt, Mycobacterium avium subsp. paratuberculosis
cgagccgagcaccggcagcaccg

SEQ ID NO: 3004595 - RNA, 15 nt, Mycobacterium avium subsp. paratuberculosis
cgagccgagcacgca

SEQ ID NO: 3004596 - RNA, 16 nt, Mycobacterium avium subsp. paratuberculosis
cgagccgagcacgcag

SEQ ID NO: 3004597 - RNA, 22 nt, Mycobacterium avium subsp. paratuberculosis
cgagccgagcacgcagccgcgc

SEQ ID NO: 3004598 - RNA, 15 nt, Mycobacterium avium subsp. paratuberculosis
cgagccgagccgacc

SEQ ID NO: 3004599 - RNA, 16 nt, Mycobacterium avium subsp. paratuberculosis
cgagccgagccgaccc

SEQ ID NO: 3004600 - RNA, 14 nt, Mycobacterium avium subsp. paratuberculosis
cgagccgagccggu

SEQ ID NO: 3004601 - RNA, 17 nt, Mycobacterium avium subsp. paratuberculosis
cgagccgagccgguccg

SEQ ID NO: 3004602 - RNA, 23 nt, Mycobacterium avium subsp. paratuberculosis
cgagccgagccgguccgaccagc

SEQ ID NO: 3004603 - RNA, 19 nt, Mycobacterium avium subsp. paratuberculosis
cgagccgaggccgauggcg

SEQ ID NO: 3004604 - RNA, 22 nt, Mycobacterium avium subsp. paratuberculosis
cgagccgaggccgauggcgccc

SEQ ID NO: 3004605 - RNA, 17 nt, Mycobacterium avium subsp. paratuberculosis
cgagccgaugcccagca

SEQ ID NO: 3004606 - RNA, 21 nt, Mycobacterium avium subsp. paratuberculosis
cgagccgaugcccagcagcgg

SEQ ID NO: 3004607 - RNA, 23 nt, Mycobacterium avium subsp. paratuberculosis
cgagccgaugcccagcagcgggg

SEQ ID NO: 3004608 - RNA, 18 nt, Mycobacterium avium subsp. paratuberculosis
cgagccgauugucgcugc

SEQ ID NO: 3004609 - RNA, 22 nt, Mycobacterium avium subsp. paratuberculosis
cgagccgauugucgcugcgagg

SEQ ID NO: 3004610 - RNA, 21 nt, Mycobacterium avium subsp. paratuberculosis
cgagccgcaccgccucaugcc

SEQ ID NO: 3004611 - RNA, 17 nt, Mycobacterium avium subsp. paratuberculosis
cgagccgcagucgauca

SEQ ID NO: 3004612 - RNA, 23 nt, Mycobacterium avium subsp. paratuberculosis
cgagccgcagucgaucaccgaga

SEQ ID NO: 3004613 - RNA, 14 nt, Mycobacterium avium subsp. paratuberculosis
cgagccgcccaggc

SEQ ID NO: 3004614 - RNA, 18 nt, Mycobacterium avium subsp. paratuberculosis
cgagccgcccaggcgggc

SEQ ID NO: 3004615 - RNA, 12 nt, Mycobacterium avium subsp. paratuberculosis
cgagccgccgcc

SEQ ID NO: 3004616 - RNA, 13 nt, Mycobacterium avium subsp. paratuberculosis
cgagccgccgccg

SEQ ID NO: 3004617 - RNA, 14 nt, Mycobacterium avium subsp. paratuberculosis
cgagccgccgccgg

SEQ ID NO: 3004618 - RNA, 23 nt, Mycobacterium avium subsp. paratuberculosis
cgagccgccgccggcgucgccgc

SEQ ID NO: 3004619 - RNA, 13 nt, Mycobacterium avium subsp. paratuberculosis
cgagccgccgcgg

SEQ ID NO: 3004620 - RNA, 23 nt, Mycobacterium avium subsp. paratuberculosis
cgagccgccgcgggucggcgacg

SEQ ID NO: 3004621 - RNA, 21 nt, Mycobacterium avium subsp. paratuberculosis
cgagccgccugcgcgccgucg

SEQ ID NO: 3004622 - RNA, 19 nt, Mycobacterium avium subsp. paratuberculosis
cgagccgcgccacgcgcag

SEQ ID NO: 3004623 - RNA, 16 nt, Mycobacterium avium subsp. paratuberculosis
cgagccgcgcgccgag

SEQ ID NO: 3004624 - RNA, 22 nt, Mycobacterium avium subsp. paratuberculosis
cgagccgcggauggccucggcg

SEQ ID NO: 3004625 - RNA, 23 nt, Mycobacterium avium subsp. paratuberculosis
cgagccgcggauggccucggcga

SEQ ID NO: 3004626 - RNA, 15 nt, Mycobacterium avium subsp. paratuberculosis
cgagccgcggcccgc

SEQ ID NO: 3004627 - RNA, 20 nt, Mycobacterium avium subsp. paratuberculosis
cgagccgcucccgcagcggg

SEQ ID NO: 3004628 - RNA, 21 nt, Mycobacterium avium subsp. paratuberculosis
cgagccgcucccgcagcgggg

SEQ ID NO: 3004629 - RNA, 23 nt, Mycobacterium avium subsp. paratuberculosis
cgagccgcucccgcagcggggcg

SEQ ID NO: 3004630 - RNA, 16 nt, Mycobacterium avium subsp. paratuberculosis
cgagccgcucgcgcac

SEQ ID NO: 3004631 - RNA, 17 nt, Mycobacterium avium subsp. paratuberculosis
cgagccgcucgcgcacc

SEQ ID NO: 3004632 - RNA, 18 nt, Mycobacterium avium subsp. paratuberculosis
cgagccgcucgcgcaccg

SEQ ID NO: 3004633 - RNA, 20 nt, Mycobacterium avium subsp. paratuberculosis
cgagccgcucgcgcaccggg

SEQ ID NO: 3004634 - RNA, 21 nt, Mycobacterium avium subsp. paratuberculosis
cgagccgcuugguggcgccgg

SEQ ID NO: 3004635 - RNA, 15 nt, Mycobacterium avium subsp. paratuberculosis
cgagccggcacgcgc

SEQ ID NO: 3004636 - RNA, 19 nt, Mycobacterium avium subsp. paratuberculosis
cgagccggcacgcgcgccg

SEQ ID NO: 3004637 - RNA, 17 nt, Mycobacterium avium subsp. paratuberculosis
cgagccggcacggccgg

SEQ ID NO: 3004638 - RNA, 18 nt, Mycobacterium avium subsp. paratuberculosis
cgagccggcacggccggc

SEQ ID NO: 3004639 - RNA, 19 nt, Mycobacterium avium subsp. paratuberculosis
cgagccggcacggccggcc

SEQ ID NO: 3004640 - RNA, 13 nt, Mycobacterium avium subsp. paratuberculosis
cgagccggcccgg

SEQ ID NO: 3004641 - RNA, 20 nt, Mycobacterium avium subsp. paratuberculosis
cgagccggcccggggugugc

SEQ ID NO: 3004642 - RNA, 23 nt, Mycobacterium avium subsp. paratuberculosis
cgagccggcccggggugugcccg

SEQ ID NO: 3004643 - RNA, 15 nt, Mycobacterium avium subsp. paratuberculosis
cgagccggccgaagc

SEQ ID NO: 3004644 - RNA, 16 nt, Mycobacterium avium subsp. paratuberculosis
cgagccggccgaagcg

SEQ ID NO: 3004645 - RNA, 18 nt, Mycobacterium avium subsp. paratuberculosis
cgagccggccggacaccg

SEQ ID NO: 3004646 - RNA, 13 nt, Mycobacterium avium subsp. paratuberculosis
cgagccggccguc

SEQ ID NO: 3004647 - RNA, 15 nt, Mycobacterium avium subsp. paratuberculosis
cgagccggccgucag

SEQ ID NO: 3004648 - RNA, 22 nt, Mycobacterium avium subsp. paratuberculosis
cgagccggcguacccgcccaug

SEQ ID NO: 3004649 - RNA, 17 nt, Mycobacterium avium subsp. paratuberculosis
cgagccggcgucgccgc

SEQ ID NO: 3004650 - RNA, 12 nt, Mycobacterium avium subsp. paratuberculosis
cgagccgggcag

SEQ ID NO: 3004651 - RNA, 15 nt, Mycobacterium avium subsp. paratuberculosis
cgagccgggcccggg

SEQ ID NO: 3004652 - RNA, 17 nt, Mycobacterium avium subsp. paratuberculosis
cgagccgggcccgggug

SEQ ID NO: 3004653 - RNA, 15 nt, Mycobacterium avium subsp. paratuberculosis
cgagccgggccgggu

SEQ ID NO: 3004654 - RNA, 13 nt, Mycobacterium avium subsp. paratuberculosis
cgagccgggcgcg

SEQ ID NO: 3004655 - RNA, 14 nt, Mycobacterium avium subsp. paratuberculosis
cgagccgggcgcgg

SEQ ID NO: 3004656 - RNA, 15 nt, Mycobacterium avium subsp. paratuberculosis
cgagccgggcgcggg

SEQ ID NO: 3004657 - RNA, 23 nt, Mycobacterium avium subsp. paratuberculosis
cgagccgggcgcgggcgccgucg

SEQ ID NO: 3004658 - RNA, 13 nt, Mycobacterium avium subsp. paratuberculosis
cgagccgggcggc

SEQ ID NO: 3004659 - RNA, 16 nt, Mycobacterium avium subsp. paratuberculosis
cgagccgggcggccag

SEQ ID NO: 3004660 - RNA, 19 nt, Mycobacterium avium subsp. paratuberculosis
cgagccgggcggccagcgu

SEQ ID NO: 3004661 - RNA, 22 nt, Mycobacterium avium subsp. paratuberculosis
cgagccgggcggccagcguggc

SEQ ID NO: 3004662 - RNA, 12 nt, Mycobacterium avium subsp. paratuberculosis
cgagccggggcu

SEQ ID NO: 3004663 - RNA, 17 nt, Mycobacterium avium subsp. paratuberculosis
cgagccgguacggcucg

SEQ ID NO: 3004664 - RNA, 16 nt, Mycobacterium avium subsp. paratuberculosis
cgagccgguccgacca

SEQ ID NO: 3004665 - RNA, 18 nt, Mycobacterium avium subsp. paratuberculosis
cgagccgguccgaccagc

SEQ ID NO: 3004666 - RNA, 19 nt, Mycobacterium avium subsp. paratuberculosis
cgagccgguccgaccagcg

SEQ ID NO: 3004667 - RNA, 21 nt, Mycobacterium avium subsp. paratuberculosis
cgagccggucugggcgaccau

SEQ ID NO: 3004668 - RNA, 23 nt, Mycobacterium avium subsp. paratuberculosis
cgagccggugaugacgucgccca

SEQ ID NO: 3004669 - RNA, 12 nt, Mycobacterium avium subsp. paratuberculosis
cgagccggugcc

SEQ ID NO: 3004670 - RNA, 15 nt, Mycobacterium avium subsp. paratuberculosis
cgagccggugccgag

SEQ ID NO: 3004671 - RNA, 17 nt, Mycobacterium avium subsp. paratuberculosis
cgagccggugccgaggc

SEQ ID NO: 3004672 - RNA, 14 nt, Mycobacterium avium subsp. paratuberculosis
cgagccgguugacc

SEQ ID NO: 3004673 - RNA, 20 nt, Mycobacterium avium subsp. paratuberculosis
cgagccgguugacccucagc

SEQ ID NO: 3004674 - RNA, 16 nt, Mycobacterium avium subsp. paratuberculosis
cgagccgguuggacau

SEQ ID NO: 3004675 - RNA, 16 nt, Mycobacterium avium subsp. paratuberculosis
cgagccguaggccagg

SEQ ID NO: 3004676 - RNA, 13 nt, Mycobacterium avium subsp. paratuberculosis
cgagccgucgacc

SEQ ID NO: 3004677 - RNA, 20 nt, Mycobacterium avium subsp. paratuberculosis
cgagccgucgaccggguccg

SEQ ID NO: 3004678 - RNA, 15 nt, Mycobacterium avium subsp. paratuberculosis
cgagccgucgcggga

SEQ ID NO: 3004679 - RNA, 14 nt, Mycobacterium avium subsp. paratuberculosis
cgagccgucgucgc

SEQ ID NO: 3004680 - RNA, 16 nt, Mycobacterium avium subsp. paratuberculosis
cgagccgucgucgcug

SEQ ID NO: 3004681 - RNA, 19 nt, Mycobacterium avium subsp. paratuberculosis
cgagccgucgucgcugcag

SEQ ID NO: 3004682 - RNA, 14 nt, Mycobacterium avium subsp. paratuberculosis
cgagccuggcgcgc

SEQ ID NO: 3004683 - RNA, 15 nt, Mycobacterium avium subsp. paratuberculosis
cgagccuggcgcgca

SEQ ID NO: 3004684 - RNA, 22 nt, Mycobacterium avium subsp. paratuberculosis
cgagccugggauugccgggcac

SEQ ID NO: 3004685 - RNA, 17 nt, Mycobacterium avium subsp. paratuberculosis
cgagcgaacacgugcag

SEQ ID NO: 3004686 - RNA, 18 nt, Mycobacterium avium subsp. paratuberculosis
cgagcgaacacgugcagc

SEQ ID NO: 3004687 - RNA, 16 nt, Mycobacterium avium subsp. paratuberculosis
cgagcgacgccacggg

SEQ ID NO: 3004688 - RNA, 11 nt, Mycobacterium avium subsp. paratuberculosis
cgagcgagccg

SEQ ID NO: 3004689 - RNA, 13 nt, Mycobacterium avium subsp. paratuberculosis
cgagcgagcgcac

SEQ ID NO: 3004690 - RNA, 14 nt, Mycobacterium avium subsp. paratuberculosis
cgagcgagcgcacc

SEQ ID NO: 3004691 - RNA, 15 nt, Mycobacterium avium subsp. paratuberculosis
cgagcgagcgcacca

SEQ ID NO: 3004692 - RNA, 18 nt, Mycobacterium avium subsp. paratuberculosis
cgagcgcaagggccgaca

SEQ ID NO: 3004693 - RNA, 20 nt, Mycobacterium avium subsp. paratuberculosis
cgagcgcaagggccgacauc

SEQ ID NO: 3004694 - RNA, 15 nt, Mycobacterium avium subsp. paratuberculosis
cgagcgcaccgccca

SEQ ID NO: 3004695 - RNA, 16 nt, Mycobacterium avium subsp. paratuberculosis
cgagcgcaccgcggag

SEQ ID NO: 3004696 - RNA, 12 nt, Mycobacterium avium subsp. paratuberculosis
cgagcgcagcag

SEQ ID NO: 3004697 - RNA, 13 nt, Mycobacterium avium subsp. paratuberculosis
cgagcgcagcagg

SEQ ID NO: 3004698 - RNA, 12 nt, Mycobacterium avium subsp. paratuberculosis
cgagcgcagcgc

SEQ ID NO: 3004699 - RNA, 14 nt, Mycobacterium avium subsp. paratuberculosis
cgagcgcagcgcca

SEQ ID NO: 3004700 - RNA, 17 nt, Mycobacterium avium subsp. paratuberculosis
cgagcgcagcgccaggc

SEQ ID NO: 3004701 - RNA, 23 nt, Mycobacterium avium subsp. paratuberculosis
cgagcgcagcgccaggcagaagc

SEQ ID NO: 3004702 - RNA, 14 nt, Mycobacterium avium subsp. paratuberculosis
cgagcgcagcgggg

SEQ ID NO: 3004703 - RNA, 23 nt, Mycobacterium avium subsp. paratuberculosis
cgagcgcagcggggaggcccagc

SEQ ID NO: 3004704 - RNA, 12 nt, Mycobacterium avium subsp. paratuberculosis
cgagcgcccggg

SEQ ID NO: 3004705 - RNA, 13 nt, Mycobacterium avium subsp. paratuberculosis
cgagcgcccgggc

SEQ ID NO: 3004706 - RNA, 13 nt, Mycobacterium avium subsp. paratuberculosis
cgagcgccgcggc

SEQ ID NO: 3004707 - RNA, 14 nt, Mycobacterium avium subsp. paratuberculosis
cgagcgccgcggcc

SEQ ID NO: 3004708 - RNA, 15 nt, Mycobacterium avium subsp. paratuberculosis
cgagcgccgcggcca

SEQ ID NO: 3004709 - RNA, 19 nt, Mycobacterium avium subsp. paratuberculosis
cgagcgccgcggccaccgg

SEQ ID NO: 3004710 - RNA, 17 nt, Mycobacterium avium subsp. paratuberculosis
cgagcgccgcguucacc

SEQ ID NO: 3004711 - RNA, 13 nt, Mycobacterium avium subsp. paratuberculosis
cgagcgccggacg

SEQ ID NO: 3004712 - RNA, 15 nt, Mycobacterium avium subsp. paratuberculosis
cgagcgccggacgcu

SEQ ID NO: 3004713 - RNA, 14 nt, Mycobacterium avium subsp. paratuberculosis
cgagcgcgccgagc

SEQ ID NO: 3004714 - RNA, 17 nt, Mycobacterium avium subsp. paratuberculosis
cgagcgcgccgaggugg

SEQ ID NO: 3004715 - RNA, 22 nt, Mycobacterium avium subsp. paratuberculosis
cgagcgcgccgagguggcccgc

SEQ ID NO: 3004716 - RNA, 15 nt, Mycobacterium avium subsp. paratuberculosis
cgagcgcgccgccgc

SEQ ID NO: 3004717 - RNA, 13 nt, Mycobacterium avium subsp. paratuberculosis
cgagcgcgcgauc

SEQ ID NO: 3004718 - RNA, 19 nt, Mycobacterium avium subsp. paratuberculosis
cgagcgcgcggugaugacc

SEQ ID NO: 3004719 - RNA, 20 nt, Mycobacterium avium subsp. paratuberculosis
cgagcgcgcucaaccgccca

SEQ ID NO: 3004720 - RNA, 19 nt, Mycobacterium avium subsp. paratuberculosis
cgagcgcgcugaucgccgc

SEQ ID NO: 3004721 - RNA, 21 nt, Mycobacterium avium subsp. paratuberculosis
cgagcgcgcuguaggucgcgu

SEQ ID NO: 3004722 - RNA, 18 nt, Mycobacterium avium subsp. paratuberculosis
cgagcgcgcugugcgcca

SEQ ID NO: 3004723 - RNA, 18 nt, Mycobacterium avium subsp. paratuberculosis
cgagcgcggcccgccgaa

SEQ ID NO: 3004724 - RNA, 16 nt, Mycobacterium avium subsp. paratuberculosis
cgagcgcgucguugcc

SEQ ID NO: 3004725 - RNA, 22 nt, Mycobacterium avium subsp. paratuberculosis
cgagcgcgugcacgaacgcggc

SEQ ID NO: 3004726 - RNA, 20 nt, Mycobacterium avium subsp. paratuberculosis
cgagcgcguucuccaccgcg

SEQ ID NO: 3004727 - RNA, 21 nt, Mycobacterium avium subsp. paratuberculosis
cgagcgcguucuccaccgcgc

SEQ ID NO: 3004728 - RNA, 22 nt, Mycobacterium avium subsp. paratuberculosis
cgagcgcguucuccaccgcgcg

SEQ ID NO: 3004729 - RNA, 16 nt, Mycobacterium avium subsp. paratuberculosis
cgagcgcuucgggagc

SEQ ID NO: 3004730 - RNA, 17 nt, Mycobacterium avium subsp. paratuberculosis
cgagcgcuucgggagca

SEQ ID NO: 3004731 - RNA, 13 nt, Mycobacterium avium subsp. paratuberculosis
cgagcggacgggc

SEQ ID NO: 3004732 - RNA, 13 nt, Mycobacterium avium subsp. paratuberculosis
cgagcggaugccg

SEQ ID NO: 3004733 - RNA, 17 nt, Mycobacterium avium subsp. paratuberculosis
cgagcggaugccguagc

SEQ ID NO: 3004734 - RNA, 22 nt, Mycobacterium avium subsp. paratuberculosis
cgagcggaugccguagcgcaug

SEQ ID NO: 3004735 - RNA, 13 nt, Mycobacterium avium subsp. paratuberculosis
cgagcggcccgca

SEQ ID NO: 3004736 - RNA, 15 nt, Mycobacterium avium subsp. paratuberculosis
cgagcggcccgcacc

SEQ ID NO: 3004737 - RNA, 14 nt, Mycobacterium avium subsp. paratuberculosis
cgagcggcccgucg

SEQ ID NO: 3004738 - RNA, 18 nt, Mycobacterium avium subsp. paratuberculosis
cgagcggcccgucgccga

SEQ ID NO: 3004739 - RNA, 19 nt, Mycobacterium avium subsp. paratuberculosis
cgagcggcccgucgccgau

SEQ ID NO: 3004740 - RNA, 17 nt, Mycobacterium avium subsp. paratuberculosis
cgagcggcccugcgcgg

SEQ ID NO: 3004741 - RNA, 16 nt, Mycobacterium avium subsp. paratuberculosis
cgagcggccguccacc

SEQ ID NO: 3004742 - RNA, 17 nt, Mycobacterium avium subsp. paratuberculosis
cgagcggccguccacca

SEQ ID NO: 3004743 - RNA, 18 nt, Mycobacterium avium subsp. paratuberculosis
cgagcggcgacuccagca

SEQ ID NO: 3004744 - RNA, 21 nt, Mycobacterium avium subsp. paratuberculosis
cgagcggcgacuccagcagcg

SEQ ID NO: 3004745 - RNA, 15 nt, Mycobacterium avium subsp. paratuberculosis
cgagcggcgccuggu

SEQ ID NO: 3004746 - RNA, 15 nt, Mycobacterium avium subsp. paratuberculosis
cgagcggcgcugcag

SEQ ID NO: 3004747 - RNA, 17 nt, Mycobacterium avium subsp. paratuberculosis
cgagcggcgcugcagca

SEQ ID NO: 3004748 - RNA, 21 nt, Mycobacterium avium subsp. paratuberculosis
cgagcggcgcugcagcagccc

SEQ ID NO: 3004749 - RNA, 17 nt, Mycobacterium avium subsp. paratuberculosis
cgagcggcuugccgccg

SEQ ID NO: 3004750 - RNA, 21 nt, Mycobacterium avium subsp. paratuberculosis
cgagcggcuugccgccgcagc

SEQ ID NO: 3004751 - RNA, 16 nt, Mycobacterium avium subsp. paratuberculosis
cgagcgggcacgccgc

SEQ ID NO: 3004752 - RNA, 18 nt, Mycobacterium avium subsp. paratuberculosis
cgagcgggcacgccgccg

SEQ ID NO: 3004753 - RNA, 11 nt, Mycobacterium avium subsp. paratuberculosis
cgagcgggccu

SEQ ID NO: 3004754 - RNA, 16 nt, Mycobacterium avium subsp. paratuberculosis
cgagcgggcgggcuca

SEQ ID NO: 3004755 - RNA, 15 nt, Mycobacterium avium subsp. paratuberculosis
cgagcgggucgucgu

SEQ ID NO: 3004756 - RNA, 21 nt, Mycobacterium avium subsp. paratuberculosis
cgagcgggugaaucgacaccg

SEQ ID NO: 3004757 - RNA, 17 nt, Mycobacterium avium subsp. paratuberculosis
cgagcgguccaacgggc

SEQ ID NO: 3004758 - RNA, 19 nt, Mycobacterium avium subsp. paratuberculosis
cgagcgguccaacgggcuc

SEQ ID NO: 3004759 - RNA, 21 nt, Mycobacterium avium subsp. paratuberculosis
cgagcgguucgaucucgucgg

SEQ ID NO: 3004760 - RNA, 12 nt, Mycobacterium avium subsp. paratuberculosis
cgagcgguuggc

SEQ ID NO: 3004761 - RNA, 13 nt, Mycobacterium avium subsp. paratuberculosis
cgagcgucacgcc

SEQ ID NO: 3004762 - RNA, 18 nt, Mycobacterium avium subsp. paratuberculosis
cgagcgucacgccagcgu

SEQ ID NO: 3004763 - RNA, 19 nt, Mycobacterium avium subsp. paratuberculosis
cgagcgucacgccagcgug

SEQ ID NO: 3004764 - RNA, 20 nt, Mycobacterium avium subsp. paratuberculosis
cgagcgucacgccagugugg

SEQ ID NO: 3004765 - RNA, 18 nt, Mycobacterium avium subsp. paratuberculosis
cgagcgucacgccgcgcc

SEQ ID NO: 3004766 - RNA, 20 nt, Mycobacterium avium subsp. paratuberculosis
cgagcgucacgccgcgcccg

SEQ ID NO: 3004767 - RNA, 18 nt, Mycobacterium avium subsp. paratuberculosis
cgagcgucacgcuagcgu

SEQ ID NO: 3004768 - RNA, 20 nt, Mycobacterium avium subsp. paratuberculosis
cgagcgucacgcuagcguga

SEQ ID NO: 3004769 - RNA, 15 nt, Mycobacterium avium subsp. paratuberculosis
cgagcgucacgcugg

SEQ ID NO: 3004770 - RNA, 20 nt, Mycobacterium avium subsp. paratuberculosis
cgagcgucacgcuggcguga

SEQ ID NO: 3004771 - RNA, 14 nt, Mycobacterium avium subsp. paratuberculosis
cgagcgucauuccg

SEQ ID NO: 3004772 - RNA, 22 nt, Mycobacterium avium subsp. paratuberculosis
cgagcgucauuccgccgcgccc

SEQ ID NO: 3004773 - RNA, 14 nt, Mycobacterium avium subsp. paratuberculosis
cgagcgucgccgcg

SEQ ID NO: 3004774 - RNA, 15 nt, Mycobacterium avium subsp. paratuberculosis
cgagcgucgccgcgu

SEQ ID NO: 3004775 - RNA, 21 nt, Mycobacterium avium subsp. paratuberculosis
cgagcgugaaguuaguuucac

SEQ ID NO: 3004776 - RNA, 12 nt, Mycobacterium avium subsp. paratuberculosis
cgagcgugcccg

SEQ ID NO: 3004777 - RNA, 23 nt, Mycobacterium avium subsp. paratuberculosis
cgagcgugcccgcgcccaccugg

SEQ ID NO: 3004778 - RNA, 16 nt, Mycobacterium avium subsp. paratuberculosis
cgagcguggggccugg

SEQ ID NO: 3004779 - RNA, 18 nt, Mycobacterium avium subsp. paratuberculosis
cgagcgugggggccaugu

SEQ ID NO: 3004780 - RNA, 17 nt, Mycobacterium avium subsp. paratuberculosis
cgagcguucggcgcgga

SEQ ID NO: 3004781 - RNA, 17 nt, Mycobacterium avium subsp. paratuberculosis
cgagcucaacagcauug

SEQ ID NO: 3004782 - RNA, 13 nt, Mycobacterium avium subsp. paratuberculosis
cgagcucaccgac

SEQ ID NO: 3004783 - RNA, 13 nt, Mycobacterium avium subsp. paratuberculosis
cgagcucaccgcc

SEQ ID NO: 3004784 - RNA, 15 nt, Mycobacterium avium subsp. paratuberculosis
cgagcucaccgccga

SEQ ID NO: 3004785 - RNA, 23 nt, Mycobacterium avium subsp. paratuberculosis
cgagcucaugguguuccaccagc

SEQ ID NO: 3004786 - RNA, 14 nt, Mycobacterium avium subsp. paratuberculosis
cgagcuccagcuag

SEQ ID NO: 3004787 - RNA, 14 nt, Mycobacterium avium subsp. paratuberculosis
cgagcuccuccggg

SEQ ID NO: 3004788 - RNA, 15 nt, Mycobacterium avium subsp. paratuberculosis
cgagcuccucggcca

SEQ ID NO: 3004789 - RNA, 19 nt, Mycobacterium avium subsp. paratuberculosis
cgagcuccucggccagcgg

SEQ ID NO: 3004790 - RNA, 13 nt, Mycobacterium avium subsp. paratuberculosis
cgagcucgauguc

SEQ ID NO: 3004791 - RNA, 15 nt, Mycobacterium avium subsp. paratuberculosis
cgagcucgcagucga

SEQ ID NO: 3004792 - RNA, 17 nt, Mycobacterium avium subsp. paratuberculosis
cgagcucgcagucgauc

SEQ ID NO: 3004793 - RNA, 19 nt, Mycobacterium avium subsp. paratuberculosis
cgagcucgcagucgaucag

SEQ ID NO: 3004794 - RNA, 21 nt, Mycobacterium avium subsp. paratuberculosis
cgagcucgccgcugucgucga

SEQ ID NO: 3004795 - RNA, 22 nt, Mycobacterium avium subsp. paratuberculosis
cgagcucgccgcugucgucgaa

SEQ ID NO: 3004796 - RNA, 15 nt, Mycobacterium avium subsp. paratuberculosis
cgagcucgcggccgu

SEQ ID NO: 3004797 - RNA, 18 nt, Mycobacterium avium subsp. paratuberculosis
cgagcucgcggccguagc

SEQ ID NO: 3004798 - RNA, 15 nt, Mycobacterium avium subsp. paratuberculosis
cgagcucggccuuga

SEQ ID NO: 3004799 - RNA, 23 nt, Mycobacterium avium subsp. paratuberculosis
cgagcucggccuugagccggucg

SEQ ID NO: 3004800 - RNA, 14 nt, Mycobacterium avium subsp. paratuberculosis
cgagcucggcgagg

SEQ ID NO: 3004801 - RNA, 13 nt, Mycobacterium avium subsp. paratuberculosis
cgagcucgggcgc

SEQ ID NO: 3004802 - RNA, 17 nt, Mycobacterium avium subsp. paratuberculosis
cgagcucgggcgcgaac

SEQ ID NO: 3004803 - RNA, 19 nt, Mycobacterium avium subsp. paratuberculosis
cgagcucgucggguguggc

SEQ ID NO: 3004804 - RNA, 14 nt, Mycobacterium avium subsp. paratuberculosis
cgagcucgugaugg

SEQ ID NO: 3004805 - RNA, 18 nt, Mycobacterium avium subsp. paratuberculosis
cgagcucguucucggcga

SEQ ID NO: 3004806 - RNA, 23 nt, Mycobacterium avium subsp. paratuberculosis
cgagcucguucucggcgaacagc

SEQ ID NO: 3004807 - RNA, 24 nt, Mycobacterium avium subsp. paratuberculosis
cgagcucguucucggcgaacagcg

SEQ ID NO: 3004808 - RNA, 14 nt, Mycobacterium avium subsp. paratuberculosis
cgagcugaccggcc

SEQ ID NO: 3004809 - RNA, 15 nt, Mycobacterium avium subsp. paratuberculosis
cgagcugaccggcca

SEQ ID NO: 3004810 - RNA, 16 nt, Mycobacterium avium subsp. paratuberculosis
cgagcugaccggccac

SEQ ID NO: 3004811 - RNA, 17 nt, Mycobacterium avium subsp. paratuberculosis
cgagcugaccggccacc

SEQ ID NO: 3004812 - RNA, 19 nt, Mycobacterium avium subsp. paratuberculosis
cgagcugaccggccaccuc

SEQ ID NO: 3004813 - RNA, 20 nt, Mycobacterium avium subsp. paratuberculosis
cgagcugacgaacgcgccgc

SEQ ID NO: 3004814 - RNA, 22 nt, Mycobacterium avium subsp. paratuberculosis
cgagcugacgaacgcgccgccc

SEQ ID NO: 3004815 - RNA, 20 nt, Mycobacterium avium subsp. paratuberculosis
cgagcugaucgcggccggcg

SEQ ID NO: 3004816 - RNA, 21 nt, Mycobacterium avium subsp. paratuberculosis
cgagcugaucgcggccggcga

SEQ ID NO: 3004817 - RNA, 14 nt, Mycobacterium avium subsp. paratuberculosis
cgagcugcaacgcg

SEQ ID NO: 3004818 - RNA, 20 nt, Mycobacterium avium subsp. paratuberculosis
cgagcugcaacgcgucggcg

SEQ ID NO: 3004819 - RNA, 15 nt, Mycobacterium avium subsp. paratuberculosis
cgagcugcacgggcg

SEQ ID NO: 3004820 - RNA, 17 nt, Mycobacterium avium subsp. paratuberculosis
cgagcugcacgggcgug

SEQ ID NO: 3004821 - RNA, 17 nt, Mycobacterium avium subsp. paratuberculosis
cgagcugccggcggccg

SEQ ID NO: 3004822 - RNA, 19 nt, Mycobacterium avium subsp. paratuberculosis
cgagcugccggcggccgcc

SEQ ID NO: 3004823 - RNA, 22 nt, Mycobacterium avium subsp. paratuberculosis
cgagcugccggcggccgccggc

SEQ ID NO: 3004824 - RNA, 19 nt, Mycobacterium avium subsp. paratuberculosis
cgagcugcgggugcucagc

SEQ ID NO: 3004825 - RNA, 20 nt, Mycobacterium avium subsp. paratuberculosis
cgagcugcgggugcucagcc

SEQ ID NO: 3004826 - RNA, 16 nt, Mycobacterium avium subsp. paratuberculosis
cgagcugcuucgucgc

SEQ ID NO: 3004827 - RNA, 20 nt, Mycobacterium avium subsp. paratuberculosis
cgagcugcuucgucgccggg

SEQ ID NO: 3004828 - RNA, 21 nt, Mycobacterium avium subsp. paratuberculosis
cgagcugcuucgucgccgggc

SEQ ID NO: 3004829 - RNA, 23 nt, Mycobacterium avium subsp. paratuberculosis
cgagcugcuucgucgccgggcuc

SEQ ID NO: 3004830 - RNA, 13 nt, Mycobacterium avium subsp. paratuberculosis
cgagcuggccgcc

SEQ ID NO: 3004831 - RNA, 14 nt, Mycobacterium avium subsp. paratuberculosis
cgagcuggccgccc

SEQ ID NO: 3004832 - RNA, 16 nt, Mycobacterium avium subsp. paratuberculosis
cgagcuggccgcccac

SEQ ID NO: 3004833 - RNA, 18 nt, Mycobacterium avium subsp. paratuberculosis
cgagcuggccgcccacca

SEQ ID NO: 3004834 - RNA, 19 nt, Mycobacterium avium subsp. paratuberculosis
cgagcuggccgcccaccac

SEQ ID NO: 3004835 - RNA, 21 nt, Mycobacterium avium subsp. paratuberculosis
cgagcuggccgcccaccacga

SEQ ID NO: 3004836 - RNA, 13 nt, Mycobacterium avium subsp. paratuberculosis
cgagcugggcccg

SEQ ID NO: 3004837 - RNA, 19 nt, Mycobacterium avium subsp. paratuberculosis
cgagcugggcccgcgcauc

SEQ ID NO: 3004838 - RNA, 14 nt, Mycobacterium avium subsp. paratuberculosis
cgagcugggccggc

SEQ ID NO: 3004839 - RNA, 18 nt, Mycobacterium avium subsp. paratuberculosis
cgagcugggccggcgccg

SEQ ID NO: 3004840 - RNA, 20 nt, Mycobacterium avium subsp. paratuberculosis
cgagcugggccggcgccgaa

SEQ ID NO: 3004841 - RNA, 19 nt, Mycobacterium avium subsp. paratuberculosis
cgagcuuccgccgagucgc

SEQ ID NO: 3004842 - RNA, 16 nt, Mycobacterium avium subsp. paratuberculosis
cgagcuugccgucguu

SEQ ID NO: 3004843 - RNA, 18 nt, Mycobacterium avium subsp. paratuberculosis
cgagcuugccgucguuga

SEQ ID NO: 3004844 - RNA, 23 nt, Mycobacterium avium subsp. paratuberculosis
cgagcuugccgucguugacgccc

SEQ ID NO: 3004845 - RNA, 17 nt, Mycobacterium avium subsp. paratuberculosis
cgagcuugggccggugc

SEQ ID NO: 3004846 - RNA, 21 nt, Mycobacterium avium subsp. paratuberculosis
cgagcuugggccggugcagca

SEQ ID NO: 3004847 - RNA, 22 nt, Mycobacterium avium subsp. paratuberculosis
cgagcuugggccggugcagcac

SEQ ID NO: 3004848 - RNA, 17 nt, Mycobacterium avium subsp. paratuberculosis
cgagcuuguccugcacc

SEQ ID NO: 3004849 - RNA, 16 nt, Mycobacterium avium subsp. paratuberculosis
cgaggaacccgaccgc

SEQ ID NO: 3004850 - RNA, 21 nt, Mycobacterium avium subsp. paratuberculosis
cgaggaaccggcagccggcgu

SEQ ID NO: 3004851 - RNA, 16 nt, Mycobacterium avium subsp. paratuberculosis
cgaggaacucagcgcc

SEQ ID NO: 3004852 - RNA, 15 nt, Mycobacterium avium subsp. paratuberculosis
cgaggaacuugcgcc

SEQ ID NO: 3004853 - RNA, 18 nt, Mycobacterium avium subsp. paratuberculosis
cgaggaacuugcgccggg

SEQ ID NO: 3004854 - RNA, 17 nt, Mycobacterium avium subsp. paratuberculosis
cgaggaaguccggcgcg

SEQ ID NO: 3004855 - RNA, 19 nt, Mycobacterium avium subsp. paratuberculosis
cgaggaaguccggcgcgcc

SEQ ID NO: 3004856 - RNA, 22 nt, Mycobacterium avium subsp. paratuberculosis
cgaggaaguccggcgcgcccgg

SEQ ID NO: 3004857 - RNA, 18 nt, Mycobacterium avium subsp. paratuberculosis
cgaggaaguuguagacgu

SEQ ID NO: 3004858 - RNA, 15 nt, Mycobacterium avium subsp. paratuberculosis
cgaggaaucgcggca

SEQ ID NO: 3004859 - RNA, 20 nt, Mycobacterium avium subsp. paratuberculosis
cgaggaaucgcggcaggcga

SEQ ID NO: 3004860 - RNA, 12 nt, Mycobacterium avium subsp. paratuberculosis
cgaggacaccgc

SEQ ID NO: 3004861 - RNA, 15 nt, Mycobacterium avium subsp. paratuberculosis
cgaggaccggcgccg

SEQ ID NO: 3004862 - RNA, 22 nt, Mycobacterium avium subsp. paratuberculosis
cgaggaccggcgccggccgccg

SEQ ID NO: 3004863 - RNA, 21 nt, Mycobacterium avium subsp. paratuberculosis
cgaggacggcuuggguguggc

SEQ ID NO: 3004864 - RNA, 21 nt, Mycobacterium avium subsp. paratuberculosis
cgaggacgucgagcggcgccu

SEQ ID NO: 3004865 - RNA, 17 nt, Mycobacterium avium subsp. paratuberculosis
cgaggacgucgucgacg

SEQ ID NO: 3004866 - RNA, 18 nt, Mycobacterium avium subsp. paratuberculosis
cgaggacgucgucgacgu

SEQ ID NO: 3004867 - RNA, 19 nt, Mycobacterium avium subsp. paratuberculosis
cgaggacgucgucgacguc

SEQ ID NO: 3004868 - RNA, 17 nt, Mycobacterium avium subsp. paratuberculosis
cgaggagaccuccugcu

SEQ ID NO: 3004869 - RNA, 14 nt, Mycobacterium avium subsp. paratuberculosis
cgaggagacgucgg

SEQ ID NO: 3004870 - RNA, 17 nt, Mycobacterium avium subsp. paratuberculosis
cgaggagacgucggccg

SEQ ID NO: 3004871 - RNA, 19 nt, Mycobacterium avium subsp. paratuberculosis
cgaggagacgucggccggg

SEQ ID NO: 3004872 - RNA, 21 nt, Mycobacterium avium subsp. paratuberculosis
cgaggagacgucggccggguc

SEQ ID NO: 3004873 - RNA, 22 nt, Mycobacterium avium subsp. paratuberculosis
cgaggagauuuuguuuggagag

SEQ ID NO: 3004874 - RNA, 15 nt, Mycobacterium avium subsp. paratuberculosis
cgaggaggccgcggc

SEQ ID NO: 3004875 - RNA, 21 nt, Mycobacterium avium subsp. paratuberculosis
cgaggaggccgcggcgacacc

SEQ ID NO: 3004876 - RNA, 14 nt, Mycobacterium avium subsp. paratuberculosis
cgaggaggggucgg

SEQ ID NO: 3004877 - RNA, 19 nt, Mycobacterium avium subsp. paratuberculosis
cgaggaggggucggugcgg

SEQ ID NO: 3004878 - RNA, 16 nt, Mycobacterium avium subsp. paratuberculosis
cgaggagggugucggc

SEQ ID NO: 3004879 - RNA, 21 nt, Mycobacterium avium subsp. paratuberculosis
cgaggagggugucggcggggc

SEQ ID NO: 3004880 - RNA, 23 nt, Mycobacterium avium subsp. paratuberculosis
cgaggagggugucggcggggccg

SEQ ID NO: 3004881 - RNA, 14 nt, Mycobacterium avium subsp. paratuberculosis
cgaggaucgcggcc

SEQ ID NO: 3004882 - RNA, 15 nt, Mycobacterium avium subsp. paratuberculosis
cgaggaucgcggcca

SEQ ID NO: 3004883 - RNA, 17 nt, Mycobacterium avium subsp. paratuberculosis
cgaggaucgcggccacg

SEQ ID NO: 3004884 - RNA, 23 nt, Mycobacterium avium subsp. paratuberculosis
cgaggaucucccggguggccucc

SEQ ID NO: 3004885 - RNA, 17 nt, Mycobacterium avium subsp. paratuberculosis
cgaggaucugggcggcg

SEQ ID NO: 3004886 - RNA, 18 nt, Mycobacterium avium subsp. paratuberculosis
cgaggaucugggcggcgg

SEQ ID NO: 3004887 - RNA, 19 nt, Mycobacterium avium subsp. paratuberculosis
cgaggaucugggcggcggg

SEQ ID NO: 3004888 - RNA, 18 nt, Mycobacterium avium subsp. paratuberculosis
cgaggaucuugaucgcga

SEQ ID NO: 3004889 - RNA, 20 nt, Mycobacterium avium subsp. paratuberculosis
cgaggaugaccgcggcgaau

SEQ ID NO: 3004890 - RNA, 19 nt, Mycobacterium avium subsp. paratuberculosis
cgaggaugccgcccaccac

SEQ ID NO: 3004891 - RNA, 23 nt, Mycobacterium avium subsp. paratuberculosis
cgaggaugccgcccaccaccggc

SEQ ID NO: 3004892 - RNA, 18 nt, Mycobacterium avium subsp. paratuberculosis
cgaggauggggucgcggg

SEQ ID NO: 3004893 - RNA, 19 nt, Mycobacterium avium subsp. paratuberculosis
cgaggauggggucgcgggc

SEQ ID NO: 3004894 - RNA, 22 nt, Mycobacterium avium subsp. paratuberculosis
cgaggauggggucgcgggcgcc

SEQ ID NO: 3004895 - RNA, 23 nt, Mycobacterium avium subsp. paratuberculosis
cgaggauggggucgcgggcgccg

SEQ ID NO: 3004896 - RNA, 19 nt, Mycobacterium avium subsp. paratuberculosis
cgaggcaaucgagcgggcg

SEQ ID NO: 3004897 - RNA, 18 nt, Mycobacterium avium subsp. paratuberculosis
cgaggcacagcagcacgu

SEQ ID NO: 3004898 - RNA, 23 nt, Mycobacterium avium subsp. paratuberculosis
cgaggcaguuccaugucgacgac

SEQ ID NO: 3004899 - RNA, 13 nt, Mycobacterium avium subsp. paratuberculosis
cgaggccagcacg

SEQ ID NO: 3004900 - RNA, 14 nt, Mycobacterium avium subsp. paratuberculosis
cgaggccagcacgc

SEQ ID NO: 3004901 - RNA, 20 nt, Mycobacterium avium subsp. paratuberculosis
cgaggccagcacgccgguca

SEQ ID NO: 3004902 - RNA, 21 nt, Mycobacterium avium subsp. paratuberculosis
cgaggccagcacgccggucag

SEQ ID NO: 3004903 - RNA, 20 nt, Mycobacterium avium subsp. paratuberculosis
cgaggccagcgcgaucgccg

SEQ ID NO: 3004904 - RNA, 16 nt, Mycobacterium avium subsp. paratuberculosis
cgaggccagggcccgc

SEQ ID NO: 3004905 - RNA, 13 nt, Mycobacterium avium subsp. paratuberculosis
cgaggccaucauc

SEQ ID NO: 3004906 - RNA, 18 nt, Mycobacterium avium subsp. paratuberculosis
cgaggcccacgaaccggu

SEQ ID NO: 3004907 - RNA, 22 nt, Mycobacterium avium subsp. paratuberculosis
cgaggccccgcgugacggccgc

SEQ ID NO: 3004908 - RNA, 15 nt, Mycobacterium avium subsp. paratuberculosis
cgaggcccucgacac

SEQ ID NO: 3004909 - RNA, 21 nt, Mycobacterium avium subsp. paratuberculosis
cgaggcccucgacaccggugg

SEQ ID NO: 3004910 - RNA, 22 nt, Mycobacterium avium subsp. paratuberculosis
cgaggccgaaccgcagccggau

SEQ ID NO: 3004911 - RNA, 14 nt, Mycobacterium avium subsp. paratuberculosis
cgaggccgacgugc

SEQ ID NO: 3004912 - RNA, 22 nt, Mycobacterium avium subsp. paratuberculosis
cgaggccgacgugcuuggccag

SEQ ID NO: 3004913 - RNA, 19 nt, Mycobacterium avium subsp. paratuberculosis
cgaggccgaggucggucgc

SEQ ID NO: 3004914 - RNA, 21 nt, Mycobacterium avium subsp. paratuberculosis
cgaggccgaggucggucgcgg

SEQ ID NO: 3004915 - RNA, 19 nt, Mycobacterium avium subsp. paratuberculosis
cgaggccgauggcgcccag

SEQ ID NO: 3004916 - RNA, 20 nt, Mycobacterium avium subsp. paratuberculosis
cgaggccgauggcgcccagc

SEQ ID NO: 3004917 - RNA, 14 nt, Mycobacterium avium subsp. paratuberculosis
cgaggccgcgggcg

SEQ ID NO: 3004918 - RNA, 17 nt, Mycobacterium avium subsp. paratuberculosis
cgaggccgcgggcguuc

SEQ ID NO: 3004919 - RNA, 15 nt, Mycobacterium avium subsp. paratuberculosis
cgaggccggccagcg

SEQ ID NO: 3004920 - RNA, 16 nt, Mycobacterium avium subsp. paratuberculosis
cgaggccggccagcgg

SEQ ID NO: 3004921 - RNA, 18 nt, Mycobacterium avium subsp. paratuberculosis
cgaggccggccagcgggu

SEQ ID NO: 3004922 - RNA, 13 nt, Mycobacterium avium subsp. paratuberculosis
cgaggccgggcug

SEQ ID NO: 3004923 - RNA, 15 nt, Mycobacterium avium subsp. paratuberculosis
cgaggccgggcuggc

SEQ ID NO: 3004924 - RNA, 16 nt, Mycobacterium avium subsp. paratuberculosis
cgaggccgggcuggcg

SEQ ID NO: 3004925 - RNA, 21 nt, Mycobacterium avium subsp. paratuberculosis
cgaggccguaucccaccacga

SEQ ID NO: 3004926 - RNA, 14 nt, Mycobacterium avium subsp. paratuberculosis
cgaggccucgccgc

SEQ ID NO: 3004927 - RNA, 21 nt, Mycobacterium avium subsp. paratuberculosis
cgaggcgaagguggcgucggc

SEQ ID NO: 3004928 - RNA, 19 nt, Mycobacterium avium subsp. paratuberculosis
cgaggcgacgucgaacgcg

SEQ ID NO: 3004929 - RNA, 18 nt, Mycobacterium avium subsp. paratuberculosis
cgaggcgaguaaggccga

SEQ ID NO: 3004930 - RNA, 15 nt, Mycobacterium avium subsp. paratuberculosis
cgaggcgagugagga

SEQ ID NO: 3004931 - RNA, 16 nt, Mycobacterium avium subsp. paratuberculosis
cgaggcgagugaggac

SEQ ID NO: 3004932 - RNA, 21 nt, Mycobacterium avium subsp. paratuberculosis
cgaggcgagugaggacgaggc

SEQ ID NO: 3004933 - RNA, 16 nt, Mycobacterium avium subsp. paratuberculosis
cgaggcgaucaucgcc

SEQ ID NO: 3004934 - RNA, 16 nt, Mycobacterium avium subsp. paratuberculosis
cgaggcgaucgcggcc

SEQ ID NO: 3004935 - RNA, 13 nt, Mycobacterium avium subsp. paratuberculosis
cgaggcgaugccg

SEQ ID NO: 3004936 - RNA, 15 nt, Mycobacterium avium subsp. paratuberculosis
cgaggcgauggugcc

SEQ ID NO: 3004937 - RNA, 15 nt, Mycobacterium avium subsp. paratuberculosis
cgaggcgcaacaccg

SEQ ID NO: 3004938 - RNA, 17 nt, Mycobacterium avium subsp. paratuberculosis
cgaggcgcaacaccgga

SEQ ID NO: 3004939 - RNA, 14 nt, Mycobacterium avium subsp. paratuberculosis
cgaggcgcaggagg

SEQ ID NO: 3004940 - RNA, 20 nt, Mycobacterium avium subsp. paratuberculosis
cgaggcgcaguagccgacgu

SEQ ID NO: 3004941 - RNA, 22 nt, Mycobacterium avium subsp. paratuberculosis
cgaggcgcaguagccgacgugc

SEQ ID NO: 3004942 - RNA, 18 nt, Mycobacterium avium subsp. paratuberculosis
cgaggcgcgaaagcgcga

SEQ ID NO: 3004943 - RNA, 19 nt, Mycobacterium avium subsp. paratuberculosis
cgaggcgcgaaagcgcgag

SEQ ID NO: 3004944 - RNA, 17 nt, Mycobacterium avium subsp. paratuberculosis
cgaggcgcgcagguagc

SEQ ID NO: 3004945 - RNA, 18 nt, Mycobacterium avium subsp. paratuberculosis
cgaggcgcgcagguagcc

SEQ ID NO: 3004946 - RNA, 22 nt, Mycobacterium avium subsp. paratuberculosis
cgaggcgcgcagguagccgccg

SEQ ID NO: 3004947 - RNA, 17 nt, Mycobacterium avium subsp. paratuberculosis
cgaggcgcggggcgcga

SEQ ID NO: 3004948 - RNA, 13 nt, Mycobacterium avium subsp. paratuberculosis
cgaggcgcuccug

SEQ ID NO: 3004949 - RNA, 22 nt, Mycobacterium avium subsp. paratuberculosis
cgaggcgcucgcacaacccgcc

SEQ ID NO: 3004950 - RNA, 13 nt, Mycobacterium avium subsp. paratuberculosis
cgaggcgcucggc

SEQ ID NO: 3004951 - RNA, 14 nt, Mycobacterium avium subsp. paratuberculosis
cgaggcgcucggcc

SEQ ID NO: 3004952 - RNA, 22 nt, Mycobacterium avium subsp. paratuberculosis
cgaggcggaucuucucgcugcu

SEQ ID NO: 3004953 - RNA, 13 nt, Mycobacterium avium subsp. paratuberculosis
cgaggcggccagc

SEQ ID NO: 3004954 - RNA, 19 nt, Mycobacterium avium subsp. paratuberculosis
cgaggcggccagcggcagc

SEQ ID NO: 3004955 - RNA, 14 nt, Mycobacterium avium subsp. paratuberculosis
cgaggcgggcacac

SEQ ID NO: 3004956 - RNA, 14 nt, Mycobacterium avium subsp. paratuberculosis
cgaggcgggcgauc

SEQ ID NO: 3004957 - RNA, 15 nt, Mycobacterium avium subsp. paratuberculosis
cgaggcgggcgaucu

SEQ ID NO: 3004958 - RNA, 20 nt, Mycobacterium avium subsp. paratuberculosis
cgaggcggguaggcgucgcg

SEQ ID NO: 3004959 - RNA, 18 nt, Mycobacterium avium subsp. paratuberculosis
cgaggcgggugaggacgc

SEQ ID NO: 3004960 - RNA, 19 nt, Mycobacterium avium subsp. paratuberculosis
cgaggcgggugaggacgcc

SEQ ID NO: 3004961 - RNA, 22 nt, Mycobacterium avium subsp. paratuberculosis
cgaggcggguguauucgcccac

SEQ ID NO: 3004962 - RNA, 14 nt, Mycobacterium avium subsp. paratuberculosis
cgaggcggucggcg

SEQ ID NO: 3004963 - RNA, 21 nt, Mycobacterium avium subsp. paratuberculosis
cgaggcggucggcggaggcga

SEQ ID NO: 3004964 - RNA, 20 nt, Mycobacterium avium subsp. paratuberculosis
cgaggcguagcugcaggcga

SEQ ID NO: 3004965 - RNA, 23 nt, Mycobacterium avium subsp. paratuberculosis
cgaggcguagcugcaggcgacga

SEQ ID NO: 3004966 - RNA, 19 nt, Mycobacterium avium subsp. paratuberculosis
cgaggcgucagggguuggc

SEQ ID NO: 3004967 - RNA, 16 nt, Mycobacterium avium subsp. paratuberculosis
cgaggcguccuccucg

SEQ ID NO: 3004968 - RNA, 23 nt, Mycobacterium avium subsp. paratuberculosis
cgaggcguccuccucguccgcgg

SEQ ID NO: 3004969 - RNA, 14 nt, Mycobacterium avium subsp. paratuberculosis
cgaggcgugcagcc

SEQ ID NO: 3004970 - RNA, 15 nt, Mycobacterium avium subsp. paratuberculosis
cgaggcgugcagccc

SEQ ID NO: 3004971 - RNA, 19 nt, Mycobacterium avium subsp. paratuberculosis
cgaggcgugcagcccgcau

SEQ ID NO: 3004972 - RNA, 17 nt, Mycobacterium avium subsp. paratuberculosis
cgaggcgugccgcuggg

SEQ ID NO: 3004973 - RNA, 20 nt, Mycobacterium avium subsp. paratuberculosis
cgaggcugacgaucgucgac

SEQ ID NO: 3004974 - RNA, 15 nt, Mycobacterium avium subsp. paratuberculosis
cgaggcugugggcca

SEQ ID NO: 3004975 - RNA, 20 nt, Mycobacterium avium subsp. paratuberculosis
cgaggcugugggccagcagc

SEQ ID NO: 3004976 - RNA, 21 nt, Mycobacterium avium subsp. paratuberculosis
cgaggcugugggccagcagcg

SEQ ID NO: 3004977 - RNA, 23 nt, Mycobacterium avium subsp. paratuberculosis
cgaggcugugggccagcagcguc

SEQ ID NO: 3004978 - RNA, 19 nt, Mycobacterium avium subsp. paratuberculosis
cgagggcaacgucuggcca

SEQ ID NO: 3004979 - RNA, 16 nt, Mycobacterium avium subsp. paratuberculosis
cgagggccaccggcuc

SEQ ID NO: 3004980 - RNA, 14 nt, Mycobacterium avium subsp. paratuberculosis
cgagggccagcagc

SEQ ID NO: 3004981 - RNA, 15 nt, Mycobacterium avium subsp. paratuberculosis
cgagggccagcagcc

SEQ ID NO: 3004982 - RNA, 19 nt, Mycobacterium avium subsp. paratuberculosis
cgagggccagcagccagcu

SEQ ID NO: 3004983 - RNA, 18 nt, Mycobacterium avium subsp. paratuberculosis
cgagggcccgggcaggca

SEQ ID NO: 3004984 - RNA, 19 nt, Mycobacterium avium subsp. paratuberculosis
cgagggccguugcggccaa

SEQ ID NO: 3004985 - RNA, 16 nt, Mycobacterium avium subsp. paratuberculosis
cgagggccuccaccac

SEQ ID NO: 3004986 - RNA, 17 nt, Mycobacterium avium subsp. paratuberculosis
cgagggccuccaccacc

SEQ ID NO: 3004987 - RNA, 17 nt, Mycobacterium avium subsp. paratuberculosis
cgagggcgacgaugccg

SEQ ID NO: 3004988 - RNA, 12 nt, Mycobacterium avium subsp. paratuberculosis
cgagggcgccgu

SEQ ID NO: 3004989 - RNA, 13 nt, Mycobacterium avium subsp. paratuberculosis
cgagggcgcgcag

SEQ ID NO: 3004990 - RNA, 14 nt, Mycobacterium avium subsp. paratuberculosis
cgagggcgcgcagc

SEQ ID NO: 3004991 - RNA, 14 nt, Mycobacterium avium subsp. paratuberculosis
cgagggcgcggcgu

SEQ ID NO: 3004992 - RNA, 19 nt, Mycobacterium avium subsp. paratuberculosis
cgagggcgcggcguagccg

SEQ ID NO: 3004993 - RNA, 21 nt, Mycobacterium avium subsp. paratuberculosis
cgagggcgcgggaucggugcc

SEQ ID NO: 3004994 - RNA, 12 nt, Mycobacterium avium subsp. paratuberculosis
cgagggcggcga

SEQ ID NO: 3004995 - RNA, 16 nt, Mycobacterium avium subsp. paratuberculosis
cgagggcgggccagcu

SEQ ID NO: 3004996 - RNA, 18 nt, Mycobacterium avium subsp. paratuberculosis
cgagggcgggccagcucg

SEQ ID NO: 3004997 - RNA, 16 nt, Mycobacterium avium subsp. paratuberculosis
cgagggcguucgcggu

SEQ ID NO: 3004998 - RNA, 18 nt, Mycobacterium avium subsp. paratuberculosis
cgagggcguucgcggugg

SEQ ID NO: 3004999 - RNA, 22 nt, Mycobacterium avium subsp. paratuberculosis
cgagggcuaaccaccggugacg

SEQ ID NO: 3005000 - RNA, 20 nt, Mycobacterium avium subsp. paratuberculosis
cgagggcucaacaggcgagu

SEQ ID NO: 3005001 - RNA, 17 nt, Mycobacterium avium subsp. paratuberculosis
cgaggggcagcagcgcc

SEQ ID NO: 3005002 - RNA, 18 nt, Mycobacterium avium subsp. paratuberculosis
cgaggggcuugagcgcgu

SEQ ID NO: 3005003 - RNA, 20 nt, Mycobacterium avium subsp. paratuberculosis
cgaggggcuugagcgcgucg

SEQ ID NO: 3005004 - RNA, 22 nt, Mycobacterium avium subsp. paratuberculosis
cgaggggcuugagcgcgucguc

SEQ ID NO: 3005005 - RNA, 19 nt, Mycobacterium avium subsp. paratuberculosis
cgaggggcuuggcgacgaa

SEQ ID NO: 3005006 - RNA, 19 nt, Mycobacterium avium subsp. paratuberculosis
cgagggggaagucgaccgg

SEQ ID NO: 3005007 - RNA, 20 nt, Mycobacterium avium subsp. paratuberculosis
cgaggggguggguccgguca

SEQ ID NO: 3005008 - RNA, 21 nt, Mycobacterium avium subsp. paratuberculosis
cgaggggguggguccggucag

SEQ ID NO: 3005009 - RNA, 22 nt, Mycobacterium avium subsp. paratuberculosis
cgagggucgccaggccaccgca

SEQ ID NO: 3005010 - RNA, 17 nt, Mycobacterium avium subsp. paratuberculosis
cgagggugacccgggcg

SEQ ID NO: 3005011 - RNA, 18 nt, Mycobacterium avium subsp. paratuberculosis
cgagggugacccgggcga

SEQ ID NO: 3005012 - RNA, 18 nt, Mycobacterium avium subsp. paratuberculosis
cgagggugaugucgcugc

SEQ ID NO: 3005013 - RNA, 23 nt, Mycobacterium avium subsp. paratuberculosis
cgagggugaugucgcugccgccg

SEQ ID NO: 3005014 - RNA, 19 nt, Mycobacterium avium subsp. paratuberculosis
cgagggugccggccaccgg

SEQ ID NO: 3005015 - RNA, 14 nt, Mycobacterium avium subsp. paratuberculosis
cgaggguucggugg

SEQ ID NO: 3005016 - RNA, 21 nt, Mycobacterium avium subsp. paratuberculosis
cgaggguucgguggccccggg

SEQ ID NO: 3005017 - RNA, 15 nt, Mycobacterium avium subsp. paratuberculosis
cgagguacugcagca

SEQ ID NO: 3005018 - RNA, 17 nt, Mycobacterium avium subsp. paratuberculosis
cgagguacugcagcagu

SEQ ID NO: 3005019 - RNA, 14 nt, Mycobacterium avium subsp. paratuberculosis
cgagguagaccgcc

SEQ ID NO: 3005020 - RNA, 15 nt, Mycobacterium avium subsp. paratuberculosis
cgagguagaccgccg

SEQ ID NO: 3005021 - RNA, 16 nt, Mycobacterium avium subsp. paratuberculosis
cgagguagaccgccga

SEQ ID NO: 3005022 - RNA, 17 nt, Mycobacterium avium subsp. paratuberculosis
cgagguagaccgccgag

SEQ ID NO: 3005023 - RNA, 14 nt, Mycobacterium avium subsp. paratuberculosis
cgagguagccgcgc

SEQ ID NO: 3005024 - RNA, 19 nt, Mycobacterium avium subsp. paratuberculosis
cgagguagcgugcgcccga

SEQ ID NO: 3005025 - RNA, 14 nt, Mycobacterium avium subsp. paratuberculosis
cgagguagggccgg

SEQ ID NO: 3005026 - RNA, 16 nt, Mycobacterium avium subsp. paratuberculosis
cgagguagggccgggu

SEQ ID NO: 3005027 - RNA, 14 nt, Mycobacterium avium subsp. paratuberculosis
cgagguagucggcc

SEQ ID NO: 3005028 - RNA, 15 nt, Mycobacterium avium subsp. paratuberculosis
cgagguagucggccu

SEQ ID NO: 3005029 - RNA, 15 nt, Mycobacterium avium subsp. paratuberculosis
cgagguagugcgcga

SEQ ID NO: 3005030 - RNA, 21 nt, Mycobacterium avium subsp. paratuberculosis
cgagguagugcgcgauggcgu

SEQ ID NO: 3005031 - RNA, 13 nt, Mycobacterium avium subsp. paratuberculosis
cgaggucaccacc

SEQ ID NO: 3005032 - RNA, 17 nt, Mycobacterium avium subsp. paratuberculosis
cgaggucaccaccgagc

SEQ ID NO: 3005033 - RNA, 19 nt, Mycobacterium avium subsp. paratuberculosis
cgaggucaccaccgagccg

SEQ ID NO: 3005034 - RNA, 17 nt, Mycobacterium avium subsp. paratuberculosis
cgaggucauaucgacgg

SEQ ID NO: 3005035 - RNA, 18 nt, Mycobacterium avium subsp. paratuberculosis
cgaggucaucgagccgag

SEQ ID NO: 3005036 - RNA, 20 nt, Mycobacterium avium subsp. paratuberculosis
cgaggucaucgagccgagca

SEQ ID NO: 3005037 - RNA, 21 nt, Mycobacterium avium subsp. paratuberculosis
cgaggucaucgagccgagcac

SEQ ID NO: 3005038 - RNA, 22 nt, Mycobacterium avium subsp. paratuberculosis
cgaggucaucgagccgagcacc

SEQ ID NO: 3005039 - RNA, 20 nt, Mycobacterium avium subsp. paratuberculosis
cgagguccucgcgcaacugg

SEQ ID NO: 3005040 - RNA, 19 nt, Mycobacterium avium subsp. paratuberculosis
cgagguccuugcggaaccg

SEQ ID NO: 3005041 - RNA, 22 nt, Mycobacterium avium subsp. paratuberculosis
cgaggucgaaccacgcggcggc

SEQ ID NO: 3005042 - RNA, 17 nt, Mycobacterium avium subsp. paratuberculosis
cgaggucgacggagucg

SEQ ID NO: 3005043 - RNA, 13 nt, Mycobacterium avium subsp. paratuberculosis
cgaggucgccgac

SEQ ID NO: 3005044 - RNA, 14 nt, Mycobacterium avium subsp. paratuberculosis
cgaggucgccgaca

SEQ ID NO: 3005045 - RNA, 19 nt, Mycobacterium avium subsp. paratuberculosis
cgaggucgccgacagcguc

SEQ ID NO: 3005046 - RNA, 14 nt, Mycobacterium avium subsp. paratuberculosis
cgaggucgccgacg

SEQ ID NO: 3005047 - RNA, 18 nt, Mycobacterium avium subsp. paratuberculosis
cgaggucgcgcagcaccu

SEQ ID NO: 3005048 - RNA, 19 nt, Mycobacterium avium subsp. paratuberculosis
cgaggucgcgcagcaccuc

SEQ ID NO: 3005049 - RNA, 20 nt, Mycobacterium avium subsp. paratuberculosis
cgaggucgcgcagcaccucc

SEQ ID NO: 3005050 - RNA, 17 nt, Mycobacterium avium subsp. paratuberculosis
cgaggucgcggcggccg

SEQ ID NO: 3005051 - RNA, 18 nt, Mycobacterium avium subsp. paratuberculosis
cgaggucgcggcggccgg

SEQ ID NO: 3005052 - RNA, 19 nt, Mycobacterium avium subsp. paratuberculosis
cgaggucgcggcggccggc

SEQ ID NO: 3005053 - RNA, 16 nt, Mycobacterium avium subsp. paratuberculosis
cgaggucggucgcggc

SEQ ID NO: 3005054 - RNA, 17 nt, Mycobacterium avium subsp. paratuberculosis
cgaggucggucgcggca

SEQ ID NO: 3005055 - RNA, 23 nt, Mycobacterium avium subsp. paratuberculosis
cgaggucggucgcggcaucccug

SEQ ID NO: 3005056 - RNA, 13 nt, Mycobacterium avium subsp. paratuberculosis
cgaggucgucgag

SEQ ID NO: 3005057 - RNA, 18 nt, Mycobacterium avium subsp. paratuberculosis
cgaggucgucgagggcca

SEQ ID NO: 3005058 - RNA, 22 nt, Mycobacterium avium subsp. paratuberculosis
cgaggucgucgagggccaccgg

SEQ ID NO: 3005059 - RNA, 15 nt, Mycobacterium avium subsp. paratuberculosis
cgaggucgucgggcg

SEQ ID NO: 3005060 - RNA, 20 nt, Mycobacterium avium subsp. paratuberculosis
cgaggucgucgggcgccggu

SEQ ID NO: 3005061 - RNA, 16 nt, Mycobacterium avium subsp. paratuberculosis
cgaggucucccggucc

SEQ ID NO: 3005062 - RNA, 16 nt, Mycobacterium avium subsp. paratuberculosis
cgaggucuucgguccc

SEQ ID NO: 3005063 - RNA, 22 nt, Mycobacterium avium subsp. paratuberculosis
cgaggucuucggucccggcggg

SEQ ID NO: 3005064 - RNA, 22 nt, Mycobacterium avium subsp. paratuberculosis
cgaggucuuucaucgccccggc

SEQ ID NO: 3005065 - RNA, 15 nt, Mycobacterium avium subsp. paratuberculosis
cgaggugaaccgcga

SEQ ID NO: 3005066 - RNA, 18 nt, Mycobacterium avium subsp. paratuberculosis
cgaggugaaccgcgacgc

SEQ ID NO: 3005067 - RNA, 23 nt, Mycobacterium avium subsp. paratuberculosis
cgaggugaaccgcgacgcgaucg

SEQ ID NO: 3005068 - RNA, 19 nt, Mycobacterium avium subsp. paratuberculosis
cgaggugaagucguccagc

SEQ ID NO: 3005069 - RNA, 21 nt, Mycobacterium avium subsp. paratuberculosis
cgaggugaagucguccagcgu

SEQ ID NO: 3005070 - RNA, 14 nt, Mycobacterium avium subsp. paratuberculosis
cgaggugaccggcg

SEQ ID NO: 3005071 - RNA, 15 nt, Mycobacterium avium subsp. paratuberculosis
cgaggugaccggcga

SEQ ID NO: 3005072 - RNA, 16 nt, Mycobacterium avium subsp. paratuberculosis
cgaggugaccggcgag

SEQ ID NO: 3005073 - RNA, 21 nt, Mycobacterium avium subsp. paratuberculosis
cgaggugaucgcgaacgcgcc

SEQ ID NO: 3005074 - RNA, 23 nt, Mycobacterium avium subsp. paratuberculosis
cgaggugaucgcgaacgcgccgg

SEQ ID NO: 3005075 - RNA, 19 nt, Mycobacterium avium subsp. paratuberculosis
cgaggugaugccguccagc

SEQ ID NO: 3005076 - RNA, 23 nt, Mycobacterium avium subsp. paratuberculosis
cgaggugauguuggccgcgacgc

SEQ ID NO: 3005077 - RNA, 23 nt, Mycobacterium avium subsp. paratuberculosis
cgaggugcaacacucgagcgcgc

SEQ ID NO: 3005078 - RNA, 13 nt, Mycobacterium avium subsp. paratuberculosis
cgaggugcacgcc

SEQ ID NO: 3005079 - RNA, 18 nt, Mycobacterium avium subsp. paratuberculosis
cgaggugcacgcccagac

SEQ ID NO: 3005080 - RNA, 14 nt, Mycobacterium avium subsp. paratuberculosis
cgaggugccgcggg

SEQ ID NO: 3005081 - RNA, 15 nt, Mycobacterium avium subsp. paratuberculosis
cgaggugcgccaguu

SEQ ID NO: 3005082 - RNA, 17 nt, Mycobacterium avium subsp. paratuberculosis
cgaggugcucgcgcagg

SEQ ID NO: 3005083 - RNA, 14 nt, Mycobacterium avium subsp. paratuberculosis
cgagguggcccagc

SEQ ID NO: 3005084 - RNA, 17 nt, Mycobacterium avium subsp. paratuberculosis
cgagguggcccagccgc

SEQ ID NO: 3005085 - RNA, 20 nt, Mycobacterium avium subsp. paratuberculosis
cgagguggcccgccacgugc

SEQ ID NO: 3005086 - RNA, 18 nt, Mycobacterium avium subsp. paratuberculosis
cgagguggccgccagcac

SEQ ID NO: 3005087 - RNA, 22 nt, Mycobacterium avium subsp. paratuberculosis
cgagguggccgccagcaccucg

SEQ ID NO: 3005088 - RNA, 15 nt, Mycobacterium avium subsp. paratuberculosis
cgaggugggcaccag

SEQ ID NO: 3005089 - RNA, 22 nt, Mycobacterium avium subsp. paratuberculosis
cgaggugggcaccagcugcgga

SEQ ID NO: 3005090 - RNA, 20 nt, Mycobacterium avium subsp. paratuberculosis
cgaggugugaggagucgggc

SEQ ID NO: 3005091 - RNA, 22 nt, Mycobacterium avium subsp. paratuberculosis
cgaggugugaggagucgggcaa

SEQ ID NO: 3005092 - RNA, 18 nt, Mycobacterium avium subsp. paratuberculosis
cgagguguugucgugccg

SEQ ID NO: 3005093 - RNA, 23 nt, Mycobacterium avium subsp. paratuberculosis
cgagguucauguggaagccgcga

SEQ ID NO: 3005094 - RNA, 18 nt, Mycobacterium avium subsp. paratuberculosis
cgagguugaugccgacgu

SEQ ID NO: 3005095 - RNA, 18 nt, Mycobacterium avium subsp. paratuberculosis
cgagguuguagaccggga

SEQ ID NO: 3005096 - RNA, 19 nt, Mycobacterium avium subsp. paratuberculosis
cgaguaacucggccuucgc

SEQ ID NO: 3005097 - RNA, 17 nt, Mycobacterium avium subsp. paratuberculosis
cgaguaaggccgaggcg

SEQ ID NO: 3005098 - RNA, 18 nt, Mycobacterium avium subsp. paratuberculosis
cgaguaaggccgaggcga

SEQ ID NO: 3005099 - RNA, 14 nt, Mycobacterium avium subsp. paratuberculosis
cgaguacaccucga

SEQ ID NO: 3005100 - RNA, 16 nt, Mycobacterium avium subsp. paratuberculosis
cgaguacccgccgcac

SEQ ID NO: 3005101 - RNA, 15 nt, Mycobacterium avium subsp. paratuberculosis
cgaguaccgacgaga

SEQ ID NO: 3005102 - RNA, 17 nt, Mycobacterium avium subsp. paratuberculosis
cgaguagaacuucgcca

SEQ ID NO: 3005103 - RNA, 23 nt, Mycobacterium avium subsp. paratuberculosis
cgaguagaacuucgccagcgggc

SEQ ID NO: 3005104 - RNA, 19 nt, Mycobacterium avium subsp. paratuberculosis
cgaguaggcgaagagcggc

SEQ ID NO: 3005105 - RNA, 13 nt, Mycobacterium avium subsp. paratuberculosis
cgaguaggcgacc

SEQ ID NO: 3005106 - RNA, 15 nt, Mycobacterium avium subsp. paratuberculosis
cgaguaggcgaccac

SEQ ID NO: 3005107 - RNA, 23 nt, Mycobacterium avium subsp. paratuberculosis
cgaguaguccgggaugacaccgc

SEQ ID NO: 3005108 - RNA, 18 nt, Mycobacterium avium subsp. paratuberculosis
cgaguauccgcgcagcgu

SEQ ID NO: 3005109 - RNA, 20 nt, Mycobacterium avium subsp. paratuberculosis
cgaguauccgcgcagcgucu

SEQ ID NO: 3005110 - RNA, 16 nt, Mycobacterium avium subsp. paratuberculosis
cgagucacccggcugg

SEQ ID NO: 3005111 - RNA, 22 nt, Mycobacterium avium subsp. paratuberculosis
cgagucacccggcuggccgcac

SEQ ID NO: 3005112 - RNA, 18 nt, Mycobacterium avium subsp. paratuberculosis
cgagucaucgccacccgc

SEQ ID NO: 3005113 - RNA, 20 nt, Mycobacterium avium subsp. paratuberculosis
cgagucaucgccacccgcac

SEQ ID NO: 3005114 - RNA, 20 nt, Mycobacterium avium subsp. paratuberculosis
cgaguccagccagccgcgcc

SEQ ID NO: 3005115 - RNA, 23 nt, Mycobacterium avium subsp. paratuberculosis
cgagucccgcgcggcgcagggcg

SEQ ID NO: 3005116 - RNA, 15 nt, Mycobacterium avium subsp. paratuberculosis
cgagucccggcgcac

SEQ ID NO: 3005117 - RNA, 17 nt, Mycobacterium avium subsp. paratuberculosis
cgagucccggcgcacca

SEQ ID NO: 3005118 - RNA, 18 nt, Mycobacterium avium subsp. paratuberculosis
cgagucccggcgcaccag

SEQ ID NO: 3005119 - RNA, 17 nt, Mycobacterium avium subsp. paratuberculosis
cgaguccgcggaggcga

SEQ ID NO: 3005120 - RNA, 18 nt, Mycobacterium avium subsp. paratuberculosis
cgaguccgcggaggcgag

SEQ ID NO: 3005121 - RNA, 14 nt, Mycobacterium avium subsp. paratuberculosis
cgaguccggccagg

SEQ ID NO: 3005122 - RNA, 17 nt, Mycobacterium avium subsp. paratuberculosis
cgaguccgggccgccgg

SEQ ID NO: 3005123 - RNA, 19 nt, Mycobacterium avium subsp. paratuberculosis
cgaguccgggccgccggcc

SEQ ID NO: 3005124 - RNA, 23 nt, Mycobacterium avium subsp. paratuberculosis
cgaguccgggccgccggccgcgg

SEQ ID NO: 3005125 - RNA, 14 nt, Mycobacterium avium subsp. paratuberculosis
cgaguccgugguca

SEQ ID NO: 3005126 - RNA, 17 nt, Mycobacterium avium subsp. paratuberculosis
cgaguccucgcgguugc

SEQ ID NO: 3005127 - RNA, 20 nt, Mycobacterium avium subsp. paratuberculosis
cgaguccugguaccccagca

SEQ ID NO: 3005128 - RNA, 17 nt, Mycobacterium avium subsp. paratuberculosis
cgagucgaagccgucca

SEQ ID NO: 3005129 - RNA, 20 nt, Mycobacterium avium subsp. paratuberculosis
cgagucgaagccguccaggc

SEQ ID NO: 3005130 - RNA, 22 nt, Mycobacterium avium subsp. paratuberculosis
cgagucgaagccguccaggccg

SEQ ID NO: 3005131 - RNA, 19 nt, Mycobacterium avium subsp. paratuberculosis
cgagucgaagccguggcag

SEQ ID NO: 3005132 - RNA, 13 nt, Mycobacterium avium subsp. paratuberculosis
cgagucgaaggcg

SEQ ID NO: 3005133 - RNA, 20 nt, Mycobacterium avium subsp. paratuberculosis
cgagucgaaggcgcgggcgu

SEQ ID NO: 3005134 - RNA, 16 nt, Mycobacterium avium subsp. paratuberculosis
cgagucgacgcugugc

SEQ ID NO: 3005135 - RNA, 14 nt, Mycobacterium avium subsp. paratuberculosis
cgagucgagcaccg

SEQ ID NO: 3005136 - RNA, 16 nt, Mycobacterium avium subsp. paratuberculosis
cgagucgagcaccgcg

SEQ ID NO: 3005137 - RNA, 17 nt, Mycobacterium avium subsp. paratuberculosis
cgagucgagcaccgcga

SEQ ID NO: 3005138 - RNA, 19 nt, Mycobacterium avium subsp. paratuberculosis
cgagucgagcaccgcgacc

SEQ ID NO: 3005139 - RNA, 15 nt, Mycobacterium avium subsp. paratuberculosis
cgagucgaucgccag

SEQ ID NO: 3005140 - RNA, 18 nt, Mycobacterium avium subsp. paratuberculosis
cgagucgaucgccagcgc

SEQ ID NO: 3005141 - RNA, 19 nt, Mycobacterium avium subsp. paratuberculosis
cgagucgaucgccagcgcg

SEQ ID NO: 3005142 - RNA, 20 nt, Mycobacterium avium subsp. paratuberculosis
cgagucgaucgccagcgcgc

SEQ ID NO: 3005143 - RNA, 20 nt, Mycobacterium avium subsp. paratuberculosis
cgagucgaugaccucgcgcc

SEQ ID NO: 3005144 - RNA, 15 nt, Mycobacterium avium subsp. paratuberculosis
cgagucgcgccgcgu

SEQ ID NO: 3005145 - RNA, 16 nt, Mycobacterium avium subsp. paratuberculosis
cgagucgcgccgcguc

SEQ ID NO: 3005146 - RNA, 17 nt, Mycobacterium avium subsp. paratuberculosis
cgagucgcgccgcgucg

SEQ ID NO: 3005147 - RNA, 14 nt, Mycobacterium avium subsp. paratuberculosis
cgagucgcggauca

SEQ ID NO: 3005148 - RNA, 12 nt, Mycobacterium avium subsp. paratuberculosis
cgagucgcugca

SEQ ID NO: 3005149 - RNA, 16 nt, Mycobacterium avium subsp. paratuberculosis
cgagucggagacccgc

SEQ ID NO: 3005150 - RNA, 18 nt, Mycobacterium avium subsp. paratuberculosis
cgagucggagacccgccc

SEQ ID NO: 3005151 - RNA, 23 nt, Mycobacterium avium subsp. paratuberculosis
cgagucggccaccgcggucgacg

SEQ ID NO: 3005152 - RNA, 15 nt, Mycobacterium avium subsp. paratuberculosis
cgagucggugaccac

SEQ ID NO: 3005153 - RNA, 19 nt, Mycobacterium avium subsp. paratuberculosis
cgagucguagaggggccgg

SEQ ID NO: 3005154 - RNA, 21 nt, Mycobacterium avium subsp. paratuberculosis
cgagucguagaggggccggac

SEQ ID NO: 3005155 - RNA, 17 nt, Mycobacterium avium subsp. paratuberculosis
cgagugaggccgaggcg

SEQ ID NO: 3005156 - RNA, 14 nt, Mycobacterium avium subsp. paratuberculosis
cgagugccggcagc

SEQ ID NO: 3005157 - RNA, 15 nt, Mycobacterium avium subsp. paratuberculosis
cgagugccggcagcc

SEQ ID NO: 3005158 - RNA, 16 nt, Mycobacterium avium subsp. paratuberculosis
cgagugccggcagccc

SEQ ID NO: 3005159 - RNA, 18 nt, Mycobacterium avium subsp. paratuberculosis
cgagugccggcagcccgg

SEQ ID NO: 3005160 - RNA, 13 nt, Mycobacterium avium subsp. paratuberculosis
cgagugccggcca

SEQ ID NO: 3005161 - RNA, 16 nt, Mycobacterium avium subsp. paratuberculosis
cgagugccggccagcu

SEQ ID NO: 3005162 - RNA, 21 nt, Mycobacterium avium subsp. paratuberculosis
cgagugccggccagcucgccg

SEQ ID NO: 3005163 - RNA, 22 nt, Mycobacterium avium subsp. paratuberculosis
cgagugccggccagcucgccgc

SEQ ID NO: 3005164 - RNA, 18 nt, Mycobacterium avium subsp. paratuberculosis
cgagugccugcgcccaca

SEQ ID NO: 3005165 - RNA, 21 nt, Mycobacterium avium subsp. paratuberculosis
cgagugcgaaacucaccgcgu

SEQ ID NO: 3005166 - RNA, 22 nt, Mycobacterium avium subsp. paratuberculosis
cgagugcgaaucaucguggcgc

SEQ ID NO: 3005167 - RNA, 13 nt, Mycobacterium avium subsp. paratuberculosis
cgagugcggcgcg

SEQ ID NO: 3005168 - RNA, 14 nt, Mycobacterium avium subsp. paratuberculosis
cgagugcucgaugg

SEQ ID NO: 3005169 - RNA, 17 nt, Mycobacterium avium subsp. paratuberculosis
cgagugcucgauggcca

SEQ ID NO: 3005170 - RNA, 19 nt, Mycobacterium avium subsp. paratuberculosis
cgagugcucgauggccagc

SEQ ID NO: 3005171 - RNA, 20 nt, Mycobacterium avium subsp. paratuberculosis
cgagugcucgauggccagcg

SEQ ID NO: 3005172 - RNA, 23 nt, Mycobacterium avium subsp. paratuberculosis
cgagugcucgauggccagcgcgu

SEQ ID NO: 3005173 - RNA, 22 nt, Mycobacterium avium subsp. paratuberculosis
cgagugguaccggguggccgug

SEQ ID NO: 3005174 - RNA, 13 nt, Mycobacterium avium subsp. paratuberculosis
cgaguggucggcc

SEQ ID NO: 3005175 - RNA, 16 nt, Mycobacterium avium subsp. paratuberculosis
cgaguggucggccgcc

SEQ ID NO: 3005176 - RNA, 21 nt, Mycobacterium avium subsp. paratuberculosis
cgagugugaacccugggcggc

SEQ ID NO: 3005177 - RNA, 23 nt, Mycobacterium avium subsp. paratuberculosis
cgagugugaacccugggcggcga

SEQ ID NO: 3005178 - RNA, 23 nt, Mycobacterium avium subsp. paratuberculosis
cgagugugcauccugggcgucga

SEQ ID NO: 3005179 - RNA, 21 nt, Mycobacterium avium subsp. paratuberculosis
cgaguguguacacagggcggc

SEQ ID NO: 3005180 - RNA, 23 nt, Mycobacterium avium subsp. paratuberculosis
cgaguguguacacagggcggcga

SEQ ID NO: 3005181 - RNA, 20 nt, Mycobacterium avium subsp. paratuberculosis
cgaguuaugccgucacccag

SEQ ID NO: 3005182 - RNA, 19 nt, Mycobacterium avium subsp. paratuberculosis
cgaguucagaagucgcccg

SEQ ID NO: 3005183 - RNA, 18 nt, Mycobacterium avium subsp. paratuberculosis
cgaguuccgcgucggccc

SEQ ID NO: 3005184 - RNA, 19 nt, Mycobacterium avium subsp. paratuberculosis
cgaguuccucgugcgugcg

SEQ ID NO: 3005185 - RNA, 14 nt, Mycobacterium avium subsp. paratuberculosis
cgaguuccugcgac

SEQ ID NO: 3005186 - RNA, 12 nt, Mycobacterium avium subsp. paratuberculosis
cgaguucgaccu

SEQ ID NO: 3005187 - RNA, 19 nt, Mycobacterium avium subsp. paratuberculosis
cgaguucgaugacgucgcg

SEQ ID NO: 3005188 - RNA, 23 nt, Mycobacterium avium subsp. paratuberculosis
cgaguucgaugacgucgcgcugc

SEQ ID NO: 3005189 - RNA, 14 nt, Mycobacterium avium subsp. paratuberculosis
cgaguucgccgucg

SEQ ID NO: 3005190 - RNA, 18 nt, Mycobacterium avium subsp. paratuberculosis
cgaguucgccgucgacgg

SEQ ID NO: 3005191 - RNA, 23 nt, Mycobacterium avium subsp. paratuberculosis
cgaguucggccagaucggccagg

SEQ ID NO: 3005192 - RNA, 14 nt, Mycobacterium avium subsp. paratuberculosis
cgaguucggcggcc

SEQ ID NO: 3005193 - RNA, 20 nt, Mycobacterium avium subsp. paratuberculosis
cgaguucggcggcccgcuug

SEQ ID NO: 3005194 - RNA, 15 nt, Mycobacterium avium subsp. paratuberculosis
cgaguucgucgacca

SEQ ID NO: 3005195 - RNA, 19 nt, Mycobacterium avium subsp. paratuberculosis
cgaguucugguaggcggcc

SEQ ID NO: 3005196 - RNA, 22 nt, Mycobacterium avium subsp. paratuberculosis
cgaguucugguaggcggccggg

SEQ ID NO: 3005197 - RNA, 20 nt, Mycobacterium avium subsp. paratuberculosis
cgaguugauaggucacgccg

SEQ ID NO: 3005198 - RNA, 17 nt, Mycobacterium avium subsp. paratuberculosis
cgaguuggccaucguca

SEQ ID NO: 3005199 - RNA, 19 nt, Mycobacterium avium subsp. paratuberculosis
cgaguuggccaucgucauc

SEQ ID NO: 3005200 - RNA, 13 nt, Mycobacterium avium subsp. paratuberculosis
cgaguuggccggc

SEQ ID NO: 3005201 - RNA, 24 nt, Mycobacterium avium subsp. paratuberculosis
cgaguuggccggcacucgccucgg

SEQ ID NO: 3005202 - RNA, 17 nt, Mycobacterium avium subsp. paratuberculosis
cgaguuucccgucgucg

SEQ ID NO: 3005203 - RNA, 19 nt, Mycobacterium avium subsp. paratuberculosis
cgaguuugcggugauccca

SEQ ID NO: 3005204 - RNA, 14 nt, Mycobacterium avium subsp. paratuberculosis
cgaguuuggccagc

SEQ ID NO: 3005205 - RNA, 18 nt, Mycobacterium avium subsp. paratuberculosis
cgaguuuggccagcucgg

SEQ ID NO: 3005206 - RNA, 20 nt, Mycobacterium avium subsp. paratuberculosis
cgaguuuggccugaaccagc

SEQ ID NO: 3005207 - RNA, 14 nt, Mycobacterium avium subsp. paratuberculosis
cgaguuuggcgucg

SEQ ID NO: 3005208 - RNA, 15 nt, Mycobacterium avium subsp. paratuberculosis
cgaguuuggcgucga

SEQ ID NO: 3005209 - RNA, 17 nt, Mycobacterium avium subsp. paratuberculosis
cgaguuuggcgucgaug

SEQ ID NO: 3005210 - RNA, 18 nt, Mycobacterium avium subsp. paratuberculosis
cgaguuuggcgucgaugc

SEQ ID NO: 3005211 - RNA, 19 nt, Mycobacterium avium subsp. paratuberculosis
cgaguuuggcgucgaugcg

SEQ ID NO: 3005212 - RNA, 17 nt, Mycobacterium avium subsp. paratuberculosis
cgauaaccucggcggcg

SEQ ID NO: 3005213 - RNA, 14 nt, Mycobacterium avium subsp. paratuberculosis
cgauaauggcggcc

SEQ ID NO: 3005214 - RNA, 18 nt, Mycobacterium avium subsp. paratuberculosis
cgauaauggcggccgccg

SEQ ID NO: 3005215 - RNA, 13 nt, Mycobacterium avium subsp. paratuberculosis
cgauaccagccgc

SEQ ID NO: 3005216 - RNA, 14 nt, Mycobacterium avium subsp. paratuberculosis
cgauaccagccgcg

SEQ ID NO: 3005217 - RNA, 19 nt, Mycobacterium avium subsp. paratuberculosis
cgauaccagccgcggacgg

SEQ ID NO: 3005218 - RNA, 15 nt, Mycobacterium avium subsp. paratuberculosis
cgauaccguccgcgc

SEQ ID NO: 3005219 - RNA, 15 nt, Mycobacterium avium subsp. paratuberculosis
cgauacgacgggaug

SEQ ID NO: 3005220 - RNA, 22 nt, Mycobacterium avium subsp. paratuberculosis
cgauagaccucacggucggcgu

SEQ ID NO: 3005221 - RNA, 22 nt, Mycobacterium avium subsp. paratuberculosis
cgauagccaucagaacgcccgc

SEQ ID NO: 3005222 - RNA, 15 nt, Mycobacterium avium subsp. paratuberculosis
cgauagccccgccag

SEQ ID NO: 3005223 - RNA, 22 nt, Mycobacterium avium subsp. paratuberculosis
cgauagccggugaucgcggcgc

SEQ ID NO: 3005224 - RNA, 21 nt, Mycobacterium avium subsp. paratuberculosis
cgauagcuucccuugcccgga

SEQ ID NO: 3005225 - RNA, 16 nt, Mycobacterium avium subsp. paratuberculosis
cgauagcuugagcccc

SEQ ID NO: 3005226 - RNA, 21 nt, Mycobacterium avium subsp. paratuberculosis
cgauagcuugagccccgccgg

SEQ ID NO: 3005227 - RNA, 14 nt, Mycobacterium avium subsp. paratuberculosis
cgauaggcggccag

SEQ ID NO: 3005228 - RNA, 12 nt, Mycobacterium avium subsp. paratuberculosis
cgauagggccgg

SEQ ID NO: 3005229 - RNA, 16 nt, Mycobacterium avium subsp. paratuberculosis
cgauaguagccagcau

SEQ ID NO: 3005230 - RNA, 18 nt, Mycobacterium avium subsp. paratuberculosis
cgauagugaacgccucgg

SEQ ID NO: 3005231 - RNA, 22 nt, Mycobacterium avium subsp. paratuberculosis
cgauagugaacgccucgggccg

SEQ ID NO: 3005232 - RNA, 23 nt, Mycobacterium avium subsp. paratuberculosis
cgauagugaacgccucgggccgg

SEQ ID NO: 3005233 - RNA, 18 nt, Mycobacterium avium subsp. paratuberculosis
cgauaucggccgcggggc

SEQ ID NO: 3005234 - RNA, 17 nt, Mycobacterium avium subsp. paratuberculosis
cgaucaaaucccgcagc

SEQ ID NO: 3005235 - RNA, 18 nt, Mycobacterium avium subsp. paratuberculosis
cgaucaaaucccgcagcu

SEQ ID NO: 3005236 - RNA, 14 nt, Mycobacterium avium subsp. paratuberculosis
cgaucaacaccgcc

SEQ ID NO: 3005237 - RNA, 15 nt, Mycobacterium avium subsp. paratuberculosis
cgaucaacaccgcca

SEQ ID NO: 3005238 - RNA, 16 nt, Mycobacterium avium subsp. paratuberculosis
cgaucaacaccgccag

SEQ ID NO: 3005239 - RNA, 17 nt, Mycobacterium avium subsp. paratuberculosis
cgaucaacaccgccagc

SEQ ID NO: 3005240 - RNA, 18 nt, Mycobacterium avium subsp. paratuberculosis
cgaucaacaccgccagca

SEQ ID NO: 3005241 - RNA, 14 nt, Mycobacterium avium subsp. paratuberculosis
cgaucaacaccggu

SEQ ID NO: 3005242 - RNA, 23 nt, Mycobacterium avium subsp. paratuberculosis
cgaucaacaggcccagcagcgca

SEQ ID NO: 3005243 - RNA, 20 nt, Mycobacterium avium subsp. paratuberculosis
cgaucaacgccgggucgacg

SEQ ID NO: 3005244 - RNA, 21 nt, Mycobacterium avium subsp. paratuberculosis
cgaucaacgccgggucgacgc

SEQ ID NO: 3005245 - RNA, 14 nt, Mycobacterium avium subsp. paratuberculosis
cgaucaacggcagc

SEQ ID NO: 3005246 - RNA, 15 nt, Mycobacterium avium subsp. paratuberculosis
cgaucaacggcagcg

SEQ ID NO: 3005247 - RNA, 13 nt, Mycobacterium avium subsp. paratuberculosis
cgaucacaccacc

SEQ ID NO: 3005248 - RNA, 14 nt, Mycobacterium avium subsp. paratuberculosis
cgaucacaccacca

SEQ ID NO: 3005249 - RNA, 19 nt, Mycobacterium avium subsp. paratuberculosis
cgaucacaccaccacgcga

SEQ ID NO: 3005250 - RNA, 21 nt, Mycobacterium avium subsp. paratuberculosis
cgaucacaccaccacgcgauc

SEQ ID NO: 3005251 - RNA, 14 nt, Mycobacterium avium subsp. paratuberculosis
cgaucaccaccacc

SEQ ID NO: 3005252 - RNA, 14 nt, Mycobacterium avium subsp. paratuberculosis
cgaucaccaggccc

SEQ ID NO: 3005253 - RNA, 17 nt, Mycobacterium avium subsp. paratuberculosis
cgaucaccaggcccagg

SEQ ID NO: 3005254 - RNA, 17 nt, Mycobacterium avium subsp. paratuberculosis
cgaucacccaggucuuc

SEQ ID NO: 3005255 - RNA, 21 nt, Mycobacterium avium subsp. paratuberculosis
cgaucacccccgacaccgugg

SEQ ID NO: 3005256 - RNA, 18 nt, Mycobacterium avium subsp. paratuberculosis
cgaucaccccgacggaga

SEQ ID NO: 3005257 - RNA, 14 nt, Mycobacterium avium subsp. paratuberculosis
cgaucaccccggcg

SEQ ID NO: 3005258 - RNA, 17 nt, Mycobacterium avium subsp. paratuberculosis
cgaucaccccggcgacg

SEQ ID NO: 3005259 - RNA, 15 nt, Mycobacterium avium subsp. paratuberculosis
cgaucaccgacagcg

SEQ ID NO: 3005260 - RNA, 13 nt, Mycobacterium avium subsp. paratuberculosis
cgaucaccgccgc

SEQ ID NO: 3005261 - RNA, 15 nt, Mycobacterium avium subsp. paratuberculosis
cgaucaccgccgcgg

SEQ ID NO: 3005262 - RNA, 16 nt, Mycobacterium avium subsp. paratuberculosis
cgaucaccgccgcggc

SEQ ID NO: 3005263 - RNA, 20 nt, Mycobacterium avium subsp. paratuberculosis
cgaucaccgccgcggcgacc

SEQ ID NO: 3005264 - RNA, 12 nt, Mycobacterium avium subsp. paratuberculosis
cgaucaccgcgg

SEQ ID NO: 3005265 - RNA, 14 nt, Mycobacterium avium subsp. paratuberculosis
cgaucaccgcggcc

SEQ ID NO: 3005266 - RNA, 15 nt, Mycobacterium avium subsp. paratuberculosis
cgaucaccgcggcca

SEQ ID NO: 3005267 - RNA, 16 nt, Mycobacterium avium subsp. paratuberculosis
cgaucaccgcggccac

SEQ ID NO: 3005268 - RNA, 15 nt, Mycobacterium avium subsp. paratuberculosis
cgaucaccgcggcga

SEQ ID NO: 3005269 - RNA, 13 nt, Mycobacterium avium subsp. paratuberculosis
cgaucaccggcag

SEQ ID NO: 3005270 - RNA, 21 nt, Mycobacterium avium subsp. paratuberculosis
cgaucaccggcagcagcgcgu

SEQ ID NO: 3005271 - RNA, 13 nt, Mycobacterium avium subsp. paratuberculosis
cgaucaccggcuu

SEQ ID NO: 3005272 - RNA, 22 nt, Mycobacterium avium subsp. paratuberculosis
cgaucaccgggacaccgcuggc

SEQ ID NO: 3005273 - RNA, 13 nt, Mycobacterium avium subsp. paratuberculosis
cgaucaccgggcg

SEQ ID NO: 3005274 - RNA, 14 nt, Mycobacterium avium subsp. paratuberculosis
cgaucaccgggcgg

SEQ ID NO: 3005275 - RNA, 15 nt, Mycobacterium avium subsp. paratuberculosis
cgaucaccgggcggc

SEQ ID NO: 3005276 - RNA, 23 nt, Mycobacterium avium subsp. paratuberculosis
cgaucaccgugaguucgcugacc

SEQ ID NO: 3005277 - RNA, 15 nt, Mycobacterium avium subsp. paratuberculosis
cgaucaccucgaacu

SEQ ID NO: 3005278 - RNA, 18 nt, Mycobacterium avium subsp. paratuberculosis
cgaucaccucgccggccg

SEQ ID NO: 3005279 - RNA, 19 nt, Mycobacterium avium subsp. paratuberculosis
cgaucaccucgccggccgg

SEQ ID NO: 3005280 - RNA, 16 nt, Mycobacterium avium subsp. paratuberculosis
cgaucaccucgucgag

SEQ ID NO: 3005281 - RNA, 16 nt, Mycobacterium avium subsp. paratuberculosis
cgaucaccuugcggcc

SEQ ID NO: 3005282 - RNA, 17 nt, Mycobacterium avium subsp. paratuberculosis
cgaucaccuugcggccg

SEQ ID NO: 3005283 - RNA, 21 nt, Mycobacterium avium subsp. paratuberculosis
cgaucaccuugcggccggcgg

SEQ ID NO: 3005284 - RNA, 22 nt, Mycobacterium avium subsp. paratuberculosis
cgaucaccuugcggccggcggc

SEQ ID NO: 3005285 - RNA, 23 nt, Mycobacterium avium subsp. paratuberculosis
cgaucaccuugcggccggcggcg

SEQ ID NO: 3005286 - RNA, 20 nt, Mycobacterium avium subsp. paratuberculosis
cgaucaccuuguugcgggcg

SEQ ID NO: 3005287 - RNA, 19 nt, Mycobacterium avium subsp. paratuberculosis
cgaucacgaacagguccgc

SEQ ID NO: 3005288 - RNA, 13 nt, Mycobacterium avium subsp. paratuberculosis
cgaucacgccgcc

SEQ ID NO: 3005289 - RNA, 15 nt, Mycobacterium avium subsp. paratuberculosis
cgaucacgccgccgg

SEQ ID NO: 3005290 - RNA, 14 nt, Mycobacterium avium subsp. paratuberculosis
cgaucacggugauc

SEQ ID NO: 3005291 - RNA, 18 nt, Mycobacterium avium subsp. paratuberculosis
cgaucacggugaucgccg

SEQ ID NO: 3005292 - RNA, 21 nt, Mycobacterium avium subsp. paratuberculosis
cgaucacgguguuguucaccg

SEQ ID NO: 3005293 - RNA, 19 nt, Mycobacterium avium subsp. paratuberculosis
cgaucacgucggugacgcc

SEQ ID NO: 3005294 - RNA, 20 nt, Mycobacterium avium subsp. paratuberculosis
cgaucacgucggugacgccc

SEQ ID NO: 3005295 - RNA, 17 nt, Mycobacterium avium subsp. paratuberculosis
cgaucacguucucggcg

SEQ ID NO: 3005296 - RNA, 18 nt, Mycobacterium avium subsp. paratuberculosis
cgaucagagcgggccgac

SEQ ID NO: 3005297 - RNA, 15 nt, Mycobacterium avium subsp. paratuberculosis
cgaucagcaccaggu

SEQ ID NO: 3005298 - RNA, 21 nt, Mycobacterium avium subsp. paratuberculosis
cgaucagcaccagguugucgc

SEQ ID NO: 3005299 - RNA, 24 nt, Mycobacterium avium subsp. paratuberculosis
cgaucagcaccagguugucgccgc

SEQ ID NO: 3005300 - RNA, 20 nt, Mycobacterium avium subsp. paratuberculosis
cgaucagcaccgccacgccg

SEQ ID NO: 3005301 - RNA, 17 nt, Mycobacterium avium subsp. paratuberculosis
cgaucagcacgucgcgg

SEQ ID NO: 3005302 - RNA, 16 nt, Mycobacterium avium subsp. paratuberculosis
cgaucagcagcaccug

SEQ ID NO: 3005303 - RNA, 14 nt, Mycobacterium avium subsp. paratuberculosis
cgaucagcagccgg

SEQ ID NO: 3005304 - RNA, 19 nt, Mycobacterium avium subsp. paratuberculosis
cgaucagcagccgggccug

SEQ ID NO: 3005305 - RNA, 19 nt, Mycobacterium avium subsp. paratuberculosis
cgaucagccacaccgccgg

SEQ ID NO: 3005306 - RNA, 21 nt, Mycobacterium avium subsp. paratuberculosis
cgaucagccacaccgccggcg

SEQ ID NO: 3005307 - RNA, 10 nt, Mycobacterium avium subsp. paratuberculosis
cgaucagccc

SEQ ID NO: 3005308 - RNA, 22 nt, Mycobacterium avium subsp. paratuberculosis
cgaucagccccagggugcgccg

SEQ ID NO: 3005309 - RNA, 23 nt, Mycobacterium avium subsp. paratuberculosis
cgaucagccccagggugcgccgc

SEQ ID NO: 3005310 - RNA, 14 nt, Mycobacterium avium subsp. paratuberculosis
cgaucagcccgccc

SEQ ID NO: 3005311 - RNA, 15 nt, Mycobacterium avium subsp. paratuberculosis
cgaucagcccgccca

SEQ ID NO: 3005312 - RNA, 16 nt, Mycobacterium avium subsp. paratuberculosis
cgaucagcccgcccac

SEQ ID NO: 3005313 - RNA, 17 nt, Mycobacterium avium subsp. paratuberculosis
cgaucagcccgcccacc

SEQ ID NO: 3005314 - RNA, 16 nt, Mycobacterium avium subsp. paratuberculosis
cgaucagcccggcccg

SEQ ID NO: 3005315 - RNA, 17 nt, Mycobacterium avium subsp. paratuberculosis
cgaucagccgcgacagc

SEQ ID NO: 3005316 - RNA, 23 nt, Mycobacterium avium subsp. paratuberculosis
cgaucagccggguagcgccgccg

SEQ ID NO: 3005317 - RNA, 21 nt, Mycobacterium avium subsp. paratuberculosis
cgaucagcgacggcccgccgg

SEQ ID NO: 3005318 - RNA, 22 nt, Mycobacterium avium subsp. paratuberculosis
cgaucagcgacggcccgccgga

SEQ ID NO: 3005319 - RNA, 23 nt, Mycobacterium avium subsp. paratuberculosis
cgaucagcgacggcccgccggag

SEQ ID NO: 3005320 - RNA, 20 nt, Mycobacterium avium subsp. paratuberculosis
cgaucagcgacucgaccccg

SEQ ID NO: 3005321 - RNA, 12 nt, Mycobacterium avium subsp. paratuberculosis
cgaucagcgcgc

SEQ ID NO: 3005322 - RNA, 15 nt, Mycobacterium avium subsp. paratuberculosis
cgaucagcgcgccgc

SEQ ID NO: 3005323 - RNA, 16 nt, Mycobacterium avium subsp. paratuberculosis
cgaucagcgcgccgcc

SEQ ID NO: 3005324 - RNA, 21 nt, Mycobacterium avium subsp. paratuberculosis
cgaucagcgcgccgcccagcg

SEQ ID NO: 3005325 - RNA, 14 nt, Mycobacterium avium subsp. paratuberculosis
cgaucagcgcgucg

SEQ ID NO: 3005326 - RNA, 17 nt, Mycobacterium avium subsp. paratuberculosis
cgaucagcgcgucgagg

SEQ ID NO: 3005327 - RNA, 15 nt, Mycobacterium avium subsp. paratuberculosis
cgaucagcggcaucg

SEQ ID NO: 3005328 - RNA, 17 nt, Mycobacterium avium subsp. paratuberculosis
cgaucagcggcgggccc

SEQ ID NO: 3005329 - RNA, 21 nt, Mycobacterium avium subsp. paratuberculosis
cgaucagcggcgggcccagca

SEQ ID NO: 3005330 - RNA, 18 nt, Mycobacterium avium subsp. paratuberculosis
cgaucagcgucagcaccg

SEQ ID NO: 3005331 - RNA, 23 nt, Mycobacterium avium subsp. paratuberculosis
cgaucagcgucagcaccgcgacg

SEQ ID NO: 3005332 - RNA, 13 nt, Mycobacterium avium subsp. paratuberculosis
cgaucagcgucau

SEQ ID NO: 3005333 - RNA, 17 nt, Mycobacterium avium subsp. paratuberculosis
cgaucagcgucaucacg

SEQ ID NO: 3005334 - RNA, 16 nt, Mycobacterium avium subsp. paratuberculosis
cgaucagcucguggcg

SEQ ID NO: 3005335 - RNA, 17 nt, Mycobacterium avium subsp. paratuberculosis
cgaucagcucguggcgg

SEQ ID NO: 3005336 - RNA, 19 nt, Mycobacterium avium subsp. paratuberculosis
cgaucagcucguggcgggc

SEQ ID NO: 3005337 - RNA, 14 nt, Mycobacterium avium subsp. paratuberculosis
cgaucagcugcccg

SEQ ID NO: 3005338 - RNA, 20 nt, Mycobacterium avium subsp. paratuberculosis
cgaucagcugcucggccacc

SEQ ID NO: 3005339 - RNA, 14 nt, Mycobacterium avium subsp. paratuberculosis
cgaucaggcgcagc

SEQ ID NO: 3005340 - RNA, 15 nt, Mycobacterium avium subsp. paratuberculosis
cgaucaggcgcagcc

SEQ ID NO: 3005341 - RNA, 16 nt, Mycobacterium avium subsp. paratuberculosis
cgaucaggcgcagccc

SEQ ID NO: 3005342 - RNA, 22 nt, Mycobacterium avium subsp. paratuberculosis
cgaucaggcgcagcccgagcgg

SEQ ID NO: 3005343 - RNA, 24 nt, Mycobacterium avium subsp. paratuberculosis
cgaucaggcgcagcccgagcggca

SEQ ID NO: 3005344 - RNA, 17 nt, Mycobacterium avium subsp. paratuberculosis
cgaucaggcugccgcug

SEQ ID NO: 3005345 - RNA, 18 nt, Mycobacterium avium subsp. paratuberculosis
cgaucaggcugccgcugc

SEQ ID NO: 3005346 - RNA, 19 nt, Mycobacterium avium subsp. paratuberculosis
cgaucaggcugccgcugcg

SEQ ID NO: 3005347 - RNA, 21 nt, Mycobacterium avium subsp. paratuberculosis
cgaucaggcugccgcugcgcc

SEQ ID NO: 3005348 - RNA, 12 nt, Mycobacterium avium subsp. paratuberculosis
cgaucaggcugg

SEQ ID NO: 3005349 - RNA, 13 nt, Mycobacterium avium subsp. paratuberculosis
cgaucaggcugga

SEQ ID NO: 3005350 - RNA, 14 nt, Mycobacterium avium subsp. paratuberculosis
cgaucaggcuggac

SEQ ID NO: 3005351 - RNA, 17 nt, Mycobacterium avium subsp. paratuberculosis
cgaucaggcuggacacc

SEQ ID NO: 3005352 - RNA, 21 nt, Mycobacterium avium subsp. paratuberculosis
cgaucagggcccacagcagcc

SEQ ID NO: 3005353 - RNA, 15 nt, Mycobacterium avium subsp. paratuberculosis
cgaucagggccgcgg

SEQ ID NO: 3005354 - RNA, 18 nt, Mycobacterium avium subsp. paratuberculosis
cgaucagggccgcggccg

SEQ ID NO: 3005355 - RNA, 21 nt, Mycobacterium avium subsp. paratuberculosis
cgaucagggccgcggccgccg

SEQ ID NO: 3005356 - RNA, 23 nt, Mycobacterium avium subsp. paratuberculosis
cgaucagggccgcggccgccgcg

SEQ ID NO: 3005357 - RNA, 24 nt, Mycobacterium avium subsp. paratuberculosis
cgaucagggccgcggccgccgcga

SEQ ID NO: 3005358 - RNA, 15 nt, Mycobacterium avium subsp. paratuberculosis
cgaucagggcggcgc

SEQ ID NO: 3005359 - RNA, 18 nt, Mycobacterium avium subsp. paratuberculosis
cgaucagggcggcgccgc

SEQ ID NO: 3005360 - RNA, 22 nt, Mycobacterium avium subsp. paratuberculosis
cgaucagggcggcgccgcggcc

SEQ ID NO: 3005361 - RNA, 12 nt, Mycobacterium avium subsp. paratuberculosis
cgaucagggucc

SEQ ID NO: 3005362 - RNA, 18 nt, Mycobacterium avium subsp. paratuberculosis
cgaucagggugucgaaca

SEQ ID NO: 3005363 - RNA, 23 nt, Mycobacterium avium subsp. paratuberculosis
cgaucagguaguacaggugcagc

SEQ ID NO: 3005364 - RNA, 23 nt, Mycobacterium avium subsp. paratuberculosis
cgaucagguggggcaggaacgcc

SEQ ID NO: 3005365 - RNA, 16 nt, Mycobacterium avium subsp. paratuberculosis
cgaucaucaccaccgc

SEQ ID NO: 3005366 - RNA, 17 nt, Mycobacterium avium subsp. paratuberculosis
cgaucaucaccaccgcc

SEQ ID NO: 3005367 - RNA, 23 nt, Mycobacterium avium subsp. paratuberculosis
cgaucaucaccaccgccgccgac

SEQ ID NO: 3005368 - RNA, 13 nt, Mycobacterium avium subsp. paratuberculosis
cgaucaucagggc

SEQ ID NO: 3005369 - RNA, 16 nt, Mycobacterium avium subsp. paratuberculosis
cgaucaucgccccgga

SEQ ID NO: 3005370 - RNA, 16 nt, Mycobacterium avium subsp. paratuberculosis
cgaucaucgccucggu

SEQ ID NO: 3005371 - RNA, 20 nt, Mycobacterium avium subsp. paratuberculosis
cgaucaucgccucggucgcg

SEQ ID NO: 3005372 - RNA, 21 nt, Mycobacterium avium subsp. paratuberculosis
cgaucaucgccucggucgcgu

SEQ ID NO: 3005373 - RNA, 16 nt, Mycobacterium avium subsp. paratuberculosis
cgaucaucgcgucggu

SEQ ID NO: 3005374 - RNA, 18 nt, Mycobacterium avium subsp. paratuberculosis
cgaucaucucaccgacga

SEQ ID NO: 3005375 - RNA, 20 nt, Mycobacterium avium subsp. paratuberculosis
cgaucaucucaccgacgacc

SEQ ID NO: 3005376 - RNA, 15 nt, Mycobacterium avium subsp. paratuberculosis
cgaucaucuccaccc

SEQ ID NO: 3005377 - RNA, 21 nt, Mycobacterium avium subsp. paratuberculosis
cgaucaucuccacccggcauc

SEQ ID NO: 3005378 - RNA, 15 nt, Mycobacterium avium subsp. paratuberculosis
cgaucauggucggcg

SEQ ID NO: 3005379 - RNA, 21 nt, Mycobacterium avium subsp. paratuberculosis
cgaucauggucggcgacgccg

SEQ ID NO: 3005380 - RNA, 22 nt, Mycobacterium avium subsp. paratuberculosis
cgaucauggucggcgacgccgu

SEQ ID NO: 3005381 - RNA, 19 nt, Mycobacterium avium subsp. paratuberculosis
cgaucauguagcgcuggua

SEQ ID NO: 3005382 - RNA, 15 nt, Mycobacterium avium subsp. paratuberculosis
cgaucauuccgccga

SEQ ID NO: 3005383 - RNA, 17 nt, Mycobacterium avium subsp. paratuberculosis
cgauccacucccgcgcg

SEQ ID NO: 3005384 - RNA, 18 nt, Mycobacterium avium subsp. paratuberculosis
cgauccacuccgagguca

SEQ ID NO: 3005385 - RNA, 14 nt, Mycobacterium avium subsp. paratuberculosis
cgauccagccgucg

SEQ ID NO: 3005386 - RNA, 18 nt, Mycobacterium avium subsp. paratuberculosis
cgauccagccgucguugc

SEQ ID NO: 3005387 - RNA, 15 nt, Mycobacterium avium subsp. paratuberculosis
cgauccagggcccgc

SEQ ID NO: 3005388 - RNA, 17 nt, Mycobacterium avium subsp. paratuberculosis
cgauccccacgucgccg

SEQ ID NO: 3005389 - RNA, 16 nt, Mycobacterium avium subsp. paratuberculosis
cgauccccgcagcucc

SEQ ID NO: 3005390 - RNA, 18 nt, Mycobacterium avium subsp. paratuberculosis
cgauccccgcagcucccc

SEQ ID NO: 3005391 - RNA, 23 nt, Mycobacterium avium subsp. paratuberculosis
cgauccccgcagcucccccggcg

SEQ ID NO: 3005392 - RNA, 12 nt, Mycobacterium avium subsp. paratuberculosis
cgaucccgccgg

SEQ ID NO: 3005393 - RNA, 15 nt, Mycobacterium avium subsp. paratuberculosis
cgaucccgccggcga

SEQ ID NO: 3005394 - RNA, 21 nt, Mycobacterium avium subsp. paratuberculosis
cgaucccgccggcgaucgacg

SEQ ID NO: 3005395 - RNA, 23 nt, Mycobacterium avium subsp. paratuberculosis
cgaucccggacuccucgguggcc

SEQ ID NO: 3005396 - RNA, 13 nt, Mycobacterium avium subsp. paratuberculosis
cgaucccggccac

SEQ ID NO: 3005397 - RNA, 15 nt, Mycobacterium avium subsp. paratuberculosis
cgaucccggccacgu

SEQ ID NO: 3005398 - RNA, 21 nt, Mycobacterium avium subsp. paratuberculosis
cgaucccggccacgucgaugc

SEQ ID NO: 3005399 - RNA, 19 nt, Mycobacterium avium subsp. paratuberculosis
cgaucccggccagcacccg

SEQ ID NO: 3005400 - RNA, 13 nt, Mycobacterium avium subsp. paratuberculosis
cgaucccggcgag

SEQ ID NO: 3005401 - RNA, 14 nt, Mycobacterium avium subsp. paratuberculosis
cgaucccggcgagc

SEQ ID NO: 3005402 - RNA, 20 nt, Mycobacterium avium subsp. paratuberculosis
cgaucccggcgagcacgccg

SEQ ID NO: 3005403 - RNA, 14 nt, Mycobacterium avium subsp. paratuberculosis
cgaucccgggccgu

SEQ ID NO: 3005404 - RNA, 18 nt, Mycobacterium avium subsp. paratuberculosis
cgaucccgggugcgaugg

SEQ ID NO: 3005405 - RNA, 20 nt, Mycobacterium avium subsp. paratuberculosis
cgaucccguagccguagauc

SEQ ID NO: 3005406 - RNA, 16 nt, Mycobacterium avium subsp. paratuberculosis
cgaucccgucggccau

SEQ ID NO: 3005407 - RNA, 14 nt, Mycobacterium avium subsp. paratuberculosis
cgaucccgucgucg

SEQ ID NO: 3005408 - RNA, 17 nt, Mycobacterium avium subsp. paratuberculosis
cgaucccgucgucggcg

SEQ ID NO: 3005409 - RNA, 17 nt, Mycobacterium avium subsp. paratuberculosis
cgaucccuuggcggcgg

SEQ ID NO: 3005410 - RNA, 13 nt, Mycobacterium avium subsp. paratuberculosis
cgauccgcaggcc

SEQ ID NO: 3005411 - RNA, 18 nt, Mycobacterium avium subsp. paratuberculosis
cgauccgcaggccgucgc

SEQ ID NO: 3005412 - RNA, 12 nt, Mycobacterium avium subsp. paratuberculosis
cgauccgccggc

SEQ ID NO: 3005413 - RNA, 15 nt, Mycobacterium avium subsp. paratuberculosis
cgauccgccggugcc

SEQ ID NO: 3005414 - RNA, 22 nt, Mycobacterium avium subsp. paratuberculosis
cgauccgcgcccuggugcaaca

SEQ ID NO: 3005415 - RNA, 15 nt, Mycobacterium avium subsp. paratuberculosis
cgauccgcgccgccg

SEQ ID NO: 3005416 - RNA, 16 nt, Mycobacterium avium subsp. paratuberculosis
cgauccgcgccgccgc

SEQ ID NO: 3005417 - RNA, 20 nt, Mycobacterium avium subsp. paratuberculosis
cgauccgcgccgccgccagc

SEQ ID NO: 3005418 - RNA, 14 nt, Mycobacterium avium subsp. paratuberculosis
cgauccgcgccgcg

SEQ ID NO: 3005419 - RNA, 15 nt, Mycobacterium avium subsp. paratuberculosis
cgauccgcgccgcga

SEQ ID NO: 3005420 - RNA, 18 nt, Mycobacterium avium subsp. paratuberculosis
cgauccgcgccgcgaugc

SEQ ID NO: 3005421 - RNA, 13 nt, Mycobacterium avium subsp. paratuberculosis
cgauccgcgcggc

SEQ ID NO: 3005422 - RNA, 15 nt, Mycobacterium avium subsp. paratuberculosis
cgauccgcgcggcca

SEQ ID NO: 3005423 - RNA, 18 nt, Mycobacterium avium subsp. paratuberculosis
cgauccgcgcggccacca

SEQ ID NO: 3005424 - RNA, 14 nt, Mycobacterium avium subsp. paratuberculosis
cgauccgcgcggcg

SEQ ID NO: 3005425 - RNA, 15 nt, Mycobacterium avium subsp. paratuberculosis
cgauccgcgcggcga

SEQ ID NO: 3005426 - RNA, 16 nt, Mycobacterium avium subsp. paratuberculosis
cgauccgcgcggcgac

SEQ ID NO: 3005427 - RNA, 17 nt, Mycobacterium avium subsp. paratuberculosis
cgauccgcgcgucgggc

SEQ ID NO: 3005428 - RNA, 15 nt, Mycobacterium avium subsp. paratuberculosis
cgauccgcgggccgg

SEQ ID NO: 3005429 - RNA, 18 nt, Mycobacterium avium subsp. paratuberculosis
cgauccgcgggccggcac

SEQ ID NO: 3005430 - RNA, 13 nt, Mycobacterium avium subsp. paratuberculosis
cgauccggccggc

SEQ ID NO: 3005431 - RNA, 17 nt, Mycobacterium avium subsp. paratuberculosis
cgauccggccggcggcg

SEQ ID NO: 3005432 - RNA, 17 nt, Mycobacterium avium subsp. paratuberculosis
cgauccggcgcccgaug

SEQ ID NO: 3005433 - RNA, 17 nt, Mycobacterium avium subsp. paratuberculosis
cgauccggcgccgcggg

SEQ ID NO: 3005434 - RNA, 18 nt, Mycobacterium avium subsp. paratuberculosis
cgauccggcgccgcgggc

SEQ ID NO: 3005435 - RNA, 23 nt, Mycobacterium avium subsp. paratuberculosis
cgauccggcgucucagucggcca

SEQ ID NO: 3005436 - RNA, 14 nt, Mycobacterium avium subsp. paratuberculosis
cgauccgggcaugg

SEQ ID NO: 3005437 - RNA, 13 nt, Mycobacterium avium subsp. paratuberculosis
cgauccgggccgg

SEQ ID NO: 3005438 - RNA, 14 nt, Mycobacterium avium subsp. paratuberculosis
cgauccgggccggu

SEQ ID NO: 3005439 - RNA, 12 nt, Mycobacterium avium subsp. paratuberculosis
cgauccgggcgc

SEQ ID NO: 3005440 - RNA, 14 nt, Mycobacterium avium subsp. paratuberculosis
cgauccgggcgccc

SEQ ID NO: 3005441 - RNA, 16 nt, Mycobacterium avium subsp. paratuberculosis
cgauccgggcgccggc

SEQ ID NO: 3005442 - RNA, 17 nt, Mycobacterium avium subsp. paratuberculosis
cgauccgggcgccggcc

SEQ ID NO: 3005443 - RNA, 18 nt, Mycobacterium avium subsp. paratuberculosis
cgauccgggcgccggccg

SEQ ID NO: 3005444 - RNA, 19 nt, Mycobacterium avium subsp. paratuberculosis
cgauccgggcgccggccgg

SEQ ID NO: 3005445 - RNA, 19 nt, Mycobacterium avium subsp. paratuberculosis
cgauccgguagaagaccac

SEQ ID NO: 3005446 - RNA, 20 nt, Mycobacterium avium subsp. paratuberculosis
cgauccgguagaagaccacc

SEQ ID NO: 3005447 - RNA, 12 nt, Mycobacterium avium subsp. paratuberculosis
cgauccucgccu

SEQ ID NO: 3005448 - RNA, 16 nt, Mycobacterium avium subsp. paratuberculosis
cgauccucgccugucg

SEQ ID NO: 3005449 - RNA, 17 nt, Mycobacterium avium subsp. paratuberculosis
cgaucgaauacaccugc

SEQ ID NO: 3005450 - RNA, 20 nt, Mycobacterium avium subsp. paratuberculosis
cgaucgaauacaccugccgc

SEQ ID NO: 3005451 - RNA, 17 nt, Mycobacterium avium subsp. paratuberculosis
cgaucgacaccagcgug

SEQ ID NO: 3005452 - RNA, 20 nt, Mycobacterium avium subsp. paratuberculosis
cgaucgacagcuccaacagc

SEQ ID NO: 3005453 - RNA, 16 nt, Mycobacterium avium subsp. paratuberculosis
cgaucgacgacgccag

SEQ ID NO: 3005454 - RNA, 15 nt, Mycobacterium avium subsp. paratuberculosis
cgaucgacgccgaca

SEQ ID NO: 3005455 - RNA, 17 nt, Mycobacterium avium subsp. paratuberculosis
cgaucgacgccgacauc

SEQ ID NO: 3005456 - RNA, 16 nt, Mycobacterium avium subsp. paratuberculosis
cgaucgacgucaccac

SEQ ID NO: 3005457 - RNA, 16 nt, Mycobacterium avium subsp. paratuberculosis
cgaucgaggacaccgc

SEQ ID NO: 3005458 - RNA, 17 nt, Mycobacterium avium subsp. paratuberculosis
cgaucgaggacaccgcg

SEQ ID NO: 3005459 - RNA, 23 nt, Mycobacterium avium subsp. paratuberculosis
cgaucgaggucuucggucccggc

SEQ ID NO: 3005460 - RNA, 17 nt, Mycobacterium avium subsp. paratuberculosis
cgaucgaucagccgcga

SEQ ID NO: 3005461 - RNA, 24 nt, Mycobacterium avium subsp. paratuberculosis
cgaucgaucagccgcgacagccgc

SEQ ID NO: 3005462 - RNA, 21 nt, Mycobacterium avium subsp. paratuberculosis
cgaucgaucccuuggcggcgg

SEQ ID NO: 3005463 - RNA, 22 nt, Mycobacterium avium subsp. paratuberculosis
cgaucgaucccuuggcggcggc

SEQ ID NO: 3005464 - RNA, 20 nt, Mycobacterium avium subsp. paratuberculosis
cgaucgaugaauccgcgcag

SEQ ID NO: 3005465 - RNA, 21 nt, Mycobacterium avium subsp. paratuberculosis
cgaucgaugaauccgcgcagc

SEQ ID NO: 3005466 - RNA, 16 nt, Mycobacterium avium subsp. paratuberculosis
cgaucgaugcccagcg

SEQ ID NO: 3005467 - RNA, 19 nt, Mycobacterium avium subsp. paratuberculosis
cgaucgaugcccagcgcgc

SEQ ID NO: 3005468 - RNA, 13 nt, Mycobacterium avium subsp. paratuberculosis
cgaucgccaacgc

SEQ ID NO: 3005469 - RNA, 18 nt, Mycobacterium avium subsp. paratuberculosis
cgaucgccaacgcgcuca

SEQ ID NO: 3005470 - RNA, 12 nt, Mycobacterium avium subsp. paratuberculosis
cgaucgccagca

SEQ ID NO: 3005471 - RNA, 13 nt, Mycobacterium avium subsp. paratuberculosis
cgaucgccagcac

SEQ ID NO: 3005472 - RNA, 14 nt, Mycobacterium avium subsp. paratuberculosis
cgaucgccagcgcg

SEQ ID NO: 3005473 - RNA, 15 nt, Mycobacterium avium subsp. paratuberculosis
cgaucgccagcgcgc

SEQ ID NO: 3005474 - RNA, 18 nt, Mycobacterium avium subsp. paratuberculosis
cgaucgccagcgcgcaga

SEQ ID NO: 3005475 - RNA, 18 nt, Mycobacterium avium subsp. paratuberculosis
cgaucgccagcgcggugu

SEQ ID NO: 3005476 - RNA, 17 nt, Mycobacterium avium subsp. paratuberculosis
cgaucgcccgcuccgcg

SEQ ID NO: 3005477 - RNA, 21 nt, Mycobacterium avium subsp. paratuberculosis
cgaucgcccgcuccgcgggca

SEQ ID NO: 3005478 - RNA, 21 nt, Mycobacterium avium subsp. paratuberculosis
cgaucgcccgguaggccgccg

SEQ ID NO: 3005479 - RNA, 12 nt, Mycobacterium avium subsp. paratuberculosis
cgaucgccgacg

SEQ ID NO: 3005480 - RNA, 19 nt, Mycobacterium avium subsp. paratuberculosis
cgaucgccgacgccagcac

SEQ ID NO: 3005481 - RNA, 13 nt, Mycobacterium avium subsp. paratuberculosis
cgaucgccgacgu

SEQ ID NO: 3005482 - RNA, 15 nt, Mycobacterium avium subsp. paratuberculosis
cgaucgccgagucga

SEQ ID NO: 3005483 - RNA, 18 nt, Mycobacterium avium subsp. paratuberculosis
cgaucgccgagucgaucg

SEQ ID NO: 3005484 - RNA, 22 nt, Mycobacterium avium subsp. paratuberculosis
cgaucgccgagucgaucgccag

SEQ ID NO: 3005485 - RNA, 19 nt, Mycobacterium avium subsp. paratuberculosis
cgaucgccgauccggcgcc

SEQ ID NO: 3005486 - RNA, 21 nt, Mycobacterium avium subsp. paratuberculosis
cgaucgccgauccggcgccgc

SEQ ID NO: 3005487 - RNA, 23 nt, Mycobacterium avium subsp. paratuberculosis
cgaucgccgauccggcgccgcgg

SEQ ID NO: 3005488 - RNA, 14 nt, Mycobacterium avium subsp. paratuberculosis
cgaucgccgcgcau

SEQ ID NO: 3005489 - RNA, 15 nt, Mycobacterium avium subsp. paratuberculosis
cgaucgccgcgcauu

SEQ ID NO: 3005490 - RNA, 16 nt, Mycobacterium avium subsp. paratuberculosis
cgaucgccgcgcccag

SEQ ID NO: 3005491 - RNA, 17 nt, Mycobacterium avium subsp. paratuberculosis
cgaucgccgcgcccagc

SEQ ID NO: 3005492 - RNA, 13 nt, Mycobacterium avium subsp. paratuberculosis
cgaucgccgggga

SEQ ID NO: 3005493 - RNA, 16 nt, Mycobacterium avium subsp. paratuberculosis
cgaucgccggugcggc

SEQ ID NO: 3005494 - RNA, 13 nt, Mycobacterium avium subsp. paratuberculosis
cgaucgccgucac

SEQ ID NO: 3005495 - RNA, 15 nt, Mycobacterium avium subsp. paratuberculosis
cgaucgccgucacgu

SEQ ID NO: 3005496 - RNA, 15 nt, Mycobacterium avium subsp. paratuberculosis
cgaucgccgugguca

SEQ ID NO: 3005497 - RNA, 16 nt, Mycobacterium avium subsp. paratuberculosis
cgaucgcgaccaccgg

SEQ ID NO: 3005498 - RNA, 18 nt, Mycobacterium avium subsp. paratuberculosis
cgaucgcgaucaccgcgg

SEQ ID NO: 3005499 - RNA, 18 nt, Mycobacterium avium subsp. paratuberculosis
cgaucgcgaucgccgauc

SEQ ID NO: 3005500 - RNA, 17 nt, Mycobacterium avium subsp. paratuberculosis
cgaucgcgccggccgcc

SEQ ID NO: 3005501 - RNA, 17 nt, Mycobacterium avium subsp. paratuberculosis
cgaucgcgcgcaggaac

SEQ ID NO: 3005502 - RNA, 12 nt, Mycobacterium avium subsp. paratuberculosis
cgaucgcggcca

SEQ ID NO: 3005503 - RNA, 13 nt, Mycobacterium avium subsp. paratuberculosis
cgaucgcggccag

SEQ ID NO: 3005504 - RNA, 16 nt, Mycobacterium avium subsp. paratuberculosis
cgaucgcggccagcgu

SEQ ID NO: 3005505 - RNA, 18 nt, Mycobacterium avium subsp. paratuberculosis
cgaucgcggccagcguga

SEQ ID NO: 3005506 - RNA, 23 nt, Mycobacterium avium subsp. paratuberculosis
cgaucgcggccagcgugaacacc

SEQ ID NO: 3005507 - RNA, 15 nt, Mycobacterium avium subsp. paratuberculosis
cgaucgcggcgauca

SEQ ID NO: 3005508 - RNA, 20 nt, Mycobacterium avium subsp. paratuberculosis
cgaucgcggcgaucagcccg

SEQ ID NO: 3005509 - RNA, 14 nt, Mycobacterium avium subsp. paratuberculosis
cgaucgcggucacc

SEQ ID NO: 3005510 - RNA, 17 nt, Mycobacterium avium subsp. paratuberculosis
cgaucgcggucaccuug

SEQ ID NO: 3005511 - RNA, 17 nt, Mycobacterium avium subsp. paratuberculosis
cgaucgcgguccaggau

SEQ ID NO: 3005512 - RNA, 18 nt, Mycobacterium avium subsp. paratuberculosis
cgaucgcggugacgcgcc

SEQ ID NO: 3005513 - RNA, 21 nt, Mycobacterium avium subsp. paratuberculosis
cgaucgcggugacgcgccggc

SEQ ID NO: 3005514 - RNA, 21 nt, Mycobacterium avium subsp. paratuberculosis
cgaucgcguaggguucgccga

SEQ ID NO: 3005515 - RNA, 14 nt, Mycobacterium avium subsp. paratuberculosis
cgaucgcgucgaug

SEQ ID NO: 3005516 - RNA, 18 nt, Mycobacterium avium subsp. paratuberculosis
cgaucgcguucugcacca

SEQ ID NO: 3005517 - RNA, 20 nt, Mycobacterium avium subsp. paratuberculosis
cgaucggauggugcccaccg

SEQ ID NO: 3005518 - RNA, 22 nt, Mycobacterium avium subsp. paratuberculosis
cgaucggauggugcccaccggg

SEQ ID NO: 3005519 - RNA, 13 nt, Mycobacterium avium subsp. paratuberculosis
cgaucggcacccg

SEQ ID NO: 3005520 - RNA, 14 nt, Mycobacterium avium subsp. paratuberculosis
cgaucggcacgucg

SEQ ID NO: 3005521 - RNA, 15 nt, Mycobacterium avium subsp. paratuberculosis
cgaucggcacgucga

SEQ ID NO: 3005522 - RNA, 16 nt, Mycobacterium avium subsp. paratuberculosis
cgaucggcacgucgag

SEQ ID NO: 3005523 - RNA, 17 nt, Mycobacterium avium subsp. paratuberculosis
cgaucggcacgucgagc

SEQ ID NO: 3005524 - RNA, 19 nt, Mycobacterium avium subsp. paratuberculosis
cgaucggcacgucgagcag

SEQ ID NO: 3005525 - RNA, 15 nt, Mycobacterium avium subsp. paratuberculosis
cgaucggcagcgcca

SEQ ID NO: 3005526 - RNA, 18 nt, Mycobacterium avium subsp. paratuberculosis
cgaucggcaggucgucga

SEQ ID NO: 3005527 - RNA, 21 nt, Mycobacterium avium subsp. paratuberculosis
cgaucggcaggucgucgacgu

SEQ ID NO: 3005528 - RNA, 17 nt, Mycobacterium avium subsp. paratuberculosis
cgaucggcaugacgccc

SEQ ID NO: 3005529 - RNA, 14 nt, Mycobacterium avium subsp. paratuberculosis
cgaucggcgagccg

SEQ ID NO: 3005530 - RNA, 12 nt, Mycobacterium avium subsp. paratuberculosis
cgaucggcgcca

SEQ ID NO: 3005531 - RNA, 13 nt, Mycobacterium avium subsp. paratuberculosis
cgaucggcgcgcc

SEQ ID NO: 3005532 - RNA, 14 nt, Mycobacterium avium subsp. paratuberculosis
cgaucggcgcgccg

SEQ ID NO: 3005533 - RNA, 16 nt, Mycobacterium avium subsp. paratuberculosis
cgaucggcgcgccgaa

SEQ ID NO: 3005534 - RNA, 15 nt, Mycobacterium avium subsp. paratuberculosis
cgaucggcgcggcga

SEQ ID NO: 3005535 - RNA, 17 nt, Mycobacterium avium subsp. paratuberculosis
cgaucggcggcucgccg

SEQ ID NO: 3005536 - RNA, 19 nt, Mycobacterium avium subsp. paratuberculosis
cgaucggcgguccgccgca

SEQ ID NO: 3005537 - RNA, 22 nt, Mycobacterium avium subsp. paratuberculosis
cgaucggcgguccgccgcagcg

SEQ ID NO: 3005538 - RNA, 15 nt, Mycobacterium avium subsp. paratuberculosis
cgaucggcgugccgg

SEQ ID NO: 3005539 - RNA, 16 nt, Mycobacterium avium subsp. paratuberculosis
cgaucggcuccagcgc

SEQ ID NO: 3005540 - RNA, 17 nt, Mycobacterium avium subsp. paratuberculosis
cgaucggcuccagcgcc

SEQ ID NO: 3005541 - RNA, 19 nt, Mycobacterium avium subsp. paratuberculosis
cgaucggcucggcgcccca

SEQ ID NO: 3005542 - RNA, 17 nt, Mycobacterium avium subsp. paratuberculosis
cgaucgggaacagcccg

SEQ ID NO: 3005543 - RNA, 24 nt, Mycobacterium avium subsp. paratuberculosis
cgaucgggaacagcccgcccuggc

SEQ ID NO: 3005544 - RNA, 15 nt, Mycobacterium avium subsp. paratuberculosis
cgaucgggcgucgca

SEQ ID NO: 3005545 - RNA, 21 nt, Mycobacterium avium subsp. paratuberculosis
cgaucggggaauccuggccga

SEQ ID NO: 3005546 - RNA, 12 nt, Mycobacterium avium subsp. paratuberculosis
cgaucggggcca

SEQ ID NO: 3005547 - RNA, 20 nt, Mycobacterium avium subsp. paratuberculosis
cgaucggggcgcagcccggc

SEQ ID NO: 3005548 - RNA, 22 nt, Mycobacterium avium subsp. paratuberculosis
cgaucggggcgcagcccggcgg

SEQ ID NO: 3005549 - RNA, 23 nt, Mycobacterium avium subsp. paratuberculosis
cgaucggggcgcagcccggcggu

SEQ ID NO: 3005550 - RNA, 21 nt, Mycobacterium avium subsp. paratuberculosis
cgaucgggucaccggccgagc

SEQ ID NO: 3005551 - RNA, 14 nt, Mycobacterium avium subsp. paratuberculosis
cgaucggguggccc

SEQ ID NO: 3005552 - RNA, 16 nt, Mycobacterium avium subsp. paratuberculosis
cgaucggugaacccgc

SEQ ID NO: 3005553 - RNA, 18 nt, Mycobacterium avium subsp. paratuberculosis
cgaucggugaacccgccg

SEQ ID NO: 3005554 - RNA, 22 nt, Mycobacterium avium subsp. paratuberculosis
cgaucggugaacccgccggcga

SEQ ID NO: 3005555 - RNA, 15 nt, Mycobacterium avium subsp. paratuberculosis
cgaucgucaccgugc

SEQ ID NO: 3005556 - RNA, 22 nt, Mycobacterium avium subsp. paratuberculosis
cgaucguccgaggccccgccag

SEQ ID NO: 3005557 - RNA, 14 nt, Mycobacterium avium subsp. paratuberculosis
cgaucguccggcgc

SEQ ID NO: 3005558 - RNA, 15 nt, Mycobacterium avium subsp. paratuberculosis
cgaucguccggcgcc

SEQ ID NO: 3005559 - RNA, 20 nt, Mycobacterium avium subsp. paratuberculosis
cgaucguccggcgccacgac

SEQ ID NO: 3005560 - RNA, 15 nt, Mycobacterium avium subsp. paratuberculosis
cgaucgucgaccacc

SEQ ID NO: 3005561 - RNA, 16 nt, Mycobacterium avium subsp. paratuberculosis
cgaucgucgaccacca

SEQ ID NO: 3005562 - RNA, 19 nt, Mycobacterium avium subsp. paratuberculosis
cgaucgucgaccaccacga

SEQ ID NO: 3005563 - RNA, 20 nt, Mycobacterium avium subsp. paratuberculosis
cgaucgucgacgucaacacc

SEQ ID NO: 3005564 - RNA, 16 nt, Mycobacterium avium subsp. paratuberculosis
cgaucgucgccgccaa

SEQ ID NO: 3005565 - RNA, 21 nt, Mycobacterium avium subsp. paratuberculosis
cgaucgucgccgccaacgcga

SEQ ID NO: 3005566 - RNA, 13 nt, Mycobacterium avium subsp. paratuberculosis
cgaucgucgccgu

SEQ ID NO: 3005567 - RNA, 15 nt, Mycobacterium avium subsp. paratuberculosis
cgaucgucgccguca

SEQ ID NO: 3005568 - RNA, 16 nt, Mycobacterium avium subsp. paratuberculosis
cgaucgucgccgucac

SEQ ID NO: 3005569 - RNA, 21 nt, Mycobacterium avium subsp. paratuberculosis
cgaucgucgccgucaccucga

SEQ ID NO: 3005570 - RNA, 16 nt, Mycobacterium avium subsp. paratuberculosis
cgaucgucucgucgag

SEQ ID NO: 3005571 - RNA, 17 nt, Mycobacterium avium subsp. paratuberculosis
cgaucgugaauucggcc

SEQ ID NO: 3005572 - RNA, 20 nt, Mycobacterium avium subsp. paratuberculosis
cgaucuccaccgagugcggc

SEQ ID NO: 3005573 - RNA, 22 nt, Mycobacterium avium subsp. paratuberculosis
cgaucuccaccguguucaccag

SEQ ID NO: 3005574 - RNA, 14 nt, Mycobacterium avium subsp. paratuberculosis
cgaucuccagcggc

SEQ ID NO: 3005575 - RNA, 16 nt, Mycobacterium avium subsp. paratuberculosis
cgaucuccagcggccg

SEQ ID NO: 3005576 - RNA, 19 nt, Mycobacterium avium subsp. paratuberculosis
cgaucucccaacgcagcgc

SEQ ID NO: 3005577 - RNA, 17 nt, Mycobacterium avium subsp. paratuberculosis
cgaucuccgucaccgug

SEQ ID NO: 3005578 - RNA, 18 nt, Mycobacterium avium subsp. paratuberculosis
cgaucuccgucaccgugg

SEQ ID NO: 3005579 - RNA, 20 nt, Mycobacterium avium subsp. paratuberculosis
cgaucuccucgcgcggcacc

SEQ ID NO: 3005580 - RNA, 15 nt, Mycobacterium avium subsp. paratuberculosis
cgaucucgaccagcg

SEQ ID NO: 3005581 - RNA, 18 nt, Mycobacterium avium subsp. paratuberculosis
cgaucucgaccagcgccg

SEQ ID NO: 3005582 - RNA, 19 nt, Mycobacterium avium subsp. paratuberculosis
cgaucucgaccagcgccga

SEQ ID NO: 3005583 - RNA, 17 nt, Mycobacterium avium subsp. paratuberculosis
cgaucucgaccaggccg

SEQ ID NO: 3005584 - RNA, 20 nt, Mycobacterium avium subsp. paratuberculosis
cgaucucgagcauccggugc

SEQ ID NO: 3005585 - RNA, 18 nt, Mycobacterium avium subsp. paratuberculosis
cgaucucgauggccacgc

SEQ ID NO: 3005586 - RNA, 19 nt, Mycobacterium avium subsp. paratuberculosis
cgaucucgauggccucguc

SEQ ID NO: 3005587 - RNA, 21 nt, Mycobacterium avium subsp. paratuberculosis
cgaucucgccgaaggccgggu

SEQ ID NO: 3005588 - RNA, 18 nt, Mycobacterium avium subsp. paratuberculosis
cgaucucgcgcgggucga

SEQ ID NO: 3005589 - RNA, 15 nt, Mycobacterium avium subsp. paratuberculosis
cgaucucgcggucga

SEQ ID NO: 3005590 - RNA, 21 nt, Mycobacterium avium subsp. paratuberculosis
cgaucucggccaaccgggcag

SEQ ID NO: 3005591 - RNA, 22 nt, Mycobacterium avium subsp. paratuberculosis
cgaucucggccaaccgggcagg

SEQ ID NO: 3005592 - RNA, 20 nt, Mycobacterium avium subsp. paratuberculosis
cgaucucggccaccgucagc

SEQ ID NO: 3005593 - RNA, 16 nt, Mycobacterium avium subsp. paratuberculosis
cgaucucggccagcgg

SEQ ID NO: 3005594 - RNA, 17 nt, Mycobacterium avium subsp. paratuberculosis
cgaucucggccagcggg

SEQ ID NO: 3005595 - RNA, 20 nt, Mycobacterium avium subsp. paratuberculosis
cgaucucggccagcgggcgg

SEQ ID NO: 3005596 - RNA, 13 nt, Mycobacterium avium subsp. paratuberculosis
cgaucucggcggc

SEQ ID NO: 3005597 - RNA, 17 nt, Mycobacterium avium subsp. paratuberculosis
cgaucucggucaccgag

SEQ ID NO: 3005598 - RNA, 19 nt, Mycobacterium avium subsp. paratuberculosis
cgaucucggucaccgagcg

SEQ ID NO: 3005599 - RNA, 23 nt, Mycobacterium avium subsp. paratuberculosis
cgaucucggucaccgagcggccg

SEQ ID NO: 3005600 - RNA, 15 nt, Mycobacterium avium subsp. paratuberculosis
cgaucucggucgcca

SEQ ID NO: 3005601 - RNA, 20 nt, Mycobacterium avium subsp. paratuberculosis
cgaucucggucgccagcacc

SEQ ID NO: 3005602 - RNA, 21 nt, Mycobacterium avium subsp. paratuberculosis
cgaucucguagcccaccucga

SEQ ID NO: 3005603 - RNA, 22 nt, Mycobacterium avium subsp. paratuberculosis
cgaucucguagguggccagcac

SEQ ID NO: 3005604 - RNA, 19 nt, Mycobacterium avium subsp. paratuberculosis
cgaucucgucccacggcgg

SEQ ID NO: 3005605 - RNA, 17 nt, Mycobacterium avium subsp. paratuberculosis
cgaucucgucgcacaac

SEQ ID NO: 3005606 - RNA, 20 nt, Mycobacterium avium subsp. paratuberculosis
cgaucucgucgcgcagcugg

SEQ ID NO: 3005607 - RNA, 16 nt, Mycobacterium avium subsp. paratuberculosis
cgaucucuucgccgga

SEQ ID NO: 3005608 - RNA, 19 nt, Mycobacterium avium subsp. paratuberculosis
cgaucucuucgccggacag

SEQ ID NO: 3005609 - RNA, 13 nt, Mycobacterium avium subsp. paratuberculosis
cgaucugcaccag

SEQ ID NO: 3005610 - RNA, 19 nt, Mycobacterium avium subsp. paratuberculosis
cgaucugcaccagcgcgga

SEQ ID NO: 3005611 - RNA, 15 nt, Mycobacterium avium subsp. paratuberculosis
cgaucugcagccggc

SEQ ID NO: 3005612 - RNA, 18 nt, Mycobacterium avium subsp. paratuberculosis
cgaucugcagccggcgcg

SEQ ID NO: 3005613 - RNA, 14 nt, Mycobacterium avium subsp. paratuberculosis
cgaucugcaggccg

SEQ ID NO: 3005614 - RNA, 14 nt, Mycobacterium avium subsp. paratuberculosis
cgaucugcggcacg

SEQ ID NO: 3005615 - RNA, 22 nt, Mycobacterium avium subsp. paratuberculosis
cgaucugcgucauggagaucac

SEQ ID NO: 3005616 - RNA, 18 nt, Mycobacterium avium subsp. paratuberculosis
cgaucugcuccucgguca

SEQ ID NO: 3005617 - RNA, 19 nt, Mycobacterium avium subsp. paratuberculosis
cgaucugcucgaugcggcc

SEQ ID NO: 3005618 - RNA, 20 nt, Mycobacterium avium subsp. paratuberculosis
cgaucugcucgaugcggccc

SEQ ID NO: 3005619 - RNA, 22 nt, Mycobacterium avium subsp. paratuberculosis
cgaucugcucggugucgaucga

SEQ ID NO: 3005620 - RNA, 16 nt, Mycobacterium avium subsp. paratuberculosis
cgaucuggcgcagcgu

SEQ ID NO: 3005621 - RNA, 20 nt, Mycobacterium avium subsp. paratuberculosis
cgaucuggcgcaucagcggg

SEQ ID NO: 3005622 - RNA, 19 nt, Mycobacterium avium subsp. paratuberculosis
cgaucuggcgggcggucca

SEQ ID NO: 3005623 - RNA, 22 nt, Mycobacterium avium subsp. paratuberculosis
cgaucugggaucggugcgcggc

SEQ ID NO: 3005624 - RNA, 21 nt, Mycobacterium avium subsp. paratuberculosis
cgaucuggguuugggucaucg

SEQ ID NO: 3005625 - RNA, 17 nt, Mycobacterium avium subsp. paratuberculosis
cgaucugguccagcgug

SEQ ID NO: 3005626 - RNA, 22 nt, Mycobacterium avium subsp. paratuberculosis
cgaucugguccagcgugcgcgg

SEQ ID NO: 3005627 - RNA, 17 nt, Mycobacterium avium subsp. paratuberculosis
cgaucugguucaccgcc

SEQ ID NO: 3005628 - RNA, 18 nt, Mycobacterium avium subsp. paratuberculosis
cgaucugguucaccgcca

SEQ ID NO: 3005629 - RNA, 20 nt, Mycobacterium avium subsp. paratuberculosis
cgaucugguucaccgccacc

SEQ ID NO: 3005630 - RNA, 21 nt, Mycobacterium avium subsp. paratuberculosis
cgaucugguucaccgccacca

SEQ ID NO: 3005631 - RNA, 22 nt, Mycobacterium avium subsp. paratuberculosis
cgaucugguucaccgccaccag

SEQ ID NO: 3005632 - RNA, 18 nt, Mycobacterium avium subsp. paratuberculosis
cgaucugguugaaccggu

SEQ ID NO: 3005633 - RNA, 15 nt, Mycobacterium avium subsp. paratuberculosis
cgaucuugacgugga

SEQ ID NO: 3005634 - RNA, 23 nt, Mycobacterium avium subsp. paratuberculosis
cgaucuugagccggaugcggccg

SEQ ID NO: 3005635 - RNA, 23 nt, Mycobacterium avium subsp. paratuberculosis
cgaucuuggcgagcugaccggcc

SEQ ID NO: 3005636 - RNA, 18 nt, Mycobacterium avium subsp. paratuberculosis
cgaugaaaccccagccgg

SEQ ID NO: 3005637 - RNA, 22 nt, Mycobacterium avium subsp. paratuberculosis
cgaugaaaccccagccggccga

SEQ ID NO: 3005638 - RNA, 15 nt, Mycobacterium avium subsp. paratuberculosis
cgaugaaauccggga

SEQ ID NO: 3005639 - RNA, 21 nt, Mycobacterium avium subsp. paratuberculosis
cgaugaacagucggccggcgu

SEQ ID NO: 3005640 - RNA, 15 nt, Mycobacterium avium subsp. paratuberculosis
cgaugaacaucgccg

SEQ ID NO: 3005641 - RNA, 16 nt, Mycobacterium avium subsp. paratuberculosis
cgaugaacaugcccug

SEQ ID NO: 3005642 - RNA, 23 nt, Mycobacterium avium subsp. paratuberculosis
cgaugaaccgcugcugcucggcc

SEQ ID NO: 3005643 - RNA, 23 nt, Mycobacterium avium subsp. paratuberculosis
cgaugaacgcacucgguguggcc

SEQ ID NO: 3005644 - RNA, 22 nt, Mycobacterium avium subsp. paratuberculosis
cgaugaacgggauggagccgcc

SEQ ID NO: 3005645 - RNA, 14 nt, Mycobacterium avium subsp. paratuberculosis
cgaugaacuccucg

SEQ ID NO: 3005646 - RNA, 15 nt, Mycobacterium avium subsp. paratuberculosis
cgaugaacuccucga

SEQ ID NO: 3005647 - RNA, 20 nt, Mycobacterium avium subsp. paratuberculosis
cgaugaagaacaccccgacc

SEQ ID NO: 3005648 - RNA, 18 nt, Mycobacterium avium subsp. paratuberculosis
cgaugaagccggcgaacu

SEQ ID NO: 3005649 - RNA, 18 nt, Mycobacterium avium subsp. paratuberculosis
cgaugaagccgugcccgc

SEQ ID NO: 3005650 - RNA, 17 nt, Mycobacterium avium subsp. paratuberculosis
cgaugaaguacccgguc

SEQ ID NO: 3005651 - RNA, 15 nt, Mycobacterium avium subsp. paratuberculosis
cgaugaagucgguga

SEQ ID NO: 3005652 - RNA, 20 nt, Mycobacterium avium subsp. paratuberculosis
cgaugaaguugaagacgcga

SEQ ID NO: 3005653 - RNA, 17 nt, Mycobacterium avium subsp. paratuberculosis
cgaugaauccgcgcagc

SEQ ID NO: 3005654 - RNA, 19 nt, Mycobacterium avium subsp. paratuberculosis
cgaugaauccgcgcagcag

SEQ ID NO: 3005655 - RNA, 20 nt, Mycobacterium avium subsp. paratuberculosis
cgaugaauccgcgcagcagc

SEQ ID NO: 3005656 - RNA, 21 nt, Mycobacterium avium subsp. paratuberculosis
cgaugaccacccucagggagc

SEQ ID NO: 3005657 - RNA, 14 nt, Mycobacterium avium subsp. paratuberculosis
cgaugaccagcgcg

SEQ ID NO: 3005658 - RNA, 15 nt, Mycobacterium avium subsp. paratuberculosis
cgaugaccagcgcga

SEQ ID NO: 3005659 - RNA, 20 nt, Mycobacterium avium subsp. paratuberculosis
cgaugaccagcgcgaacagc

SEQ ID NO: 3005660 - RNA, 21 nt, Mycobacterium avium subsp. paratuberculosis
cgaugaccgccugcggcaggu

SEQ ID NO: 3005661 - RNA, 18 nt, Mycobacterium avium subsp. paratuberculosis
cgaugaccgcggcgggca

SEQ ID NO: 3005662 - RNA, 15 nt, Mycobacterium avium subsp. paratuberculosis
cgaugaccggcccgg

SEQ ID NO: 3005663 - RNA, 16 nt, Mycobacterium avium subsp. paratuberculosis
cgaugaccggcccggc

SEQ ID NO: 3005664 - RNA, 21 nt, Mycobacterium avium subsp. paratuberculosis
cgaugaccggcccggcggccg

SEQ ID NO: 3005665 - RNA, 16 nt, Mycobacterium avium subsp. paratuberculosis
cgaugaccucgcacag

SEQ ID NO: 3005666 - RNA, 16 nt, Mycobacterium avium subsp. paratuberculosis
cgaugaccucgcgcag

SEQ ID NO: 3005667 - RNA, 17 nt, Mycobacterium avium subsp. paratuberculosis
cgaugaccucgcgcccg

SEQ ID NO: 3005668 - RNA, 18 nt, Mycobacterium avium subsp. paratuberculosis
cgaugaccucgcgcccgg

SEQ ID NO: 3005669 - RNA, 21 nt, Mycobacterium avium subsp. paratuberculosis
cgaugaccucgcgcccggcgc

SEQ ID NO: 3005670 - RNA, 17 nt, Mycobacterium avium subsp. paratuberculosis
cgaugaccucgcgggug

SEQ ID NO: 3005671 - RNA, 19 nt, Mycobacterium avium subsp. paratuberculosis
cgaugacgaauuccgcacc

SEQ ID NO: 3005672 - RNA, 17 nt, Mycobacterium avium subsp. paratuberculosis
cgaugacgaccgggucc

SEQ ID NO: 3005673 - RNA, 15 nt, Mycobacterium avium subsp. paratuberculosis
cgaugacgagcagcg

SEQ ID NO: 3005674 - RNA, 20 nt, Mycobacterium avium subsp. paratuberculosis
cgaugacgagcagcgugcug

SEQ ID NO: 3005675 - RNA, 14 nt, Mycobacterium avium subsp. paratuberculosis
cgaugacgaugccc

SEQ ID NO: 3005676 - RNA, 13 nt, Mycobacterium avium subsp. paratuberculosis
cgaugacgccgcg

SEQ ID NO: 3005677 - RNA, 16 nt, Mycobacterium avium subsp. paratuberculosis
cgaugacgccggacag

SEQ ID NO: 3005678 - RNA, 12 nt, Mycobacterium avium subsp. paratuberculosis
cgaugacgcggu

SEQ ID NO: 3005679 - RNA, 17 nt, Mycobacterium avium subsp. paratuberculosis
cgaugacgcugccgcgc

SEQ ID NO: 3005680 - RNA, 20 nt, Mycobacterium avium subsp. paratuberculosis
cgaugacgcugccgcgccgc

SEQ ID NO: 3005681 - RNA, 22 nt, Mycobacterium avium subsp. paratuberculosis
cgaugacgcugccgcgccgcca

SEQ ID NO: 3005682 - RNA, 12 nt, Mycobacterium avium subsp. paratuberculosis
cgaugacggccg

SEQ ID NO: 3005683 - RNA, 14 nt, Mycobacterium avium subsp. paratuberculosis
cgaugacggcggcg

SEQ ID NO: 3005684 - RNA, 15 nt, Mycobacterium avium subsp. paratuberculosis
cgaugacggcggcgc

SEQ ID NO: 3005685 - RNA, 17 nt, Mycobacterium avium subsp. paratuberculosis
cgaugacggcggcgccc

SEQ ID NO: 3005686 - RNA, 19 nt, Mycobacterium avium subsp. paratuberculosis
cgaugacggcggcgcccug

SEQ ID NO: 3005687 - RNA, 19 nt, Mycobacterium avium subsp. paratuberculosis
cgaugacggucuugcggcc

SEQ ID NO: 3005688 - RNA, 20 nt, Mycobacterium avium subsp. paratuberculosis
cgaugacggucuugcggccg

SEQ ID NO: 3005689 - RNA, 15 nt, Mycobacterium avium subsp. paratuberculosis
cgaugacguccacca

SEQ ID NO: 3005690 - RNA, 17 nt, Mycobacterium avium subsp. paratuberculosis
cgaugacguccaccagg

SEQ ID NO: 3005691 - RNA, 14 nt, Mycobacterium avium subsp. paratuberculosis
cgaugacgucgcgc

SEQ ID NO: 3005692 - RNA, 15 nt, Mycobacterium avium subsp. paratuberculosis
cgaugacgucgcgcu

SEQ ID NO: 3005693 - RNA, 17 nt, Mycobacterium avium subsp. paratuberculosis
cgaugacgucgcgcugc

SEQ ID NO: 3005694 - RNA, 19 nt, Mycobacterium avium subsp. paratuberculosis
cgaugacgucgcgcugccg

SEQ ID NO: 3005695 - RNA, 16 nt, Mycobacterium avium subsp. paratuberculosis
cgaugacgucgucgcg

SEQ ID NO: 3005696 - RNA, 18 nt, Mycobacterium avium subsp. paratuberculosis
cgaugacgucgucgcggc

SEQ ID NO: 3005697 - RNA, 22 nt, Mycobacterium avium subsp. paratuberculosis
cgaugacgucgucgcggcgcug

SEQ ID NO: 3005698 - RNA, 18 nt, Mycobacterium avium subsp. paratuberculosis
cgaugacguugcgcgcca

SEQ ID NO: 3005699 - RNA, 22 nt, Mycobacterium avium subsp. paratuberculosis
cgaugagccucagcgcgcaacg

SEQ ID NO: 3005700 - RNA, 21 nt, Mycobacterium avium subsp. paratuberculosis
cgaugagcuggugcagcgacu

SEQ ID NO: 3005701 - RNA, 22 nt, Mycobacterium avium subsp. paratuberculosis
cgaugaggcucaggccgguggc

SEQ ID NO: 3005702 - RNA, 16 nt, Mycobacterium avium subsp. paratuberculosis
cgaugagggccagcag

SEQ ID NO: 3005703 - RNA, 13 nt, Mycobacterium avium subsp. paratuberculosis
cgaugaucaggcc

SEQ ID NO: 3005704 - RNA, 21 nt, Mycobacterium avium subsp. paratuberculosis
cgaugaucccgaggaugccgc

SEQ ID NO: 3005705 - RNA, 14 nt, Mycobacterium avium subsp. paratuberculosis
cgaugauccgcggc

SEQ ID NO: 3005706 - RNA, 16 nt, Mycobacterium avium subsp. paratuberculosis
cgaugauccgcggcgc

SEQ ID NO: 3005707 - RNA, 15 nt, Mycobacterium avium subsp. paratuberculosis
cgaugauccuggccu

SEQ ID NO: 3005708 - RNA, 14 nt, Mycobacterium avium subsp. paratuberculosis
cgaugaucgccggc

SEQ ID NO: 3005709 - RNA, 16 nt, Mycobacterium avium subsp. paratuberculosis
cgaugaucgccggcgc

SEQ ID NO: 3005710 - RNA, 19 nt, Mycobacterium avium subsp. paratuberculosis
cgaugaucgccggcgccgg

SEQ ID NO: 3005711 - RNA, 20 nt, Mycobacterium avium subsp. paratuberculosis
cgaugaucgccggcgccgga

SEQ ID NO: 3005712 - RNA, 18 nt, Mycobacterium avium subsp. paratuberculosis
cgaugaucgucggcagcg

SEQ ID NO: 3005713 - RNA, 20 nt, Mycobacterium avium subsp. paratuberculosis
cgaugaucuggcggucccgc

SEQ ID NO: 3005714 - RNA, 21 nt, Mycobacterium avium subsp. paratuberculosis
cgaugaucugguuccacagcu

SEQ ID NO: 3005715 - RNA, 19 nt, Mycobacterium avium subsp. paratuberculosis
cgaugaugaaaccggccag

SEQ ID NO: 3005716 - RNA, 22 nt, Mycobacterium avium subsp. paratuberculosis
cgaugaugaaaccggccagcag

SEQ ID NO: 3005717 - RNA, 23 nt, Mycobacterium avium subsp. paratuberculosis
cgaugaugaaaccggccagcagc

SEQ ID NO: 3005718 - RNA, 16 nt, Mycobacterium avium subsp. paratuberculosis
cgaugaugccggcgga

SEQ ID NO: 3005719 - RNA, 17 nt, Mycobacterium avium subsp. paratuberculosis
cgaugaugggcgaucga

SEQ ID NO: 3005720 - RNA, 18 nt, Mycobacterium avium subsp. paratuberculosis
cgaugaugggcgaucgac

SEQ ID NO: 3005721 - RNA, 13 nt, Mycobacterium avium subsp. paratuberculosis
cgaugaugguggc

SEQ ID NO: 3005722 - RNA, 18 nt, Mycobacterium avium subsp. paratuberculosis
cgaugaugguggcggcca

SEQ ID NO: 3005723 - RNA, 21 nt, Mycobacterium avium subsp. paratuberculosis
cgaugaugguggcggccacca

SEQ ID NO: 3005724 - RNA, 19 nt, Mycobacterium avium subsp. paratuberculosis
cgaugaugucgcccggcgg

SEQ ID NO: 3005725 - RNA, 20 nt, Mycobacterium avium subsp. paratuberculosis
cgaugaugucgcccggcggc

SEQ ID NO: 3005726 - RNA, 16 nt, Mycobacterium avium subsp. paratuberculosis
cgaugaugucggccgg

SEQ ID NO: 3005727 - RNA, 20 nt, Mycobacterium avium subsp. paratuberculosis
cgaugaugucggccggcagu

SEQ ID NO: 3005728 - RNA, 19 nt, Mycobacterium avium subsp. paratuberculosis
cgaugcaacaccgaacgcc

SEQ ID NO: 3005729 - RNA, 20 nt, Mycobacterium avium subsp. paratuberculosis
cgaugcaacaccgaacgccg

SEQ ID NO: 3005730 - RNA, 20 nt, Mycobacterium avium subsp. paratuberculosis
cgaugcacaaccgcugcugc

SEQ ID NO: 3005731 - RNA, 15 nt, Mycobacterium avium subsp. paratuberculosis
cgaugcacggucggc

SEQ ID NO: 3005732 - RNA, 16 nt, Mycobacterium avium subsp. paratuberculosis
cgaugcacggucggcc

SEQ ID NO: 3005733 - RNA, 17 nt, Mycobacterium avium subsp. paratuberculosis
cgaugcacggucggccc

SEQ ID NO: 3005734 - RNA, 19 nt, Mycobacterium avium subsp. paratuberculosis
cgaugcacggucggccccg

SEQ ID NO: 3005735 - RNA, 20 nt, Mycobacterium avium subsp. paratuberculosis
cgaugcacggucggccccgc

SEQ ID NO: 3005736 - RNA, 18 nt, Mycobacterium avium subsp. paratuberculosis
cgaugcagaacagccggu

SEQ ID NO: 3005737 - RNA, 16 nt, Mycobacterium avium subsp. paratuberculosis
cgaugcagaucaccac

SEQ ID NO: 3005738 - RNA, 18 nt, Mycobacterium avium subsp. paratuberculosis
cgaugcagaucaccacgg

SEQ ID NO: 3005739 - RNA, 20 nt, Mycobacterium avium subsp. paratuberculosis
cgaugcagcacauccagccc

SEQ ID NO: 3005740 - RNA, 19 nt, Mycobacterium avium subsp. paratuberculosis
cgaugcauuggugcacgcc

SEQ ID NO: 3005741 - RNA, 24 nt, Mycobacterium avium subsp. paratuberculosis
cgaugcauuggugcacgccguacc

SEQ ID NO: 3005742 - RNA, 16 nt, Mycobacterium avium subsp. paratuberculosis
cgaugccagacgcucu

SEQ ID NO: 3005743 - RNA, 16 nt, Mycobacterium avium subsp. paratuberculosis
cgaugccagcgcaccg

SEQ ID NO: 3005744 - RNA, 20 nt, Mycobacterium avium subsp. paratuberculosis
cgaugccagcgcaccgggcc

SEQ ID NO: 3005745 - RNA, 22 nt, Mycobacterium avium subsp. paratuberculosis
cgaugccagcgcaccgggcccg

SEQ ID NO: 3005746 - RNA, 14 nt, Mycobacterium avium subsp. paratuberculosis
cgaugcccagcagc

SEQ ID NO: 3005747 - RNA, 13 nt, Mycobacterium avium subsp. paratuberculosis
cgaugcccagccc

SEQ ID NO: 3005748 - RNA, 18 nt, Mycobacterium avium subsp. paratuberculosis
cgaugcccagccccucga

SEQ ID NO: 3005749 - RNA, 14 nt, Mycobacterium avium subsp. paratuberculosis
cgaugcccagcgcg

SEQ ID NO: 3005750 - RNA, 15 nt, Mycobacterium avium subsp. paratuberculosis
cgaugcccagcgcgc

SEQ ID NO: 3005751 - RNA, 20 nt, Mycobacterium avium subsp. paratuberculosis
cgaugcccagcgcgcggugc

SEQ ID NO: 3005752 - RNA, 17 nt, Mycobacterium avium subsp. paratuberculosis
cgaugcccgacaccgcc

SEQ ID NO: 3005753 - RNA, 12 nt, Mycobacterium avium subsp. paratuberculosis
cgaugcccgccc

SEQ ID NO: 3005754 - RNA, 13 nt, Mycobacterium avium subsp. paratuberculosis
cgaugcccgccgg

SEQ ID NO: 3005755 - RNA, 14 nt, Mycobacterium avium subsp. paratuberculosis
cgaugcccgccggc

SEQ ID NO: 3005756 - RNA, 15 nt, Mycobacterium avium subsp. paratuberculosis
cgaugcccgccggcc

SEQ ID NO: 3005757 - RNA, 14 nt, Mycobacterium avium subsp. paratuberculosis
cgaugcccgcgccg

SEQ ID NO: 3005758 - RNA, 15 nt, Mycobacterium avium subsp. paratuberculosis
cgaugcccgcgccga

SEQ ID NO: 3005759 - RNA, 24 nt, Mycobacterium avium subsp. paratuberculosis
cgaugcccgcguccugcagcgccg

SEQ ID NO: 3005760 - RNA, 20 nt, Mycobacterium avium subsp. paratuberculosis
cgaugcccggggugcuggcg

SEQ ID NO: 3005761 - RNA, 15 nt, Mycobacterium avium subsp. paratuberculosis
cgaugcccgugaucg

SEQ ID NO: 3005762 - RNA, 17 nt, Mycobacterium avium subsp. paratuberculosis
cgaugcccuccagcacc

SEQ ID NO: 3005763 - RNA, 19 nt, Mycobacterium avium subsp. paratuberculosis
cgaugcccuccagcaccgu

SEQ ID NO: 3005764 - RNA, 23 nt, Mycobacterium avium subsp. paratuberculosis
cgaugcccuuggccagcagugcc

SEQ ID NO: 3005765 - RNA, 12 nt, Mycobacterium avium subsp. paratuberculosis
cgaugccgacac

SEQ ID NO: 3005766 - RNA, 13 nt, Mycobacterium avium subsp. paratuberculosis
cgaugccgacacc

SEQ ID NO: 3005767 - RNA, 18 nt, Mycobacterium avium subsp. paratuberculosis
cgaugccgaccaacaccc

SEQ ID NO: 3005768 - RNA, 23 nt, Mycobacterium avium subsp. paratuberculosis
cgaugccgaccgacagccgcacc

SEQ ID NO: 3005769 - RNA, 17 nt, Mycobacterium avium subsp. paratuberculosis
cgaugccgagccggccg

SEQ ID NO: 3005770 - RNA, 23 nt, Mycobacterium avium subsp. paratuberculosis
cgaugccgaggauuucgcgaucg

SEQ ID NO: 3005771 - RNA, 11 nt, Mycobacterium avium subsp. paratuberculosis
cgaugccgauc

SEQ ID NO: 3005772 - RNA, 18 nt, Mycobacterium avium subsp. paratuberculosis
cgaugccgaucacgguga

SEQ ID NO: 3005773 - RNA, 18 nt, Mycobacterium avium subsp. paratuberculosis
cgaugccgaucggggcgc

SEQ ID NO: 3005774 - RNA, 13 nt, Mycobacterium avium subsp. paratuberculosis
cgaugccgccgac

SEQ ID NO: 3005775 - RNA, 23 nt, Mycobacterium avium subsp. paratuberculosis
cgaugccgccgagggccagcagc

SEQ ID NO: 3005776 - RNA, 16 nt, Mycobacterium avium subsp. paratuberculosis
cgaugccgcgcaggcc

SEQ ID NO: 3005777 - RNA, 23 nt, Mycobacterium avium subsp. paratuberculosis
cgaugccgcgcaggccguccagc

SEQ ID NO: 3005778 - RNA, 13 nt, Mycobacterium avium subsp. paratuberculosis
cgaugccgcgcug

SEQ ID NO: 3005779 - RNA, 14 nt, Mycobacterium avium subsp. paratuberculosis
cgaugccgcgcugc

SEQ ID NO: 3005780 - RNA, 19 nt, Mycobacterium avium subsp. paratuberculosis
cgaugccgcgcugcgccgg

SEQ ID NO: 3005781 - RNA, 20 nt, Mycobacterium avium subsp. paratuberculosis
cgaugccgcgcugcgccggg

SEQ ID NO: 3005782 - RNA, 15 nt, Mycobacterium avium subsp. paratuberculosis
cgaugccgcggcguc

SEQ ID NO: 3005783 - RNA, 16 nt, Mycobacterium avium subsp. paratuberculosis
cgaugccgcugaucaa

SEQ ID NO: 3005784 - RNA, 19 nt, Mycobacterium avium subsp. paratuberculosis
cgaugccggaaaaguucgg

SEQ ID NO: 3005785 - RNA, 16 nt, Mycobacterium avium subsp. paratuberculosis
cgaugccggcaaccgc

SEQ ID NO: 3005786 - RNA, 13 nt, Mycobacterium avium subsp. paratuberculosis
cgaugccggccag

SEQ ID NO: 3005787 - RNA, 16 nt, Mycobacterium avium subsp. paratuberculosis
cgaugccggccagcgg

SEQ ID NO: 3005788 - RNA, 17 nt, Mycobacterium avium subsp. paratuberculosis
cgaugccggccagcggc

SEQ ID NO: 3005789 - RNA, 18 nt, Mycobacterium avium subsp. paratuberculosis
cgaugccggccagcggcc

SEQ ID NO: 3005790 - RNA, 19 nt, Mycobacterium avium subsp. paratuberculosis
cgaugccggccagcggcca

SEQ ID NO: 3005791 - RNA, 15 nt, Mycobacterium avium subsp. paratuberculosis
cgaugccggccaggc

SEQ ID NO: 3005792 - RNA, 22 nt, Mycobacterium avium subsp. paratuberculosis
cgaugccggccaggcacagcag

SEQ ID NO: 3005793 - RNA, 13 nt, Mycobacterium avium subsp. paratuberculosis
cgaugccggccgg

SEQ ID NO: 3005794 - RNA, 13 nt, Mycobacterium avium subsp. paratuberculosis
cgaugccggccug

SEQ ID NO: 3005795 - RNA, 15 nt, Mycobacterium avium subsp. paratuberculosis
cgaugccggccuggc

SEQ ID NO: 3005796 - RNA, 20 nt, Mycobacterium avium subsp. paratuberculosis
cgaugccggcgacgaacgcu

SEQ ID NO: 3005797 - RNA, 12 nt, Mycobacterium avium subsp. paratuberculosis
cgaugccggcgu

SEQ ID NO: 3005798 - RNA, 16 nt, Mycobacterium avium subsp. paratuberculosis
cgaugccggcgucguc

SEQ ID NO: 3005799 - RNA, 17 nt, Mycobacterium avium subsp. paratuberculosis
cgaugccggcgucgucg

SEQ ID NO: 3005800 - RNA, 13 nt, Mycobacterium avium subsp. paratuberculosis
cgaugccgggcac

SEQ ID NO: 3005801 - RNA, 14 nt, Mycobacterium avium subsp. paratuberculosis
cgaugccgggcacg

SEQ ID NO: 3005802 - RNA, 17 nt, Mycobacterium avium subsp. paratuberculosis
cgaugccgggcacgaau

SEQ ID NO: 3005803 - RNA, 20 nt, Mycobacterium avium subsp. paratuberculosis
cgaugccguagaccagcauc

SEQ ID NO: 3005804 - RNA, 14 nt, Mycobacterium avium subsp. paratuberculosis
cgaugccguagagc

SEQ ID NO: 3005805 - RNA, 14 nt, Mycobacterium avium subsp. paratuberculosis
cgaugccgugccgg

SEQ ID NO: 3005806 - RNA, 17 nt, Mycobacterium avium subsp. paratuberculosis
cgaugccgugcugggcg

SEQ ID NO: 3005807 - RNA, 14 nt, Mycobacterium avium subsp. paratuberculosis
cgaugccguucgcg

SEQ ID NO: 3005808 - RNA, 15 nt, Mycobacterium avium subsp. paratuberculosis
cgaugccguucgcgc

SEQ ID NO: 3005809 - RNA, 20 nt, Mycobacterium avium subsp. paratuberculosis
cgaugccguucgcgccguag

SEQ ID NO: 3005810 - RNA, 18 nt, Mycobacterium avium subsp. paratuberculosis
cgaugccguugaucaccg

SEQ ID NO: 3005811 - RNA, 20 nt, Mycobacterium avium subsp. paratuberculosis
cgaugccguugaucaccgug

SEQ ID NO: 3005812 - RNA, 21 nt, Mycobacterium avium subsp. paratuberculosis
cgaugccguugaucaccguga

SEQ ID NO: 3005813 - RNA, 20 nt, Mycobacterium avium subsp. paratuberculosis
cgaugccguugugcaccauc

SEQ ID NO: 3005814 - RNA, 20 nt, Mycobacterium avium subsp. paratuberculosis
cgaugccuacaggugccggc

SEQ ID NO: 3005815 - RNA, 18 nt, Mycobacterium avium subsp. paratuberculosis
cgaugccuuccucggcgc

SEQ ID NO: 3005816 - RNA, 14 nt, Mycobacterium avium subsp. paratuberculosis
cgaugcgacaccgc

SEQ ID NO: 3005817 - RNA, 12 nt, Mycobacterium avium subsp. paratuberculosis
cgaugcgacgca

SEQ ID NO: 3005818 - RNA, 14 nt, Mycobacterium avium subsp. paratuberculosis
cgaugcgacgcacc

SEQ ID NO: 3005819 - RNA, 15 nt, Mycobacterium avium subsp. paratuberculosis
cgaugcgaucgauga

SEQ ID NO: 3005820 - RNA, 18 nt, Mycobacterium avium subsp. paratuberculosis
cgaugcgcaccaucaccu

SEQ ID NO: 3005821 - RNA, 19 nt, Mycobacterium avium subsp. paratuberculosis
cgaugcgcaccaucaccug

SEQ ID NO: 3005822 - RNA, 19 nt, Mycobacterium avium subsp. paratuberculosis
cgaugcgcaccgugccgcc

SEQ ID NO: 3005823 - RNA, 20 nt, Mycobacterium avium subsp. paratuberculosis
cgaugcgcacgucggccgcc

SEQ ID NO: 3005824 - RNA, 12 nt, Mycobacterium avium subsp. paratuberculosis
cgaugcgcagca

SEQ ID NO: 3005825 - RNA, 13 nt, Mycobacterium avium subsp. paratuberculosis
cgaugcgcagcag

SEQ ID NO: 3005826 - RNA, 15 nt, Mycobacterium avium subsp. paratuberculosis
cgaugcgcagcagcg

SEQ ID NO: 3005827 - RNA, 17 nt, Mycobacterium avium subsp. paratuberculosis
cgaugcgcagcagcggc

SEQ ID NO: 3005828 - RNA, 18 nt, Mycobacterium avium subsp. paratuberculosis
cgaugcgcccgcgccacc

SEQ ID NO: 3005829 - RNA, 15 nt, Mycobacterium avium subsp. paratuberculosis
cgaugcgcccgcugc

SEQ ID NO: 3005830 - RNA, 16 nt, Mycobacterium avium subsp. paratuberculosis
cgaugcgccgcaccag

SEQ ID NO: 3005831 - RNA, 12 nt, Mycobacterium avium subsp. paratuberculosis
cgaugcgcgcca

SEQ ID NO: 3005832 - RNA, 13 nt, Mycobacterium avium subsp. paratuberculosis
cgaugcgcggccc

SEQ ID NO: 3005833 - RNA, 14 nt, Mycobacterium avium subsp. paratuberculosis
cgaugcgcggcccg

SEQ ID NO: 3005834 - RNA, 15 nt, Mycobacterium avium subsp. paratuberculosis
cgaugcgcggcccgu

SEQ ID NO: 3005835 - RNA, 20 nt, Mycobacterium avium subsp. paratuberculosis
cgaugcgcgguaacagagcg

SEQ ID NO: 3005836 - RNA, 14 nt, Mycobacterium avium subsp. paratuberculosis
cgaugcgcgugacg

SEQ ID NO: 3005837 - RNA, 16 nt, Mycobacterium avium subsp. paratuberculosis
cgaugcgcgugacgcg

SEQ ID NO: 3005838 - RNA, 17 nt, Mycobacterium avium subsp. paratuberculosis
cgaugcgcuccagcagg

SEQ ID NO: 3005839 - RNA, 22 nt, Mycobacterium avium subsp. paratuberculosis
cgaugcgcuccagcaggcuggc

SEQ ID NO: 3005840 - RNA, 14 nt, Mycobacterium avium subsp. paratuberculosis
cgaugcgcucgccg

SEQ ID NO: 3005841 - RNA, 15 nt, Mycobacterium avium subsp. paratuberculosis
cgaugcgcucgccga

SEQ ID NO: 3005842 - RNA, 17 nt, Mycobacterium avium subsp. paratuberculosis
cgaugcgcucgccgauc

SEQ ID NO: 3005843 - RNA, 18 nt, Mycobacterium avium subsp. paratuberculosis
cgaugcgcucgccgaucu

SEQ ID NO: 3005844 - RNA, 13 nt, Mycobacterium avium subsp. paratuberculosis
cgaugcgcucggc

SEQ ID NO: 3005845 - RNA, 19 nt, Mycobacterium avium subsp. paratuberculosis
cgaugcgcucggcgaccug

SEQ ID NO: 3005846 - RNA, 14 nt, Mycobacterium avium subsp. paratuberculosis
cgaugcgcugcugu

SEQ ID NO: 3005847 - RNA, 17 nt, Mycobacterium avium subsp. paratuberculosis
cgaugcgcugugcgggu

SEQ ID NO: 3005848 - RNA, 23 nt, Mycobacterium avium subsp. paratuberculosis
cgaugcggaucucggugccggug

SEQ ID NO: 3005849 - RNA, 12 nt, Mycobacterium avium subsp. paratuberculosis
cgaugcggcccg

SEQ ID NO: 3005850 - RNA, 14 nt, Mycobacterium avium subsp. paratuberculosis
cgaugcggcccggc

SEQ ID NO: 3005851 - RNA, 16 nt, Mycobacterium avium subsp. paratuberculosis
cgaugcggccggcggg

SEQ ID NO: 3005852 - RNA, 12 nt, Mycobacterium avium subsp. paratuberculosis
cgaugcggccgu

SEQ ID NO: 3005853 - RNA, 17 nt, Mycobacterium avium subsp. paratuberculosis
cgaugcggcucaccagg

SEQ ID NO: 3005854 - RNA, 12 nt, Mycobacterium avium subsp. paratuberculosis
cgaugcgggcca

SEQ ID NO: 3005855 - RNA, 13 nt, Mycobacterium avium subsp. paratuberculosis
cgaugcgggcccg

SEQ ID NO: 3005856 - RNA, 14 nt, Mycobacterium avium subsp. paratuberculosis
cgaugcgggcgccg

SEQ ID NO: 3005857 - RNA, 15 nt, Mycobacterium avium subsp. paratuberculosis
cgaugcgggcgccga

SEQ ID NO: 3005858 - RNA, 17 nt, Mycobacterium avium subsp. paratuberculosis
cgaugcgggcgccgaac

SEQ ID NO: 3005859 - RNA, 21 nt, Mycobacterium avium subsp. paratuberculosis
cgaugcgggcgccgaacgucg

SEQ ID NO: 3005860 - RNA, 14 nt, Mycobacterium avium subsp. paratuberculosis
cgaugcggggccgg

SEQ ID NO: 3005861 - RNA, 15 nt, Mycobacterium avium subsp. paratuberculosis
cgaugcggggccggc

SEQ ID NO: 3005862 - RNA, 18 nt, Mycobacterium avium subsp. paratuberculosis
cgaugcggggccggcggc

SEQ ID NO: 3005863 - RNA, 13 nt, Mycobacterium avium subsp. paratuberculosis
cgaugcggggcgg

SEQ ID NO: 3005864 - RNA, 21 nt, Mycobacterium avium subsp. paratuberculosis
cgaugcggguguugcgcagcg

SEQ ID NO: 3005865 - RNA, 23 nt, Mycobacterium avium subsp. paratuberculosis
cgaugcggguguugcgcagcguc

SEQ ID NO: 3005866 - RNA, 14 nt, Mycobacterium avium subsp. paratuberculosis
cgaugcggucccgc

SEQ ID NO: 3005867 - RNA, 17 nt, Mycobacterium avium subsp. paratuberculosis
cgaugcggugccgggcc

SEQ ID NO: 3005868 - RNA, 18 nt, Mycobacterium avium subsp. paratuberculosis
cgaugcggugccgggugc

SEQ ID NO: 3005869 - RNA, 15 nt, Mycobacterium avium subsp. paratuberculosis
cgaugcuauucgggc

SEQ ID NO: 3005870 - RNA, 16 nt, Mycobacterium avium subsp. paratuberculosis
cgaugcuauucgggcc

SEQ ID NO: 3005871 - RNA, 16 nt, Mycobacterium avium subsp. paratuberculosis
cgaugcucccggucgu

SEQ ID NO: 3005872 - RNA, 22 nt, Mycobacterium avium subsp. paratuberculosis
cgaugcugagcgggucggccgg

SEQ ID NO: 3005873 - RNA, 20 nt, Mycobacterium avium subsp. paratuberculosis
cgaugcugauacccgcgcgg

SEQ ID NO: 3005874 - RNA, 22 nt, Mycobacterium avium subsp. paratuberculosis
cgaugcugauacccgcgcggcg

SEQ ID NO: 3005875 - RNA, 23 nt, Mycobacterium avium subsp. paratuberculosis
cgaugcugauacccgcgcggcgc

SEQ ID NO: 3005876 - RNA, 17 nt, Mycobacterium avium subsp. paratuberculosis
cgaugcuggccaucgcc

SEQ ID NO: 3005877 - RNA, 22 nt, Mycobacterium avium subsp. paratuberculosis
cgaugcuucccauuucggcgaa

SEQ ID NO: 3005878 - RNA, 20 nt, Mycobacterium avium subsp. paratuberculosis
cgauggaagcgcccgcgcgc

SEQ ID NO: 3005879 - RNA, 20 nt, Mycobacterium avium subsp. paratuberculosis
cgauggaauucgucggcggu

SEQ ID NO: 3005880 - RNA, 22 nt, Mycobacterium avium subsp. paratuberculosis
cgauggaauucgucggcggugu

SEQ ID NO: 3005881 - RNA, 15 nt, Mycobacterium avium subsp. paratuberculosis
cgauggacaggcacu

SEQ ID NO: 3005882 - RNA, 17 nt, Mycobacterium avium subsp. paratuberculosis
cgauggacaggcacucg

SEQ ID NO: 3005883 - RNA, 14 nt, Mycobacterium avium subsp. paratuberculosis
cgauggacagggcg

SEQ ID NO: 3005884 - RNA, 17 nt, Mycobacterium avium subsp. paratuberculosis
cgauggacagggcgaca

SEQ ID NO: 3005885 - RNA, 14 nt, Mycobacterium avium subsp. paratuberculosis
cgauggacgcggug

SEQ ID NO: 3005886 - RNA, 17 nt, Mycobacterium avium subsp. paratuberculosis
cgauggacgcgguggug

SEQ ID NO: 3005887 - RNA, 17 nt, Mycobacterium avium subsp. paratuberculosis
cgauggacguccagcgg

SEQ ID NO: 3005888 - RNA, 17 nt, Mycobacterium avium subsp. paratuberculosis
cgauggaggugccgcgc

SEQ ID NO: 3005889 - RNA, 23 nt, Mycobacterium avium subsp. paratuberculosis
cgauggaggugccgcgcagcacc

SEQ ID NO: 3005890 - RNA, 14 nt, Mycobacterium avium subsp. paratuberculosis
cgauggaguagcug

SEQ ID NO: 3005891 - RNA, 17 nt, Mycobacterium avium subsp. paratuberculosis
cgauggcaacgccgguc

SEQ ID NO: 3005892 - RNA, 16 nt, Mycobacterium avium subsp. paratuberculosis
cgauggccaccagguc

SEQ ID NO: 3005893 - RNA, 16 nt, Mycobacterium avium subsp. paratuberculosis
cgauggccaccgggcg

SEQ ID NO: 3005894 - RNA, 23 nt, Mycobacterium avium subsp. paratuberculosis
cgauggccacgcucucgccgguc

SEQ ID NO: 3005895 - RNA, 17 nt, Mycobacterium avium subsp. paratuberculosis
cgauggccaggcccagc

SEQ ID NO: 3005896 - RNA, 22 nt, Mycobacterium avium subsp. paratuberculosis
cgauggccaggcccagcccggc

SEQ ID NO: 3005897 - RNA, 14 nt, Mycobacterium avium subsp. paratuberculosis
cgauggccaucguc

SEQ ID NO: 3005898 - RNA, 20 nt, Mycobacterium avium subsp. paratuberculosis
cgauggccauggccaggaac

SEQ ID NO: 3005899 - RNA, 13 nt, Mycobacterium avium subsp. paratuberculosis
cgauggcccaggc

SEQ ID NO: 3005900 - RNA, 16 nt, Mycobacterium avium subsp. paratuberculosis
cgauggcccaggccgc

SEQ ID NO: 3005901 - RNA, 21 nt, Mycobacterium avium subsp. paratuberculosis
cgauggcccaggccgcggucg

SEQ ID NO: 3005902 - RNA, 13 nt, Mycobacterium avium subsp. paratuberculosis
cgauggcccgcgc

SEQ ID NO: 3005903 - RNA, 16 nt, Mycobacterium avium subsp. paratuberculosis
cgauggcccgcucggu

SEQ ID NO: 3005904 - RNA, 17 nt, Mycobacterium avium subsp. paratuberculosis
cgauggcccgcugcgcc

SEQ ID NO: 3005905 - RNA, 18 nt, Mycobacterium avium subsp. paratuberculosis
cgauggcccgcugcgccg

SEQ ID NO: 3005906 - RNA, 19 nt, Mycobacterium avium subsp. paratuberculosis
cgauggcccgcugcgccga

SEQ ID NO: 3005907 - RNA, 20 nt, Mycobacterium avium subsp. paratuberculosis
cgauggcccgcugcgccgac

SEQ ID NO: 3005908 - RNA, 18 nt, Mycobacterium avium subsp. paratuberculosis
cgauggcccggaccgccg

SEQ ID NO: 3005909 - RNA, 19 nt, Mycobacterium avium subsp. paratuberculosis
cgauggcccgggccacacc

SEQ ID NO: 3005910 - RNA, 14 nt, Mycobacterium avium subsp. paratuberculosis
cgauggccgacaac

SEQ ID NO: 3005911 - RNA, 12 nt, Mycobacterium avium subsp. paratuberculosis
cgauggccgccc

SEQ ID NO: 3005912 - RNA, 14 nt, Mycobacterium avium subsp. paratuberculosis
cgauggccgcccgc

SEQ ID NO: 3005913 - RNA, 18 nt, Mycobacterium avium subsp. paratuberculosis
cgauggccucgucgcgga

SEQ ID NO: 3005914 - RNA, 18 nt, Mycobacterium avium subsp. paratuberculosis
cgauggccuucuggaagc

SEQ ID NO: 3005915 - RNA, 17 nt, Mycobacterium avium subsp. paratuberculosis
cgauggcgaccgcgcag

SEQ ID NO: 3005916 - RNA, 22 nt, Mycobacterium avium subsp. paratuberculosis
cgauggcgaccgcgcaggcggc

SEQ ID NO: 3005917 - RNA, 11 nt, Mycobacterium avium subsp. paratuberculosis
cgauggcgacg

SEQ ID NO: 3005918 - RNA, 19 nt, Mycobacterium avium subsp. paratuberculosis
cgauggcgacggucugccg

SEQ ID NO: 3005919 - RNA, 19 nt, Mycobacterium avium subsp. paratuberculosis
cgauggcgcccagcgucuc

SEQ ID NO: 3005920 - RNA, 23 nt, Mycobacterium avium subsp. paratuberculosis
cgauggcgcccagcgucucggcg

SEQ ID NO: 3005921 - RNA, 17 nt, Mycobacterium avium subsp. paratuberculosis
cgauggcgccgaucgcg

SEQ ID NO: 3005922 - RNA, 21 nt, Mycobacterium avium subsp. paratuberculosis
cgauggcgccgaucgcgcgca

SEQ ID NO: 3005923 - RNA, 13 nt, Mycobacterium avium subsp. paratuberculosis
cgauggcgcggcc

SEQ ID NO: 3005924 - RNA, 14 nt, Mycobacterium avium subsp. paratuberculosis
cgauggcgcggccg

SEQ ID NO: 3005925 - RNA, 15 nt, Mycobacterium avium subsp. paratuberculosis
cgauggcgcggccgg

SEQ ID NO: 3005926 - RNA, 16 nt, Mycobacterium avium subsp. paratuberculosis
cgauggcgcggccggc

SEQ ID NO: 3005927 - RNA, 21 nt, Mycobacterium avium subsp. paratuberculosis
cgauggcgcggccggccgaca

SEQ ID NO: 3005928 - RNA, 18 nt, Mycobacterium avium subsp. paratuberculosis
cgauggcgcggcgcaccg

SEQ ID NO: 3005929 - RNA, 14 nt, Mycobacterium avium subsp. paratuberculosis
cgauggcgcuggcc

SEQ ID NO: 3005930 - RNA, 16 nt, Mycobacterium avium subsp. paratuberculosis
cgauggcgcuggccgc

SEQ ID NO: 3005931 - RNA, 12 nt, Mycobacterium avium subsp. paratuberculosis
cgauggcggccu

SEQ ID NO: 3005932 - RNA, 14 nt, Mycobacterium avium subsp. paratuberculosis
cgauggcggccugc

SEQ ID NO: 3005933 - RNA, 18 nt, Mycobacterium avium subsp. paratuberculosis
cgauggcggccugcagga

SEQ ID NO: 3005934 - RNA, 17 nt, Mycobacterium avium subsp. paratuberculosis
cgauggcggcgcgcucg

SEQ ID NO: 3005935 - RNA, 20 nt, Mycobacterium avium subsp. paratuberculosis
cgauggcggcgcgcucgucg

SEQ ID NO: 3005936 - RNA, 22 nt, Mycobacterium avium subsp. paratuberculosis
cgauggcggcgcgcucgucguc

SEQ ID NO: 3005937 - RNA, 19 nt, Mycobacterium avium subsp. paratuberculosis
cgauggcggcggcccgccg

SEQ ID NO: 3005938 - RNA, 20 nt, Mycobacterium avium subsp. paratuberculosis
cgauggcggcggcccgccgc

SEQ ID NO: 3005939 - RNA, 14 nt, Mycobacterium avium subsp. paratuberculosis
cgauggcggcggcu

SEQ ID NO: 3005940 - RNA, 15 nt, Mycobacterium avium subsp. paratuberculosis
cgauggcggcggcug

SEQ ID NO: 3005941 - RNA, 17 nt, Mycobacterium avium subsp. paratuberculosis
cgauggcggcgucgagu

SEQ ID NO: 3005942 - RNA, 23 nt, Mycobacterium avium subsp. paratuberculosis
cgauggcggcgugcagucccaga

SEQ ID NO: 3005943 - RNA, 13 nt, Mycobacterium avium subsp. paratuberculosis
cgauggcgggccg

SEQ ID NO: 3005944 - RNA, 17 nt, Mycobacterium avium subsp. paratuberculosis
cgauggcgggccgcuuc

SEQ ID NO: 3005945 - RNA, 22 nt, Mycobacterium avium subsp. paratuberculosis
cgauggcgggccgcuucgaggu

SEQ ID NO: 3005946 - RNA, 13 nt, Mycobacterium avium subsp. paratuberculosis
cgauggcgggcgc

SEQ ID NO: 3005947 - RNA, 15 nt, Mycobacterium avium subsp. paratuberculosis
cgauggcgggcgcgc

SEQ ID NO: 3005948 - RNA, 17 nt, Mycobacterium avium subsp. paratuberculosis
cgauggcgggcgcgccg

SEQ ID NO: 3005949 - RNA, 18 nt, Mycobacterium avium subsp. paratuberculosis
cgauggcgguccaccacc

SEQ ID NO: 3005950 - RNA, 21 nt, Mycobacterium avium subsp. paratuberculosis
cgauggcgguccaccaccaca

SEQ ID NO: 3005951 - RNA, 13 nt, Mycobacterium avium subsp. paratuberculosis
cgauggcggugug

SEQ ID NO: 3005952 - RNA, 15 nt, Mycobacterium avium subsp. paratuberculosis
cgauggcggugugga

SEQ ID NO: 3005953 - RNA, 18 nt, Mycobacterium avium subsp. paratuberculosis
cgauggcguagcggguca

SEQ ID NO: 3005954 - RNA, 12 nt, Mycobacterium avium subsp. paratuberculosis
cgauggcgugcc

SEQ ID NO: 3005955 - RNA, 18 nt, Mycobacterium avium subsp. paratuberculosis
cgauggcgugccggcgcu

SEQ ID NO: 3005956 - RNA, 22 nt, Mycobacterium avium subsp. paratuberculosis
cgauggcucgcgggggccgcga

SEQ ID NO: 3005957 - RNA, 21 nt, Mycobacterium avium subsp. paratuberculosis
cgaugggaaccgcucggcucg

SEQ ID NO: 3005958 - RNA, 19 nt, Mycobacterium avium subsp. paratuberculosis
cgaugggcaauaccggcag

SEQ ID NO: 3005959 - RNA, 20 nt, Mycobacterium avium subsp. paratuberculosis
cgaugggcaauaccggcagc

SEQ ID NO: 3005960 - RNA, 21 nt, Mycobacterium avium subsp. paratuberculosis
cgaugggcaauaccggcagca

SEQ ID NO: 3005961 - RNA, 13 nt, Mycobacterium avium subsp. paratuberculosis
cgaugggccgccc

SEQ ID NO: 3005962 - RNA, 23 nt, Mycobacterium avium subsp. paratuberculosis
cgaugggcgcgaucaggcugccg

SEQ ID NO: 3005963 - RNA, 13 nt, Mycobacterium avium subsp. paratuberculosis
cgaugggcucgag

SEQ ID NO: 3005964 - RNA, 14 nt, Mycobacterium avium subsp. paratuberculosis
cgaugggcucgagc

SEQ ID NO: 3005965 - RNA, 18 nt, Mycobacterium avium subsp. paratuberculosis
cgauggggacgucgacgu

SEQ ID NO: 3005966 - RNA, 21 nt, Mycobacterium avium subsp. paratuberculosis
cgauggggauggugcgccggg

SEQ ID NO: 3005967 - RNA, 22 nt, Mycobacterium avium subsp. paratuberculosis
cgauggggauggugcgccgggu

SEQ ID NO: 3005968 - RNA, 19 nt, Mycobacterium avium subsp. paratuberculosis
cgaugggggugccgcagcg

SEQ ID NO: 3005969 - RNA, 15 nt, Mycobacterium avium subsp. paratuberculosis
cgaugggugaucgcg

SEQ ID NO: 3005970 - RNA, 21 nt, Mycobacterium avium subsp. paratuberculosis
cgaugggugaucgcggcccgc

SEQ ID NO: 3005971 - RNA, 23 nt, Mycobacterium avium subsp. paratuberculosis
cgauggguguggcgucgaugccg

SEQ ID NO: 3005972 - RNA, 17 nt, Mycobacterium avium subsp. paratuberculosis
cgauggguuggccgucg

SEQ ID NO: 3005973 - RNA, 18 nt, Mycobacterium avium subsp. paratuberculosis
cgauggguuggccgucgc

SEQ ID NO: 3005974 - RNA, 21 nt, Mycobacterium avium subsp. paratuberculosis
cgaugguauccgaucgcggcc

SEQ ID NO: 3005975 - RNA, 15 nt, Mycobacterium avium subsp. paratuberculosis
cgauggucagcugcc

SEQ ID NO: 3005976 - RNA, 18 nt, Mycobacterium avium subsp. paratuberculosis
cgauggucagcugccgca

SEQ ID NO: 3005977 - RNA, 19 nt, Mycobacterium avium subsp. paratuberculosis
cgauggucagcugccgcac

SEQ ID NO: 3005978 - RNA, 20 nt, Mycobacterium avium subsp. paratuberculosis
cgauggucagcugccgcacc

SEQ ID NO: 3005979 - RNA, 22 nt, Mycobacterium avium subsp. paratuberculosis
cgauggucagcugccgcaccgc

SEQ ID NO: 3005980 - RNA, 13 nt, Mycobacterium avium subsp. paratuberculosis
cgauggucgucgg

SEQ ID NO: 3005981 - RNA, 15 nt, Mycobacterium avium subsp. paratuberculosis
cgauggucgucgggu

SEQ ID NO: 3005982 - RNA, 23 nt, Mycobacterium avium subsp. paratuberculosis
cgauggucugcccgccgccgaug

SEQ ID NO: 3005983 - RNA, 20 nt, Mycobacterium avium subsp. paratuberculosis
cgauggugaaccacuucugg

SEQ ID NO: 3005984 - RNA, 23 nt, Mycobacterium avium subsp. paratuberculosis
cgauggugaagccgugcacgccg

SEQ ID NO: 3005985 - RNA, 17 nt, Mycobacterium avium subsp. paratuberculosis
cgauggugacggugccg

SEQ ID NO: 3005986 - RNA, 20 nt, Mycobacterium avium subsp. paratuberculosis
cgauggugacggugccgccg

SEQ ID NO: 3005987 - RNA, 21 nt, Mycobacterium avium subsp. paratuberculosis
cgauggugaugugcggcgcgg

SEQ ID NO: 3005988 - RNA, 23 nt, Mycobacterium avium subsp. paratuberculosis
cgauggugaugugcggcgcggcg

SEQ ID NO: 3005989 - RNA, 13 nt, Mycobacterium avium subsp. paratuberculosis
cgauggugccgcc

SEQ ID NO: 3005990 - RNA, 14 nt, Mycobacterium avium subsp. paratuberculosis
cgauggugccgccg

SEQ ID NO: 3005991 - RNA, 20 nt, Mycobacterium avium subsp. paratuberculosis
cgauggugccgucggcggga

SEQ ID NO: 3005992 - RNA, 13 nt, Mycobacterium avium subsp. paratuberculosis
cgauggugcugcc

SEQ ID NO: 3005993 - RNA, 18 nt, Mycobacterium avium subsp. paratuberculosis
cgauggugcugcccggcg

SEQ ID NO: 3005994 - RNA, 15 nt, Mycobacterium avium subsp. paratuberculosis
cgaugguggcgcugc

SEQ ID NO: 3005995 - RNA, 17 nt, Mycobacterium avium subsp. paratuberculosis
cgaugguggcgcugccg

SEQ ID NO: 3005996 - RNA, 15 nt, Mycobacterium avium subsp. paratuberculosis
cgaugguggucgccg

SEQ ID NO: 3005997 - RNA, 19 nt, Mycobacterium avium subsp. paratuberculosis
cgaugguggucgccgucgu

SEQ ID NO: 3005998 - RNA, 19 nt, Mycobacterium avium subsp. paratuberculosis
cgaugguguagccgugccc

SEQ ID NO: 3005999 - RNA, 20 nt, Mycobacterium avium subsp. paratuberculosis
cgaugguguagccgugcccc

SEQ ID NO: 3006000 - RNA, 21 nt, Mycobacterium avium subsp. paratuberculosis
cgaugguguagccgugcccca

SEQ ID NO: 3006001 - RNA, 21 nt, Mycobacterium avium subsp. paratuberculosis
cgaugguguaguccugcuuca

SEQ ID NO: 3006002 - RNA, 23 nt, Mycobacterium avium subsp. paratuberculosis
cgaugguguaguccugcuucagc

SEQ ID NO: 3006003 - RNA, 17 nt, Mycobacterium avium subsp. paratuberculosis
cgauguacugggccguc

SEQ ID NO: 3006004 - RNA, 19 nt, Mycobacterium avium subsp. paratuberculosis
cgauguagcggacgggccg

SEQ ID NO: 3006005 - RNA, 23 nt, Mycobacterium avium subsp. paratuberculosis
cgauguagcggacgggccgcauc

SEQ ID NO: 3006006 - RNA, 15 nt, Mycobacterium avium subsp. paratuberculosis
cgauguaggacaggu

SEQ ID NO: 3006007 - RNA, 19 nt, Mycobacterium avium subsp. paratuberculosis
cgauguaggacaggucgcg

SEQ ID NO: 3006008 - RNA, 15 nt, Mycobacterium avium subsp. paratuberculosis
cgauguaggacgccg

SEQ ID NO: 3006009 - RNA, 16 nt, Mycobacterium avium subsp. paratuberculosis
cgauguaggacgccgc

SEQ ID NO: 3006010 - RNA, 21 nt, Mycobacterium avium subsp. paratuberculosis
cgauguaggacgccgcaccgc

SEQ ID NO: 3006011 - RNA, 22 nt, Mycobacterium avium subsp. paratuberculosis
cgauguaggacgccgcaccgca

SEQ ID NO: 3006012 - RNA, 16 nt, Mycobacterium avium subsp. paratuberculosis
cgauguaggugcgcga

SEQ ID NO: 3006013 - RNA, 23 nt, Mycobacterium avium subsp. paratuberculosis
cgauguccagguaggcguugauc

SEQ ID NO: 3006014 - RNA, 23 nt, Mycobacterium avium subsp. paratuberculosis
cgauguccccgcgggugacgcug

SEQ ID NO: 3006015 - RNA, 14 nt, Mycobacterium avium subsp. paratuberculosis
cgauguccgacagc

SEQ ID NO: 3006016 - RNA, 14 nt, Mycobacterium avium subsp. paratuberculosis
cgauguccgccggc

SEQ ID NO: 3006017 - RNA, 15 nt, Mycobacterium avium subsp. paratuberculosis
cgauguccgccggcc

SEQ ID NO: 3006018 - RNA, 17 nt, Mycobacterium avium subsp. paratuberculosis
cgauguccgccggccgg

SEQ ID NO: 3006019 - RNA, 16 nt, Mycobacterium avium subsp. paratuberculosis
cgaugucgacccgcgg

SEQ ID NO: 3006020 - RNA, 19 nt, Mycobacterium avium subsp. paratuberculosis
cgaugucgacccgcggcgc

SEQ ID NO: 3006021 - RNA, 13 nt, Mycobacterium avium subsp. paratuberculosis
cgaugucgacgcc

SEQ ID NO: 3006022 - RNA, 14 nt, Mycobacterium avium subsp. paratuberculosis
cgaugucgacgccg

SEQ ID NO: 3006023 - RNA, 17 nt, Mycobacterium avium subsp. paratuberculosis
cgaugucgacgccgugc

SEQ ID NO: 3006024 - RNA, 21 nt, Mycobacterium avium subsp. paratuberculosis
cgaugucgacgccgugcugcc

SEQ ID NO: 3006025 - RNA, 12 nt, Mycobacterium avium subsp. paratuberculosis
cgaugucgacgg

SEQ ID NO: 3006026 - RNA, 13 nt, Mycobacterium avium subsp. paratuberculosis
cgaugucgacgga

SEQ ID NO: 3006027 - RNA, 13 nt, Mycobacterium avium subsp. paratuberculosis
cgaugucgacggu

SEQ ID NO: 3006028 - RNA, 23 nt, Mycobacterium avium subsp. paratuberculosis
cgaugucgacgguuugcccggcg

SEQ ID NO: 3006029 - RNA, 21 nt, Mycobacterium avium subsp. paratuberculosis
cgaugucgaugacggcggcgc

SEQ ID NO: 3006030 - RNA, 16 nt, Mycobacterium avium subsp. paratuberculosis
cgaugucgcccggcgc

SEQ ID NO: 3006031 - RNA, 17 nt, Mycobacterium avium subsp. paratuberculosis
cgaugucgcccggcgcg

SEQ ID NO: 3006032 - RNA, 18 nt, Mycobacterium avium subsp. paratuberculosis
cgaugucgcccggcgcgg

SEQ ID NO: 3006033 - RNA, 19 nt, Mycobacterium avium subsp. paratuberculosis
cgaugucgccggcgaccgc

SEQ ID NO: 3006034 - RNA, 13 nt, Mycobacterium avium subsp. paratuberculosis
cgaugucggccag

SEQ ID NO: 3006035 - RNA, 20 nt, Mycobacterium avium subsp. paratuberculosis
cgaugucggccagcgcggcg

SEQ ID NO: 3006036 - RNA, 15 nt, Mycobacterium avium subsp. paratuberculosis
cgaugucggcgaacc

SEQ ID NO: 3006037 - RNA, 14 nt, Mycobacterium avium subsp. paratuberculosis
cgaugucggcuucg

SEQ ID NO: 3006038 - RNA, 15 nt, Mycobacterium avium subsp. paratuberculosis
cgaugucgggcaccu

SEQ ID NO: 3006039 - RNA, 15 nt, Mycobacterium avium subsp. paratuberculosis
cgaugucggugcggc

SEQ ID NO: 3006040 - RNA, 17 nt, Mycobacterium avium subsp. paratuberculosis
cgaugucggugcggccg

SEQ ID NO: 3006041 - RNA, 15 nt, Mycobacterium avium subsp. paratuberculosis
cgaugucgguggcgc

SEQ ID NO: 3006042 - RNA, 17 nt, Mycobacterium avium subsp. paratuberculosis
cgaugucgguggcgcgc

SEQ ID NO: 3006043 - RNA, 15 nt, Mycobacterium avium subsp. paratuberculosis
cgaugucggugggcc

SEQ ID NO: 3006044 - RNA, 19 nt, Mycobacterium avium subsp. paratuberculosis
cgaugucggugggccgcac

SEQ ID NO: 3006045 - RNA, 20 nt, Mycobacterium avium subsp. paratuberculosis
cgaugucggugggccgcacc

SEQ ID NO: 3006046 - RNA, 13 nt, Mycobacterium avium subsp. paratuberculosis
cgaugucgguggu

SEQ ID NO: 3006047 - RNA, 14 nt, Mycobacterium avium subsp. paratuberculosis
cgaugucgucgaac

SEQ ID NO: 3006048 - RNA, 17 nt, Mycobacterium avium subsp. paratuberculosis
cgaugucgucgaacgcg

SEQ ID NO: 3006049 - RNA, 21 nt, Mycobacterium avium subsp. paratuberculosis
cgaugucgucgaacgcggcga

SEQ ID NO: 3006050 - RNA, 13 nt, Mycobacterium avium subsp. paratuberculosis
cgaugucgucgac

SEQ ID NO: 3006051 - RNA, 14 nt, Mycobacterium avium subsp. paratuberculosis
cgaugucgucgacg

SEQ ID NO: 3006052 - RNA, 13 nt, Mycobacterium avium subsp. paratuberculosis
cgaugucgucgau

SEQ ID NO: 3006053 - RNA, 14 nt, Mycobacterium avium subsp. paratuberculosis
cgaugucgucgaug

SEQ ID NO: 3006054 - RNA, 16 nt, Mycobacterium avium subsp. paratuberculosis
cgaugucgucgccggu

SEQ ID NO: 3006055 - RNA, 19 nt, Mycobacterium avium subsp. paratuberculosis
cgaugucgucgccgguggc

SEQ ID NO: 3006056 - RNA, 21 nt, Mycobacterium avium subsp. paratuberculosis
cgaugucgucgucgacgcuga

SEQ ID NO: 3006057 - RNA, 22 nt, Mycobacterium avium subsp. paratuberculosis
cgaugucugaucgcguagcgcc

SEQ ID NO: 3006058 - RNA, 13 nt, Mycobacterium avium subsp. paratuberculosis
cgaugugaucgcg

SEQ ID NO: 3006059 - RNA, 16 nt, Mycobacterium avium subsp. paratuberculosis
cgaugugaucggcggc

SEQ ID NO: 3006060 - RNA, 17 nt, Mycobacterium avium subsp. paratuberculosis
cgaugugaucggcggcc

SEQ ID NO: 3006061 - RNA, 18 nt, Mycobacterium avium subsp. paratuberculosis
cgaugugaucggcggcca

SEQ ID NO: 3006062 - RNA, 20 nt, Mycobacterium avium subsp. paratuberculosis
cgaugugaucggcggccacc

SEQ ID NO: 3006063 - RNA, 13 nt, Mycobacterium avium subsp. paratuberculosis
cgaugugcgcgcu

SEQ ID NO: 3006064 - RNA, 14 nt, Mycobacterium avium subsp. paratuberculosis
cgaugugcgcgcug

SEQ ID NO: 3006065 - RNA, 16 nt, Mycobacterium avium subsp. paratuberculosis
cgaugugcgcgcuggc

SEQ ID NO: 3006066 - RNA, 20 nt, Mycobacterium avium subsp. paratuberculosis
cgaugugcgcgcuggccgcg

SEQ ID NO: 3006067 - RNA, 21 nt, Mycobacterium avium subsp. paratuberculosis
cgaugugcgcgcuggccgcgu

SEQ ID NO: 3006068 - RNA, 21 nt, Mycobacterium avium subsp. paratuberculosis
cgaugugcucggucaacccga

SEQ ID NO: 3006069 - RNA, 18 nt, Mycobacterium avium subsp. paratuberculosis
cgauguggacgaugcggg

SEQ ID NO: 3006070 - RNA, 13 nt, Mycobacterium avium subsp. paratuberculosis
cgauguggccggc

SEQ ID NO: 3006071 - RNA, 15 nt, Mycobacterium avium subsp. paratuberculosis
cgauguggccggcga

SEQ ID NO: 3006072 - RNA, 21 nt, Mycobacterium avium subsp. paratuberculosis
cgauguggccggcgauggcgc

SEQ ID NO: 3006073 - RNA, 21 nt, Mycobacterium avium subsp. paratuberculosis
cgauguggguggucagcgcgg

SEQ ID NO: 3006074 - RNA, 22 nt, Mycobacterium avium subsp. paratuberculosis
cgauguggguggucagcgcggu

SEQ ID NO: 3006075 - RNA, 15 nt, Mycobacterium avium subsp. paratuberculosis
cgauguucaccccga

SEQ ID NO: 3006076 - RNA, 15 nt, Mycobacterium avium subsp. paratuberculosis
cgauguugaucgcca

SEQ ID NO: 3006077 - RNA, 21 nt, Mycobacterium avium subsp. paratuberculosis
cgauguugaucgccaugcugg

SEQ ID NO: 3006078 - RNA, 15 nt, Mycobacterium avium subsp. paratuberculosis
cgauguuggcgacga

SEQ ID NO: 3006079 - RNA, 16 nt, Mycobacterium avium subsp. paratuberculosis
cgauuacgaccaguuc

SEQ ID NO: 3006080 - RNA, 23 nt, Mycobacterium avium subsp. paratuberculosis
cgauuaggucgguggccaccacc

SEQ ID NO: 3006081 - RNA, 17 nt, Mycobacterium avium subsp. paratuberculosis
cgauucacccagcgagc

SEQ ID NO: 3006082 - RNA, 19 nt, Mycobacterium avium subsp. paratuberculosis
cgauucagccggcgggcgc

SEQ ID NO: 3006083 - RNA, 17 nt, Mycobacterium avium subsp. paratuberculosis
cgauuccccggcguguc

SEQ ID NO: 3006084 - RNA, 16 nt, Mycobacterium avium subsp. paratuberculosis
cgauucccgccggaug

SEQ ID NO: 3006085 - RNA, 14 nt, Mycobacterium avium subsp. paratuberculosis
cgauuccggccggc

SEQ ID NO: 3006086 - RNA, 17 nt, Mycobacterium avium subsp. paratuberculosis
cgauuccggccggccgc

SEQ ID NO: 3006087 - RNA, 20 nt, Mycobacterium avium subsp. paratuberculosis
cgauuccggccggccgccgg

SEQ ID NO: 3006088 - RNA, 14 nt, Mycobacterium avium subsp. paratuberculosis
cgauuccucggacc

SEQ ID NO: 3006089 - RNA, 15 nt, Mycobacterium avium subsp. paratuberculosis
cgauucgcgaucaac

SEQ ID NO: 3006090 - RNA, 17 nt, Mycobacterium avium subsp. paratuberculosis
cgauucgcggccaccac

SEQ ID NO: 3006091 - RNA, 18 nt, Mycobacterium avium subsp. paratuberculosis
cgauucgcggccaccacc

SEQ ID NO: 3006092 - RNA, 18 nt, Mycobacterium avium subsp. paratuberculosis
cgauucggcgccgcgacc

SEQ ID NO: 3006093 - RNA, 20 nt, Mycobacterium avium subsp. paratuberculosis
cgauucggcgccgcgacccc

SEQ ID NO: 3006094 - RNA, 23 nt, Mycobacterium avium subsp. paratuberculosis
cgauucgguaccagggcagcgcc

SEQ ID NO: 3006095 - RNA, 12 nt, Mycobacterium avium subsp. paratuberculosis
cgauucgucguc

SEQ ID NO: 3006096 - RNA, 18 nt, Mycobacterium avium subsp. paratuberculosis
cgauucucgcugcggcgc

SEQ ID NO: 3006097 - RNA, 22 nt, Mycobacterium avium subsp. paratuberculosis
cgauugcaccaccgucuugccg

SEQ ID NO: 3006098 - RNA, 12 nt, Mycobacterium avium subsp. paratuberculosis
cgauugccgcgg

SEQ ID NO: 3006099 - RNA, 15 nt, Mycobacterium avium subsp. paratuberculosis
cgauugccgcggccg

SEQ ID NO: 3006100 - RNA, 16 nt, Mycobacterium avium subsp. paratuberculosis
cgauugccgcggccgc

SEQ ID NO: 3006101 - RNA, 13 nt, Mycobacterium avium subsp. paratuberculosis
cgauugcggccgc

SEQ ID NO: 3006102 - RNA, 14 nt, Mycobacterium avium subsp. paratuberculosis
cgauugcggccgcc

SEQ ID NO: 3006103 - RNA, 15 nt, Mycobacterium avium subsp. paratuberculosis
cgauugcggccgccg

SEQ ID NO: 3006104 - RNA, 21 nt, Mycobacterium avium subsp. paratuberculosis
cgauugucgcugcgaggcggg

SEQ ID NO: 3006105 - RNA, 17 nt, Mycobacterium avium subsp. paratuberculosis
cgauugucggggccgca

SEQ ID NO: 3006106 - RNA, 15 nt, Mycobacterium avium subsp. paratuberculosis
cgauuucgcggccga

SEQ ID NO: 3006107 - RNA, 17 nt, Mycobacterium avium subsp. paratuberculosis
cgauuucggccgugauc

SEQ ID NO: 3006108 - RNA, 13 nt, Mycobacterium avium subsp. paratuberculosis
cgauuucgggauc

SEQ ID NO: 3006109 - RNA, 18 nt, Mycobacterium avium subsp. paratuberculosis
cgcaaaacggugcggccu

SEQ ID NO: 3006110 - RNA, 20 nt, Mycobacterium avium subsp. paratuberculosis
cgcaaaacggugcggccucg

SEQ ID NO: 3006111 - RNA, 23 nt, Mycobacterium avium subsp. paratuberculosis
cgcaaagacauucggggccacca

SEQ ID NO: 3006112 - RNA, 13 nt, Mycobacterium avium subsp. paratuberculosis
cgcaaagcaccgc

SEQ ID NO: 3006113 - RNA, 15 nt, Mycobacterium avium subsp. paratuberculosis
cgcaacaacuucgcg

SEQ ID NO: 3006114 - RNA, 14 nt, Mycobacterium avium subsp. paratuberculosis
cgcaacaccacguc

SEQ ID NO: 3006115 - RNA, 16 nt, Mycobacterium avium subsp. paratuberculosis
cgcaacaccacgucgg

SEQ ID NO: 3006116 - RNA, 18 nt, Mycobacterium avium subsp. paratuberculosis
cgcaacaccacgucggug

SEQ ID NO: 3006117 - RNA, 20 nt, Mycobacterium avium subsp. paratuberculosis
cgcaacaccacgucggugcc

SEQ ID NO: 3006118 - RNA, 14 nt, Mycobacterium avium subsp. paratuberculosis
cgcaacaccagcac

SEQ ID NO: 3006119 - RNA, 15 nt, Mycobacterium avium subsp. paratuberculosis
cgcaacaccagcacg

SEQ ID NO: 3006120 - RNA, 16 nt, Mycobacterium avium subsp. paratuberculosis
cgcaacaccgaaagcc

SEQ ID NO: 3006121 - RNA, 20 nt, Mycobacterium avium subsp. paratuberculosis
cgcaacaccgaaagccgaca

SEQ ID NO: 3006122 - RNA, 15 nt, Mycobacterium avium subsp. paratuberculosis
cgcaacaccucggcg

SEQ ID NO: 3006123 - RNA, 16 nt, Mycobacterium avium subsp. paratuberculosis
cgcaacacggccucga

SEQ ID NO: 3006124 - RNA, 22 nt, Mycobacterium avium subsp. paratuberculosis
cgcaacagcaccucgucgcccg

SEQ ID NO: 3006125 - RNA, 20 nt, Mycobacterium avium subsp. paratuberculosis
cgcaacagcauuucgcgcgg

SEQ ID NO: 3006126 - RNA, 16 nt, Mycobacterium avium subsp. paratuberculosis
cgcaacagccggcccg

SEQ ID NO: 3006127 - RNA, 13 nt, Mycobacterium avium subsp. paratuberculosis
cgcaacagcgagu

SEQ ID NO: 3006128 - RNA, 22 nt, Mycobacterium avium subsp. paratuberculosis
cgcaacagguuucgcucgucgg

SEQ ID NO: 3006129 - RNA, 18 nt, Mycobacterium avium subsp. paratuberculosis
cgcaaccacugauccguc

SEQ ID NO: 3006130 - RNA, 18 nt, Mycobacterium avium subsp. paratuberculosis
cgcaaccacuuucgcgag

SEQ ID NO: 3006131 - RNA, 16 nt, Mycobacterium avium subsp. paratuberculosis
cgcaaccgccggcagc

SEQ ID NO: 3006132 - RNA, 17 nt, Mycobacterium avium subsp. paratuberculosis
cgcaaccgccggcagcg

SEQ ID NO: 3006133 - RNA, 19 nt, Mycobacterium avium subsp. paratuberculosis
cgcaaccgccggcagcggc

SEQ ID NO: 3006134 - RNA, 16 nt, Mycobacterium avium subsp. paratuberculosis
cgcaaccgcggcggcg

SEQ ID NO: 3006135 - RNA, 19 nt, Mycobacterium avium subsp. paratuberculosis
cgcaaccgcggcggcggcc

SEQ ID NO: 3006136 - RNA, 22 nt, Mycobacterium avium subsp. paratuberculosis
cgcaaccgcggcggcggcccgu

SEQ ID NO: 3006137 - RNA, 14 nt, Mycobacterium avium subsp. paratuberculosis
cgcaaccgggccgc

SEQ ID NO: 3006138 - RNA, 15 nt, Mycobacterium avium subsp. paratuberculosis
cgcaaccgggccgca

SEQ ID NO: 3006139 - RNA, 17 nt, Mycobacterium avium subsp. paratuberculosis
cgcaaccgggccgcacc

SEQ ID NO: 3006140 - RNA, 20 nt, Mycobacterium avium subsp. paratuberculosis
cgcaaccgggccgcaccccc

SEQ ID NO: 3006141 - RNA, 22 nt, Mycobacterium avium subsp. paratuberculosis
cgcaaccgggccgcacccccuc

SEQ ID NO: 3006142 - RNA, 20 nt, Mycobacterium avium subsp. paratuberculosis
cgcaaccgguccaguccggc

SEQ ID NO: 3006143 - RNA, 18 nt, Mycobacterium avium subsp. paratuberculosis
cgcaaccguucaacggcc

SEQ ID NO: 3006144 - RNA, 19 nt, Mycobacterium avium subsp. paratuberculosis
cgcaaccguucaacggcca

SEQ ID NO: 3006145 - RNA, 18 nt, Mycobacterium avium subsp. paratuberculosis
cgcaaccuucuuggccgg

SEQ ID NO: 3006146 - RNA, 21 nt, Mycobacterium avium subsp. paratuberculosis
cgcaaccuucuuggccggagc

SEQ ID NO: 3006147 - RNA, 13 nt, Mycobacterium avium subsp. paratuberculosis
cgcaacgagcuga

SEQ ID NO: 3006148 - RNA, 15 nt, Mycobacterium avium subsp. paratuberculosis
cgcaacgagcugacg

SEQ ID NO: 3006149 - RNA, 22 nt, Mycobacterium avium subsp. paratuberculosis
cgcaacgagcugacgaacgcgc

SEQ ID NO: 3006150 - RNA, 16 nt, Mycobacterium avium subsp. paratuberculosis
cgcaacgaggcggugg

SEQ ID NO: 3006151 - RNA, 23 nt, Mycobacterium avium subsp. paratuberculosis
cgcaacgaggcgguggugaugga

SEQ ID NO: 3006152 - RNA, 19 nt, Mycobacterium avium subsp. paratuberculosis
cgcaacgauucacccagcg

SEQ ID NO: 3006153 - RNA, 22 nt, Mycobacterium avium subsp. paratuberculosis
cgcaacgccggcgugcacaggc

SEQ ID NO: 3006154 - RNA, 15 nt, Mycobacterium avium subsp. paratuberculosis
cgcaacgcgcgcgac

SEQ ID NO: 3006155 - RNA, 17 nt, Mycobacterium avium subsp. paratuberculosis
cgcaacgcgcgcgacgg

SEQ ID NO: 3006156 - RNA, 21 nt, Mycobacterium avium subsp. paratuberculosis
cgcaacgcgcgcgacggcgcg

SEQ ID NO: 3006157 - RNA, 14 nt, Mycobacterium avium subsp. paratuberculosis
cgcaacgcggcggu

SEQ ID NO: 3006158 - RNA, 15 nt, Mycobacterium avium subsp. paratuberculosis
cgcaacggcggucgu

SEQ ID NO: 3006159 - RNA, 23 nt, Mycobacterium avium subsp. paratuberculosis
cgcaacggcggucgugcggcugc

SEQ ID NO: 3006160 - RNA, 13 nt, Mycobacterium avium subsp. paratuberculosis
cgcaacggcgucg

SEQ ID NO: 3006161 - RNA, 15 nt, Mycobacterium avium subsp. paratuberculosis
cgcaacggcgucgac

SEQ ID NO: 3006162 - RNA, 16 nt, Mycobacterium avium subsp. paratuberculosis
cgcaacggcucccagg

SEQ ID NO: 3006163 - RNA, 15 nt, Mycobacterium avium subsp. paratuberculosis
cgcaacgggccgcag

SEQ ID NO: 3006164 - RNA, 16 nt, Mycobacterium avium subsp. paratuberculosis
cgcaacgggccgcagc

SEQ ID NO: 3006165 - RNA, 18 nt, Mycobacterium avium subsp. paratuberculosis
cgcaacgggccgcagccg

SEQ ID NO: 3006166 - RNA, 20 nt, Mycobacterium avium subsp. paratuberculosis
cgcaacgggccgcagccgcg

SEQ ID NO: 3006167 - RNA, 15 nt, Mycobacterium avium subsp. paratuberculosis
cgcaacgugcgccgg

SEQ ID NO: 3006168 - RNA, 16 nt, Mycobacterium avium subsp. paratuberculosis
cgcaacgugcgccggc

SEQ ID NO: 3006169 - RNA, 17 nt, Mycobacterium avium subsp. paratuberculosis
cgcaacgugcgccggcc

SEQ ID NO: 3006170 - RNA, 19 nt, Mycobacterium avium subsp. paratuberculosis
cgcaacguguacucggcgu

SEQ ID NO: 3006171 - RNA, 16 nt, Mycobacterium avium subsp. paratuberculosis
cgcaacucguccacca

SEQ ID NO: 3006172 - RNA, 22 nt, Mycobacterium avium subsp. paratuberculosis
cgcaacucguccaccagcucga

SEQ ID NO: 3006173 - RNA, 16 nt, Mycobacterium avium subsp. paratuberculosis
cgcaacucguccagcg

SEQ ID NO: 3006174 - RNA, 19 nt, Mycobacterium avium subsp. paratuberculosis
cgcaacucguccagcgucg

SEQ ID NO: 3006175 - RNA, 18 nt, Mycobacterium avium subsp. paratuberculosis
cgcaacuggguggucaca

SEQ ID NO: 3006176 - RNA, 21 nt, Mycobacterium avium subsp. paratuberculosis
cgcaacuguucgcggcuggcc

SEQ ID NO: 3006177 - RNA, 15 nt, Mycobacterium avium subsp. paratuberculosis
cgcaacuugcccgac

SEQ ID NO: 3006178 - RNA, 13 nt, Mycobacterium avium subsp. paratuberculosis
cgcaagcaccggc

SEQ ID NO: 3006179 - RNA, 17 nt, Mycobacterium avium subsp. paratuberculosis
cgcaagcaccggcuggc

SEQ ID NO: 3006180 - RNA, 20 nt, Mycobacterium avium subsp. paratuberculosis
cgcaagcaccggcuggccga

SEQ ID NO: 3006181 - RNA, 15 nt, Mycobacterium avium subsp. paratuberculosis
cgcaagcagagcagc

SEQ ID NO: 3006182 - RNA, 15 nt, Mycobacterium avium subsp. paratuberculosis
cgcaaggccgccagc

SEQ ID NO: 3006183 - RNA, 14 nt, Mycobacterium avium subsp. paratuberculosis
cgcaagggccgaca

SEQ ID NO: 3006184 - RNA, 20 nt, Mycobacterium avium subsp. paratuberculosis
cgcaagggccgacaucgucg

SEQ ID NO: 3006185 - RNA, 21 nt, Mycobacterium avium subsp. paratuberculosis
cgcaaggugauucgcgcggcg

SEQ ID NO: 3006186 - RNA, 22 nt, Mycobacterium avium subsp. paratuberculosis
cgcaaggugauucgcgcggcgc

SEQ ID NO: 3006187 - RNA, 13 nt, Mycobacterium avium subsp. paratuberculosis
cgcaagugcgguc

SEQ ID NO: 3006188 - RNA, 17 nt, Mycobacterium avium subsp. paratuberculosis
cgcaauacccgaccagc

SEQ ID NO: 3006189 - RNA, 14 nt, Mycobacterium avium subsp. paratuberculosis
cgcaauacggugcc

SEQ ID NO: 3006190 - RNA, 20 nt, Mycobacterium avium subsp. paratuberculosis
cgcaauacggugcccgccgc

SEQ ID NO: 3006191 - RNA, 14 nt, Mycobacterium avium subsp. paratuberculosis
cgcaauccugcccg

SEQ ID NO: 3006192 - RNA, 16 nt, Mycobacterium avium subsp. paratuberculosis
cgcaauccugcccggu

SEQ ID NO: 3006193 - RNA, 23 nt, Mycobacterium avium subsp. paratuberculosis
cgcaauccugcccggucugcggc

SEQ ID NO: 3006194 - RNA, 22 nt, Mycobacterium avium subsp. paratuberculosis
cgcaauccuguuccccggcggg

SEQ ID NO: 3006195 - RNA, 15 nt, Mycobacterium avium subsp. paratuberculosis
cgcaaucggcgccgg

SEQ ID NO: 3006196 - RNA, 21 nt, Mycobacterium avium subsp. paratuberculosis
cgcaaucggggccgacccgca

SEQ ID NO: 3006197 - RNA, 16 nt, Mycobacterium avium subsp. paratuberculosis
cgcaaugccgccgcga

SEQ ID NO: 3006198 - RNA, 19 nt, Mycobacterium avium subsp. paratuberculosis
cgcaaugccgccgcgacga

SEQ ID NO: 3006199 - RNA, 22 nt, Mycobacterium avium subsp. paratuberculosis
cgcaaugcgucgcggcggcgcu

SEQ ID NO: 3006200 - RNA, 14 nt, Mycobacterium avium subsp. paratuberculosis
cgcaauggcgaaca

SEQ ID NO: 3006201 - RNA, 18 nt, Mycobacterium avium subsp. paratuberculosis
cgcacaacagacgaucac

SEQ ID NO: 3006202 - RNA, 15 nt, Mycobacterium avium subsp. paratuberculosis
cgcacaacccgcccg

SEQ ID NO: 3006203 - RNA, 17 nt, Mycobacterium avium subsp. paratuberculosis
cgcacaacccggacagc

SEQ ID NO: 3006204 - RNA, 15 nt, Mycobacterium avium subsp. paratuberculosis
cgcacaaccgggcca

SEQ ID NO: 3006205 - RNA, 16 nt, Mycobacterium avium subsp. paratuberculosis
cgcacaaccgggccaa

SEQ ID NO: 3006206 - RNA, 19 nt, Mycobacterium avium subsp. paratuberculosis
cgcacaaccgggccaacgg

SEQ ID NO: 3006207 - RNA, 13 nt, Mycobacterium avium subsp. paratuberculosis
cgcacaacgaggc

SEQ ID NO: 3006208 - RNA, 14 nt, Mycobacterium avium subsp. paratuberculosis
cgcacaacgaggcc

SEQ ID NO: 3006209 - RNA, 22 nt, Mycobacterium avium subsp. paratuberculosis
cgcacaacgaggcccggacggc

SEQ ID NO: 3006210 - RNA, 17 nt, Mycobacterium avium subsp. paratuberculosis
cgcacaauccggucagc

SEQ ID NO: 3006211 - RNA, 16 nt, Mycobacterium avium subsp. paratuberculosis
cgcacaauucggucag

SEQ ID NO: 3006212 - RNA, 13 nt, Mycobacterium avium subsp. paratuberculosis
cgcacaccaccac

SEQ ID NO: 3006213 - RNA, 17 nt, Mycobacterium avium subsp. paratuberculosis
cgcacaccagcacggcg

SEQ ID NO: 3006214 - RNA, 19 nt, Mycobacterium avium subsp. paratuberculosis
cgcacaccagcacggcggc

SEQ ID NO: 3006215 - RNA, 20 nt, Mycobacterium avium subsp. paratuberculosis
cgcacaccagcacggcggcg

SEQ ID NO: 3006216 - RNA, 13 nt, Mycobacterium avium subsp. paratuberculosis
cgcacaccgcgcg

SEQ ID NO: 3006217 - RNA, 16 nt, Mycobacterium avium subsp. paratuberculosis
cgcacaccgcggcggc

SEQ ID NO: 3006218 - RNA, 17 nt, Mycobacterium avium subsp. paratuberculosis
cgcacaccgcggcggcg

SEQ ID NO: 3006219 - RNA, 23 nt, Mycobacterium avium subsp. paratuberculosis
cgcacaccgcggcggcgucggcg

SEQ ID NO: 3006220 - RNA, 15 nt, Mycobacterium avium subsp. paratuberculosis
cgcacaccugcauca

SEQ ID NO: 3006221 - RNA, 15 nt, Mycobacterium avium subsp. paratuberculosis
cgcacacggccucgc

SEQ ID NO: 3006222 - RNA, 23 nt, Mycobacterium avium subsp. paratuberculosis
cgcacacuuccgggaagucgucg

SEQ ID NO: 3006223 - RNA, 18 nt, Mycobacterium avium subsp. paratuberculosis
cgcacagauacgcgacga

SEQ ID NO: 3006224 - RNA, 19 nt, Mycobacterium avium subsp. paratuberculosis
cgcacagauacgcgacgaa

SEQ ID NO: 3006225 - RNA, 20 nt, Mycobacterium avium subsp. paratuberculosis
cgcacagaucgucucggcca

SEQ ID NO: 3006226 - RNA, 21 nt, Mycobacterium avium subsp. paratuberculosis
cgcacagaucgucucggccag

SEQ ID NO: 3006227 - RNA, 22 nt, Mycobacterium avium subsp. paratuberculosis
cgcacagaucgucucggccagc

SEQ ID NO: 3006228 - RNA, 13 nt, Mycobacterium avium subsp. paratuberculosis
cgcacagcaccag

SEQ ID NO: 3006229 - RNA, 14 nt, Mycobacterium avium subsp. paratuberculosis
cgcacagcaccagu

SEQ ID NO: 3006230 - RNA, 23 nt, Mycobacterium avium subsp. paratuberculosis
cgcacagcaccaguugcaccggc

SEQ ID NO: 3006231 - RNA, 14 nt, Mycobacterium avium subsp. paratuberculosis
cgcacagccgcagc

SEQ ID NO: 3006232 - RNA, 19 nt, Mycobacterium avium subsp. paratuberculosis
cgcacagccgcagcagccg

SEQ ID NO: 3006233 - RNA, 13 nt, Mycobacterium avium subsp. paratuberculosis
cgcacagccggcg

SEQ ID NO: 3006234 - RNA, 15 nt, Mycobacterium avium subsp. paratuberculosis
cgcacagccggcgcg

SEQ ID NO: 3006235 - RNA, 16 nt, Mycobacterium avium subsp. paratuberculosis
cgcacagccggcgcgc

SEQ ID NO: 3006236 - RNA, 14 nt, Mycobacterium avium subsp. paratuberculosis
cgcacagccggcgg

SEQ ID NO: 3006237 - RNA, 15 nt, Mycobacterium avium subsp. paratuberculosis
cgcacagccggcggc

SEQ ID NO: 3006238 - RNA, 21 nt, Mycobacterium avium subsp. paratuberculosis
cgcacagccggcggcggcggu

SEQ ID NO: 3006239 - RNA, 12 nt, Mycobacterium avium subsp. paratuberculosis
cgcacagcgcca

SEQ ID NO: 3006240 - RNA, 17 nt, Mycobacterium avium subsp. paratuberculosis
cgcacagcgccacaccg

SEQ ID NO: 3006241 - RNA, 16 nt, Mycobacterium avium subsp. paratuberculosis
cgcacagcgccgcguu

SEQ ID NO: 3006242 - RNA, 20 nt, Mycobacterium avium subsp. paratuberculosis
cgcacagcuaggucguggcg

SEQ ID NO: 3006243 - RNA, 23 nt, Mycobacterium avium subsp. paratuberculosis
cgcacagcuaggucguggcgccg

SEQ ID NO: 3006244 - RNA, 16 nt, Mycobacterium avium subsp. paratuberculosis
cgcacagcuuucgggc

SEQ ID NO: 3006245 - RNA, 19 nt, Mycobacterium avium subsp. paratuberculosis
cgcacagcuuucgggcggc

SEQ ID NO: 3006246 - RNA, 13 nt, Mycobacterium avium subsp. paratuberculosis
cgcacaggaacgc

SEQ ID NO: 3006247 - RNA, 19 nt, Mycobacterium avium subsp. paratuberculosis
cgcacaggaacgcgucgac

SEQ ID NO: 3006248 - RNA, 20 nt, Mycobacterium avium subsp. paratuberculosis
cgcacaggaacgcgucgacc

SEQ ID NO: 3006249 - RNA, 22 nt, Mycobacterium avium subsp. paratuberculosis
cgcacaggaacgcgucgaccgc

SEQ ID NO: 3006250 - RNA, 17 nt, Mycobacterium avium subsp. paratuberculosis
cgcacaucacgguggcc

SEQ ID NO: 3006251 - RNA, 23 nt, Mycobacterium avium subsp. paratuberculosis
cgcacaucacgguggccgccacc

SEQ ID NO: 3006252 - RNA, 14 nt, Mycobacterium avium subsp. paratuberculosis
cgcacaucguggcg

SEQ ID NO: 3006253 - RNA, 19 nt, Mycobacterium avium subsp. paratuberculosis
cgcacaucguggcgacgac

SEQ ID NO: 3006254 - RNA, 19 nt, Mycobacterium avium subsp. paratuberculosis
cgcaccaaagugccguuga

SEQ ID NO: 3006255 - RNA, 21 nt, Mycobacterium avium subsp. paratuberculosis
cgcaccaaagugccguugagc

SEQ ID NO: 3006256 - RNA, 17 nt, Mycobacterium avium subsp. paratuberculosis
cgcaccacccagcccuu

SEQ ID NO: 3006257 - RNA, 19 nt, Mycobacterium avium subsp. paratuberculosis
cgcaccacccagcccuugg

SEQ ID NO: 3006258 - RNA, 21 nt, Mycobacterium avium subsp. paratuberculosis
cgcaccacccagcccuuggcg

SEQ ID NO: 3006259 - RNA, 22 nt, Mycobacterium avium subsp. paratuberculosis
cgcaccacccagcccuuggcga

SEQ ID NO: 3006260 - RNA, 16 nt, Mycobacterium avium subsp. paratuberculosis
cgcaccaccgcccgga

SEQ ID NO: 3006261 - RNA, 21 nt, Mycobacterium avium subsp. paratuberculosis
cgcaccaccgcccggaccggc

SEQ ID NO: 3006262 - RNA, 16 nt, Mycobacterium avium subsp. paratuberculosis
cgcaccaccgcgguga

SEQ ID NO: 3006263 - RNA, 15 nt, Mycobacterium avium subsp. paratuberculosis
cgcaccaccucggcg

SEQ ID NO: 3006264 - RNA, 22 nt, Mycobacterium avium subsp. paratuberculosis
cgcaccacgaccuccgugccga

SEQ ID NO: 3006265 - RNA, 15 nt, Mycobacterium avium subsp. paratuberculosis
cgcaccacgagcagc

SEQ ID NO: 3006266 - RNA, 23 nt, Mycobacterium avium subsp. paratuberculosis
cgcaccacgagcagccgaucugg

SEQ ID NO: 3006267 - RNA, 13 nt, Mycobacterium avium subsp. paratuberculosis
cgcaccacgcccg

SEQ ID NO: 3006268 - RNA, 20 nt, Mycobacterium avium subsp. paratuberculosis
cgcaccacgguggcgccgcg

SEQ ID NO: 3006269 - RNA, 22 nt, Mycobacterium avium subsp. paratuberculosis
cgcaccacgguggcgccgcgca

SEQ ID NO: 3006270 - RNA, 24 nt, Mycobacterium avium subsp. paratuberculosis
cgcaccacgguggcgccgcgcagc

SEQ ID NO: 3006271 - RNA, 14 nt, Mycobacterium avium subsp. paratuberculosis
cgcaccacgucggg

SEQ ID NO: 3006272 - RNA, 17 nt, Mycobacterium avium subsp. paratuberculosis
cgcaccagaucgucggg

SEQ ID NO: 3006273 - RNA, 20 nt, Mycobacterium avium subsp. paratuberculosis
cgcaccagaucgucgggcac

SEQ ID NO: 3006274 - RNA, 21 nt, Mycobacterium avium subsp. paratuberculosis
cgcaccagauucaccagcgcc

SEQ ID NO: 3006275 - RNA, 13 nt, Mycobacterium avium subsp. paratuberculosis
cgcaccagcaccc

SEQ ID NO: 3006276 - RNA, 18 nt, Mycobacterium avium subsp. paratuberculosis
cgcaccagcaccccgccg

SEQ ID NO: 3006277 - RNA, 12 nt, Mycobacterium avium subsp. paratuberculosis
cgcaccagcagg

SEQ ID NO: 3006278 - RNA, 16 nt, Mycobacterium avium subsp. paratuberculosis
cgcaccagcaggucca

SEQ ID NO: 3006279 - RNA, 21 nt, Mycobacterium avium subsp. paratuberculosis
cgcaccagcucgaggccgcgg

SEQ ID NO: 3006280 - RNA, 22 nt, Mycobacterium avium subsp. paratuberculosis
cgcaccagcucgaggccgcggg

SEQ ID NO: 3006281 - RNA, 23 nt, Mycobacterium avium subsp. paratuberculosis
cgcaccagcucgaggccgcgggc

SEQ ID NO: 3006282 - RNA, 21 nt, Mycobacterium avium subsp. paratuberculosis
cgcaccagcucggcgcugucg

SEQ ID NO: 3006283 - RNA, 21 nt, Mycobacterium avium subsp. paratuberculosis
cgcaccagcugauucgcggug

SEQ ID NO: 3006284 - RNA, 15 nt, Mycobacterium avium subsp. paratuberculosis
cgcaccaggccgacg

SEQ ID NO: 3006285 - RNA, 23 nt, Mycobacterium avium subsp. paratuberculosis
cgcaccaggccgacgcuggccga

SEQ ID NO: 3006286 - RNA, 14 nt, Mycobacterium avium subsp. paratuberculosis
cgcaccaggcgcca

SEQ ID NO: 3006287 - RNA, 18 nt, Mycobacterium avium subsp. paratuberculosis
cgcaccaggcgccacagc

SEQ ID NO: 3006288 - RNA, 16 nt, Mycobacterium avium subsp. paratuberculosis
cgcaccagggccgcga

SEQ ID NO: 3006289 - RNA, 18 nt, Mycobacterium avium subsp. paratuberculosis
cgcaccagggccgcgagc

SEQ ID NO: 3006290 - RNA, 19 nt, Mycobacterium avium subsp. paratuberculosis
cgcaccagggccgcgagcg

SEQ ID NO: 3006291 - RNA, 18 nt, Mycobacterium avium subsp. paratuberculosis
cgcaccagggccugcagc

SEQ ID NO: 3006292 - RNA, 19 nt, Mycobacterium avium subsp. paratuberculosis
cgcaccagggccugcagca

SEQ ID NO: 3006293 - RNA, 20 nt, Mycobacterium avium subsp. paratuberculosis
cgcaccagggccugcagcac

SEQ ID NO: 3006294 - RNA, 21 nt, Mycobacterium avium subsp. paratuberculosis
cgcaccagggccugcagcacc

SEQ ID NO: 3006295 - RNA, 22 nt, Mycobacterium avium subsp. paratuberculosis
cgcaccagggccugcagcacca

SEQ ID NO: 3006296 - RNA, 20 nt, Mycobacterium avium subsp. paratuberculosis
cgcaccagggugucgucgcg

SEQ ID NO: 3006297 - RNA, 22 nt, Mycobacterium avium subsp. paratuberculosis
cgcaccagguagguggccgucg

SEQ ID NO: 3006298 - RNA, 13 nt, Mycobacterium avium subsp. paratuberculosis
cgcaccaucaccu

SEQ ID NO: 3006299 - RNA, 15 nt, Mycobacterium avium subsp. paratuberculosis
cgcaccaucaccugu

SEQ ID NO: 3006300 - RNA, 16 nt, Mycobacterium avium subsp. paratuberculosis
cgcaccauccgcgacg

SEQ ID NO: 3006301 - RNA, 14 nt, Mycobacterium avium subsp. paratuberculosis
cgcacccagccgca

SEQ ID NO: 3006302 - RNA, 15 nt, Mycobacterium avium subsp. paratuberculosis
cgcacccagccgcau

SEQ ID NO: 3006303 - RNA, 17 nt, Mycobacterium avium subsp. paratuberculosis
cgcacccagcgggcgac

SEQ ID NO: 3006304 - RNA, 17 nt, Mycobacterium avium subsp. paratuberculosis
cgcaccccacccgcgcg

SEQ ID NO: 3006305 - RNA, 18 nt, Mycobacterium avium subsp. paratuberculosis
cgcaccccacccgcgcga

SEQ ID NO: 3006306 - RNA, 19 nt, Mycobacterium avium subsp. paratuberculosis
cgcaccccacccgcgcgac

SEQ ID NO: 3006307 - RNA, 15 nt, Mycobacterium avium subsp. paratuberculosis
cgcaccccaccgaca

SEQ ID NO: 3006308 - RNA, 17 nt, Mycobacterium avium subsp. paratuberculosis
cgcaccccaccgacagc

SEQ ID NO: 3006309 - RNA, 19 nt, Mycobacterium avium subsp. paratuberculosis
cgcaccccaccgacagccg

SEQ ID NO: 3006310 - RNA, 16 nt, Mycobacterium avium subsp. paratuberculosis
cgcacccccagcucga

SEQ ID NO: 3006311 - RNA, 19 nt, Mycobacterium avium subsp. paratuberculosis
cgcacccccagcucgacga

SEQ ID NO: 3006312 - RNA, 16 nt, Mycobacterium avium subsp. paratuberculosis
cgcacccccuccacac

SEQ ID NO: 3006313 - RNA, 21 nt, Mycobacterium avium subsp. paratuberculosis
cgcacccccuccacacggcag

SEQ ID NO: 3006314 - RNA, 14 nt, Mycobacterium avium subsp. paratuberculosis
cgcaccccgaacca

SEQ ID NO: 3006315 - RNA, 15 nt, Mycobacterium avium subsp. paratuberculosis
cgcaccccgaaccag

SEQ ID NO: 3006316 - RNA, 16 nt, Mycobacterium avium subsp. paratuberculosis
cgcaccccgucgcgga

SEQ ID NO: 3006317 - RNA, 12 nt, Mycobacterium avium subsp. paratuberculosis
cgcaccccgugg

SEQ ID NO: 3006318 - RNA, 22 nt, Mycobacterium avium subsp. paratuberculosis
cgcaccccgugguagacgccgg

SEQ ID NO: 3006319 - RNA, 18 nt, Mycobacterium avium subsp. paratuberculosis
cgcaccccguugccgccg

SEQ ID NO: 3006320 - RNA, 20 nt, Mycobacterium avium subsp. paratuberculosis
cgcaccccguugccgccggc

SEQ ID NO: 3006321 - RNA, 21 nt, Mycobacterium avium subsp. paratuberculosis
cgcaccccguugccgccggcg

SEQ ID NO: 3006322 - RNA, 19 nt, Mycobacterium avium subsp. paratuberculosis
cgcacccgauccacggcga

SEQ ID NO: 3006323 - RNA, 12 nt, Mycobacterium avium subsp. paratuberculosis
cgcacccgcggg

SEQ ID NO: 3006324 - RNA, 15 nt, Mycobacterium avium subsp. paratuberculosis
cgcacccgcgggucg

SEQ ID NO: 3006325 - RNA, 16 nt, Mycobacterium avium subsp. paratuberculosis
cgcacccgcgggucgu

SEQ ID NO: 3006326 - RNA, 19 nt, Mycobacterium avium subsp. paratuberculosis
cgcacccgcgggucgucgg

SEQ ID NO: 3006327 - RNA, 21 nt, Mycobacterium avium subsp. paratuberculosis
cgcacccgcgggucgucgggc

SEQ ID NO: 3006328 - RNA, 14 nt, Mycobacterium avium subsp. paratuberculosis
cgcacccgggcagc

SEQ ID NO: 3006329 - RNA, 13 nt, Mycobacterium avium subsp. paratuberculosis
cgcacccgggccc

SEQ ID NO: 3006330 - RNA, 15 nt, Mycobacterium avium subsp. paratuberculosis
cgcacccggucaggu

SEQ ID NO: 3006331 - RNA, 19 nt, Mycobacterium avium subsp. paratuberculosis
cgcacccgguccggcuggu

SEQ ID NO: 3006332 - RNA, 14 nt, Mycobacterium avium subsp. paratuberculosis
cgcacccguaacac

SEQ ID NO: 3006333 - RNA, 21 nt, Mycobacterium avium subsp. paratuberculosis
cgcacccguaacacgaucacc

SEQ ID NO: 3006334 - RNA, 13 nt, Mycobacterium avium subsp. paratuberculosis
cgcacccguucgg

SEQ ID NO: 3006335 - RNA, 18 nt, Mycobacterium avium subsp. paratuberculosis
cgcacccguucggcgucg

SEQ ID NO: 3006336 - RNA, 19 nt, Mycobacterium avium subsp. paratuberculosis
cgcacccguucggcgucga

SEQ ID NO: 3006337 - RNA, 18 nt, Mycobacterium avium subsp. paratuberculosis
cgcacccuugacuaccgc

SEQ ID NO: 3006338 - RNA, 21 nt, Mycobacterium avium subsp. paratuberculosis
cgcacccuugacuaccgcgcc

SEQ ID NO: 3006339 - RNA, 13 nt, Mycobacterium avium subsp. paratuberculosis
cgcaccgaccagc

SEQ ID NO: 3006340 - RNA, 15 nt, Mycobacterium avium subsp. paratuberculosis
cgcaccgaccagcgg

SEQ ID NO: 3006341 - RNA, 18 nt, Mycobacterium avium subsp. paratuberculosis
cgcaccgagaccaugccg

SEQ ID NO: 3006342 - RNA, 19 nt, Mycobacterium avium subsp. paratuberculosis
cgcaccgagaccaugccgc

SEQ ID NO: 3006343 - RNA, 21 nt, Mycobacterium avium subsp. paratuberculosis
cgcaccgagaccaugccgccg

SEQ ID NO: 3006344 - RNA, 22 nt, Mycobacterium avium subsp. paratuberculosis
cgcaccgagaccaugccgccga

SEQ ID NO: 3006345 - RNA, 14 nt, Mycobacterium avium subsp. paratuberculosis
cgcaccgagccugg

SEQ ID NO: 3006346 - RNA, 13 nt, Mycobacterium avium subsp. paratuberculosis
cgcaccgagucgg

SEQ ID NO: 3006347 - RNA, 22 nt, Mycobacterium avium subsp. paratuberculosis
cgcaccgauggguuggccgucg

SEQ ID NO: 3006348 - RNA, 20 nt, Mycobacterium avium subsp. paratuberculosis
cgcaccgcaaagcaccgcga

SEQ ID NO: 3006349 - RNA, 12 nt, Mycobacterium avium subsp. paratuberculosis
cgcaccgccacc

SEQ ID NO: 3006350 - RNA, 13 nt, Mycobacterium avium subsp. paratuberculosis
cgcaccgccaccg

SEQ ID NO: 3006351 - RNA, 14 nt, Mycobacterium avium subsp. paratuberculosis
cgcaccgccaccgc

SEQ ID NO: 3006352 - RNA, 19 nt, Mycobacterium avium subsp. paratuberculosis
cgcaccgccaccgcccgcu

SEQ ID NO: 3006353 - RNA, 16 nt, Mycobacterium avium subsp. paratuberculosis
cgcaccgccaccgcgc

SEQ ID NO: 3006354 - RNA, 14 nt, Mycobacterium avium subsp. paratuberculosis
cgcaccgccagcac

SEQ ID NO: 3006355 - RNA, 15 nt, Mycobacterium avium subsp. paratuberculosis
cgcaccgccagcacc

SEQ ID NO: 3006356 - RNA, 17 nt, Mycobacterium avium subsp. paratuberculosis
cgcaccgccagcaccga

SEQ ID NO: 3006357 - RNA, 13 nt, Mycobacterium avium subsp. paratuberculosis
cgcaccgccccgc

SEQ ID NO: 3006358 - RNA, 15 nt, Mycobacterium avium subsp. paratuberculosis
cgcaccgccccgccc

SEQ ID NO: 3006359 - RNA, 16 nt, Mycobacterium avium subsp. paratuberculosis
cgcaccgcccgcggug

SEQ ID NO: 3006360 - RNA, 19 nt, Mycobacterium avium subsp. paratuberculosis
cgcaccgccgggcauccgg

SEQ ID NO: 3006361 - RNA, 22 nt, Mycobacterium avium subsp. paratuberculosis
cgcaccgccgucggggcgucgg

SEQ ID NO: 3006362 - RNA, 23 nt, Mycobacterium avium subsp. paratuberculosis
cgcaccgccgucggggcgucggc

SEQ ID NO: 3006363 - RNA, 21 nt, Mycobacterium avium subsp. paratuberculosis
cgcaccgccucaugccagacg

SEQ ID NO: 3006364 - RNA, 21 nt, Mycobacterium avium subsp. paratuberculosis
cgcaccgccuccucgaugucg

SEQ ID NO: 3006365 - RNA, 20 nt, Mycobacterium avium subsp. paratuberculosis
cgcaccgccugugcgacggc

SEQ ID NO: 3006366 - RNA, 21 nt, Mycobacterium avium subsp. paratuberculosis
cgcaccgccugugcgacggcg

SEQ ID NO: 3006367 - RNA, 22 nt, Mycobacterium avium subsp. paratuberculosis
cgcaccgccugugcgacggcgu

SEQ ID NO: 3006368 - RNA, 13 nt, Mycobacterium avium subsp. paratuberculosis
cgcaccgcgaccg

SEQ ID NO: 3006369 - RNA, 15 nt, Mycobacterium avium subsp. paratuberculosis
cgcaccgcgaccguc

SEQ ID NO: 3006370 - RNA, 18 nt, Mycobacterium avium subsp. paratuberculosis
cgcaccgcgaccgucauc

SEQ ID NO: 3006371 - RNA, 12 nt, Mycobacterium avium subsp. paratuberculosis
cgcaccgcgacg

SEQ ID NO: 3006372 - RNA, 13 nt, Mycobacterium avium subsp. paratuberculosis
cgcaccgcgagca

SEQ ID NO: 3006373 - RNA, 14 nt, Mycobacterium avium subsp. paratuberculosis
cgcaccgcgcgcca

SEQ ID NO: 3006374 - RNA, 12 nt, Mycobacterium avium subsp. paratuberculosis
cgcaccgcggcc

SEQ ID NO: 3006375 - RNA, 13 nt, Mycobacterium avium subsp. paratuberculosis
cgcaccgcggccu

SEQ ID NO: 3006376 - RNA, 17 nt, Mycobacterium avium subsp. paratuberculosis
cgcaccgcggccucggc

SEQ ID NO: 3006377 - RNA, 18 nt, Mycobacterium avium subsp. paratuberculosis
cgcaccgcggccucggcg

SEQ ID NO: 3006378 - RNA, 13 nt, Mycobacterium avium subsp. paratuberculosis
cgcaccgcggcgg

SEQ ID NO: 3006379 - RNA, 14 nt, Mycobacterium avium subsp. paratuberculosis
cgcaccgcggcggg

SEQ ID NO: 3006380 - RNA, 17 nt, Mycobacterium avium subsp. paratuberculosis
cgcaccgcggcgggguc

SEQ ID NO: 3006381 - RNA, 13 nt, Mycobacterium avium subsp. paratuberculosis
cgcaccgcggcgu

SEQ ID NO: 3006382 - RNA, 15 nt, Mycobacterium avium subsp. paratuberculosis
cgcaccgcggcgugc

SEQ ID NO: 3006383 - RNA, 19 nt, Mycobacterium avium subsp. paratuberculosis
cgcaccgcggcgugcgcca

SEQ ID NO: 3006384 - RNA, 16 nt, Mycobacterium avium subsp. paratuberculosis
cgcaccgcggcgugga

SEQ ID NO: 3006385 - RNA, 20 nt, Mycobacterium avium subsp. paratuberculosis
cgcaccgcgucgaccaccgc

SEQ ID NO: 3006386 - RNA, 16 nt, Mycobacterium avium subsp. paratuberculosis
cgcaccgcgucgaugc

SEQ ID NO: 3006387 - RNA, 20 nt, Mycobacterium avium subsp. paratuberculosis
cgcaccgcgucgaugcgggc

SEQ ID NO: 3006388 - RNA, 14 nt, Mycobacterium avium subsp. paratuberculosis
cgcaccggaaagcu

SEQ ID NO: 3006389 - RNA, 13 nt, Mycobacterium avium subsp. paratuberculosis
cgcaccggcagug

SEQ ID NO: 3006390 - RNA, 21 nt, Mycobacterium avium subsp. paratuberculosis
cgcaccggcagugaucggcgg

SEQ ID NO: 3006391 - RNA, 16 nt, Mycobacterium avium subsp. paratuberculosis
cgcaccggccggcccc

SEQ ID NO: 3006392 - RNA, 21 nt, Mycobacterium avium subsp. paratuberculosis
cgcaccggcgaugcagaucac

SEQ ID NO: 3006393 - RNA, 15 nt, Mycobacterium avium subsp. paratuberculosis
cgcaccggcgccgcc

SEQ ID NO: 3006394 - RNA, 16 nt, Mycobacterium avium subsp. paratuberculosis
cgcaccggcgccgcca

SEQ ID NO: 3006395 - RNA, 16 nt, Mycobacterium avium subsp. paratuberculosis
cgcaccggcgccucga

SEQ ID NO: 3006396 - RNA, 14 nt, Mycobacterium avium subsp. paratuberculosis
cgcaccggcugccc

SEQ ID NO: 3006397 - RNA, 16 nt, Mycobacterium avium subsp. paratuberculosis
cgcaccgggaccagcg

SEQ ID NO: 3006398 - RNA, 17 nt, Mycobacterium avium subsp. paratuberculosis
cgcaccgggaccagcgc

SEQ ID NO: 3006399 - RNA, 21 nt, Mycobacterium avium subsp. paratuberculosis
cgcaccgggaccagcgcggug

SEQ ID NO: 3006400 - RNA, 22 nt, Mycobacterium avium subsp. paratuberculosis
cgcaccgggaccagcgcggugc

SEQ ID NO: 3006401 - RNA, 16 nt, Mycobacterium avium subsp. paratuberculosis
cgcaccgggcccgccc

SEQ ID NO: 3006402 - RNA, 22 nt, Mycobacterium avium subsp. paratuberculosis
cgcaccgggcccgcccgcagcg

SEQ ID NO: 3006403 - RNA, 14 nt, Mycobacterium avium subsp. paratuberculosis
cgcaccggucuccg

SEQ ID NO: 3006404 - RNA, 20 nt, Mycobacterium avium subsp. paratuberculosis
cgcaccgguuugucggcgcc

SEQ ID NO: 3006405 - RNA, 13 nt, Mycobacterium avium subsp. paratuberculosis
cgcaccgucaucg

SEQ ID NO: 3006406 - RNA, 16 nt, Mycobacterium avium subsp. paratuberculosis
cgcaccgucaucgcgg

SEQ ID NO: 3006407 - RNA, 22 nt, Mycobacterium avium subsp. paratuberculosis
cgcaccgucaucgcggcgaaca

SEQ ID NO: 3006408 - RNA, 20 nt, Mycobacterium avium subsp. paratuberculosis
cgcaccgucgugccagcgca

SEQ ID NO: 3006409 - RNA, 19 nt, Mycobacterium avium subsp. paratuberculosis
cgcaccgugccgcccgucg

SEQ ID NO: 3006410 - RNA, 20 nt, Mycobacterium avium subsp. paratuberculosis
cgcaccgugccgcccgucgc

SEQ ID NO: 3006411 - RNA, 18 nt, Mycobacterium avium subsp. paratuberculosis
cgcaccguguagccgacc

SEQ ID NO: 3006412 - RNA, 13 nt, Mycobacterium avium subsp. paratuberculosis
cgcaccgugucgu

SEQ ID NO: 3006413 - RNA, 21 nt, Mycobacterium avium subsp. paratuberculosis
cgcaccgugucgucgcugacg

SEQ ID NO: 3006414 - RNA, 12 nt, Mycobacterium avium subsp. paratuberculosis
cgcaccucgccc

SEQ ID NO: 3006415 - RNA, 15 nt, Mycobacterium avium subsp. paratuberculosis
cgcaccucgcccggc

SEQ ID NO: 3006416 - RNA, 18 nt, Mycobacterium avium subsp. paratuberculosis
cgcaccucgcccggcucg

SEQ ID NO: 3006417 - RNA, 21 nt, Mycobacterium avium subsp. paratuberculosis
cgcaccucgcccggcucgaag

SEQ ID NO: 3006418 - RNA, 17 nt, Mycobacterium avium subsp. paratuberculosis
cgcaccucgccgaucuc

SEQ ID NO: 3006419 - RNA, 14 nt, Mycobacterium avium subsp. paratuberculosis
cgcaccucgccggc

SEQ ID NO: 3006420 - RNA, 15 nt, Mycobacterium avium subsp. paratuberculosis
cgcaccucgccggcc

SEQ ID NO: 3006421 - RNA, 17 nt, Mycobacterium avium subsp. paratuberculosis
cgcaccucgccggccgc

SEQ ID NO: 3006422 - RNA, 19 nt, Mycobacterium avium subsp. paratuberculosis
cgcaccucgccggccgccg

SEQ ID NO: 3006423 - RNA, 19 nt, Mycobacterium avium subsp. paratuberculosis
cgcaccucgcucagcccgg

SEQ ID NO: 3006424 - RNA, 20 nt, Mycobacterium avium subsp. paratuberculosis
cgcaccucgcucagcccgga

SEQ ID NO: 3006425 - RNA, 15 nt, Mycobacterium avium subsp. paratuberculosis
cgcaccucggccggg

SEQ ID NO: 3006426 - RNA, 17 nt, Mycobacterium avium subsp. paratuberculosis
cgcaccucggggcgugg

SEQ ID NO: 3006427 - RNA, 16 nt, Mycobacterium avium subsp. paratuberculosis
cgcaccugaaccgcgc

SEQ ID NO: 3006428 - RNA, 18 nt, Mycobacterium avium subsp. paratuberculosis
cgcaccugaaccgcgcac

SEQ ID NO: 3006429 - RNA, 18 nt, Mycobacterium avium subsp. paratuberculosis
cgcaccugaucgaugccg

SEQ ID NO: 3006430 - RNA, 12 nt, Mycobacterium avium subsp. paratuberculosis
cgcaccugccgu

SEQ ID NO: 3006431 - RNA, 15 nt, Mycobacterium avium subsp. paratuberculosis
cgcaccugccgucga

SEQ ID NO: 3006432 - RNA, 20 nt, Mycobacterium avium subsp. paratuberculosis
cgcaccugccgucgacgacc

SEQ ID NO: 3006433 - RNA, 15 nt, Mycobacterium avium subsp. paratuberculosis
cgcaccugcgcgccg

SEQ ID NO: 3006434 - RNA, 18 nt, Mycobacterium avium subsp. paratuberculosis
cgcaccugcgcgccguug

SEQ ID NO: 3006435 - RNA, 13 nt, Mycobacterium avium subsp. paratuberculosis
cgcaccugcggcc

SEQ ID NO: 3006436 - RNA, 14 nt, Mycobacterium avium subsp. paratuberculosis
cgcaccugcggccc

SEQ ID NO: 3006437 - RNA, 15 nt, Mycobacterium avium subsp. paratuberculosis
cgcaccugcggcccc

SEQ ID NO: 3006438 - RNA, 16 nt, Mycobacterium avium subsp. paratuberculosis
cgcaccugcggccccu

SEQ ID NO: 3006439 - RNA, 18 nt, Mycobacterium avium subsp. paratuberculosis
cgcaccugcggccccugc

SEQ ID NO: 3006440 - RNA, 16 nt, Mycobacterium avium subsp. paratuberculosis
cgcaccugcuccucga

SEQ ID NO: 3006441 - RNA, 18 nt, Mycobacterium avium subsp. paratuberculosis
cgcaccuggcagcauccg

SEQ ID NO: 3006442 - RNA, 22 nt, Mycobacterium avium subsp. paratuberculosis
cgcaccuggcagcauccgccga

SEQ ID NO: 3006443 - RNA, 15 nt, Mycobacterium avium subsp. paratuberculosis
cgcaccuggcgcagc

SEQ ID NO: 3006444 - RNA, 16 nt, Mycobacterium avium subsp. paratuberculosis
cgcaccuggcgcagca

SEQ ID NO: 3006445 - RNA, 21 nt, Mycobacterium avium subsp. paratuberculosis
cgcaccuggucggucagcucg

SEQ ID NO: 3006446 - RNA, 22 nt, Mycobacterium avium subsp. paratuberculosis
cgcaccugguugaacggcaccc

SEQ ID NO: 3006447 - RNA, 14 nt, Mycobacterium avium subsp. paratuberculosis
cgcaccuucccggc

SEQ ID NO: 3006448 - RNA, 15 nt, Mycobacterium avium subsp. paratuberculosis
cgcaccuucccggcc

SEQ ID NO: 3006449 - RNA, 17 nt, Mycobacterium avium subsp. paratuberculosis
cgcaccuucccggccgc

SEQ ID NO: 3006450 - RNA, 13 nt, Mycobacterium avium subsp. paratuberculosis
cgcacgaaaccgc

SEQ ID NO: 3006451 - RNA, 19 nt, Mycobacterium avium subsp. paratuberculosis
cgcacgaaaccgcguggcg

SEQ ID NO: 3006452 - RNA, 15 nt, Mycobacterium avium subsp. paratuberculosis
cgcacgaacggcgcg

SEQ ID NO: 3006453 - RNA, 16 nt, Mycobacterium avium subsp. paratuberculosis
cgcacgaacggcgcga

SEQ ID NO: 3006454 - RNA, 22 nt, Mycobacterium avium subsp. paratuberculosis
cgcacgaacggcgcgaaccggg

SEQ ID NO: 3006455 - RNA, 16 nt, Mycobacterium avium subsp. paratuberculosis
cgcacgaauugccggu

SEQ ID NO: 3006456 - RNA, 19 nt, Mycobacterium avium subsp. paratuberculosis
cgcacgaauugccgguggu

SEQ ID NO: 3006457 - RNA, 19 nt, Mycobacterium avium subsp. paratuberculosis
ugcccaccaccugcuucca

SEQ ID NO: 3006458 - RNA, 15 nt, Mycobacterium avium subsp. paratuberculosis
ugcccaccagcaggu

SEQ ID NO: 3006459 - RNA, 15 nt, Mycobacterium avium subsp. paratuberculosis
ugcccaccagccggc

SEQ ID NO: 3006460 - RNA, 16 nt, Mycobacterium avium subsp. paratuberculosis
ugcccaccagccggcc

SEQ ID NO: 3006461 - RNA, 17 nt, Mycobacterium avium subsp. paratuberculosis
ugcccaccagccggccg

SEQ ID NO: 3006462 - RNA, 20 nt, Mycobacterium avium subsp. paratuberculosis
ugcccaccagccggccggcg

SEQ ID NO: 3006463 - RNA, 22 nt, Mycobacterium avium subsp. paratuberculosis
ugcccaccaucccgccgccgaa

SEQ ID NO: 3006464 - RNA, 23 nt, Mycobacterium avium subsp. paratuberculosis
ugcccaccgggcagccgcacacc

SEQ ID NO: 3006465 - RNA, 13 nt, Mycobacterium avium subsp. paratuberculosis
ugcccacgccguc

SEQ ID NO: 3006466 - RNA, 16 nt, Mycobacterium avium subsp. paratuberculosis
ugcccagauacgccgc

SEQ ID NO: 3006467 - RNA, 17 nt, Mycobacterium avium subsp. paratuberculosis
ugcccagauacgccgcg

SEQ ID NO: 3006468 - RNA, 21 nt, Mycobacterium avium subsp. paratuberculosis
ugcccagauugcggcccuugc

SEQ ID NO: 3006469 - RNA, 17 nt, Mycobacterium avium subsp. paratuberculosis
ugcccagcaccgccggc

SEQ ID NO: 3006470 - RNA, 12 nt, Mycobacterium avium subsp. paratuberculosis
ugcccagcacga

SEQ ID NO: 3006471 - RNA, 15 nt, Mycobacterium avium subsp. paratuberculosis
ugcccagcacgacgc

SEQ ID NO: 3006472 - RNA, 19 nt, Mycobacterium avium subsp. paratuberculosis
ugcccagcaguccggcggu

SEQ ID NO: 3006473 - RNA, 22 nt, Mycobacterium avium subsp. paratuberculosis
ugcccagcaguuuguccugcuc

SEQ ID NO: 3006474 - RNA, 12 nt, Mycobacterium avium subsp. paratuberculosis
ugcccagccgca

SEQ ID NO: 3006475 - RNA, 16 nt, Mycobacterium avium subsp. paratuberculosis
ugcccagccgcaggug

SEQ ID NO: 3006476 - RNA, 20 nt, Mycobacterium avium subsp. paratuberculosis
ugcccagccgcaggugcagc

SEQ ID NO: 3006477 - RNA, 12 nt, Mycobacterium avium subsp. paratuberculosis
ugcccagcgcga

SEQ ID NO: 3006478 - RNA, 19 nt, Mycobacterium avium subsp. paratuberculosis
ugcccagcgcgaggucgac

SEQ ID NO: 3006479 - RNA, 21 nt, Mycobacterium avium subsp. paratuberculosis
ugcccagcgcgaggucgacgg

SEQ ID NO: 3006480 - RNA, 12 nt, Mycobacterium avium subsp. paratuberculosis
ugcccagcgcgc

SEQ ID NO: 3006481 - RNA, 15 nt, Mycobacterium avium subsp. paratuberculosis
ugcccagcgcgcggu

SEQ ID NO: 3006482 - RNA, 17 nt, Mycobacterium avium subsp. paratuberculosis
ugcccagcgcgcggugc

SEQ ID NO: 3006483 - RNA, 22 nt, Mycobacterium avium subsp. paratuberculosis
ugcccagcgcgguaaagucuuc

SEQ ID NO: 3006484 - RNA, 18 nt, Mycobacterium avium subsp. paratuberculosis
ugcccagcgcggucgcca

SEQ ID NO: 3006485 - RNA, 12 nt, Mycobacterium avium subsp. paratuberculosis
ugcccagcggca

SEQ ID NO: 3006486 - RNA, 20 nt, Mycobacterium avium subsp. paratuberculosis
ugcccaggaaguagccggcc

SEQ ID NO: 3006487 - RNA, 22 nt, Mycobacterium avium subsp. paratuberculosis
ugcccaggaaguagccggccag

SEQ ID NO: 3006488 - RNA, 23 nt, Mycobacterium avium subsp. paratuberculosis
ugcccaggaaguagccggccagc

SEQ ID NO: 3006489 - RNA, 17 nt, Mycobacterium avium subsp. paratuberculosis
ugcccaggaucaccggg

SEQ ID NO: 3006490 - RNA, 13 nt, Mycobacterium avium subsp. paratuberculosis
ugcccaggaugau

SEQ ID NO: 3006491 - RNA, 15 nt, Mycobacterium avium subsp. paratuberculosis
ugcccaggcccacca

SEQ ID NO: 3006492 - RNA, 16 nt, Mycobacterium avium subsp. paratuberculosis
ugcccaggcccaccag

SEQ ID NO: 3006493 - RNA, 13 nt, Mycobacterium avium subsp. paratuberculosis
ugcccaggccggc

SEQ ID NO: 3006494 - RNA, 21 nt, Mycobacterium avium subsp. paratuberculosis
ugcccaggccggcgagcucgc

SEQ ID NO: 3006495 - RNA, 17 nt, Mycobacterium avium subsp. paratuberculosis
ugcccagggcgcgucca

SEQ ID NO: 3006496 - RNA, 22 nt, Mycobacterium avium subsp. paratuberculosis
ugcccagggcgcguccacucca

SEQ ID NO: 3006497 - RNA, 23 nt, Mycobacterium avium subsp. paratuberculosis
ugcccagggcguuugccacugag

SEQ ID NO: 3006498 - RNA, 16 nt, Mycobacterium avium subsp. paratuberculosis
ugcccaucgccacgcc

SEQ ID NO: 3006499 - RNA, 17 nt, Mycobacterium avium subsp. paratuberculosis
ugcccaucugcacagcu

SEQ ID NO: 3006500 - RNA, 22 nt, Mycobacterium avium subsp. paratuberculosis
ugcccaugucgaucggcucggc

SEQ ID NO: 3006501 - RNA, 20 nt, Mycobacterium avium subsp. paratuberculosis
ugccccacacgaugcgcggu

SEQ ID NO: 3006502 - RNA, 19 nt, Mycobacterium avium subsp. paratuberculosis
ugccccacacgcucggcgc

SEQ ID NO: 3006503 - RNA, 15 nt, Mycobacterium avium subsp. paratuberculosis
ugccccaccaccgcc

SEQ ID NO: 3006504 - RNA, 15 nt, Mycobacterium avium subsp. paratuberculosis
ugccccacggcccgg

SEQ ID NO: 3006505 - RNA, 16 nt, Mycobacterium avium subsp. paratuberculosis
ugccccagccacagcc

SEQ ID NO: 3006506 - RNA, 18 nt, Mycobacterium avium subsp. paratuberculosis
ugccccagcugucgggug

SEQ ID NO: 3006507 - RNA, 21 nt, Mycobacterium avium subsp. paratuberculosis
ugccccagggaccaguggugg

SEQ ID NO: 3006508 - RNA, 18 nt, Mycobacterium avium subsp. paratuberculosis
ugccccaggugacgccgc

SEQ ID NO: 3006509 - RNA, 20 nt, Mycobacterium avium subsp. paratuberculosis
ugccccaucuugaccagggu

SEQ ID NO: 3006510 - RNA, 20 nt, Mycobacterium avium subsp. paratuberculosis
ugcccccgaaaugcaucagc

SEQ ID NO: 3006511 - RNA, 14 nt, Mycobacterium avium subsp. paratuberculosis
ugcccccgaugaac

SEQ ID NO: 3006512 - RNA, 15 nt, Mycobacterium avium subsp. paratuberculosis
ugccccgcaccgcca

SEQ ID NO: 3006513 - RNA, 13 nt, Mycobacterium avium subsp. paratuberculosis
ugccccgcgaccg

SEQ ID NO: 3006514 - RNA, 18 nt, Mycobacterium avium subsp. paratuberculosis
ugccccgcuccuccucgc

SEQ ID NO: 3006515 - RNA, 22 nt, Mycobacterium avium subsp. paratuberculosis
ugccccgcuccuccucgcgccg

SEQ ID NO: 3006516 - RNA, 22 nt, Mycobacterium avium subsp. paratuberculosis
ugccccgggugaccgccuuggc

SEQ ID NO: 3006517 - RNA, 13 nt, Mycobacterium avium subsp. paratuberculosis
ugccccguccggc

SEQ ID NO: 3006518 - RNA, 21 nt, Mycobacterium avium subsp. paratuberculosis
ugccccguccggcgccagccc

SEQ ID NO: 3006519 - RNA, 17 nt, Mycobacterium avium subsp. paratuberculosis
ugccccucgacccgaag

SEQ ID NO: 3006520 - RNA, 15 nt, Mycobacterium avium subsp. paratuberculosis
ugccccuugacggug

SEQ ID NO: 3006521 - RNA, 17 nt, Mycobacterium avium subsp. paratuberculosis
ugcccgaauugcgcugc

SEQ ID NO: 3006522 - RNA, 13 nt, Mycobacterium avium subsp. paratuberculosis
ugcccgacccgca

SEQ ID NO: 3006523 - RNA, 15 nt, Mycobacterium avium subsp. paratuberculosis
ugcccgaccgcgccg

SEQ ID NO: 3006524 - RNA, 14 nt, Mycobacterium avium subsp. paratuberculosis
ugcccgacggcgcg

SEQ ID NO: 3006525 - RNA, 18 nt, Mycobacterium avium subsp. paratuberculosis
ugcccgacggcgcgcccg

SEQ ID NO: 3006526 - RNA, 20 nt, Mycobacterium avium subsp. paratuberculosis
ugcccgacggcgcgcccgac

SEQ ID NO: 3006527 - RNA, 23 nt, Mycobacterium avium subsp. paratuberculosis
ugcccgacggcgcgcccgacgau

SEQ ID NO: 3006528 - RNA, 15 nt, Mycobacterium avium subsp. paratuberculosis
ugcccgacggcgucu

SEQ ID NO: 3006529 - RNA, 14 nt, Mycobacterium avium subsp. paratuberculosis
ugcccgacuccuca

SEQ ID NO: 3006530 - RNA, 15 nt, Mycobacterium avium subsp. paratuberculosis
ugcccgacuccucac

SEQ ID NO: 3006531 - RNA, 16 nt, Mycobacterium avium subsp. paratuberculosis
ugcccgacuccucaca

SEQ ID NO: 3006532 - RNA, 17 nt, Mycobacterium avium subsp. paratuberculosis
ugcccgacuccucacac

SEQ ID NO: 3006533 - RNA, 14 nt, Mycobacterium avium subsp. paratuberculosis
ugcccgagaucacc

SEQ ID NO: 3006534 - RNA, 11 nt, Mycobacterium avium subsp. paratuberculosis
ugcccgagcgg

SEQ ID NO: 3006535 - RNA, 21 nt, Mycobacterium avium subsp. paratuberculosis
ugcccgagcugaucgcggccg

SEQ ID NO: 3006536 - RNA, 18 nt, Mycobacterium avium subsp. paratuberculosis
ugcccgaggucauaucga

SEQ ID NO: 3006537 - RNA, 12 nt, Mycobacterium avium subsp. paratuberculosis
ugcccgagguga

SEQ ID NO: 3006538 - RNA, 22 nt, Mycobacterium avium subsp. paratuberculosis
ugcccgaggugaauaccacugc

SEQ ID NO: 3006539 - RNA, 18 nt, Mycobacterium avium subsp. paratuberculosis
ugcccgaucucgucggug

SEQ ID NO: 3006540 - RNA, 14 nt, Mycobacterium avium subsp. paratuberculosis
ugcccgauggugaa

SEQ ID NO: 3006541 - RNA, 22 nt, Mycobacterium avium subsp. paratuberculosis
ugcccgauuggaagagggccau

SEQ ID NO: 3006542 - RNA, 23 nt, Mycobacterium avium subsp. paratuberculosis
ugcccgauuggaagagggccauc

SEQ ID NO: 3006543 - RNA, 15 nt, Mycobacterium avium subsp. paratuberculosis
ugcccgcaucgccga

SEQ ID NO: 3006544 - RNA, 17 nt, Mycobacterium avium subsp. paratuberculosis
ugcccgcaucgccgaac

SEQ ID NO: 3006545 - RNA, 22 nt, Mycobacterium avium subsp. paratuberculosis
ugcccgcaucgccgaaccgggc

SEQ ID NO: 3006546 - RNA, 17 nt, Mycobacterium avium subsp. paratuberculosis
ugcccgcccacgggucg

SEQ ID NO: 3006547 - RNA, 22 nt, Mycobacterium avium subsp. paratuberculosis
ugcccgcccacgggucgccgau

SEQ ID NO: 3006548 - RNA, 17 nt, Mycobacterium avium subsp. paratuberculosis
ugcccgccccgcccggc

SEQ ID NO: 3006549 - RNA, 16 nt, Mycobacterium avium subsp. paratuberculosis
ugcccgccccggacau

SEQ ID NO: 3006550 - RNA, 22 nt, Mycobacterium avium subsp. paratuberculosis
ugcccgcccgagaguccgccgc

SEQ ID NO: 3006551 - RNA, 20 nt, Mycobacterium avium subsp. paratuberculosis
ugcccgcccuugucgauccg

SEQ ID NO: 3006552 - RNA, 22 nt, Mycobacterium avium subsp. paratuberculosis
ugcccgcccuugucgauccggu

SEQ ID NO: 3006553 - RNA, 13 nt, Mycobacterium avium subsp. paratuberculosis
ugcccgccgacca

SEQ ID NO: 3006554 - RNA, 15 nt, Mycobacterium avium subsp. paratuberculosis
ugcccgccgccgaug

SEQ ID NO: 3006555 - RNA, 21 nt, Mycobacterium avium subsp. paratuberculosis
ugcccgccgccgaugcugauc

SEQ ID NO: 3006556 - RNA, 15 nt, Mycobacterium avium subsp. paratuberculosis
ugcccgccgcgaccg

SEQ ID NO: 3006557 - RNA, 12 nt, Mycobacterium avium subsp. paratuberculosis
ugcccgccgcgg

SEQ ID NO: 3006558 - RNA, 13 nt, Mycobacterium avium subsp. paratuberculosis
ugcccgccgcggc

SEQ ID NO: 3006559 - RNA, 16 nt, Mycobacterium avium subsp. paratuberculosis
ugcccgccgcggccgc

SEQ ID NO: 3006560 - RNA, 18 nt, Mycobacterium avium subsp. paratuberculosis
ugcccgccgcggccgcug

SEQ ID NO: 3006561 - RNA, 12 nt, Mycobacterium avium subsp. paratuberculosis
ugcccgccgcgu

SEQ ID NO: 3006562 - RNA, 22 nt, Mycobacterium avium subsp. paratuberculosis
ugcccgccgcguacagcagcug

SEQ ID NO: 3006563 - RNA, 23 nt, Mycobacterium avium subsp. paratuberculosis
ugcccgccgcgucagcggcgggc

SEQ ID NO: 3006564 - RNA, 23 nt, Mycobacterium avium subsp. paratuberculosis
ugcccgccgcugacgcggcgggc

SEQ ID NO: 3006565 - RNA, 14 nt, Mycobacterium avium subsp. paratuberculosis
ugcccgccggcguc

SEQ ID NO: 3006566 - RNA, 23 nt, Mycobacterium avium subsp. paratuberculosis
ugcccgccggcgucugcauccgg

SEQ ID NO: 3006567 - RNA, 16 nt, Mycobacterium avium subsp. paratuberculosis
ugcccgccgugcgccc

SEQ ID NO: 3006568 - RNA, 19 nt, Mycobacterium avium subsp. paratuberculosis
ugcccgccucgcagcgaca

SEQ ID NO: 3006569 - RNA, 20 nt, Mycobacterium avium subsp. paratuberculosis
ugcccgccucgcagcgacaa

SEQ ID NO: 3006570 - RNA, 19 nt, Mycobacterium avium subsp. paratuberculosis
ugcccgccuuugagcgaca

SEQ ID NO: 3006571 - RNA, 23 nt, Mycobacterium avium subsp. paratuberculosis
ugcccgcgacggcgagccgggcc

SEQ ID NO: 3006572 - RNA, 19 nt, Mycobacterium avium subsp. paratuberculosis
ugcccgcgacugucggcgc

SEQ ID NO: 3006573 - RNA, 20 nt, Mycobacterium avium subsp. paratuberculosis
ugcccgcgaucgccagcgcg

SEQ ID NO: 3006574 - RNA, 12 nt, Mycobacterium avium subsp. paratuberculosis
ugcccgcgcagg

SEQ ID NO: 3006575 - RNA, 19 nt, Mycobacterium avium subsp. paratuberculosis
ugcccgcgcaggccccggg

SEQ ID NO: 3006576 - RNA, 17 nt, Mycobacterium avium subsp. paratuberculosis
ugcccgcgcccaccugg

SEQ ID NO: 3006577 - RNA, 15 nt, Mycobacterium avium subsp. paratuberculosis
ugcccgcgccccggc

SEQ ID NO: 3006578 - RNA, 13 nt, Mycobacterium avium subsp. paratuberculosis
ugcccgcgccgac

SEQ ID NO: 3006579 - RNA, 16 nt, Mycobacterium avium subsp. paratuberculosis
ugcccgcgccgaccag

SEQ ID NO: 3006580 - RNA, 22 nt, Mycobacterium avium subsp. paratuberculosis
ugcccgcgcggcucacagcgcg

SEQ ID NO: 3006581 - RNA, 18 nt, Mycobacterium avium subsp. paratuberculosis
ugcccgcggccgccgccg

SEQ ID NO: 3006582 - RNA, 22 nt, Mycobacterium avium subsp. paratuberculosis
ugcccgcggccgccgccgcggc

SEQ ID NO: 3006583 - RNA, 20 nt, Mycobacterium avium subsp. paratuberculosis
ugcccgcgggacacggcggc

SEQ ID NO: 3006584 - RNA, 22 nt, Mycobacterium avium subsp. paratuberculosis
ugcccgcgggacacggcggcgc

SEQ ID NO: 3006585 - RNA, 17 nt, Mycobacterium avium subsp. paratuberculosis
ugcccgcgggccagacu

SEQ ID NO: 3006586 - RNA, 20 nt, Mycobacterium avium subsp. paratuberculosis
ugcccgcggguagcccgucg

SEQ ID NO: 3006587 - RNA, 14 nt, Mycobacterium avium subsp. paratuberculosis
ugcccgcggguggc

SEQ ID NO: 3006588 - RNA, 22 nt, Mycobacterium avium subsp. paratuberculosis
ugcccgcggguggccuucauca

SEQ ID NO: 3006589 - RNA, 23 nt, Mycobacterium avium subsp. paratuberculosis
ugcccgcggguguuucggucggc

SEQ ID NO: 3006590 - RNA, 20 nt, Mycobacterium avium subsp. paratuberculosis
ugcccgcugacaaagcacaa

SEQ ID NO: 3006591 - RNA, 15 nt, Mycobacterium avium subsp. paratuberculosis
ugcccggaagccgca

SEQ ID NO: 3006592 - RNA, 20 nt, Mycobacterium avium subsp. paratuberculosis
ugcccggagaaaccgucggc

SEQ ID NO: 3006593 - RNA, 18 nt, Mycobacterium avium subsp. paratuberculosis
ugcccggaguccggcucg

SEQ ID NO: 3006594 - RNA, 16 nt, Mycobacterium avium subsp. paratuberculosis
ugcccggaucgccgaa

SEQ ID NO: 3006595 - RNA, 13 nt, Mycobacterium avium subsp. paratuberculosis
ugcccggcccgcc

SEQ ID NO: 3006596 - RNA, 10 nt, Mycobacterium avium subsp. paratuberculosis
ugcccggcga

SEQ ID NO: 3006597 - RNA, 16 nt, Mycobacterium avium subsp. paratuberculosis
ugcccggcgacggcgc

SEQ ID NO: 3006598 - RNA, 22 nt, Mycobacterium avium subsp. paratuberculosis
ugcccggcgacggcgccugauc

SEQ ID NO: 3006599 - RNA, 23 nt, Mycobacterium avium subsp. paratuberculosis
ugcccggcgagcgacgccacggg

SEQ ID NO: 3006600 - RNA, 11 nt, Mycobacterium avium subsp. paratuberculosis
ugcccggcgau

SEQ ID NO: 3006601 - RNA, 12 nt, Mycobacterium avium subsp. paratuberculosis
ugcccggcgcac

SEQ ID NO: 3006602 - RNA, 15 nt, Mycobacterium avium subsp. paratuberculosis
ugcccggcgccggac

SEQ ID NO: 3006603 - RNA, 15 nt, Mycobacterium avium subsp. paratuberculosis
ugcccggcgccgguc

SEQ ID NO: 3006604 - RNA, 19 nt, Mycobacterium avium subsp. paratuberculosis
ugcccggcgccggucguua

SEQ ID NO: 3006605 - RNA, 21 nt, Mycobacterium avium subsp. paratuberculosis
ugcccggcgcggacagcgcgg

SEQ ID NO: 3006606 - RNA, 22 nt, Mycobacterium avium subsp. paratuberculosis
ugcccggcgcggacagcgcggu

SEQ ID NO: 3006607 - RNA, 23 nt, Mycobacterium avium subsp. paratuberculosis
ugcccggcgcuaaagccgaccgc

SEQ ID NO: 3006608 - RNA, 23 nt, Mycobacterium avium subsp. paratuberculosis
ugcccggcucggugcgccagauc

SEQ ID NO: 3006609 - RNA, 16 nt, Mycobacterium avium subsp. paratuberculosis
ugcccgggccgcagcu

SEQ ID NO: 3006610 - RNA, 22 nt, Mycobacterium avium subsp. paratuberculosis
ugcccgggccgucaucgccgac

SEQ ID NO: 3006611 - RNA, 17 nt, Mycobacterium avium subsp. paratuberculosis
ugcccgggccguccggg

SEQ ID NO: 3006612 - RNA, 23 nt, Mycobacterium avium subsp. paratuberculosis
ugcccgggcuguugaccacggcc

SEQ ID NO: 3006613 - RNA, 20 nt, Mycobacterium avium subsp. paratuberculosis
ugcccgggguccaccggccg

SEQ ID NO: 3006614 - RNA, 16 nt, Mycobacterium avium subsp. paratuberculosis
ugcccggucugcggcc

SEQ ID NO: 3006615 - RNA, 18 nt, Mycobacterium avium subsp. paratuberculosis
ugcccggucugcggccgc

SEQ ID NO: 3006616 - RNA, 17 nt, Mycobacterium avium subsp. paratuberculosis
ugcccgguuccgcgaca

SEQ ID NO: 3006617 - RNA, 15 nt, Mycobacterium avium subsp. paratuberculosis
ugcccgucacggccg

SEQ ID NO: 3006618 - RNA, 15 nt, Mycobacterium avium subsp. paratuberculosis
ugcccgucgaccucc

SEQ ID NO: 3006619 - RNA, 15 nt, Mycobacterium avium subsp. paratuberculosis
ugcccgucgcguccc

SEQ ID NO: 3006620 - RNA, 18 nt, Mycobacterium avium subsp. paratuberculosis
ugcccguugcccgaucag

SEQ ID NO: 3006621 - RNA, 13 nt, Mycobacterium avium subsp. paratuberculosis
ugcccuagcggug

SEQ ID NO: 3006622 - RNA, 15 nt, Mycobacterium avium subsp. paratuberculosis
ugcccuagcgguggc

SEQ ID NO: 3006623 - RNA, 15 nt, Mycobacterium avium subsp. paratuberculosis
ugcccuccagcaccg

SEQ ID NO: 3006624 - RNA, 16 nt, Mycobacterium avium subsp. paratuberculosis
ugcccuccagcaccgu

SEQ ID NO: 3006625 - RNA, 11 nt, Mycobacterium avium subsp. paratuberculosis
ugcccuccucg

SEQ ID NO: 3006626 - RNA, 17 nt, Mycobacterium avium subsp. paratuberculosis
ugcccuccucgccggag

SEQ ID NO: 3006627 - RNA, 17 nt, Mycobacterium avium subsp. paratuberculosis
ugcccuccuucccggug

SEQ ID NO: 3006628 - RNA, 16 nt, Mycobacterium avium subsp. paratuberculosis
ugcccucggucgccga

SEQ ID NO: 3006629 - RNA, 24 nt, Mycobacterium avium subsp. paratuberculosis
ugcccucguagaaggaccgguccu

SEQ ID NO: 3006630 - RNA, 20 nt, Mycobacterium avium subsp. paratuberculosis
ugcccucguagcggccgcac

SEQ ID NO: 3006631 - RNA, 13 nt, Mycobacterium avium subsp. paratuberculosis
ugcccucgucgac

SEQ ID NO: 3006632 - RNA, 16 nt, Mycobacterium avium subsp. paratuberculosis
ugcccucgucgaccag

SEQ ID NO: 3006633 - RNA, 19 nt, Mycobacterium avium subsp. paratuberculosis
ugcccucgucgaccagggc

SEQ ID NO: 3006634 - RNA, 21 nt, Mycobacterium avium subsp. paratuberculosis
ugcccucgucgaccagggcga

SEQ ID NO: 3006635 - RNA, 16 nt, Mycobacterium avium subsp. paratuberculosis
ugcccucgugguggac

SEQ ID NO: 3006636 - RNA, 18 nt, Mycobacterium avium subsp. paratuberculosis
ugcccugaagcugggcgc

SEQ ID NO: 3006637 - RNA, 13 nt, Mycobacterium avium subsp. paratuberculosis
ugcccugcacgau

SEQ ID NO: 3006638 - RNA, 16 nt, Mycobacterium avium subsp. paratuberculosis
ugcccugccugcugcc

SEQ ID NO: 3006639 - RNA, 17 nt, Mycobacterium avium subsp. paratuberculosis
ugcccugcgugcagaca

SEQ ID NO: 3006640 - RNA, 17 nt, Mycobacterium avium subsp. paratuberculosis
ugcccugguacgcgccg

SEQ ID NO: 3006641 - RNA, 19 nt, Mycobacterium avium subsp. paratuberculosis
ugcccugguacgcgccguc

SEQ ID NO: 3006642 - RNA, 17 nt, Mycobacterium avium subsp. paratuberculosis
ugcccuuccccggcggc

SEQ ID NO: 3006643 - RNA, 23 nt, Mycobacterium avium subsp. paratuberculosis
ugcccuuccccggcggccggccc

SEQ ID NO: 3006644 - RNA, 17 nt, Mycobacterium avium subsp. paratuberculosis
ugcccuuggccagcagu

SEQ ID NO: 3006645 - RNA, 17 nt, Mycobacterium avium subsp. paratuberculosis
ugcccuuggcccgggcg

SEQ ID NO: 3006646 - RNA, 18 nt, Mycobacterium avium subsp. paratuberculosis
ugccgaacaacagggccg

SEQ ID NO: 3006647 - RNA, 16 nt, Mycobacterium avium subsp. paratuberculosis
ugccgaacagcgacgu

SEQ ID NO: 3006648 - RNA, 18 nt, Mycobacterium avium subsp. paratuberculosis
ugccgaacaucagccgau

SEQ ID NO: 3006649 - RNA, 19 nt, Mycobacterium avium subsp. paratuberculosis
ugccgaaccgcuccccgag

SEQ ID NO: 3006650 - RNA, 17 nt, Mycobacterium avium subsp. paratuberculosis
ugccgaaccgcugcgga

SEQ ID NO: 3006651 - RNA, 14 nt, Mycobacterium avium subsp. paratuberculosis
ugccgaacgcgauc

SEQ ID NO: 3006652 - RNA, 16 nt, Mycobacterium avium subsp. paratuberculosis
ugccgaacgcgaucca

SEQ ID NO: 3006653 - RNA, 18 nt, Mycobacterium avium subsp. paratuberculosis
ugccgaacgucaccaaca

SEQ ID NO: 3006654 - RNA, 22 nt, Mycobacterium avium subsp. paratuberculosis
ugccgaacgugcugugcgggcg

SEQ ID NO: 3006655 - RNA, 16 nt, Mycobacterium avium subsp. paratuberculosis
ugccgaacuccgccga

SEQ ID NO: 3006656 - RNA, 14 nt, Mycobacterium avium subsp. paratuberculosis
ugccgaagccguug

SEQ ID NO: 3006657 - RNA, 15 nt, Mycobacterium avium subsp. paratuberculosis
ugccgaagcgccgca

SEQ ID NO: 3006658 - RNA, 16 nt, Mycobacterium avium subsp. paratuberculosis
ugccgaagggcaaccg

SEQ ID NO: 3006659 - RNA, 22 nt, Mycobacterium avium subsp. paratuberculosis
ugccgaagggcaaccgcagcau

SEQ ID NO: 3006660 - RNA, 13 nt, Mycobacterium avium subsp. paratuberculosis
ugccgaaguccuu

SEQ ID NO: 3006661 - RNA, 14 nt, Mycobacterium avium subsp. paratuberculosis
ugccgacaccccac

SEQ ID NO: 3006662 - RNA, 18 nt, Mycobacterium avium subsp. paratuberculosis
ugccgacaccccacaccg

SEQ ID NO: 3006663 - RNA, 19 nt, Mycobacterium avium subsp. paratuberculosis
ugccgacaccccacaccgu

SEQ ID NO: 3006664 - RNA, 22 nt, Mycobacterium avium subsp. paratuberculosis
ugccgacaccccacaccguccg

SEQ ID NO: 3006665 - RNA, 16 nt, Mycobacterium avium subsp. paratuberculosis
ugccgacccggcguag

SEQ ID NO: 3006666 - RNA, 13 nt, Mycobacterium avium subsp. paratuberculosis
ugccgaccgacag

SEQ ID NO: 3006667 - RNA, 21 nt, Mycobacterium avium subsp. paratuberculosis
ugccgaccgacagccgcacca

SEQ ID NO: 3006668 - RNA, 17 nt, Mycobacterium avium subsp. paratuberculosis
ugccgaccugcgcgacg

SEQ ID NO: 3006669 - RNA, 16 nt, Mycobacterium avium subsp. paratuberculosis
ugccgaccugggcggc

SEQ ID NO: 3006670 - RNA, 21 nt, Mycobacterium avium subsp. paratuberculosis
ugccgacgaccucgucgucga

SEQ ID NO: 3006671 - RNA, 14 nt, Mycobacterium avium subsp. paratuberculosis
ugccgacgacgucg

SEQ ID NO: 3006672 - RNA, 20 nt, Mycobacterium avium subsp. paratuberculosis
ugccgacgaugucggcuucg

SEQ ID NO: 3006673 - RNA, 17 nt, Mycobacterium avium subsp. paratuberculosis
ugccgacggcgccggug

SEQ ID NO: 3006674 - RNA, 13 nt, Mycobacterium avium subsp. paratuberculosis
ugccgacggugcg

SEQ ID NO: 3006675 - RNA, 14 nt, Mycobacterium avium subsp. paratuberculosis
ugccgacggugucg

SEQ ID NO: 3006676 - RNA, 13 nt, Mycobacterium avium subsp. paratuberculosis
ugccgacgucggu

SEQ ID NO: 3006677 - RNA, 12 nt, Mycobacterium avium subsp. paratuberculosis
ugccgagcaccc

SEQ ID NO: 3006678 - RNA, 15 nt, Mycobacterium avium subsp. paratuberculosis
ugccgagcaccccgu

SEQ ID NO: 3006679 - RNA, 21 nt, Mycobacterium avium subsp. paratuberculosis
ugccgagcaccucgucgccgu

SEQ ID NO: 3006680 - RNA, 22 nt, Mycobacterium avium subsp. paratuberculosis
ugccgagcaccucgucgccguc

SEQ ID NO: 3006681 - RNA, 23 nt, Mycobacterium avium subsp. paratuberculosis
ugccgagcaccucgucgccgucg

SEQ ID NO: 3006682 - RNA, 15 nt, Mycobacterium avium subsp. paratuberculosis
ugccgagcagcaccg

SEQ ID NO: 3006683 - RNA, 21 nt, Mycobacterium avium subsp. paratuberculosis
ugccgagcagcaccgcgaccc

SEQ ID NO: 3006684 - RNA, 20 nt, Mycobacterium avium subsp. paratuberculosis
ugccgagcccgccggcggcg

SEQ ID NO: 3006685 - RNA, 21 nt, Mycobacterium avium subsp. paratuberculosis
ugccgagcccgccggcggcga

SEQ ID NO: 3006686 - RNA, 20 nt, Mycobacterium avium subsp. paratuberculosis
ugccgagcccuuugcgcugc

SEQ ID NO: 3006687 - RNA, 20 nt, Mycobacterium avium subsp. paratuberculosis
ugccgagccgcuugguggcg

SEQ ID NO: 3006688 - RNA, 22 nt, Mycobacterium avium subsp. paratuberculosis
ugccgagccgcuugguggcgcc

SEQ ID NO: 3006689 - RNA, 14 nt, Mycobacterium avium subsp. paratuberculosis
ugccgagcgccgcg

SEQ ID NO: 3006690 - RNA, 17 nt, Mycobacterium avium subsp. paratuberculosis
ugccgaggauuucgcga

SEQ ID NO: 3006691 - RNA, 18 nt, Mycobacterium avium subsp. paratuberculosis
ugccgaggauuucgcgau

SEQ ID NO: 3006692 - RNA, 19 nt, Mycobacterium avium subsp. paratuberculosis
ugccgaggauuucgcgauc

SEQ ID NO: 3006693 - RNA, 22 nt, Mycobacterium avium subsp. paratuberculosis
ugccgaggcaguuccaugucga

SEQ ID NO: 3006694 - RNA, 17 nt, Mycobacterium avium subsp. paratuberculosis
ugccgagguagucggcc

SEQ ID NO: 3006695 - RNA, 11 nt, Mycobacterium avium subsp. paratuberculosis
ugccgaucacc

SEQ ID NO: 3006696 - RNA, 23 nt, Mycobacterium avium subsp. paratuberculosis
ugccgaucaccucgccggccggg

SEQ ID NO: 3006697 - RNA, 21 nt, Mycobacterium avium subsp. paratuberculosis
ugccgaucagcgucagcaccg

SEQ ID NO: 3006698 - RNA, 16 nt, Mycobacterium avium subsp. paratuberculosis
ugccgaucaggcugga

SEQ ID NO: 3006699 - RNA, 16 nt, Mycobacterium avium subsp. paratuberculosis
ugccgaucccggccag

SEQ ID NO: 3006700 - RNA, 17 nt, Mycobacterium avium subsp. paratuberculosis
ugccgaucccggccagc

SEQ ID NO: 3006701 - RNA, 17 nt, Mycobacterium avium subsp. paratuberculosis
ugccgauccgcaccgga

SEQ ID NO: 3006702 - RNA, 19 nt, Mycobacterium avium subsp. paratuberculosis
ugccgauccgcaccggacg

SEQ ID NO: 3006703 - RNA, 13 nt, Mycobacterium avium subsp. paratuberculosis
ugccgaucgagac

SEQ ID NO: 3006704 - RNA, 14 nt, Mycobacterium avium subsp. paratuberculosis
ugccgaucgagacc

SEQ ID NO: 3006705 - RNA, 17 nt, Mycobacterium avium subsp. paratuberculosis
ugccgaucgccgcggcg

SEQ ID NO: 3006706 - RNA, 20 nt, Mycobacterium avium subsp. paratuberculosis
ugccgaucgccgcggcgauc

SEQ ID NO: 3006707 - RNA, 16 nt, Mycobacterium avium subsp. paratuberculosis
ugccgaucggggcgca

SEQ ID NO: 3006708 - RNA, 21 nt, Mycobacterium avium subsp. paratuberculosis
ugccgaucggggcgcagcccg

SEQ ID NO: 3006709 - RNA, 12 nt, Mycobacterium avium subsp. paratuberculosis
ugccgaucguga

SEQ ID NO: 3006710 - RNA, 23 nt, Mycobacterium avium subsp. paratuberculosis
ugccgaucgugaauucggccggg

SEQ ID NO: 3006711 - RNA, 15 nt, Mycobacterium avium subsp. paratuberculosis
ugccgaucuggucca

SEQ ID NO: 3006712 - RNA, 18 nt, Mycobacterium avium subsp. paratuberculosis
ugccgaucugguccagcg

SEQ ID NO: 3006713 - RNA, 20 nt, Mycobacterium avium subsp. paratuberculosis
ugccgaugcugagcgggucg

SEQ ID NO: 3006714 - RNA, 16 nt, Mycobacterium avium subsp. paratuberculosis
ugccgauggccaccgg

SEQ ID NO: 3006715 - RNA, 23 nt, Mycobacterium avium subsp. paratuberculosis
ugccgauggcgguccaccaccac

SEQ ID NO: 3006716 - RNA, 14 nt, Mycobacterium avium subsp. paratuberculosis
ugccgaugucggcg

SEQ ID NO: 3006717 - RNA, 15 nt, Mycobacterium avium subsp. paratuberculosis
ugccgcaacgggccg

SEQ ID NO: 3006718 - RNA, 18 nt, Mycobacterium avium subsp. paratuberculosis
ugccgcaacgggccgcag

SEQ ID NO: 3006719 - RNA, 12 nt, Mycobacterium avium subsp. paratuberculosis
ugccgcacaccg

SEQ ID NO: 3006720 - RNA, 16 nt, Mycobacterium avium subsp. paratuberculosis
ugccgcacaccgcgca

SEQ ID NO: 3006721 - RNA, 22 nt, Mycobacterium avium subsp. paratuberculosis
ugccgcacaccgucucccacga

SEQ ID NO: 3006722 - RNA, 14 nt, Mycobacterium avium subsp. paratuberculosis
ugccgcagccgucc

SEQ ID NO: 3006723 - RNA, 13 nt, Mycobacterium avium subsp. paratuberculosis
ugccgcagcggcg

SEQ ID NO: 3006724 - RNA, 18 nt, Mycobacterium avium subsp. paratuberculosis
ugccgcagcucgaucacc

SEQ ID NO: 3006725 - RNA, 12 nt, Mycobacterium avium subsp. paratuberculosis
ugccgcaggcga

SEQ ID NO: 3006726 - RNA, 21 nt, Mycobacterium avium subsp. paratuberculosis
ugccgcagguggugggcgugc

SEQ ID NO: 3006727 - RNA, 21 nt, Mycobacterium avium subsp. paratuberculosis
ugccgcagugccggcgcaccg

SEQ ID NO: 3006728 - RNA, 13 nt, Mycobacterium avium subsp. paratuberculosis
ugccgccaccgcg

SEQ ID NO: 3006729 - RNA, 20 nt, Mycobacterium avium subsp. paratuberculosis
ugccgccauccugucauccg

SEQ ID NO: 3006730 - RNA, 18 nt, Mycobacterium avium subsp. paratuberculosis
ugccgcccaacgacgucg

SEQ ID NO: 3006731 - RNA, 16 nt, Mycobacterium avium subsp. paratuberculosis
ugccgcccaccaccgg

SEQ ID NO: 3006732 - RNA, 18 nt, Mycobacterium avium subsp. paratuberculosis
ugccgcccaccaccggcu

SEQ ID NO: 3006733 - RNA, 17 nt, Mycobacterium avium subsp. paratuberculosis
ugccgcccaucaccccg

SEQ ID NO: 3006734 - RNA, 18 nt, Mycobacterium avium subsp. paratuberculosis
ugccgcccaucaccccga

SEQ ID NO: 3006735 - RNA, 20 nt, Mycobacterium avium subsp. paratuberculosis
ugccgcccggaccgcggucg

SEQ ID NO: 3006736 - RNA, 18 nt, Mycobacterium avium subsp. paratuberculosis
ugccgcccgggaagcugg

SEQ ID NO: 3006737 - RNA, 14 nt, Mycobacterium avium subsp. paratuberculosis
ugccgcccgggccg

SEQ ID NO: 3006738 - RNA, 15 nt, Mycobacterium avium subsp. paratuberculosis
ugccgcccucggccg

SEQ ID NO: 3006739 - RNA, 23 nt, Mycobacterium avium subsp. paratuberculosis
ugccgcccuugcucgcggcguag

SEQ ID NO: 3006740 - RNA, 21 nt, Mycobacterium avium subsp. paratuberculosis
ugccgccgaagcggcgcacgc

SEQ ID NO: 3006741 - RNA, 15 nt, Mycobacterium avium subsp. paratuberculosis
ugccgccgaccgccg

SEQ ID NO: 3006742 - RNA, 13 nt, Mycobacterium avium subsp. paratuberculosis
ugccgccgagcgu

SEQ ID NO: 3006743 - RNA, 20 nt, Mycobacterium avium subsp. paratuberculosis
ugccgccgagggccagcagc

SEQ ID NO: 3006744 - RNA, 21 nt, Mycobacterium avium subsp. paratuberculosis
ugccgccgagggccagcagcc

SEQ ID NO: 3006745 - RNA, 22 nt, Mycobacterium avium subsp. paratuberculosis
ugccgccgagggccagcagcca

SEQ ID NO: 3006746 - RNA, 14 nt, Mycobacterium avium subsp. paratuberculosis
ugccgccgcagcag

SEQ ID NO: 3006747 - RNA, 16 nt, Mycobacterium avium subsp. paratuberculosis
ugccgccgcagcgcag

SEQ ID NO: 3006748 - RNA, 16 nt, Mycobacterium avium subsp. paratuberculosis
ugccgccgccagcgcg

SEQ ID NO: 3006749 - RNA, 18 nt, Mycobacterium avium subsp. paratuberculosis
ugccgccgcccgucagcc

SEQ ID NO: 3006750 - RNA, 14 nt, Mycobacterium avium subsp. paratuberculosis
ugccgccgccgcug

SEQ ID NO: 3006751 - RNA, 13 nt, Mycobacterium avium subsp. paratuberculosis
ugccgccgccggc

SEQ ID NO: 3006752 - RNA, 15 nt, Mycobacterium avium subsp. paratuberculosis
ugccgccgccggcgg

SEQ ID NO: 3006753 - RNA, 14 nt, Mycobacterium avium subsp. paratuberculosis
ugccgccgcgacga

SEQ ID NO: 3006754 - RNA, 15 nt, Mycobacterium avium subsp. paratuberculosis
ugccgccgcgcgcgg

SEQ ID NO: 3006755 - RNA, 17 nt, Mycobacterium avium subsp. paratuberculosis
ugccgccgcgcgcggcc

SEQ ID NO: 3006756 - RNA, 13 nt, Mycobacterium avium subsp. paratuberculosis
ugccgccggcgca

SEQ ID NO: 3006757 - RNA, 15 nt, Mycobacterium avium subsp. paratuberculosis
ugccgccggcgcauc

SEQ ID NO: 3006758 - RNA, 17 nt, Mycobacterium avium subsp. paratuberculosis
ugccgccggcgcccugc

SEQ ID NO: 3006759 - RNA, 14 nt, Mycobacterium avium subsp. paratuberculosis
ugccgccggcgcgg

SEQ ID NO: 3006760 - RNA, 19 nt, Mycobacterium avium subsp. paratuberculosis
ugccgccgggcaccucggc

SEQ ID NO: 3006761 - RNA, 13 nt, Mycobacterium avium subsp. paratuberculosis
ugccgccgggcca

SEQ ID NO: 3006762 - RNA, 15 nt, Mycobacterium avium subsp. paratuberculosis
ugccgccgggccagg

SEQ ID NO: 3006763 - RNA, 23 nt, Mycobacterium avium subsp. paratuberculosis
ugccgccggggacccgcaccgga

SEQ ID NO: 3006764 - RNA, 14 nt, Mycobacterium avium subsp. paratuberculosis
ugccgccggggugc

SEQ ID NO: 3006765 - RNA, 23 nt, Mycobacterium avium subsp. paratuberculosis
ugccgccggucacggcgucggcg

SEQ ID NO: 3006766 - RNA, 17 nt, Mycobacterium avium subsp. paratuberculosis
ugccgccgugcgcggcg

SEQ ID NO: 3006767 - RNA, 23 nt, Mycobacterium avium subsp. paratuberculosis
ugccgccgugcgcggcgaccacc

SEQ ID NO: 3006768 - RNA, 22 nt, Mycobacterium avium subsp. paratuberculosis
ugccgccguugcgagucaucgc

SEQ ID NO: 3006769 - RNA, 20 nt, Mycobacterium avium subsp. paratuberculosis
ugccgcgacccgggccgcca

SEQ ID NO: 3006770 - RNA, 18 nt, Mycobacterium avium subsp. paratuberculosis
ugccgcgacucggugucg

SEQ ID NO: 3006771 - RNA, 15 nt, Mycobacterium avium subsp. paratuberculosis
ugccgcgcagcaccg

SEQ ID NO: 3006772 - RNA, 17 nt, Mycobacterium avium subsp. paratuberculosis
ugccgcgcagcaccguc

SEQ ID NO: 3006773 - RNA, 14 nt, Mycobacterium avium subsp. paratuberculosis
ugccgcgcaggccg

SEQ ID NO: 3006774 - RNA, 13 nt, Mycobacterium avium subsp. paratuberculosis
ugccgcgccaacg

SEQ ID NO: 3006775 - RNA, 18 nt, Mycobacterium avium subsp. paratuberculosis
ugccgcgccccgagcagc

SEQ ID NO: 3006776 - RNA, 13 nt, Mycobacterium avium subsp. paratuberculosis
ugccgcgcgcccg

SEQ ID NO: 3006777 - RNA, 19 nt, Mycobacterium avium subsp. paratuberculosis
ugccgcgcgcccgcggcca

SEQ ID NO: 3006778 - RNA, 12 nt, Mycobacterium avium subsp. paratuberculosis
ugccgcgcgccg

SEQ ID NO: 3006779 - RNA, 13 nt, Mycobacterium avium subsp. paratuberculosis
ugccgcgcgccga

SEQ ID NO: 3006780 - RNA, 14 nt, Mycobacterium avium subsp. paratuberculosis
ugccgcgcggacgc

SEQ ID NO: 3006781 - RNA, 17 nt, Mycobacterium avium subsp. paratuberculosis
ugccgcgcggcgccagc

SEQ ID NO: 3006782 - RNA, 19 nt, Mycobacterium avium subsp. paratuberculosis
ugccgcgcggcgccagcgg

SEQ ID NO: 3006783 - RNA, 15 nt, Mycobacterium avium subsp. paratuberculosis
ugccgcgcucgucga

SEQ ID NO: 3006784 - RNA, 17 nt, Mycobacterium avium subsp. paratuberculosis
ugccgcgcugcgccggg

SEQ ID NO: 3006785 - RNA, 17 nt, Mycobacterium avium subsp. paratuberculosis
ugccgcggcggcgccga

SEQ ID NO: 3006786 - RNA, 18 nt, Mycobacterium avium subsp. paratuberculosis
ugccgcggcggcgccgac

SEQ ID NO: 3006787 - RNA, 20 nt, Mycobacterium avium subsp. paratuberculosis
ugccgcgggccagcagccgg

SEQ ID NO: 3006788 - RNA, 18 nt, Mycobacterium avium subsp. paratuberculosis
ugccgcggugcggcccgc

SEQ ID NO: 3006789 - RNA, 22 nt, Mycobacterium avium subsp. paratuberculosis
ugccgcggugcggcccgcggca

SEQ ID NO: 3006790 - RNA, 22 nt, Mycobacterium avium subsp. paratuberculosis
ugccgcgguugaacaggcugcc

SEQ ID NO: 3006791 - RNA, 21 nt, Mycobacterium avium subsp. paratuberculosis
ugccgcgugacaggggcagca

SEQ ID NO: 3006792 - RNA, 13 nt, Mycobacterium avium subsp. paratuberculosis
ugccgcucggcgc

SEQ ID NO: 3006793 - RNA, 22 nt, Mycobacterium avium subsp. paratuberculosis
ugccgcucggcgcuccagcggg

SEQ ID NO: 3006794 - RNA, 20 nt, Mycobacterium avium subsp. paratuberculosis
ugccgcugacggucgccgac

SEQ ID NO: 3006795 - RNA, 17 nt, Mycobacterium avium subsp. paratuberculosis
ugccgcugcgccggcgc

SEQ ID NO: 3006796 - RNA, 17 nt, Mycobacterium avium subsp. paratuberculosis
ugccgcuggauuccacc

SEQ ID NO: 3006797 - RNA, 20 nt, Mycobacterium avium subsp. paratuberculosis
ugccgcuggauuccaccgug

SEQ ID NO: 3006798 - RNA, 23 nt, Mycobacterium avium subsp. paratuberculosis
ugccgcuggauuccaccgugguc

SEQ ID NO: 3006799 - RNA, 13 nt, Mycobacterium avium subsp. paratuberculosis
ugccgcugggagc

SEQ ID NO: 3006800 - RNA, 19 nt, Mycobacterium avium subsp. paratuberculosis
ugccgcugggagcacguga

SEQ ID NO: 3006801 - RNA, 18 nt, Mycobacterium avium subsp. paratuberculosis
ugccgcugguaggcggcg

SEQ ID NO: 3006802 - RNA, 21 nt, Mycobacterium avium subsp. paratuberculosis
ugccgcugguaggcggcgcag

SEQ ID NO: 3006803 - RNA, 21 nt, Mycobacterium avium subsp. paratuberculosis
ugccggaaaaguucggcgggg

SEQ ID NO: 3006804 - RNA, 16 nt, Mycobacterium avium subsp. paratuberculosis
ugccggaagcggcggu

SEQ ID NO: 3006805 - RNA, 22 nt, Mycobacterium avium subsp. paratuberculosis
ugccggaaguucucgccgugca

SEQ ID NO: 3006806 - RNA, 15 nt, Mycobacterium avium subsp. paratuberculosis
ugccggacaccccgg

SEQ ID NO: 3006807 - RNA, 19 nt, Mycobacterium avium subsp. paratuberculosis
ugccggacaccccggccag

SEQ ID NO: 3006808 - RNA, 21 nt, Mycobacterium avium subsp. paratuberculosis
ugccggacaccccggccaguc

SEQ ID NO: 3006809 - RNA, 16 nt, Mycobacterium avium subsp. paratuberculosis
ugccggacaccggcac

SEQ ID NO: 3006810 - RNA, 21 nt, Mycobacterium avium subsp. paratuberculosis
ugccggaccgcgcgggccagc

SEQ ID NO: 3006811 - RNA, 16 nt, Mycobacterium avium subsp. paratuberculosis
ugccggaccucgacca

SEQ ID NO: 3006812 - RNA, 19 nt, Mycobacterium avium subsp. paratuberculosis
ugccggaccucgaccagcc

SEQ ID NO: 3006813 - RNA, 12 nt, Mycobacterium avium subsp. paratuberculosis
ugccggacgagg

SEQ ID NO: 3006814 - RNA, 20 nt, Mycobacterium avium subsp. paratuberculosis
ugccggacgaggaucgcagg

SEQ ID NO: 3006815 - RNA, 20 nt, Mycobacterium avium subsp. paratuberculosis
ugccggacuugaugcugccc

SEQ ID NO: 3006816 - RNA, 14 nt, Mycobacterium avium subsp. paratuberculosis
ugccggaggcggcg

SEQ ID NO: 3006817 - RNA, 15 nt, Mycobacterium avium subsp. paratuberculosis
ugccggaggcggcgu

SEQ ID NO: 3006818 - RNA, 21 nt, Mycobacterium avium subsp. paratuberculosis
ugccggaggcggcguagucgg

SEQ ID NO: 3006819 - RNA, 15 nt, Mycobacterium avium subsp. paratuberculosis
ugccggaugccgcgc

SEQ ID NO: 3006820 - RNA, 14 nt, Mycobacterium avium subsp. paratuberculosis
ugccggaugcgguc

SEQ ID NO: 3006821 - RNA, 16 nt, Mycobacterium avium subsp. paratuberculosis
ugccggauugcgagcc

SEQ ID NO: 3006822 - RNA, 17 nt, Mycobacterium avium subsp. paratuberculosis
ugccggcauaggccagc

SEQ ID NO: 3006823 - RNA, 21 nt, Mycobacterium avium subsp. paratuberculosis
ugccggcauaggccagcacca

SEQ ID NO: 3006824 - RNA, 23 nt, Mycobacterium avium subsp. paratuberculosis
ugccggcauaggccagcaccagc

SEQ ID NO: 3006825 - RNA, 18 nt, Mycobacterium avium subsp. paratuberculosis
ugccggcauccucggcgc

SEQ ID NO: 3006826 - RNA, 20 nt, Mycobacterium avium subsp. paratuberculosis
ugccggcauccucggcgcgu

SEQ ID NO: 3006827 - RNA, 22 nt, Mycobacterium avium subsp. paratuberculosis
ugccggcauccucggcgcgucg

SEQ ID NO: 3006828 - RNA, 13 nt, Mycobacterium avium subsp. paratuberculosis
ugccggccaccgg

SEQ ID NO: 3006829 - RNA, 15 nt, Mycobacterium avium subsp. paratuberculosis
ugccggccaccggcg

SEQ ID NO: 3006830 - RNA, 21 nt, Mycobacterium avium subsp. paratuberculosis
ugccggccaccggcgcgacgg

SEQ ID NO: 3006831 - RNA, 18 nt, Mycobacterium avium subsp. paratuberculosis
ugccggccagaucgacgc

SEQ ID NO: 3006832 - RNA, 21 nt, Mycobacterium avium subsp. paratuberculosis
ugccggccagaucgacgccgc

SEQ ID NO: 3006833 - RNA, 22 nt, Mycobacterium avium subsp. paratuberculosis
ugccggccagaucgacgccgcg

SEQ ID NO: 3006834 - RNA, 12 nt, Mycobacterium avium subsp. paratuberculosis
ugccggccagcc

SEQ ID NO: 3006835 - RNA, 15 nt, Mycobacterium avium subsp. paratuberculosis
ugccggccagccgcg

SEQ ID NO: 3006836 - RNA, 22 nt, Mycobacterium avium subsp. paratuberculosis
ugccggccagcuuuccggccgc

SEQ ID NO: 3006837 - RNA, 17 nt, Mycobacterium avium subsp. paratuberculosis
ugccggccaggcacagc

SEQ ID NO: 3006838 - RNA, 19 nt, Mycobacterium avium subsp. paratuberculosis
ugccggccaggcacagcag

SEQ ID NO: 3006839 - RNA, 23 nt, Mycobacterium avium subsp. paratuberculosis
ugccggccaugaccaugucgacg

SEQ ID NO: 3006840 - RNA, 12 nt, Mycobacterium avium subsp. paratuberculosis
ugccggcccgca

SEQ ID NO: 3006841 - RNA, 16 nt, Mycobacterium avium subsp. paratuberculosis
ugccggccgaagugcu

SEQ ID NO: 3006842 - RNA, 13 nt, Mycobacterium avium subsp. paratuberculosis
ugccggccgccgc

SEQ ID NO: 3006843 - RNA, 15 nt, Mycobacterium avium subsp. paratuberculosis
ugccggccgccgcgc

SEQ ID NO: 3006844 - RNA, 18 nt, Mycobacterium avium subsp. paratuberculosis
ugccggccgccgcgcauc

SEQ ID NO: 3006845 - RNA, 16 nt, Mycobacterium avium subsp. paratuberculosis
ugccggccgccguauc

SEQ ID NO: 3006846 - RNA, 11 nt, Mycobacterium avium subsp. paratuberculosis
ugccggccgcg

SEQ ID NO: 3006847 - RNA, 12 nt, Mycobacterium avium subsp. paratuberculosis
ugccggccggca

SEQ ID NO: 3006848 - RNA, 13 nt, Mycobacterium avium subsp. paratuberculosis
ugccggccggcag

SEQ ID NO: 3006849 - RNA, 14 nt, Mycobacterium avium subsp. paratuberculosis
ugccggccggcagc

SEQ ID NO: 3006850 - RNA, 22 nt, Mycobacterium avium subsp. paratuberculosis
ugccggccggcagcugcccguc

SEQ ID NO: 3006851 - RNA, 14 nt, Mycobacterium avium subsp. paratuberculosis
ugccggccggggcg

SEQ ID NO: 3006852 - RNA, 17 nt, Mycobacterium avium subsp. paratuberculosis
ugccggccggggcggcg

SEQ ID NO: 3006853 - RNA, 19 nt, Mycobacterium avium subsp. paratuberculosis
ugccggccggggcggcggu

SEQ ID NO: 3006854 - RNA, 21 nt, Mycobacterium avium subsp. paratuberculosis
ugccggccggggcggcgguac

SEQ ID NO: 3006855 - RNA, 16 nt, Mycobacterium avium subsp. paratuberculosis
ugccggccugacugag

SEQ ID NO: 3006856 - RNA, 20 nt, Mycobacterium avium subsp. paratuberculosis
ugccggccugacugagucaa

SEQ ID NO: 3006857 - RNA, 17 nt, Mycobacterium avium subsp. paratuberculosis
ugccggcgaaccucacc

SEQ ID NO: 3006858 - RNA, 19 nt, Mycobacterium avium subsp. paratuberculosis
ugccggcgaacucgcggcg

SEQ ID NO: 3006859 - RNA, 13 nt, Mycobacterium avium subsp. paratuberculosis
ugccggcgaccag

SEQ ID NO: 3006860 - RNA, 14 nt, Mycobacterium avium subsp. paratuberculosis
ugccggcgaccagc

SEQ ID NO: 3006861 - RNA, 19 nt, Mycobacterium avium subsp. paratuberculosis
ugccggcgaccagccccuc

SEQ ID NO: 3006862 - RNA, 20 nt, Mycobacterium avium subsp. paratuberculosis
ugccggcgacgguggcgccc

SEQ ID NO: 3006863 - RNA, 21 nt, Mycobacterium avium subsp. paratuberculosis
ugccggcgagugcgaaucauc

SEQ ID NO: 3006864 - RNA, 17 nt, Mycobacterium avium subsp. paratuberculosis
ugccggcgaucaccggg

SEQ ID NO: 3006865 - RNA, 19 nt, Mycobacterium avium subsp. paratuberculosis
ugccggcgauccgcgcggc

SEQ ID NO: 3006866 - RNA, 21 nt, Mycobacterium avium subsp. paratuberculosis
ugccggcgauccgcgcggcga

SEQ ID NO: 3006867 - RNA, 23 nt, Mycobacterium avium subsp. paratuberculosis
ugccggcgauccgcgcggcgacg

SEQ ID NO: 3006868 - RNA, 14 nt, Mycobacterium avium subsp. paratuberculosis
ugccggcgauggug

SEQ ID NO: 3006869 - RNA, 21 nt, Mycobacterium avium subsp. paratuberculosis
ugccggcgaugguggcgcugc

SEQ ID NO: 3006870 - RNA, 23 nt, Mycobacterium avium subsp. paratuberculosis
ugccggcgaugguggcgcugccg

SEQ ID NO: 3006871 - RNA, 14 nt, Mycobacterium avium subsp. paratuberculosis
ugccggcgcacccg

SEQ ID NO: 3006872 - RNA, 14 nt, Mycobacterium avium subsp. paratuberculosis
ugccggcgcaccgc

SEQ ID NO: 3006873 - RNA, 15 nt, Mycobacterium avium subsp. paratuberculosis
ugccggcgcaccgcg

SEQ ID NO: 3006874 - RNA, 16 nt, Mycobacterium avium subsp. paratuberculosis
ugccggcgcaccgcgu

SEQ ID NO: 3006875 - RNA, 22 nt, Mycobacterium avium subsp. paratuberculosis
ugccggcgcaccgcgucgacca

SEQ ID NO: 3006876 - RNA, 23 nt, Mycobacterium avium subsp. paratuberculosis
ugccggcgccgauuccgucggug

SEQ ID NO: 3006877 - RNA, 13 nt, Mycobacterium avium subsp. paratuberculosis
ugccggcgccgga

SEQ ID NO: 3006878 - RNA, 15 nt, Mycobacterium avium subsp. paratuberculosis
ugccggcgccggauc

SEQ ID NO: 3006879 - RNA, 18 nt, Mycobacterium avium subsp. paratuberculosis
ugccggcgcucgucgucg

SEQ ID NO: 3006880 - RNA, 13 nt, Mycobacterium avium subsp. paratuberculosis
ugccggcggacag

SEQ ID NO: 3006881 - RNA, 19 nt, Mycobacterium avium subsp. paratuberculosis
ugccggcggacagccccga

SEQ ID NO: 3006882 - RNA, 23 nt, Mycobacterium avium subsp. paratuberculosis
ugccggcggacagccccgagccg

SEQ ID NO: 3006883 - RNA, 15 nt, Mycobacterium avium subsp. paratuberculosis
ugccggcggccagca

SEQ ID NO: 3006884 - RNA, 13 nt, Mycobacterium avium subsp. paratuberculosis
ugccggcggccgc

SEQ ID NO: 3006885 - RNA, 13 nt, Mycobacterium avium subsp. paratuberculosis
ugccggcggcgcg

SEQ ID NO: 3006886 - RNA, 17 nt, Mycobacterium avium subsp. paratuberculosis
ugccggcggcgcggcag

SEQ ID NO: 3006887 - RNA, 16 nt, Mycobacterium avium subsp. paratuberculosis
ugccggcgggucagca

SEQ ID NO: 3006888 - RNA, 20 nt, Mycobacterium avium subsp. paratuberculosis
ugccggcgguaccgccgauc

SEQ ID NO: 3006889 - RNA, 24 nt, Mycobacterium avium subsp. paratuberculosis
ugccggcgguaccgccgaucguga

SEQ ID NO: 3006890 - RNA, 12 nt, Mycobacterium avium subsp. paratuberculosis
ugccggcggugu

SEQ ID NO: 3006891 - RNA, 21 nt, Mycobacterium avium subsp. paratuberculosis
ugccggcgguguccacgaugc

SEQ ID NO: 3006892 - RNA, 15 nt, Mycobacterium avium subsp. paratuberculosis
ugccggcucggcggc

SEQ ID NO: 3006893 - RNA, 22 nt, Mycobacterium avium subsp. paratuberculosis
ugccggcucggcggcucagcaa

SEQ ID NO: 3006894 - RNA, 18 nt, Mycobacterium avium subsp. paratuberculosis
ugccggcugaaccugcug

SEQ ID NO: 3006895 - RNA, 16 nt, Mycobacterium avium subsp. paratuberculosis
ugccgggaagcgaagc

SEQ ID NO: 3006896 - RNA, 22 nt, Mycobacterium avium subsp. paratuberculosis
ugccgggcaaccacagcggcgc

SEQ ID NO: 3006897 - RNA, 16 nt, Mycobacterium avium subsp. paratuberculosis
ugccgggcaccagcga

SEQ ID NO: 3006898 - RNA, 20 nt, Mycobacterium avium subsp. paratuberculosis
ugccgggcaccagcgacagc

SEQ ID NO: 3006899 - RNA, 15 nt, Mycobacterium avium subsp. paratuberculosis
ugccgggcagcggcc

SEQ ID NO: 3006900 - RNA, 15 nt, Mycobacterium avium subsp. paratuberculosis
ugccgggcauggcug

SEQ ID NO: 3006901 - RNA, 12 nt, Mycobacterium avium subsp. paratuberculosis
ugccgggccaga

SEQ ID NO: 3006902 - RNA, 15 nt, Mycobacterium avium subsp. paratuberculosis
ugccgggccagccgg

SEQ ID NO: 3006903 - RNA, 21 nt, Mycobacterium avium subsp. paratuberculosis
ugccgggccagcugcucguac

SEQ ID NO: 3006904 - RNA, 21 nt, Mycobacterium avium subsp. paratuberculosis
ugccgggccgcauccagcgcc

SEQ ID NO: 3006905 - RNA, 15 nt, Mycobacterium avium subsp. paratuberculosis
ugccgggcggcgacg

SEQ ID NO: 3006906 - RNA, 21 nt, Mycobacterium avium subsp. paratuberculosis
ugccgggcggcgacgucgugg

SEQ ID NO: 3006907 - RNA, 22 nt, Mycobacterium avium subsp. paratuberculosis
ugccgggcgguacgcgccgcgc

SEQ ID NO: 3006908 - RNA, 17 nt, Mycobacterium avium subsp. paratuberculosis
ugccgggcgucgacgau

SEQ ID NO: 3006909 - RNA, 18 nt, Mycobacterium avium subsp. paratuberculosis
ugccgggcuccgcguucg

SEQ ID NO: 3006910 - RNA, 16 nt, Mycobacterium avium subsp. paratuberculosis
ugccggggcagcaccc

SEQ ID NO: 3006911 - RNA, 15 nt, Mycobacterium avium subsp. paratuberculosis
ugccggggcgcagcu

SEQ ID NO: 3006912 - RNA, 16 nt, Mycobacterium avium subsp. paratuberculosis
ugccgggggccgagca

SEQ ID NO: 3006913 - RNA, 17 nt, Mycobacterium avium subsp. paratuberculosis
ugccggggugcagcacc

SEQ ID NO: 3006914 - RNA, 18 nt, Mycobacterium avium subsp. paratuberculosis
ugccggggugcagcacca

SEQ ID NO: 3006915 - RNA, 19 nt, Mycobacterium avium subsp. paratuberculosis
ugccggggugcagcaccac

SEQ ID NO: 3006916 - RNA, 16 nt, Mycobacterium avium subsp. paratuberculosis
ugccgggucgcagcgg

SEQ ID NO: 3006917 - RNA, 21 nt, Mycobacterium avium subsp. paratuberculosis
ugccgggucgcagcggcacgu

SEQ ID NO: 3006918 - RNA, 15 nt, Mycobacterium avium subsp. paratuberculosis
ugccgggugaugcag

SEQ ID NO: 3006919 - RNA, 19 nt, Mycobacterium avium subsp. paratuberculosis
ugccgggugggcagcccca

SEQ ID NO: 3006920 - RNA, 18 nt, Mycobacterium avium subsp. paratuberculosis
ugccgguacggccgacgc

SEQ ID NO: 3006921 - RNA, 22 nt, Mycobacterium avium subsp. paratuberculosis
ugccggucaggcauuccaccgc

SEQ ID NO: 3006922 - RNA, 23 nt, Mycobacterium avium subsp. paratuberculosis
ugccggucaggcauuccaccgcg

SEQ ID NO: 3006923 - RNA, 17 nt, Mycobacterium avium subsp. paratuberculosis
ugccgguccagccgccg

SEQ ID NO: 3006924 - RNA, 19 nt, Mycobacterium avium subsp. paratuberculosis
ugccggucgaugucggcga

SEQ ID NO: 3006925 - RNA, 20 nt, Mycobacterium avium subsp. paratuberculosis
ugccggucuuguagucgacc

SEQ ID NO: 3006926 - RNA, 20 nt, Mycobacterium avium subsp. paratuberculosis
ugccggugacggucagggug

SEQ ID NO: 3006927 - RNA, 22 nt, Mycobacterium avium subsp. paratuberculosis
ugccggugaugaacgcgccguc

SEQ ID NO: 3006928 - RNA, 19 nt, Mycobacterium avium subsp. paratuberculosis
ugccggugcagaucgucca

SEQ ID NO: 3006929 - RNA, 17 nt, Mycobacterium avium subsp. paratuberculosis
ugccggugccgacgauc

SEQ ID NO: 3006930 - RNA, 23 nt, Mycobacterium avium subsp. paratuberculosis
ugccgguggaacaguucggugcg

SEQ ID NO: 3006931 - RNA, 19 nt, Mycobacterium avium subsp. paratuberculosis
ugccgguggucccggucag

SEQ ID NO: 3006932 - RNA, 13 nt, Mycobacterium avium subsp. paratuberculosis
ugccggugucggu

SEQ ID NO: 3006933 - RNA, 15 nt, Mycobacterium avium subsp. paratuberculosis
ugccggugucggugc

SEQ ID NO: 3006934 - RNA, 16 nt, Mycobacterium avium subsp. paratuberculosis
ugccggugucggugcg

SEQ ID NO: 3006935 - RNA, 19 nt, Mycobacterium avium subsp. paratuberculosis
ugccgguguugccgacggc

SEQ ID NO: 3006936 - RNA, 17 nt, Mycobacterium avium subsp. paratuberculosis
ugccguaaguggcgccg

SEQ ID NO: 3006937 - RNA, 19 nt, Mycobacterium avium subsp. paratuberculosis
ugccguaaguggcgccgcg

SEQ ID NO: 3006938 - RNA, 20 nt, Mycobacterium avium subsp. paratuberculosis
ugccguaaguggcgccgcgg

SEQ ID NO: 3006939 - RNA, 21 nt, Mycobacterium avium subsp. paratuberculosis
ugccguaaguggcgccgcggu

SEQ ID NO: 3006940 - RNA, 15 nt, Mycobacterium avium subsp. paratuberculosis
ugccguacaugguga

SEQ ID NO: 3006941 - RNA, 21 nt, Mycobacterium avium subsp. paratuberculosis
ugccguacauggugaccagcg

SEQ ID NO: 3006942 - RNA, 22 nt, Mycobacterium avium subsp. paratuberculosis
ugccguagagccguuuggcgcc

SEQ ID NO: 3006943 - RNA, 19 nt, Mycobacterium avium subsp. paratuberculosis
ugccguagaucucgcgccg

SEQ ID NO: 3006944 - RNA, 20 nt, Mycobacterium avium subsp. paratuberculosis
ugccguagaucucgcgccgc

SEQ ID NO: 3006945 - RNA, 23 nt, Mycobacterium avium subsp. paratuberculosis
ugccguagaucucgcgccgcgca

SEQ ID NO: 3006946 - RNA, 13 nt, Mycobacterium avium subsp. paratuberculosis
ugccguagcgcau

SEQ ID NO: 3006947 - RNA, 16 nt, Mycobacterium avium subsp. paratuberculosis
ugccguagcgcaugau

SEQ ID NO: 3006948 - RNA, 15 nt, Mycobacterium avium subsp. paratuberculosis
ugccguagcgcuggg

SEQ ID NO: 3006949 - RNA, 13 nt, Mycobacterium avium subsp. paratuberculosis
ugccguagcgguc

SEQ ID NO: 3006950 - RNA, 15 nt, Mycobacterium avium subsp. paratuberculosis
ugccguagcggucgc

SEQ ID NO: 3006951 - RNA, 23 nt, Mycobacterium avium subsp. paratuberculosis
ugccgucacccagaucgcccggg

SEQ ID NO: 3006952 - RNA, 20 nt, Mycobacterium avium subsp. paratuberculosis
ugccgucaccggccauccgc

SEQ ID NO: 3006953 - RNA, 14 nt, Mycobacterium avium subsp. paratuberculosis
ugccgucacgcccg

SEQ ID NO: 3006954 - RNA, 15 nt, Mycobacterium avium subsp. paratuberculosis
ugccgucacgcccgu

SEQ ID NO: 3006955 - RNA, 20 nt, Mycobacterium avium subsp. paratuberculosis
ugccgucacgcccguugacg

SEQ ID NO: 3006956 - RNA, 21 nt, Mycobacterium avium subsp. paratuberculosis
ugccgucacguucaccaccgg

SEQ ID NO: 3006957 - RNA, 17 nt, Mycobacterium avium subsp. paratuberculosis
ugccgucacugucggcg

SEQ ID NO: 3006958 - RNA, 20 nt, Mycobacterium avium subsp. paratuberculosis
ugccgucacugucggcgcgg

SEQ ID NO: 3006959 - RNA, 20 nt, Mycobacterium avium subsp. paratuberculosis
ugccguccagcaacgccgac

SEQ ID NO: 3006960 - RNA, 21 nt, Mycobacterium avium subsp. paratuberculosis
ugccguccagcuccgccgaca

SEQ ID NO: 3006961 - RNA, 22 nt, Mycobacterium avium subsp. paratuberculosis
ugccgucccccgagcgggccuu

SEQ ID NO: 3006962 - RNA, 14 nt, Mycobacterium avium subsp. paratuberculosis
ugccguccggccgg

SEQ ID NO: 3006963 - RNA, 23 nt, Mycobacterium avium subsp. paratuberculosis
ugccguccggccgguuggcggcc

SEQ ID NO: 3006964 - RNA, 13 nt, Mycobacterium avium subsp. paratuberculosis
ugccguccggcgg

SEQ ID NO: 3006965 - RNA, 14 nt, Mycobacterium avium subsp. paratuberculosis
ugccguccggcggc

SEQ ID NO: 3006966 - RNA, 18 nt, Mycobacterium avium subsp. paratuberculosis
ugccguccucggccgcca

SEQ ID NO: 3006967 - RNA, 17 nt, Mycobacterium avium subsp. paratuberculosis
ugccguccuugucgcgc

SEQ ID NO: 3006968 - RNA, 13 nt, Mycobacterium avium subsp. paratuberculosis
ugccgucgacgaa

SEQ ID NO: 3006969 - RNA, 17 nt, Mycobacterium avium subsp. paratuberculosis
ugccgucgacgacgguc

SEQ ID NO: 3006970 - RNA, 12 nt, Mycobacterium avium subsp. paratuberculosis
ugccgucgacgc

SEQ ID NO: 3006971 - RNA, 20 nt, Mycobacterium avium subsp. paratuberculosis
ugccgucgagcagggugacg

SEQ ID NO: 3006972 - RNA, 17 nt, Mycobacterium avium subsp. paratuberculosis
ugccgucgaucgcccgc

SEQ ID NO: 3006973 - RNA, 18 nt, Mycobacterium avium subsp. paratuberculosis
ugccgucgcgcucgacga

SEQ ID NO: 3006974 - RNA, 24 nt, Mycobacterium avium subsp. paratuberculosis
ugccgucgcgggcgucgggcagca

SEQ ID NO: 3006975 - RNA, 16 nt, Mycobacterium avium subsp. paratuberculosis
ugccgucgggacgcgg

SEQ ID NO: 3006976 - RNA, 17 nt, Mycobacterium avium subsp. paratuberculosis
ugccgucgggacgcggc

SEQ ID NO: 3006977 - RNA, 18 nt, Mycobacterium avium subsp. paratuberculosis
ugccgucgggacgcggca

SEQ ID NO: 3006978 - RNA, 23 nt, Mycobacterium avium subsp. paratuberculosis
ugccgucgguuucggucgcggug

SEQ ID NO: 3006979 - RNA, 14 nt, Mycobacterium avium subsp. paratuberculosis
ugccgucguugacg

SEQ ID NO: 3006980 - RNA, 20 nt, Mycobacterium avium subsp. paratuberculosis
ugccgucguugacgcccucc

SEQ ID NO: 3006981 - RNA, 18 nt, Mycobacterium avium subsp. paratuberculosis
ugccgugccagccggccg

SEQ ID NO: 3006982 - RNA, 13 nt, Mycobacterium avium subsp. paratuberculosis
ugccgugcgcgcu

SEQ ID NO: 3006983 - RNA, 12 nt, Mycobacterium avium subsp. paratuberculosis
ugccgugcucgg

SEQ ID NO: 3006984 - RNA, 16 nt, Mycobacterium avium subsp. paratuberculosis
ugccgugcucggcggc

SEQ ID NO: 3006985 - RNA, 20 nt, Mycobacterium avium subsp. paratuberculosis
ugccgugcucggcggcgggg

SEQ ID NO: 3006986 - RNA, 14 nt, Mycobacterium avium subsp. paratuberculosis
ugccgugcugggac

SEQ ID NO: 3006987 - RNA, 14 nt, Mycobacterium avium subsp. paratuberculosis
ugccgugcugggcg

SEQ ID NO: 3006988 - RNA, 15 nt, Mycobacterium avium subsp. paratuberculosis
ugccguggcggcggu

SEQ ID NO: 3006989 - RNA, 13 nt, Mycobacterium avium subsp. paratuberculosis
ugccguggucggu

SEQ ID NO: 3006990 - RNA, 19 nt, Mycobacterium avium subsp. paratuberculosis
ugccguuccagccggcccg

SEQ ID NO: 3006991 - RNA, 15 nt, Mycobacterium avium subsp. paratuberculosis
ugccguucgcgccgu

SEQ ID NO: 3006992 - RNA, 16 nt, Mycobacterium avium subsp. paratuberculosis
ugccguugagcgugga

SEQ ID NO: 3006993 - RNA, 22 nt, Mycobacterium avium subsp. paratuberculosis
ugccguugagcguggacaccgc

SEQ ID NO: 3006994 - RNA, 17 nt, Mycobacterium avium subsp. paratuberculosis
ugccguugaucaccgug

SEQ ID NO: 3006995 - RNA, 20 nt, Mycobacterium avium subsp. paratuberculosis
ugccguugaucagggcggcg

SEQ ID NO: 3006996 - RNA, 14 nt, Mycobacterium avium subsp. paratuberculosis
ugccguugccaggc

SEQ ID NO: 3006997 - RNA, 22 nt, Mycobacterium avium subsp. paratuberculosis
ugccguugccaggccgcgagca

SEQ ID NO: 3006998 - RNA, 18 nt, Mycobacterium avium subsp. paratuberculosis
ugccguugcgccagcggg

SEQ ID NO: 3006999 - RNA, 15 nt, Mycobacterium avium subsp. paratuberculosis
ugccguugggcacgg

SEQ ID NO: 3007000 - RNA, 21 nt, Mycobacterium avium subsp. paratuberculosis
ugccguuggucuguggucggu

SEQ ID NO: 3007001 - RNA, 13 nt, Mycobacterium avium subsp. paratuberculosis
ugccguuggugac

SEQ ID NO: 3007002 - RNA, 18 nt, Mycobacterium avium subsp. paratuberculosis
ugccuacaggugccggcg

SEQ ID NO: 3007003 - RNA, 16 nt, Mycobacterium avium subsp. paratuberculosis
ugccuacuugcggccg

SEQ ID NO: 3007004 - RNA, 19 nt, Mycobacterium avium subsp. paratuberculosis
ugccuccacgucaccgacg

SEQ ID NO: 3007005 - RNA, 17 nt, Mycobacterium avium subsp. paratuberculosis
ugccucgacgaugggug

SEQ ID NO: 3007006 - RNA, 14 nt, Mycobacterium avium subsp. paratuberculosis
ugccucggccagca

SEQ ID NO: 3007007 - RNA, 17 nt, Mycobacterium avium subsp. paratuberculosis
ugccucuucgucggccg

SEQ ID NO: 3007008 - RNA, 19 nt, Mycobacterium avium subsp. paratuberculosis
ugccucuucgucggccggc

SEQ ID NO: 3007009 - RNA, 14 nt, Mycobacterium avium subsp. paratuberculosis
ugccugcccagcgg

SEQ ID NO: 3007010 - RNA, 18 nt, Mycobacterium avium subsp. paratuberculosis
ugccugcccgcgcaggcc

SEQ ID NO: 3007011 - RNA, 17 nt, Mycobacterium avium subsp. paratuberculosis
ugccugcgggcccagcu

SEQ ID NO: 3007012 - RNA, 22 nt, Mycobacterium avium subsp. paratuberculosis
ugccuggcccagacaggccggc

SEQ ID NO: 3007013 - RNA, 15 nt, Mycobacterium avium subsp. paratuberculosis
ugccuuagcccggcc

SEQ ID NO: 3007014 - RNA, 12 nt, Mycobacterium avium subsp. paratuberculosis
ugccuugcgccc

SEQ ID NO: 3007015 - RNA, 17 nt, Mycobacterium avium subsp. paratuberculosis
ugccuugcugacgccgc

SEQ ID NO: 3007016 - RNA, 23 nt, Mycobacterium avium subsp. paratuberculosis
ugccuuggcccgcgcggccgcca

SEQ ID NO: 3007017 - RNA, 13 nt, Mycobacterium avium subsp. paratuberculosis
ugccuuggcggcg

SEQ ID NO: 3007018 - RNA, 17 nt, Mycobacterium avium subsp. paratuberculosis
ugccuuuccgcgcggcg

SEQ ID NO: 3007019 - RNA, 18 nt, Mycobacterium avium subsp. paratuberculosis
ugcgaaacucaccgcguc

SEQ ID NO: 3007020 - RNA, 20 nt, Mycobacterium avium subsp. paratuberculosis
ugcgaaacucaccgcgucag

SEQ ID NO: 3007021 - RNA, 20 nt, Mycobacterium avium subsp. paratuberculosis
ugcgaaagcccaggcccggc

SEQ ID NO: 3007022 - RNA, 14 nt, Mycobacterium avium subsp. paratuberculosis
ugcgaaagcgcggg

SEQ ID NO: 3007023 - RNA, 21 nt, Mycobacterium avium subsp. paratuberculosis
ugcgaagacccgaaacuggga

SEQ ID NO: 3007024 - RNA, 17 nt, Mycobacterium avium subsp. paratuberculosis
ugcgaauacccgcccag

SEQ ID NO: 3007025 - RNA, 18 nt, Mycobacterium avium subsp. paratuberculosis
ugcgaauacccgcccagc

SEQ ID NO: 3007026 - RNA, 13 nt, Mycobacterium avium subsp. paratuberculosis
ugcgaaucgucgg

SEQ ID NO: 3007027 - RNA, 16 nt, Mycobacterium avium subsp. paratuberculosis
ugcgaaucgucggcga

SEQ ID NO: 3007028 - RNA, 15 nt, Mycobacterium avium subsp. paratuberculosis
ugcgaaugacgcgca

SEQ ID NO: 3007029 - RNA, 16 nt, Mycobacterium avium subsp. paratuberculosis
ugcgacaccgcguccu

SEQ ID NO: 3007030 - RNA, 15 nt, Mycobacterium avium subsp. paratuberculosis
ugcgacagaaaucgc

SEQ ID NO: 3007031 - RNA, 20 nt, Mycobacterium avium subsp. paratuberculosis
ugcgacagaaaucgcgcaga

SEQ ID NO: 3007032 - RNA, 16 nt, Mycobacterium avium subsp. paratuberculosis
ugcgacaggucggcgg

SEQ ID NO: 3007033 - RNA, 18 nt, Mycobacterium avium subsp. paratuberculosis
ugcgacccaccgucgaag

SEQ ID NO: 3007034 - RNA, 17 nt, Mycobacterium avium subsp. paratuberculosis
ugcgaccccgccgucga

SEQ ID NO: 3007035 - RNA, 21 nt, Mycobacterium avium subsp. paratuberculosis
ugcgaccccgccgucgacgcg

SEQ ID NO: 3007036 - RNA, 12 nt, Mycobacterium avium subsp. paratuberculosis
ugcgaccgccgc

SEQ ID NO: 3007037 - RNA, 20 nt, Mycobacterium avium subsp. paratuberculosis
ugcgaccgccgccgcgacca

SEQ ID NO: 3007038 - RNA, 14 nt, Mycobacterium avium subsp. paratuberculosis
ugcgaccgccgcua

SEQ ID NO: 3007039 - RNA, 18 nt, Mycobacterium avium subsp. paratuberculosis
ugcgacgcaccucggccg

SEQ ID NO: 3007040 - RNA, 13 nt, Mycobacterium avium subsp. paratuberculosis
ugcgacgccgcgc

SEQ ID NO: 3007041 - RNA, 22 nt, Mycobacterium avium subsp. paratuberculosis
ugcgacgccgcgcagcggggcg

SEQ ID NO: 3007042 - RNA, 14 nt, Mycobacterium avium subsp. paratuberculosis
ugcgacggcagcac

SEQ ID NO: 3007043 - RNA, 14 nt, Mycobacterium avium subsp. paratuberculosis
ugcgacggcucuuc

SEQ ID NO: 3007044 - RNA, 20 nt, Mycobacterium avium subsp. paratuberculosis
ugcgacggcucuucgcggcg

SEQ ID NO: 3007045 - RNA, 21 nt, Mycobacterium avium subsp. paratuberculosis
ugcgacggcucuucgcggcgg

SEQ ID NO: 3007046 - RNA, 22 nt, Mycobacterium avium subsp. paratuberculosis
ugcgacuucuacggcgggccgg

SEQ ID NO: 3007047 - RNA, 16 nt, Mycobacterium avium subsp. paratuberculosis
ugcgacuugcgcgccg

SEQ ID NO: 3007048 - RNA, 18 nt, Mycobacterium avium subsp. paratuberculosis
ugcgacuugcgcgccgug

SEQ ID NO: 3007049 - RNA, 19 nt, Mycobacterium avium subsp. paratuberculosis
ugcgacuugcgcgccguga

SEQ ID NO: 3007050 - RNA, 19 nt, Mycobacterium avium subsp. paratuberculosis
ugcgacuugguggccagca

SEQ ID NO: 3007051 - RNA, 14 nt, Mycobacterium avium subsp. paratuberculosis
ugcgagaucggcag

SEQ ID NO: 3007052 - RNA, 22 nt, Mycobacterium avium subsp. paratuberculosis
ugcgagauggggugaugcgucc

SEQ ID NO: 3007053 - RNA, 14 nt, Mycobacterium avium subsp. paratuberculosis
ugcgagcaggccga

SEQ ID NO: 3007054 - RNA, 17 nt, Mycobacterium avium subsp. paratuberculosis
ugcgagcaggccgaggc

SEQ ID NO: 3007055 - RNA, 15 nt, Mycobacterium avium subsp. paratuberculosis
ugcgagcccggccag

SEQ ID NO: 3007056 - RNA, 20 nt, Mycobacterium avium subsp. paratuberculosis
ugcgagccgagcacgcagcc

SEQ ID NO: 3007057 - RNA, 21 nt, Mycobacterium avium subsp. paratuberculosis
ugcgagccgagcacgcagccg

SEQ ID NO: 3007058 - RNA, 12 nt, Mycobacterium avium subsp. paratuberculosis
ugcgagccgcug

SEQ ID NO: 3007059 - RNA, 16 nt, Mycobacterium avium subsp. paratuberculosis
ugcgagccggagccuu

SEQ ID NO: 3007060 - RNA, 23 nt, Mycobacterium avium subsp. paratuberculosis
ugcgagcgugaaguuaguuucac

SEQ ID NO: 3007061 - RNA, 13 nt, Mycobacterium avium subsp. paratuberculosis
ugcgaucauuccg

SEQ ID NO: 3007062 - RNA, 13 nt, Mycobacterium avium subsp. paratuberculosis
ugcgaucgccgac

SEQ ID NO: 3007063 - RNA, 13 nt, Mycobacterium avium subsp. paratuberculosis
ugcgaucgccgcg

SEQ ID NO: 3007064 - RNA, 13 nt, Mycobacterium avium subsp. paratuberculosis
ugcgaucgcgucg

SEQ ID NO: 3007065 - RNA, 21 nt, Mycobacterium avium subsp. paratuberculosis
ugcgaugggugaucgcggccc

SEQ ID NO: 3007066 - RNA, 15 nt, Mycobacterium avium subsp. paratuberculosis
ugcgaugguggucgc

SEQ ID NO: 3007067 - RNA, 19 nt, Mycobacterium avium subsp. paratuberculosis
ugcgaugguggucgccguc

SEQ ID NO: 3007068 - RNA, 15 nt, Mycobacterium avium subsp. paratuberculosis
ugcgaugucggugcg

SEQ ID NO: 3007069 - RNA, 20 nt, Mycobacterium avium subsp. paratuberculosis
ugcgcaacaccucggcgacg

SEQ ID NO: 3007070 - RNA, 13 nt, Mycobacterium avium subsp. paratuberculosis
ugcgcaacagcgu

SEQ ID NO: 3007071 - RNA, 14 nt, Mycobacterium avium subsp. paratuberculosis
ugcgcaacagcgug

SEQ ID NO: 3007072 - RNA, 21 nt, Mycobacterium avium subsp. paratuberculosis
ugcgcaacagcgugcacaccc

SEQ ID NO: 3007073 - RNA, 14 nt, Mycobacterium avium subsp. paratuberculosis
ugcgcaagaagggc

SEQ ID NO: 3007074 - RNA, 14 nt, Mycobacterium avium subsp. paratuberculosis
ugcgcaagcaccgg

SEQ ID NO: 3007075 - RNA, 21 nt, Mycobacterium avium subsp. paratuberculosis
ugcgcaccacgcccgacgacg

SEQ ID NO: 3007076 - RNA, 13 nt, Mycobacterium avium subsp. paratuberculosis
ugcgcaccacguc

SEQ ID NO: 3007077 - RNA, 14 nt, Mycobacterium avium subsp. paratuberculosis
ugcgcaccagcagg

SEQ ID NO: 3007078 - RNA, 16 nt, Mycobacterium avium subsp. paratuberculosis
ugcgcaccaucaccug

SEQ ID NO: 3007079 - RNA, 21 nt, Mycobacterium avium subsp. paratuberculosis
ugcgcaccccguugccgccgg

SEQ ID NO: 3007080 - RNA, 22 nt, Mycobacterium avium subsp. paratuberculosis
ugcgcaccccguugccgccggc

SEQ ID NO: 3007081 - RNA, 21 nt, Mycobacterium avium subsp. paratuberculosis
ugcgcacccgcgggucgucgg

SEQ ID NO: 3007082 - RNA, 15 nt, Mycobacterium avium subsp. paratuberculosis
ugcgcacccgguccg

SEQ ID NO: 3007083 - RNA, 21 nt, Mycobacterium avium subsp. paratuberculosis
ugcgcaccgccagcaccgacg

SEQ ID NO: 3007084 - RNA, 14 nt, Mycobacterium avium subsp. paratuberculosis
ugcgcaccgugccg

SEQ ID NO: 3007085 - RNA, 15 nt, Mycobacterium avium subsp. paratuberculosis
ugcgcaccugcggcc

SEQ ID NO: 3007086 - RNA, 19 nt, Mycobacterium avium subsp. paratuberculosis
ugcgcacgaucugcaggcc

SEQ ID NO: 3007087 - RNA, 16 nt, Mycobacterium avium subsp. paratuberculosis
ugcgcacguaccggua

SEQ ID NO: 3007088 - RNA, 22 nt, Mycobacterium avium subsp. paratuberculosis
ugcgcacguaccgguacagcga

SEQ ID NO: 3007089 - RNA, 15 nt, Mycobacterium avium subsp. paratuberculosis
ugcgcacgucggccg

SEQ ID NO: 3007090 - RNA, 16 nt, Mycobacterium avium subsp. paratuberculosis
ugcgcacgucggccgc

SEQ ID NO: 3007091 - RNA, 22 nt, Mycobacterium avium subsp. paratuberculosis
ugcgcacgucggccgccagggc

SEQ ID NO: 3007092 - RNA, 13 nt, Mycobacterium avium subsp. paratuberculosis
ugcgcagcaccgu

SEQ ID NO: 3007093 - RNA, 12 nt, Mycobacterium avium subsp. paratuberculosis
ugcgcagcaccu

SEQ ID NO: 3007094 - RNA, 20 nt, Mycobacterium avium subsp. paratuberculosis
ugcgcagcagcaggucggcc

SEQ ID NO: 3007095 - RNA, 22 nt, Mycobacterium avium subsp. paratuberculosis
ugcgcagcagccaggacagcgu

SEQ ID NO: 3007096 - RNA, 12 nt, Mycobacterium avium subsp. paratuberculosis
ugcgcagcagcg

SEQ ID NO: 3007097 - RNA, 14 nt, Mycobacterium avium subsp. paratuberculosis
ugcgcagccgcugc

SEQ ID NO: 3007098 - RNA, 17 nt, Mycobacterium avium subsp. paratuberculosis
ugcgcagccgcugcagc

SEQ ID NO: 3007099 - RNA, 21 nt, Mycobacterium avium subsp. paratuberculosis
ugcgcagccgcugcagcgccg

SEQ ID NO: 3007100 - RNA, 23 nt, Mycobacterium avium subsp. paratuberculosis
ugcgcagccgcugcagcgccgcc

SEQ ID NO: 3007101 - RNA, 15 nt, Mycobacterium avium subsp. paratuberculosis
ugcgcagccggcagc

SEQ ID NO: 3007102 - RNA, 14 nt, Mycobacterium avium subsp. paratuberculosis
ugcgcagccgggcg

SEQ ID NO: 3007103 - RNA, 18 nt, Mycobacterium avium subsp. paratuberculosis
ugcgcagccgggcgguga

SEQ ID NO: 3007104 - RNA, 13 nt, Mycobacterium avium subsp. paratuberculosis
ugcgcagcgcagc

SEQ ID NO: 3007105 - RNA, 14 nt, Mycobacterium avium subsp. paratuberculosis
ugcgcagcgcagca

SEQ ID NO: 3007106 - RNA, 20 nt, Mycobacterium avium subsp. paratuberculosis
ugcgcagcgcagcaccaucc

SEQ ID NO: 3007107 - RNA, 20 nt, Mycobacterium avium subsp. paratuberculosis
ugcgcagcgcccaggcgugc

SEQ ID NO: 3007108 - RNA, 20 nt, Mycobacterium avium subsp. paratuberculosis
ugcgcaggcggcgcgcagcc

SEQ ID NO: 3007109 - RNA, 23 nt, Mycobacterium avium subsp. paratuberculosis
ugcgcaggcggcgcgcagccggc

SEQ ID NO: 3007110 - RNA, 22 nt, Mycobacterium avium subsp. paratuberculosis
ugcgcagguugucggccaacag

SEQ ID NO: 3007111 - RNA, 16 nt, Mycobacterium avium subsp. paratuberculosis
ugcgcagucgcugguc

SEQ ID NO: 3007112 - RNA, 18 nt, Mycobacterium avium subsp. paratuberculosis
ugcgcaucagcgccacca

SEQ ID NO: 3007113 - RNA, 19 nt, Mycobacterium avium subsp. paratuberculosis
ugcgcaucggcgacgccgc

SEQ ID NO: 3007114 - RNA, 20 nt, Mycobacterium avium subsp. paratuberculosis
ugcgcaucggcgacgccgcc

SEQ ID NO: 3007115 - RNA, 21 nt, Mycobacterium avium subsp. paratuberculosis
ugcgcaucggcgacgccgccg

SEQ ID NO: 3007116 - RNA, 17 nt, Mycobacterium avium subsp. paratuberculosis
ugcgcaugacggccugc

SEQ ID NO: 3007117 - RNA, 16 nt, Mycobacterium avium subsp. paratuberculosis
ugcgcauucggcgacg

SEQ ID NO: 3007118 - RNA, 23 nt, Mycobacterium avium subsp. paratuberculosis
ugcgcauucggcgacgcucaggc

SEQ ID NO: 3007119 - RNA, 12 nt, Mycobacterium avium subsp. paratuberculosis
ugcgccaacgcu

SEQ ID NO: 3007120 - RNA, 15 nt, Mycobacterium avium subsp. paratuberculosis
ugcgccaccgacacc

SEQ ID NO: 3007121 - RNA, 22 nt, Mycobacterium avium subsp. paratuberculosis
ugcgccaccgacaccaccggcc

SEQ ID NO: 3007122 - RNA, 13 nt, Mycobacterium avium subsp. paratuberculosis
ugcgccacugcgg

SEQ ID NO: 3007123 - RNA, 18 nt, Mycobacterium avium subsp. paratuberculosis
ugcgccacugcgggaacg

SEQ ID NO: 3007124 - RNA, 23 nt, Mycobacterium avium subsp. paratuberculosis
ugcgccagaucagcguggucagc

SEQ ID NO: 3007125 - RNA, 16 nt, Mycobacterium avium subsp. paratuberculosis
ugcgccagcaccgaca

SEQ ID NO: 3007126 - RNA, 16 nt, Mycobacterium avium subsp. paratuberculosis
ugcgccagcagcagcg

SEQ ID NO: 3007127 - RNA, 21 nt, Mycobacterium avium subsp. paratuberculosis
ugcgccagcagcagcgcggca

SEQ ID NO: 3007128 - RNA, 13 nt, Mycobacterium avium subsp. paratuberculosis
ugcgccagcgacg

SEQ ID NO: 3007129 - RNA, 13 nt, Mycobacterium avium subsp. paratuberculosis
ugcgccagcgccg

SEQ ID NO: 3007130 - RNA, 14 nt, Mycobacterium avium subsp. paratuberculosis
ugcgccagcgccgg

SEQ ID NO: 3007131 - RNA, 15 nt, Mycobacterium avium subsp. paratuberculosis
ugcgccagcgccggg

SEQ ID NO: 3007132 - RNA, 13 nt, Mycobacterium avium subsp. paratuberculosis
ugcgccagcucca

SEQ ID NO: 3007133 - RNA, 17 nt, Mycobacterium avium subsp. paratuberculosis
ugcgccagcuccagcag

SEQ ID NO: 3007134 - RNA, 14 nt, Mycobacterium avium subsp. paratuberculosis
ugcgccaggauccg

SEQ ID NO: 3007135 - RNA, 22 nt, Mycobacterium avium subsp. paratuberculosis
ucggggcaucgcagcgcgcggc

SEQ ID NO: 3007136 - RNA, 16 nt, Mycobacterium avium subsp. paratuberculosis
ucggggcccaccccgg

SEQ ID NO: 3007137 - RNA, 18 nt, Mycobacterium avium subsp. paratuberculosis
ucggggcccaccccggac

SEQ ID NO: 3007138 - RNA, 20 nt, Mycobacterium avium subsp. paratuberculosis
ucggggcccaccccggacaa

SEQ ID NO: 3007139 - RNA, 18 nt, Mycobacterium avium subsp. paratuberculosis
ucggggcccggcccggcg

SEQ ID NO: 3007140 - RNA, 12 nt, Mycobacterium avium subsp. paratuberculosis
ucggggcccguc

SEQ ID NO: 3007141 - RNA, 22 nt, Mycobacterium avium subsp. paratuberculosis
ucggggcccguccccaccaccg

SEQ ID NO: 3007142 - RNA, 20 nt, Mycobacterium avium subsp. paratuberculosis
ucggggcccuccgcggcgcc

SEQ ID NO: 3007143 - RNA, 23 nt, Mycobacterium avium subsp. paratuberculosis
ucggggccgcacucuugcgugcg

SEQ ID NO: 3007144 - RNA, 17 nt, Mycobacterium avium subsp. paratuberculosis
ucggggcgcagcccggc

SEQ ID NO: 3007145 - RNA, 18 nt, Mycobacterium avium subsp. paratuberculosis
ucggggcgcagcccggcg

SEQ ID NO: 3007146 - RNA, 23 nt, Mycobacterium avium subsp. paratuberculosis
ucggggcgccuaccggguggcca

SEQ ID NO: 3007147 - RNA, 24 nt, Mycobacterium avium subsp. paratuberculosis
ucggggcggaugugccuggcccag

SEQ ID NO: 3007148 - RNA, 17 nt, Mycobacterium avium subsp. paratuberculosis
ucggggcgucggcggcc

SEQ ID NO: 3007149 - RNA, 20 nt, Mycobacterium avium subsp. paratuberculosis
ucggggcguggcggaagcgc

SEQ ID NO: 3007150 - RNA, 22 nt, Mycobacterium avium subsp. paratuberculosis
ucggggcucgcggugugggcgg

SEQ ID NO: 3007151 - RNA, 11 nt, Mycobacterium avium subsp. paratuberculosis
ucggggcuggc

SEQ ID NO: 3007152 - RNA, 13 nt, Mycobacterium avium subsp. paratuberculosis
ucgggggugucgu

SEQ ID NO: 3007153 - RNA, 16 nt, Mycobacterium avium subsp. paratuberculosis
ucgggggugucguagc

SEQ ID NO: 3007154 - RNA, 16 nt, Mycobacterium avium subsp. paratuberculosis
ucgggguacucggcgg

SEQ ID NO: 3007155 - RNA, 17 nt, Mycobacterium avium subsp. paratuberculosis
ucgggguacucggcggc

SEQ ID NO: 3007156 - RNA, 16 nt, Mycobacterium avium subsp. paratuberculosis
ucgggguagccggccc

SEQ ID NO: 3007157 - RNA, 18 nt, Mycobacterium avium subsp. paratuberculosis
ucgggguccaggccgcgc

SEQ ID NO: 3007158 - RNA, 20 nt, Mycobacterium avium subsp. paratuberculosis
ucgggguccaggccgcgccg

SEQ ID NO: 3007159 - RNA, 22 nt, Mycobacterium avium subsp. paratuberculosis
ucggggucgaacaucacccggc

SEQ ID NO: 3007160 - RNA, 13 nt, Mycobacterium avium subsp. paratuberculosis
ucggggucgauca

SEQ ID NO: 3007161 - RNA, 14 nt, Mycobacterium avium subsp. paratuberculosis
ucggggucggccga

SEQ ID NO: 3007162 - RNA, 13 nt, Mycobacterium avium subsp. paratuberculosis
ucggggucgucga

SEQ ID NO: 3007163 - RNA, 16 nt, Mycobacterium avium subsp. paratuberculosis
ucggggugcgccaggc

SEQ ID NO: 3007164 - RNA, 23 nt, Mycobacterium avium subsp. paratuberculosis
ucggggugcgccaggcaggcggc

SEQ ID NO: 3007165 - RNA, 15 nt, Mycobacterium avium subsp. paratuberculosis
ucgggguggacgcga

SEQ ID NO: 3007166 - RNA, 14 nt, Mycobacterium avium subsp. paratuberculosis
ucgggguggaucgc

SEQ ID NO: 3007167 - RNA, 17 nt, Mycobacterium avium subsp. paratuberculosis
ucgggguggaucgccca

SEQ ID NO: 3007168 - RNA, 15 nt, Mycobacterium avium subsp. paratuberculosis
ucgggguggccggcc

SEQ ID NO: 3007169 - RNA, 17 nt, Mycobacterium avium subsp. paratuberculosis
ucgggguggccggccag

SEQ ID NO: 3007170 - RNA, 23 nt, Mycobacterium avium subsp. paratuberculosis
ucgggguggccggccagcacacc

SEQ ID NO: 3007171 - RNA, 18 nt, Mycobacterium avium subsp. paratuberculosis
ucgggguggggacgacgc

SEQ ID NO: 3007172 - RNA, 21 nt, Mycobacterium avium subsp. paratuberculosis
ucgggguggggacgacgccga

SEQ ID NO: 3007173 - RNA, 16 nt, Mycobacterium avium subsp. paratuberculosis
ucgggguggugggcgc

SEQ ID NO: 3007174 - RNA, 18 nt, Mycobacterium avium subsp. paratuberculosis
ucgggguugacccggccg

SEQ ID NO: 3007175 - RNA, 16 nt, Mycobacterium avium subsp. paratuberculosis
ucggguacaccgagcc

SEQ ID NO: 3007176 - RNA, 15 nt, Mycobacterium avium subsp. paratuberculosis
ucggguagggcgccg

SEQ ID NO: 3007177 - RNA, 20 nt, Mycobacterium avium subsp. paratuberculosis
ucgggucaccgugcgggucg

SEQ ID NO: 3007178 - RNA, 14 nt, Mycobacterium avium subsp. paratuberculosis
ucggguccagcgcc

SEQ ID NO: 3007179 - RNA, 23 nt, Mycobacterium avium subsp. paratuberculosis
ucggguccagcgccgagcacggc

SEQ ID NO: 3007180 - RNA, 16 nt, Mycobacterium avium subsp. paratuberculosis
ucggguccgaccagca

SEQ ID NO: 3007181 - RNA, 18 nt, Mycobacterium avium subsp. paratuberculosis
ucggguccgaccagcacc

SEQ ID NO: 3007182 - RNA, 22 nt, Mycobacterium avium subsp. paratuberculosis
ucggguccgaccagcacccggg

SEQ ID NO: 3007183 - RNA, 14 nt, Mycobacterium avium subsp. paratuberculosis
ucggguccgcgguc

SEQ ID NO: 3007184 - RNA, 13 nt, Mycobacterium avium subsp. paratuberculosis
ucgggucgacgag

SEQ ID NO: 3007185 - RNA, 12 nt, Mycobacterium avium subsp. paratuberculosis
ucgggucgccgg

SEQ ID NO: 3007186 - RNA, 18 nt, Mycobacterium avium subsp. paratuberculosis
ucgggucggcgagcagcc

SEQ ID NO: 3007187 - RNA, 18 nt, Mycobacterium avium subsp. paratuberculosis
ucgggucgguggcgauga

SEQ ID NO: 3007188 - RNA, 14 nt, Mycobacterium avium subsp. paratuberculosis
ucgggugacgccuc

SEQ ID NO: 3007189 - RNA, 18 nt, Mycobacterium avium subsp. paratuberculosis
ucgggugcgcucaccgca

SEQ ID NO: 3007190 - RNA, 15 nt, Mycobacterium avium subsp. paratuberculosis
ucgggugcgggugcg

SEQ ID NO: 3007191 - RNA, 14 nt, Mycobacterium avium subsp. paratuberculosis
ucggguggcaggaa

SEQ ID NO: 3007192 - RNA, 13 nt, Mycobacterium avium subsp. paratuberculosis
ucggguggcgucg

SEQ ID NO: 3007193 - RNA, 17 nt, Mycobacterium avium subsp. paratuberculosis
ucggguggcgucgccgc

SEQ ID NO: 3007194 - RNA, 20 nt, Mycobacterium avium subsp. paratuberculosis
ucggguguaggcccgaucag

SEQ ID NO: 3007195 - RNA, 17 nt, Mycobacterium avium subsp. paratuberculosis
ucgggugucgccgagcc

SEQ ID NO: 3007196 - RNA, 16 nt, Mycobacterium avium subsp. paratuberculosis
ucggguguggacggcg

SEQ ID NO: 3007197 - RNA, 15 nt, Mycobacterium avium subsp. paratuberculosis
ucggguguggcgccg

SEQ ID NO: 3007198 - RNA, 17 nt, Mycobacterium avium subsp. paratuberculosis
ucggguucgccggugac

SEQ ID NO: 3007199 - RNA, 15 nt, Mycobacterium avium subsp. paratuberculosis
ucggguuggccaggg

SEQ ID NO: 3007200 - RNA, 16 nt, Mycobacterium avium subsp. paratuberculosis
ucggguuucgcgggcu

SEQ ID NO: 3007201 - RNA, 21 nt, Mycobacterium avium subsp. paratuberculosis
ucggguuuguccggcucugcc

SEQ ID NO: 3007202 - RNA, 15 nt, Mycobacterium avium subsp. paratuberculosis
ucgguaacugcgugu

SEQ ID NO: 3007203 - RNA, 23 nt, Mycobacterium avium subsp. paratuberculosis
ucgguaacugcguguggcgcacg

SEQ ID NO: 3007204 - RNA, 21 nt, Mycobacterium avium subsp. paratuberculosis
ucgguaaucggcgguggugaa

SEQ ID NO: 3007205 - RNA, 19 nt, Mycobacterium avium subsp. paratuberculosis
ucgguaccagggcagcgcc

SEQ ID NO: 3007206 - RNA, 24 nt, Mycobacterium avium subsp. paratuberculosis
ucgguaccagggcagcgccucggc

SEQ ID NO: 3007207 - RNA, 16 nt, Mycobacterium avium subsp. paratuberculosis
ucgguacccccgccgg

SEQ ID NO: 3007208 - RNA, 15 nt, Mycobacterium avium subsp. paratuberculosis
ucgguagggucgggu

SEQ ID NO: 3007209 - RNA, 23 nt, Mycobacterium avium subsp. paratuberculosis
ucgguagggucgggugcggcggu

SEQ ID NO: 3007210 - RNA, 18 nt, Mycobacterium avium subsp. paratuberculosis
ucggucaacccgaucgag

SEQ ID NO: 3007211 - RNA, 15 nt, Mycobacterium avium subsp. paratuberculosis
ucggucaagccggcc

SEQ ID NO: 3007212 - RNA, 18 nt, Mycobacterium avium subsp. paratuberculosis
ucggucaagccggccagc

SEQ ID NO: 3007213 - RNA, 21 nt, Mycobacterium avium subsp. paratuberculosis
ucggucaagccggccagcagc

SEQ ID NO: 3007214 - RNA, 13 nt, Mycobacterium avium subsp. paratuberculosis
ucggucaccagcg

SEQ ID NO: 3007215 - RNA, 17 nt, Mycobacterium avium subsp. paratuberculosis
ucggucaccagcggccc

SEQ ID NO: 3007216 - RNA, 13 nt, Mycobacterium avium subsp. paratuberculosis
ucggucaccagcu

SEQ ID NO: 3007217 - RNA, 19 nt, Mycobacterium avium subsp. paratuberculosis
ucggucacggacagccggc

SEQ ID NO: 3007218 - RNA, 18 nt, Mycobacterium avium subsp. paratuberculosis
ucggucagcaccggggcc

SEQ ID NO: 3007219 - RNA, 17 nt, Mycobacterium avium subsp. paratuberculosis
ucggucagcaggcgccg

SEQ ID NO: 3007220 - RNA, 19 nt, Mycobacterium avium subsp. paratuberculosis
ucggcgucgaugucgucgu

SEQ ID NO: 3007221 - RNA, 24 nt, Mycobacterium avium subsp. paratuberculosis
ucggcgucgaugucgucgucgacg

SEQ ID NO: 3007222 - RNA, 15 nt, Mycobacterium avium subsp. paratuberculosis
ucggcgucgcacgug

SEQ ID NO: 3007223 - RNA, 13 nt, Mycobacterium avium subsp. paratuberculosis
ucggcgucgccga

SEQ ID NO: 3007224 - RNA, 17 nt, Mycobacterium avium subsp. paratuberculosis
ucggcgucgccgagccg

SEQ ID NO: 3007225 - RNA, 19 nt, Mycobacterium avium subsp. paratuberculosis
ucggcgucgccgagccgcg

SEQ ID NO: 3007226 - RNA, 20 nt, Mycobacterium avium subsp. paratuberculosis
ucggcgucgccgagccgcgc

SEQ ID NO: 3007227 - RNA, 14 nt, Mycobacterium avium subsp. paratuberculosis
ucggcgucgcggcg

SEQ ID NO: 3007228 - RNA, 15 nt, Mycobacterium avium subsp. paratuberculosis
ucggcgucgcggcgc

SEQ ID NO: 3007229 - RNA, 19 nt, Mycobacterium avium subsp. paratuberculosis
ucggcgucgcggcgcaccc

SEQ ID NO: 3007230 - RNA, 22 nt, Mycobacterium avium subsp. paratuberculosis
ucggcgucgcggcgcacccggg

SEQ ID NO: 3007231 - RNA, 18 nt, Mycobacterium avium subsp. paratuberculosis
ucggcgucggaggcggcg

SEQ ID NO: 3007232 - RNA, 12 nt, Mycobacterium avium subsp. paratuberculosis
ucggcgucggcc

SEQ ID NO: 3007233 - RNA, 14 nt, Mycobacterium avium subsp. paratuberculosis
ucggcgucggccac

SEQ ID NO: 3007234 - RNA, 16 nt, Mycobacterium avium subsp. paratuberculosis
ucggcgucggccaccg

SEQ ID NO: 3007235 - RNA, 17 nt, Mycobacterium avium subsp. paratuberculosis
ucggcgucggccaccgc

SEQ ID NO: 3007236 - RNA, 18 nt, Mycobacterium avium subsp. paratuberculosis
ucggcgucggccaccgcg

SEQ ID NO: 3007237 - RNA, 22 nt, Mycobacterium avium subsp. paratuberculosis
ucggcgucggccaccgcgccuu

SEQ ID NO: 3007238 - RNA, 14 nt, Mycobacterium avium subsp. paratuberculosis
ucggcgucggcgcg

SEQ ID NO: 3007239 - RNA, 13 nt, Mycobacterium avium subsp. paratuberculosis
ucggcgucgggcc

SEQ ID NO: 3007240 - RNA, 23 nt, Mycobacterium avium subsp. paratuberculosis
ucggcgucgggccgggggcggcg

SEQ ID NO: 3007241 - RNA, 14 nt, Mycobacterium avium subsp. paratuberculosis
ucggcgucgggcgg

SEQ ID NO: 3007242 - RNA, 18 nt, Mycobacterium avium subsp. paratuberculosis
ucggcgucguacagcagc

SEQ ID NO: 3007243 - RNA, 15 nt, Mycobacterium avium subsp. paratuberculosis
ucggcgucucggccc

SEQ ID NO: 3007244 - RNA, 15 nt, Mycobacterium avium subsp. paratuberculosis
ucggcgugcccgccg

SEQ ID NO: 3007245 - RNA, 19 nt, Mycobacterium avium subsp. paratuberculosis
ucggcgugcccgccgacca

SEQ ID NO: 3007246 - RNA, 16 nt, Mycobacterium avium subsp. paratuberculosis
ucggcgugcucggcca

SEQ ID NO: 3007247 - RNA, 22 nt, Mycobacterium avium subsp. paratuberculosis
ucggcgugcucggccacgacgc

SEQ ID NO: 3007248 - RNA, 20 nt, Mycobacterium avium subsp. paratuberculosis
ucggcgugcucgucgcggag

SEQ ID NO: 3007249 - RNA, 15 nt, Mycobacterium avium subsp. paratuberculosis
ucggcguggcaggcg

SEQ ID NO: 3007250 - RNA, 16 nt, Mycobacterium avium subsp. paratuberculosis
ucggcguggccguccg

SEQ ID NO: 3007251 - RNA, 20 nt, Mycobacterium avium subsp. paratuberculosis
ucggcguggcgcucagcggc

SEQ ID NO: 3007252 - RNA, 21 nt, Mycobacterium avium subsp. paratuberculosis
ucggcguggcgcucagcggca

SEQ ID NO: 3007253 - RNA, 22 nt, Mycobacterium avium subsp. paratuberculosis
ucggcguggcgcucagcggcag

SEQ ID NO: 3007254 - RNA, 17 nt, Mycobacterium avium subsp. paratuberculosis
ucggcguggcgguggcg

SEQ ID NO: 3007255 - RNA, 20 nt, Mycobacterium avium subsp. paratuberculosis
ucggcguggcgguggcggcg

SEQ ID NO: 3007256 - RNA, 15 nt, Mycobacterium avium subsp. paratuberculosis
ucggcgugucgggug

SEQ ID NO: 3007257 - RNA, 23 nt, Mycobacterium avium subsp. paratuberculosis
ucggcgugucgggugcuuucgcg

SEQ ID NO: 3007258 - RNA, 16 nt, Mycobacterium avium subsp. paratuberculosis
ucggcguguuccuugc

SEQ ID NO: 3007259 - RNA, 20 nt, Mycobacterium avium subsp. paratuberculosis
ucggcguguuccuugcggcc

SEQ ID NO: 3007260 - RNA, 22 nt, Mycobacterium avium subsp. paratuberculosis
ucggcguguuccuugcggccgc

SEQ ID NO: 3007261 - RNA, 14 nt, Mycobacterium avium subsp. paratuberculosis
ucggcguucagcgg

SEQ ID NO: 3007262 - RNA, 18 nt, Mycobacterium avium subsp. paratuberculosis
ucggcguucagcggcacc

SEQ ID NO: 3007263 - RNA, 21 nt, Mycobacterium avium subsp. paratuberculosis
ucggcguucagcggcaccguc

SEQ ID NO: 3007264 - RNA, 17 nt, Mycobacterium avium subsp. paratuberculosis
ucggcguugagccggcg

SEQ ID NO: 3007265 - RNA, 20 nt, Mycobacterium avium subsp. paratuberculosis
ucggcguugagccggcgcac

SEQ ID NO: 3007266 - RNA, 14 nt, Mycobacterium avium subsp. paratuberculosis
ucggcguuggucca

SEQ ID NO: 3007267 - RNA, 20 nt, Mycobacterium avium subsp. paratuberculosis
ucggcguugguccacacguc

SEQ ID NO: 3007268 - RNA, 22 nt, Mycobacterium avium subsp. paratuberculosis
ucggcguugguccacacguccu

SEQ ID NO: 3007269 - RNA, 23 nt, Mycobacterium avium subsp. paratuberculosis
ucggcuagcagcuccggucggcg

SEQ ID NO: 3007270 - RNA, 17 nt, Mycobacterium avium subsp. paratuberculosis
ucggcuccagcgcccgc

SEQ ID NO: 3007271 - RNA, 13 nt, Mycobacterium avium subsp. paratuberculosis
ucggcuccugccg

SEQ ID NO: 3007272 - RNA, 23 nt, Mycobacterium avium subsp. paratuberculosis
ucggcuccugccguucggccagc

SEQ ID NO: 3007273 - RNA, 23 nt, Mycobacterium avium subsp. paratuberculosis
ucggcucgauccacagcgucaau

SEQ ID NO: 3007274 - RNA, 17 nt, Mycobacterium avium subsp. paratuberculosis
ucggcucgaucgucagg

SEQ ID NO: 3007275 - RNA, 16 nt, Mycobacterium avium subsp. paratuberculosis
ucggcucgcccgcgac

SEQ ID NO: 3007276 - RNA, 17 nt, Mycobacterium avium subsp. paratuberculosis
ucggcucgcccgcgacu

SEQ ID NO: 3007277 - RNA, 19 nt, Mycobacterium avium subsp. paratuberculosis
ucggcucgcccgcgacugu

SEQ ID NO: 3007278 - RNA, 16 nt, Mycobacterium avium subsp. paratuberculosis
ucggcucgccgauccg

SEQ ID NO: 3007279 - RNA, 13 nt, Mycobacterium avium subsp. paratuberculosis
ucggcucggccgg

SEQ ID NO: 3007280 - RNA, 16 nt, Mycobacterium avium subsp. paratuberculosis
ucggcucggccggccg

SEQ ID NO: 3007281 - RNA, 13 nt, Mycobacterium avium subsp. paratuberculosis
ucggcucggcgac

SEQ ID NO: 3007282 - RNA, 19 nt, Mycobacterium avium subsp. paratuberculosis
ucggcucguguccgaugac

SEQ ID NO: 3007283 - RNA, 17 nt, Mycobacterium avium subsp. paratuberculosis
ucggcuggucggcggcc

SEQ ID NO: 3007284 - RNA, 21 nt, Mycobacterium avium subsp. paratuberculosis
ucggcuguggcgcacagaucg

SEQ ID NO: 3007285 - RNA, 15 nt, Mycobacterium avium subsp. paratuberculosis
ucggcuuccuccucg

SEQ ID NO: 3007286 - RNA, 22 nt, Mycobacterium avium subsp. paratuberculosis
ucggcuuccuccucggcgcgga

SEQ ID NO: 3007287 - RNA, 15 nt, Mycobacterium avium subsp. paratuberculosis
ucggcuucgucgggu

SEQ ID NO: 3007288 - RNA, 20 nt, Mycobacterium avium subsp. paratuberculosis
ucggcuuggggaagccggcc

SEQ ID NO: 3007289 - RNA, 14 nt, Mycobacterium avium subsp. paratuberculosis
ucgggaaacgcguc

SEQ ID NO: 3007290 - RNA, 23 nt, Mycobacterium avium subsp. paratuberculosis
ucgggaaaucggacccagcccgg

SEQ ID NO: 3007291 - RNA, 17 nt, Mycobacterium avium subsp. paratuberculosis
ucgggaaaugcgucggc

SEQ ID NO: 3007292 - RNA, 20 nt, Mycobacterium avium subsp. paratuberculosis
ucgggaaugucggcguuggu

SEQ ID NO: 3007293 - RNA, 16 nt, Mycobacterium avium subsp. paratuberculosis
ucgggacccuugucca

SEQ ID NO: 3007294 - RNA, 15 nt, Mycobacterium avium subsp. paratuberculosis
ucgggaccgaugccg

SEQ ID NO: 3007295 - RNA, 19 nt, Mycobacterium avium subsp. paratuberculosis
ucgggaccgggaagccgag

SEQ ID NO: 3007296 - RNA, 21 nt, Mycobacterium avium subsp. paratuberculosis
ucgggaccgucaccguggcgg

SEQ ID NO: 3007297 - RNA, 18 nt, Mycobacterium avium subsp. paratuberculosis
ucgggaccgucgcgcagc

SEQ ID NO: 3007298 - RNA, 15 nt, Mycobacterium avium subsp. paratuberculosis
ucgggacgccacggc

SEQ ID NO: 3007299 - RNA, 20 nt, Mycobacterium avium subsp. paratuberculosis
ucgggacgccacggcgaaca

SEQ ID NO: 3007300 - RNA, 12 nt, Mycobacterium avium subsp. paratuberculosis
ucgggacgcggc

SEQ ID NO: 3007301 - RNA, 19 nt, Mycobacterium avium subsp. paratuberculosis
ucgggacgcggcaggcgcc

SEQ ID NO: 3007302 - RNA, 22 nt, Mycobacterium avium subsp. paratuberculosis
ucgggacgcggcaggcgcccca

SEQ ID NO: 3007303 - RNA, 15 nt, Mycobacterium avium subsp. paratuberculosis
ucgggacggccagca

SEQ ID NO: 3007304 - RNA, 20 nt, Mycobacterium avium subsp. paratuberculosis
ucgggacggccagcagggcg

SEQ ID NO: 3007305 - RNA, 15 nt, Mycobacterium avium subsp. paratuberculosis
ucgggaguuggucug

SEQ ID NO: 3007306 - RNA, 19 nt, Mycobacterium avium subsp. paratuberculosis
ucgggauagccgagcggcg

SEQ ID NO: 3007307 - RNA, 14 nt, Mycobacterium avium subsp. paratuberculosis
ucgggauagggcgc

SEQ ID NO: 3007308 - RNA, 18 nt, Mycobacterium avium subsp. paratuberculosis
ucgggaucagccguaccg

SEQ ID NO: 3007309 - RNA, 14 nt, Mycobacterium avium subsp. paratuberculosis
ucgggauccaggaa

SEQ ID NO: 3007310 - RNA, 15 nt, Mycobacterium avium subsp. paratuberculosis
ucgggauccaggaac

SEQ ID NO: 3007311 - RNA, 20 nt, Mycobacterium avium subsp. paratuberculosis
ucgggauccaggaacggcac

SEQ ID NO: 3007312 - RNA, 22 nt, Mycobacterium avium subsp. paratuberculosis
ucgggauccaggaacggcaccc

SEQ ID NO: 3007313 - RNA, 18 nt, Mycobacterium avium subsp. paratuberculosis
ucgggauccucgccgcgg

SEQ ID NO: 3007314 - RNA, 16 nt, Mycobacterium avium subsp. paratuberculosis
ucgggaucggcgccca

SEQ ID NO: 3007315 - RNA, 14 nt, Mycobacterium avium subsp. paratuberculosis
ucgggauggcggcg

SEQ ID NO: 3007316 - RNA, 22 nt, Mycobacterium avium subsp. paratuberculosis
ucgggauugaggcuggcgauca

SEQ ID NO: 3007317 - RNA, 17 nt, Mycobacterium avium subsp. paratuberculosis
ucgggauuggacagcgg

SEQ ID NO: 3007318 - RNA, 19 nt, Mycobacterium avium subsp. paratuberculosis
ucgggauuggacagcggcg

SEQ ID NO: 3007319 - RNA, 18 nt, Mycobacterium avium subsp. paratuberculosis
ucgggcaacgcgccggcg

SEQ ID NO: 3007320 - RNA, 20 nt, Mycobacterium avium subsp. paratuberculosis
ucgggcaacgcgccggcggu

SEQ ID NO: 3007321 - RNA, 22 nt, Mycobacterium avium subsp. paratuberculosis
ucgggcaacgcgccggcggucg

SEQ ID NO: 3007322 - RNA, 20 nt, Mycobacterium avium subsp. paratuberculosis
ucgggcaaucggacccagcc

SEQ ID NO: 3007323 - RNA, 23 nt, Mycobacterium avium subsp. paratuberculosis
ucgggcaaucggacccagcccga

SEQ ID NO: 3007324 - RNA, 22 nt, Mycobacterium avium subsp. paratuberculosis
ucgggcacagccagcgcccggc

SEQ ID NO: 3007325 - RNA, 16 nt, Mycobacterium avium subsp. paratuberculosis
ucgggcaccacgccga

SEQ ID NO: 3007326 - RNA, 14 nt, Mycobacterium avium subsp. paratuberculosis
ucgggcaccacggc

SEQ ID NO: 3007327 - RNA, 15 nt, Mycobacterium avium subsp. paratuberculosis
ucgggcaccacggcg

SEQ ID NO: 3007328 - RNA, 14 nt, Mycobacterium avium subsp. paratuberculosis
ucgggcaccagcac

SEQ ID NO: 3007329 - RNA, 23 nt, Mycobacterium avium subsp. paratuberculosis
ucgggcaccccugccgccaccgc

SEQ ID NO: 3007330 - RNA, 12 nt, Mycobacterium avium subsp. paratuberculosis
ucgggcaccgcc

SEQ ID NO: 3007331 - RNA, 14 nt, Mycobacterium avium subsp. paratuberculosis
ucgggcaccgccag

SEQ ID NO: 3007332 - RNA, 18 nt, Mycobacterium avium subsp. paratuberculosis
ucgggcacguccagcccg

SEQ ID NO: 3007333 - RNA, 15 nt, Mycobacterium avium subsp. paratuberculosis
ucgggcagcagcacc

SEQ ID NO: 3007334 - RNA, 18 nt, Mycobacterium avium subsp. paratuberculosis
ucgggcagcccgccgacc

SEQ ID NO: 3007335 - RNA, 20 nt, Mycobacterium avium subsp. paratuberculosis
ucgggcagcccgccgaccac

SEQ ID NO: 3007336 - RNA, 23 nt, Mycobacterium avium subsp. paratuberculosis
ucgggcagcgugucccgguacag

SEQ ID NO: 3007337 - RNA, 17 nt, Mycobacterium avium subsp. paratuberculosis
ucgggcagugcacgacg

SEQ ID NO: 3007338 - RNA, 19 nt, Mycobacterium avium subsp. paratuberculosis
ucgggcagugcacgacgac

SEQ ID NO: 3007339 - RNA, 13 nt, Mycobacterium avium subsp. paratuberculosis
ucgggcaugccgg

SEQ ID NO: 3007340 - RNA, 18 nt, Mycobacterium avium subsp. paratuberculosis
ucgggcaugccggccggc

SEQ ID NO: 3007341 - RNA, 23 nt, Mycobacterium avium subsp. paratuberculosis
ucgggccauauuucgugaagccg

SEQ ID NO: 3007342 - RNA, 14 nt, Mycobacterium avium subsp. paratuberculosis
ucgggcccagcagc

SEQ ID NO: 3007343 - RNA, 13 nt, Mycobacterium avium subsp. paratuberculosis
ucgggccccaugg

SEQ ID NO: 3007344 - RNA, 14 nt, Mycobacterium avium subsp. paratuberculosis
ucgggcccgacgac

SEQ ID NO: 3007345 - RNA, 17 nt, Mycobacterium avium subsp. paratuberculosis
ucgggcccgacgacgau

SEQ ID NO: 3007346 - RNA, 23 nt, Mycobacterium avium subsp. paratuberculosis
ucgggcccgcgcaccgucaucgc

SEQ ID NO: 3007347 - RNA, 14 nt, Mycobacterium avium subsp. paratuberculosis
ucgggccgcgggcc

SEQ ID NO: 3007348 - RNA, 13 nt, Mycobacterium avium subsp. paratuberculosis
ucgggccggacag

SEQ ID NO: 3007349 - RNA, 14 nt, Mycobacterium avium subsp. paratuberculosis
ucgggccggaucag

SEQ ID NO: 3007350 - RNA, 12 nt, Mycobacterium avium subsp. paratuberculosis
ucgggccggcag

SEQ ID NO: 3007351 - RNA, 14 nt, Mycobacterium avium subsp. paratuberculosis
ucgggccggcagcc

SEQ ID NO: 3007352 - RNA, 17 nt, Mycobacterium avium subsp. paratuberculosis
ucgggccggcagccggc

SEQ ID NO: 3007353 - RNA, 12 nt, Mycobacterium avium subsp. paratuberculosis
ucgggccggccg

SEQ ID NO: 3007354 - RNA, 19 nt, Mycobacterium avium subsp. paratuberculosis
ucgggccggcgccgacgac

SEQ ID NO: 3007355 - RNA, 16 nt, Mycobacterium avium subsp. paratuberculosis
ucgggccgggcgggca

SEQ ID NO: 3007356 - RNA, 17 nt, Mycobacterium avium subsp. paratuberculosis
ucgggccgggcgggcac

SEQ ID NO: 3007357 - RNA, 20 nt, Mycobacterium avium subsp. paratuberculosis
ucgggccgggggcggcggcg

SEQ ID NO: 3007358 - RNA, 21 nt, Mycobacterium avium subsp. paratuberculosis
ucgggccgggggcggcggcgc

SEQ ID NO: 3007359 - RNA, 18 nt, Mycobacterium avium subsp. paratuberculosis
ucgggccggucagcgcga

SEQ ID NO: 3007360 - RNA, 19 nt, Mycobacterium avium subsp. paratuberculosis
ucgggccggucagcgcgac

SEQ ID NO: 3007361 - RNA, 13 nt, Mycobacterium avium subsp. paratuberculosis
ucgggccugacca

SEQ ID NO: 3007362 - RNA, 12 nt, Mycobacterium avium subsp. paratuberculosis
ucgggcgcacca

SEQ ID NO: 3007363 - RNA, 16 nt, Mycobacterium avium subsp. paratuberculosis
ucgggcgcaccacgac

SEQ ID NO: 3007364 - RNA, 22 nt, Mycobacterium avium subsp. paratuberculosis
ucgggcgcagaaaaaggccgcc

SEQ ID NO: 3007365 - RNA, 15 nt, Mycobacterium avium subsp. paratuberculosis
ucgggcgccggcgcg

SEQ ID NO: 3007366 - RNA, 20 nt, Mycobacterium avium subsp. paratuberculosis
ucgggcgcgaacagcgccga

SEQ ID NO: 3007367 - RNA, 21 nt, Mycobacterium avium subsp. paratuberculosis
ucgggcgcgaacagcgccgac

SEQ ID NO: 3007368 - RNA, 15 nt, Mycobacterium avium subsp. paratuberculosis
ucgggcgcgcgcgcc

SEQ ID NO: 3007369 - RNA, 15 nt, Mycobacterium avium subsp. paratuberculosis
ucgggcgcggcggca

SEQ ID NO: 3007370 - RNA, 18 nt, Mycobacterium avium subsp. paratuberculosis
ucgggcgcggugugggcg

SEQ ID NO: 3007371 - RNA, 22 nt, Mycobacterium avium subsp. paratuberculosis
ucgggcgcggugugggcgaugg

SEQ ID NO: 3007372 - RNA, 15 nt, Mycobacterium avium subsp. paratuberculosis
ucgggcgcucggcca

SEQ ID NO: 3007373 - RNA, 18 nt, Mycobacterium avium subsp. paratuberculosis
ucgggcgcucggccagca

SEQ ID NO: 3007374 - RNA, 20 nt, Mycobacterium avium subsp. paratuberculosis
ucgggcggccgcggauuccg

SEQ ID NO: 3007375 - RNA, 17 nt, Mycobacterium avium subsp. paratuberculosis
ucgggcggccugccggc

SEQ ID NO: 3007376 - RNA, 21 nt, Mycobacterium avium subsp. paratuberculosis
ucgggcggccugccggccgcc

SEQ ID NO: 3007377 - RNA, 23 nt, Mycobacterium avium subsp. paratuberculosis
ucgggcggggugugcggcacggc

SEQ ID NO: 3007378 - RNA, 21 nt, Mycobacterium avium subsp. paratuberculosis
ucgggcggguggaucuugacg

SEQ ID NO: 3007379 - RNA, 22 nt, Mycobacterium avium subsp. paratuberculosis
ucgggcgguccaccgacgccac

SEQ ID NO: 3007380 - RNA, 15 nt, Mycobacterium avium subsp. paratuberculosis
ucgggcguggcgucg

SEQ ID NO: 3007381 - RNA, 23 nt, Mycobacterium avium subsp. paratuberculosis
ucgggcguugcgcucuguuggcc

SEQ ID NO: 3007382 - RNA, 14 nt, Mycobacterium avium subsp. paratuberculosis
ucgggcucggccgc

SEQ ID NO: 3007383 - RNA, 18 nt, Mycobacterium avium subsp. paratuberculosis
ucgggcucggccgccgac

SEQ ID NO: 3007384 - RNA, 14 nt, Mycobacterium avium subsp. paratuberculosis
ucgggcucgucgug

SEQ ID NO: 3007385 - RNA, 21 nt, Mycobacterium avium subsp. paratuberculosis
ucgggcugcgcuugcggcgca

SEQ ID NO: 3007386 - RNA, 20 nt, Mycobacterium avium subsp. paratuberculosis
ucggggaccguccccguccg

SEQ ID NO: 3007387 - RNA, 23 nt, Mycobacterium avium subsp. paratuberculosis
ucggggaucccgaaaccgucgac

SEQ ID NO: 3007388 - RNA, 15 nt, Mycobacterium avium subsp. paratuberculosis
ucggggcagccgucg

SEQ ID NO: 3007389 - RNA, 18 nt, Mycobacterium avium subsp. paratuberculosis
ucgucaccgugccgucgc

SEQ ID NO: 3007390 - RNA, 19 nt, Mycobacterium avium subsp. paratuberculosis
ucgucaccgugggcggcgc

SEQ ID NO: 3007391 - RNA, 17 nt, Mycobacterium avium subsp. paratuberculosis
ucgucacuucgccgggc

SEQ ID NO: 3007392 - RNA, 13 nt, Mycobacterium avium subsp. paratuberculosis
ucgucagcaccgu

SEQ ID NO: 3007393 - RNA, 15 nt, Mycobacterium avium subsp. paratuberculosis
ucgucagccgggcca

SEQ ID NO: 3007394 - RNA, 15 nt, Mycobacterium avium subsp. paratuberculosis
ucgucagcgcgggcc

SEQ ID NO: 3007395 - RNA, 17 nt, Mycobacterium avium subsp. paratuberculosis
ucgucaggccgugaucg

SEQ ID NO: 3007396 - RNA, 23 nt, Mycobacterium avium subsp. paratuberculosis
ucgucaggccgugaucggccagc

SEQ ID NO: 3007397 - RNA, 19 nt, Mycobacterium avium subsp. paratuberculosis
ucguccaaacuccggggga

SEQ ID NO: 3007398 - RNA, 13 nt, Mycobacterium avium subsp. paratuberculosis
ucguccacaccgg

SEQ ID NO: 3007399 - RNA, 14 nt, Mycobacterium avium subsp. paratuberculosis
ucguccaccgacag

SEQ ID NO: 3007400 - RNA, 21 nt, Mycobacterium avium subsp. paratuberculosis
ucguccacgcuggcggugucg

SEQ ID NO: 3007401 - RNA, 17 nt, Mycobacterium avium subsp. paratuberculosis
ucguccagcccggucac

SEQ ID NO: 3007402 - RNA, 13 nt, Mycobacterium avium subsp. paratuberculosis
ucguccagcgucg

SEQ ID NO: 3007403 - RNA, 19 nt, Mycobacterium avium subsp. paratuberculosis
ucguccaggguggccagca

SEQ ID NO: 3007404 - RNA, 22 nt, Mycobacterium avium subsp. paratuberculosis
ucguccaggguggccagcacgc

SEQ ID NO: 3007405 - RNA, 23 nt, Mycobacterium avium subsp. paratuberculosis
ucguccaggguggccagcacgcu

SEQ ID NO: 3007406 - RNA, 20 nt, Mycobacterium avium subsp. paratuberculosis
ucguccaggugcacccgcgg

SEQ ID NO: 3007407 - RNA, 17 nt, Mycobacterium avium subsp. paratuberculosis
ucguccagugacgccug

SEQ ID NO: 3007408 - RNA, 21 nt, Mycobacterium avium subsp. paratuberculosis
ucguccaugcuggugccgccg

SEQ ID NO: 3007409 - RNA, 22 nt, Mycobacterium avium subsp. paratuberculosis
ucgucccagcgcaacggcgucg

SEQ ID NO: 3007410 - RNA, 21 nt, Mycobacterium avium subsp. paratuberculosis
ucgucccaguccagccguucg

SEQ ID NO: 3007411 - RNA, 17 nt, Mycobacterium avium subsp. paratuberculosis
ucgucccggcgccucgg

SEQ ID NO: 3007412 - RNA, 24 nt, Mycobacterium avium subsp. paratuberculosis
ucgucccggcgccucggcgccucg

SEQ ID NO: 3007413 - RNA, 17 nt, Mycobacterium avium subsp. paratuberculosis
ucgucccggugaugacg

SEQ ID NO: 3007414 - RNA, 21 nt, Mycobacterium avium subsp. paratuberculosis
ucguccgacagcgccugcccg

SEQ ID NO: 3007415 - RNA, 20 nt, Mycobacterium avium subsp. paratuberculosis
ucguccgcaaccgccggcag

SEQ ID NO: 3007416 - RNA, 22 nt, Mycobacterium avium subsp. paratuberculosis
ucguccgcaaccgccggcagcg

SEQ ID NO: 3007417 - RNA, 16 nt, Mycobacterium avium subsp. paratuberculosis
ucguccgcggcggcgu

SEQ ID NO: 3007418 - RNA, 17 nt, Mycobacterium avium subsp. paratuberculosis
ucguccggcgccacgac

SEQ ID NO: 3007419 - RNA, 15 nt, Mycobacterium avium subsp. paratuberculosis
ucguccggcgcgcag

SEQ ID NO: 3007420 - RNA, 21 nt, Mycobacterium avium subsp. paratuberculosis
ucguccgugcugccggccggc

SEQ ID NO: 3007421 - RNA, 15 nt, Mycobacterium avium subsp. paratuberculosis
ucguccucccggccg

SEQ ID NO: 3007422 - RNA, 16 nt, Mycobacterium avium subsp. paratuberculosis
ucguccucgaucaccg

SEQ ID NO: 3007423 - RNA, 20 nt, Mycobacterium avium subsp. paratuberculosis
ucguccucgaucaccgacag

SEQ ID NO: 3007424 - RNA, 21 nt, Mycobacterium avium subsp. paratuberculosis
ucguccucgaucaccgacagc

SEQ ID NO: 3007425 - RNA, 17 nt, Mycobacterium avium subsp. paratuberculosis
ucguccucgcgccgugg

SEQ ID NO: 3007426 - RNA, 15 nt, Mycobacterium avium subsp. paratuberculosis
ucguccucggucagg

SEQ ID NO: 3007427 - RNA, 14 nt, Mycobacterium avium subsp. paratuberculosis
ucguccuggcgcug

SEQ ID NO: 3007428 - RNA, 18 nt, Mycobacterium avium subsp. paratuberculosis
ucguccuugagcccccac

SEQ ID NO: 3007429 - RNA, 15 nt, Mycobacterium avium subsp. paratuberculosis
ucgucgaacgcggcg

SEQ ID NO: 3007430 - RNA, 19 nt, Mycobacterium avium subsp. paratuberculosis
ucgucgaacuccauccgcc

SEQ ID NO: 3007431 - RNA, 15 nt, Mycobacterium avium subsp. paratuberculosis
ucgucgaacucgggc

SEQ ID NO: 3007432 - RNA, 17 nt, Mycobacterium avium subsp. paratuberculosis
ucgucgaacucgggccc

SEQ ID NO: 3007433 - RNA, 17 nt, Mycobacterium avium subsp. paratuberculosis
ucgucgaagagcugguc

SEQ ID NO: 3007434 - RNA, 16 nt, Mycobacterium avium subsp. paratuberculosis
ucgucgaagccgauca

SEQ ID NO: 3007435 - RNA, 17 nt, Mycobacterium avium subsp. paratuberculosis
ucgucgaagccgaucac

SEQ ID NO: 3007436 - RNA, 21 nt, Mycobacterium avium subsp. paratuberculosis
ucgucgaagccgaucaccggc

SEQ ID NO: 3007437 - RNA, 21 nt, Mycobacterium avium subsp. paratuberculosis
ucgucgaaguagggccgcagc

SEQ ID NO: 3007438 - RNA, 16 nt, Mycobacterium avium subsp. paratuberculosis
ucgucgaccaacgcca

SEQ ID NO: 3007439 - RNA, 13 nt, Mycobacterium avium subsp. paratuberculosis
ucgucgaccacca

SEQ ID NO: 3007440 - RNA, 16 nt, Mycobacterium avium subsp. paratuberculosis
ucgucgaccaccacga

SEQ ID NO: 3007441 - RNA, 17 nt, Mycobacterium avium subsp. paratuberculosis
ucgucgaccaccacgac

SEQ ID NO: 3007442 - RNA, 19 nt, Mycobacterium avium subsp. paratuberculosis
ucgucgaccagggcgauca

SEQ ID NO: 3007443 - RNA, 22 nt, Mycobacterium avium subsp. paratuberculosis
ucgucgacccggccgcgccgga

SEQ ID NO: 3007444 - RNA, 12 nt, Mycobacterium avium subsp. paratuberculosis
ucgucgaccgcg

SEQ ID NO: 3007445 - RNA, 16 nt, Mycobacterium avium subsp. paratuberculosis
ucgucgaccgcggccu

SEQ ID NO: 3007446 - RNA, 13 nt, Mycobacterium avium subsp. paratuberculosis
ucgucgaccguca

SEQ ID NO: 3007447 - RNA, 13 nt, Mycobacterium avium subsp. paratuberculosis
ucgucgaccugcu

SEQ ID NO: 3007448 - RNA, 24 nt, Mycobacterium avium subsp. paratuberculosis
ucgucgaccugcucgucggugacg

SEQ ID NO: 3007449 - RNA, 21 nt, Mycobacterium avium subsp. paratuberculosis
ucgucgacgagcccgccggcg

SEQ ID NO: 3007450 - RNA, 22 nt, Mycobacterium avium subsp. paratuberculosis
ucgucgacgagcccgccggcgg

SEQ ID NO: 3007451 - RNA, 16 nt, Mycobacterium avium subsp. paratuberculosis
ucgucgacgcccaccu

SEQ ID NO: 3007452 - RNA, 10 nt, Mycobacterium avium subsp. paratuberculosis
ucgucgacgg

SEQ ID NO: 3007453 - RNA, 15 nt, Mycobacterium avium subsp. paratuberculosis
ucgucgacggccgcg

SEQ ID NO: 3007454 - RNA, 14 nt, Mycobacterium avium subsp. paratuberculosis
ucgucgacggcggc

SEQ ID NO: 3007455 - RNA, 13 nt, Mycobacterium avium subsp. paratuberculosis
ucgucgacgucgg

SEQ ID NO: 3007456 - RNA, 15 nt, Mycobacterium avium subsp. paratuberculosis
ucgucgacguucgag

SEQ ID NO: 3007457 - RNA, 14 nt, Mycobacterium avium subsp. paratuberculosis
ucgucgagcaccac

SEQ ID NO: 3007458 - RNA, 16 nt, Mycobacterium avium subsp. paratuberculosis
ucgucgagcaccaccc

SEQ ID NO: 3007459 - RNA, 14 nt, Mycobacterium avium subsp. paratuberculosis
ucgucgagcagcgc

SEQ ID NO: 3007460 - RNA, 23 nt, Mycobacterium avium subsp. paratuberculosis
ucgucgagcauccggcgcacggc

SEQ ID NO: 3007461 - RNA, 13 nt, Mycobacterium avium subsp. paratuberculosis
ucgucgagccgcu

SEQ ID NO: 3007462 - RNA, 15 nt, Mycobacterium avium subsp. paratuberculosis
ucgucgagccgcucg

SEQ ID NO: 3007463 - RNA, 12 nt, Mycobacterium avium subsp. paratuberculosis
ucgucgagccgg

SEQ ID NO: 3007464 - RNA, 15 nt, Mycobacterium avium subsp. paratuberculosis
ucgucgagccggccg

SEQ ID NO: 3007465 - RNA, 14 nt, Mycobacterium avium subsp. paratuberculosis
ucgucgagcgcucg

SEQ ID NO: 3007466 - RNA, 22 nt, Mycobacterium avium subsp. paratuberculosis
ucgucgagcugacacccgacga

SEQ ID NO: 3007467 - RNA, 17 nt, Mycobacterium avium subsp. paratuberculosis
ucgucgagggccaccgg

SEQ ID NO: 3007468 - RNA, 20 nt, Mycobacterium avium subsp. paratuberculosis
ucgucgagggccaccggcuc

SEQ ID NO: 3007469 - RNA, 19 nt, Mycobacterium avium subsp. paratuberculosis
ucgucgaguucgcggcgca

SEQ ID NO: 3007470 - RNA, 16 nt, Mycobacterium avium subsp. paratuberculosis
ucgucgaucgacgccg

SEQ ID NO: 3007471 - RNA, 15 nt, Mycobacterium avium subsp. paratuberculosis
ucgucgaucgcggcg

SEQ ID NO: 3007472 - RNA, 17 nt, Mycobacterium avium subsp. paratuberculosis
ucgucgaucucggugag

SEQ ID NO: 3007473 - RNA, 19 nt, Mycobacterium avium subsp. paratuberculosis
ucgucgaucuucgcggcgu

SEQ ID NO: 3007474 - RNA, 14 nt, Mycobacterium avium subsp. paratuberculosis
ucgucgaugaacag

SEQ ID NO: 3007475 - RNA, 15 nt, Mycobacterium avium subsp. paratuberculosis
ucgucgaugaacagc

SEQ ID NO: 3007476 - RNA, 20 nt, Mycobacterium avium subsp. paratuberculosis
ucgucgaugaagucggugag

SEQ ID NO: 3007477 - RNA, 22 nt, Mycobacterium avium subsp. paratuberculosis
ucgucgaugaagucggugagca

SEQ ID NO: 3007478 - RNA, 15 nt, Mycobacterium avium subsp. paratuberculosis
ucgucgaugacgucc

SEQ ID NO: 3007479 - RNA, 20 nt, Mycobacterium avium subsp. paratuberculosis
ucgucgaugacguccaccag

SEQ ID NO: 3007480 - RNA, 18 nt, Mycobacterium avium subsp. paratuberculosis
ucgucgaugcacgccgga

SEQ ID NO: 3007481 - RNA, 14 nt, Mycobacterium avium subsp. paratuberculosis
ucgucgaugccgau

SEQ ID NO: 3007482 - RNA, 13 nt, Mycobacterium avium subsp. paratuberculosis
ucgucgaugccgu

SEQ ID NO: 3007483 - RNA, 22 nt, Mycobacterium avium subsp. paratuberculosis
ucgucgaugccguagaccagca

SEQ ID NO: 3007484 - RNA, 17 nt, Mycobacterium avium subsp. paratuberculosis
ucgucgaugcgcagcag

SEQ ID NO: 3007485 - RNA, 14 nt, Mycobacterium avium subsp. paratuberculosis
ucgucgauggccac

SEQ ID NO: 3007486 - RNA, 19 nt, Mycobacterium avium subsp. paratuberculosis
ucgucgaugggcucgagca

SEQ ID NO: 3007487 - RNA, 16 nt, Mycobacterium avium subsp. paratuberculosis
ucgucgaugucggcgg

SEQ ID NO: 3007488 - RNA, 19 nt, Mycobacterium avium subsp. paratuberculosis
ucgucgcacaaccgggcca

SEQ ID NO: 3007489 - RNA, 23 nt, Mycobacterium avium subsp. paratuberculosis
ucgucgcacaaccgggccaacgg

SEQ ID NO: 3007490 - RNA, 13 nt, Mycobacterium avium subsp. paratuberculosis
ucgucgcaccggc

SEQ ID NO: 3007491 - RNA, 15 nt, Mycobacterium avium subsp. paratuberculosis
ucgucgcaccggcag

SEQ ID NO: 3007492 - RNA, 22 nt, Mycobacterium avium subsp. paratuberculosis
ucgucgcaccggcagugaucgg

SEQ ID NO: 3007493 - RNA, 14 nt, Mycobacterium avium subsp. paratuberculosis
ucgucgcccacccg

SEQ ID NO: 3007494 - RNA, 15 nt, Mycobacterium avium subsp. paratuberculosis
ucgucgcccacccgc

SEQ ID NO: 3007495 - RNA, 16 nt, Mycobacterium avium subsp. paratuberculosis
ucgucgcccacccgcc

SEQ ID NO: 3007496 - RNA, 23 nt, Mycobacterium avium subsp. paratuberculosis
ucgucgcccacccgccagcccgc

SEQ ID NO: 3007497 - RNA, 15 nt, Mycobacterium avium subsp. paratuberculosis
ucgucgcccaccgac

SEQ ID NO: 3007498 - RNA, 19 nt, Mycobacterium avium subsp. paratuberculosis
ucgucgcccaccgacgcgg

SEQ ID NO: 3007499 - RNA, 20 nt, Mycobacterium avium subsp. paratuberculosis
ucgucgcccaccgacgcggc

SEQ ID NO: 3007500 - RNA, 21 nt, Mycobacterium avium subsp. paratuberculosis
ucgucgcccaccgacgcggcg

SEQ ID NO: 3007501 - RNA, 19 nt, Mycobacterium avium subsp. paratuberculosis
ucgucgcccgucucggcgu

SEQ ID NO: 3007502 - RNA, 12 nt, Mycobacterium avium subsp. paratuberculosis
ucgucgccgacc

SEQ ID NO: 3007503 - RNA, 15 nt, Mycobacterium avium subsp. paratuberculosis
ucgucgccgccaacg

SEQ ID NO: 3007504 - RNA, 22 nt, Mycobacterium avium subsp. paratuberculosis
ucgucgccgcgcgcgucgacgu

SEQ ID NO: 3007505 - RNA, 12 nt, Mycobacterium avium subsp. paratuberculosis
ucgucgccgcgg

SEQ ID NO: 3007506 - RNA, 14 nt, Mycobacterium avium subsp. paratuberculosis
ucgucgccgcggua

SEQ ID NO: 3007507 - RNA, 15 nt, Mycobacterium avium subsp. paratuberculosis
ucgucgccggccgcg

SEQ ID NO: 3007508 - RNA, 20 nt, Mycobacterium avium subsp. paratuberculosis
ucgucgccggccgcggugug

SEQ ID NO: 3007509 - RNA, 16 nt, Mycobacterium avium subsp. paratuberculosis
ucgucgccggugagca

SEQ ID NO: 3007510 - RNA, 19 nt, Mycobacterium avium subsp. paratuberculosis
ucgucgccgguggccgccg

SEQ ID NO: 3007511 - RNA, 14 nt, Mycobacterium avium subsp. paratuberculosis
ucgucgccgucacc

SEQ ID NO: 3007512 - RNA, 15 nt, Mycobacterium avium subsp. paratuberculosis
ucgucgccgucgggg

SEQ ID NO: 3007513 - RNA, 22 nt, Mycobacterium avium subsp. paratuberculosis
ucgucgccguggcggcccgacc

SEQ ID NO: 3007514 - RNA, 23 nt, Mycobacterium avium subsp. paratuberculosis
ucgucgcggaggaugccggccag

SEQ ID NO: 3007515 - RNA, 12 nt, Mycobacterium avium subsp. paratuberculosis
ucgucgcggcca

SEQ ID NO: 3007516 - RNA, 14 nt, Mycobacterium avium subsp. paratuberculosis
ucgucgcggcggcc

SEQ ID NO: 3007517 - RNA, 17 nt, Mycobacterium avium subsp. paratuberculosis
ucgucgcggcggucacg

SEQ ID NO: 3007518 - RNA, 17 nt, Mycobacterium avium subsp. paratuberculosis
ucgucgcggcugccggu

SEQ ID NO: 3007519 - RNA, 20 nt, Mycobacterium avium subsp. paratuberculosis
ucgucgcgguccacgccggc

SEQ ID NO: 3007520 - RNA, 15 nt, Mycobacterium avium subsp. paratuberculosis
ucgucgcguccagca

SEQ ID NO: 3007521 - RNA, 15 nt, Mycobacterium avium subsp. paratuberculosis
ucgucgcugaucgcg

SEQ ID NO: 3007522 - RNA, 17 nt, Mycobacterium avium subsp. paratuberculosis
ucgucgcugaucgcgau

SEQ ID NO: 3007523 - RNA, 20 nt, Mycobacterium avium subsp. paratuberculosis
ucgucgcugaucgcgauccg

SEQ ID NO: 3007524 - RNA, 23 nt, Mycobacterium avium subsp. paratuberculosis
ucgucgcugcaguagccggccag

SEQ ID NO: 3007525 - RNA, 13 nt, Mycobacterium avium subsp. paratuberculosis
ucgucgcuggcca

SEQ ID NO: 3007526 - RNA, 17 nt, Mycobacterium avium subsp. paratuberculosis
ucgucgcuguccucgag

SEQ ID NO: 3007527 - RNA, 24 nt, Mycobacterium avium subsp. paratuberculosis
ucgucgcuguccucgagcgcgucg

SEQ ID NO: 3007528 - RNA, 19 nt, Mycobacterium avium subsp. paratuberculosis
ucgucggacaccagcaugg

SEQ ID NO: 3007529 - RNA, 18 nt, Mycobacterium avium subsp. paratuberculosis
ucgucggacagcagcacc

SEQ ID NO: 3007530 - RNA, 15 nt, Mycobacterium avium subsp. paratuberculosis
ucgucggaggcgucg

SEQ ID NO: 3007531 - RNA, 16 nt, Mycobacterium avium subsp. paratuberculosis
ucgucggcagcgacgc

SEQ ID NO: 3007532 - RNA, 14 nt, Mycobacterium avium subsp. paratuberculosis
ucgucggccacgcu

SEQ ID NO: 3007533 - RNA, 16 nt, Mycobacterium avium subsp. paratuberculosis
ucgucggccacgcucg

SEQ ID NO: 3007534 - RNA, 22 nt, Mycobacterium avium subsp. paratuberculosis
ucgucggccacgcucgccagac

SEQ ID NO: 3007535 - RNA, 15 nt, Mycobacterium avium subsp. paratuberculosis
ucgucggccagcgag

SEQ ID NO: 3007536 - RNA, 13 nt, Mycobacterium avium subsp. paratuberculosis
ucgucggccggca

SEQ ID NO: 3007537 - RNA, 14 nt, Mycobacterium avium subsp. paratuberculosis
ucgucggccggcag

SEQ ID NO: 3007538 - RNA, 22 nt, Mycobacterium avium subsp. paratuberculosis
ucgucggccggcaguugcggcc

SEQ ID NO: 3007539 - RNA, 15 nt, Mycobacterium avium subsp. paratuberculosis
ucgucggccgggccg

SEQ ID NO: 3007540 - RNA, 13 nt, Mycobacterium avium subsp. paratuberculosis
ucgucggccgucg

SEQ ID NO: 3007541 - RNA, 23 nt, Mycobacterium avium subsp. paratuberculosis
ucgucggccgucggcgccgccga

SEQ ID NO: 3007542 - RNA, 12 nt, Mycobacterium avium subsp. paratuberculosis
ucgucggccucg

SEQ ID NO: 3007543 - RNA, 14 nt, Mycobacterium avium subsp. paratuberculosis
ucgucggccucggc

SEQ ID NO: 3007544 - RNA, 21 nt, Mycobacterium avium subsp. paratuberculosis
ucgucggcgaacggccagucc

SEQ ID NO: 3007545 - RNA, 13 nt, Mycobacterium avium subsp. paratuberculosis
ucgucggcgagca

SEQ ID NO: 3007546 - RNA, 13 nt, Mycobacterium avium subsp. paratuberculosis
ucgucggcgaugg

SEQ ID NO: 3007547 - RNA, 14 nt, Mycobacterium avium subsp. paratuberculosis
ucgucggcgccggc

SEQ ID NO: 3007548 - RNA, 17 nt, Mycobacterium avium subsp. paratuberculosis
ucgucggcgcgccaccc

SEQ ID NO: 3007549 - RNA, 19 nt, Mycobacterium avium subsp. paratuberculosis
ucgucggcgcgccacccga

SEQ ID NO: 3007550 - RNA, 18 nt, Mycobacterium avium subsp. paratuberculosis
ucgucggcgcgggccagc

SEQ ID NO: 3007551 - RNA, 21 nt, Mycobacterium avium subsp. paratuberculosis
ucgucggcgcgguugucguug

SEQ ID NO: 3007552 - RNA, 12 nt, Mycobacterium avium subsp. paratuberculosis
ucgucggcggcg

SEQ ID NO: 3007553 - RNA, 15 nt, Mycobacterium avium subsp. paratuberculosis
ucgucggcgggcacc

SEQ ID NO: 3007554 - RNA, 15 nt, Mycobacterium avium subsp. paratuberculosis
ucgucggcggugggc

SEQ ID NO: 3007555 - RNA, 14 nt, Mycobacterium avium subsp. paratuberculosis
ucgucggcgucgga

SEQ ID NO: 3007556 - RNA, 18 nt, Mycobacterium avium subsp. paratuberculosis
ucgucgggaacgccgauc

SEQ ID NO: 3007557 - RNA, 23 nt, Mycobacterium avium subsp. paratuberculosis
ucgucgggaacgccgaucaccgc

SEQ ID NO: 3007558 - RNA, 12 nt, Mycobacterium avium subsp. paratuberculosis
ucgucgggcacc

SEQ ID NO: 3007559 - RNA, 17 nt, Mycobacterium avium subsp. paratuberculosis
ucgucgggcaccacggc

SEQ ID NO: 3007560 - RNA, 18 nt, Mycobacterium avium subsp. paratuberculosis
ucgucgggcaccacggcg

SEQ ID NO: 3007561 - RNA, 21 nt, Mycobacterium avium subsp. paratuberculosis
ucgucgggcaccacggcggca

SEQ ID NO: 3007562 - RNA, 23 nt, Mycobacterium avium subsp. paratuberculosis
ucgucgggcaccacggcggcaug

SEQ ID NO: 3007563 - RNA, 16 nt, Mycobacterium avium subsp. paratuberculosis
ucgucgggcaccagca

SEQ ID NO: 3007564 - RNA, 14 nt, Mycobacterium avium subsp. paratuberculosis
ucgucgggcaccgc

SEQ ID NO: 3007565 - RNA, 13 nt, Mycobacterium avium subsp. paratuberculosis
ucgucgggcgccg

SEQ ID NO: 3007566 - RNA, 14 nt, Mycobacterium avium subsp. paratuberculosis
ucgucgggcgccgg

SEQ ID NO: 3007567 - RNA, 15 nt, Mycobacterium avium subsp. paratuberculosis
ucgucgggcgccggu

SEQ ID NO: 3007568 - RNA, 13 nt, Mycobacterium avium subsp. paratuberculosis
ucgucgggcggca

SEQ ID NO: 3007569 - RNA, 18 nt, Mycobacterium avium subsp. paratuberculosis
ucgucggggcagccgucg

SEQ ID NO: 3007570 - RNA, 16 nt, Mycobacterium avium subsp. paratuberculosis
ucgucggggcuggcgg

SEQ ID NO: 3007571 - RNA, 23 nt, Mycobacterium avium subsp. paratuberculosis
ucgucgggugucaggucggcgau

SEQ ID NO: 3007572 - RNA, 18 nt, Mycobacterium avium subsp. paratuberculosis
ucgucggguguggcgccg

SEQ ID NO: 3007573 - RNA, 18 nt, Mycobacterium avium subsp. paratuberculosis
ucgucggguuggccaggg

SEQ ID NO: 3007574 - RNA, 19 nt, Mycobacterium avium subsp. paratuberculosis
ucgucggguuggccagggc

SEQ ID NO: 3007575 - RNA, 16 nt, Mycobacterium avium subsp. paratuberculosis
ucgucggucacccggu

SEQ ID NO: 3007576 - RNA, 22 nt, Mycobacterium avium subsp. paratuberculosis
ucgucggucaggccggcgccgg

SEQ ID NO: 3007577 - RNA, 20 nt, Mycobacterium avium subsp. paratuberculosis
ucgucggucucuucgacccg

SEQ ID NO: 3007578 - RNA, 17 nt, Mycobacterium avium subsp. paratuberculosis
ucgucggugacggugug

SEQ ID NO: 3007579 - RNA, 22 nt, Mycobacterium avium subsp. paratuberculosis
ucgucggugauggugaccaacc

SEQ ID NO: 3007580 - RNA, 20 nt, Mycobacterium avium subsp. paratuberculosis
ucgucggugggccgccgcgg

SEQ ID NO: 3007581 - RNA, 14 nt, Mycobacterium avium subsp. paratuberculosis
ucgucgucaccucg

SEQ ID NO: 3007582 - RNA, 18 nt, Mycobacterium avium subsp. paratuberculosis
ucgucgucccgucggcgc

SEQ ID NO: 3007583 - RNA, 18 nt, Mycobacterium avium subsp. paratuberculosis
ucgucguccgcaaccgcc

SEQ ID NO: 3007584 - RNA, 14 nt, Mycobacterium avium subsp. paratuberculosis
ucgucgucgaccgu

SEQ ID NO: 3007585 - RNA, 13 nt, Mycobacterium avium subsp. paratuberculosis
ucgucgucgacgc

SEQ ID NO: 3007586 - RNA, 21 nt, Mycobacterium avium subsp. paratuberculosis
ucgucgucgagccgcucgcgc

SEQ ID NO: 3007587 - RNA, 14 nt, Mycobacterium avium subsp. paratuberculosis
ucgucgucgcagug

SEQ ID NO: 3007588 - RNA, 21 nt, Mycobacterium avium subsp. paratuberculosis
ucgucgucgcagugcccgccc

SEQ ID NO: 3007589 - RNA, 13 nt, Mycobacterium avium subsp. paratuberculosis
ucgucgucggccg

SEQ ID NO: 3007590 - RNA, 13 nt, Mycobacterium avium subsp. paratuberculosis
ucgucgucggcgg

SEQ ID NO: 3007591 - RNA, 14 nt, Mycobacterium avium subsp. paratuberculosis
ucgucgucggcggg

SEQ ID NO: 3007592 - RNA, 15 nt, Mycobacterium avium subsp. paratuberculosis
ucgucgucggcgggg

SEQ ID NO: 3007593 - RNA, 15 nt, Mycobacterium avium subsp. paratuberculosis
ucgucgucggugaug

SEQ ID NO: 3007594 - RNA, 21 nt, Mycobacterium avium subsp. paratuberculosis
ucgucgugcaccacgacgucg

SEQ ID NO: 3007595 - RNA, 19 nt, Mycobacterium avium subsp. paratuberculosis
ucgucgugggugacccggc

SEQ ID NO: 3007596 - RNA, 21 nt, Mycobacterium avium subsp. paratuberculosis
ucgucgugggugacccggccg

SEQ ID NO: 3007597 - RNA, 22 nt, Mycobacterium avium subsp. paratuberculosis
ucgucguugagcaucaccauga

SEQ ID NO: 3007598 - RNA, 14 nt, Mycobacterium avium subsp. paratuberculosis
ucgucguuggcccg

SEQ ID NO: 3007599 - RNA, 18 nt, Mycobacterium avium subsp. paratuberculosis
ucgucguuguuggcggcg

SEQ ID NO: 3007600 - RNA, 22 nt, Mycobacterium avium subsp. paratuberculosis
ucgucguuguuggcggcgguga

SEQ ID NO: 3007601 - RNA, 16 nt, Mycobacterium avium subsp. paratuberculosis
ucgucuacuccaccaa

SEQ ID NO: 3007602 - RNA, 19 nt, Mycobacterium avium subsp. paratuberculosis
ucgucuccgcugucgucgu

SEQ ID NO: 3007603 - RNA, 15 nt, Mycobacterium avium subsp. paratuberculosis
ucgucuccggcggca

SEQ ID NO: 3007604 - RNA, 14 nt, Mycobacterium avium subsp. paratuberculosis
ucgucucggccgcg

SEQ ID NO: 3007605 - RNA, 17 nt, Mycobacterium avium subsp. paratuberculosis
ucgucuggccguugaug

SEQ ID NO: 3007606 - RNA, 18 nt, Mycobacterium avium subsp. paratuberculosis
ucgucuucuuggccgcgg

SEQ ID NO: 3007607 - RNA, 12 nt, Mycobacterium avium subsp. paratuberculosis
ucgucuuggccu

SEQ ID NO: 3007608 - RNA, 15 nt, Mycobacterium avium subsp. paratuberculosis
ucgucuuggccugcu

SEQ ID NO: 3007609 - RNA, 23 nt, Mycobacterium avium subsp. paratuberculosis
ucgugaccaaugcggugaacgcg

SEQ ID NO: 3007610 - RNA, 15 nt, Mycobacterium avium subsp. paratuberculosis
ucgugaccgaccucc

SEQ ID NO: 3007611 - RNA, 16 nt, Mycobacterium avium subsp. paratuberculosis
ucgugaccgaccucca

SEQ ID NO: 3007612 - RNA, 12 nt, Mycobacterium avium subsp. paratuberculosis
ucgugacgccgu

SEQ ID NO: 3007613 - RNA, 13 nt, Mycobacterium avium subsp. paratuberculosis
ucgugacgccguc

SEQ ID NO: 3007614 - RNA, 18 nt, Mycobacterium avium subsp. paratuberculosis
ucgugacgcggcgucggg

SEQ ID NO: 3007615 - RNA, 20 nt, Mycobacterium avium subsp. paratuberculosis
ucgugacgcggcgucgggcg

SEQ ID NO: 3007616 - RNA, 16 nt, Mycobacterium avium subsp. paratuberculosis
ucgugaucgcccaccu

SEQ ID NO: 3007617 - RNA, 23 nt, Mycobacterium avium subsp. paratuberculosis
ucgugaugguccagcaccggcgc

SEQ ID NO: 3007618 - RNA, 24 nt, Mycobacterium avium subsp. paratuberculosis
ucgugcaaaccggaccgccgcggc

SEQ ID NO: 3007619 - RNA, 23 nt, Mycobacterium avium subsp. paratuberculosis
ucgugcaacucccgcgccgcggc

SEQ ID NO: 3007620 - RNA, 21 nt, Mycobacterium avium subsp. paratuberculosis
ucgugcacaugcccgucgggc

SEQ ID NO: 3007621 - RNA, 22 nt, Mycobacterium avium subsp. paratuberculosis
ucgugcacaugcccgucgggcg

SEQ ID NO: 3007622 - RNA, 20 nt, Mycobacterium avium subsp. paratuberculosis
ucgugcaccacgacgucgag

SEQ ID NO: 3007623 - RNA, 17 nt, Mycobacterium avium subsp. paratuberculosis
ucgugcagcaccgccag

SEQ ID NO: 3007624 - RNA, 14 nt, Mycobacterium avium subsp. paratuberculosis
ucgugcagccggcg

SEQ ID NO: 3007625 - RNA, 17 nt, Mycobacterium avium subsp. paratuberculosis
ucgugcagccggcggcg

SEQ ID NO: 3007626 - RNA, 15 nt, Mycobacterium avium subsp. paratuberculosis
ucgugcagcuguucc

SEQ ID NO: 3007627 - RNA, 17 nt, Mycobacterium avium subsp. paratuberculosis
ucgugcagugcgaucgc

SEQ ID NO: 3007628 - RNA, 14 nt, Mycobacterium avium subsp. paratuberculosis
ucgugcaucggcgc

SEQ ID NO: 3007629 - RNA, 16 nt, Mycobacterium avium subsp. paratuberculosis
ucgugcaucggcgccu

SEQ ID NO: 3007630 - RNA, 14 nt, Mycobacterium avium subsp. paratuberculosis
ucgugcccgggccc

SEQ ID NO: 3007631 - RNA, 22 nt, Mycobacterium avium subsp. paratuberculosis
ucgugccgcacccgauccacgg

SEQ ID NO: 3007632 - RNA, 13 nt, Mycobacterium avium subsp. paratuberculosis
ucgugcggccggc

SEQ ID NO: 3007633 - RNA, 14 nt, Mycobacterium avium subsp. paratuberculosis
ucgugcggccggcg

SEQ ID NO: 3007634 - RNA, 22 nt, Mycobacterium avium subsp. paratuberculosis
ucgugcggccggcgccggcggu

SEQ ID NO: 3007635 - RNA, 13 nt, Mycobacterium avium subsp. paratuberculosis
ucgugcggcgccg

SEQ ID NO: 3007636 - RNA, 20 nt, Mycobacterium avium subsp. paratuberculosis
ucgugcggcgccgcccggcg

SEQ ID NO: 3007637 - RNA, 19 nt, Mycobacterium avium subsp. paratuberculosis
ucgugcgggaugccgagca

SEQ ID NO: 3007638 - RNA, 22 nt, Mycobacterium avium subsp. paratuberculosis
ucgugcgggcuccgcacgaccu

SEQ ID NO: 3007639 - RNA, 23 nt, Mycobacterium avium subsp. paratuberculosis
ucgugcgggcuccgcacgaccug

SEQ ID NO: 3007640 - RNA, 16 nt, Mycobacterium avium subsp. paratuberculosis
ucgugcucggcgagca

SEQ ID NO: 3007641 - RNA, 13 nt, Mycobacterium avium subsp. paratuberculosis
ucgugcugggccg

SEQ ID NO: 3007642 - RNA, 16 nt, Mycobacterium avium subsp. paratuberculosis
ucgugcugggccgggc

SEQ ID NO: 3007643 - RNA, 23 nt, Mycobacterium avium subsp. paratuberculosis
ucgugcuguggaacacgucggcg

SEQ ID NO: 3007644 - RNA, 20 nt, Mycobacterium avium subsp. paratuberculosis
ucguggaaaucgagcgcgcu

SEQ ID NO: 3007645 - RNA, 19 nt, Mycobacterium avium subsp. paratuberculosis
ucguggaauccuuccucgc

SEQ ID NO: 3007646 - RNA, 19 nt, Mycobacterium avium subsp. paratuberculosis
ucguggacaggaggacaag

SEQ ID NO: 3007647 - RNA, 17 nt, Mycobacterium avium subsp. paratuberculosis
ucguggacgaacgcggc

SEQ ID NO: 3007648 - RNA, 22 nt, Mycobacterium avium subsp. paratuberculosis
ucguggacgaacgcggcgaaca

SEQ ID NO: 3007649 - RNA, 18 nt, Mycobacterium avium subsp. paratuberculosis
ucguggauguugucgugg

SEQ ID NO: 3007650 - RNA, 19 nt, Mycobacterium avium subsp. paratuberculosis
ucguggcugaacagcgcgc

SEQ ID NO: 3007651 - RNA, 16 nt, Mycobacterium avium subsp. paratuberculosis
ucguggcuuucggcgc

SEQ ID NO: 3007652 - RNA, 17 nt, Mycobacterium avium subsp. paratuberculosis
ucgugggcaacacgucg

SEQ ID NO: 3007653 - RNA, 21 nt, Mycobacterium avium subsp. paratuberculosis
ucgugggcgauccgcaggccg

SEQ ID NO: 3007654 - RNA, 15 nt, Mycobacterium avium subsp. paratuberculosis
ucgugggcgccgucg

SEQ ID NO: 3007655 - RNA, 13 nt, Mycobacterium avium subsp. paratuberculosis
ucgugggcgugcc

SEQ ID NO: 3007656 - RNA, 19 nt, Mycobacterium avium subsp. paratuberculosis
ucguggggcucagccgaag

SEQ ID NO: 3007657 - RNA, 20 nt, Mycobacterium avium subsp. paratuberculosis
ucgugguaccggcgccaggc

SEQ ID NO: 3007658 - RNA, 14 nt, Mycobacterium avium subsp. paratuberculosis
ucguggucgacgcc

SEQ ID NO: 3007659 - RNA, 15 nt, Mycobacterium avium subsp. paratuberculosis
ucgugguggccgcga

SEQ ID NO: 3007660 - RNA, 15 nt, Mycobacterium avium subsp. paratuberculosis
ucgugguucuccgcg

SEQ ID NO: 3007661 - RNA, 14 nt, Mycobacterium avium subsp. paratuberculosis
ucgugucccggcgc

SEQ ID NO: 3007662 - RNA, 16 nt, Mycobacterium avium subsp. paratuberculosis
ucguguccgcgccggc

SEQ ID NO: 3007663 - RNA, 12 nt, Mycobacterium avium subsp. paratuberculosis
ucgugucgaucg

SEQ ID NO: 3007664 - RNA, 16 nt, Mycobacterium avium subsp. paratuberculosis
ucguguggcgcacgcu

SEQ ID NO: 3007665 - RNA, 16 nt, Mycobacterium avium subsp. paratuberculosis
ucgugugggcgcccgc

SEQ ID NO: 3007666 - RNA, 17 nt, Mycobacterium avium subsp. paratuberculosis
ucguguucucacggcga

SEQ ID NO: 3007667 - RNA, 19 nt, Mycobacterium avium subsp. paratuberculosis
ucguucagcugcagccggc

SEQ ID NO: 3007668 - RNA, 17 nt, Mycobacterium avium subsp. paratuberculosis
ucguucccugcgcggcg

SEQ ID NO: 3007669 - RNA, 22 nt, Mycobacterium avium subsp. paratuberculosis
ucguucccugcgcggcgaugcg

SEQ ID NO: 3007670 - RNA, 20 nt, Mycobacterium avium subsp. paratuberculosis
ucguucgaauuguggcggcc

SEQ ID NO: 3007671 - RNA, 13 nt, Mycobacterium avium subsp. paratuberculosis
ucguucgacgccg

SEQ ID NO: 3007672 - RNA, 22 nt, Mycobacterium avium subsp. paratuberculosis
ucguucgugagcgguggccacg

SEQ ID NO: 3007673 - RNA, 15 nt, Mycobacterium avium subsp. paratuberculosis
ucguucucgggggcg

SEQ ID NO: 3007674 - RNA, 19 nt, Mycobacterium avium subsp. paratuberculosis
ucguucucgggggcgggca

SEQ ID NO: 3007675 - RNA, 13 nt, Mycobacterium avium subsp. paratuberculosis
ucguucuggcccg

SEQ ID NO: 3007676 - RNA, 18 nt, Mycobacterium avium subsp. paratuberculosis
ucguugaacaguucggug

SEQ ID NO: 3007677 - RNA, 14 nt, Mycobacterium avium subsp. paratuberculosis
ucguugaccggguc

SEQ ID NO: 3007678 - RNA, 19 nt, Mycobacterium avium subsp. paratuberculosis
ucguugaccgggucgccga

SEQ ID NO: 3007679 - RNA, 24 nt, Mycobacterium avium subsp. paratuberculosis
ucguugaccugcuugagcccgucg

SEQ ID NO: 3007680 - RNA, 14 nt, Mycobacterium avium subsp. paratuberculosis
ucguugacgcccuc

SEQ ID NO: 3007681 - RNA, 22 nt, Mycobacterium avium subsp. paratuberculosis
ucguugacgcccuccuggcggg

SEQ ID NO: 3007682 - RNA, 15 nt, Mycobacterium avium subsp. paratuberculosis
ucguugacgcugggc

SEQ ID NO: 3007683 - RNA, 22 nt, Mycobacterium avium subsp. paratuberculosis
ucguugagcacacccagcgagc

SEQ ID NO: 3007684 - RNA, 13 nt, Mycobacterium avium subsp. paratuberculosis
ucguugagcacca

SEQ ID NO: 3007685 - RNA, 14 nt, Mycobacterium avium subsp. paratuberculosis
ucguugagcaccac

SEQ ID NO: 3007686 - RNA, 16 nt, Mycobacterium avium subsp. paratuberculosis
ucguugagcaccacga

SEQ ID NO: 3007687 - RNA, 15 nt, Mycobacterium avium subsp. paratuberculosis
ucguugagcaucacc

SEQ ID NO: 3007688 - RNA, 15 nt, Mycobacterium avium subsp. paratuberculosis
ucguugagugcgcug

SEQ ID NO: 3007689 - RNA, 18 nt, Mycobacterium avium subsp. paratuberculosis
ucguugaucaggugcagc

SEQ ID NO: 3007690 - RNA, 16 nt, Mycobacterium avium subsp. paratuberculosis
ucguugcacacccggu

SEQ ID NO: 3007691 - RNA, 15 nt, Mycobacterium avium subsp. paratuberculosis
ucguugccggcggcc

SEQ ID NO: 3007692 - RNA, 12 nt, Mycobacterium avium subsp. paratuberculosis
ucguugcgccgc

SEQ ID NO: 3007693 - RNA, 13 nt, Mycobacterium avium subsp. paratuberculosis
ucguugcgccgcc

SEQ ID NO: 3007694 - RNA, 14 nt, Mycobacterium avium subsp. paratuberculosis
ucguugcgccgcca

SEQ ID NO: 3007695 - RNA, 19 nt, Mycobacterium avium subsp. paratuberculosis
ucguugcgccgccagggcg

SEQ ID NO: 3007696 - RNA, 15 nt, Mycobacterium avium subsp. paratuberculosis
ucguugcgggcggcg

SEQ ID NO: 3007697 - RNA, 20 nt, Mycobacterium avium subsp. paratuberculosis
ucguugcgggcggcgcggcg

SEQ ID NO: 3007698 - RNA, 12 nt, Mycobacterium avium subsp. paratuberculosis
ucguuggcggcg

SEQ ID NO: 3007699 - RNA, 17 nt, Mycobacterium avium subsp. paratuberculosis
ucguugucgucgccggc

SEQ ID NO: 3007700 - RNA, 13 nt, Mycobacterium avium subsp. paratuberculosis
ucguugugcaccg

SEQ ID NO: 3007701 - RNA, 24 nt, Mycobacterium avium subsp. paratuberculosis
ucguugugcauguggccgucgccg

SEQ ID NO: 3007702 - RNA, 18 nt, Mycobacterium avium subsp. paratuberculosis
ucuaacuccgcucgggcc

SEQ ID NO: 3007703 - RNA, 14 nt, Mycobacterium avium subsp. paratuberculosis
ucuacgaccucgaa

SEQ ID NO: 3007704 - RNA, 12 nt, Mycobacterium avium subsp. paratuberculosis
ucuacggcgggc

SEQ ID NO: 3007705 - RNA, 16 nt, Mycobacterium avium subsp. paratuberculosis
ucuacgucgucgccgg

SEQ ID NO: 3007706 - RNA, 14 nt, Mycobacterium avium subsp. paratuberculosis
ucuacuuggccagc

SEQ ID NO: 3007707 - RNA, 15 nt, Mycobacterium avium subsp. paratuberculosis
ucuacuuggccagcu

SEQ ID NO: 3007708 - RNA, 19 nt, Mycobacterium avium subsp. paratuberculosis
ucuaggacgugcucugccu

SEQ ID NO: 3007709 - RNA, 14 nt, Mycobacterium avium subsp. paratuberculosis
ucucaccggcggcg

SEQ ID NO: 3007710 - RNA, 16 nt, Mycobacterium avium subsp. paratuberculosis
ucucacggcgaauauu

SEQ ID NO: 3007711 - RNA, 18 nt, Mycobacterium avium subsp. paratuberculosis
ucucacggcgaauauuuc

SEQ ID NO: 3007712 - RNA, 21 nt, Mycobacterium avium subsp. paratuberculosis
ucucagcguucacgucgauca

SEQ ID NO: 3007713 - RNA, 21 nt, Mycobacterium avium subsp. paratuberculosis
ucucaggaauuugcggcccgg

SEQ ID NO: 3007714 - RNA, 23 nt, Mycobacterium avium subsp. paratuberculosis
ucucaggcguggguuccgccguc

SEQ ID NO: 3007715 - RNA, 14 nt, Mycobacterium avium subsp. paratuberculosis
ucucagucggccac

SEQ ID NO: 3007716 - RNA, 23 nt, Mycobacterium avium subsp. paratuberculosis
ucuccacccgccccuccaggcau

SEQ ID NO: 3007717 - RNA, 13 nt, Mycobacterium avium subsp. paratuberculosis
ucuccaccgcgcg

SEQ ID NO: 3007718 - RNA, 12 nt, Mycobacterium avium subsp. paratuberculosis
ucuccaccgucg

SEQ ID NO: 3007719 - RNA, 14 nt, Mycobacterium avium subsp. paratuberculosis
ucuccacgccgacg

SEQ ID NO: 3007720 - RNA, 21 nt, Mycobacterium avium subsp. paratuberculosis
ucuccacgccgacgaacaggu

SEQ ID NO: 3007721 - RNA, 16 nt, Mycobacterium avium subsp. paratuberculosis
ucuccagcagcuucau

SEQ ID NO: 3007722 - RNA, 21 nt, Mycobacterium avium subsp. paratuberculosis
ucuccagcagcuucaugcccg

SEQ ID NO: 3007723 - RNA, 12 nt, Mycobacterium avium subsp. paratuberculosis
ucuccagccgcg

SEQ ID NO: 3007724 - RNA, 13 nt, Mycobacterium avium subsp. paratuberculosis
ucuccagcgcggu

SEQ ID NO: 3007725 - RNA, 15 nt, Mycobacterium avium subsp. paratuberculosis
ucuccagcggccgca

SEQ ID NO: 3007726 - RNA, 23 nt, Mycobacterium avium subsp. paratuberculosis
ucuccagcggccgcagcgcgacg

SEQ ID NO: 3007727 - RNA, 15 nt, Mycobacterium avium subsp. paratuberculosis
ucuccagcggccggg

SEQ ID NO: 3007728 - RNA, 13 nt, Mycobacterium avium subsp. paratuberculosis
ucuccagcuccgc

SEQ ID NO: 3007729 - RNA, 20 nt, Mycobacterium avium subsp. paratuberculosis
ucuccagcuccgcggccagc

SEQ ID NO: 3007730 - RNA, 21 nt, Mycobacterium avium subsp. paratuberculosis
ucuccaggcucgacaacugcc

SEQ ID NO: 3007731 - RNA, 14 nt, Mycobacterium avium subsp. paratuberculosis
ucuccaucccgcug

SEQ ID NO: 3007732 - RNA, 21 nt, Mycobacterium avium subsp. paratuberculosis
ucuccauccgggcggccagcc

SEQ ID NO: 3007733 - RNA, 18 nt, Mycobacterium avium subsp. paratuberculosis
ucuccauggugaacuggu

SEQ ID NO: 3007734 - RNA, 14 nt, Mycobacterium avium subsp. paratuberculosis
ucucccagacgucg

SEQ ID NO: 3007735 - RNA, 18 nt, Mycobacterium avium subsp. paratuberculosis
ucucccgggugcgcgucg

SEQ ID NO: 3007736 - RNA, 19 nt, Mycobacterium avium subsp. paratuberculosis
ucuccgagucggcgucgga

SEQ ID NO: 3007737 - RNA, 18 nt, Mycobacterium avium subsp. paratuberculosis
ucuccgcgacaucggcgc

SEQ ID NO: 3007738 - RNA, 12 nt, Mycobacterium avium subsp. paratuberculosis
ucuccgcggccg

SEQ ID NO: 3007739 - RNA, 15 nt, Mycobacterium avium subsp. paratuberculosis
ucuccggccccgagc

SEQ ID NO: 3007740 - RNA, 17 nt, Mycobacterium avium subsp. paratuberculosis
ucuccggccccgagccg

SEQ ID NO: 3007741 - RNA, 20 nt, Mycobacterium avium subsp. paratuberculosis
ucuccggccccgagccgacg

SEQ ID NO: 3007742 - RNA, 22 nt, Mycobacterium avium subsp. paratuberculosis
ucuccggccccgagccgacgau

SEQ ID NO: 3007743 - RNA, 12 nt, Mycobacterium avium subsp. paratuberculosis
ucuccggcccgg

SEQ ID NO: 3007744 - RNA, 13 nt, Mycobacterium avium subsp. paratuberculosis
ucuccggcccggc

SEQ ID NO: 3007745 - RNA, 13 nt, Mycobacterium avium subsp. paratuberculosis
ucuccggcgggcu

SEQ ID NO: 3007746 - RNA, 13 nt, Mycobacterium avium subsp. paratuberculosis
ucuccucccagcc

SEQ ID NO: 3007747 - RNA, 14 nt, Mycobacterium avium subsp. paratuberculosis
ucuccucccagccc

SEQ ID NO: 3007748 - RNA, 14 nt, Mycobacterium avium subsp. paratuberculosis
ucuccuggccgccg

SEQ ID NO: 3007749 - RNA, 23 nt, Mycobacterium avium subsp. paratuberculosis
ucuccuggugucguauuguccug

SEQ ID NO: 3007750 - RNA, 14 nt, Mycobacterium avium subsp. paratuberculosis
ucuccuuguugacg

SEQ ID NO: 3007751 - RNA, 16 nt, Mycobacterium avium subsp. paratuberculosis
ucuccuuguugacgau

SEQ ID NO: 3007752 - RNA, 17 nt, Mycobacterium avium subsp. paratuberculosis
ucucgaacacgccgucg

SEQ ID NO: 3007753 - RNA, 20 nt, Mycobacterium avium subsp. paratuberculosis
ucucgaaccgggcggugacc

SEQ ID NO: 3007754 - RNA, 20 nt, Mycobacterium avium subsp. paratuberculosis
ucucgaaccgucuagcggcg

SEQ ID NO: 3007755 - RNA, 15 nt, Mycobacterium avium subsp. paratuberculosis
ucucgaagcgcagca

SEQ ID NO: 3007756 - RNA, 17 nt, Mycobacterium avium subsp. paratuberculosis
ucucgaagcgcagcagc

SEQ ID NO: 3007757 - RNA, 17 nt, Mycobacterium avium subsp. paratuberculosis
ucucgaccaggccguug

SEQ ID NO: 3007758 - RNA, 11 nt, Mycobacterium avium subsp. paratuberculosis
ucucgaccgcg

SEQ ID NO: 3007759 - RNA, 14 nt, Mycobacterium avium subsp. paratuberculosis
ucucgaccgcggcg

SEQ ID NO: 3007760 - RNA, 17 nt, Mycobacterium avium subsp. paratuberculosis
ucucgaccgcggcgccg

SEQ ID NO: 3007761 - RNA, 22 nt, Mycobacterium avium subsp. paratuberculosis
ucucgaccgcgguggcggugcg

SEQ ID NO: 3007762 - RNA, 15 nt, Mycobacterium avium subsp. paratuberculosis
ucucgaccucgucgg

SEQ ID NO: 3007763 - RNA, 13 nt, Mycobacterium avium subsp. paratuberculosis
ucucgaccuucuu

SEQ ID NO: 3007764 - RNA, 14 nt, Mycobacterium avium subsp. paratuberculosis
ucucgacggcgccg

SEQ ID NO: 3007765 - RNA, 16 nt, Mycobacterium avium subsp. paratuberculosis
ucucgacggugaccgg

SEQ ID NO: 3007766 - RNA, 17 nt, Mycobacterium avium subsp. paratuberculosis
ucucgacgguggccucg

SEQ ID NO: 3007767 - RNA, 14 nt, Mycobacterium avium subsp. paratuberculosis
ucucgaucgacgac

SEQ ID NO: 3007768 - RNA, 20 nt, Mycobacterium avium subsp. paratuberculosis
ucucgaucgacgacgccagc

SEQ ID NO: 3007769 - RNA, 20 nt, Mycobacterium avium subsp. paratuberculosis
ucucgaugaccucgcgggug

SEQ ID NO: 3007770 - RNA, 17 nt, Mycobacterium avium subsp. paratuberculosis
ucucgauggacgcggug

SEQ ID NO: 3007771 - RNA, 20 nt, Mycobacterium avium subsp. paratuberculosis
ucucgauggacgcgguggug

SEQ ID NO: 3007772 - RNA, 18 nt, Mycobacterium avium subsp. paratuberculosis
ucucgauggccacgcucu

SEQ ID NO: 3007773 - RNA, 18 nt, Mycobacterium avium subsp. paratuberculosis
ucucgauggccucgucga

SEQ ID NO: 3007774 - RNA, 19 nt, Mycobacterium avium subsp. paratuberculosis
ucucgauggccucgucgau

SEQ ID NO: 3007775 - RNA, 20 nt, Mycobacterium avium subsp. paratuberculosis
ucucgaugguguagccgugc

SEQ ID NO: 3007776 - RNA, 14 nt, Mycobacterium avium subsp. paratuberculosis
ucucgcacccgguc

SEQ ID NO: 3007777 - RNA, 17 nt, Mycobacterium avium subsp. paratuberculosis
ucucgccaauaaagcgg

SEQ ID NO: 3007778 - RNA, 14 nt, Mycobacterium avium subsp. paratuberculosis
ucucgccccggccg

SEQ ID NO: 3007779 - RNA, 16 nt, Mycobacterium avium subsp. paratuberculosis
ucucgccccggccguu

SEQ ID NO: 3007780 - RNA, 13 nt, Mycobacterium avium subsp. paratuberculosis
ucucgccgagcac

SEQ ID NO: 3007781 - RNA, 21 nt, Mycobacterium avium subsp. paratuberculosis
ucucgccgagcacaccgucgc

SEQ ID NO: 3007782 - RNA, 16 nt, Mycobacterium avium subsp. paratuberculosis
ucucgccguccccacc

SEQ ID NO: 3007783 - RNA, 19 nt, Mycobacterium avium subsp. paratuberculosis
ucucgccguuuugccgccg

SEQ ID NO: 3007784 - RNA, 13 nt, Mycobacterium avium subsp. paratuberculosis
ucucgcgcaccgc

SEQ ID NO: 3007785 - RNA, 14 nt, Mycobacterium avium subsp. paratuberculosis
ucucgcgcaccgcg

SEQ ID NO: 3007786 - RNA, 21 nt, Mycobacterium avium subsp. paratuberculosis
ucucgcgcaggucacccuccu

SEQ ID NO: 3007787 - RNA, 13 nt, Mycobacterium avium subsp. paratuberculosis
ucucgcggcggcc

SEQ ID NO: 3007788 - RNA, 14 nt, Mycobacterium avium subsp. paratuberculosis
ucucgcggcggccg

SEQ ID NO: 3007789 - RNA, 21 nt, Mycobacterium avium subsp. paratuberculosis
ucucgcguucgcuuucgccgg

SEQ ID NO: 3007790 - RNA, 18 nt, Mycobacterium avium subsp. paratuberculosis
ucucgcugaucucgacgg

SEQ ID NO: 3007791 - RNA, 19 nt, Mycobacterium avium subsp. paratuberculosis
ucucgcugaucucgacggu

SEQ ID NO: 3007792 - RNA, 13 nt, Mycobacterium avium subsp. paratuberculosis
ucucgcugcggcg

SEQ ID NO: 3007793 - RNA, 12 nt, Mycobacterium avium subsp. paratuberculosis
ucucggccaacc

SEQ ID NO: 3007794 - RNA, 17 nt, Mycobacterium avium subsp. paratuberculosis
ucucggccagccgguag

SEQ ID NO: 3007795 - RNA, 12 nt, Mycobacterium avium subsp. paratuberculosis
ucucggccagcg

SEQ ID NO: 3007796 - RNA, 13 nt, Mycobacterium avium subsp. paratuberculosis
ucucggccagcgg

SEQ ID NO: 3007797 - RNA, 12 nt, Mycobacterium avium subsp. paratuberculosis
ucucggccaggc

SEQ ID NO: 3007798 - RNA, 12 nt, Mycobacterium avium subsp. paratuberculosis
ucucggccgcgg

SEQ ID NO: 3007799 - RNA, 16 nt, Mycobacterium avium subsp. paratuberculosis
ucucggccggaagguc

SEQ ID NO: 3007800 - RNA, 22 nt, Mycobacterium avium subsp. paratuberculosis
ucucggcgaaggucugaaaugc

SEQ ID NO: 3007801 - RNA, 16 nt, Mycobacterium avium subsp. paratuberculosis
ucucggcgaaguagcg

SEQ ID NO: 3007802 - RNA, 16 nt, Mycobacterium avium subsp. paratuberculosis
ucucggcgaucagcug

SEQ ID NO: 3007803 - RNA, 17 nt, Mycobacterium avium subsp. paratuberculosis
ucucggcgaucagcugc

SEQ ID NO: 3007804 - RNA, 22 nt, Mycobacterium avium subsp. paratuberculosis
ucucggcgccguccagcucgcg

SEQ ID NO: 3007805 - RNA, 16 nt, Mycobacterium avium subsp. paratuberculosis
ucucggcggacaucgc

SEQ ID NO: 3007806 - RNA, 19 nt, Mycobacterium avium subsp. paratuberculosis
ucucggcggacaucgccuc

SEQ ID NO: 3007807 - RNA, 13 nt, Mycobacterium avium subsp. paratuberculosis
ucucggcggcgcc

SEQ ID NO: 3007808 - RNA, 18 nt, Mycobacterium avium subsp. paratuberculosis
ucucggcggucugucgcg

SEQ ID NO: 3007809 - RNA, 23 nt, Mycobacterium avium subsp. paratuberculosis
ucucggcggucuuugccaucccg

SEQ ID NO: 3007810 - RNA, 20 nt, Mycobacterium avium subsp. paratuberculosis
ucucggcguacagcccgcgg

SEQ ID NO: 3007811 - RNA, 19 nt, Mycobacterium avium subsp. paratuberculosis
ucucggcguccccggcggu

SEQ ID NO: 3007812 - RNA, 21 nt, Mycobacterium avium subsp. paratuberculosis
ucucggcgugcucggccacga

SEQ ID NO: 3007813 - RNA, 18 nt, Mycobacterium avium subsp. paratuberculosis
ucucgggaaacgcgucgc

SEQ ID NO: 3007814 - RNA, 17 nt, Mycobacterium avium subsp. paratuberculosis
ucucgggcaccacgccg

SEQ ID NO: 3007815 - RNA, 15 nt, Mycobacterium avium subsp. paratuberculosis
ucucgggcagcagca

SEQ ID NO: 3007816 - RNA, 16 nt, Mycobacterium avium subsp. paratuberculosis
ucucgggcagcagcac

SEQ ID NO: 3007817 - RNA, 15 nt, Mycobacterium avium subsp. paratuberculosis
ucucggucaccgagc

SEQ ID NO: 3007818 - RNA, 16 nt, Mycobacterium avium subsp. paratuberculosis
ucucggugagccgcug

SEQ ID NO: 3007819 - RNA, 23 nt, Mycobacterium avium subsp. paratuberculosis
ucucggugucggacuugucgccg

SEQ ID NO: 3007820 - RNA, 14 nt, Mycobacterium avium subsp. paratuberculosis
ucucggugucgucg

SEQ ID NO: 3007821 - RNA, 17 nt, Mycobacterium avium subsp. paratuberculosis
ucucguagcccaccucg

SEQ ID NO: 3007822 - RNA, 14 nt, Mycobacterium avium subsp. paratuberculosis
ucucgucccacggc

SEQ ID NO: 3007823 - RNA, 18 nt, Mycobacterium avium subsp. paratuberculosis
ucucguccugggccggga

SEQ ID NO: 3007824 - RNA, 16 nt, Mycobacterium avium subsp. paratuberculosis
ucucgucgaugacgau

SEQ ID NO: 3007825 - RNA, 17 nt, Mycobacterium avium subsp. paratuberculosis
ucucgucgaugggcucg

SEQ ID NO: 3007826 - RNA, 13 nt, Mycobacterium avium subsp. paratuberculosis
ucucgucgcgcag

SEQ ID NO: 3007827 - RNA, 12 nt, Mycobacterium avium subsp. paratuberculosis
ucucgucggccg

SEQ ID NO: 3007828 - RNA, 14 nt, Mycobacterium avium subsp. paratuberculosis
ucucgucggccgcg

SEQ ID NO: 3007829 - RNA, 14 nt, Mycobacterium avium subsp. paratuberculosis
ucucgucggcggcg

SEQ ID NO: 3007830 - RNA, 21 nt, Mycobacterium avium subsp. paratuberculosis
ucucgucggcggcggccugca

SEQ ID NO: 3007831 - RNA, 13 nt, Mycobacterium avium subsp. paratuberculosis
ucucgugccgcac

SEQ ID NO: 3007832 - RNA, 21 nt, Mycobacterium avium subsp. paratuberculosis
ucucugauuugaaauucaccu

SEQ ID NO: 3007833 - RNA, 14 nt, Mycobacterium avium subsp. paratuberculosis
ucugaauucggcca

SEQ ID NO: 3007834 - RNA, 15 nt, Mycobacterium avium subsp. paratuberculosis
ucugaccgagcagcg

SEQ ID NO: 3007835 - RNA, 18 nt, Mycobacterium avium subsp. paratuberculosis
ucugaccgagcagcgggg

SEQ ID NO: 3007836 - RNA, 20 nt, Mycobacterium avium subsp. paratuberculosis
ucugaccucgcgccgcgauc

SEQ ID NO: 3007837 - RNA, 21 nt, Mycobacterium avium subsp. paratuberculosis
ucugacggcucuucggcgccg

SEQ ID NO: 3007838 - RNA, 21 nt, Mycobacterium avium subsp. paratuberculosis
ucugagcccgggcaggcggcg

SEQ ID NO: 3007839 - RNA, 18 nt, Mycobacterium avium subsp. paratuberculosis
ucugcacagcuucggcgc

SEQ ID NO: 3007840 - RNA, 14 nt, Mycobacterium avium subsp. paratuberculosis
ucugcacgucggcg

SEQ ID NO: 3007841 - RNA, 15 nt, Mycobacterium avium subsp. paratuberculosis
ucugcacguggugac

SEQ ID NO: 3007842 - RNA, 20 nt, Mycobacterium avium subsp. paratuberculosis
ucugcacucagagcagcgcc

SEQ ID NO: 3007843 - RNA, 17 nt, Mycobacterium avium subsp. paratuberculosis
ucugcacugcgguucac

SEQ ID NO: 3007844 - RNA, 14 nt, Mycobacterium avium subsp. paratuberculosis
ucugcagagcggug

SEQ ID NO: 3007845 - RNA, 12 nt, Mycobacterium avium subsp. paratuberculosis
ucugcagccgca

SEQ ID NO: 3007846 - RNA, 15 nt, Mycobacterium avium subsp. paratuberculosis
ucugcagccggcgcg

SEQ ID NO: 3007847 - RNA, 23 nt, Mycobacterium avium subsp. paratuberculosis
ucugcagccggcgcggcagggcc

SEQ ID NO: 3007848 - RNA, 12 nt, Mycobacterium avium subsp. paratuberculosis
ucugcagcgacg

SEQ ID NO: 3007849 - RNA, 14 nt, Mycobacterium avium subsp. paratuberculosis
ucugcaggccccag

SEQ ID NO: 3007850 - RNA, 16 nt, Mycobacterium avium subsp. paratuberculosis
ucugccacgcccaccg

SEQ ID NO: 3007851 - RNA, 15 nt, Mycobacterium avium subsp. paratuberculosis
ucugccagaacggcg

SEQ ID NO: 3007852 - RNA, 17 nt, Mycobacterium avium subsp. paratuberculosis
ucugccagaacggcggc

SEQ ID NO: 3007853 - RNA, 18 nt, Mycobacterium avium subsp. paratuberculosis
ucugccagaacggcggca

SEQ ID NO: 3007854 - RNA, 20 nt, Mycobacterium avium subsp. paratuberculosis
ucugccagaacggcggcagc

SEQ ID NO: 3007855 - RNA, 15 nt, Mycobacterium avium subsp. paratuberculosis
ucugcccggccagca

SEQ ID NO: 3007856 - RNA, 15 nt, Mycobacterium avium subsp. paratuberculosis
ucugcccugcacuuc

SEQ ID NO: 3007857 - RNA, 14 nt, Mycobacterium avium subsp. paratuberculosis
ucugccgggcggcg

SEQ ID NO: 3007858 - RNA, 16 nt, Mycobacterium avium subsp. paratuberculosis
ucugccggugccgccg

SEQ ID NO: 3007859 - RNA, 19 nt, Mycobacterium avium subsp. paratuberculosis
ucugccggugccgccggcg

SEQ ID NO: 3007860 - RNA, 19 nt, Mycobacterium avium subsp. paratuberculosis
ucugcgcaagaagggcgaa

SEQ ID NO: 3007861 - RNA, 19 nt, Mycobacterium avium subsp. paratuberculosis
ucugcgccccggcgucgau

SEQ ID NO: 3007862 - RNA, 15 nt, Mycobacterium avium subsp. paratuberculosis
ucugcgcccgaucgg

SEQ ID NO: 3007863 - RNA, 12 nt, Mycobacterium avium subsp. paratuberculosis
ucugcgccgccu

SEQ ID NO: 3007864 - RNA, 18 nt, Mycobacterium avium subsp. paratuberculosis
ucugcgccgccuccgggc

SEQ ID NO: 3007865 - RNA, 15 nt, Mycobacterium avium subsp. paratuberculosis
ucugcgccggcggug

SEQ ID NO: 3007866 - RNA, 19 nt, Mycobacterium avium subsp. paratuberculosis
ucugcgccucgaucagcgc

SEQ ID NO: 3007867 - RNA, 20 nt, Mycobacterium avium subsp. paratuberculosis
ucugcgccuuuugcacccgc

SEQ ID NO: 3007868 - RNA, 22 nt, Mycobacterium avium subsp. paratuberculosis
ucugcgcgacgaauccggugac

SEQ ID NO: 3007869 - RNA, 18 nt, Mycobacterium avium subsp. paratuberculosis
ucugcgcgaugucgacgg

SEQ ID NO: 3007870 - RNA, 17 nt, Mycobacterium avium subsp. paratuberculosis
ucugcgcgccgucggcg

SEQ ID NO: 3007871 - RNA, 20 nt, Mycobacterium avium subsp. paratuberculosis
ucugcggccggggcagaccc

SEQ ID NO: 3007872 - RNA, 18 nt, Mycobacterium avium subsp. paratuberculosis
ucugcucccaggacggcg

SEQ ID NO: 3007873 - RNA, 20 nt, Mycobacterium avium subsp. paratuberculosis
ucugcucccaggacggcgcg

SEQ ID NO: 3007874 - RNA, 14 nt, Mycobacterium avium subsp. paratuberculosis
ucugcuccccguug

SEQ ID NO: 3007875 - RNA, 21 nt, Mycobacterium avium subsp. paratuberculosis
ucugcuccucggucagcggcg

SEQ ID NO: 3007876 - RNA, 23 nt, Mycobacterium avium subsp. paratuberculosis
ucugcucgccagacucacggcgg

SEQ ID NO: 3007877 - RNA, 13 nt, Mycobacterium avium subsp. paratuberculosis
ucugcucgccggc

SEQ ID NO: 3007878 - RNA, 22 nt, Mycobacterium avium subsp. paratuberculosis
ucugcucgccgucacaccgcgg

SEQ ID NO: 3007879 - RNA, 14 nt, Mycobacterium avium subsp. paratuberculosis
ucugcucggcggcu

SEQ ID NO: 3007880 - RNA, 13 nt, Mycobacterium avium subsp. paratuberculosis
ucugcucgguguc

SEQ ID NO: 3007881 - RNA, 23 nt, Mycobacterium avium subsp. paratuberculosis
ucugcuugaugaugucggcggcc

SEQ ID NO: 3007882 - RNA, 15 nt, Mycobacterium avium subsp. paratuberculosis
ucugcuugcaaggcg

SEQ ID NO: 3007883 - RNA, 15 nt, Mycobacterium avium subsp. paratuberculosis
ucugcuuggcaggcg

SEQ ID NO: 3007884 - RNA, 21 nt, Mycobacterium avium subsp. paratuberculosis
ucugcuugugaaugggcugcg

SEQ ID NO: 3007885 - RNA, 21 nt, Mycobacterium avium subsp. paratuberculosis
ucugcuuugccuuagcccggc

SEQ ID NO: 3007886 - RNA, 17 nt, Mycobacterium avium subsp. paratuberculosis
ucuggaagauguccucg

SEQ ID NO: 3007887 - RNA, 18 nt, Mycobacterium avium subsp. paratuberculosis
ucuggaagauguccucgg

SEQ ID NO: 3007888 - RNA, 18 nt, Mycobacterium avium subsp. paratuberculosis
ucuggaucaccugggaga

SEQ ID NO: 3007889 - RNA, 22 nt, Mycobacterium avium subsp. paratuberculosis
ucuggaugaucgucucggccgc

SEQ ID NO: 3007890 - RNA, 22 nt, Mycobacterium avium subsp. paratuberculosis
ucuggaugcggcccuggcgggc

SEQ ID NO: 3007891 - RNA, 14 nt, Mycobacterium avium subsp. paratuberculosis
ucuggcagccggcc

SEQ ID NO: 3007892 - RNA, 15 nt, Mycobacterium avium subsp. paratuberculosis
ucuggcagccggccg

SEQ ID NO: 3007893 - RNA, 18 nt, Mycobacterium avium subsp. paratuberculosis
ucuggcagccggccggca

SEQ ID NO: 3007894 - RNA, 13 nt, Mycobacterium avium subsp. paratuberculosis
ucuggccaccgaa

SEQ ID NO: 3007895 - RNA, 14 nt, Mycobacterium avium subsp. paratuberculosis
ucuggccaccgaag

SEQ ID NO: 3007896 - RNA, 16 nt, Mycobacterium avium subsp. paratuberculosis
ucuggccccgucgucu

SEQ ID NO: 3007897 - RNA, 16 nt, Mycobacterium avium subsp. paratuberculosis
ucuggcccgccaucgc

SEQ ID NO: 3007898 - RNA, 20 nt, Mycobacterium avium subsp. paratuberculosis
ucuggcccgccaucgcccgg

SEQ ID NO: 3007899 - RNA, 15 nt, Mycobacterium avium subsp. paratuberculosis
ucuggccgaccgccg

SEQ ID NO: 3007900 - RNA, 23 nt, Mycobacterium avium subsp. paratuberculosis
ucuggccgaucuugucgaccuug

SEQ ID NO: 3007901 - RNA, 21 nt, Mycobacterium avium subsp. paratuberculosis
ucuggccggagcggugcggcu

SEQ ID NO: 3007902 - RNA, 20 nt, Mycobacterium avium subsp. paratuberculosis
ucuggcgcaucagcggggcg

SEQ ID NO: 3007903 - RNA, 19 nt, Mycobacterium avium subsp. paratuberculosis
ucuggcggacccgcucccg

SEQ ID NO: 3007904 - RNA, 15 nt, Mycobacterium avium subsp. paratuberculosis
ucuggcggucccgca

SEQ ID NO: 3007905 - RNA, 19 nt, Mycobacterium avium subsp. paratuberculosis
ucuggcggucccgcauguc

SEQ ID NO: 3007906 - RNA, 20 nt, Mycobacterium avium subsp. paratuberculosis
ucuggcgguuggacaggccg

SEQ ID NO: 3007907 - RNA, 16 nt, Mycobacterium avium subsp. paratuberculosis
ucuggcgugacgcucg

SEQ ID NO: 3007908 - RNA, 17 nt, Mycobacterium avium subsp. paratuberculosis
ucuggcgugacgcucgg

SEQ ID NO: 3007909 - RNA, 18 nt, Mycobacterium avium subsp. paratuberculosis
ucuggcgugacgcucggc

SEQ ID NO: 3007910 - RNA, 22 nt, Mycobacterium avium subsp. paratuberculosis
ucuggcgugacgcucggcgcgu

SEQ ID NO: 3007911 - RNA, 17 nt, Mycobacterium avium subsp. paratuberculosis
ucuggcgugacguucgg

SEQ ID NO: 3007912 - RNA, 21 nt, Mycobacterium avium subsp. paratuberculosis
ucuggcuggugauggccaucu

SEQ ID NO: 3007913 - RNA, 14 nt, Mycobacterium avium subsp. paratuberculosis
ucugggaggcggcg

SEQ ID NO: 3007914 - RNA, 21 nt, Mycobacterium avium subsp. paratuberculosis
ucugggccaggaucucgucgg

SEQ ID NO: 3007915 - RNA, 23 nt, Mycobacterium avium subsp. paratuberculosis
ucugggccaggaucucgucggga

SEQ ID NO: 3007916 - RNA, 21 nt, Mycobacterium avium subsp. paratuberculosis
ucugggcgaacggcaacggcg

SEQ ID NO: 3007917 - RNA, 20 nt, Mycobacterium avium subsp. paratuberculosis
ucugggcgaccaugccgcgg

SEQ ID NO: 3007918 - RNA, 11 nt, Mycobacterium avium subsp. paratuberculosis
ucugggcgcgc

SEQ ID NO: 3007919 - RNA, 19 nt, Mycobacterium avium subsp. paratuberculosis
ucugguacccgauggugaa

SEQ ID NO: 3007920 - RNA, 23 nt, Mycobacterium avium subsp. paratuberculosis
ucuggucaugaaggcgacgucgg

SEQ ID NO: 3007921 - RNA, 15 nt, Mycobacterium avium subsp. paratuberculosis
ucuggucggccagcg

SEQ ID NO: 3007922 - RNA, 14 nt, Mycobacterium avium subsp. paratuberculosis
ucugguggcagcgg

SEQ ID NO: 3007923 - RNA, 21 nt, Mycobacterium avium subsp. paratuberculosis
ucugguucaccgccaccagca

SEQ ID NO: 3007924 - RNA, 15 nt, Mycobacterium avium subsp. paratuberculosis
ucugguuggccggcg

SEQ ID NO: 3007925 - RNA, 13 nt, Mycobacterium avium subsp. paratuberculosis
ucuguauuaagcu

SEQ ID NO: 3007926 - RNA, 23 nt, Mycobacterium avium subsp. paratuberculosis
ucugucgcgcgaacagccgaccg

SEQ ID NO: 3007927 - RNA, 13 nt, Mycobacterium avium subsp. paratuberculosis
ucugugaccacgg

SEQ ID NO: 3007928 - RNA, 15 nt, Mycobacterium avium subsp. paratuberculosis
ucuguucggcggcga

SEQ ID NO: 3007929 - RNA, 13 nt, Mycobacterium avium subsp. paratuberculosis
ucuuacggauauc

SEQ ID NO: 3007930 - RNA, 23 nt, Mycobacterium avium subsp. paratuberculosis
ucuucacgaagugcccggcgccg

SEQ ID NO: 3007931 - RNA, 17 nt, Mycobacterium avium subsp. paratuberculosis
ucuucacgugcgcggcg

SEQ ID NO: 3007932 - RNA, 16 nt, Mycobacterium avium subsp. paratuberculosis
ucuucaugugguuggg

SEQ ID NO: 3007933 - RNA, 12 nt, Mycobacterium avium subsp. paratuberculosis
ucuuccacgccg

SEQ ID NO: 3007934 - RNA, 13 nt, Mycobacterium avium subsp. paratuberculosis
ucuucccagugcc

SEQ ID NO: 3007935 - RNA, 15 nt, Mycobacterium avium subsp. paratuberculosis
ucuucccgccgccgu

SEQ ID NO: 3007936 - RNA, 15 nt, Mycobacterium avium subsp. paratuberculosis
ucuuccucgcugucc

SEQ ID NO: 3007937 - RNA, 13 nt, Mycobacterium avium subsp. paratuberculosis
ucuucgacccgca

SEQ ID NO: 3007938 - RNA, 14 nt, Mycobacterium avium subsp. paratuberculosis
ucuucgaggucgua

SEQ ID NO: 3007939 - RNA, 17 nt, Mycobacterium avium subsp. paratuberculosis
ucuucgaucaggcgcag

SEQ ID NO: 3007940 - RNA, 20 nt, Mycobacterium avium subsp. paratuberculosis
ucuucgcagcgcucaguguc

SEQ ID NO: 3007941 - RNA, 21 nt, Mycobacterium avium subsp. paratuberculosis
ucuucgccgcaaccuucuugg

SEQ ID NO: 3007942 - RNA, 22 nt, Mycobacterium avium subsp. paratuberculosis
ucuucgccggcgcuuugccguc

SEQ ID NO: 3007943 - RNA, 18 nt, Mycobacterium avium subsp. paratuberculosis
ucuucgcggucucucuaa

SEQ ID NO: 3007944 - RNA, 16 nt, Mycobacterium avium subsp. paratuberculosis
ucuucgcugccgccgc

SEQ ID NO: 3007945 - RNA, 21 nt, Mycobacterium avium subsp. paratuberculosis
ucuucgcugccgccgccgcug

SEQ ID NO: 3007946 - RNA, 12 nt, Mycobacterium avium subsp. paratuberculosis
ucuucggcgccg

SEQ ID NO: 3007947 - RNA, 13 nt, Mycobacterium avium subsp. paratuberculosis
ucuucgggcugcg

SEQ ID NO: 3007948 - RNA, 21 nt, Mycobacterium avium subsp. paratuberculosis
ucuucggggauguagccgccg

SEQ ID NO: 3007949 - RNA, 15 nt, Mycobacterium avium subsp. paratuberculosis
ucuucggggccgccg

SEQ ID NO: 3007950 - RNA, 16 nt, Mycobacterium avium subsp. paratuberculosis
ucuucggggccgccgu

SEQ ID NO: 3007951 - RNA, 18 nt, Mycobacterium avium subsp. paratuberculosis
ucuucggggguggccagc

SEQ ID NO: 3007952 - RNA, 15 nt, Mycobacterium avium subsp. paratuberculosis
ucuucucacagguga

SEQ ID NO: 3007953 - RNA, 13 nt, Mycobacterium avium subsp. paratuberculosis
ucuucucggccag

SEQ ID NO: 3007954 - RNA, 21 nt, Mycobacterium avium subsp. paratuberculosis
ucuucuuggcgggcgacuucu

SEQ ID NO: 3007955 - RNA, 21 nt, Mycobacterium avium subsp. paratuberculosis
ucuugaacgcguacagcgccc

SEQ ID NO: 3007956 - RNA, 13 nt, Mycobacterium avium subsp. paratuberculosis
ucuugaacggcgc

SEQ ID NO: 3007957 - RNA, 17 nt, Mycobacterium avium subsp. paratuberculosis
ucuugaccgucgcggag

SEQ ID NO: 3007958 - RNA, 14 nt, Mycobacterium avium subsp. paratuberculosis
ucuugacgccgaug

SEQ ID NO: 3007959 - RNA, 15 nt, Mycobacterium avium subsp. paratuberculosis
ucuugacggccgcgg

SEQ ID NO: 3007960 - RNA, 20 nt, Mycobacterium avium subsp. paratuberculosis
ucuugacggccgcggcggug

SEQ ID NO: 3007961 - RNA, 14 nt, Mycobacterium avium subsp. paratuberculosis
ucuugacggcgacg

SEQ ID NO: 3007962 - RNA, 17 nt, Mycobacterium avium subsp. paratuberculosis
ucuugacggcgacggcg

SEQ ID NO: 3007963 - RNA, 12 nt, Mycobacterium avium subsp. paratuberculosis
ucuugaucucgg

SEQ ID NO: 3007964 - RNA, 17 nt, Mycobacterium avium subsp. paratuberculosis
ucuugaucucggcggcg

SEQ ID NO: 3007965 - RNA, 14 nt, Mycobacterium avium subsp. paratuberculosis
ucuugcagccgggg

SEQ ID NO: 3007966 - RNA, 15 nt, Mycobacterium avium subsp. paratuberculosis
ucuugcccagcgggg

SEQ ID NO: 3007967 - RNA, 19 nt, Mycobacterium avium subsp. paratuberculosis
ucuugcccggcgagcgacg

SEQ ID NO: 3007968 - RNA, 18 nt, Mycobacterium avium subsp. paratuberculosis
ucuugccggcuuccucgc

SEQ ID NO: 3007969 - RNA, 21 nt, Mycobacterium avium subsp. paratuberculosis
ucuugccggcuuccucgcgga

SEQ ID NO: 3007970 - RNA, 18 nt, Mycobacterium avium subsp. paratuberculosis
ucuugccgucggccgccg

SEQ ID NO: 3007971 - RNA, 17 nt, Mycobacterium avium subsp. paratuberculosis
ucuugcgaaagcgcggg

SEQ ID NO: 3007972 - RNA, 14 nt, Mycobacterium avium subsp. paratuberculosis
ucuugcgggcggca

SEQ ID NO: 3007973 - RNA, 18 nt, Mycobacterium avium subsp. paratuberculosis
ucuugcguuccucgacgg

SEQ ID NO: 3007974 - RNA, 16 nt, Mycobacterium avium subsp. paratuberculosis
ucuugcugagcugcgc

SEQ ID NO: 3007975 - RNA, 15 nt, Mycobacterium avium subsp. paratuberculosis
ucuuggacagcagca

SEQ ID NO: 3007976 - RNA, 15 nt, Mycobacterium avium subsp. paratuberculosis
ucuuggacgcccggu

SEQ ID NO: 3007977 - RNA, 13 nt, Mycobacterium avium subsp. paratuberculosis
ucuuggccagcag

SEQ ID NO: 3007978 - RNA, 12 nt, Mycobacterium avium subsp. paratuberculosis
ucuuggccgcgg

SEQ ID NO: 3007979 - RNA, 17 nt, Mycobacterium avium subsp. paratuberculosis
ucuuggccggagccuug

SEQ ID NO: 3007980 - RNA, 16 nt, Mycobacterium avium subsp. paratuberculosis
ucuuggccuccaccgg

SEQ ID NO: 3007981 - RNA, 14 nt, Mycobacterium avium subsp. paratuberculosis
ucuuggcggccugc

SEQ ID NO: 3007982 - RNA, 23 nt, Mycobacterium avium subsp. paratuberculosis
ucuuggcguaugccuccucggug

SEQ ID NO: 3007983 - RNA, 17 nt, Mycobacterium avium subsp. paratuberculosis
ucuugggaaugucguag

SEQ ID NO: 3007984 - RNA, 12 nt, Mycobacterium avium subsp. paratuberculosis
ucuugggcggcc

SEQ ID NO: 3007985 - RNA, 22 nt, Mycobacterium avium subsp. paratuberculosis
ucuuggucagccgcggcggcag

SEQ ID NO: 3007986 - RNA, 14 nt, Mycobacterium avium subsp. paratuberculosis
ucuugucggcggcc

SEQ ID NO: 3007987 - RNA, 17 nt, Mycobacterium avium subsp. paratuberculosis
ucuuugaucucaucguc

SEQ ID NO: 3007988 - RNA, 22 nt, Mycobacterium avium subsp. paratuberculosis
ucuuugguagucugcacugcgg

SEQ ID NO: 3007989 - RNA, 15 nt, Mycobacterium avium subsp. paratuberculosis
ugaaaaccgggcccu

SEQ ID NO: 3007990 - RNA, 17 nt, Mycobacterium avium subsp. paratuberculosis
ugaaaaccgggcccucg

SEQ ID NO: 3007991 - RNA, 20 nt, Mycobacterium avium subsp. paratuberculosis
ugaaaccggcgccgaagccc

SEQ ID NO: 3007992 - RNA, 19 nt, Mycobacterium avium subsp. paratuberculosis
ugaaacuagcuucacgguc

SEQ ID NO: 3007993 - RNA, 20 nt, Mycobacterium avium subsp. paratuberculosis
ugaaacuagcuucacggucg

SEQ ID NO: 3007994 - RNA, 20 nt, Mycobacterium avium subsp. paratuberculosis
ugaaacuaguuucacguucg

SEQ ID NO: 3007995 - RNA, 12 nt, Mycobacterium avium subsp. paratuberculosis
ugaaauccgggg

SEQ ID NO: 3007996 - RNA, 15 nt, Mycobacterium avium subsp. paratuberculosis
ugaaaugccgggccg

SEQ ID NO: 3007997 - RNA, 19 nt, Mycobacterium avium subsp. paratuberculosis
ugaacaccaccaggccgua

SEQ ID NO: 3007998 - RNA, 12 nt, Mycobacterium avium subsp. paratuberculosis
ugaacagcagca

SEQ ID NO: 3007999 - RNA, 12 nt, Mycobacterium avium subsp. paratuberculosis
ugaacagcagcc

SEQ ID NO: 3008000 - RNA, 17 nt, Mycobacterium avium subsp. paratuberculosis
ugaacagcgcccggccg

SEQ ID NO: 3008001 - RNA, 17 nt, Mycobacterium avium subsp. paratuberculosis
ugaacagcgccggaccg

SEQ ID NO: 3008002 - RNA, 13 nt, Mycobacterium avium subsp. paratuberculosis
ugaacagcgcgcc

SEQ ID NO: 3008003 - RNA, 18 nt, Mycobacterium avium subsp. paratuberculosis
ugaacagcgcgccgaaca

SEQ ID NO: 3008004 - RNA, 16 nt, Mycobacterium avium subsp. paratuberculosis
ugaacagucggccggc

SEQ ID NO: 3008005 - RNA, 22 nt, Mycobacterium avium subsp. paratuberculosis
ugaaccacuucuggcgcugcuc

SEQ ID NO: 3008006 - RNA, 21 nt, Mycobacterium avium subsp. paratuberculosis
ugaaccaggccgcgcuggcgc

SEQ ID NO: 3008007 - RNA, 18 nt, Mycobacterium avium subsp. paratuberculosis
ugaacccgccggcgaacg

SEQ ID NO: 3008008 - RNA, 13 nt, Mycobacterium avium subsp. paratuberculosis
ugaacccugggcg

SEQ ID NO: 3008009 - RNA, 20 nt, Mycobacterium avium subsp. paratuberculosis
ugaaccgguacaggccccac

SEQ ID NO: 3008010 - RNA, 19 nt, Mycobacterium avium subsp. paratuberculosis
ugaaccggucguuggccuc

SEQ ID NO: 3008011 - RNA, 14 nt, Mycobacterium avium subsp. paratuberculosis
ugaaccugcugggc

SEQ ID NO: 3008012 - RNA, 15 nt, Mycobacterium avium subsp. paratuberculosis
ugaaccuggccacca

SEQ ID NO: 3008013 - RNA, 22 nt, Mycobacterium avium subsp. paratuberculosis
ugaacgaccugguugacaccac

SEQ ID NO: 3008014 - RNA, 14 nt, Mycobacterium avium subsp. paratuberculosis
ugaacgaggccgcg

SEQ ID NO: 3008015 - RNA, 17 nt, Mycobacterium avium subsp. paratuberculosis
ugaacgaggccgcgccg

SEQ ID NO: 3008016 - RNA, 12 nt, Mycobacterium avium subsp. paratuberculosis
ugaacgccgcca

SEQ ID NO: 3008017 - RNA, 17 nt, Mycobacterium avium subsp. paratuberculosis
ugaacgccgcccccgcc

SEQ ID NO: 3008018 - RNA, 14 nt, Mycobacterium avium subsp. paratuberculosis
ugaacgccggugag

SEQ ID NO: 3008019 - RNA, 18 nt, Mycobacterium avium subsp. paratuberculosis
ugaacgccucgggccggc

SEQ ID NO: 3008020 - RNA, 15 nt, Mycobacterium avium subsp. paratuberculosis
ugaacgcggccaggg

SEQ ID NO: 3008021 - RNA, 20 nt, Mycobacterium avium subsp. paratuberculosis
ugaacgcgguaccgaugacc

SEQ ID NO: 3008022 - RNA, 21 nt, Mycobacterium avium subsp. paratuberculosis
ugaacgcggugggcaccagca

SEQ ID NO: 3008023 - RNA, 22 nt, Mycobacterium avium subsp. paratuberculosis
ugaacgcggugggcaccagcag

SEQ ID NO: 3008024 - RNA, 19 nt, Mycobacterium avium subsp. paratuberculosis
ugaacgcgucgccgugccg

SEQ ID NO: 3008025 - RNA, 23 nt, Mycobacterium avium subsp. paratuberculosis
ugaacgcguugaccagaccgaag

SEQ ID NO: 3008026 - RNA, 15 nt, Mycobacterium avium subsp. paratuberculosis
ugaacggcaccagcg

SEQ ID NO: 3008027 - RNA, 21 nt, Mycobacterium avium subsp. paratuberculosis
ugaacggcaccccgcggucgg

SEQ ID NO: 3008028 - RNA, 23 nt, Mycobacterium avium subsp. paratuberculosis
ugaacggcagcucgucgacgucc

SEQ ID NO: 3008029 - RNA, 19 nt, Mycobacterium avium subsp. paratuberculosis
ugaacggugcccgccgauc

SEQ ID NO: 3008030 - RNA, 20 nt, Mycobacterium avium subsp. paratuberculosis
ugaacuccgggcccaccagg

SEQ ID NO: 3008031 - RNA, 12 nt, Mycobacterium avium subsp. paratuberculosis
ugaacuccucga

SEQ ID NO: 3008032 - RNA, 22 nt, Mycobacterium avium subsp. paratuberculosis
ugaacucgcgggcgagcagcgc

SEQ ID NO: 3008033 - RNA, 23 nt, Mycobacterium avium subsp. paratuberculosis
ugaacuucaccgucugcuggccc

SEQ ID NO: 3008034 - RNA, 12 nt, Mycobacterium avium subsp. paratuberculosis
ugaacuucagcu

SEQ ID NO: 3008035 - RNA, 15 nt, Mycobacterium avium subsp. paratuberculosis
ugaagaacgggcuga

SEQ ID NO: 3008036 - RNA, 19 nt, Mycobacterium avium subsp. paratuberculosis
ugaagaagcgggccaaaga

SEQ ID NO: 3008037 - RNA, 22 nt, Mycobacterium avium subsp. paratuberculosis
ugaagaccggaagccuguuggc

SEQ ID NO: 3008038 - RNA, 15 nt, Mycobacterium avium subsp. paratuberculosis
ugaagaccuggccgg

SEQ ID NO: 3008039 - RNA, 22 nt, Mycobacterium avium subsp. paratuberculosis
ugaagacgcgaaagcagcguuc

SEQ ID NO: 3008040 - RNA, 19 nt, Mycobacterium avium subsp. paratuberculosis
ugaagaucagcgcgucggu

SEQ ID NO: 3008041 - RNA, 13 nt, Mycobacterium avium subsp. paratuberculosis
ugaagaucgacgc

SEQ ID NO: 3008042 - RNA, 20 nt, Mycobacterium avium subsp. paratuberculosis
ugaagcacaccguucccacc

SEQ ID NO: 3008043 - RNA, 12 nt, Mycobacterium avium subsp. paratuberculosis
ugaagcccagcg

SEQ ID NO: 3008044 - RNA, 15 nt, Mycobacterium avium subsp. paratuberculosis
ugaagcccagcgcgu

SEQ ID NO: 3008045 - RNA, 20 nt, Mycobacterium avium subsp. paratuberculosis
ugaagcccugcucggugaug

SEQ ID NO: 3008046 - RNA, 13 nt, Mycobacterium avium subsp. paratuberculosis
ugaagccgacgcc

SEQ ID NO: 3008047 - RNA, 14 nt, Mycobacterium avium subsp. paratuberculosis
ugaagccgacgccg

SEQ ID NO: 3008048 - RNA, 15 nt, Mycobacterium avium subsp. paratuberculosis
ugaagccgugcccgc

SEQ ID NO: 3008049 - RNA, 17 nt, Mycobacterium avium subsp. paratuberculosis
ugaagccguugccgccg

SEQ ID NO: 3008050 - RNA, 20 nt, Mycobacterium avium subsp. paratuberculosis
ugaagcgcugggacagcgug

SEQ ID NO: 3008051 - RNA, 22 nt, Mycobacterium avium subsp. paratuberculosis
ugaagcggcgcgggucgcgguu

SEQ ID NO: 3008052 - RNA, 20 nt, Mycobacterium avium subsp. paratuberculosis
ugaagcgggacagcaaucgg

SEQ ID NO: 3008053 - RNA, 20 nt, Mycobacterium avium subsp. paratuberculosis
ugaagcuagcuucacgcucg

SEQ ID NO: 3008054 - RNA, 21 nt, Mycobacterium avium subsp. paratuberculosis
ugaagcuagcuucacgcucgg

SEQ ID NO: 3008055 - RNA, 22 nt, Mycobacterium avium subsp. paratuberculosis
ugaagcuagcuucacgcucggc

SEQ ID NO: 3008056 - RNA, 22 nt, Mycobacterium avium subsp. paratuberculosis
ugaagcuaguuucacgcucggc

SEQ ID NO: 3008057 - RNA, 20 nt, Mycobacterium avium subsp. paratuberculosis
ugaagcuaguuucacguucg

SEQ ID NO: 3008058 - RNA, 15 nt, Mycobacterium avium subsp. paratuberculosis
ugaagcugccgacca

SEQ ID NO: 3008059 - RNA, 18 nt, Mycobacterium avium subsp. paratuberculosis
ugaagcugccgaccagga

SEQ ID NO: 3008060 - RNA, 12 nt, Mycobacterium avium subsp. paratuberculosis
ugaagcuggcca

SEQ ID NO: 3008061 - RNA, 16 nt, Mycobacterium avium subsp. paratuberculosis
ugaagcuggccaccgc

SEQ ID NO: 3008062 - RNA, 17 nt, Mycobacterium avium subsp. paratuberculosis
ugaagcuggccaccgca

SEQ ID NO: 3008063 - RNA, 22 nt, Mycobacterium avium subsp. paratuberculosis
ugaagcuggccaccgcaucgcc

SEQ ID NO: 3008064 - RNA, 17 nt, Mycobacterium avium subsp. paratuberculosis
ugaaggacuggcccacg

SEQ ID NO: 3008065 - RNA, 21 nt, Mycobacterium avium subsp. paratuberculosis
ugaaggacuggcccacgcagc

SEQ ID NO: 3008066 - RNA, 16 nt, Mycobacterium avium subsp. paratuberculosis
ugaaggaggcggucga

SEQ ID NO: 3008067 - RNA, 19 nt, Mycobacterium avium subsp. paratuberculosis
ugaaggaggcggucgacug

SEQ ID NO: 3008068 - RNA, 21 nt, Mycobacterium avium subsp. paratuberculosis
ugaaggaggcggucgacuggu

SEQ ID NO: 3008069 - RNA, 16 nt, Mycobacterium avium subsp. paratuberculosis
ugaaggcgaacaccag

SEQ ID NO: 3008070 - RNA, 15 nt, Mycobacterium avium subsp. paratuberculosis
ugaaggugcccuccu

SEQ ID NO: 3008071 - RNA, 19 nt, Mycobacterium avium subsp. paratuberculosis
ugaagguuguucugcucga

SEQ ID NO: 3008072 - RNA, 18 nt, Mycobacterium avium subsp. paratuberculosis
ugaaguacccggucugau

SEQ ID NO: 3008073 - RNA, 17 nt, Mycobacterium avium subsp. paratuberculosis
ugaaguccggcggucgc

SEQ ID NO: 3008074 - RNA, 21 nt, Mycobacterium avium subsp. paratuberculosis
ugaaguccggcggucgcugca

SEQ ID NO: 3008075 - RNA, 13 nt, Mycobacterium avium subsp. paratuberculosis
ugaagucggugag

SEQ ID NO: 3008076 - RNA, 21 nt, Mycobacterium avium subsp. paratuberculosis
ugaagucggugcccagcgcga

SEQ ID NO: 3008077 - RNA, 16 nt, Mycobacterium avium subsp. paratuberculosis
ugaagucguucuccag

SEQ ID NO: 3008078 - RNA, 23 nt, Mycobacterium avium subsp. paratuberculosis
ugaagucguucuccagcccucgu

SEQ ID NO: 3008079 - RNA, 17 nt, Mycobacterium avium subsp. paratuberculosis
ugaagugcacucggcga

SEQ ID NO: 3008080 - RNA, 19 nt, Mycobacterium avium subsp. paratuberculosis
ugaaguuaguuucacgcug

SEQ ID NO: 3008081 - RNA, 15 nt, Mycobacterium avium subsp. paratuberculosis
ugaaguucaccaccg

SEQ ID NO: 3008082 - RNA, 16 nt, Mycobacterium avium subsp. paratuberculosis
ugaaguuggccaccgg

SEQ ID NO: 3008083 - RNA, 19 nt, Mycobacterium avium subsp. paratuberculosis
ugaauaccacugcgcgccc

SEQ ID NO: 3008084 - RNA, 20 nt, Mycobacterium avium subsp. paratuberculosis
ugaaucccuccggcaggccg

SEQ ID NO: 3008085 - RNA, 22 nt, Mycobacterium avium subsp. paratuberculosis
ugaaucccuccggcaggccgcg

SEQ ID NO: 3008086 - RNA, 18 nt, Mycobacterium avium subsp. paratuberculosis
ugaauccgcgcagcagcg

SEQ ID NO: 3008087 - RNA, 15 nt, Mycobacterium avium subsp. paratuberculosis
ugaauccucagcacg

SEQ ID NO: 3008088 - RNA, 13 nt, Mycobacterium avium subsp. paratuberculosis
ugaaugcccagcg

SEQ ID NO: 3008089 - RNA, 18 nt, Mycobacterium avium subsp. paratuberculosis
ugaaugggcugcgcgucg

SEQ ID NO: 3008090 - RNA, 15 nt, Mycobacterium avium subsp. paratuberculosis
ugaauuccuggccgg

SEQ ID NO: 3008091 - RNA, 16 nt, Mycobacterium avium subsp. paratuberculosis
ugaauucgaccacggc

SEQ ID NO: 3008092 - RNA, 11 nt, Mycobacterium avium subsp. paratuberculosis
ugaauugggcg

SEQ ID NO: 3008093 - RNA, 16 nt, Mycobacterium avium subsp. paratuberculosis
ugacaaagcacaacuc

SEQ ID NO: 3008094 - RNA, 22 nt, Mycobacterium avium subsp. paratuberculosis
ugacaacacgucuggcagucuu

SEQ ID NO: 3008095 - RNA, 13 nt, Mycobacterium avium subsp. paratuberculosis
ugacacagcaccg

SEQ ID NO: 3008096 - RNA, 18 nt, Mycobacterium avium subsp. paratuberculosis
ugacacagcaccggcguc

SEQ ID NO: 3008097 - RNA, 21 nt, Mycobacterium avium subsp. paratuberculosis
ugacaccgggugcguccagac

SEQ ID NO: 3008098 - RNA, 13 nt, Mycobacterium avium subsp. paratuberculosis
ugacagacccgau

SEQ ID NO: 3008099 - RNA, 14 nt, Mycobacterium avium subsp. paratuberculosis
ugacagacccgauc

SEQ ID NO: 3008100 - RNA, 24 nt, Mycobacterium avium subsp. paratuberculosis
ugacaggcggucgugucagggaug

SEQ ID NO: 3008101 - RNA, 17 nt, Mycobacterium avium subsp. paratuberculosis
ugacaggggcagcagca

SEQ ID NO: 3008102 - RNA, 15 nt, Mycobacterium avium subsp. paratuberculosis
ugacagguggggcac

SEQ ID NO: 3008103 - RNA, 12 nt, Mycobacterium avium subsp. paratuberculosis
ugacagucgacc

SEQ ID NO: 3008104 - RNA, 15 nt, Mycobacterium avium subsp. paratuberculosis
ugaccaacgccgccu

SEQ ID NO: 3008105 - RNA, 13 nt, Mycobacterium avium subsp. paratuberculosis
ugaccaccaggua

SEQ ID NO: 3008106 - RNA, 17 nt, Mycobacterium avium subsp. paratuberculosis
ugaccacccggucgacg

SEQ ID NO: 3008107 - RNA, 22 nt, Mycobacterium avium subsp. paratuberculosis
ugaccacccucagggagcugcc

SEQ ID NO: 3008108 - RNA, 15 nt, Mycobacterium avium subsp. paratuberculosis
ugaccaccgaccggc

SEQ ID NO: 3008109 - RNA, 17 nt, Mycobacterium avium subsp. paratuberculosis
ugaccaccgaccggcuc

SEQ ID NO: 3008110 - RNA, 18 nt, Mycobacterium avium subsp. paratuberculosis
ugaccaccgaccggcucu

SEQ ID NO: 3008111 - RNA, 17 nt, Mycobacterium avium subsp. paratuberculosis
ugaccaccgaggugacg

SEQ ID NO: 3008112 - RNA, 12 nt, Mycobacterium avium subsp. paratuberculosis
ugaccaccggca

SEQ ID NO: 3008113 - RNA, 12 nt, Mycobacterium avium subsp. paratuberculosis
ugaccacgccgu

SEQ ID NO: 3008114 - RNA, 15 nt, Mycobacterium avium subsp. paratuberculosis
ugaccacggcgcgga

SEQ ID NO: 3008115 - RNA, 18 nt, Mycobacterium avium subsp. paratuberculosis
ugaccacggucggcgggu

SEQ ID NO: 3008116 - RNA, 13 nt, Mycobacterium avium subsp. paratuberculosis
ugaccacggugcg

SEQ ID NO: 3008117 - RNA, 23 nt, Mycobacterium avium subsp. paratuberculosis
ugaccagaccgaagaucaccgcg

SEQ ID NO: 3008118 - RNA, 19 nt, Mycobacterium avium subsp. paratuberculosis
ugaccagcacguugugcuc

SEQ ID NO: 3008119 - RNA, 12 nt, Mycobacterium avium subsp. paratuberculosis
ugaccagcgcga

SEQ ID NO: 3008120 - RNA, 22 nt, Mycobacterium avium subsp. paratuberculosis
ugaccagcgcgaacagcgcggc

SEQ ID NO: 3008121 - RNA, 14 nt, Mycobacterium avium subsp. paratuberculosis
ugaccagcgugacg

SEQ ID NO: 3008122 - RNA, 20 nt, Mycobacterium avium subsp. paratuberculosis
ugaccaggaagaugccgauc

SEQ ID NO: 3008123 - RNA, 12 nt, Mycobacterium avium subsp. paratuberculosis
ugaccaggccga

SEQ ID NO: 3008124 - RNA, 21 nt, Mycobacterium avium subsp. paratuberculosis
ugaccagggccucgucgucgu

SEQ ID NO: 3008125 - RNA, 12 nt, Mycobacterium avium subsp. paratuberculosis
ugaccagggugg

SEQ ID NO: 3008126 - RNA, 20 nt, Mycobacterium avium subsp. paratuberculosis
ugaccaggguuccggucacg

SEQ ID NO: 3008127 - RNA, 15 nt, Mycobacterium avium subsp. paratuberculosis
ugaccaggucgccgg

SEQ ID NO: 3008128 - RNA, 16 nt, Mycobacterium avium subsp. paratuberculosis
ugaccaggucgccggc

SEQ ID NO: 3008129 - RNA, 22 nt, Mycobacterium avium subsp. paratuberculosis
ugaccaggucgccggcggccga

SEQ ID NO: 3008130 - RNA, 14 nt, Mycobacterium avium subsp. paratuberculosis
ugaccaucacgcag

SEQ ID NO: 3008131 - RNA, 21 nt, Mycobacterium avium subsp. paratuberculosis
ugaccaucgggucgucggcgu

SEQ ID NO: 3008132 - RNA, 21 nt, Mycobacterium avium subsp. paratuberculosis
ugacccaacucaugggcccgg

SEQ ID NO: 3008133 - RNA, 22 nt, Mycobacterium avium subsp. paratuberculosis
ugacccaacucaugggcccggc

SEQ ID NO: 3008134 - RNA, 15 nt, Mycobacterium avium subsp. paratuberculosis
ugacccaauccggcu

SEQ ID NO: 3008135 - RNA, 23 nt, Mycobacterium avium subsp. paratuberculosis
ugacccacggguuggggccgcgg

SEQ ID NO: 3008136 - RNA, 14 nt, Mycobacterium avium subsp. paratuberculosis
ugacccagcccagc

SEQ ID NO: 3008137 - RNA, 13 nt, Mycobacterium avium subsp. paratuberculosis
ugacccagcgcgg

SEQ ID NO: 3008138 - RNA, 15 nt, Mycobacterium avium subsp. paratuberculosis
ugacccagcgcgggg

SEQ ID NO: 3008139 - RNA, 15 nt, Mycobacterium avium subsp. paratuberculosis
ugaccccccgacgcc

SEQ ID NO: 3008140 - RNA, 16 nt, Mycobacterium avium subsp. paratuberculosis
ugaccccccgacgccg

SEQ ID NO: 3008141 - RNA, 20 nt, Mycobacterium avium subsp. paratuberculosis
ugaccccccgacgccgacgg

SEQ ID NO: 3008142 - RNA, 23 nt, Mycobacterium avium subsp. paratuberculosis
ugaccccgacggcgccgcggccg

SEQ ID NO: 3008143 - RNA, 24 nt, Mycobacterium avium subsp. paratuberculosis
ugaccccgacggcgccgcggccgu

SEQ ID NO: 3008144 - RNA, 16 nt, Mycobacterium avium subsp. paratuberculosis
ugaccccgcucggcgu

SEQ ID NO: 3008145 - RNA, 18 nt, Mycobacterium avium subsp. paratuberculosis
ugaccccggccccggccg

SEQ ID NO: 3008146 - RNA, 18 nt, Mycobacterium avium subsp. paratuberculosis
ugaccccgguuucguugu

SEQ ID NO: 3008147 - RNA, 17 nt, Mycobacterium avium subsp. paratuberculosis
ugaccccguugcacagg

SEQ ID NO: 3008148 - RNA, 21 nt, Mycobacterium avium subsp. paratuberculosis
ugacccgauccagggcccgcu

SEQ ID NO: 3008149 - RNA, 21 nt, Mycobacterium avium subsp. paratuberculosis
ugacccgcaacucgggcucgu

SEQ ID NO: 3008150 - RNA, 15 nt, Mycobacterium avium subsp. paratuberculosis
ugacccgccgcaaca

SEQ ID NO: 3008151 - RNA, 17 nt, Mycobacterium avium subsp. paratuberculosis
ugacccgccgcaacagc

SEQ ID NO: 3008152 - RNA, 21 nt, Mycobacterium avium subsp. paratuberculosis
ugacccgcuccagcggccaca

SEQ ID NO: 3008153 - RNA, 19 nt, Mycobacterium avium subsp. paratuberculosis
ugacccggcccaucaccgg

SEQ ID NO: 3008154 - RNA, 17 nt, Mycobacterium avium subsp. paratuberculosis
ugacccggccgcacacc

SEQ ID NO: 3008155 - RNA, 21 nt, Mycobacterium avium subsp. paratuberculosis
ugacccggccgcacaccacca

SEQ ID NO: 3008156 - RNA, 22 nt, Mycobacterium avium subsp. paratuberculosis
ugacccggccgcacaccaccac

SEQ ID NO: 3008157 - RNA, 13 nt, Mycobacterium avium subsp. paratuberculosis
ugacccggccggu

SEQ ID NO: 3008158 - RNA, 13 nt, Mycobacterium avium subsp. paratuberculosis
ugacccucagcag

SEQ ID NO: 3008159 - RNA, 15 nt, Mycobacterium avium subsp. paratuberculosis
ugacccugccgucac

SEQ ID NO: 3008160 - RNA, 20 nt, Mycobacterium avium subsp. paratuberculosis
ugacccugccgucaccggcc

SEQ ID NO: 3008161 - RNA, 22 nt, Mycobacterium avium subsp. paratuberculosis
ugacccugccgucaccggccau

SEQ ID NO: 3008162 - RNA, 17 nt, Mycobacterium avium subsp. paratuberculosis
ugaccgacauggccagc

SEQ ID NO: 3008163 - RNA, 21 nt, Mycobacterium avium subsp. paratuberculosis
ugaccgacauggccagcacca

SEQ ID NO: 3008164 - RNA, 15 nt, Mycobacterium avium subsp. paratuberculosis
ugaccgacgacguga

SEQ ID NO: 3008165 - RNA, 18 nt, Mycobacterium avium subsp. paratuberculosis
ugaccgacgacgugacga

SEQ ID NO: 3008166 - RNA, 14 nt, Mycobacterium avium subsp. paratuberculosis
ugaccgacggcgac

SEQ ID NO: 3008167 - RNA, 16 nt, Mycobacterium avium subsp. paratuberculosis
ugaccgauccgccggc

SEQ ID NO: 3008168 - RNA, 17 nt, Mycobacterium avium subsp. paratuberculosis
ugaccgauccgccggcg

SEQ ID NO: 3008169 - RNA, 14 nt, Mycobacterium avium subsp. paratuberculosis
ugaccgauggccgc

SEQ ID NO: 3008170 - RNA, 18 nt, Mycobacterium avium subsp. paratuberculosis
ugaccgauggccgcccgc

SEQ ID NO: 3008171 - RNA, 16 nt, Mycobacterium avium subsp. paratuberculosis
ugaccgccagcaccgc

SEQ ID NO: 3008172 - RNA, 23 nt, Mycobacterium avium subsp. paratuberculosis
ugaccgccauugucaucauggug

SEQ ID NO: 3008173 - RNA, 13 nt, Mycobacterium avium subsp. paratuberculosis
ugaccgcccagga

SEQ ID NO: 3008174 - RNA, 16 nt, Mycobacterium avium subsp. paratuberculosis
ugaccgcccaggaccc

SEQ ID NO: 3008175 - RNA, 18 nt, Mycobacterium avium subsp. paratuberculosis
ugaccgcccgcucgacgg

SEQ ID NO: 3008176 - RNA, 12 nt, Mycobacterium avium subsp. paratuberculosis
ugaccgcccggg

SEQ ID NO: 3008177 - RNA, 13 nt, Mycobacterium avium subsp. paratuberculosis
ugaccgccgacac

SEQ ID NO: 3008178 - RNA, 21 nt, Mycobacterium avium subsp. paratuberculosis
ugaccgccgccauccgcgccg

SEQ ID NO: 3008179 - RNA, 16 nt, Mycobacterium avium subsp. paratuberculosis
ugaccgccugcggcag

SEQ ID NO: 3008180 - RNA, 19 nt, Mycobacterium avium subsp. paratuberculosis
ugaccgccugcuugaugau

SEQ ID NO: 3008181 - RNA, 19 nt, Mycobacterium avium subsp. paratuberculosis
ugaccgccuuggcgcgcuc

SEQ ID NO: 3008182 - RNA, 17 nt, Mycobacterium avium subsp. paratuberculosis
ugaccgcgaagguggca

SEQ ID NO: 3008183 - RNA, 13 nt, Mycobacterium avium subsp. paratuberculosis
ugaccgcggacac

SEQ ID NO: 3008184 - RNA, 12 nt, Mycobacterium avium subsp. paratuberculosis
ugaccgcggccu

SEQ ID NO: 3008185 - RNA, 21 nt, Mycobacterium avium subsp. paratuberculosis
ugaccgcggccucgucgaggu

SEQ ID NO: 3008186 - RNA, 23 nt, Mycobacterium avium subsp. paratuberculosis
ugaccgcggcgauggugggcagc

SEQ ID NO: 3008187 - RNA, 14 nt, Mycobacterium avium subsp. paratuberculosis
ugaccgcggcgggc

SEQ ID NO: 3008188 - RNA, 23 nt, Mycobacterium avium subsp. paratuberculosis
ugaccgcgggugaggggcgcgcg

SEQ ID NO: 3008189 - RNA, 22 nt, Mycobacterium avium subsp. paratuberculosis
ugaccgcgucggcgccguaguc

SEQ ID NO: 3008190 - RNA, 12 nt, Mycobacterium avium subsp. paratuberculosis
ugaccggcccgg

SEQ ID NO: 3008191 - RNA, 16 nt, Mycobacterium avium subsp. paratuberculosis
ugaccggcccggcggc

SEQ ID NO: 3008192 - RNA, 20 nt, Mycobacterium avium subsp. paratuberculosis
ugaccggcccggcggccggc

SEQ ID NO: 3008193 - RNA, 22 nt, Mycobacterium avium subsp. paratuberculosis
ugaccggcccggcggccggccg

SEQ ID NO: 3008194 - RNA, 23 nt, Mycobacterium avium subsp. paratuberculosis
ugaccggccugagacgacgccac

SEQ ID NO: 3008195 - RNA, 14 nt, Mycobacterium avium subsp. paratuberculosis
ugaccggcgccggg

SEQ ID NO: 3008196 - RNA, 15 nt, Mycobacterium avium subsp. paratuberculosis
ugaccggcgcgcagc

SEQ ID NO: 3008197 - RNA, 19 nt, Mycobacterium avium subsp. paratuberculosis
ugaccggcgcgcagcaucu

SEQ ID NO: 3008198 - RNA, 18 nt, Mycobacterium avium subsp. paratuberculosis
ugaccggcgcgcccgagu

SEQ ID NO: 3008199 - RNA, 20 nt, Mycobacterium avium subsp. paratuberculosis
ugaccggcgcgcccgaguca

SEQ ID NO: 3008200 - RNA, 14 nt, Mycobacterium avium subsp. paratuberculosis
ugaccggcggccag

SEQ ID NO: 3008201 - RNA, 20 nt, Mycobacterium avium subsp. paratuberculosis
ugaccggcucgccggcgcgc

SEQ ID NO: 3008202 - RNA, 16 nt, Mycobacterium avium subsp. paratuberculosis
ugaccggggucggcgc

SEQ ID NO: 3008203 - RNA, 16 nt, Mycobacterium avium subsp. paratuberculosis
ugaccgggucgccgau

SEQ ID NO: 3008204 - RNA, 17 nt, Mycobacterium avium subsp. paratuberculosis
ugaccgggucgccgauc

SEQ ID NO: 3008205 - RNA, 19 nt, Mycobacterium avium subsp. paratuberculosis
ugaccgggucgccgaucac

SEQ ID NO: 3008206 - RNA, 14 nt, Mycobacterium avium subsp. paratuberculosis
ugaccggugcgccc

SEQ ID NO: 3008207 - RNA, 16 nt, Mycobacterium avium subsp. paratuberculosis
ugaccgucgccgacca

SEQ ID NO: 3008208 - RNA, 17 nt, Mycobacterium avium subsp. paratuberculosis
ugaccgucgccgaccag

SEQ ID NO: 3008209 - RNA, 16 nt, Mycobacterium avium subsp. paratuberculosis
ugaccgugacggugcg

SEQ ID NO: 3008210 - RNA, 14 nt, Mycobacterium avium subsp. paratuberculosis
ugaccucccggaca

SEQ ID NO: 3008211 - RNA, 17 nt, Mycobacterium avium subsp. paratuberculosis
ugaccuccuugcccagc

SEQ ID NO: 3008212 - RNA, 15 nt, Mycobacterium avium subsp. paratuberculosis
ugaccucgagcaccg

SEQ ID NO: 3008213 - RNA, 14 nt, Mycobacterium avium subsp. paratuberculosis
ugaccucgccgccc

SEQ ID NO: 3008214 - RNA, 15 nt, Mycobacterium avium subsp. paratuberculosis
ugaccucgcgcccgg

SEQ ID NO: 3008215 - RNA, 20 nt, Mycobacterium avium subsp. paratuberculosis
ugaccucgcgcccggcgccg

SEQ ID NO: 3008216 - RNA, 14 nt, Mycobacterium avium subsp. paratuberculosis
ugaccugugcgccc

SEQ ID NO: 3008217 - RNA, 15 nt, Mycobacterium avium subsp. paratuberculosis
ugaccuugaccagcu

SEQ ID NO: 3008218 - RNA, 18 nt, Mycobacterium avium subsp. paratuberculosis
ugaccuugucgaagguga

SEQ ID NO: 3008219 - RNA, 20 nt, Mycobacterium avium subsp. paratuberculosis
ugacgaacaugcugccgccg

SEQ ID NO: 3008220 - RNA, 14 nt, Mycobacterium avium subsp. paratuberculosis
ugacgaacgcgccg

SEQ ID NO: 3008221 - RNA, 20 nt, Mycobacterium avium subsp. paratuberculosis
ugacgaacuccugcucgcgg

SEQ ID NO: 3008222 - RNA, 21 nt, Mycobacterium avium subsp. paratuberculosis
ugacgaacucguuggcguggc

SEQ ID NO: 3008223 - RNA, 19 nt, Mycobacterium avium subsp. paratuberculosis
ugacgaauuccgcaccggu

SEQ ID NO: 3008224 - RNA, 20 nt, Mycobacterium avium subsp. paratuberculosis
ugacgaauuccgcaccgguc

SEQ ID NO: 3008225 - RNA, 13 nt, Mycobacterium avium subsp. paratuberculosis
ugacgaccggcag

SEQ ID NO: 3008226 - RNA, 19 nt, Mycobacterium avium subsp. paratuberculosis
ugacgaccggcagccgcgc

SEQ ID NO: 3008227 - RNA, 22 nt, Mycobacterium avium subsp. paratuberculosis
ugacgaccggcagccgcgccca

SEQ ID NO: 3008228 - RNA, 13 nt, Mycobacterium avium subsp. paratuberculosis
ugacgaccugguc

SEQ ID NO: 3008229 - RNA, 19 nt, Mycobacterium avium subsp. paratuberculosis
ugacgaccuggucgccgcc

SEQ ID NO: 3008230 - RNA, 22 nt, Mycobacterium avium subsp. paratuberculosis
ugacgaccuggucgccgccguc

SEQ ID NO: 3008231 - RNA, 19 nt, Mycobacterium avium subsp. paratuberculosis
ugacgaccuugucgcgcac

SEQ ID NO: 3008232 - RNA, 19 nt, Mycobacterium avium subsp. paratuberculosis
ugacgacggucaccggcag

SEQ ID NO: 3008233 - RNA, 18 nt, Mycobacterium avium subsp. paratuberculosis
ugacgacguuggccagca

SEQ ID NO: 3008234 - RNA, 20 nt, Mycobacterium avium subsp. paratuberculosis
ugacgaggagggugucggcg

SEQ ID NO: 3008235 - RNA, 23 nt, Mycobacterium avium subsp. paratuberculosis
ugacgaggagggugucggcgggg

SEQ ID NO: 3008236 - RNA, 16 nt, Mycobacterium avium subsp. paratuberculosis
ugacgaguuccaccuc

SEQ ID NO: 3008237 - RNA, 18 nt, Mycobacterium avium subsp. paratuberculosis
ugacgaucgucgacguca

SEQ ID NO: 3008238 - RNA, 11 nt, Mycobacterium avium subsp. paratuberculosis
ugacgaugacg

SEQ ID NO: 3008239 - RNA, 18 nt, Mycobacterium avium subsp. paratuberculosis
ugacgaugauccuggccu

SEQ ID NO: 3008240 - RNA, 20 nt, Mycobacterium avium subsp. paratuberculosis
ugacgaugaugucggccggc

SEQ ID NO: 3008241 - RNA, 16 nt, Mycobacterium avium subsp. paratuberculosis
ugacgaugcggccggc

SEQ ID NO: 3008242 - RNA, 17 nt, Mycobacterium avium subsp. paratuberculosis
ugacgaugcggccggcg

SEQ ID NO: 3008243 - RNA, 14 nt, Mycobacterium avium subsp. paratuberculosis
ugacgauggcgacc

SEQ ID NO: 3008244 - RNA, 13 nt, Mycobacterium avium subsp. paratuberculosis
ugacgauggugua

SEQ ID NO: 3008245 - RNA, 21 nt, Mycobacterium avium subsp. paratuberculosis
ugacgaugucgaugacggcgg

SEQ ID NO: 3008246 - RNA, 22 nt, Mycobacterium avium subsp. paratuberculosis
ugacgaugucgaugacggcggc

SEQ ID NO: 3008247 - RNA, 15 nt, Mycobacterium avium subsp. paratuberculosis
ugacgcaucaccacg

SEQ ID NO: 3008248 - RNA, 17 nt, Mycobacterium avium subsp. paratuberculosis
ugacgcaucaccacgcu

SEQ ID NO: 3008249 - RNA, 16 nt, Mycobacterium avium subsp. paratuberculosis
ugacgccacgcgucag

SEQ ID NO: 3008250 - RNA, 17 nt, Mycobacterium avium subsp. paratuberculosis
ugacgcccccggugacg

SEQ ID NO: 3008251 - RNA, 14 nt, Mycobacterium avium subsp. paratuberculosis
ugacgcccuccugg

SEQ ID NO: 3008252 - RNA, 13 nt, Mycobacterium avium subsp. paratuberculosis
ugacgccgacgua

SEQ ID NO: 3008253 - RNA, 14 nt, Mycobacterium avium subsp. paratuberculosis
ugacgccgacguag

SEQ ID NO: 3008254 - RNA, 21 nt, Mycobacterium avium subsp. paratuberculosis
ugacgccgcacgaauugccgg

SEQ ID NO: 3008255 - RNA, 15 nt, Mycobacterium avium subsp. paratuberculosis
ugacgccgccgaacc

SEQ ID NO: 3008256 - RNA, 19 nt, Mycobacterium avium subsp. paratuberculosis
ugacgccgccgaaccccag

SEQ ID NO: 3008257 - RNA, 19 nt, Mycobacterium avium subsp. paratuberculosis
ugacgccgcgccgcccggc

SEQ ID NO: 3008258 - RNA, 12 nt, Mycobacterium avium subsp. paratuberculosis
ugacgccgcggu

SEQ ID NO: 3008259 - RNA, 17 nt, Mycobacterium avium subsp. paratuberculosis
ugacgccgcggugcagc

SEQ ID NO: 3008260 - RNA, 20 nt, Mycobacterium avium subsp. paratuberculosis
ugacgccgcgguuggucacc

SEQ ID NO: 3008261 - RNA, 14 nt, Mycobacterium avium subsp. paratuberculosis
ugacgccgcucggc

SEQ ID NO: 3008262 - RNA, 18 nt, Mycobacterium avium subsp. paratuberculosis
ugacgccgcucggccagc

SEQ ID NO: 3008263 - RNA, 14 nt, Mycobacterium avium subsp. paratuberculosis
ugacgccgggccgc

SEQ ID NO: 3008264 - RNA, 22 nt, Mycobacterium avium subsp. paratuberculosis
ugacgccgggccgccgcggcca

SEQ ID NO: 3008265 - RNA, 21 nt, Mycobacterium avium subsp. paratuberculosis
ugacgccggucgcugcgauga

SEQ ID NO: 3008266 - RNA, 17 nt, Mycobacterium avium subsp. paratuberculosis
ugacgccguccgacgug

SEQ ID NO: 3008267 - RNA, 18 nt, Mycobacterium avium subsp. paratuberculosis
ugacgccugcggcccagc

SEQ ID NO: 3008268 - RNA, 18 nt, Mycobacterium avium subsp. paratuberculosis
ugacgcgaaugucgacca

SEQ ID NO: 3008269 - RNA, 20 nt, Mycobacterium avium subsp. paratuberculosis
ugacgcgaaugucgaccacc

SEQ ID NO: 3008270 - RNA, 22 nt, Mycobacterium avium subsp. paratuberculosis
ugacgcgaaugucgaccaccgg

SEQ ID NO: 3008271 - RNA, 13 nt, Mycobacterium avium subsp. paratuberculosis
ugacgcgaccgcg

SEQ ID NO: 3008272 - RNA, 12 nt, Mycobacterium avium subsp. paratuberculosis
ugacgcgccggc

SEQ ID NO: 3008273 - RNA, 22 nt, Mycobacterium avium subsp. paratuberculosis
ugacgcgcuuguacaggucgac

SEQ ID NO: 3008274 - RNA, 14 nt, Mycobacterium avium subsp. paratuberculosis
ugacgcggcgucgg

SEQ ID NO: 3008275 - RNA, 17 nt, Mycobacterium avium subsp. paratuberculosis
ugacgcggcgucgggcg

SEQ ID NO: 3008276 - RNA, 21 nt, Mycobacterium avium subsp. paratuberculosis
ugacgcgggaccgggcccggc

SEQ ID NO: 3008277 - RNA, 15 nt, Mycobacterium avium subsp. paratuberculosis
ugacgcucacccggc

SEQ ID NO: 3008278 - RNA, 16 nt, Mycobacterium avium subsp. paratuberculosis
ugacgcucgacggccg

SEQ ID NO: 3008279 - RNA, 17 nt, Mycobacterium avium subsp. paratuberculosis
ugacgcucgacggccgg

SEQ ID NO: 3008280 - RNA, 18 nt, Mycobacterium avium subsp. paratuberculosis
ugacgcucgacggccggc

SEQ ID NO: 3008281 - RNA, 22 nt, Mycobacterium avium subsp. paratuberculosis
ugacgcucgacggccggcguca

SEQ ID NO: 3008282 - RNA, 20 nt, Mycobacterium avium subsp. paratuberculosis
ugacgcucgaggccccgcgu

SEQ ID NO: 3008283 - RNA, 24 nt, Mycobacterium avium subsp. paratuberculosis
ugacgcucgaggccccgcgugacg

SEQ ID NO: 3008284 - RNA, 17 nt, Mycobacterium avium subsp. paratuberculosis
ugacgcucgccggcggc

SEQ ID NO: 3008285 - RNA, 12 nt, Mycobacterium avium subsp. paratuberculosis
ugacgcucgcgg

SEQ ID NO: 3008286 - RNA, 18 nt, Mycobacterium avium subsp. paratuberculosis
ugacgcucgcguggccug

SEQ ID NO: 3008287 - RNA, 13 nt, Mycobacterium avium subsp. paratuberculosis
ugacgcucggccg

SEQ ID NO: 3008288 - RNA, 12 nt, Mycobacterium avium subsp. paratuberculosis
ugacgcucggcg

SEQ ID NO: 3008289 - RNA, 13 nt, Mycobacterium avium subsp. paratuberculosis
ugacgcucggcgc

SEQ ID NO: 3008290 - RNA, 19 nt, Mycobacterium avium subsp. paratuberculosis
ugacgcucggcgccgcggg

SEQ ID NO: 3008291 - RNA, 18 nt, Mycobacterium avium subsp. paratuberculosis
ugacgcucggcgccggcc

SEQ ID NO: 3008292 - RNA, 15 nt, Mycobacterium avium subsp. paratuberculosis
ugacgcucggcgcgu

SEQ ID NO: 3008293 - RNA, 16 nt, Mycobacterium avium subsp. paratuberculosis
ugacgcucggcggccg

SEQ ID NO: 3008294 - RNA, 20 nt, Mycobacterium avium subsp. paratuberculosis
ugacgcucggucgccacggc

SEQ ID NO: 3008295 - RNA, 19 nt, Mycobacterium avium subsp. paratuberculosis
ugacgcugaccugugcgcc

SEQ ID NO: 3008296 - RNA, 18 nt, Mycobacterium avium subsp. paratuberculosis
ugacgcugggcggcgaca

SEQ ID NO: 3008297 - RNA, 21 nt, Mycobacterium avium subsp. paratuberculosis
ugacggacuugggcgucucga

SEQ ID NO: 3008298 - RNA, 19 nt, Mycobacterium avium subsp. paratuberculosis
ugacggauccgggcgccgg

SEQ ID NO: 3008299 - RNA, 20 nt, Mycobacterium avium subsp. paratuberculosis
ugacggauccgggcgccggu

SEQ ID NO: 3008300 - RNA, 24 nt, Mycobacterium avium subsp. paratuberculosis
ugacggauguggucggccacgacg

SEQ ID NO: 3008301 - RNA, 21 nt, Mycobacterium avium subsp. paratuberculosis
ugacggccaugaauucgaacu

SEQ ID NO: 3008302 - RNA, 12 nt, Mycobacterium avium subsp. paratuberculosis
ugacggcccacg

SEQ ID NO: 3008303 - RNA, 19 nt, Mycobacterium avium subsp. paratuberculosis
ugacggcccacgucgcgcc

SEQ ID NO: 3008304 - RNA, 23 nt, Mycobacterium avium subsp. paratuberculosis
ugacggcccacgucgcgccgaug

SEQ ID NO: 3008305 - RNA, 14 nt, Mycobacterium avium subsp. paratuberculosis
ugacggccgggccc

SEQ ID NO: 3008306 - RNA, 22 nt, Mycobacterium avium subsp. paratuberculosis
ugacggccucccacucgucgau

SEQ ID NO: 3008307 - RNA, 16 nt, Mycobacterium avium subsp. paratuberculosis
ugacggcggcgcccug

SEQ ID NO: 3008308 - RNA, 16 nt, Mycobacterium avium subsp. paratuberculosis
ugacggcggcggugcc

SEQ ID NO: 3008309 - RNA, 23 nt, Mycobacterium avium subsp. paratuberculosis
ugacggcggggcggaugcgcugg

SEQ ID NO: 3008310 - RNA, 17 nt, Mycobacterium avium subsp. paratuberculosis
ugacggcgucggcgauc

SEQ ID NO: 3008311 - RNA, 15 nt, Mycobacterium avium subsp. paratuberculosis
ugacggcgucguuga

SEQ ID NO: 3008312 - RNA, 20 nt, Mycobacterium avium subsp. paratuberculosis
ugacggcucuucggcgccga

SEQ ID NO: 3008313 - RNA, 18 nt, Mycobacterium avium subsp. paratuberculosis
ugacggcuuccgcggacg

SEQ ID NO: 3008314 - RNA, 19 nt, Mycobacterium avium subsp. paratuberculosis
ugacgggaccgcacgccgg

SEQ ID NO: 3008315 - RNA, 11 nt, Mycobacterium avium subsp. paratuberculosis
ugacgggccgc

SEQ ID NO: 3008316 - RNA, 21 nt, Mycobacterium avium subsp. paratuberculosis
ugacggggcguugguugcggc

SEQ ID NO: 3008317 - RNA, 17 nt, Mycobacterium avium subsp. paratuberculosis
ugacggucacggugacg

SEQ ID NO: 3008318 - RNA, 20 nt, Mycobacterium avium subsp. paratuberculosis
ugacggucaugccgagccgc

SEQ ID NO: 3008319 - RNA, 22 nt, Mycobacterium avium subsp. paratuberculosis
ugacggucgaccucgagcguca

SEQ ID NO: 3008320 - RNA, 13 nt, Mycobacterium avium subsp. paratuberculosis
ugacggucgccga

SEQ ID NO: 3008321 - RNA, 16 nt, Mycobacterium avium subsp. paratuberculosis
ugacggucuugcggcc

SEQ ID NO: 3008322 - RNA, 12 nt, Mycobacterium avium subsp. paratuberculosis
ugacggugaccg

SEQ ID NO: 3008323 - RNA, 18 nt, Mycobacterium avium subsp. paratuberculosis
ugacggugaccggcgcgc

SEQ ID NO: 3008324 - RNA, 14 nt, Mycobacterium avium subsp. paratuberculosis
ugacggugccgccg

SEQ ID NO: 3008325 - RNA, 21 nt, Mycobacterium avium subsp. paratuberculosis
ugacgguggcguccucgacgg

SEQ ID NO: 3008326 - RNA, 19 nt, Mycobacterium avium subsp. paratuberculosis
ugacgguuuuggucugcgc

SEQ ID NO: 3008327 - RNA, 17 nt, Mycobacterium avium subsp. paratuberculosis
ugacguacgggcugaag

SEQ ID NO: 3008328 - RNA, 15 nt, Mycobacterium avium subsp. paratuberculosis
ugacguacuggcgcc

SEQ ID NO: 3008329 - RNA, 22 nt, Mycobacterium avium subsp. paratuberculosis
ugacguagaagucgauugccgc

SEQ ID NO: 3008330 - RNA, 16 nt, Mycobacterium avium subsp. paratuberculosis
ugacguccaccagggu

SEQ ID NO: 3008331 - RNA, 14 nt, Mycobacterium avium subsp. paratuberculosis
ugacguccgcggga

SEQ ID NO: 3008332 - RNA, 17 nt, Mycobacterium avium subsp. paratuberculosis
ugacgucgaugccggcc

SEQ ID NO: 3008333 - RNA, 18 nt, Mycobacterium avium subsp. paratuberculosis
ugacgucgcccacccggg

SEQ ID NO: 3008334 - RNA, 22 nt, Mycobacterium avium subsp. paratuberculosis
ugacgucgcccacccggggccg

SEQ ID NO: 3008335 - RNA, 20 nt, Mycobacterium avium subsp. paratuberculosis
ugacgucgcgcggggugacg

SEQ ID NO: 3008336 - RNA, 14 nt, Mycobacterium avium subsp. paratuberculosis
ugacgucgcgcugc

SEQ ID NO: 3008337 - RNA, 21 nt, Mycobacterium avium subsp. paratuberculosis
ugacgucgcgcugccggcccg

SEQ ID NO: 3008338 - RNA, 15 nt, Mycobacterium avium subsp. paratuberculosis
ugacgucggucagca

SEQ ID NO: 3008339 - RNA, 15 nt, Mycobacterium avium subsp. paratuberculosis
ugacgucgucgcggc

SEQ ID NO: 3008340 - RNA, 22 nt, Mycobacterium avium subsp. paratuberculosis
ugacgugcaccggcgaguccgc

SEQ ID NO: 3008341 - RNA, 13 nt, Mycobacterium avium subsp. paratuberculosis
ugacguggcggcc

SEQ ID NO: 3008342 - RNA, 17 nt, Mycobacterium avium subsp. paratuberculosis
ugacgugguugcguucg

SEQ ID NO: 3008343 - RNA, 19 nt, Mycobacterium avium subsp. paratuberculosis
ugacguuccagccgugcug

SEQ ID NO: 3008344 - RNA, 18 nt, Mycobacterium avium subsp. paratuberculosis
ugacguugagcacccgga

SEQ ID NO: 3008345 - RNA, 18 nt, Mycobacterium avium subsp. paratuberculosis
ugacguuggugaucgccg

SEQ ID NO: 3008346 - RNA, 23 nt, Mycobacterium avium subsp. paratuberculosis
ugacuaauccccccgcgccgccc

SEQ ID NO: 3008347 - RNA, 17 nt, Mycobacterium avium subsp. paratuberculosis
ugacuccuccucggcca

SEQ ID NO: 3008348 - RNA, 19 nt, Mycobacterium avium subsp. paratuberculosis
ugacugcgaucgccgacgc

SEQ ID NO: 3008349 - RNA, 21 nt, Mycobacterium avium subsp. paratuberculosis
ugacugcgaucgccgacgcca

SEQ ID NO: 3008350 - RNA, 17 nt, Mycobacterium avium subsp. paratuberculosis
ugacuucgauguagaag

SEQ ID NO: 3008351 - RNA, 19 nt, Mycobacterium avium subsp. paratuberculosis
ugacuucgauguagaagcc

SEQ ID NO: 3008352 - RNA, 17 nt, Mycobacterium avium subsp. paratuberculosis
ugacuugucgggccgca

SEQ ID NO: 3008353 - RNA, 19 nt, Mycobacterium avium subsp. paratuberculosis
ugagaaagucgaucuggcg

SEQ ID NO: 3008354 - RNA, 14 nt, Mycobacterium avium subsp. paratuberculosis
ugagacgacccaac

SEQ ID NO: 3008355 - RNA, 17 nt, Mycobacterium avium subsp. paratuberculosis
ugagacggccagcagca

SEQ ID NO: 3008356 - RNA, 16 nt, Mycobacterium avium subsp. paratuberculosis
ugagcaacgccagcgc

SEQ ID NO: 3008357 - RNA, 20 nt, Mycobacterium avium subsp. paratuberculosis
ugagcaacgccagcgcgacc

SEQ ID NO: 3008358 - RNA, 17 nt, Mycobacterium avium subsp. paratuberculosis
ugagcaagucggcggug

SEQ ID NO: 3008359 - RNA, 18 nt, Mycobacterium avium subsp. paratuberculosis
ugagcaagucggcgguga

SEQ ID NO: 3008360 - RNA, 20 nt, Mycobacterium avium subsp. paratuberculosis
ugagcaagucggcggugaug

SEQ ID NO: 3008361 - RNA, 17 nt, Mycobacterium avium subsp. paratuberculosis
ugagcaauucggugacg

SEQ ID NO: 3008362 - RNA, 21 nt, Mycobacterium avium subsp. paratuberculosis
ugagcacacacaggucgcccg

SEQ ID NO: 3008363 - RNA, 18 nt, Mycobacterium avium subsp. paratuberculosis
ugagcacacccagcgagc

SEQ ID NO: 3008364 - RNA, 14 nt, Mycobacterium avium subsp. paratuberculosis
ugagcaccacgagg

SEQ ID NO: 3008365 - RNA, 22 nt, Mycobacterium avium subsp. paratuberculosis
ugagcaccacgaggcugugggc

SEQ ID NO: 3008366 - RNA, 16 nt, Mycobacterium avium subsp. paratuberculosis
ugagcaccagcccggc

SEQ ID NO: 3008367 - RNA, 20 nt, Mycobacterium avium subsp. paratuberculosis
ugagcaccagcccggccagc

SEQ ID NO: 3008368 - RNA, 14 nt, Mycobacterium avium subsp. paratuberculosis
ugagcaccgccguc

SEQ ID NO: 3008369 - RNA, 17 nt, Mycobacterium avium subsp. paratuberculosis
ugagcaccgcgaccagc

SEQ ID NO: 3008370 - RNA, 20 nt, Mycobacterium avium subsp. paratuberculosis
ugagcaccgcgaccagcucg

SEQ ID NO: 3008371 - RNA, 13 nt, Mycobacterium avium subsp. paratuberculosis
ugagcaccgcguc

SEQ ID NO: 3008372 - RNA, 13 nt, Mycobacterium avium subsp. paratuberculosis
ugagcaccgggaa

SEQ ID NO: 3008373 - RNA, 21 nt, Mycobacterium avium subsp. paratuberculosis
ugagcacgaccgccagcagca

SEQ ID NO: 3008374 - RNA, 17 nt, Mycobacterium avium subsp. paratuberculosis
ugagcacgcccgcgauc

SEQ ID NO: 3008375 - RNA, 22 nt, Mycobacterium avium subsp. paratuberculosis
ugagcacggugaacuccgggcc

SEQ ID NO: 3008376 - RNA, 21 nt, Mycobacterium avium subsp. paratuberculosis
ugagcacggugaucagcagca

SEQ ID NO: 3008377 - RNA, 12 nt, Mycobacterium avium subsp. paratuberculosis
ugagcagcaccc

SEQ ID NO: 3008378 - RNA, 14 nt, Mycobacterium avium subsp. paratuberculosis
ugagcagcagaccg

SEQ ID NO: 3008379 - RNA, 14 nt, Mycobacterium avium subsp. paratuberculosis
ugagcagcaugccg

SEQ ID NO: 3008380 - RNA, 19 nt, Mycobacterium avium subsp. paratuberculosis
ugagcagcaugccgagcac

SEQ ID NO: 3008381 - RNA, 16 nt, Mycobacterium avium subsp. paratuberculosis
ugagcagcccgaccac

SEQ ID NO: 3008382 - RNA, 19 nt, Mycobacterium avium subsp. paratuberculosis
ugagcagcccgaccaccuc

SEQ ID NO: 3008383 - RNA, 21 nt, Mycobacterium avium subsp. paratuberculosis
ugagcagcucggucaccagcg

SEQ ID NO: 3008384 - RNA, 14 nt, Mycobacterium avium subsp. paratuberculosis
ugagcaggcuggag

SEQ ID NO: 3008385 - RNA, 17 nt, Mycobacterium avium subsp. paratuberculosis
ugagcagggccagcggc

SEQ ID NO: 3008386 - RNA, 18 nt, Mycobacterium avium subsp. paratuberculosis
ugagcagggccagcggca

SEQ ID NO: 3008387 - RNA, 21 nt, Mycobacterium avium subsp. paratuberculosis
ugagcaucgaggaucgccaac

SEQ ID NO: 3008388 - RNA, 17 nt, Mycobacterium avium subsp. paratuberculosis
ugagcaucgggcgcagg

SEQ ID NO: 3008389 - RNA, 14 nt, Mycobacterium avium subsp. paratuberculosis
ugagcauguugaac

SEQ ID NO: 3008390 - RNA, 20 nt, Mycobacterium avium subsp. paratuberculosis
ugagcauguugaacgccgcg

SEQ ID NO: 3008391 - RNA, 16 nt, Mycobacterium avium subsp. paratuberculosis
ugagcauuggcgaugg

SEQ ID NO: 3008392 - RNA, 18 nt, Mycobacterium avium subsp. paratuberculosis
ugagccaguucgccagca

SEQ ID NO: 3008393 - RNA, 19 nt, Mycobacterium avium subsp. paratuberculosis
ugagcccgaugcuggccau

SEQ ID NO: 3008394 - RNA, 16 nt, Mycobacterium avium subsp. paratuberculosis
ugagcccggaccggcc

SEQ ID NO: 3008395 - RNA, 15 nt, Mycobacterium avium subsp. paratuberculosis
ugagcccggcgacga

SEQ ID NO: 3008396 - RNA, 17 nt, Mycobacterium avium subsp. paratuberculosis
ugagcccggcgacgaag

SEQ ID NO: 3008397 - RNA, 22 nt, Mycobacterium avium subsp. paratuberculosis
ugagcccgggcaggcggcgcgc

SEQ ID NO: 3008398 - RNA, 16 nt, Mycobacterium avium subsp. paratuberculosis
ugagcccgucgacguc

SEQ ID NO: 3008399 - RNA, 14 nt, Mycobacterium avium subsp. paratuberculosis
ugagccgccgagcc

SEQ ID NO: 3008400 - RNA, 14 nt, Mycobacterium avium subsp. paratuberculosis
ugagccgccggggc

SEQ ID NO: 3008401 - RNA, 17 nt, Mycobacterium avium subsp. paratuberculosis
ugagccgcucgccgggg

SEQ ID NO: 3008402 - RNA, 23 nt, Mycobacterium avium subsp. paratuberculosis
ugagccgcuggauguccaggccg

SEQ ID NO: 3008403 - RNA, 23 nt, Mycobacterium avium subsp. paratuberculosis
ugagccggauguccuacggcggg

SEQ ID NO: 3008404 - RNA, 17 nt, Mycobacterium avium subsp. paratuberculosis
ugagccggcgcaccgcg

SEQ ID NO: 3008405 - RNA, 16 nt, Mycobacterium avium subsp. paratuberculosis
ugagccgggugcccgc

SEQ ID NO: 3008406 - RNA, 17 nt, Mycobacterium avium subsp. paratuberculosis
ugagccgggugcccgcg

SEQ ID NO: 3008407 - RNA, 15 nt, Mycobacterium avium subsp. paratuberculosis
ugagccucagcgcgc

SEQ ID NO: 3008408 - RNA, 20 nt, Mycobacterium avium subsp. paratuberculosis
ugagccucagggcgcgcugu

SEQ ID NO: 3008409 - RNA, 15 nt, Mycobacterium avium subsp. paratuberculosis
ugagcgacaccaggu

SEQ ID NO: 3008410 - RNA, 19 nt, Mycobacterium avium subsp. paratuberculosis
ugagcgccaccccgaaccc

SEQ ID NO: 3008411 - RNA, 19 nt, Mycobacterium avium subsp. paratuberculosis
ugagcgccagcgcggugcc

SEQ ID NO: 3008412 - RNA, 14 nt, Mycobacterium avium subsp. paratuberculosis
ugagcgccggggcg

SEQ ID NO: 3008413 - RNA, 13 nt, Mycobacterium avium subsp. paratuberculosis
ugagcgcgccggc

SEQ ID NO: 3008414 - RNA, 16 nt, Mycobacterium avium subsp. paratuberculosis
ugagcgcgccggcccg

SEQ ID NO: 3008415 - RNA, 18 nt, Mycobacterium avium subsp. paratuberculosis
ugagcgcgccggcccgau

SEQ ID NO: 3008416 - RNA, 16 nt, Mycobacterium avium subsp. paratuberculosis
ugagcgcggcgagcgg

SEQ ID NO: 3008417 - RNA, 13 nt, Mycobacterium avium subsp. paratuberculosis
ugagcggcgcguc

SEQ ID NO: 3008418 - RNA, 15 nt, Mycobacterium avium subsp. paratuberculosis
ugagcggcgcgucca

SEQ ID NO: 3008419 - RNA, 22 nt, Mycobacterium avium subsp. paratuberculosis
ugagcggcgcguccauggucga

SEQ ID NO: 3008420 - RNA, 14 nt, Mycobacterium avium subsp. paratuberculosis
ugagcgggaagcug

SEQ ID NO: 3008421 - RNA, 15 nt, Mycobacterium avium subsp. paratuberculosis
ugagcgguggccacg

SEQ ID NO: 3008422 - RNA, 16 nt, Mycobacterium avium subsp. paratuberculosis
ugagcgguggccacgc

SEQ ID NO: 3008423 - RNA, 19 nt, Mycobacterium avium subsp. paratuberculosis
ugagcgguggccacgcccc

SEQ ID NO: 3008424 - RNA, 15 nt, Mycobacterium avium subsp. paratuberculosis
ugagcgucgccacca

SEQ ID NO: 3008425 - RNA, 19 nt, Mycobacterium avium subsp. paratuberculosis
ugagcguggcagcggucgg

SEQ ID NO: 3008426 - RNA, 13 nt, Mycobacterium avium subsp. paratuberculosis
ugagcucgcggcg

SEQ ID NO: 3008427 - RNA, 13 nt, Mycobacterium avium subsp. paratuberculosis
ugagcugggcggc

SEQ ID NO: 3008428 - RNA, 15 nt, Mycobacterium avium subsp. paratuberculosis
ugagcugggcggcgc

SEQ ID NO: 3008429 - RNA, 20 nt, Mycobacterium avium subsp. paratuberculosis
ugagcugggcggcgcgcugc

SEQ ID NO: 3008430 - RNA, 14 nt, Mycobacterium avium subsp. paratuberculosis
ugagcugugccgcg

SEQ ID NO: 3008431 - RNA, 23 nt, Mycobacterium avium subsp. paratuberculosis
ugagcugugccgcggugcggccc

SEQ ID NO: 3008432 - RNA, 19 nt, Mycobacterium avium subsp. paratuberculosis
ugagcuucccggcggucgc

SEQ ID NO: 3008433 - RNA, 20 nt, Mycobacterium avium subsp. paratuberculosis
ugagcuucugcccggccagc

SEQ ID NO: 3008434 - RNA, 15 nt, Mycobacterium avium subsp. paratuberculosis
ugaggaacgcgaccg

SEQ ID NO: 3008435 - RNA, 16 nt, Mycobacterium avium subsp. paratuberculosis
ugaggacaccacgauc

SEQ ID NO: 3008436 - RNA, 14 nt, Mycobacterium avium subsp. paratuberculosis
ugaggacgaggcga

SEQ ID NO: 3008437 - RNA, 14 nt, Mycobacterium avium subsp. paratuberculosis
ugaggacgcccggc

SEQ ID NO: 3008438 - RNA, 15 nt, Mycobacterium avium subsp. paratuberculosis
ugaggacgcccggcg

SEQ ID NO: 3008439 - RNA, 17 nt, Mycobacterium avium subsp. paratuberculosis
ugaggacgcccggcgag

SEQ ID NO: 3008440 - RNA, 19 nt, Mycobacterium avium subsp. paratuberculosis
ugaggacgcccggcgagug

SEQ ID NO: 3008441 - RNA, 15 nt, Mycobacterium avium subsp. paratuberculosis
ugaggaugacgacgg

SEQ ID NO: 3008442 - RNA, 16 nt, Mycobacterium avium subsp. paratuberculosis
ugaggaugucgacgau

SEQ ID NO: 3008443 - RNA, 22 nt, Mycobacterium avium subsp. paratuberculosis
ugaggcacccgcugcaccagcc

SEQ ID NO: 3008444 - RNA, 23 nt, Mycobacterium avium subsp. paratuberculosis
ugaggcaccgaacgccagcagcu

SEQ ID NO: 3008445 - RNA, 13 nt, Mycobacterium avium subsp. paratuberculosis
ugaggccagcacc

SEQ ID NO: 3008446 - RNA, 11 nt, Mycobacterium avium subsp. paratuberculosis
ugaggccaggc

SEQ ID NO: 3008447 - RNA, 22 nt, Mycobacterium avium subsp. paratuberculosis
ugaggcccggcgugggccgcag

SEQ ID NO: 3008448 - RNA, 15 nt, Mycobacterium avium subsp. paratuberculosis
ugaggccgccccggc

SEQ ID NO: 3008449 - RNA, 23 nt, Mycobacterium avium subsp. paratuberculosis
ugaggccgccccggccgcgcacc

SEQ ID NO: 3008450 - RNA, 23 nt, Mycobacterium avium subsp. paratuberculosis
ugaggcgacccccggugucugac

SEQ ID NO: 3008451 - RNA, 14 nt, Mycobacterium avium subsp. paratuberculosis
ugaggcgcgccggu

SEQ ID NO: 3008452 - RNA, 15 nt, Mycobacterium avium subsp. paratuberculosis
ugaggcgcgccggua

SEQ ID NO: 3008453 - RNA, 23 nt, Mycobacterium avium subsp. paratuberculosis
ugaggcgcgccgguaaugggcga

SEQ ID NO: 3008454 - RNA, 16 nt, Mycobacterium avium subsp. paratuberculosis
ugaggcggcggcgggc

SEQ ID NO: 3008455 - RNA, 20 nt, Mycobacterium avium subsp. paratuberculosis
ugaggcggcggcgggccagg

SEQ ID NO: 3008456 - RNA, 22 nt, Mycobacterium avium subsp. paratuberculosis
ugaggcguuggcccgcacccgc

SEQ ID NO: 3008457 - RNA, 16 nt, Mycobacterium avium subsp. paratuberculosis
ugagggaacgccgauc

SEQ ID NO: 3008458 - RNA, 21 nt, Mycobacterium avium subsp. paratuberculosis
ugagggccagcagucgugacg

SEQ ID NO: 3008459 - RNA, 17 nt, Mycobacterium avium subsp. paratuberculosis
ugagggcggggcagcag

SEQ ID NO: 3008460 - RNA, 12 nt, Mycobacterium avium subsp. paratuberculosis
ugaggggcgcgc

SEQ ID NO: 3008461 - RNA, 16 nt, Mycobacterium avium subsp. paratuberculosis
ugaggguccgcgcgua

SEQ ID NO: 3008462 - RNA, 23 nt, Mycobacterium avium subsp. paratuberculosis
ugaggguuuccacgugcacggcg

SEQ ID NO: 3008463 - RNA, 22 nt, Mycobacterium avium subsp. paratuberculosis
ugagguagucgcgcagcugcgc

SEQ ID NO: 3008464 - RNA, 16 nt, Mycobacterium avium subsp. paratuberculosis
ugagguauucgucgag

SEQ ID NO: 3008465 - RNA, 14 nt, Mycobacterium avium subsp. paratuberculosis
ugaggucgcgaccg

SEQ ID NO: 3008466 - RNA, 22 nt, Mycobacterium avium subsp. paratuberculosis
ugaggucgcgcaggaugcccag

SEQ ID NO: 3008467 - RNA, 21 nt, Mycobacterium avium subsp. paratuberculosis
ugagguugacgugcaccggcg

SEQ ID NO: 3008468 - RNA, 16 nt, Mycobacterium avium subsp. paratuberculosis
ugagguuuccgcugau

SEQ ID NO: 3008469 - RNA, 17 nt, Mycobacterium avium subsp. paratuberculosis
ugagucuacuuggccag

SEQ ID NO: 3008470 - RNA, 19 nt, Mycobacterium avium subsp. paratuberculosis
ugagucugggucacgcuga

SEQ ID NO: 3008471 - RNA, 18 nt, Mycobacterium avium subsp. paratuberculosis
ugagugcgccgugcagca

SEQ ID NO: 3008472 - RNA, 21 nt, Mycobacterium avium subsp. paratuberculosis
ugaguucggugaacugcagcc

SEQ ID NO: 3008473 - RNA, 22 nt, Mycobacterium avium subsp. paratuberculosis
ugaguucggugaacugcagccc

SEQ ID NO: 3008474 - RNA, 18 nt, Mycobacterium avium subsp. paratuberculosis
ugauacaggagggccagg

SEQ ID NO: 3008475 - RNA, 19 nt, Mycobacterium avium subsp. paratuberculosis
ugauacaggagggccaggg

SEQ ID NO: 3008476 - RNA, 15 nt, Mycobacterium avium subsp. paratuberculosis
ugauaccggcccagc

SEQ ID NO: 3008477 - RNA, 17 nt, Mycobacterium avium subsp. paratuberculosis
ugauacgacguccgggc

SEQ ID NO: 3008478 - RNA, 22 nt, Mycobacterium avium subsp. paratuberculosis
ugauagaucaucccggccaccc

SEQ ID NO: 3008479 - RNA, 22 nt, Mycobacterium avium subsp. paratuberculosis
ugauagcccaggccuuguacgc

SEQ ID NO: 3008480 - RNA, 17 nt, Mycobacterium avium subsp. paratuberculosis
ugauagcccgccgcggc

SEQ ID NO: 3008481 - RNA, 15 nt, Mycobacterium avium subsp. paratuberculosis
ugauagccgcccugc

SEQ ID NO: 3008482 - RNA, 14 nt, Mycobacterium avium subsp. paratuberculosis
ugauaggucacgcc

SEQ ID NO: 3008483 - RNA, 21 nt, Mycobacterium avium subsp. paratuberculosis
ugaucaacggcuugaugaugc

SEQ ID NO: 3008484 - RNA, 20 nt, Mycobacterium avium subsp. paratuberculosis
ugaucaccaaauagccgucg

SEQ ID NO: 3008485 - RNA, 22 nt, Mycobacterium avium subsp. paratuberculosis
ugaucaccaaauagccgucggc

SEQ ID NO: 3008486 - RNA, 13 nt, Mycobacterium avium subsp. paratuberculosis
ugaucacccagcc

SEQ ID NO: 3008487 - RNA, 22 nt, Mycobacterium avium subsp. paratuberculosis
ugaucacccgccggguggccgc

SEQ ID NO: 3008488 - RNA, 12 nt, Mycobacterium avium subsp. paratuberculosis
ugaucaccgcca

SEQ ID NO: 3008489 - RNA, 17 nt, Mycobacterium avium subsp. paratuberculosis
ugaucaccgugaucgcc

SEQ ID NO: 3008490 - RNA, 15 nt, Mycobacterium avium subsp. paratuberculosis
ugaucacguugucgc

SEQ ID NO: 3008491 - RNA, 22 nt, Mycobacterium avium subsp. paratuberculosis
ugaucagcagguugauccgcgc

SEQ ID NO: 3008492 - RNA, 18 nt, Mycobacterium avium subsp. paratuberculosis
ugaucagcauccgcaacg

SEQ ID NO: 3008493 - RNA, 20 nt, Mycobacterium avium subsp. paratuberculosis
ugaucagcauccgcaacgug

SEQ ID NO: 3008494 - RNA, 19 nt, Mycobacterium avium subsp. paratuberculosis
ugaucagcccgacccggcu

SEQ ID NO: 3008495 - RNA, 13 nt, Mycobacterium avium subsp. paratuberculosis
ugaucagccggcg

SEQ ID NO: 3008496 - RNA, 15 nt, Mycobacterium avium subsp. paratuberculosis
ugaucagccggcgag

SEQ ID NO: 3008497 - RNA, 12 nt, Mycobacterium avium subsp. paratuberculosis
ugaucagcgcca

SEQ ID NO: 3008498 - RNA, 14 nt, Mycobacterium avium subsp. paratuberculosis
ugaucaggcccucg

SEQ ID NO: 3008499 - RNA, 23 nt, Mycobacterium avium subsp. paratuberculosis
ugaucagguccuugcgcgccgcg

SEQ ID NO: 3008500 - RNA, 15 nt, Mycobacterium avium subsp. paratuberculosis
ugaucaggucgccga

SEQ ID NO: 3008501 - RNA, 20 nt, Mycobacterium avium subsp. paratuberculosis
ugaucagguucaccagcacg

SEQ ID NO: 3008502 - RNA, 14 nt, Mycobacterium avium subsp. paratuberculosis
ugaucaugucgucc

SEQ ID NO: 3008503 - RNA, 19 nt, Mycobacterium avium subsp. paratuberculosis
ugauccacuccagcaccgg

SEQ ID NO: 3008504 - RNA, 13 nt, Mycobacterium avium subsp. paratuberculosis
ugauccagcagcg

SEQ ID NO: 3008505 - RNA, 22 nt, Mycobacterium avium subsp. paratuberculosis
ugaucccaggaacgcgcccggc

SEQ ID NO: 3008506 - RNA, 17 nt, Mycobacterium avium subsp. paratuberculosis
ugaucccggugaugccg

SEQ ID NO: 3008507 - RNA, 21 nt, Mycobacterium avium subsp. paratuberculosis
ugauccgggcgccauccgcca

SEQ ID NO: 3008508 - RNA, 16 nt, Mycobacterium avium subsp. paratuberculosis
ugaucgaaacgccgcg

SEQ ID NO: 3008509 - RNA, 17 nt, Mycobacterium avium subsp. paratuberculosis
ugaucgagcaccgggcg

SEQ ID NO: 3008510 - RNA, 15 nt, Mycobacterium avium subsp. paratuberculosis
ugaucgagccgcggc

SEQ ID NO: 3008511 - RNA, 17 nt, Mycobacterium avium subsp. paratuberculosis
ugaucgaguuccgcguc

SEQ ID NO: 3008512 - RNA, 18 nt, Mycobacterium avium subsp. paratuberculosis
ugaucgccaccaccagcg

SEQ ID NO: 3008513 - RNA, 17 nt, Mycobacterium avium subsp. paratuberculosis
ugaucgccacggcggug

SEQ ID NO: 3008514 - RNA, 20 nt, Mycobacterium avium subsp. paratuberculosis
ugaucgccacggcggugucg

SEQ ID NO: 3008515 - RNA, 16 nt, Mycobacterium avium subsp. paratuberculosis
ugaucgccagcccggc

SEQ ID NO: 3008516 - RNA, 20 nt, Mycobacterium avium subsp. paratuberculosis
ugaucgccaugcuggcacuc

SEQ ID NO: 3008517 - RNA, 20 nt, Mycobacterium avium subsp. paratuberculosis
ugaucgcccgcuccgcggug

SEQ ID NO: 3008518 - RNA, 14 nt, Mycobacterium avium subsp. paratuberculosis
ugaucgccgacguc

SEQ ID NO: 3008519 - RNA, 15 nt, Mycobacterium avium subsp. paratuberculosis
ugaucgccgacgucu

SEQ ID NO: 3008520 - RNA, 17 nt, Mycobacterium avium subsp. paratuberculosis
ugaucgccgcccacugg

SEQ ID NO: 3008521 - RNA, 11 nt, Mycobacterium avium subsp. paratuberculosis
ugaucgccgcu

SEQ ID NO: 3008522 - RNA, 19 nt, Mycobacterium avium subsp. paratuberculosis
ugaucgccggaucgccgag

SEQ ID NO: 3008523 - RNA, 15 nt, Mycobacterium avium subsp. paratuberculosis
ugaucgccggcgccg

SEQ ID NO: 3008524 - RNA, 17 nt, Mycobacterium avium subsp. paratuberculosis
ugaucgccggggcgcug

SEQ ID NO: 3008525 - RNA, 14 nt, Mycobacterium avium subsp. paratuberculosis
ugaucgccgggucg

SEQ ID NO: 3008526 - RNA, 16 nt, Mycobacterium avium subsp. paratuberculosis
ugaucgccucgaccag

SEQ ID NO: 3008527 - RNA, 17 nt, Mycobacterium avium subsp. paratuberculosis
ugaucgcgaacgcgccg

SEQ ID NO: 3008528 - RNA, 17 nt, Mycobacterium avium subsp. paratuberculosis
ugaucgcgauccgggcg

SEQ ID NO: 3008529 - RNA, 14 nt, Mycobacterium avium subsp. paratuberculosis
ugaucgcggcccgc

SEQ ID NO: 3008530 - RNA, 15 nt, Mycobacterium avium subsp. paratuberculosis
ugaucgcggcccgcg

SEQ ID NO: 3008531 - RNA, 14 nt, Mycobacterium avium subsp. paratuberculosis
ugaucgcggccggc

SEQ ID NO: 3008532 - RNA, 17 nt, Mycobacterium avium subsp. paratuberculosis
ugaucgcggccggcgag

SEQ ID NO: 3008533 - RNA, 17 nt, Mycobacterium avium subsp. paratuberculosis
ugaucgcggcgcugccg

SEQ ID NO: 3008534 - RNA, 19 nt, Mycobacterium avium subsp. paratuberculosis
ugaucgcguagcgccggua

SEQ ID NO: 3008535 - RNA, 15 nt, Mycobacterium avium subsp. paratuberculosis
ugaucgcgucgacgg

SEQ ID NO: 3008536 - RNA, 13 nt, Mycobacterium avium subsp. paratuberculosis
ugaucggccaggc

SEQ ID NO: 3008537 - RNA, 15 nt, Mycobacterium avium subsp. paratuberculosis
ugaucggccaggcgc

SEQ ID NO: 3008538 - RNA, 20 nt, Mycobacterium avium subsp. paratuberculosis
ugaucggccgcaagcgaagc

SEQ ID NO: 3008539 - RNA, 22 nt, Mycobacterium avium subsp. paratuberculosis
ugaucggucugccuggcgaacu

SEQ ID NO: 3008540 - RNA, 14 nt, Mycobacterium avium subsp. paratuberculosis
ugaucggugcccgc

SEQ ID NO: 3008541 - RNA, 14 nt, Mycobacterium avium subsp. paratuberculosis
ugaucgguucgucg

SEQ ID NO: 3008542 - RNA, 17 nt, Mycobacterium avium subsp. paratuberculosis
ugaucgucucggccgcg

SEQ ID NO: 3008543 - RNA, 15 nt, Mycobacterium avium subsp. paratuberculosis
ugaucucccgugcgg

SEQ ID NO: 3008544 - RNA, 15 nt, Mycobacterium avium subsp. paratuberculosis
ugaucucgaccuucu

SEQ ID NO: 3008545 - RNA, 13 nt, Mycobacterium avium subsp. paratuberculosis
ugaucucgccgag

SEQ ID NO: 3008546 - RNA, 22 nt, Mycobacterium avium subsp. paratuberculosis
ugaucucgccgcgguggugggc

SEQ ID NO: 3008547 - RNA, 17 nt, Mycobacterium avium subsp. paratuberculosis
ugaucucgucgaugacg

SEQ ID NO: 3008548 - RNA, 14 nt, Mycobacterium avium subsp. paratuberculosis
ugaucucgucgcgg

SEQ ID NO: 3008549 - RNA, 14 nt, Mycobacterium avium subsp. paratuberculosis
ugaucugcaccagc

SEQ ID NO: 3008550 - RNA, 12 nt, Mycobacterium avium subsp. paratuberculosis
ugaucuugaccg

SEQ ID NO: 3008551 - RNA, 14 nt, Mycobacterium avium subsp. paratuberculosis
ugaucuugaucgcc

SEQ ID NO: 3008552 - RNA, 16 nt, Mycobacterium avium subsp. paratuberculosis
ugaucuugaucgccuu

SEQ ID NO: 3008553 - RNA, 22 nt, Mycobacterium avium subsp. paratuberculosis
ugaucuuggcacgggcccgcgg

SEQ ID NO: 3008554 - RNA, 12 nt, Mycobacterium avium subsp. paratuberculosis
ugaucuuggccu

SEQ ID NO: 3008555 - RNA, 20 nt, Mycobacterium avium subsp. paratuberculosis
ugaugaaaaccgggcccucg

SEQ ID NO: 3008556 - RNA, 18 nt, Mycobacterium avium subsp. paratuberculosis
ugaugaaaccggccagca

SEQ ID NO: 3008557 - RNA, 21 nt, Mycobacterium avium subsp. paratuberculosis
ugaugaaaccggccagcagca

SEQ ID NO: 3008558 - RNA, 22 nt, Mycobacterium avium subsp. paratuberculosis
ugaugaaaccggccagcagcag

SEQ ID NO: 3008559 - RNA, 19 nt, Mycobacterium avium subsp. paratuberculosis
ugaugaacacggucgccgg

SEQ ID NO: 3008560 - RNA, 21 nt, Mycobacterium avium subsp. paratuberculosis
ugaugaacgcgccgucgucgg

SEQ ID NO: 3008561 - RNA, 18 nt, Mycobacterium avium subsp. paratuberculosis
ugaugaagaccuggccgg

SEQ ID NO: 3008562 - RNA, 16 nt, Mycobacterium avium subsp. paratuberculosis
ugaugaagccgccgac

SEQ ID NO: 3008563 - RNA, 17 nt, Mycobacterium avium subsp. paratuberculosis
ugaugaagccgccgacg

SEQ ID NO: 3008564 - RNA, 20 nt, Mycobacterium avium subsp. paratuberculosis
ugaugaagccgccgacggug

SEQ ID NO: 3008565 - RNA, 14 nt, Mycobacterium avium subsp. paratuberculosis
ugaugacgacguga

SEQ ID NO: 3008566 - RNA, 21 nt, Mycobacterium avium subsp. paratuberculosis
ugaugacguuggugaucgccg

SEQ ID NO: 3008567 - RNA, 24 nt, Mycobacterium avium subsp. paratuberculosis
ugaugacguuggugaucgccgacg

SEQ ID NO: 3008568 - RNA, 14 nt, Mycobacterium avium subsp. paratuberculosis
ugaugaggucgcga

SEQ ID NO: 3008569 - RNA, 15 nt, Mycobacterium avium subsp. paratuberculosis
ugaugaucgccgauc

SEQ ID NO: 3008570 - RNA, 12 nt, Mycobacterium avium subsp. paratuberculosis
ugaugaugccgc

SEQ ID NO: 3008571 - RNA, 21 nt, Mycobacterium avium subsp. paratuberculosis
ugaugaugccgcccaucagca

SEQ ID NO: 3008572 - RNA, 22 nt, Mycobacterium avium subsp. paratuberculosis
ugaugaugccgcccaucagcag

SEQ ID NO: 3008573 - RNA, 12 nt, Mycobacterium avium subsp. paratuberculosis
ugaugaugcugu

SEQ ID NO: 3008574 - RNA, 15 nt, Mycobacterium avium subsp. paratuberculosis
ugaugaugucggcgg

SEQ ID NO: 3008575 - RNA, 21 nt, Mycobacterium avium subsp. paratuberculosis
ugaugcacccggacgugaucg

SEQ ID NO: 3008576 - RNA, 23 nt, Mycobacterium avium subsp. paratuberculosis
ugaugcacccggacgugaucgcg

SEQ ID NO: 3008577 - RNA, 21 nt, Mycobacterium avium subsp. paratuberculosis
ugaugcagugguugagcagca

SEQ ID NO: 3008578 - RNA, 18 nt, Mycobacterium avium subsp. paratuberculosis
ugaugcccaggcccacca

SEQ ID NO: 3008579 - RNA, 21 nt, Mycobacterium avium subsp. paratuberculosis
ugaugccccgggugaccgccu

SEQ ID NO: 3008580 - RNA, 15 nt, Mycobacterium avium subsp. paratuberculosis
ugaugcccucgccgg

SEQ ID NO: 3008581 - RNA, 16 nt, Mycobacterium avium subsp. paratuberculosis
ugaugcccuugcggaa

SEQ ID NO: 3008582 - RNA, 14 nt, Mycobacterium avium subsp. paratuberculosis
ugaugccgacgucg

SEQ ID NO: 3008583 - RNA, 15 nt, Mycobacterium avium subsp. paratuberculosis
ugaugccggcggaca

SEQ ID NO: 3008584 - RNA, 21 nt, Mycobacterium avium subsp. paratuberculosis
ugaugccgggcaaccacagcg

SEQ ID NO: 3008585 - RNA, 24 nt, Mycobacterium avium subsp. paratuberculosis
ugaugccgggcaaccacagcggcg

SEQ ID NO: 3008586 - RNA, 23 nt, Mycobacterium avium subsp. paratuberculosis
ugaugccgucacugucggcgcgg

SEQ ID NO: 3008587 - RNA, 14 nt, Mycobacterium avium subsp. paratuberculosis
ugaugccguccagc

SEQ ID NO: 3008588 - RNA, 22 nt, Mycobacterium avium subsp. paratuberculosis
ugaugccgucgaucaccugcgg

SEQ ID NO: 3008589 - RNA, 21 nt, Mycobacterium avium subsp. paratuberculosis
ugaugccguggucggcgaacg

SEQ ID NO: 3008590 - RNA, 16 nt, Mycobacterium avium subsp. paratuberculosis
ugaugcgcaccgcggc

SEQ ID NO: 3008591 - RNA, 11 nt, Mycobacterium avium subsp. paratuberculosis
ugaugcgccgg

SEQ ID NO: 3008592 - RNA, 18 nt, Mycobacterium avium subsp. paratuberculosis
ugaugcgcgccgacgacc

SEQ ID NO: 3008593 - RNA, 15 nt, Mycobacterium avium subsp. paratuberculosis
ugaugcgcggcgacg

SEQ ID NO: 3008594 - RNA, 17 nt, Mycobacterium avium subsp. paratuberculosis
ugaugcggguguugacc

SEQ ID NO: 3008595 - RNA, 18 nt, Mycobacterium avium subsp. paratuberculosis
ugaugcggucggcgcggg

SEQ ID NO: 3008596 - RNA, 14 nt, Mycobacterium avium subsp. paratuberculosis
ugaugcugcccggc

SEQ ID NO: 3008597 - RNA, 20 nt, Mycobacterium avium subsp. paratuberculosis
ugauggccaucuggccgcgg

SEQ ID NO: 3008598 - RNA, 12 nt, Mycobacterium avium subsp. paratuberculosis
ugauggccgccg

SEQ ID NO: 3008599 - RNA, 14 nt, Mycobacterium avium subsp. paratuberculosis
ugauggccgcgccg

SEQ ID NO: 3008600 - RNA, 18 nt, Mycobacterium avium subsp. paratuberculosis
ugauggccgcgccgccgc

SEQ ID NO: 3008601 - RNA, 24 nt, Mycobacterium avium subsp. paratuberculosis
ugauggccgcgccgccgcccuggc

SEQ ID NO: 3008602 - RNA, 18 nt, Mycobacterium avium subsp. paratuberculosis
ugauggcgaaccagcgcc

SEQ ID NO: 3008603 - RNA, 19 nt, Mycobacterium avium subsp. paratuberculosis
ugauggcgaaccagcgccc

SEQ ID NO: 3008604 - RNA, 21 nt, Mycobacterium avium subsp. paratuberculosis
ugauggcgaaccagcgcccgc

SEQ ID NO: 3008605 - RNA, 20 nt, Mycobacterium avium subsp. paratuberculosis
ugauggcggcggcccgccgc

SEQ ID NO: 3008606 - RNA, 15 nt, Mycobacterium avium subsp. paratuberculosis
ugauggcgucgacgu

SEQ ID NO: 3008607 - RNA, 17 nt, Mycobacterium avium subsp. paratuberculosis
ugaugggcagcgccccg

SEQ ID NO: 3008608 - RNA, 16 nt, Mycobacterium avium subsp. paratuberculosis
ugaugggugggcagcu

SEQ ID NO: 3008609 - RNA, 19 nt, Mycobacterium avium subsp. paratuberculosis
ugaugggugggcagcucgg

SEQ ID NO: 3008610 - RNA, 12 nt, Mycobacterium avium subsp. paratuberculosis
ugauggucagcc

SEQ ID NO: 3008611 - RNA, 15 nt, Mycobacterium avium subsp. paratuberculosis
ugauggucagccgca

SEQ ID NO: 3008612 - RNA, 14 nt, Mycobacterium avium subsp. paratuberculosis
ugaugguccagcac

SEQ ID NO: 3008613 - RNA, 15 nt, Mycobacterium avium subsp. paratuberculosis
ugaugguccagcacc

SEQ ID NO: 3008614 - RNA, 21 nt, Mycobacterium avium subsp. paratuberculosis
ugauggugaucucgccgcggu

SEQ ID NO: 3008615 - RNA, 13 nt, Mycobacterium avium subsp. paratuberculosis
ugaugguggcgcg

SEQ ID NO: 3008616 - RNA, 17 nt, Mycobacterium avium subsp. paratuberculosis
ugauguagcggcggucg

SEQ ID NO: 3008617 - RNA, 14 nt, Mycobacterium avium subsp. paratuberculosis
ugaugucggccggc

SEQ ID NO: 3008618 - RNA, 16 nt, Mycobacterium avium subsp. paratuberculosis
ugaugucggcgggccg

SEQ ID NO: 3008619 - RNA, 16 nt, Mycobacterium avium subsp. paratuberculosis
ugaugucgguggugug

SEQ ID NO: 3008620 - RNA, 14 nt, Mycobacterium avium subsp. paratuberculosis
ugaugucguuggug

SEQ ID NO: 3008621 - RNA, 17 nt, Mycobacterium avium subsp. paratuberculosis
ugaugugcggcgcggcg

SEQ ID NO: 3008622 - RNA, 15 nt, Mycobacterium avium subsp. paratuberculosis
ugauguuggccgcga

SEQ ID NO: 3008623 - RNA, 20 nt, Mycobacterium avium subsp. paratuberculosis
ugauuccgccgggcggcagc

SEQ ID NO: 3008624 - RNA, 21 nt, Mycobacterium avium subsp. paratuberculosis
ugauuccgcgucuugcgccga

SEQ ID NO: 3008625 - RNA, 16 nt, Mycobacterium avium subsp. paratuberculosis
ugauugcgugcccggc

SEQ ID NO: 3008626 - RNA, 22 nt, Mycobacterium avium subsp. paratuberculosis
ugauuguaggugugcagccagg

SEQ ID NO: 3008627 - RNA, 23 nt, Mycobacterium avium subsp. paratuberculosis
ugauuucaucgcggcgacccgcu

SEQ ID NO: 3008628 - RNA, 17 nt, Mycobacterium avium subsp. paratuberculosis
ugauuucgcgcaccacc

SEQ ID NO: 3008629 - RNA, 15 nt, Mycobacterium avium subsp. paratuberculosis
ugcaaaagcauccgg

SEQ ID NO: 3008630 - RNA, 19 nt, Mycobacterium avium subsp. paratuberculosis
ugcaaaagcauccggccgu

SEQ ID NO: 3008631 - RNA, 18 nt, Mycobacterium avium subsp. paratuberculosis
ugcaacaccgaacgccga

SEQ ID NO: 3008632 - RNA, 18 nt, Mycobacterium avium subsp. paratuberculosis
ugcaacacucgagcgcgc

SEQ ID NO: 3008633 - RNA, 20 nt, Mycobacterium avium subsp. paratuberculosis
ugcaaccgcuuuuccaccau

SEQ ID NO: 3008634 - RNA, 20 nt, Mycobacterium avium subsp. paratuberculosis
ugcaaccgguccgccgucgg

SEQ ID NO: 3008635 - RNA, 19 nt, Mycobacterium avium subsp. paratuberculosis
ugcaacgcgucggcgccgg

SEQ ID NO: 3008636 - RNA, 18 nt, Mycobacterium avium subsp. paratuberculosis
ugcaacggcuggcgcagg

SEQ ID NO: 3008637 - RNA, 21 nt, Mycobacterium avium subsp. paratuberculosis
ugcaacuaccgacggcaccuc

SEQ ID NO: 3008638 - RNA, 17 nt, Mycobacterium avium subsp. paratuberculosis
ugcaacucccgcgccgc

SEQ ID NO: 3008639 - RNA, 22 nt, Mycobacterium avium subsp. paratuberculosis
ugcaacucccgcgccgcggcca

SEQ ID NO: 3008640 - RNA, 18 nt, Mycobacterium avium subsp. paratuberculosis
ugcaacuggucgugcagc

SEQ ID NO: 3008641 - RNA, 22 nt, Mycobacterium avium subsp. paratuberculosis
ugcaacuggucgugcagcaccg

SEQ ID NO: 3008642 - RNA, 21 nt, Mycobacterium avium subsp. paratuberculosis
ugcaagaacccgaacgcgucg

SEQ ID NO: 3008643 - RNA, 18 nt, Mycobacterium avium subsp. paratuberculosis
ugcacaaccgcugcugcu

SEQ ID NO: 3008644 - RNA, 15 nt, Mycobacterium avium subsp. paratuberculosis
ugcacaccaccagcg

SEQ ID NO: 3008645 - RNA, 21 nt, Mycobacterium avium subsp. paratuberculosis
ugcacacccggugcgccggua

SEQ ID NO: 3008646 - RNA, 13 nt, Mycobacterium avium subsp. paratuberculosis
ugcacaccggccu

SEQ ID NO: 3008647 - RNA, 21 nt, Mycobacterium avium subsp. paratuberculosis
ugcacaccggccuucaccagg

SEQ ID NO: 3008648 - RNA, 14 nt, Mycobacterium avium subsp. paratuberculosis
ugcacacgccgagg

SEQ ID NO: 3008649 - RNA, 17 nt, Mycobacterium avium subsp. paratuberculosis
ugcacacggccuugccg

SEQ ID NO: 3008650 - RNA, 22 nt, Mycobacterium avium subsp. paratuberculosis
ugcacacggccuugccgaucag

SEQ ID NO: 3008651 - RNA, 18 nt, Mycobacterium avium subsp. paratuberculosis
ugcacagcuucggcgccg

SEQ ID NO: 3008652 - RNA, 15 nt, Mycobacterium avium subsp. paratuberculosis
ugcacaggccgccgc

SEQ ID NO: 3008653 - RNA, 20 nt, Mycobacterium avium subsp. paratuberculosis
ugcacagugcgucgcccauc

SEQ ID NO: 3008654 - RNA, 18 nt, Mycobacterium avium subsp. paratuberculosis
ugcacaucccgaaugaga

SEQ ID NO: 3008655 - RNA, 22 nt, Mycobacterium avium subsp. paratuberculosis
ugcacaugcccgucgggcgggg

SEQ ID NO: 3008656 - RNA, 18 nt, Mycobacterium avium subsp. paratuberculosis
ugcaccaacacgucgagu

SEQ ID NO: 3008657 - RNA, 19 nt, Mycobacterium avium subsp. paratuberculosis
ugcaccaacacgucgaguu

SEQ ID NO: 3008658 - RNA, 23 nt, Mycobacterium avium subsp. paratuberculosis
ugcaccaccacacccagcgccag

SEQ ID NO: 3008659 - RNA, 14 nt, Mycobacterium avium subsp. paratuberculosis
ugcaccacccaggc

SEQ ID NO: 3008660 - RNA, 15 nt, Mycobacterium avium subsp. paratuberculosis
ugcaccacccaggcc

SEQ ID NO: 3008661 - RNA, 19 nt, Mycobacterium avium subsp. paratuberculosis
ugcaccacccaggccaccc

SEQ ID NO: 3008662 - RNA, 21 nt, Mycobacterium avium subsp. paratuberculosis
ugcaccacccaggccacccgg

SEQ ID NO: 3008663 - RNA, 15 nt, Mycobacterium avium subsp. paratuberculosis
ugcaccaccgugccg

SEQ ID NO: 3008664 - RNA, 20 nt, Mycobacterium avium subsp. paratuberculosis
ugcaccacgaagcgggcggc

SEQ ID NO: 3008665 - RNA, 20 nt, Mycobacterium avium subsp. paratuberculosis
ugcaccagcacgacaccgac

SEQ ID NO: 3008666 - RNA, 21 nt, Mycobacterium avium subsp. paratuberculosis
ugcaccagcacgacaccgacg

SEQ ID NO: 3008667 - RNA, 13 nt, Mycobacterium avium subsp. paratuberculosis
ugcaccagcgauc

SEQ ID NO: 3008668 - RNA, 19 nt, Mycobacterium avium subsp. paratuberculosis
ugcaccagcgauccggcgc

SEQ ID NO: 3008669 - RNA, 14 nt, Mycobacterium avium subsp. paratuberculosis
ugcaccagcguggu

SEQ ID NO: 3008670 - RNA, 23 nt, Mycobacterium avium subsp. paratuberculosis
ugcaccagcguggugcgcccguc

SEQ ID NO: 3008671 - RNA, 18 nt, Mycobacterium avium subsp. paratuberculosis
ugcaccaggacgcgaccg

SEQ ID NO: 3008672 - RNA, 22 nt, Mycobacterium avium subsp. paratuberculosis
ugcaccaggacgcgaccggcca

SEQ ID NO: 3008673 - RNA, 22 nt, Mycobacterium avium subsp. paratuberculosis
ugcaccagggcgucgagcgcgu

SEQ ID NO: 3008674 - RNA, 15 nt, Mycobacterium avium subsp. paratuberculosis
ugcacccaccggccc

SEQ ID NO: 3008675 - RNA, 17 nt, Mycobacterium avium subsp. paratuberculosis
ugcacccagccgugccc

SEQ ID NO: 3008676 - RNA, 14 nt, Mycobacterium avium subsp. paratuberculosis
ugcacccagcggaa

SEQ ID NO: 3008677 - RNA, 15 nt, Mycobacterium avium subsp. paratuberculosis
ugcacccgcggcgcg

SEQ ID NO: 3008678 - RNA, 15 nt, Mycobacterium avium subsp. paratuberculosis
ugcacccggacguga

SEQ ID NO: 3008679 - RNA, 13 nt, Mycobacterium avium subsp. paratuberculosis
ugcacccucugcc

SEQ ID NO: 3008680 - RNA, 17 nt, Mycobacterium avium subsp. paratuberculosis
ugcaccgccagcgcggc

SEQ ID NO: 3008681 - RNA, 19 nt, Mycobacterium avium subsp. paratuberculosis
ugcaccgccagcgcggcgg

SEQ ID NO: 3008682 - RNA, 21 nt, Mycobacterium avium subsp. paratuberculosis
ugcaccgccagcgcggcggcg

SEQ ID NO: 3008683 - RNA, 13 nt, Mycobacterium avium subsp. paratuberculosis
ugcaccgcccgcg

SEQ ID NO: 3008684 - RNA, 15 nt, Mycobacterium avium subsp. paratuberculosis
ugcaccgcgauggcc

SEQ ID NO: 3008685 - RNA, 16 nt, Mycobacterium avium subsp. paratuberculosis
ugcaccgcgcgcacca

SEQ ID NO: 3008686 - RNA, 16 nt, Mycobacterium avium subsp. paratuberculosis
ugcaccggcaccgcgg

SEQ ID NO: 3008687 - RNA, 16 nt, Mycobacterium avium subsp. paratuberculosis
ugcaccggcgaguccg

SEQ ID NO: 3008688 - RNA, 22 nt, Mycobacterium avium subsp. paratuberculosis
ugcaccggguacaccggcucgc

SEQ ID NO: 3008689 - RNA, 14 nt, Mycobacterium avium subsp. paratuberculosis
ugcaccguggugac

SEQ ID NO: 3008690 - RNA, 22 nt, Mycobacterium avium subsp. paratuberculosis
ugcaccguggugacccggaccg

SEQ ID NO: 3008691 - RNA, 21 nt, Mycobacterium avium subsp. paratuberculosis
ugcaccucgcccugcagccgg

SEQ ID NO: 3008692 - RNA, 20 nt, Mycobacterium avium subsp. paratuberculosis
ugcaccugugaggcaccgaa

SEQ ID NO: 3008693 - RNA, 17 nt, Mycobacterium avium subsp. paratuberculosis
ugcaccuugcccgucgc

SEQ ID NO: 3008694 - RNA, 19 nt, Mycobacterium avium subsp. paratuberculosis
ugcaccuugcccgucgcgu

SEQ ID NO: 3008695 - RNA, 19 nt, Mycobacterium avium subsp. paratuberculosis
ugcaccuuggucagcuccc

SEQ ID NO: 3008696 - RNA, 20 nt, Mycobacterium avium subsp. paratuberculosis
ugcacgaaauaaccgcgcgg

SEQ ID NO: 3008697 - RNA, 15 nt, Mycobacterium avium subsp. paratuberculosis
ugcacgaacagggug

SEQ ID NO: 3008698 - RNA, 14 nt, Mycobacterium avium subsp. paratuberculosis
ugcacgaagucgac

SEQ ID NO: 3008699 - RNA, 15 nt, Mycobacterium avium subsp. paratuberculosis
ugcacgacgaacacc

SEQ ID NO: 3008700 - RNA, 20 nt, Mycobacterium avium subsp. paratuberculosis
ugcacgacgaacaccaccgg

SEQ ID NO: 3008701 - RNA, 22 nt, Mycobacterium avium subsp. paratuberculosis
ugcacgacgaacaccaccggca

SEQ ID NO: 3008702 - RNA, 21 nt, Mycobacterium avium subsp. paratuberculosis
ugcacgagcgucgugcgggcu

SEQ ID NO: 3008703 - RNA, 17 nt, Mycobacterium avium subsp. paratuberculosis
ugcacgaugccgaccaa

SEQ ID NO: 3008704 - RNA, 18 nt, Mycobacterium avium subsp. paratuberculosis
ugcacgcaaaaaccaugc

SEQ ID NO: 3008705 - RNA, 22 nt, Mycobacterium avium subsp. paratuberculosis
ugcacgcaaaaaccaugccagu

SEQ ID NO: 3008706 - RNA, 12 nt, Mycobacterium avium subsp. paratuberculosis
ugcacgcaggcc

SEQ ID NO: 3008707 - RNA, 16 nt, Mycobacterium avium subsp. paratuberculosis
ugcacgccgagcagca

SEQ ID NO: 3008708 - RNA, 17 nt, Mycobacterium avium subsp. paratuberculosis
ugcacgccgagcagcac

SEQ ID NO: 3008709 - RNA, 23 nt, Mycobacterium avium subsp. paratuberculosis
ugcacgccgaggcgugccgcugg

SEQ ID NO: 3008710 - RNA, 22 nt, Mycobacterium avium subsp. paratuberculosis
ugcacgccguggcggcgggcca

SEQ ID NO: 3008711 - RNA, 19 nt, Mycobacterium avium subsp. paratuberculosis
ugcacgcguugcagcgccg

SEQ ID NO: 3008712 - RNA, 23 nt, Mycobacterium avium subsp. paratuberculosis
ugcacgcguugcagcgccgcggc

SEQ ID NO: 3008713 - RNA, 13 nt, Mycobacterium avium subsp. paratuberculosis
ugcacgcucggcg

SEQ ID NO: 3008714 - RNA, 22 nt, Mycobacterium avium subsp. paratuberculosis
ugcacgcuguuggaaccggcca

SEQ ID NO: 3008715 - RNA, 12 nt, Mycobacterium avium subsp. paratuberculosis
ugcacggccaac

SEQ ID NO: 3008716 - RNA, 18 nt, Mycobacterium avium subsp. paratuberculosis
ugcacggccucggucacg

SEQ ID NO: 3008717 - RNA, 15 nt, Mycobacterium avium subsp. paratuberculosis
ugcacggcgccacca

SEQ ID NO: 3008718 - RNA, 17 nt, Mycobacterium avium subsp. paratuberculosis
ugcacggcgccgugccg

SEQ ID NO: 3008719 - RNA, 13 nt, Mycobacterium avium subsp. paratuberculosis
ugcacggcggcga

SEQ ID NO: 3008720 - RNA, 16 nt, Mycobacterium avium subsp. paratuberculosis
ugcacggucagcucgc

SEQ ID NO: 3008721 - RNA, 21 nt, Mycobacterium avium subsp. paratuberculosis
ugcacggucagcucgcgcccg

SEQ ID NO: 3008722 - RNA, 16 nt, Mycobacterium avium subsp. paratuberculosis
ugcacggucugguggc

SEQ ID NO: 3008723 - RNA, 21 nt, Mycobacterium avium subsp. paratuberculosis
ugcacggucugguggcagcgg

SEQ ID NO: 3008724 - RNA, 16 nt, Mycobacterium avium subsp. paratuberculosis
ugcacggugcgccggc

SEQ ID NO: 3008725 - RNA, 20 nt, Mycobacterium avium subsp. paratuberculosis
ugcacgguguagacgcgggc

SEQ ID NO: 3008726 - RNA, 16 nt, Mycobacterium avium subsp. paratuberculosis
ugcacguaggcggcga

SEQ ID NO: 3008727 - RNA, 18 nt, Mycobacterium avium subsp. paratuberculosis
ugcacgucacgggccagg

SEQ ID NO: 3008728 - RNA, 20 nt, Mycobacterium avium subsp. paratuberculosis
ugcacguccgccuccgacca

SEQ ID NO: 3008729 - RNA, 16 nt, Mycobacterium avium subsp. paratuberculosis
ugcacgucggcggccg

SEQ ID NO: 3008730 - RNA, 16 nt, Mycobacterium avium subsp. paratuberculosis
ugcacgugcaccgcgg

SEQ ID NO: 3008731 - RNA, 15 nt, Mycobacterium avium subsp. paratuberculosis
ugcacucucgcggca

SEQ ID NO: 3008732 - RNA, 14 nt, Mycobacterium avium subsp. paratuberculosis
ugcacugccgaccc

SEQ ID NO: 3008733 - RNA, 21 nt, Mycobacterium avium subsp. paratuberculosis
ugcacuuucgcggucagccgg

SEQ ID NO: 3008734 - RNA, 17 nt, Mycobacterium avium subsp. paratuberculosis
ugcacuuucggcagcug

SEQ ID NO: 3008735 - RNA, 13 nt, Mycobacterium avium subsp. paratuberculosis
ugcagaacagcac

SEQ ID NO: 3008736 - RNA, 14 nt, Mycobacterium avium subsp. paratuberculosis
ugcagaacagcacg

SEQ ID NO: 3008737 - RNA, 14 nt, Mycobacterium avium subsp. paratuberculosis
ugcagaacagccgg

SEQ ID NO: 3008738 - RNA, 18 nt, Mycobacterium avium subsp. paratuberculosis
ugcagaacagccgguccg

SEQ ID NO: 3008739 - RNA, 23 nt, Mycobacterium avium subsp. paratuberculosis
ugcagaacgcgcggaugcccagg

SEQ ID NO: 3008740 - RNA, 15 nt, Mycobacterium avium subsp. paratuberculosis
ugcagaccagcccgu

SEQ ID NO: 3008741 - RNA, 16 nt, Mycobacterium avium subsp. paratuberculosis
ugcagaucaccacggu

SEQ ID NO: 3008742 - RNA, 18 nt, Mycobacterium avium subsp. paratuberculosis
ugcagauccagaugccgg

SEQ ID NO: 3008743 - RNA, 19 nt, Mycobacterium avium subsp. paratuberculosis
ugcagauccgcucgccguc

SEQ ID NO: 3008744 - RNA, 20 nt, Mycobacterium avium subsp. paratuberculosis
ugcagauccgcucgccgucg

SEQ ID NO: 3008745 - RNA, 19 nt, Mycobacterium avium subsp. paratuberculosis
ugcagaucguccaucgcgu

SEQ ID NO: 3008746 - RNA, 14 nt, Mycobacterium avium subsp. paratuberculosis
ugcagcacaacggc

SEQ ID NO: 3008747 - RNA, 12 nt, Mycobacterium avium subsp. paratuberculosis
ugcagcacagcg

SEQ ID NO: 3008748 - RNA, 13 nt, Mycobacterium avium subsp. paratuberculosis
ugcagcacagcgg

SEQ ID NO: 3008749 - RNA, 14 nt, Mycobacterium avium subsp. paratuberculosis
ugcagcacagcggg

SEQ ID NO: 3008750 - RNA, 19 nt, Mycobacterium avium subsp. paratuberculosis
ugcagcacagcgggauccc

SEQ ID NO: 3008751 - RNA, 16 nt, Mycobacterium avium subsp. paratuberculosis
ugcagcacauccagcc

SEQ ID NO: 3008752 - RNA, 14 nt, Mycobacterium avium subsp. paratuberculosis
ugcagcacgccgcg

SEQ ID NO: 3008753 - RNA, 22 nt, Mycobacterium avium subsp. paratuberculosis
ugcagcagcagccacgccagcc

SEQ ID NO: 3008754 - RNA, 13 nt, Mycobacterium avium subsp. paratuberculosis
ugcagcagcgccg

SEQ ID NO: 3008755 - RNA, 14 nt, Mycobacterium avium subsp. paratuberculosis
ugcagcagcgccgc

SEQ ID NO: 3008756 - RNA, 19 nt, Mycobacterium avium subsp. paratuberculosis
ugcagcagcgccgcgacga

SEQ ID NO: 3008757 - RNA, 12 nt, Mycobacterium avium subsp. paratuberculosis
ugcagcagcucg

SEQ ID NO: 3008758 - RNA, 13 nt, Mycobacterium avium subsp. paratuberculosis
ugcagcagcucgg

SEQ ID NO: 3008759 - RNA, 16 nt, Mycobacterium avium subsp. paratuberculosis
ugcagcagcucggcga

SEQ ID NO: 3008760 - RNA, 16 nt, Mycobacterium avium subsp. paratuberculosis
ugcagcagcuggaaca

SEQ ID NO: 3008761 - RNA, 22 nt, Mycobacterium avium subsp. paratuberculosis
ugcagcaggaacucccgcgccg

SEQ ID NO: 3008762 - RNA, 19 nt, Mycobacterium avium subsp. paratuberculosis
ugcagcagucccucgauca

SEQ ID NO: 3008763 - RNA, 18 nt, Mycobacterium avium subsp. paratuberculosis
ugcagcauuuccgagcga

SEQ ID NO: 3008764 - RNA, 21 nt, Mycobacterium avium subsp. paratuberculosis
ugcagcauuuccgagcgacga

SEQ ID NO: 3008765 - RNA, 15 nt, Mycobacterium avium subsp. paratuberculosis
ugcagccccgcacug

SEQ ID NO: 3008766 - RNA, 18 nt, Mycobacterium avium subsp. paratuberculosis
ugcagcccgcguccagca

SEQ ID NO: 3008767 - RNA, 21 nt, Mycobacterium avium subsp. paratuberculosis
ugcagcccgcguccagcagca

SEQ ID NO: 3008768 - RNA, 20 nt, Mycobacterium avium subsp. paratuberculosis
ugcagcccgcugaccaggcc

SEQ ID NO: 3008769 - RNA, 14 nt, Mycobacterium avium subsp. paratuberculosis
ugcagccgcccguc

SEQ ID NO: 3008770 - RNA, 21 nt, Mycobacterium avium subsp. paratuberculosis
ugcagccgccgcgccaccgag

SEQ ID NO: 3008771 - RNA, 20 nt, Mycobacterium avium subsp. paratuberculosis
ugcagccgcggucuuuggcg

SEQ ID NO: 3008772 - RNA, 14 nt, Mycobacterium avium subsp. paratuberculosis
ugcagccgcugccg

SEQ ID NO: 3008773 - RNA, 19 nt, Mycobacterium avium subsp. paratuberculosis
ugcagccgcugccgcaccc

SEQ ID NO: 3008774 - RNA, 20 nt, Mycobacterium avium subsp. paratuberculosis
ugcagccggccaacagcagc

SEQ ID NO: 3008775 - RNA, 21 nt, Mycobacterium avium subsp. paratuberculosis
ugcagccggccaucucggcgg

SEQ ID NO: 3008776 - RNA, 13 nt, Mycobacterium avium subsp. paratuberculosis
ugcagccggcgcg

SEQ ID NO: 3008777 - RNA, 13 nt, Mycobacterium avium subsp. paratuberculosis
ugcagccgggccu

SEQ ID NO: 3008778 - RNA, 22 nt, Mycobacterium avium subsp. paratuberculosis
ugcagccgggccugcagcaacu

SEQ ID NO: 3008779 - RNA, 17 nt, Mycobacterium avium subsp. paratuberculosis
ugcagccgggcggcgcc

SEQ ID NO: 3008780 - RNA, 19 nt, Mycobacterium avium subsp. paratuberculosis
ugcagccgggcggcgccga

SEQ ID NO: 3008781 - RNA, 20 nt, Mycobacterium avium subsp. paratuberculosis
ugcagccgggcggcgccgaa

SEQ ID NO: 3008782 - RNA, 18 nt, Mycobacterium avium subsp. paratuberculosis
ugcagccgggggcggugc

SEQ ID NO: 3008783 - RNA, 22 nt, Mycobacterium avium subsp. paratuberculosis
ugcagccgggggcggugcagcc

SEQ ID NO: 3008784 - RNA, 19 nt, Mycobacterium avium subsp. paratuberculosis
ugcagccggguggcccgcc

SEQ ID NO: 3008785 - RNA, 22 nt, Mycobacterium avium subsp. paratuberculosis
ugcagcgacggaucggccgcgu

SEQ ID NO: 3008786 - RNA, 21 nt, Mycobacterium avium subsp. paratuberculosis
ugcagcgagaccucccggcgc

SEQ ID NO: 3008787 - RNA, 15 nt, Mycobacterium avium subsp. paratuberculosis
ugcagcgccagcacc

SEQ ID NO: 3008788 - RNA, 21 nt, Mycobacterium avium subsp. paratuberculosis
ugcagcgccagcaccgggccc

SEQ ID NO: 3008789 - RNA, 15 nt, Mycobacterium avium subsp. paratuberculosis
ugcagcgcccagccg

SEQ ID NO: 3008790 - RNA, 15 nt, Mycobacterium avium subsp. paratuberculosis
ugcagcgcccgggcc

SEQ ID NO: 3008791 - RNA, 19 nt, Mycobacterium avium subsp. paratuberculosis
ugcagcgcccgggccagga

SEQ ID NO: 3008792 - RNA, 12 nt, Mycobacterium avium subsp. paratuberculosis
ugcagcgccgag

SEQ ID NO: 3008793 - RNA, 18 nt, Mycobacterium avium subsp. paratuberculosis
ugcagcgccgaggccagc

SEQ ID NO: 3008794 - RNA, 13 nt, Mycobacterium avium subsp. paratuberculosis
ugcagcgccgccc

SEQ ID NO: 3008795 - RNA, 15 nt, Mycobacterium avium subsp. paratuberculosis
ugcagcgccgcccgc

SEQ ID NO: 3008796 - RNA, 12 nt, Mycobacterium avium subsp. paratuberculosis
ugcagcgccgcg

SEQ ID NO: 3008797 - RNA, 15 nt, Mycobacterium avium subsp. paratuberculosis
ugcagcgccgcggcg

SEQ ID NO: 3008798 - RNA, 17 nt, Mycobacterium avium subsp. paratuberculosis
ugcagcgccguccgcac

SEQ ID NO: 3008799 - RNA, 13 nt, Mycobacterium avium subsp. paratuberculosis
ugcagcgcggcga

SEQ ID NO: 3008800 - RNA, 15 nt, Mycobacterium avium subsp. paratuberculosis
ugcagcgcggcgauc

SEQ ID NO: 3008801 - RNA, 20 nt, Mycobacterium avium subsp. paratuberculosis
ugcagcgcggcgaucagcug

SEQ ID NO: 3008802 - RNA, 20 nt, Mycobacterium avium subsp. paratuberculosis
ugcagcggaaugaacgcggc

SEQ ID NO: 3008803 - RNA, 22 nt, Mycobacterium avium subsp. paratuberculosis
ugcagcggaaugaacgcggcca

SEQ ID NO: 3008804 - RNA, 16 nt, Mycobacterium avium subsp. paratuberculosis
ugcagcggcggccagu

SEQ ID NO: 3008805 - RNA, 13 nt, Mycobacterium avium subsp. paratuberculosis
ugcagcgggcugg

SEQ ID NO: 3008806 - RNA, 12 nt, Mycobacterium avium subsp. paratuberculosis
ugcagcgucggg

SEQ ID NO: 3008807 - RNA, 16 nt, Mycobacterium avium subsp. paratuberculosis
ugcagcuccucggcgg

SEQ ID NO: 3008808 - RNA, 21 nt, Mycobacterium avium subsp. paratuberculosis
ugcagcuccucggcggccucg

SEQ ID NO: 3008809 - RNA, 18 nt, Mycobacterium avium subsp. paratuberculosis
ugcagcuccuugagccgc

SEQ ID NO: 3008810 - RNA, 16 nt, Mycobacterium avium subsp. paratuberculosis
ugcagcucggugcaga

SEQ ID NO: 3008811 - RNA, 17 nt, Mycobacterium avium subsp. paratuberculosis
ugcagcucggugcgcac

SEQ ID NO: 3008812 - RNA, 19 nt, Mycobacterium avium subsp. paratuberculosis
ugcagcucggugcgcaccc

SEQ ID NO: 3008813 - RNA, 14 nt, Mycobacterium avium subsp. paratuberculosis
ugcaggaucggcuu

SEQ ID NO: 3008814 - RNA, 13 nt, Mycobacterium avium subsp. paratuberculosis
ugcaggcagccgu

SEQ ID NO: 3008815 - RNA, 23 nt, Mycobacterium avium subsp. paratuberculosis
ugcaggcaggccccuccagcugg

SEQ ID NO: 3008816 - RNA, 18 nt, Mycobacterium avium subsp. paratuberculosis
ugcaggcaggccggcagc

SEQ ID NO: 3008817 - RNA, 15 nt, Mycobacterium avium subsp. paratuberculosis
ugcaggccacgccca

SEQ ID NO: 3008818 - RNA, 12 nt, Mycobacterium avium subsp. paratuberculosis
ugcaggcccagc

SEQ ID NO: 3008819 - RNA, 13 nt, Mycobacterium avium subsp. paratuberculosis
ugcaggcccagcu

SEQ ID NO: 3008820 - RNA, 19 nt, Mycobacterium avium subsp. paratuberculosis
ugcaggcccagcugcugga

SEQ ID NO: 3008821 - RNA, 23 nt, Mycobacterium avium subsp. paratuberculosis
ugcaggcccgggcggcgaguccg

SEQ ID NO: 3008822 - RNA, 13 nt, Mycobacterium avium subsp. paratuberculosis
ugcaggccgagcc

SEQ ID NO: 3008823 - RNA, 15 nt, Mycobacterium avium subsp. paratuberculosis
ugcaggccgagccgc

SEQ ID NO: 3008824 - RNA, 16 nt, Mycobacterium avium subsp. paratuberculosis
ugcaggccgagccgcc

SEQ ID NO: 3008825 - RNA, 20 nt, Mycobacterium avium subsp. paratuberculosis
ugcaggccgcggguggcgcc

SEQ ID NO: 3008826 - RNA, 21 nt, Mycobacterium avium subsp. paratuberculosis
ugcaggccgcggguggcgcca

SEQ ID NO: 3008827 - RNA, 14 nt, Mycobacterium avium subsp. paratuberculosis
ugcaggcgcccagg

SEQ ID NO: 3008828 - RNA, 18 nt, Mycobacterium avium subsp. paratuberculosis
ugcaggcugacgcgaccg

SEQ ID NO: 3008829 - RNA, 19 nt, Mycobacterium avium subsp. paratuberculosis
ugcagggggcgcagccgau

SEQ ID NO: 3008830 - RNA, 20 nt, Mycobacterium avium subsp. paratuberculosis
ugcagggucagcagcacccg

SEQ ID NO: 3008831 - RNA, 22 nt, Mycobacterium avium subsp. paratuberculosis
ugcagggucagcagcacccggu

SEQ ID NO: 3008832 - RNA, 16 nt, Mycobacterium avium subsp. paratuberculosis
ugcaggguccgccguc

SEQ ID NO: 3008833 - RNA, 16 nt, Mycobacterium avium subsp. paratuberculosis
ucggcgccgagcguca

SEQ ID NO: 3008834 - RNA, 20 nt, Mycobacterium avium subsp. paratuberculosis
ucggcgccgagcgucacgcu

SEQ ID NO: 3008835 - RNA, 12 nt, Mycobacterium avium subsp. paratuberculosis
ucggcgccgauc

SEQ ID NO: 3008836 - RNA, 14 nt, Mycobacterium avium subsp. paratuberculosis
ucggcgccgaucac

SEQ ID NO: 3008837 - RNA, 19 nt, Mycobacterium avium subsp. paratuberculosis
ucggcgccgaucacgccgg

SEQ ID NO: 3008838 - RNA, 11 nt, Mycobacterium avium subsp. paratuberculosis
ucggcgccgcc

SEQ ID NO: 3008839 - RNA, 14 nt, Mycobacterium avium subsp. paratuberculosis
ucggcgccgccgag

SEQ ID NO: 3008840 - RNA, 17 nt, Mycobacterium avium subsp. paratuberculosis
ucggcgccgccgagccg

SEQ ID NO: 3008841 - RNA, 13 nt, Mycobacterium avium subsp. paratuberculosis
ucggcgccgccgg

SEQ ID NO: 3008842 - RNA, 15 nt, Mycobacterium avium subsp. paratuberculosis
ucggcgccgcgaccc

SEQ ID NO: 3008843 - RNA, 17 nt, Mycobacterium avium subsp. paratuberculosis
ucggcgccgcgaccccg

SEQ ID NO: 3008844 - RNA, 18 nt, Mycobacterium avium subsp. paratuberculosis
ucggcgccgcgaccccgg

SEQ ID NO: 3008845 - RNA, 12 nt, Mycobacterium avium subsp. paratuberculosis
ucggcgccgcgc

SEQ ID NO: 3008846 - RNA, 14 nt, Mycobacterium avium subsp. paratuberculosis
ucggcgccgcgccg

SEQ ID NO: 3008847 - RNA, 15 nt, Mycobacterium avium subsp. paratuberculosis
ucggcgccgcgccgg

SEQ ID NO: 3008848 - RNA, 16 nt, Mycobacterium avium subsp. paratuberculosis
ucggcgccgcgccggc

SEQ ID NO: 3008849 - RNA, 13 nt, Mycobacterium avium subsp. paratuberculosis
ucggcgccggcca

SEQ ID NO: 3008850 - RNA, 14 nt, Mycobacterium avium subsp. paratuberculosis
ucggcgccggccgu

SEQ ID NO: 3008851 - RNA, 17 nt, Mycobacterium avium subsp. paratuberculosis
ucggcgccggccgucac

SEQ ID NO: 3008852 - RNA, 13 nt, Mycobacterium avium subsp. paratuberculosis
ucggcgccggcgc

SEQ ID NO: 3008853 - RNA, 15 nt, Mycobacterium avium subsp. paratuberculosis
ucggcgccggcgcgc

SEQ ID NO: 3008854 - RNA, 16 nt, Mycobacterium avium subsp. paratuberculosis
ucggcgccggcgcgca

SEQ ID NO: 3008855 - RNA, 17 nt, Mycobacterium avium subsp. paratuberculosis
ucggcgccggcuccgca

SEQ ID NO: 3008856 - RNA, 16 nt, Mycobacterium avium subsp. paratuberculosis
ucggcgccguccagcu

SEQ ID NO: 3008857 - RNA, 15 nt, Mycobacterium avium subsp. paratuberculosis
ucggcgccgucgccg

SEQ ID NO: 3008858 - RNA, 16 nt, Mycobacterium avium subsp. paratuberculosis
ucggcgccgucgccgg

SEQ ID NO: 3008859 - RNA, 18 nt, Mycobacterium avium subsp. paratuberculosis
ucggcgccgucgccggac

SEQ ID NO: 3008860 - RNA, 21 nt, Mycobacterium avium subsp. paratuberculosis
ucggcgccucggcgucccggc

SEQ ID NO: 3008861 - RNA, 17 nt, Mycobacterium avium subsp. paratuberculosis
ucggcgccugcgagcac

SEQ ID NO: 3008862 - RNA, 18 nt, Mycobacterium avium subsp. paratuberculosis
ucggcgcgaagucgagca

SEQ ID NO: 3008863 - RNA, 13 nt, Mycobacterium avium subsp. paratuberculosis
ucggcgcgcaccg

SEQ ID NO: 3008864 - RNA, 15 nt, Mycobacterium avium subsp. paratuberculosis
ucggcgcgcaccgcg

SEQ ID NO: 3008865 - RNA, 20 nt, Mycobacterium avium subsp. paratuberculosis
ucggcgcgcagcucgcgcag

SEQ ID NO: 3008866 - RNA, 17 nt, Mycobacterium avium subsp. paratuberculosis
ucggcgcgccacccgac

SEQ ID NO: 3008867 - RNA, 12 nt, Mycobacterium avium subsp. paratuberculosis
ucggcgcgccgg

SEQ ID NO: 3008868 - RNA, 14 nt, Mycobacterium avium subsp. paratuberculosis
ucggcgcgccggcg

SEQ ID NO: 3008869 - RNA, 15 nt, Mycobacterium avium subsp. paratuberculosis
ucggcgcgcgccgau

SEQ ID NO: 3008870 - RNA, 19 nt, Mycobacterium avium subsp. paratuberculosis
ucggcgcgcggggccggcg

SEQ ID NO: 3008871 - RNA, 21 nt, Mycobacterium avium subsp. paratuberculosis
ucggcgcgcggggccggcgcg

SEQ ID NO: 3008872 - RNA, 14 nt, Mycobacterium avium subsp. paratuberculosis
ucggcgcggacgug

SEQ ID NO: 3008873 - RNA, 17 nt, Mycobacterium avium subsp. paratuberculosis
ucggcgcggcgacguga

SEQ ID NO: 3008874 - RNA, 21 nt, Mycobacterium avium subsp. paratuberculosis
ucggcgcggcuuuuggcgucg

SEQ ID NO: 3008875 - RNA, 22 nt, Mycobacterium avium subsp. paratuberculosis
ucggcgcggcuuuuggcgucgu

SEQ ID NO: 3008876 - RNA, 12 nt, Mycobacterium avium subsp. paratuberculosis
ucggcgcgggcc

SEQ ID NO: 3008877 - RNA, 16 nt, Mycobacterium avium subsp. paratuberculosis
ucggcgcgggccagca

SEQ ID NO: 3008878 - RNA, 23 nt, Mycobacterium avium subsp. paratuberculosis
ucggcgcggggccaccaggcgcc

SEQ ID NO: 3008879 - RNA, 20 nt, Mycobacterium avium subsp. paratuberculosis
ucggcgcgguccacggucag

SEQ ID NO: 3008880 - RNA, 15 nt, Mycobacterium avium subsp. paratuberculosis
ucggcgcgucggcgu

SEQ ID NO: 3008881 - RNA, 22 nt, Mycobacterium avium subsp. paratuberculosis
ucggcgcgucguccgacaccac

SEQ ID NO: 3008882 - RNA, 20 nt, Mycobacterium avium subsp. paratuberculosis
ucggcgcguuggccgagggg

SEQ ID NO: 3008883 - RNA, 20 nt, Mycobacterium avium subsp. paratuberculosis
ucggcgcucgccgcgcggcc

SEQ ID NO: 3008884 - RNA, 13 nt, Mycobacterium avium subsp. paratuberculosis
ucggcgcucgcgg

SEQ ID NO: 3008885 - RNA, 18 nt, Mycobacterium avium subsp. paratuberculosis
ucggcgcucgcgggugcg

SEQ ID NO: 3008886 - RNA, 22 nt, Mycobacterium avium subsp. paratuberculosis
ucggcgcugaacugcucgacca

SEQ ID NO: 3008887 - RNA, 16 nt, Mycobacterium avium subsp. paratuberculosis
ucggcgcugcccgccg

SEQ ID NO: 3008888 - RNA, 21 nt, Mycobacterium avium subsp. paratuberculosis
ucggcgcugcccgccgcggug

SEQ ID NO: 3008889 - RNA, 15 nt, Mycobacterium avium subsp. paratuberculosis
ucggcgcuggccagc

SEQ ID NO: 3008890 - RNA, 17 nt, Mycobacterium avium subsp. paratuberculosis
ucggcgcuggccagcgc

SEQ ID NO: 3008891 - RNA, 15 nt, Mycobacterium avium subsp. paratuberculosis
ucggcgcugucggcg

SEQ ID NO: 3008892 - RNA, 16 nt, Mycobacterium avium subsp. paratuberculosis
ucggcgcugucggcgg

SEQ ID NO: 3008893 - RNA, 17 nt, Mycobacterium avium subsp. paratuberculosis
ucggcgcugucggcggg

SEQ ID NO: 3008894 - RNA, 15 nt, Mycobacterium avium subsp. paratuberculosis
ucggcggaacggucg

SEQ ID NO: 3008895 - RNA, 21 nt, Mycobacterium avium subsp. paratuberculosis
ucggcggaacggucggggcgg

SEQ ID NO: 3008896 - RNA, 16 nt, Mycobacterium avium subsp. paratuberculosis
ucggcggacucggcga

SEQ ID NO: 3008897 - RNA, 19 nt, Mycobacterium avium subsp. paratuberculosis
ucggcggacuggcugagca

SEQ ID NO: 3008898 - RNA, 13 nt, Mycobacterium avium subsp. paratuberculosis
ucggcggaggcga

SEQ ID NO: 3008899 - RNA, 22 nt, Mycobacterium avium subsp. paratuberculosis
ucggcggaggcgaaugcggcca

SEQ ID NO: 3008900 - RNA, 15 nt, Mycobacterium avium subsp. paratuberculosis
ucggcggcaaagcgu

SEQ ID NO: 3008901 - RNA, 22 nt, Mycobacterium avium subsp. paratuberculosis
ucggcggcaaagcguugccgcg

SEQ ID NO: 3008902 - RNA, 19 nt, Mycobacterium avium subsp. paratuberculosis
ucggcggccaccagccggc

SEQ ID NO: 3008903 - RNA, 21 nt, Mycobacterium avium subsp. paratuberculosis
ucggcggccaccagccggccg

SEQ ID NO: 3008904 - RNA, 23 nt, Mycobacterium avium subsp. paratuberculosis
ucggcggccaccagccggccggc

SEQ ID NO: 3008905 - RNA, 17 nt, Mycobacterium avium subsp. paratuberculosis
ucggcggccagcgcgac

SEQ ID NO: 3008906 - RNA, 16 nt, Mycobacterium avium subsp. paratuberculosis
ucggcggccccuucga

SEQ ID NO: 3008907 - RNA, 12 nt, Mycobacterium avium subsp. paratuberculosis
ucggcggcccgc

SEQ ID NO: 3008908 - RNA, 14 nt, Mycobacterium avium subsp. paratuberculosis
ucggcggccgccag

SEQ ID NO: 3008909 - RNA, 19 nt, Mycobacterium avium subsp. paratuberculosis
ucggcggccgcccgggcgg

SEQ ID NO: 3008910 - RNA, 12 nt, Mycobacterium avium subsp. paratuberculosis
ucggcggccggg

SEQ ID NO: 3008911 - RNA, 11 nt, Mycobacterium avium subsp. paratuberculosis
ucggcggccug

SEQ ID NO: 3008912 - RNA, 16 nt, Mycobacterium avium subsp. paratuberculosis
ucggcggccugcggcg

SEQ ID NO: 3008913 - RNA, 16 nt, Mycobacterium avium subsp. paratuberculosis
ucggcggccugcucca

SEQ ID NO: 3008914 - RNA, 21 nt, Mycobacterium avium subsp. paratuberculosis
ucggcggccuuuuccggcgac

SEQ ID NO: 3008915 - RNA, 14 nt, Mycobacterium avium subsp. paratuberculosis
ucggcggcgacggc

SEQ ID NO: 3008916 - RNA, 17 nt, Mycobacterium avium subsp. paratuberculosis
ucggcggcgacggcgac

SEQ ID NO: 3008917 - RNA, 14 nt, Mycobacterium avium subsp. paratuberculosis
ucggcggcgacgug

SEQ ID NO: 3008918 - RNA, 20 nt, Mycobacterium avium subsp. paratuberculosis
ucggcggcgacgugccggcg

SEQ ID NO: 3008919 - RNA, 13 nt, Mycobacterium avium subsp. paratuberculosis
ucggcggcgagga

SEQ ID NO: 3008920 - RNA, 21 nt, Mycobacterium avium subsp. paratuberculosis
ucggcggcgaggacgucgucg

SEQ ID NO: 3008921 - RNA, 22 nt, Mycobacterium avium subsp. paratuberculosis
ucggcggcgaggacgucgucga

SEQ ID NO: 3008922 - RNA, 17 nt, Mycobacterium avium subsp. paratuberculosis
ucggcggcgcaggcgcg

SEQ ID NO: 3008923 - RNA, 19 nt, Mycobacterium avium subsp. paratuberculosis
ucggcggcgcaggcgcgca

SEQ ID NO: 3008924 - RNA, 12 nt, Mycobacterium avium subsp. paratuberculosis
ucggcggcgccg

SEQ ID NO: 3008925 - RNA, 15 nt, Mycobacterium avium subsp. paratuberculosis
ucggcggcgccgucg

SEQ ID NO: 3008926 - RNA, 12 nt, Mycobacterium avium subsp. paratuberculosis
ucggcggcgcgc

SEQ ID NO: 3008927 - RNA, 13 nt, Mycobacterium avium subsp. paratuberculosis
ucggcggcgcgca

SEQ ID NO: 3008928 - RNA, 15 nt, Mycobacterium avium subsp. paratuberculosis
ucggcggcgcggccc

SEQ ID NO: 3008929 - RNA, 16 nt, Mycobacterium avium subsp. paratuberculosis
ucggcggcgcggccca

SEQ ID NO: 3008930 - RNA, 18 nt, Mycobacterium avium subsp. paratuberculosis
ucggcggcgcggcccagg

SEQ ID NO: 3008931 - RNA, 19 nt, Mycobacterium avium subsp. paratuberculosis
ucggcggcggccugcaccu

SEQ ID NO: 3008932 - RNA, 20 nt, Mycobacterium avium subsp. paratuberculosis
ucggcggcggccugcaccuc

SEQ ID NO: 3008933 - RNA, 19 nt, Mycobacterium avium subsp. paratuberculosis
ucggcggcggcggccgcgu

SEQ ID NO: 3008934 - RNA, 16 nt, Mycobacterium avium subsp. paratuberculosis
ucggcggcgggcaggc

SEQ ID NO: 3008935 - RNA, 19 nt, Mycobacterium avium subsp. paratuberculosis
ucggcggcgggcaggcuca

SEQ ID NO: 3008936 - RNA, 12 nt, Mycobacterium avium subsp. paratuberculosis
ucggcggcgucg

SEQ ID NO: 3008937 - RNA, 13 nt, Mycobacterium avium subsp. paratuberculosis
ucggcggcgucgu

SEQ ID NO: 3008938 - RNA, 18 nt, Mycobacterium avium subsp. paratuberculosis
ucggcggcugaaccaccg

SEQ ID NO: 3008939 - RNA, 19 nt, Mycobacterium avium subsp. paratuberculosis
ucggcggcugaaccaccgc

SEQ ID NO: 3008940 - RNA, 17 nt, Mycobacterium avium subsp. paratuberculosis
ucggcgggacccgcgac

SEQ ID NO: 3008941 - RNA, 19 nt, Mycobacterium avium subsp. paratuberculosis
ucggcgggacccgcgaccc

SEQ ID NO: 3008942 - RNA, 19 nt, Mycobacterium avium subsp. paratuberculosis
ucggcgggagccggcggcg

SEQ ID NO: 3008943 - RNA, 21 nt, Mycobacterium avium subsp. paratuberculosis
ucggcgggagccggcggcggu

SEQ ID NO: 3008944 - RNA, 19 nt, Mycobacterium avium subsp. paratuberculosis
ucggcgggaucggaccgca

SEQ ID NO: 3008945 - RNA, 21 nt, Mycobacterium avium subsp. paratuberculosis
ucggcgggauggguggucacc

SEQ ID NO: 3008946 - RNA, 20 nt, Mycobacterium avium subsp. paratuberculosis
ucggcgggauguggcaucac

SEQ ID NO: 3008947 - RNA, 19 nt, Mycobacterium avium subsp. paratuberculosis
ucggcgggcaccucggcca

SEQ ID NO: 3008948 - RNA, 20 nt, Mycobacterium avium subsp. paratuberculosis
ucggcgggcaccucggccag

SEQ ID NO: 3008949 - RNA, 22 nt, Mycobacterium avium subsp. paratuberculosis
ucggcgggcaccucggccaggu

SEQ ID NO: 3008950 - RNA, 17 nt, Mycobacterium avium subsp. paratuberculosis
ucggcgggccgcccggc

SEQ ID NO: 3008951 - RNA, 20 nt, Mycobacterium avium subsp. paratuberculosis
ucggcgggccgcccggcgcg

SEQ ID NO: 3008952 - RNA, 12 nt, Mycobacterium avium subsp. paratuberculosis
ucggcgggccgg

SEQ ID NO: 3008953 - RNA, 14 nt, Mycobacterium avium subsp. paratuberculosis
ucggcgggcgugcc

SEQ ID NO: 3008954 - RNA, 13 nt, Mycobacterium avium subsp. paratuberculosis
ucggcgggcugca

SEQ ID NO: 3008955 - RNA, 20 nt, Mycobacterium avium subsp. paratuberculosis
ucggcgggcugcagcgacug

SEQ ID NO: 3008956 - RNA, 17 nt, Mycobacterium avium subsp. paratuberculosis
ucggcggggaaggugcg

SEQ ID NO: 3008957 - RNA, 23 nt, Mycobacterium avium subsp. paratuberculosis
ucggcggggggagaggcgcggcg

SEQ ID NO: 3008958 - RNA, 18 nt, Mycobacterium avium subsp. paratuberculosis
ucggcggguaugucggcg

SEQ ID NO: 3008959 - RNA, 18 nt, Mycobacterium avium subsp. paratuberculosis
ucggcgggucacucgacc

SEQ ID NO: 3008960 - RNA, 20 nt, Mycobacterium avium subsp. paratuberculosis
ucggcgggucguagccgucg

SEQ ID NO: 3008961 - RNA, 19 nt, Mycobacterium avium subsp. paratuberculosis
ucggcgggugcgggcgcug

SEQ ID NO: 3008962 - RNA, 22 nt, Mycobacterium avium subsp. paratuberculosis
ucggcggguugcugagccgccg

SEQ ID NO: 3008963 - RNA, 17 nt, Mycobacterium avium subsp. paratuberculosis
ucggcgguccgccgcag

SEQ ID NO: 3008964 - RNA, 22 nt, Mycobacterium avium subsp. paratuberculosis
ucggcgguccgccgcagcggcg

SEQ ID NO: 3008965 - RNA, 17 nt, Mycobacterium avium subsp. paratuberculosis
ucggcggucgccagcgc

SEQ ID NO: 3008966 - RNA, 18 nt, Mycobacterium avium subsp. paratuberculosis
ucggcggucgccagcgcc

SEQ ID NO: 3008967 - RNA, 19 nt, Mycobacterium avium subsp. paratuberculosis
ucggcggucgccagcgcca

SEQ ID NO: 3008968 - RNA, 15 nt, Mycobacterium avium subsp. paratuberculosis
ucggcggucgcggug

SEQ ID NO: 3008969 - RNA, 19 nt, Mycobacterium avium subsp. paratuberculosis
ucggcggucgcggugccca

SEQ ID NO: 3008970 - RNA, 15 nt, Mycobacterium avium subsp. paratuberculosis
ucggcggucugagcc

SEQ ID NO: 3008971 - RNA, 16 nt, Mycobacterium avium subsp. paratuberculosis
ucggcggucugucgcg

SEQ ID NO: 3008972 - RNA, 17 nt, Mycobacterium avium subsp. paratuberculosis
ucggcggucugucgcgc

SEQ ID NO: 3008973 - RNA, 21 nt, Mycobacterium avium subsp. paratuberculosis
ucggcggucugucgcgcgaac

SEQ ID NO: 3008974 - RNA, 21 nt, Mycobacterium avium subsp. paratuberculosis
ucggcggucuuggcggccagc

SEQ ID NO: 3008975 - RNA, 21 nt, Mycobacterium avium subsp. paratuberculosis
ucggcggugaugcgcgccgac

SEQ ID NO: 3008976 - RNA, 16 nt, Mycobacterium avium subsp. paratuberculosis
ucggcggugccgagcc

SEQ ID NO: 3008977 - RNA, 20 nt, Mycobacterium avium subsp. paratuberculosis
ucggcggugccguccucggc

SEQ ID NO: 3008978 - RNA, 22 nt, Mycobacterium avium subsp. paratuberculosis
ucggcgguucggaguccaccgg

SEQ ID NO: 3008979 - RNA, 18 nt, Mycobacterium avium subsp. paratuberculosis
ucggcgguuucggugccg

SEQ ID NO: 3008980 - RNA, 18 nt, Mycobacterium avium subsp. paratuberculosis
ucggcguacaggccgucg

SEQ ID NO: 3008981 - RNA, 19 nt, Mycobacterium avium subsp. paratuberculosis
ucggcguacugcgcgacca

SEQ ID NO: 3008982 - RNA, 22 nt, Mycobacterium avium subsp. paratuberculosis
ucggcguagggcagcccgagca

SEQ ID NO: 3008983 - RNA, 21 nt, Mycobacterium avium subsp. paratuberculosis
ucggcgucaccaggcugcucg

SEQ ID NO: 3008984 - RNA, 19 nt, Mycobacterium avium subsp. paratuberculosis
ucggcgucaccccaccgag

SEQ ID NO: 3008985 - RNA, 16 nt, Mycobacterium avium subsp. paratuberculosis
ucggcgucacucuggc

SEQ ID NO: 3008986 - RNA, 22 nt, Mycobacterium avium subsp. paratuberculosis
ucggcgucacucuggcgugacg

SEQ ID NO: 3008987 - RNA, 14 nt, Mycobacterium avium subsp. paratuberculosis
ucggcgucacugcc

SEQ ID NO: 3008988 - RNA, 23 nt, Mycobacterium avium subsp. paratuberculosis
ucggcgucacugcccagccaucu

SEQ ID NO: 3008989 - RNA, 17 nt, Mycobacterium avium subsp. paratuberculosis
ucggcguccagcgcggu

SEQ ID NO: 3008990 - RNA, 22 nt, Mycobacterium avium subsp. paratuberculosis
ucggcguccagcgcggugagca

SEQ ID NO: 3008991 - RNA, 20 nt, Mycobacterium avium subsp. paratuberculosis
ucggcguccaugcucuugcg

SEQ ID NO: 3008992 - RNA, 14 nt, Mycobacterium avium subsp. paratuberculosis
ucggcguccccggc

SEQ ID NO: 3008993 - RNA, 15 nt, Mycobacterium avium subsp. paratuberculosis
ucggcguccccggcg

SEQ ID NO: 3008994 - RNA, 16 nt, Mycobacterium avium subsp. paratuberculosis
ucggcgucccggcguc

SEQ ID NO: 3008995 - RNA, 19 nt, Mycobacterium avium subsp. paratuberculosis
ucggcgucccggcgucucg

SEQ ID NO: 3008996 - RNA, 15 nt, Mycobacterium avium subsp. paratuberculosis
ucggcguccgcggcg

SEQ ID NO: 3008997 - RNA, 15 nt, Mycobacterium avium subsp. paratuberculosis
ucggcguccgugccg

SEQ ID NO: 3008998 - RNA, 14 nt, Mycobacterium avium subsp. paratuberculosis
ucggcgucgaacgg

SEQ ID NO: 3008999 - RNA, 17 nt, Mycobacterium avium subsp. paratuberculosis
ucggcgucgaacggcgu

SEQ ID NO: 3009000 - RNA, 14 nt, Mycobacterium avium subsp. paratuberculosis
ucggcgucgacgac

SEQ ID NO: 3009001 - RNA, 16 nt, Mycobacterium avium subsp. paratuberculosis
ucggcgucgacgacgg

SEQ ID NO: 3009002 - RNA, 13 nt, Mycobacterium avium subsp. paratuberculosis
ucggcgucgaucg

SEQ ID NO: 3009003 - RNA, 13 nt, Mycobacterium avium subsp. paratuberculosis
ucggcgacgccgu

SEQ ID NO: 3009004 - RNA, 15 nt, Mycobacterium avium subsp. paratuberculosis
ucggcgacgccgucg

SEQ ID NO: 3009005 - RNA, 22 nt, Mycobacterium avium subsp. paratuberculosis
ucggcgacgcugguggccugca

SEQ ID NO: 3009006 - RNA, 15 nt, Mycobacterium avium subsp. paratuberculosis
ucggcgacggcgacg

SEQ ID NO: 3009007 - RNA, 19 nt, Mycobacterium avium subsp. paratuberculosis
ucggcgacggcgacggcgu

SEQ ID NO: 3009008 - RNA, 21 nt, Mycobacterium avium subsp. paratuberculosis
ucggcgacggcgacggcgucc

SEQ ID NO: 3009009 - RNA, 22 nt, Mycobacterium avium subsp. paratuberculosis
ucggcgacggcgacggcguccg

SEQ ID NO: 3009010 - RNA, 14 nt, Mycobacterium avium subsp. paratuberculosis
ucggcgacggcgcu

SEQ ID NO: 3009011 - RNA, 21 nt, Mycobacterium avium subsp. paratuberculosis
ucggcgacggcgcucaccggc

SEQ ID NO: 3009012 - RNA, 22 nt, Mycobacterium avium subsp. paratuberculosis
ucggcgacggcgcucaccggcg

SEQ ID NO: 3009013 - RNA, 13 nt, Mycobacterium avium subsp. paratuberculosis
ucggcgacggcgg

SEQ ID NO: 3009014 - RNA, 19 nt, Mycobacterium avium subsp. paratuberculosis
ucggcgacggcguccagcu

SEQ ID NO: 3009015 - RNA, 19 nt, Mycobacterium avium subsp. paratuberculosis
ucggcgagcaaggcgagca

SEQ ID NO: 3009016 - RNA, 21 nt, Mycobacterium avium subsp. paratuberculosis
ucggcgagcaccgugccgucg

SEQ ID NO: 3009017 - RNA, 13 nt, Mycobacterium avium subsp. paratuberculosis
ucggcgagcagca

SEQ ID NO: 3009018 - RNA, 17 nt, Mycobacterium avium subsp. paratuberculosis
ucggcgagcagcagcgc

SEQ ID NO: 3009019 - RNA, 16 nt, Mycobacterium avium subsp. paratuberculosis
ucggcgagcagccgcg

SEQ ID NO: 3009020 - RNA, 18 nt, Mycobacterium avium subsp. paratuberculosis
ucggcgagcagccgcgcc

SEQ ID NO: 3009021 - RNA, 20 nt, Mycobacterium avium subsp. paratuberculosis
ucggcgagcagccgcgccgg

SEQ ID NO: 3009022 - RNA, 21 nt, Mycobacterium avium subsp. paratuberculosis
ucggcgagcagcugcagcguc

SEQ ID NO: 3009023 - RNA, 14 nt, Mycobacterium avium subsp. paratuberculosis
ucggcgagccgcuc

SEQ ID NO: 3009024 - RNA, 21 nt, Mycobacterium avium subsp. paratuberculosis
ucggcgagccgggaccgugcg

SEQ ID NO: 3009025 - RNA, 14 nt, Mycobacterium avium subsp. paratuberculosis
ucggcgagcgaggc

SEQ ID NO: 3009026 - RNA, 15 nt, Mycobacterium avium subsp. paratuberculosis
ucggcgagcugcggg

SEQ ID NO: 3009027 - RNA, 17 nt, Mycobacterium avium subsp. paratuberculosis
ucggcgagcugcgggug

SEQ ID NO: 3009028 - RNA, 23 nt, Mycobacterium avium subsp. paratuberculosis
ucggcgagcuugccuugcgccca

SEQ ID NO: 3009029 - RNA, 19 nt, Mycobacterium avium subsp. paratuberculosis
ucggcgagcuuggcgggcg

SEQ ID NO: 3009030 - RNA, 17 nt, Mycobacterium avium subsp. paratuberculosis
ucggcgagguagaccgc

SEQ ID NO: 3009031 - RNA, 17 nt, Mycobacterium avium subsp. paratuberculosis
ucggcgaggucgucgag

SEQ ID NO: 3009032 - RNA, 19 nt, Mycobacterium avium subsp. paratuberculosis
ucggcgaggucgucgaggg

SEQ ID NO: 3009033 - RNA, 23 nt, Mycobacterium avium subsp. paratuberculosis
ucggcgaggucgucgagggccac

SEQ ID NO: 3009034 - RNA, 12 nt, Mycobacterium avium subsp. paratuberculosis
ucggcgaucagc

SEQ ID NO: 3009035 - RNA, 16 nt, Mycobacterium avium subsp. paratuberculosis
ucggcgaucagcuccu

SEQ ID NO: 3009036 - RNA, 17 nt, Mycobacterium avium subsp. paratuberculosis
ucggcgaucagcuccuc

SEQ ID NO: 3009037 - RNA, 15 nt, Mycobacterium avium subsp. paratuberculosis
ucggcgauccacgcc

SEQ ID NO: 3009038 - RNA, 18 nt, Mycobacterium avium subsp. paratuberculosis
ucggcgauccgggcacgc

SEQ ID NO: 3009039 - RNA, 11 nt, Mycobacterium avium subsp. paratuberculosis
ucggcgaucgc

SEQ ID NO: 3009040 - RNA, 15 nt, Mycobacterium avium subsp. paratuberculosis
ucggcgaucgccagc

SEQ ID NO: 3009041 - RNA, 16 nt, Mycobacterium avium subsp. paratuberculosis
ucggcgaucgccagca

SEQ ID NO: 3009042 - RNA, 15 nt, Mycobacterium avium subsp. paratuberculosis
ucggcgaucggccgc

SEQ ID NO: 3009043 - RNA, 19 nt, Mycobacterium avium subsp. paratuberculosis
ucggcgaucggccgcugcg

SEQ ID NO: 3009044 - RNA, 16 nt, Mycobacterium avium subsp. paratuberculosis
ucggcgaucucguccc

SEQ ID NO: 3009045 - RNA, 17 nt, Mycobacterium avium subsp. paratuberculosis
ucggcgaucucgucgcg

SEQ ID NO: 3009046 - RNA, 22 nt, Mycobacterium avium subsp. paratuberculosis
ucggcgaugccuuccucggcgc

SEQ ID NO: 3009047 - RNA, 16 nt, Mycobacterium avium subsp. paratuberculosis
ucggcgaugcgcacca

SEQ ID NO: 3009048 - RNA, 17 nt, Mycobacterium avium subsp. paratuberculosis
ucggcgaugcgcaccau

SEQ ID NO: 3009049 - RNA, 23 nt, Mycobacterium avium subsp. paratuberculosis
ucggcgaugcgcaccaucaccug

SEQ ID NO: 3009050 - RNA, 15 nt, Mycobacterium avium subsp. paratuberculosis
ucggcgaugcgccgu

SEQ ID NO: 3009051 - RNA, 19 nt, Mycobacterium avium subsp. paratuberculosis
ucggcgaugcguugcgcca

SEQ ID NO: 3009052 - RNA, 23 nt, Mycobacterium avium subsp. paratuberculosis
ucggcgaugcguugcgccagcac

SEQ ID NO: 3009053 - RNA, 17 nt, Mycobacterium avium subsp. paratuberculosis
ucggcgauggaguagcu

SEQ ID NO: 3009054 - RNA, 19 nt, Mycobacterium avium subsp. paratuberculosis
ucggcgauggcggcgugca

SEQ ID NO: 3009055 - RNA, 22 nt, Mycobacterium avium subsp. paratuberculosis
ucggcgauggugaugugcggcg

SEQ ID NO: 3009056 - RNA, 22 nt, Mycobacterium avium subsp. paratuberculosis
ucggcgaugucgaagcccuuca

SEQ ID NO: 3009057 - RNA, 22 nt, Mycobacterium avium subsp. paratuberculosis
ucggcgauguugaccacccgca

SEQ ID NO: 3009058 - RNA, 13 nt, Mycobacterium avium subsp. paratuberculosis
ucggcgcagcgca

SEQ ID NO: 3009059 - RNA, 19 nt, Mycobacterium avium subsp. paratuberculosis
ucggcgccaacaacucgac

SEQ ID NO: 3009060 - RNA, 22 nt, Mycobacterium avium subsp. paratuberculosis
ucggcgccaacaacucgacgcu

SEQ ID NO: 3009061 - RNA, 16 nt, Mycobacterium avium subsp. paratuberculosis
ucggcgccaccccggg

SEQ ID NO: 3009062 - RNA, 18 nt, Mycobacterium avium subsp. paratuberculosis
ucggcgccaccccgggaa

SEQ ID NO: 3009063 - RNA, 13 nt, Mycobacterium avium subsp. paratuberculosis
ucggcgccacgac

SEQ ID NO: 3009064 - RNA, 15 nt, Mycobacterium avium subsp. paratuberculosis
ucggcgccacgacca

SEQ ID NO: 3009065 - RNA, 14 nt, Mycobacterium avium subsp. paratuberculosis
ucggcgccagcccg

SEQ ID NO: 3009066 - RNA, 20 nt, Mycobacterium avium subsp. paratuberculosis
ucggcgccagcccgccgaac

SEQ ID NO: 3009067 - RNA, 14 nt, Mycobacterium avium subsp. paratuberculosis
ucggcgccagccgc

SEQ ID NO: 3009068 - RNA, 17 nt, Mycobacterium avium subsp. paratuberculosis
ucggcgcccaccgcggc

SEQ ID NO: 3009069 - RNA, 22 nt, Mycobacterium avium subsp. paratuberculosis
ucggcgcccaccgcggcgcgcg

SEQ ID NO: 3009070 - RNA, 21 nt, Mycobacterium avium subsp. paratuberculosis
ucggcgccccccugcucgcug

SEQ ID NO: 3009071 - RNA, 16 nt, Mycobacterium avium subsp. paratuberculosis
ucggcgccccgcccgc

SEQ ID NO: 3009072 - RNA, 13 nt, Mycobacterium avium subsp. paratuberculosis
ucggcgccccggc

SEQ ID NO: 3009073 - RNA, 16 nt, Mycobacterium avium subsp. paratuberculosis
ucggcgccccggcgcu

SEQ ID NO: 3009074 - RNA, 18 nt, Mycobacterium avium subsp. paratuberculosis
ucggcgccccggcgcuga

SEQ ID NO: 3009075 - RNA, 18 nt, Mycobacterium avium subsp. paratuberculosis
ucggcgcccggcccagcc

SEQ ID NO: 3009076 - RNA, 20 nt, Mycobacterium avium subsp. paratuberculosis
ucggcgcccggcccagccgc

SEQ ID NO: 3009077 - RNA, 18 nt, Mycobacterium avium subsp. paratuberculosis
ucggcgcccucgccgacc

SEQ ID NO: 3009078 - RNA, 19 nt, Mycobacterium avium subsp. paratuberculosis
ucggcgcccucgccgaccu

SEQ ID NO: 3009079 - RNA, 14 nt, Mycobacterium avium subsp. paratuberculosis
ucggcgcccucggc

SEQ ID NO: 3009080 - RNA, 12 nt, Mycobacterium avium subsp. paratuberculosis
ucggcgccgaau

SEQ ID NO: 3009081 - RNA, 13 nt, Mycobacterium avium subsp. paratuberculosis
ucggcgccgaccu

SEQ ID NO: 3009082 - RNA, 15 nt, Mycobacterium avium subsp. paratuberculosis
ucggcgccgaccucg

SEQ ID NO: 3009083 - RNA, 17 nt, Mycobacterium avium subsp. paratuberculosis
ucggcgccgaccucggc

SEQ ID NO: 3009084 - RNA, 19 nt, Mycobacterium avium subsp. paratuberculosis
ucggcgccgaccucggcca

SEQ ID NO: 3009085 - RNA, 19 nt, Mycobacterium avium subsp. paratuberculosis
ucggcgccgacggccagca

SEQ ID NO: 3009086 - RNA, 14 nt, Mycobacterium avium subsp. paratuberculosis
ucggcgccgagcac

SEQ ID NO: 3009087 - RNA, 13 nt, Mycobacterium avium subsp. paratuberculosis
ucggcgccgagcg

SEQ ID NO: 3009088 - RNA, 22 nt, Mycobacterium avium subsp. paratuberculosis
gguagaugguggccgucggccu

SEQ ID NO: 3009089 - RNA, 16 nt, Mycobacterium avium subsp. paratuberculosis
gguagccagcaccgcc

SEQ ID NO: 3009090 - RNA, 20 nt, Mycobacterium avium subsp. paratuberculosis
gguagcccaugucgccggug

SEQ ID NO: 3009091 - RNA, 12 nt, Mycobacterium avium subsp. paratuberculosis
gguagcccgcgu

SEQ ID NO: 3009092 - RNA, 18 nt, Mycobacterium avium subsp. paratuberculosis
gguagcccgcgugcacac

SEQ ID NO: 3009093 - RNA, 20 nt, Mycobacterium avium subsp. paratuberculosis
gguagccgccguagccggcg

SEQ ID NO: 3009094 - RNA, 22 nt, Mycobacterium avium subsp. paratuberculosis
gguagccgccguagccggcggu

SEQ ID NO: 3009095 - RNA, 19 nt, Mycobacterium avium subsp. paratuberculosis
gguagccgccguucucgcg

SEQ ID NO: 3009096 - RNA, 20 nt, Mycobacterium avium subsp. paratuberculosis
gguagccgccguucucgcgc

SEQ ID NO: 3009097 - RNA, 22 nt, Mycobacterium avium subsp. paratuberculosis
gguagccgccguucucgcgcag

SEQ ID NO: 3009098 - RNA, 15 nt, Mycobacterium avium subsp. paratuberculosis
gguagccgcucgccc

SEQ ID NO: 3009099 - RNA, 23 nt, Mycobacterium avium subsp. paratuberculosis
gguagccgcucgcccagcgcggc

SEQ ID NO: 3009100 - RNA, 16 nt, Mycobacterium avium subsp. paratuberculosis
gguagccggcccgcag

SEQ ID NO: 3009101 - RNA, 22 nt, Mycobacterium avium subsp. paratuberculosis
gguagccggcccgcagccagcg

SEQ ID NO: 3009102 - RNA, 18 nt, Mycobacterium avium subsp. paratuberculosis
gguagcgcagcaccaggc

SEQ ID NO: 3009103 - RNA, 16 nt, Mycobacterium avium subsp. paratuberculosis
gguagcgcagcccggu

SEQ ID NO: 3009104 - RNA, 18 nt, Mycobacterium avium subsp. paratuberculosis
gguagcgccgccggggcg

SEQ ID NO: 3009105 - RNA, 23 nt, Mycobacterium avium subsp. paratuberculosis
gguagcgccgccggggcgggcag

SEQ ID NO: 3009106 - RNA, 21 nt, Mycobacterium avium subsp. paratuberculosis
gguagcggcagauggucucga

SEQ ID NO: 3009107 - RNA, 16 nt, Mycobacterium avium subsp. paratuberculosis
gguagcgguccucgaa

SEQ ID NO: 3009108 - RNA, 19 nt, Mycobacterium avium subsp. paratuberculosis
gguagcggugcucgaugua

SEQ ID NO: 3009109 - RNA, 13 nt, Mycobacterium avium subsp. paratuberculosis
gguagcgugcgcc

SEQ ID NO: 3009110 - RNA, 14 nt, Mycobacterium avium subsp. paratuberculosis
gguagcgugcgccc

SEQ ID NO: 3009111 - RNA, 21 nt, Mycobacterium avium subsp. paratuberculosis
gguagcgugcgcccgacgccg

SEQ ID NO: 3009112 - RNA, 14 nt, Mycobacterium avium subsp. paratuberculosis
gguagcugagcagc

SEQ ID NO: 3009113 - RNA, 13 nt, Mycobacterium avium subsp. paratuberculosis
gguaggacaccga

SEQ ID NO: 3009114 - RNA, 12 nt, Mycobacterium avium subsp. paratuberculosis
gguaggccaccg

SEQ ID NO: 3009115 - RNA, 14 nt, Mycobacterium avium subsp. paratuberculosis
gguaggccaccggg

SEQ ID NO: 3009116 - RNA, 18 nt, Mycobacterium avium subsp. paratuberculosis
gguaggccaccgggucgc

SEQ ID NO: 3009117 - RNA, 23 nt, Mycobacterium avium subsp. paratuberculosis
gguaggccgccuugggccggucg

SEQ ID NO: 3009118 - RNA, 23 nt, Mycobacterium avium subsp. paratuberculosis
gguaggccggccgcagcugcugc

SEQ ID NO: 3009119 - RNA, 22 nt, Mycobacterium avium subsp. paratuberculosis
gguaggcggccagcgcccgcgg

SEQ ID NO: 3009120 - RNA, 15 nt, Mycobacterium avium subsp. paratuberculosis
gguaggcggccggga

SEQ ID NO: 3009121 - RNA, 12 nt, Mycobacterium avium subsp. paratuberculosis
gguaggcggcga

SEQ ID NO: 3009122 - RNA, 13 nt, Mycobacterium avium subsp. paratuberculosis
gguaggcggcgcc

SEQ ID NO: 3009123 - RNA, 14 nt, Mycobacterium avium subsp. paratuberculosis
gguaggcggcgccg

SEQ ID NO: 3009124 - RNA, 13 nt, Mycobacterium avium subsp. paratuberculosis
gguagggcacacc

SEQ ID NO: 3009125 - RNA, 15 nt, Mycobacterium avium subsp. paratuberculosis
gguagggccggucac

SEQ ID NO: 3009126 - RNA, 17 nt, Mycobacterium avium subsp. paratuberculosis
gguagggcgccgucggc

SEQ ID NO: 3009127 - RNA, 16 nt, Mycobacterium avium subsp. paratuberculosis
gguagggguccuccag

SEQ ID NO: 3009128 - RNA, 13 nt, Mycobacterium avium subsp. paratuberculosis
gguagggucgggu

SEQ ID NO: 3009129 - RNA, 23 nt, Mycobacterium avium subsp. paratuberculosis
gguaggugcccgggucgugcggc

SEQ ID NO: 3009130 - RNA, 15 nt, Mycobacterium avium subsp. paratuberculosis
gguagguggccagcc

SEQ ID NO: 3009131 - RNA, 18 nt, Mycobacterium avium subsp. paratuberculosis
gguaguacaccgggcugg

SEQ ID NO: 3009132 - RNA, 15 nt, Mycobacterium avium subsp. paratuberculosis
gguaguccgacuucg

SEQ ID NO: 3009133 - RNA, 13 nt, Mycobacterium avium subsp. paratuberculosis
gguagucgcgcag

SEQ ID NO: 3009134 - RNA, 14 nt, Mycobacterium avium subsp. paratuberculosis
gguaguucagcgcg

SEQ ID NO: 3009135 - RNA, 15 nt, Mycobacterium avium subsp. paratuberculosis
gguaguucagcgcgc

SEQ ID NO: 3009136 - RNA, 14 nt, Mycobacterium avium subsp. paratuberculosis
gguaguucugcucg

SEQ ID NO: 3009137 - RNA, 20 nt, Mycobacterium avium subsp. paratuberculosis
gguaguugcacucucgcggc

SEQ ID NO: 3009138 - RNA, 13 nt, Mycobacterium avium subsp. paratuberculosis
gguauccgugacc

SEQ ID NO: 3009139 - RNA, 14 nt, Mycobacterium avium subsp. paratuberculosis
gguaugcggcgacg

SEQ ID NO: 3009140 - RNA, 15 nt, Mycobacterium avium subsp. paratuberculosis
gguaugcggcgacga

SEQ ID NO: 3009141 - RNA, 20 nt, Mycobacterium avium subsp. paratuberculosis
gguauucaucgcggccgccg

SEQ ID NO: 3009142 - RNA, 19 nt, Mycobacterium avium subsp. paratuberculosis
ggucaaaacaacgcgcagc

SEQ ID NO: 3009143 - RNA, 13 nt, Mycobacterium avium subsp. paratuberculosis
ggucaacaccggg

SEQ ID NO: 3009144 - RNA, 22 nt, Mycobacterium avium subsp. paratuberculosis
ggucaaccaggccuuccgcaac

SEQ ID NO: 3009145 - RNA, 16 nt, Mycobacterium avium subsp. paratuberculosis
ggucaacggcucgguc

SEQ ID NO: 3009146 - RNA, 13 nt, Mycobacterium avium subsp. paratuberculosis
ggucaacgugucg

SEQ ID NO: 3009147 - RNA, 18 nt, Mycobacterium avium subsp. paratuberculosis
ggucaacucgacccgcac

SEQ ID NO: 3009148 - RNA, 22 nt, Mycobacterium avium subsp. paratuberculosis
ggucaagaacgaaucgucgccg

SEQ ID NO: 3009149 - RNA, 23 nt, Mycobacterium avium subsp. paratuberculosis
ggucaagaacgcaaucgcccagu

SEQ ID NO: 3009150 - RNA, 22 nt, Mycobacterium avium subsp. paratuberculosis
ggucaagauaccggccggcgcg

SEQ ID NO: 3009151 - RNA, 16 nt, Mycobacterium avium subsp. paratuberculosis
ggucaagccggccagc

SEQ ID NO: 3009152 - RNA, 18 nt, Mycobacterium avium subsp. paratuberculosis
ggucaagccggccagcag

SEQ ID NO: 3009153 - RNA, 19 nt, Mycobacterium avium subsp. paratuberculosis
ggucaagcgcuuucgccga

SEQ ID NO: 3009154 - RNA, 20 nt, Mycobacterium avium subsp. paratuberculosis
ggucaagcgcuuucgccgaa

SEQ ID NO: 3009155 - RNA, 16 nt, Mycobacterium avium subsp. paratuberculosis
ggucaaguccgcgagg

SEQ ID NO: 3009156 - RNA, 18 nt, Mycobacterium avium subsp. paratuberculosis
ggucaauugacguaaccg

SEQ ID NO: 3009157 - RNA, 20 nt, Mycobacterium avium subsp. paratuberculosis
ggucacaaagcccgggauga

SEQ ID NO: 3009158 - RNA, 15 nt, Mycobacterium avium subsp. paratuberculosis
ggucacacccucggc

SEQ ID NO: 3009159 - RNA, 18 nt, Mycobacterium avium subsp. paratuberculosis
ggucacacccucggcccg

SEQ ID NO: 3009160 - RNA, 19 nt, Mycobacterium avium subsp. paratuberculosis
ggucacacccuugucggug

SEQ ID NO: 3009161 - RNA, 22 nt, Mycobacterium avium subsp. paratuberculosis
ggucacacccuugucggugacc

SEQ ID NO: 3009162 - RNA, 13 nt, Mycobacterium avium subsp. paratuberculosis
ggucacagccgcg

SEQ ID NO: 3009163 - RNA, 14 nt, Mycobacterium avium subsp. paratuberculosis
ggucacagccgcga

SEQ ID NO: 3009164 - RNA, 20 nt, Mycobacterium avium subsp. paratuberculosis
ggucaccaccaacgccacgu

SEQ ID NO: 3009165 - RNA, 14 nt, Mycobacterium avium subsp. paratuberculosis
ggucaccaccacca

SEQ ID NO: 3009166 - RNA, 15 nt, Mycobacterium avium subsp. paratuberculosis
ggucaccaccgagcc

SEQ ID NO: 3009167 - RNA, 17 nt, Mycobacterium avium subsp. paratuberculosis
ggucaccacggucaccc

SEQ ID NO: 3009168 - RNA, 13 nt, Mycobacterium avium subsp. paratuberculosis
ggucaccagcgcg

SEQ ID NO: 3009169 - RNA, 14 nt, Mycobacterium avium subsp. paratuberculosis
ggucaccagcgcgg

SEQ ID NO: 3009170 - RNA, 15 nt, Mycobacterium avium subsp. paratuberculosis
ggucaccagcgcggu

SEQ ID NO: 3009171 - RNA, 15 nt, Mycobacterium avium subsp. paratuberculosis
ggucaccagcggccc

SEQ ID NO: 3009172 - RNA, 17 nt, Mycobacterium avium subsp. paratuberculosis
ggucaccagcggcccgc

SEQ ID NO: 3009173 - RNA, 21 nt, Mycobacterium avium subsp. paratuberculosis
ggucagcgacgagagcggauc

SEQ ID NO: 3009174 - RNA, 23 nt, Mycobacterium avium subsp. paratuberculosis
ggucagcgagugguaccgggugg

SEQ ID NO: 3009175 - RNA, 15 nt, Mycobacterium avium subsp. paratuberculosis
ggucagcgccagcau

SEQ ID NO: 3009176 - RNA, 13 nt, Mycobacterium avium subsp. paratuberculosis
ggucagcgccccc

SEQ ID NO: 3009177 - RNA, 22 nt, Mycobacterium avium subsp. paratuberculosis
ggucagcgcgacaucgccggcg

SEQ ID NO: 3009178 - RNA, 13 nt, Mycobacterium avium subsp. paratuberculosis
ggucagcgcggcc

SEQ ID NO: 3009179 - RNA, 14 nt, Mycobacterium avium subsp. paratuberculosis
ggucagcgcggccc

SEQ ID NO: 3009180 - RNA, 15 nt, Mycobacterium avium subsp. paratuberculosis
ggucagcgcggcccg

SEQ ID NO: 3009181 - RNA, 21 nt, Mycobacterium avium subsp. paratuberculosis
ggucagcgcggucagcccgcc

SEQ ID NO: 3009182 - RNA, 15 nt, Mycobacterium avium subsp. paratuberculosis
ggucagcgcgucggc

SEQ ID NO: 3009183 - RNA, 16 nt, Mycobacterium avium subsp. paratuberculosis
ggucagcgcgucggcg

SEQ ID NO: 3009184 - RNA, 17 nt, Mycobacterium avium subsp. paratuberculosis
ggucagcgcgucggcga

SEQ ID NO: 3009185 - RNA, 18 nt, Mycobacterium avium subsp. paratuberculosis
ggucagcgcuacugccgc

SEQ ID NO: 3009186 - RNA, 18 nt, Mycobacterium avium subsp. paratuberculosis
ggucagcgcuccuggccg

SEQ ID NO: 3009187 - RNA, 22 nt, Mycobacterium avium subsp. paratuberculosis
ggucagcggcaacacgccggcg

SEQ ID NO: 3009188 - RNA, 13 nt, Mycobacterium avium subsp. paratuberculosis
ggucagcggcagg

SEQ ID NO: 3009189 - RNA, 14 nt, Mycobacterium avium subsp. paratuberculosis
ggucagcggcaggu

SEQ ID NO: 3009190 - RNA, 16 nt, Mycobacterium avium subsp. paratuberculosis
ggucagcggccagccc

SEQ ID NO: 3009191 - RNA, 19 nt, Mycobacterium avium subsp. paratuberculosis
ggucagcggccagcccauc

SEQ ID NO: 3009192 - RNA, 22 nt, Mycobacterium avium subsp. paratuberculosis
ggucagcggcccgaucaccagg

SEQ ID NO: 3009193 - RNA, 13 nt, Mycobacterium avium subsp. paratuberculosis
ggucagcggcguc

SEQ ID NO: 3009194 - RNA, 22 nt, Mycobacterium avium subsp. paratuberculosis
ggguagaggcggcgaccgcgac

SEQ ID NO: 3009195 - RNA, 19 nt, Mycobacterium avium subsp. paratuberculosis
ggguagccggcccgcagcc

SEQ ID NO: 3009196 - RNA, 19 nt, Mycobacterium avium subsp. paratuberculosis
ggguagggcggcgggguuc

SEQ ID NO: 3009197 - RNA, 19 nt, Mycobacterium avium subsp. paratuberculosis
ggguaguucagcgcgcggg

SEQ ID NO: 3009198 - RNA, 17 nt, Mycobacterium avium subsp. paratuberculosis
ggguaguucuugacgcc

SEQ ID NO: 3009199 - RNA, 17 nt, Mycobacterium avium subsp. paratuberculosis
ggguauuucgagcacac

SEQ ID NO: 3009200 - RNA, 20 nt, Mycobacterium avium subsp. paratuberculosis
gggucaaaacaacgcgcagc

SEQ ID NO: 3009201 - RNA, 20 nt, Mycobacterium avium subsp. paratuberculosis
gggucaagauaccggccggc

SEQ ID NO: 3009202 - RNA, 21 nt, Mycobacterium avium subsp. paratuberculosis
gggucaagauaccggccggcg

SEQ ID NO: 3009203 - RNA, 18 nt, Mycobacterium avium subsp. paratuberculosis
gggucaauugccacagcc

SEQ ID NO: 3009204 - RNA, 16 nt, Mycobacterium avium subsp. paratuberculosis
gggucacacccucggc

SEQ ID NO: 3009205 - RNA, 17 nt, Mycobacterium avium subsp. paratuberculosis
gggucacacccucggcc

SEQ ID NO: 3009206 - RNA, 14 nt, Mycobacterium avium subsp. paratuberculosis
gggucaccacgguc

SEQ ID NO: 3009207 - RNA, 11 nt, Mycobacterium avium subsp. paratuberculosis
gggucaccgga

SEQ ID NO: 3009208 - RNA, 16 nt, Mycobacterium avium subsp. paratuberculosis
gggucaccggccgagc

SEQ ID NO: 3009209 - RNA, 21 nt, Mycobacterium avium subsp. paratuberculosis
gggucaccgugcgggucgcgc

SEQ ID NO: 3009210 - RNA, 15 nt, Mycobacterium avium subsp. paratuberculosis
gggucaccuuggccg

SEQ ID NO: 3009211 - RNA, 23 nt, Mycobacterium avium subsp. paratuberculosis
gggucacgaacuccuugacccgg

SEQ ID NO: 3009212 - RNA, 21 nt, Mycobacterium avium subsp. paratuberculosis
gggucacggauacccgcggcc

SEQ ID NO: 3009213 - RNA, 23 nt, Mycobacterium avium subsp. paratuberculosis
gggucacggauacccgcggccuc

SEQ ID NO: 3009214 - RNA, 18 nt, Mycobacterium avium subsp. paratuberculosis
gggucacggucaggccgg

SEQ ID NO: 3009215 - RNA, 23 nt, Mycobacterium avium subsp. paratuberculosis
gggucacgugcacccacgccagc

SEQ ID NO: 3009216 - RNA, 14 nt, Mycobacterium avium subsp. paratuberculosis
gggucacucgaccu

SEQ ID NO: 3009217 - RNA, 22 nt, Mycobacterium avium subsp. paratuberculosis
gggucacucgaccuucgagccg

SEQ ID NO: 3009218 - RNA, 14 nt, Mycobacterium avium subsp. paratuberculosis
gggucagaccgcgg

SEQ ID NO: 3009219 - RNA, 16 nt, Mycobacterium avium subsp. paratuberculosis
gggucagaccgcggcg

SEQ ID NO: 3009220 - RNA, 13 nt, Mycobacterium avium subsp. paratuberculosis
gggucagcaccac

SEQ ID NO: 3009221 - RNA, 15 nt, Mycobacterium avium subsp. paratuberculosis
gggucagcaccacca

SEQ ID NO: 3009222 - RNA, 21 nt, Mycobacterium avium subsp. paratuberculosis
gggucagcacccgcagccgcg

SEQ ID NO: 3009223 - RNA, 19 nt, Mycobacterium avium subsp. paratuberculosis
gggucagcaccgcggagga

SEQ ID NO: 3009224 - RNA, 14 nt, Mycobacterium avium subsp. paratuberculosis
gggucagcagcacc

SEQ ID NO: 3009225 - RNA, 21 nt, Mycobacterium avium subsp. paratuberculosis
gggucagcagcgucugcgcca

SEQ ID NO: 3009226 - RNA, 17 nt, Mycobacterium avium subsp. paratuberculosis
gggucagccacgggcgg

SEQ ID NO: 3009227 - RNA, 16 nt, Mycobacterium avium subsp. paratuberculosis
gggucagccggccugc

SEQ ID NO: 3009228 - RNA, 13 nt, Mycobacterium avium subsp. paratuberculosis
gggucagcgaggc

SEQ ID NO: 3009229 - RNA, 21 nt, Mycobacterium avium subsp. paratuberculosis
gggucaggaacaccgagccgg

SEQ ID NO: 3009230 - RNA, 22 nt, Mycobacterium avium subsp. paratuberculosis
gggucaggaacaccgagccggc

SEQ ID NO: 3009231 - RNA, 16 nt, Mycobacterium avium subsp. paratuberculosis
gggucaguucgcggcg

SEQ ID NO: 3009232 - RNA, 15 nt, Mycobacterium avium subsp. paratuberculosis
gggucaucagugacc

SEQ ID NO: 3009233 - RNA, 20 nt, Mycobacterium avium subsp. paratuberculosis
gggucaucagugaccgcacg

SEQ ID NO: 3009234 - RNA, 15 nt, Mycobacterium avium subsp. paratuberculosis
gggucauccagccgu

SEQ ID NO: 3009235 - RNA, 17 nt, Mycobacterium avium subsp. paratuberculosis
gggucauccagccgugg

SEQ ID NO: 3009236 - RNA, 15 nt, Mycobacterium avium subsp. paratuberculosis
ggguccaccggccga

SEQ ID NO: 3009237 - RNA, 13 nt, Mycobacterium avium subsp. paratuberculosis
ggguccagccgcc

SEQ ID NO: 3009238 - RNA, 17 nt, Mycobacterium avium subsp. paratuberculosis
ggguccagccgccggcg

SEQ ID NO: 3009239 - RNA, 14 nt, Mycobacterium avium subsp. paratuberculosis
ggguccagccgcgg

SEQ ID NO: 3009240 - RNA, 17 nt, Mycobacterium avium subsp. paratuberculosis
ggguccaggccgcgccg

SEQ ID NO: 3009241 - RNA, 18 nt, Mycobacterium avium subsp. paratuberculosis
ggguccaggccgcgccgg

SEQ ID NO: 3009242 - RNA, 14 nt, Mycobacterium avium subsp. paratuberculosis
ggguccagggcggg

SEQ ID NO: 3009243 - RNA, 21 nt, Mycobacterium avium subsp. paratuberculosis
ggguccagggcgggucgucga

SEQ ID NO: 3009244 - RNA, 14 nt, Mycobacterium avium subsp. paratuberculosis
ggguccagggugcc

SEQ ID NO: 3009245 - RNA, 21 nt, Mycobacterium avium subsp. paratuberculosis
ggguccaucgccucgaccagc

SEQ ID NO: 3009246 - RNA, 18 nt, Mycobacterium avium subsp. paratuberculosis
gggucccaauccucgccg

SEQ ID NO: 3009247 - RNA, 22 nt, Mycobacterium avium subsp. paratuberculosis
gggucccaauccucgccgagca

SEQ ID NO: 3009248 - RNA, 19 nt, Mycobacterium avium subsp. paratuberculosis
gggucccagaugcgcgacg

SEQ ID NO: 3009249 - RNA, 20 nt, Mycobacterium avium subsp. paratuberculosis
gggucccaggugggcgcgca

SEQ ID NO: 3009250 - RNA, 14 nt, Mycobacterium avium subsp. paratuberculosis
gggucccccgccga

SEQ ID NO: 3009251 - RNA, 13 nt, Mycobacterium avium subsp. paratuberculosis
ggguccccgccgc

SEQ ID NO: 3009252 - RNA, 15 nt, Mycobacterium avium subsp. paratuberculosis
ggguccgaccagcac

SEQ ID NO: 3009253 - RNA, 21 nt, Mycobacterium avium subsp. paratuberculosis
ggguccgaccagcacccgggc

SEQ ID NO: 3009254 - RNA, 21 nt, Mycobacterium avium subsp. paratuberculosis
ggguccgcaacgccggcgugc

SEQ ID NO: 3009255 - RNA, 21 nt, Mycobacterium avium subsp. paratuberculosis
ggguccgcacccgggcccggu

SEQ ID NO: 3009256 - RNA, 23 nt, Mycobacterium avium subsp. paratuberculosis
ggguccgcacccgggcccggucg

SEQ ID NO: 3009257 - RNA, 14 nt, Mycobacterium avium subsp. paratuberculosis
ggguccgcaggcga

SEQ ID NO: 3009258 - RNA, 16 nt, Mycobacterium avium subsp. paratuberculosis
ggguccgccgggcgcg

SEQ ID NO: 3009259 - RNA, 22 nt, Mycobacterium avium subsp. paratuberculosis
ggguccggaagcccuugcagca

SEQ ID NO: 3009260 - RNA, 15 nt, Mycobacterium avium subsp. paratuberculosis
ggguccggucagcac

SEQ ID NO: 3009261 - RNA, 16 nt, Mycobacterium avium subsp. paratuberculosis
ggguccggucagcacc

SEQ ID NO: 3009262 - RNA, 20 nt, Mycobacterium avium subsp. paratuberculosis
ggguccguguggcgcugaug

SEQ ID NO: 3009263 - RNA, 22 nt, Mycobacterium avium subsp. paratuberculosis
ggguccguguggcgcugaugaa

SEQ ID NO: 3009264 - RNA, 18 nt, Mycobacterium avium subsp. paratuberculosis
ggguccuccagcggcagg

SEQ ID NO: 3009265 - RNA, 18 nt, Mycobacterium avium subsp. paratuberculosis
ggguccucgauggcggcg

SEQ ID NO: 3009266 - RNA, 14 nt, Mycobacterium avium subsp. paratuberculosis
ggguccucucggcg

SEQ ID NO: 3009267 - RNA, 15 nt, Mycobacterium avium subsp. paratuberculosis
ggguccuugccggcg

SEQ ID NO: 3009268 - RNA, 16 nt, Mycobacterium avium subsp. paratuberculosis
gggugaaucgacaccg

SEQ ID NO: 3009269 - RNA, 21 nt, Mycobacterium avium subsp. paratuberculosis
gggugaaucgacaccgcacgg

SEQ ID NO: 3009270 - RNA, 15 nt, Mycobacterium avium subsp. paratuberculosis
gggugacccggccgu

SEQ ID NO: 3009271 - RNA, 18 nt, Mycobacterium avium subsp. paratuberculosis
gggugacccggccguugg

SEQ ID NO: 3009272 - RNA, 22 nt, Mycobacterium avium subsp. paratuberculosis
gggugacccgggcgauggugcc

SEQ ID NO: 3009273 - RNA, 22 nt, Mycobacterium avium subsp. paratuberculosis
gggugaccgagucgucgcgcac

SEQ ID NO: 3009274 - RNA, 23 nt, Mycobacterium avium subsp. paratuberculosis
gggugaccgagucgucgcgcacc

SEQ ID NO: 3009275 - RNA, 18 nt, Mycobacterium avium subsp. paratuberculosis
gggugaccggcgcgcagc

SEQ ID NO: 3009276 - RNA, 14 nt, Mycobacterium avium subsp. paratuberculosis
gggugaccggcggc

SEQ ID NO: 3009277 - RNA, 18 nt, Mycobacterium avium subsp. paratuberculosis
gggugaccggcggccagc

SEQ ID NO: 3009278 - RNA, 15 nt, Mycobacterium avium subsp. paratuberculosis
ggcgcggcgacguga

SEQ ID NO: 3009279 - RNA, 14 nt, Mycobacterium avium subsp. paratuberculosis
ggcgcggcgcaccg

SEQ ID NO: 3009280 - RNA, 17 nt, Mycobacterium avium subsp. paratuberculosis
ggcgcggcgcaccgagu

SEQ ID NO: 3009281 - RNA, 23 nt, Mycobacterium avium subsp. paratuberculosis
ggcgcggcgcaccgagucgguga

SEQ ID NO: 3009282 - RNA, 16 nt, Mycobacterium avium subsp. paratuberculosis
ggcgcggcgcagcgcg

SEQ ID NO: 3009283 - RNA, 11 nt, Mycobacterium avium subsp. paratuberculosis
ggcgcggcggc

SEQ ID NO: 3009284 - RNA, 15 nt, Mycobacterium avium subsp. paratuberculosis
ggcgcggcggccggc

SEQ ID NO: 3009285 - RNA, 17 nt, Mycobacterium avium subsp. paratuberculosis
ggcgcggcggccggcca

SEQ ID NO: 3009286 - RNA, 22 nt, Mycobacterium avium subsp. paratuberculosis
ggcgcggcggccggccagcgcg

SEQ ID NO: 3009287 - RNA, 14 nt, Mycobacterium avium subsp. paratuberculosis
ggcgcggcggcgcc

SEQ ID NO: 3009288 - RNA, 15 nt, Mycobacterium avium subsp. paratuberculosis
ggcgcggcggcgccg

SEQ ID NO: 3009289 - RNA, 18 nt, Mycobacterium avium subsp. paratuberculosis
ggcgcggcggcgccgcgg

SEQ ID NO: 3009290 - RNA, 19 nt, Mycobacterium avium subsp. paratuberculosis
ggcgcggcguagccgccgg

SEQ ID NO: 3009291 - RNA, 19 nt, Mycobacterium avium subsp. paratuberculosis
ggcgcggcuuuuggcgucg

SEQ ID NO: 3009292 - RNA, 23 nt, Mycobacterium avium subsp. paratuberculosis
ggcgcggcuuuuggcgucguuga

SEQ ID NO: 3009293 - RNA, 16 nt, Mycobacterium avium subsp. paratuberculosis
ggcgcgggccgcagcg

SEQ ID NO: 3009294 - RNA, 15 nt, Mycobacterium avium subsp. paratuberculosis
ggcgcgggcgcccuc

SEQ ID NO: 3009295 - RNA, 13 nt, Mycobacterium avium subsp. paratuberculosis
ggcgcgggcggca

SEQ ID NO: 3009296 - RNA, 19 nt, Mycobacterium avium subsp. paratuberculosis
ggcgcgggcggcgcgguug

SEQ ID NO: 3009297 - RNA, 20 nt, Mycobacterium avium subsp. paratuberculosis
ggcgcgggcggcgucggcga

SEQ ID NO: 3009298 - RNA, 13 nt, Mycobacterium avium subsp. paratuberculosis
ggcgcgggcgucc

SEQ ID NO: 3009299 - RNA, 13 nt, Mycobacterium avium subsp. paratuberculosis
ggcgcggggccac

SEQ ID NO: 3009300 - RNA, 15 nt, Mycobacterium avium subsp. paratuberculosis
ggcgcggggccacca

SEQ ID NO: 3009301 - RNA, 14 nt, Mycobacterium avium subsp. paratuberculosis
ggcgcggggcgcga

SEQ ID NO: 3009302 - RNA, 16 nt, Mycobacterium avium subsp. paratuberculosis
ggcgcgggggcggccu

SEQ ID NO: 3009303 - RNA, 18 nt, Mycobacterium avium subsp. paratuberculosis
ggcgcgggucgcgguucg

SEQ ID NO: 3009304 - RNA, 18 nt, Mycobacterium avium subsp. paratuberculosis
ggcgcgggucgcuggccg

SEQ ID NO: 3009305 - RNA, 20 nt, Mycobacterium avium subsp. paratuberculosis
ggcgcgggucgcuggccgcg

SEQ ID NO: 3009306 - RNA, 12 nt, Mycobacterium avium subsp. paratuberculosis
ggcgcgguccac

SEQ ID NO: 3009307 - RNA, 18 nt, Mycobacterium avium subsp. paratuberculosis
ggcgcgguccacggucag

SEQ ID NO: 3009308 - RNA, 15 nt, Mycobacterium avium subsp. paratuberculosis
ggcgcggucgcaggc

SEQ ID NO: 3009309 - RNA, 16 nt, Mycobacterium avium subsp. paratuberculosis
ggcgcggucgguggcg

SEQ ID NO: 3009310 - RNA, 21 nt, Mycobacterium avium subsp. paratuberculosis
ggcgcggugcgccgacagcug

SEQ ID NO: 3009311 - RNA, 17 nt, Mycobacterium avium subsp. paratuberculosis
ggcgcggugcucggcgc

SEQ ID NO: 3009312 - RNA, 20 nt, Mycobacterium avium subsp. paratuberculosis
ggcgcggugcucggcgcgcg

SEQ ID NO: 3009313 - RNA, 19 nt, Mycobacterium avium subsp. paratuberculosis
ggcgcggugugggcgaugg

SEQ ID NO: 3009314 - RNA, 15 nt, Mycobacterium avium subsp. paratuberculosis
ggcgcgguugaccgc

SEQ ID NO: 3009315 - RNA, 16 nt, Mycobacterium avium subsp. paratuberculosis
ggcgcgguugaccgcc

SEQ ID NO: 3009316 - RNA, 17 nt, Mycobacterium avium subsp. paratuberculosis
ggcgcgguugucguuga

SEQ ID NO: 3009317 - RNA, 18 nt, Mycobacterium avium subsp. paratuberculosis
ggcgcgguuucggcgucg

SEQ ID NO: 3009318 - RNA, 22 nt, Mycobacterium avium subsp. paratuberculosis
ggcgcguaaaggaugucgccgc

SEQ ID NO: 3009319 - RNA, 22 nt, Mycobacterium avium subsp. paratuberculosis
ggcgcguccauggucgagccgc

SEQ ID NO: 3009320 - RNA, 16 nt, Mycobacterium avium subsp. paratuberculosis
ggcgcguccgcgggcg

SEQ ID NO: 3009321 - RNA, 23 nt, Mycobacterium avium subsp. paratuberculosis
ggcgcguccgcgggcggggccug

SEQ ID NO: 3009322 - RNA, 20 nt, Mycobacterium avium subsp. paratuberculosis
ggcgcguccggaggugccgg

SEQ ID NO: 3009323 - RNA, 16 nt, Mycobacterium avium subsp. paratuberculosis
ggcgcgucgaucgcgu

SEQ ID NO: 3009324 - RNA, 14 nt, Mycobacterium avium subsp. paratuberculosis
ggcgcgucgcuggg

SEQ ID NO: 3009325 - RNA, 21 nt, Mycobacterium avium subsp. paratuberculosis
ggcgcgucgcugggcagccgu

SEQ ID NO: 3009326 - RNA, 22 nt, Mycobacterium avium subsp. paratuberculosis
ggcgcgucgcugggcagccguc

SEQ ID NO: 3009327 - RNA, 15 nt, Mycobacterium avium subsp. paratuberculosis
ggcgcgucgguaauc

SEQ ID NO: 3009328 - RNA, 20 nt, Mycobacterium avium subsp. paratuberculosis
ggcgcgucgguaaucggcgg

SEQ ID NO: 3009329 - RNA, 23 nt, Mycobacterium avium subsp. paratuberculosis
ggcgcgucguacaccucggucgg

SEQ ID NO: 3009330 - RNA, 22 nt, Mycobacterium avium subsp. paratuberculosis
ggcgcgucguagucgcucggcg

SEQ ID NO: 3009331 - RNA, 14 nt, Mycobacterium avium subsp. paratuberculosis
ggcgcgucguccga

SEQ ID NO: 3009332 - RNA, 16 nt, Mycobacterium avium subsp. paratuberculosis
ggcgcgucguccgaca

SEQ ID NO: 3009333 - RNA, 19 nt, Mycobacterium avium subsp. paratuberculosis
ggcgcgugcacaccggccu

SEQ ID NO: 3009334 - RNA, 22 nt, Mycobacterium avium subsp. paratuberculosis
ggcgcgugcgccgcggcggcuc

SEQ ID NO: 3009335 - RNA, 22 nt, Mycobacterium avium subsp. paratuberculosis
ggcgcguuccaucagcgcccgc

SEQ ID NO: 3009336 - RNA, 23 nt, Mycobacterium avium subsp. paratuberculosis
ggcgcguuccaucagcgcccgcg

SEQ ID NO: 3009337 - RNA, 14 nt, Mycobacterium avium subsp. paratuberculosis
ggcgcguuggcccg

SEQ ID NO: 3009338 - RNA, 15 nt, Mycobacterium avium subsp. paratuberculosis
ggcgcguuggccgag

SEQ ID NO: 3009339 - RNA, 18 nt, Mycobacterium avium subsp. paratuberculosis
ggcgcguuggccggcugg

SEQ ID NO: 3009340 - RNA, 15 nt, Mycobacterium avium subsp. paratuberculosis
ggcgcuaaagccacc

SEQ ID NO: 3009341 - RNA, 18 nt, Mycobacterium avium subsp. paratuberculosis
ggcgcuaaagccaccagc

SEQ ID NO: 3009342 - RNA, 16 nt, Mycobacterium avium subsp. paratuberculosis
ggcgcuaaagccgacc

SEQ ID NO: 3009343 - RNA, 17 nt, Mycobacterium avium subsp. paratuberculosis
ggcgcuaaagccgaccg

SEQ ID NO: 3009344 - RNA, 23 nt, Mycobacterium avium subsp. paratuberculosis
ggcgcuaaagccgaccgccccgc

SEQ ID NO: 3009345 - RNA, 12 nt, Mycobacterium avium subsp. paratuberculosis
ggcgcuacgcgc

SEQ ID NO: 3009346 - RNA, 15 nt, Mycobacterium avium subsp. paratuberculosis
ggcgcuacgcgccua

SEQ ID NO: 3009347 - RNA, 16 nt, Mycobacterium avium subsp. paratuberculosis
ggcgcuagcugcgccg

SEQ ID NO: 3009348 - RNA, 20 nt, Mycobacterium avium subsp. paratuberculosis
ggcgcucaacgugauacgcc

SEQ ID NO: 3009349 - RNA, 23 nt, Mycobacterium avium subsp. paratuberculosis
ggcgcucagcggcagcgucgcca

SEQ ID NO: 3009350 - RNA, 20 nt, Mycobacterium avium subsp. paratuberculosis
ggcgcucaucaggcggccgg

SEQ ID NO: 3009351 - RNA, 21 nt, Mycobacterium avium subsp. paratuberculosis
ggcgcucaucaggcggccggc

SEQ ID NO: 3009352 - RNA, 22 nt, Mycobacterium avium subsp. paratuberculosis
ggcgcuccagccacuccaccac

SEQ ID NO: 3009353 - RNA, 18 nt, Mycobacterium avium subsp. paratuberculosis
ggcgcuccagcgggcggc

SEQ ID NO: 3009354 - RNA, 19 nt, Mycobacterium avium subsp. paratuberculosis
ggcgcuccagcgggcggcg

SEQ ID NO: 3009355 - RNA, 22 nt, Mycobacterium avium subsp. paratuberculosis
ggcgcuccagcgggcggcggug

SEQ ID NO: 3009356 - RNA, 21 nt, Mycobacterium avium subsp. paratuberculosis
ggcgcucccgauggcucgcgg

SEQ ID NO: 3009357 - RNA, 21 nt, Mycobacterium avium subsp. paratuberculosis
ggcgcucgcacaacccgcccg

SEQ ID NO: 3009358 - RNA, 13 nt, Mycobacterium avium subsp. paratuberculosis
ggcgcucgccgcg

SEQ ID NO: 3009359 - RNA, 14 nt, Mycobacterium avium subsp. paratuberculosis
ucgcccgccgcgac

SEQ ID NO: 3009360 - RNA, 15 nt, Mycobacterium avium subsp. paratuberculosis
ucgcccgccgcgagc

SEQ ID NO: 3009361 - RNA, 21 nt, Mycobacterium avium subsp. paratuberculosis
ucgcccgccgcgagccgccca

SEQ ID NO: 3009362 - RNA, 22 nt, Mycobacterium avium subsp. paratuberculosis
ucgcccgcgacugucggcucgc

SEQ ID NO: 3009363 - RNA, 19 nt, Mycobacterium avium subsp. paratuberculosis
ucgcccgcgucguggcccu

SEQ ID NO: 3009364 - RNA, 15 nt, Mycobacterium avium subsp. paratuberculosis
ucgcccgcgugggca

SEQ ID NO: 3009365 - RNA, 23 nt, Mycobacterium avium subsp. paratuberculosis
ucgcccgcgugggcaccccgauc

SEQ ID NO: 3009366 - RNA, 17 nt, Mycobacterium avium subsp. paratuberculosis
ucgcccgcguugcggcg

SEQ ID NO: 3009367 - RNA, 18 nt, Mycobacterium avium subsp. paratuberculosis
ucgcccgcguugcggcgc

SEQ ID NO: 3009368 - RNA, 20 nt, Mycobacterium avium subsp. paratuberculosis
ucgcccgcguugcggcgcag

SEQ ID NO: 3009369 - RNA, 23 nt, Mycobacterium avium subsp. paratuberculosis
ucgcccgcguugcggcgcagcgu

SEQ ID NO: 3009370 - RNA, 14 nt, Mycobacterium avium subsp. paratuberculosis
ucgcccgcuccgcg

SEQ ID NO: 3009371 - RNA, 12 nt, Mycobacterium avium subsp. paratuberculosis
ucgcccggcgcg

SEQ ID NO: 3009372 - RNA, 16 nt, Mycobacterium avium subsp. paratuberculosis
ucgcccggcgcggcau

SEQ ID NO: 3009373 - RNA, 17 nt, Mycobacterium avium subsp. paratuberculosis
ucgcccggcgcggcauc

SEQ ID NO: 3009374 - RNA, 23 nt, Mycobacterium avium subsp. paratuberculosis
ucgcccggcuccacgaugcccgu

SEQ ID NO: 3009375 - RNA, 23 nt, Mycobacterium avium subsp. paratuberculosis
ucgcccggcucgaaguggcagcg

SEQ ID NO: 3009376 - RNA, 13 nt, Mycobacterium avium subsp. paratuberculosis
ucgcccggcucgc

SEQ ID NO: 3009377 - RNA, 21 nt, Mycobacterium avium subsp. paratuberculosis
ucgcccgggccaggucgguga

SEQ ID NO: 3009378 - RNA, 14 nt, Mycobacterium avium subsp. paratuberculosis
ucgcccgggcggcg

SEQ ID NO: 3009379 - RNA, 17 nt, Mycobacterium avium subsp. paratuberculosis
ucgcccgggcggcgggg

SEQ ID NO: 3009380 - RNA, 18 nt, Mycobacterium avium subsp. paratuberculosis
ucgcccgggcggcggggc

SEQ ID NO: 3009381 - RNA, 18 nt, Mycobacterium avium subsp. paratuberculosis
ucgcccgguaggccgccg

SEQ ID NO: 3009382 - RNA, 22 nt, Mycobacterium avium subsp. paratuberculosis
ucgcccgguaggccgccgcgac

SEQ ID NO: 3009383 - RNA, 17 nt, Mycobacterium avium subsp. paratuberculosis
ucgcccgguccaucccg

SEQ ID NO: 3009384 - RNA, 14 nt, Mycobacterium avium subsp. paratuberculosis
ucgcccuccccggc

SEQ ID NO: 3009385 - RNA, 18 nt, Mycobacterium avium subsp. paratuberculosis
ucgcccuccccggccagc

SEQ ID NO: 3009386 - RNA, 19 nt, Mycobacterium avium subsp. paratuberculosis
ucgcccuccccggccagca

SEQ ID NO: 3009387 - RNA, 23 nt, Mycobacterium avium subsp. paratuberculosis
ucgcccucgaaguagagccgcug

SEQ ID NO: 3009388 - RNA, 15 nt, Mycobacterium avium subsp. paratuberculosis
ucgcccucgaucgcg

SEQ ID NO: 3009389 - RNA, 22 nt, Mycobacterium avium subsp. paratuberculosis
ucgcccucgaucgcgaccaccg

SEQ ID NO: 3009390 - RNA, 13 nt, Mycobacterium avium subsp. paratuberculosis
ucgcccucgcuga

SEQ ID NO: 3009391 - RNA, 23 nt, Mycobacterium avium subsp. paratuberculosis
ucgcccugacacagcaccggcgu

SEQ ID NO: 3009392 - RNA, 19 nt, Mycobacterium avium subsp. paratuberculosis
ucgcccugcagccgggugg

SEQ ID NO: 3009393 - RNA, 17 nt, Mycobacterium avium subsp. paratuberculosis
ucgcccugggggucggu

SEQ ID NO: 3009394 - RNA, 21 nt, Mycobacterium avium subsp. paratuberculosis
ucgcccugggggucggugacc

SEQ ID NO: 3009395 - RNA, 16 nt, Mycobacterium avium subsp. paratuberculosis
ucgccgaaaugccgug

SEQ ID NO: 3009396 - RNA, 19 nt, Mycobacterium avium subsp. paratuberculosis
ucgccgaaaugccgugcca

SEQ ID NO: 3009397 - RNA, 22 nt, Mycobacterium avium subsp. paratuberculosis
ucgccgaaaugccgugccagcc

SEQ ID NO: 3009398 - RNA, 15 nt, Mycobacterium avium subsp. paratuberculosis
ucgccgaaccgggcg

SEQ ID NO: 3009399 - RNA, 16 nt, Mycobacterium avium subsp. paratuberculosis
ucgccgaaccgggcgc

SEQ ID NO: 3009400 - RNA, 20 nt, Mycobacterium avium subsp. paratuberculosis
ucgccgaaccgggcgcgcag

SEQ ID NO: 3009401 - RNA, 16 nt, Mycobacterium avium subsp. paratuberculosis
ucgccgaaccggggcc

SEQ ID NO: 3009402 - RNA, 17 nt, Mycobacterium avium subsp. paratuberculosis
ucgccgaaccggggccg

SEQ ID NO: 3009403 - RNA, 17 nt, Mycobacterium avium subsp. paratuberculosis
ucgccgaacgccaccac

SEQ ID NO: 3009404 - RNA, 20 nt, Mycobacterium avium subsp. paratuberculosis
ucgccgaacgccaccaccuc

SEQ ID NO: 3009405 - RNA, 14 nt, Mycobacterium avium subsp. paratuberculosis
ucgccgaacgccuc

SEQ ID NO: 3009406 - RNA, 21 nt, Mycobacterium avium subsp. paratuberculosis
ucgccgaacgugcgcggcgcg

SEQ ID NO: 3009407 - RNA, 23 nt, Mycobacterium avium subsp. paratuberculosis
ucgccgaaguuccagccgaucgc

SEQ ID NO: 3009408 - RNA, 23 nt, Mycobacterium avium subsp. paratuberculosis
ucgccgaauuguucggccaccgc

SEQ ID NO: 3009409 - RNA, 12 nt, Mycobacterium avium subsp. paratuberculosis
ucgccgacaccg

SEQ ID NO: 3009410 - RNA, 15 nt, Mycobacterium avium subsp. paratuberculosis
ucgccgacagcagcu

SEQ ID NO: 3009411 - RNA, 15 nt, Mycobacterium avium subsp. paratuberculosis
ucgccgacagcgucg

SEQ ID NO: 3009412 - RNA, 17 nt, Mycobacterium avium subsp. paratuberculosis
ucgccgacagcgucguc

SEQ ID NO: 3009413 - RNA, 23 nt, Mycobacterium avium subsp. paratuberculosis
ucgccgaccagcaggacgcgccc

SEQ ID NO: 3009414 - RNA, 21 nt, Mycobacterium avium subsp. paratuberculosis
ucgccgaccagccgaggcgcu

SEQ ID NO: 3009415 - RNA, 22 nt, Mycobacterium avium subsp. paratuberculosis
ucgccgaccagguagcgcugca

SEQ ID NO: 3009416 - RNA, 14 nt, Mycobacterium avium subsp. paratuberculosis
ucgccgacccgguu

SEQ ID NO: 3009417 - RNA, 21 nt, Mycobacterium avium subsp. paratuberculosis
ucgccgacccgguugauccgg

SEQ ID NO: 3009418 - RNA, 15 nt, Mycobacterium avium subsp. paratuberculosis
ucgccgaccuuggcg

SEQ ID NO: 3009419 - RNA, 12 nt, Mycobacterium avium subsp. paratuberculosis
ucgccgacgccg

SEQ ID NO: 3009420 - RNA, 14 nt, Mycobacterium avium subsp. paratuberculosis
ucgccgacgccguc

SEQ ID NO: 3009421 - RNA, 15 nt, Mycobacterium avium subsp. paratuberculosis
ucgccgacgcgcugc

SEQ ID NO: 3009422 - RNA, 20 nt, Mycobacterium avium subsp. paratuberculosis
ucgccgacgcgcugcgcgcc

SEQ ID NO: 3009423 - RNA, 16 nt, Mycobacterium avium subsp. paratuberculosis
ucgccgacggugagca

SEQ ID NO: 3009424 - RNA, 19 nt, Mycobacterium avium subsp. paratuberculosis
ucgccgacggugagcaccg

SEQ ID NO: 3009425 - RNA, 22 nt, Mycobacterium avium subsp. paratuberculosis
ucgccgacgguguccgcgggca

SEQ ID NO: 3009426 - RNA, 23 nt, Mycobacterium avium subsp. paratuberculosis
ucgccgacgguguccgcgggcag

SEQ ID NO: 3009427 - RNA, 19 nt, Mycobacterium avium subsp. paratuberculosis
ucgccgacgucccagcaca

SEQ ID NO: 3009428 - RNA, 13 nt, Mycobacterium avium subsp. paratuberculosis
ucgccgacgucgg

SEQ ID NO: 3009429 - RNA, 23 nt, Mycobacterium avium subsp. paratuberculosis
ucgccgacgucugguuggccggc

SEQ ID NO: 3009430 - RNA, 22 nt, Mycobacterium avium subsp. paratuberculosis
ucgccgacucgcaggugccggu

SEQ ID NO: 3009431 - RNA, 23 nt, Mycobacterium avium subsp. paratuberculosis
ucgccgacucgcaggugccggug

SEQ ID NO: 3009432 - RNA, 17 nt, Mycobacterium avium subsp. paratuberculosis
ucgccgagcacaccguc

SEQ ID NO: 3009433 - RNA, 18 nt, Mycobacterium avium subsp. paratuberculosis
ucgccgagcacaccgucg

SEQ ID NO: 3009434 - RNA, 20 nt, Mycobacterium avium subsp. paratuberculosis
ucgccgagcacaccgucgcc

SEQ ID NO: 3009435 - RNA, 14 nt, Mycobacterium avium subsp. paratuberculosis
ucgccgagccgcac

SEQ ID NO: 3009436 - RNA, 17 nt, Mycobacterium avium subsp. paratuberculosis
ucgccgagccgcaccgc

SEQ ID NO: 3009437 - RNA, 20 nt, Mycobacterium avium subsp. paratuberculosis
ucgccgagccguaggccagg

SEQ ID NO: 3009438 - RNA, 21 nt, Mycobacterium avium subsp. paratuberculosis
ucgccgagccguaggccaggu

SEQ ID NO: 3009439 - RNA, 17 nt, Mycobacterium avium subsp. paratuberculosis
ucgccgagcucgugaug

SEQ ID NO: 3009440 - RNA, 18 nt, Mycobacterium avium subsp. paratuberculosis
ucgccgaggaaccggcag

SEQ ID NO: 3009441 - RNA, 19 nt, Mycobacterium avium subsp. paratuberculosis
ucgccgaggaaccggcagc

SEQ ID NO: 3009442 - RNA, 16 nt, Mycobacterium avium subsp. paratuberculosis
ucgccgagggcgacga

SEQ ID NO: 3009443 - RNA, 23 nt, Mycobacterium avium subsp. paratuberculosis
ucgccgagggcgacgaugccggc

SEQ ID NO: 3009444 - RNA, 19 nt, Mycobacterium avium subsp. paratuberculosis
ucgccgagguccucgaccu

SEQ ID NO: 3009445 - RNA, 21 nt, Mycobacterium avium subsp. paratuberculosis
ucgccgagucgaucgccagcg

SEQ ID NO: 3009446 - RNA, 21 nt, Mycobacterium avium subsp. paratuberculosis
ucgccgaucaccugacagacc

SEQ ID NO: 3009447 - RNA, 15 nt, Mycobacterium avium subsp. paratuberculosis
ucgccgaucagcacc

SEQ ID NO: 3009448 - RNA, 20 nt, Mycobacterium avium subsp. paratuberculosis
ucgccgaucagcaccagguu

SEQ ID NO: 3009449 - RNA, 16 nt, Mycobacterium avium subsp. paratuberculosis
ucgccgauccagccgu

SEQ ID NO: 3009450 - RNA, 15 nt, Mycobacterium avium subsp. paratuberculosis
ucgccgauccggcgc

SEQ ID NO: 3009451 - RNA, 17 nt, Mycobacterium avium subsp. paratuberculosis
ucgccgauccggcgccg

SEQ ID NO: 3009452 - RNA, 20 nt, Mycobacterium avium subsp. paratuberculosis
ucgccgauccggcgccgcgg

SEQ ID NO: 3009453 - RNA, 18 nt, Mycobacterium avium subsp. paratuberculosis
ucgccgauccgggcggca

SEQ ID NO: 3009454 - RNA, 19 nt, Mycobacterium avium subsp. paratuberculosis
ucgccgauccgggcggcag

SEQ ID NO: 3009455 - RNA, 15 nt, Mycobacterium avium subsp. paratuberculosis
ucgccgaucgcccgg

SEQ ID NO: 3009456 - RNA, 19 nt, Mycobacterium avium subsp. paratuberculosis
ucgccgaucgggaccguca

SEQ ID NO: 3009457 - RNA, 20 nt, Mycobacterium avium subsp. paratuberculosis
ucgccgaucucggccaaccg

SEQ ID NO: 3009458 - RNA, 16 nt, Mycobacterium avium subsp. paratuberculosis
ucgccgaucugucgcg

SEQ ID NO: 3009459 - RNA, 19 nt, Mycobacterium avium subsp. paratuberculosis
ucgccgaucuuggcgagcu

SEQ ID NO: 3009460 - RNA, 14 nt, Mycobacterium avium subsp. paratuberculosis
ucgccgaugacguu

SEQ ID NO: 3009461 - RNA, 15 nt, Mycobacterium avium subsp. paratuberculosis
ucgccgaugacguug

SEQ ID NO: 3009462 - RNA, 17 nt, Mycobacterium avium subsp. paratuberculosis
ucgccgaugacguugcg

SEQ ID NO: 3009463 - RNA, 15 nt, Mycobacterium avium subsp. paratuberculosis
ucgccgauggcguuc

SEQ ID NO: 3009464 - RNA, 14 nt, Mycobacterium avium subsp. paratuberculosis
ucgccgauggugac

SEQ ID NO: 3009465 - RNA, 21 nt, Mycobacterium avium subsp. paratuberculosis
ucgccgauggugacggugccg

SEQ ID NO: 3009466 - RNA, 21 nt, Mycobacterium avium subsp. paratuberculosis
ucgccgauguaguccagccca

SEQ ID NO: 3009467 - RNA, 21 nt, Mycobacterium avium subsp. paratuberculosis
ucgccgaugucggccgguccg

SEQ ID NO: 3009468 - RNA, 18 nt, Mycobacterium avium subsp. paratuberculosis
ucgccgauguggcgggcg

SEQ ID NO: 3009469 - RNA, 11 nt, Mycobacterium avium subsp. paratuberculosis
ucgccgcaacc

SEQ ID NO: 3009470 - RNA, 14 nt, Mycobacterium avium subsp. paratuberculosis
ucgccgcaggcguc

SEQ ID NO: 3009471 - RNA, 19 nt, Mycobacterium avium subsp. paratuberculosis
ucgccgccaacgcgaacgg

SEQ ID NO: 3009472 - RNA, 21 nt, Mycobacterium avium subsp. paratuberculosis
ucgccgccaaggggaacaacg

SEQ ID NO: 3009473 - RNA, 17 nt, Mycobacterium avium subsp. paratuberculosis
ucgccgcccacgccgug

SEQ ID NO: 3009474 - RNA, 20 nt, Mycobacterium avium subsp. paratuberculosis
ucgccgcccacgccgugcag

SEQ ID NO: 3009475 - RNA, 17 nt, Mycobacterium avium subsp. paratuberculosis
ucgccgcccaucggcag

SEQ ID NO: 3009476 - RNA, 15 nt, Mycobacterium avium subsp. paratuberculosis
ucgccgcccgggccg

SEQ ID NO: 3009477 - RNA, 19 nt, Mycobacterium avium subsp. paratuberculosis
ucgccgcccgggccgcgcc

SEQ ID NO: 3009478 - RNA, 21 nt, Mycobacterium avium subsp. paratuberculosis
ucgccgcccgggccgcgccca

SEQ ID NO: 3009479 - RNA, 22 nt, Mycobacterium avium subsp. paratuberculosis
ucgccgccgcaauacaccgcga

SEQ ID NO: 3009480 - RNA, 12 nt, Mycobacterium avium subsp. paratuberculosis
ucgccgccgcac

SEQ ID NO: 3009481 - RNA, 16 nt, Mycobacterium avium subsp. paratuberculosis
ucgccgccgcaccggc

SEQ ID NO: 3009482 - RNA, 17 nt, Mycobacterium avium subsp. paratuberculosis
ucgccgccgcaccggcc

SEQ ID NO: 3009483 - RNA, 12 nt, Mycobacterium avium subsp. paratuberculosis
ucgccgccgcca

SEQ ID NO: 3009484 - RNA, 13 nt, Mycobacterium avium subsp. paratuberculosis
ucgccgccgccag

SEQ ID NO: 3009485 - RNA, 17 nt, Mycobacterium avium subsp. paratuberculosis
ucgccgccgccagcacc

SEQ ID NO: 3009486 - RNA, 18 nt, Mycobacterium avium subsp. paratuberculosis
ucgccgccgccagcacca

SEQ ID NO: 3009487 - RNA, 19 nt, Mycobacterium avium subsp. paratuberculosis
ucgccgccgccagcaccac

SEQ ID NO: 3009488 - RNA, 21 nt, Mycobacterium avium subsp. paratuberculosis
ucgccgccgccaucuccuccg

SEQ ID NO: 3009489 - RNA, 23 nt, Mycobacterium avium subsp. paratuberculosis
ucgccgccgccgaucuugagccg

SEQ ID NO: 3009490 - RNA, 13 nt, Mycobacterium avium subsp. paratuberculosis
ucgccgccgcgca

SEQ ID NO: 3009491 - RNA, 19 nt, Mycobacterium avium subsp. paratuberculosis
ucgccgccgcgcaccgcgc

SEQ ID NO: 3009492 - RNA, 21 nt, Mycobacterium avium subsp. paratuberculosis
ucgccgccgcgcaccgcgcgu

SEQ ID NO: 3009493 - RNA, 15 nt, Mycobacterium avium subsp. paratuberculosis
ucgccgccggugccg

SEQ ID NO: 3009494 - RNA, 14 nt, Mycobacterium avium subsp. paratuberculosis
ucgccgccguccag

SEQ ID NO: 3009495 - RNA, 17 nt, Mycobacterium avium subsp. paratuberculosis
ucgccgcgaacgacgac

SEQ ID NO: 3009496 - RNA, 12 nt, Mycobacterium avium subsp. paratuberculosis
ucgccgcgaccc

SEQ ID NO: 3009497 - RNA, 13 nt, Mycobacterium avium subsp. paratuberculosis
ucgccgcgcaccc

SEQ ID NO: 3009498 - RNA, 16 nt, Mycobacterium avium subsp. paratuberculosis
ucgccgcgcacccggc

SEQ ID NO: 3009499 - RNA, 19 nt, Mycobacterium avium subsp. paratuberculosis
ucgccgcgcacccggccac

SEQ ID NO: 3009500 - RNA, 22 nt, Mycobacterium avium subsp. paratuberculosis
ucgccgcgcacccggccacgcc

SEQ ID NO: 3009501 - RNA, 22 nt, Mycobacterium avium subsp. paratuberculosis
ucgccgcgcagcaccgcgucgg

SEQ ID NO: 3009502 - RNA, 22 nt, Mycobacterium avium subsp. paratuberculosis
ucgccgcgcaucaucgcccagc

SEQ ID NO: 3009503 - RNA, 21 nt, Mycobacterium avium subsp. paratuberculosis
ucgccgcgcauucaccagcug

SEQ ID NO: 3009504 - RNA, 16 nt, Mycobacterium avium subsp. paratuberculosis
ucgccgcgccagcacc

SEQ ID NO: 3009505 - RNA, 17 nt, Mycobacterium avium subsp. paratuberculosis
ucgccgcgccagcaccu

SEQ ID NO: 3009506 - RNA, 19 nt, Mycobacterium avium subsp. paratuberculosis
ucgccgcgccagcaccucg

SEQ ID NO: 3009507 - RNA, 16 nt, Mycobacterium avium subsp. paratuberculosis
ucgccgcgccagccgc

SEQ ID NO: 3009508 - RNA, 23 nt, Mycobacterium avium subsp. paratuberculosis
ucgccgcgccagccgccgccgac

SEQ ID NO: 3009509 - RNA, 14 nt, Mycobacterium avium subsp. paratuberculosis
ucgccgcgcccagc

SEQ ID NO: 3009510 - RNA, 15 nt, Mycobacterium avium subsp. paratuberculosis
ucgccgcgcccagca

SEQ ID NO: 3009511 - RNA, 17 nt, Mycobacterium avium subsp. paratuberculosis
ucgccgcgcccgccggc

SEQ ID NO: 3009512 - RNA, 13 nt, Mycobacterium avium subsp. paratuberculosis
ucgccgcgccgcc

SEQ ID NO: 3009513 - RNA, 14 nt, Mycobacterium avium subsp. paratuberculosis
ucgccgcgccgccg

SEQ ID NO: 3009514 - RNA, 13 nt, Mycobacterium avium subsp. paratuberculosis
ucgccgcgcgcgu

SEQ ID NO: 3009515 - RNA, 14 nt, Mycobacterium avium subsp. paratuberculosis
ucgccgcgcgcguc

SEQ ID NO: 3009516 - RNA, 19 nt, Mycobacterium avium subsp. paratuberculosis
ucgccgcgcgcgucgacgu

SEQ ID NO: 3009517 - RNA, 16 nt, Mycobacterium avium subsp. paratuberculosis
ucgccgcgcggcccgc

SEQ ID NO: 3009518 - RNA, 19 nt, Mycobacterium avium subsp. paratuberculosis
ucgccgcgcggcccgcgac

SEQ ID NO: 3009519 - RNA, 20 nt, Mycobacterium avium subsp. paratuberculosis
ucgccgcgcuugcgaccgcc

SEQ ID NO: 3009520 - RNA, 21 nt, Mycobacterium avium subsp. paratuberculosis
ucgccgcgcuugcgaccgccg

SEQ ID NO: 3009521 - RNA, 15 nt, Mycobacterium avium subsp. paratuberculosis
ucgccgcggacccca

SEQ ID NO: 3009522 - RNA, 16 nt, Mycobacterium avium subsp. paratuberculosis
ucgccgcggccacgcu

SEQ ID NO: 3009523 - RNA, 17 nt, Mycobacterium avium subsp. paratuberculosis
ucgccgcggccacgcuc

SEQ ID NO: 3009524 - RNA, 18 nt, Mycobacterium avium subsp. paratuberculosis
ucgccgcggccacgcucg

SEQ ID NO: 3009525 - RNA, 14 nt, Mycobacterium avium subsp. paratuberculosis
ucgccgcggccgga

SEQ ID NO: 3009526 - RNA, 13 nt, Mycobacterium avium subsp. paratuberculosis
ucgccgcggcgau

SEQ ID NO: 3009527 - RNA, 14 nt, Mycobacterium avium subsp. paratuberculosis
ucgccgcggcgauc

SEQ ID NO: 3009528 - RNA, 13 nt, Mycobacterium avium subsp. paratuberculosis
ucgccgcgggcca

SEQ ID NO: 3009529 - RNA, 14 nt, Mycobacterium avium subsp. paratuberculosis
ucgccgcgggccag

SEQ ID NO: 3009530 - RNA, 15 nt, Mycobacterium avium subsp. paratuberculosis
ucgccgcgggccagc

SEQ ID NO: 3009531 - RNA, 21 nt, Mycobacterium avium subsp. paratuberculosis
ucgccgcgguagacaccgccg

SEQ ID NO: 3009532 - RNA, 17 nt, Mycobacterium avium subsp. paratuberculosis
ucgccgcggucaucgag

SEQ ID NO: 3009533 - RNA, 16 nt, Mycobacterium avium subsp. paratuberculosis
ucgccgcggugcgcga

SEQ ID NO: 3009534 - RNA, 22 nt, Mycobacterium avium subsp. paratuberculosis
ucgccgcggugcgcgaguaggc

SEQ ID NO: 3009535 - RNA, 19 nt, Mycobacterium avium subsp. paratuberculosis
ucgccgcgguggcgccgcg

SEQ ID NO: 3009536 - RNA, 19 nt, Mycobacterium avium subsp. paratuberculosis
ucgccgcgguggugggcgc

SEQ ID NO: 3009537 - RNA, 17 nt, Mycobacterium avium subsp. paratuberculosis
ucgccgcguacgccgcc

SEQ ID NO: 3009538 - RNA, 19 nt, Mycobacterium avium subsp. paratuberculosis
ucgccgcguacgccgccuu

SEQ ID NO: 3009539 - RNA, 20 nt, Mycobacterium avium subsp. paratuberculosis
ucgccgcguacgccgccuug

SEQ ID NO: 3009540 - RNA, 19 nt, Mycobacterium avium subsp. paratuberculosis
ucgccgcucguaacgccac

SEQ ID NO: 3009541 - RNA, 21 nt, Mycobacterium avium subsp. paratuberculosis
ucgccgcucguaacgccacgg

SEQ ID NO: 3009542 - RNA, 22 nt, Mycobacterium avium subsp. paratuberculosis
ucgccgcucguaacgccacggc

SEQ ID NO: 3009543 - RNA, 18 nt, Mycobacterium avium subsp. paratuberculosis
ucgccgcucuucgacgac

SEQ ID NO: 3009544 - RNA, 18 nt, Mycobacterium avium subsp. paratuberculosis
ucgccgcugggacugaag

SEQ ID NO: 3009545 - RNA, 22 nt, Mycobacterium avium subsp. paratuberculosis
ucgccggaauggcaaggccagc

SEQ ID NO: 3009546 - RNA, 15 nt, Mycobacterium avium subsp. paratuberculosis
ucgccggacagccgg

SEQ ID NO: 3009547 - RNA, 20 nt, Mycobacterium avium subsp. paratuberculosis
ucgccggacagccggggcag

SEQ ID NO: 3009548 - RNA, 16 nt, Mycobacterium avium subsp. paratuberculosis
ucgccggacagcgggc

SEQ ID NO: 3009549 - RNA, 22 nt, Mycobacterium avium subsp. paratuberculosis
ucgccggacucgaucgccaccg

SEQ ID NO: 3009550 - RNA, 20 nt, Mycobacterium avium subsp. paratuberculosis
ucgccggagagcccgucguc

SEQ ID NO: 3009551 - RNA, 21 nt, Mycobacterium avium subsp. paratuberculosis
ucgccggagagcccgucgucg

SEQ ID NO: 3009552 - RNA, 20 nt, Mycobacterium avium subsp. paratuberculosis
ucgccggaggcgaucaggug

SEQ ID NO: 3009553 - RNA, 14 nt, Mycobacterium avium subsp. paratuberculosis
ucgccggaucgccg

SEQ ID NO: 3009554 - RNA, 16 nt, Mycobacterium avium subsp. paratuberculosis
ucgccggaucgccgag

SEQ ID NO: 3009555 - RNA, 17 nt, Mycobacterium avium subsp. paratuberculosis
ucgccggaucgccgagg

SEQ ID NO: 3009556 - RNA, 13 nt, Mycobacterium avium subsp. paratuberculosis
ucgccggccagca

SEQ ID NO: 3009557 - RNA, 15 nt, Mycobacterium avium subsp. paratuberculosis
ucgccggccagcacg

SEQ ID NO: 3009558 - RNA, 13 nt, Mycobacterium avium subsp. paratuberculosis
ucgccggccaggc

SEQ ID NO: 3009559 - RNA, 14 nt, Mycobacterium avium subsp. paratuberculosis
ucgccggccaggcc

SEQ ID NO: 3009560 - RNA, 15 nt, Mycobacterium avium subsp. paratuberculosis
ucgccggccaggccg

SEQ ID NO: 3009561 - RNA, 21 nt, Mycobacterium avium subsp. paratuberculosis
ucgccggcccgaccggagccg

SEQ ID NO: 3009562 - RNA, 21 nt, Mycobacterium avium subsp. paratuberculosis
ucgccggccgccagcgcccgc

SEQ ID NO: 3009563 - RNA, 16 nt, Mycobacterium avium subsp. paratuberculosis
ucgccggccgccgugg

SEQ ID NO: 3009564 - RNA, 22 nt, Mycobacterium avium subsp. paratuberculosis
ucgccggccgccguggcccacg

SEQ ID NO: 3009565 - RNA, 13 nt, Mycobacterium avium subsp. paratuberculosis
ucgccggccgcgg

SEQ ID NO: 3009566 - RNA, 19 nt, Mycobacterium avium subsp. paratuberculosis
ucgccggccuccagcuguu

SEQ ID NO: 3009567 - RNA, 18 nt, Mycobacterium avium subsp. paratuberculosis
ucgccggccugcccgccg

SEQ ID NO: 3009568 - RNA, 19 nt, Mycobacterium avium subsp. paratuberculosis
ucgccggccugcccgccgc

SEQ ID NO: 3009569 - RNA, 15 nt, Mycobacterium avium subsp. paratuberculosis
ucgccggcgaccgcc

SEQ ID NO: 3009570 - RNA, 16 nt, Mycobacterium avium subsp. paratuberculosis
ucgccggcgaccgccu

SEQ ID NO: 3009571 - RNA, 17 nt, Mycobacterium avium subsp. paratuberculosis
ucgccggcgaccgccuu

SEQ ID NO: 3009572 - RNA, 22 nt, Mycobacterium avium subsp. paratuberculosis
ucgccggcgaccgugcccacca

SEQ ID NO: 3009573 - RNA, 17 nt, Mycobacterium avium subsp. paratuberculosis
ucgccggcgacggccag

SEQ ID NO: 3009574 - RNA, 18 nt, Mycobacterium avium subsp. paratuberculosis
ucgccggcgacggccagc

SEQ ID NO: 3009575 - RNA, 22 nt, Mycobacterium avium subsp. paratuberculosis
ucgccggcgacggccagcgcgg

SEQ ID NO: 3009576 - RNA, 13 nt, Mycobacterium avium subsp. paratuberculosis
ucgccggcgaugc

SEQ ID NO: 3009577 - RNA, 14 nt, Mycobacterium avium subsp. paratuberculosis
ucgccggcgccgga

SEQ ID NO: 3009578 - RNA, 16 nt, Mycobacterium avium subsp. paratuberculosis
ucgccggcgccgggcg

SEQ ID NO: 3009579 - RNA, 20 nt, Mycobacterium avium subsp. paratuberculosis
ucgccggcgccgggcgggcg

SEQ ID NO: 3009580 - RNA, 19 nt, Mycobacterium avium subsp. paratuberculosis
ucgccggcgcgcaccccgg

SEQ ID NO: 3009581 - RNA, 14 nt, Mycobacterium avium subsp. paratuberculosis
ucgccggcgcgcag

SEQ ID NO: 3009582 - RNA, 13 nt, Mycobacterium avium subsp. paratuberculosis
ucgccggcgcgcu

SEQ ID NO: 3009583 - RNA, 22 nt, Mycobacterium avium subsp. paratuberculosis
ucgccggcgcggaacagcgucg

SEQ ID NO: 3009584 - RNA, 23 nt, Mycobacterium avium subsp. paratuberculosis
ucgccggcgcggaacagcgucgc

SEQ ID NO: 3009585 - RNA, 16 nt, Mycobacterium avium subsp. paratuberculosis
ucgccggcgcuuugcc

SEQ ID NO: 3009586 - RNA, 16 nt, Mycobacterium avium subsp. paratuberculosis
ucgccggcggccgaca

SEQ ID NO: 3009587 - RNA, 19 nt, Mycobacterium avium subsp. paratuberculosis
ucgccggcggccgccacgc

SEQ ID NO: 3009588 - RNA, 20 nt, Mycobacterium avium subsp. paratuberculosis
ucgccggcggccgccacgcu

SEQ ID NO: 3009589 - RNA, 12 nt, Mycobacterium avium subsp. paratuberculosis
ucgccggcggcg

SEQ ID NO: 3009590 - RNA, 17 nt, Mycobacterium avium subsp. paratuberculosis
ucgccggcggcgaucgc

SEQ ID NO: 3009591 - RNA, 18 nt, Mycobacterium avium subsp. paratuberculosis
ucgccggcggcgcccgcg

SEQ ID NO: 3009592 - RNA, 22 nt, Mycobacterium avium subsp. paratuberculosis
ucgccggcggcgcccgcggccu

SEQ ID NO: 3009593 - RNA, 21 nt, Mycobacterium avium subsp. paratuberculosis
ucgccggcguagaccagcgac

SEQ ID NO: 3009594 - RNA, 23 nt, Mycobacterium avium subsp. paratuberculosis
ucgccggcguagaccagcgacgc

SEQ ID NO: 3009595 - RNA, 18 nt, Mycobacterium avium subsp. paratuberculosis
ucgccggcuaccggcgcu

SEQ ID NO: 3009596 - RNA, 17 nt, Mycobacterium avium subsp. paratuberculosis
ucgccggcugacugccg

SEQ ID NO: 3009597 - RNA, 18 nt, Mycobacterium avium subsp. paratuberculosis
ucgccggcugacugccgg

SEQ ID NO: 3009598 - RNA, 20 nt, Mycobacterium avium subsp. paratuberculosis
ucgccggcugacugccggcg

SEQ ID NO: 3009599 - RNA, 22 nt, Mycobacterium avium subsp. paratuberculosis
ucgccggcugacugccggcgac

SEQ ID NO: 3009600 - RNA, 18 nt, Mycobacterium avium subsp. paratuberculosis
ucgccggcuuaccgaccu

SEQ ID NO: 3009601 - RNA, 21 nt, Mycobacterium avium subsp. paratuberculosis
ucgccgggauggugagcccga

SEQ ID NO: 3009602 - RNA, 21 nt, Mycobacterium avium subsp. paratuberculosis
ucgccgggcagguggucggcg

SEQ ID NO: 3009603 - RNA, 14 nt, Mycobacterium avium subsp. paratuberculosis
ucgccgggcccgcu

SEQ ID NO: 3009604 - RNA, 13 nt, Mycobacterium avium subsp. paratuberculosis
ucgccgggccggc

SEQ ID NO: 3009605 - RNA, 15 nt, Mycobacterium avium subsp. paratuberculosis
ucgccgggccggccg

SEQ ID NO: 3009606 - RNA, 17 nt, Mycobacterium avium subsp. paratuberculosis
ucgccgggcgucacucu

SEQ ID NO: 3009607 - RNA, 18 nt, Mycobacterium avium subsp. paratuberculosis
ucgccgggcugcacgcug

SEQ ID NO: 3009608 - RNA, 21 nt, Mycobacterium avium subsp. paratuberculosis
ucgccgggcuuggucaugaac

SEQ ID NO: 3009609 - RNA, 16 nt, Mycobacterium avium subsp. paratuberculosis
ucgccggggccuucuu

SEQ ID NO: 3009610 - RNA, 15 nt, Mycobacterium avium subsp. paratuberculosis
ucgccggggcgcuga

SEQ ID NO: 3009611 - RNA, 15 nt, Mycobacterium avium subsp. paratuberculosis
ucgccggggucgcgc

SEQ ID NO: 3009612 - RNA, 17 nt, Mycobacterium avium subsp. paratuberculosis
ucgccggggucgcgcgc

SEQ ID NO: 3009613 - RNA, 21 nt, Mycobacterium avium subsp. paratuberculosis
ucgccgggucuuccacgccgg

SEQ ID NO: 3009614 - RNA, 15 nt, Mycobacterium avium subsp. paratuberculosis
ucgccgguaccgccg

SEQ ID NO: 3009615 - RNA, 16 nt, Mycobacterium avium subsp. paratuberculosis
ucgccgguaccgccgg

SEQ ID NO: 3009616 - RNA, 19 nt, Mycobacterium avium subsp. paratuberculosis
ucgccgguaccgccggcca

SEQ ID NO: 3009617 - RNA, 14 nt, Mycobacterium avium subsp. paratuberculosis
ucgccggucagcgc

SEQ ID NO: 3009618 - RNA, 15 nt, Mycobacterium avium subsp. paratuberculosis
ucgccggucagcgca

SEQ ID NO: 3009619 - RNA, 17 nt, Mycobacterium avium subsp. paratuberculosis
ucgccggucagcgcauc

SEQ ID NO: 3009620 - RNA, 15 nt, Mycobacterium avium subsp. paratuberculosis
ucgccggugaccgcg

SEQ ID NO: 3009621 - RNA, 13 nt, Mycobacterium avium subsp. paratuberculosis
ucgccggugaccu

SEQ ID NO: 3009622 - RNA, 15 nt, Mycobacterium avium subsp. paratuberculosis
ucgccggugcggccg

SEQ ID NO: 3009623 - RNA, 16 nt, Mycobacterium avium subsp. paratuberculosis
ucgccggugcggccgc

SEQ ID NO: 3009624 - RNA, 18 nt, Mycobacterium avium subsp. paratuberculosis
ucgccggugucauaccag

SEQ ID NO: 3009625 - RNA, 22 nt, Mycobacterium avium subsp. paratuberculosis
ucgccggugugaucgagcacca

SEQ ID NO: 3009626 - RNA, 20 nt, Mycobacterium avium subsp. paratuberculosis
ucgccguacgcgccggccag

SEQ ID NO: 3009627 - RNA, 22 nt, Mycobacterium avium subsp. paratuberculosis
ucgccguacgcgccggccagcc

SEQ ID NO: 3009628 - RNA, 21 nt, Mycobacterium avium subsp. paratuberculosis
ucgccguacuugacgugcgac

SEQ ID NO: 3009629 - RNA, 19 nt, Mycobacterium avium subsp. paratuberculosis
ucgccguagaauccgccgu

SEQ ID NO: 3009630 - RNA, 18 nt, Mycobacterium avium subsp. paratuberculosis
ucgccgucacaccgcggc

SEQ ID NO: 3009631 - RNA, 14 nt, Mycobacterium avium subsp. paratuberculosis
ucgccgucaccucg

SEQ ID NO: 3009632 - RNA, 22 nt, Mycobacterium avium subsp. paratuberculosis
ucgccgucacugcacgcacggc

SEQ ID NO: 3009633 - RNA, 14 nt, Mycobacterium avium subsp. paratuberculosis
ucgccgucagugcg

SEQ ID NO: 3009634 - RNA, 16 nt, Mycobacterium avium subsp. paratuberculosis
ucgccgucagugcgca

SEQ ID NO: 3009635 - RNA, 22 nt, Mycobacterium avium subsp. paratuberculosis
ucgccguccacgggucgccgug

SEQ ID NO: 3009636 - RNA, 23 nt, Mycobacterium avium subsp. paratuberculosis
ucgccguccacgggucgccgugg

SEQ ID NO: 3009637 - RNA, 13 nt, Mycobacterium avium subsp. paratuberculosis
ucgccguccccac

SEQ ID NO: 3009638 - RNA, 15 nt, Mycobacterium avium subsp. paratuberculosis
ucgccguccggggcc

SEQ ID NO: 3009639 - RNA, 16 nt, Mycobacterium avium subsp. paratuberculosis
ucgccguccucgcguc

SEQ ID NO: 3009640 - RNA, 20 nt, Mycobacterium avium subsp. paratuberculosis
ucgccguccucgcgucgcgc

SEQ ID NO: 3009641 - RNA, 15 nt, Mycobacterium avium subsp. paratuberculosis
ucgccgucgaaggcc

SEQ ID NO: 3009642 - RNA, 21 nt, Mycobacterium avium subsp. paratuberculosis
ucgccgucgaaggccgggcug

SEQ ID NO: 3009643 - RNA, 14 nt, Mycobacterium avium subsp. paratuberculosis
ucgccgucgacggu

SEQ ID NO: 3009644 - RNA, 14 nt, Mycobacterium avium subsp. paratuberculosis
ucgccgucgccgca

SEQ ID NO: 3009645 - RNA, 14 nt, Mycobacterium avium subsp. paratuberculosis
ucgccgucgcgauc

SEQ ID NO: 3009646 - RNA, 16 nt, Mycobacterium avium subsp. paratuberculosis
ucgccgucgcgaucgc

SEQ ID NO: 3009647 - RNA, 17 nt, Mycobacterium avium subsp. paratuberculosis
ucgccgucgcgaucgcg

SEQ ID NO: 3009648 - RNA, 19 nt, Mycobacterium avium subsp. paratuberculosis
ucgccgucgcgggugggga

SEQ ID NO: 3009649 - RNA, 15 nt, Mycobacterium avium subsp. paratuberculosis
ucgccgucggccagc

SEQ ID NO: 3009650 - RNA, 16 nt, Mycobacterium avium subsp. paratuberculosis
ucgccgucggccagca

SEQ ID NO: 3009651 - RNA, 19 nt, Mycobacterium avium subsp. paratuberculosis
ucgccgucggccagcagcg

SEQ ID NO: 3009652 - RNA, 22 nt, Mycobacterium avium subsp. paratuberculosis
ucgccgucggggucgcgccggu

SEQ ID NO: 3009653 - RNA, 16 nt, Mycobacterium avium subsp. paratuberculosis
ucgccgucggugauga

SEQ ID NO: 3009654 - RNA, 20 nt, Mycobacterium avium subsp. paratuberculosis
ucgccgucguauucgacggc

SEQ ID NO: 3009655 - RNA, 20 nt, Mycobacterium avium subsp. paratuberculosis
ucgccgucgugguggccgcg

SEQ ID NO: 3009656 - RNA, 13 nt, Mycobacterium avium subsp. paratuberculosis
ucgccgucguuga

SEQ ID NO: 3009657 - RNA, 22 nt, Mycobacterium avium subsp. paratuberculosis
ucgccgucguugaucaggugca

SEQ ID NO: 3009658 - RNA, 22 nt, Mycobacterium avium subsp. paratuberculosis
ucgccgugagauccagcagcca

SEQ ID NO: 3009659 - RNA, 13 nt, Mycobacterium avium subsp. paratuberculosis
ucgccgugcagca

SEQ ID NO: 3009660 - RNA, 14 nt, Mycobacterium avium subsp. paratuberculosis
ucgccgugcagcac

SEQ ID NO: 3009661 - RNA, 16 nt, Mycobacterium avium subsp. paratuberculosis
ucgccgugcagcaccu

SEQ ID NO: 3009662 - RNA, 17 nt, Mycobacterium avium subsp. paratuberculosis
ucgccgugcagcaccuc

SEQ ID NO: 3009663 - RNA, 19 nt, Mycobacterium avium subsp. paratuberculosis
ucgccgugcagcaccucga

SEQ ID NO: 3009664 - RNA, 15 nt, Mycobacterium avium subsp. paratuberculosis
ucgccgugccggacc

SEQ ID NO: 3009665 - RNA, 18 nt, Mycobacterium avium subsp. paratuberculosis
ucgccgugccggaccgcg

SEQ ID NO: 3009666 - RNA, 19 nt, Mycobacterium avium subsp. paratuberculosis
ucgccgugcggcguucggu

SEQ ID NO: 3009667 - RNA, 17 nt, Mycobacterium avium subsp. paratuberculosis
ucgccguggcggcccga

SEQ ID NO: 3009668 - RNA, 19 nt, Mycobacterium avium subsp. paratuberculosis
ucgccguggcggcccgacc

SEQ ID NO: 3009669 - RNA, 15 nt, Mycobacterium avium subsp. paratuberculosis
ucgccguugccggcc

SEQ ID NO: 3009670 - RNA, 14 nt, Mycobacterium avium subsp. paratuberculosis
ucgccguugcgggu

SEQ ID NO: 3009671 - RNA, 20 nt, Mycobacterium avium subsp. paratuberculosis
ucgccguugcgggucggcgu

SEQ ID NO: 3009672 - RNA, 22 nt, Mycobacterium avium subsp. paratuberculosis
ucgccguuggucugcgcgagca

SEQ ID NO: 3009673 - RNA, 23 nt, Mycobacterium avium subsp. paratuberculosis
ucgccguuggucugcgcgagcag

SEQ ID NO: 3009674 - RNA, 21 nt, Mycobacterium avium subsp. paratuberculosis
ucgccguuuugccgccgagcg

SEQ ID NO: 3009675 - RNA, 22 nt, Mycobacterium avium subsp. paratuberculosis
ucgccucaggcugacgccacgc

SEQ ID NO: 3009676 - RNA, 22 nt, Mycobacterium avium subsp. paratuberculosis
ucgccuccgggaaggcggccgc

SEQ ID NO: 3009677 - RNA, 16 nt, Mycobacterium avium subsp. paratuberculosis
ucgccuccgucagcgc

SEQ ID NO: 3009678 - RNA, 21 nt, Mycobacterium avium subsp. paratuberculosis
ucgccuccgucagcgccgccc

SEQ ID NO: 3009679 - RNA, 19 nt, Mycobacterium avium subsp. paratuberculosis
ucgccuccugcuggcgcug

SEQ ID NO: 3009680 - RNA, 12 nt, Mycobacterium avium subsp. paratuberculosis
ucgccucgacca

SEQ ID NO: 3009681 - RNA, 13 nt, Mycobacterium avium subsp. paratuberculosis
ucgccucgaccag

SEQ ID NO: 3009682 - RNA, 22 nt, Mycobacterium avium subsp. paratuberculosis
ucgccucgaccaggcuuggccc

SEQ ID NO: 3009683 - RNA, 15 nt, Mycobacterium avium subsp. paratuberculosis
ucgccucggccacca

SEQ ID NO: 3009684 - RNA, 23 nt, Mycobacterium avium subsp. paratuberculosis
ucgccucggccaccagaugccgg

SEQ ID NO: 3009685 - RNA, 15 nt, Mycobacterium avium subsp. paratuberculosis
ucgccucggccgcgg

SEQ ID NO: 3009686 - RNA, 21 nt, Mycobacterium avium subsp. paratuberculosis
ucgccucggccuuggccaccg

SEQ ID NO: 3009687 - RNA, 18 nt, Mycobacterium avium subsp. paratuberculosis
ucgccucggcggccgccc

SEQ ID NO: 3009688 - RNA, 20 nt, Mycobacterium avium subsp. paratuberculosis
ucgccucggcggccgcccgg

SEQ ID NO: 3009689 - RNA, 21 nt, Mycobacterium avium subsp. paratuberculosis
ucgccucggggaucgccaggc

SEQ ID NO: 3009690 - RNA, 16 nt, Mycobacterium avium subsp. paratuberculosis
ucgccucggucgcgug

SEQ ID NO: 3009691 - RNA, 12 nt, Mycobacterium avium subsp. paratuberculosis
ucgccucguccc

SEQ ID NO: 3009692 - RNA, 17 nt, Mycobacterium avium subsp. paratuberculosis
ucgccucgucccucguc

SEQ ID NO: 3009693 - RNA, 17 nt, Mycobacterium avium subsp. paratuberculosis
ucgccugauacgacguc

SEQ ID NO: 3009694 - RNA, 22 nt, Mycobacterium avium subsp. paratuberculosis
ucgccugcacgaaauaaccgcg

SEQ ID NO: 3009695 - RNA, 15 nt, Mycobacterium avium subsp. paratuberculosis
ucgccugcagccgcc

SEQ ID NO: 3009696 - RNA, 16 nt, Mycobacterium avium subsp. paratuberculosis
ucgccugcagccgccg

SEQ ID NO: 3009697 - RNA, 16 nt, Mycobacterium avium subsp. paratuberculosis
ucgccugcuggacguu

SEQ ID NO: 3009698 - RNA, 21 nt, Mycobacterium avium subsp. paratuberculosis
ucgccugcuucuggaugcggu

SEQ ID NO: 3009699 - RNA, 15 nt, Mycobacterium avium subsp. paratuberculosis
ucgccuguccgacca

SEQ ID NO: 3009700 - RNA, 17 nt, Mycobacterium avium subsp. paratuberculosis
ucgccuguccgaccagc

SEQ ID NO: 3009701 - RNA, 18 nt, Mycobacterium avium subsp. paratuberculosis
ucgccuuggcucgggcca

SEQ ID NO: 3009702 - RNA, 20 nt, Mycobacterium avium subsp. paratuberculosis
ucgccuuggcucgggccaua

SEQ ID NO: 3009703 - RNA, 17 nt, Mycobacterium avium subsp. paratuberculosis
ucgccuuguuggcccac

SEQ ID NO: 3009704 - RNA, 20 nt, Mycobacterium avium subsp. paratuberculosis
ucgccuuugaugacgacgug

SEQ ID NO: 3009705 - RNA, 15 nt, Mycobacterium avium subsp. paratuberculosis
ucgcgaacgcgccgg

SEQ ID NO: 3009706 - RNA, 16 nt, Mycobacterium avium subsp. paratuberculosis
ucgcgaacgcgccggu

SEQ ID NO: 3009707 - RNA, 19 nt, Mycobacterium avium subsp. paratuberculosis
ucgcgaacuucaggcccuc

SEQ ID NO: 3009708 - RNA, 16 nt, Mycobacterium avium subsp. paratuberculosis
ucgcgaagaacgacgc

SEQ ID NO: 3009709 - RNA, 22 nt, Mycobacterium avium subsp. paratuberculosis
ucgcgaagaacgacgccaccgc

SEQ ID NO: 3009710 - RNA, 22 nt, Mycobacterium avium subsp. paratuberculosis
ucgcgaagaccagcgugucgcc

SEQ ID NO: 3009711 - RNA, 23 nt, Mycobacterium avium subsp. paratuberculosis
ucgcgaagaccagcgugucgccg

SEQ ID NO: 3009712 - RNA, 19 nt, Mycobacterium avium subsp. paratuberculosis
ucgcgaagacgcuggccac

SEQ ID NO: 3009713 - RNA, 23 nt, Mycobacterium avium subsp. paratuberculosis
ucgcgaagacgcuggccacgauc

SEQ ID NO: 3009714 - RNA, 21 nt, Mycobacterium avium subsp. paratuberculosis
ucgcgaaguagacgagcucac

SEQ ID NO: 3009715 - RNA, 15 nt, Mycobacterium avium subsp. paratuberculosis
ucgcgaccaccggcc

SEQ ID NO: 3009716 - RNA, 16 nt, Mycobacterium avium subsp. paratuberculosis
ucgcgaccaccggccg

SEQ ID NO: 3009717 - RNA, 18 nt, Mycobacterium avium subsp. paratuberculosis
ucgcgacccgguccaccu

SEQ ID NO: 3009718 - RNA, 18 nt, Mycobacterium avium subsp. paratuberculosis
ucgcgaccgccggacacc

SEQ ID NO: 3009719 - RNA, 18 nt, Mycobacterium avium subsp. paratuberculosis
ucgcgacgagcgggccga

SEQ ID NO: 3009720 - RNA, 21 nt, Mycobacterium avium subsp. paratuberculosis
ucgcgacgcggcucgcgcggu

SEQ ID NO: 3009721 - RNA, 18 nt, Mycobacterium avium subsp. paratuberculosis
ucgcgacggccggggcca

SEQ ID NO: 3009722 - RNA, 21 nt, Mycobacterium avium subsp. paratuberculosis
ucgcgacggccggggccagca

SEQ ID NO: 3009723 - RNA, 14 nt, Mycobacterium avium subsp. paratuberculosis
ucgcgaggccgcca

SEQ ID NO: 3009724 - RNA, 18 nt, Mycobacterium avium subsp. paratuberculosis
ucgcgauagggccggccg

SEQ ID NO: 3009725 - RNA, 21 nt, Mycobacterium avium subsp. paratuberculosis
ucgcgauagggccggccggac

SEQ ID NO: 3009726 - RNA, 19 nt, Mycobacterium avium subsp. paratuberculosis
ucgcgaucaacugaucgag

SEQ ID NO: 3009727 - RNA, 18 nt, Mycobacterium avium subsp. paratuberculosis
ucgcgaucacaccaccac

SEQ ID NO: 3009728 - RNA, 13 nt, Mycobacterium avium subsp. paratuberculosis
ucgcgaucaccgc

SEQ ID NO: 3009729 - RNA, 22 nt, Mycobacterium avium subsp. paratuberculosis
ucgcgaucaccgcggccaccac

SEQ ID NO: 3009730 - RNA, 18 nt, Mycobacterium avium subsp. paratuberculosis
ucgcgauccgggcgccgg

SEQ ID NO: 3009731 - RNA, 19 nt, Mycobacterium avium subsp. paratuberculosis
ucgcgauccgggcgccggc

SEQ ID NO: 3009732 - RNA, 24 nt, Mycobacterium avium subsp. paratuberculosis
ucgcgauccgggcgccggccggcg

SEQ ID NO: 3009733 - RNA, 18 nt, Mycobacterium avium subsp. paratuberculosis
ucgcgaucgacagcucca

SEQ ID NO: 3009734 - RNA, 16 nt, Mycobacterium avium subsp. paratuberculosis
ucgcgaucgccgaucc

SEQ ID NO: 3009735 - RNA, 20 nt, Mycobacterium avium subsp. paratuberculosis
ucgcgaucgccgauccggcg

SEQ ID NO: 3009736 - RNA, 20 nt, Mycobacterium avium subsp. paratuberculosis
ucgcgaucgcgguccaggau

SEQ ID NO: 3009737 - RNA, 19 nt, Mycobacterium avium subsp. paratuberculosis
ucgcgaugcccaagccggc

SEQ ID NO: 3009738 - RNA, 23 nt, Mycobacterium avium subsp. paratuberculosis
ucgcgauggaggucccgaggagg

SEQ ID NO: 3009739 - RNA, 14 nt, Mycobacterium avium subsp. paratuberculosis
ucgcgaugucgacg

SEQ ID NO: 3009740 - RNA, 21 nt, Mycobacterium avium subsp. paratuberculosis
ucgcgauuggccucgagugcc

SEQ ID NO: 3009741 - RNA, 18 nt, Mycobacterium avium subsp. paratuberculosis
ucgcgcaacaacuucgcg

SEQ ID NO: 3009742 - RNA, 22 nt, Mycobacterium avium subsp. paratuberculosis
ucgcgcaauaacggagcggccu

SEQ ID NO: 3009743 - RNA, 19 nt, Mycobacterium avium subsp. paratuberculosis
ucgcgcaaugccgccgcga

SEQ ID NO: 3009744 - RNA, 22 nt, Mycobacterium avium subsp. paratuberculosis
ucgcgcaaugccgccgcgacga

SEQ ID NO: 3009745 - RNA, 23 nt, Mycobacterium avium subsp. paratuberculosis
ucgcgcaaugccgccgcgacgau

SEQ ID NO: 3009746 - RNA, 15 nt, Mycobacterium avium subsp. paratuberculosis
ucgcgcaccagggcc

SEQ ID NO: 3009747 - RNA, 18 nt, Mycobacterium avium subsp. paratuberculosis
ucgcgcaccauccgcgac

SEQ ID NO: 3009748 - RNA, 22 nt, Mycobacterium avium subsp. paratuberculosis
ucgcgcaccauccgcgacgcca

SEQ ID NO: 3009749 - RNA, 12 nt, Mycobacterium avium subsp. paratuberculosis
ucgcgcacccgc

SEQ ID NO: 3009750 - RNA, 19 nt, Mycobacterium avium subsp. paratuberculosis
ucgcgcacccgcacgugcg

SEQ ID NO: 3009751 - RNA, 10 nt, Mycobacterium avium subsp. paratuberculosis
ucgcgcaccg

SEQ ID NO: 3009752 - RNA, 14 nt, Mycobacterium avium subsp. paratuberculosis
ucgcgcaccgcggc

SEQ ID NO: 3009753 - RNA, 16 nt, Mycobacterium avium subsp. paratuberculosis
ucgcgcaccgcgggcu

SEQ ID NO: 3009754 - RNA, 14 nt, Mycobacterium avium subsp. paratuberculosis
ucgcgcaccggcug

SEQ ID NO: 3009755 - RNA, 20 nt, Mycobacterium avium subsp. paratuberculosis
ucgcgcaccuucccggccgc

SEQ ID NO: 3009756 - RNA, 16 nt, Mycobacterium avium subsp. paratuberculosis
ucgcgcacgccaucgc

SEQ ID NO: 3009757 - RNA, 22 nt, Mycobacterium avium subsp. paratuberculosis
ucgcgcacgccaucgccucggc

SEQ ID NO: 3009758 - RNA, 12 nt, Mycobacterium avium subsp. paratuberculosis
ucgcgcacgcug

SEQ ID NO: 3009759 - RNA, 14 nt, Mycobacterium avium subsp. paratuberculosis
ucgcgcacggcgcg

SEQ ID NO: 3009760 - RNA, 12 nt, Mycobacterium avium subsp. paratuberculosis
ucgcgcacgucg

SEQ ID NO: 3009761 - RNA, 20 nt, Mycobacterium avium subsp. paratuberculosis
ucgcgcacuucgcgggcggc

SEQ ID NO: 3009762 - RNA, 21 nt, Mycobacterium avium subsp. paratuberculosis
ucgcgcacuucgcgggcggcg

SEQ ID NO: 3009763 - RNA, 23 nt, Mycobacterium avium subsp. paratuberculosis
ucgcgcacuucgcgggcggcgca

SEQ ID NO: 3009764 - RNA, 19 nt, Mycobacterium avium subsp. paratuberculosis
ucgcgcagaaagcgauugg

SEQ ID NO: 3009765 - RNA, 16 nt, Mycobacterium avium subsp. paratuberculosis
ucgcgcagcaacggua

SEQ ID NO: 3009766 - RNA, 18 nt, Mycobacterium avium subsp. paratuberculosis
ucgcgcagcaacgguacg

SEQ ID NO: 3009767 - RNA, 14 nt, Mycobacterium avium subsp. paratuberculosis
ucgcgcagcaccuc

SEQ ID NO: 3009768 - RNA, 22 nt, Mycobacterium avium subsp. paratuberculosis
ucgcgcagcagcugcacccgcu

SEQ ID NO: 3009769 - RNA, 20 nt, Mycobacterium avium subsp. paratuberculosis
ucgcgcagcauccgcaccag

SEQ ID NO: 3009770 - RNA, 23 nt, Mycobacterium avium subsp. paratuberculosis
ucgcgcagcauccgcaccaggua

SEQ ID NO: 3009771 - RNA, 20 nt, Mycobacterium avium subsp. paratuberculosis
ucgcgcagcauggcccacag

SEQ ID NO: 3009772 - RNA, 17 nt, Mycobacterium avium subsp. paratuberculosis
ucgcgcagcccccggac

SEQ ID NO: 3009773 - RNA, 14 nt, Mycobacterium avium subsp. paratuberculosis
ucgcgcagcccgau

SEQ ID NO: 3009774 - RNA, 16 nt, Mycobacterium avium subsp. paratuberculosis
ucgcgcagcccgaucg

SEQ ID NO: 3009775 - RNA, 22 nt, Mycobacterium avium subsp. paratuberculosis
ucgcgcagcccgaucgccagcg

SEQ ID NO: 3009776 - RNA, 13 nt, Mycobacterium avium subsp. paratuberculosis
ucgcgcagccgcc

SEQ ID NO: 3009777 - RNA, 15 nt, Mycobacterium avium subsp. paratuberculosis
ucgcgcagccgccgg

SEQ ID NO: 3009778 - RNA, 22 nt, Mycobacterium avium subsp. paratuberculosis
ucgcgcagccgcgguggcggug

SEQ ID NO: 3009779 - RNA, 15 nt, Mycobacterium avium subsp. paratuberculosis
ucgcgcagccggccg

SEQ ID NO: 3009780 - RNA, 16 nt, Mycobacterium avium subsp. paratuberculosis
ucgcgcagccggccga

SEQ ID NO: 3009781 - RNA, 18 nt, Mycobacterium avium subsp. paratuberculosis
ucgcgcagccgggcggcg

SEQ ID NO: 3009782 - RNA, 20 nt, Mycobacterium avium subsp. paratuberculosis
ucgcgcagccgggcggcgcu

SEQ ID NO: 3009783 - RNA, 14 nt, Mycobacterium avium subsp. paratuberculosis
ucgcgcagcgaagc

SEQ ID NO: 3009784 - RNA, 13 nt, Mycobacterium avium subsp. paratuberculosis
ucgcgcagcgcgu

SEQ ID NO: 3009785 - RNA, 16 nt, Mycobacterium avium subsp. paratuberculosis
ucgcgcagcgcgucgg

SEQ ID NO: 3009786 - RNA, 18 nt, Mycobacterium avium subsp. paratuberculosis
ucgcgcagcgcgucgggc

SEQ ID NO: 3009787 - RNA, 20 nt, Mycobacterium avium subsp. paratuberculosis
ucgcgcagcugcgccgcguc

SEQ ID NO: 3009788 - RNA, 17 nt, Mycobacterium avium subsp. paratuberculosis
ucgcgcagcuggccgug

SEQ ID NO: 3009789 - RNA, 23 nt, Mycobacterium avium subsp. paratuberculosis
ucgcgcaggaacagcgacccgaa

SEQ ID NO: 3009790 - RNA, 22 nt, Mycobacterium avium subsp. paratuberculosis
ucgcgcaggaacuccagcagcu

SEQ ID NO: 3009791 - RNA, 19 nt, Mycobacterium avium subsp. paratuberculosis
ucgcgcaggaugcccagca

SEQ ID NO: 3009792 - RNA, 21 nt, Mycobacterium avium subsp. paratuberculosis
ucgcgcaggaugcccagcacc

SEQ ID NO: 3009793 - RNA, 14 nt, Mycobacterium avium subsp. paratuberculosis
ucgcgcagggccag

SEQ ID NO: 3009794 - RNA, 23 nt, Mycobacterium avium subsp. paratuberculosis
ucgcgcagggccagcgccucggc

SEQ ID NO: 3009795 - RNA, 16 nt, Mycobacterium avium subsp. paratuberculosis
ucgcgcaucacccggc

SEQ ID NO: 3009796 - RNA, 18 nt, Mycobacterium avium subsp. paratuberculosis
ucgcgcaucacccggcgc

SEQ ID NO: 3009797 - RNA, 19 nt, Mycobacterium avium subsp. paratuberculosis
ucgcgcaucacccggcgcg

SEQ ID NO: 3009798 - RNA, 20 nt, Mycobacterium avium subsp. paratuberculosis
ucgcgcaucacccggcgcgc

SEQ ID NO: 3009799 - RNA, 14 nt, Mycobacterium avium subsp. paratuberculosis
ucgcgcaucgccuc

SEQ ID NO: 3009800 - RNA, 20 nt, Mycobacterium avium subsp. paratuberculosis
ucgcgcaucgccucggcggc

SEQ ID NO: 3009801 - RNA, 14 nt, Mycobacterium avium subsp. paratuberculosis
ucgcgccagacguc

SEQ ID NO: 3009802 - RNA, 17 nt, Mycobacterium avium subsp. paratuberculosis
ucgcgccaggaccagcg

SEQ ID NO: 3009803 - RNA, 14 nt, Mycobacterium avium subsp. paratuberculosis
ucgcgcccggccag

SEQ ID NO: 3009804 - RNA, 13 nt, Mycobacterium avium subsp. paratuberculosis
ucgcgcccggcgc

SEQ ID NO: 3009805 - RNA, 13 nt, Mycobacterium avium subsp. paratuberculosis
ucgcgcccggcgu

SEQ ID NO: 3009806 - RNA, 14 nt, Mycobacterium avium subsp. paratuberculosis
ucgcgcccggcguc

SEQ ID NO: 3009807 - RNA, 16 nt, Mycobacterium avium subsp. paratuberculosis
ucgcgcccggcgucgg

SEQ ID NO: 3009808 - RNA, 21 nt, Mycobacterium avium subsp. paratuberculosis
ucgcgcccuaacgugcccggc

SEQ ID NO: 3009809 - RNA, 23 nt, Mycobacterium avium subsp. paratuberculosis
ucgcgcccuaacgugcccggccc

SEQ ID NO: 3009810 - RNA, 18 nt, Mycobacterium avium subsp. paratuberculosis
ucgcgcccuggaucgcgc

SEQ ID NO: 3009811 - RNA, 16 nt, Mycobacterium avium subsp. paratuberculosis
ucgcgccgacccgccc

SEQ ID NO: 3009812 - RNA, 18 nt, Mycobacterium avium subsp. paratuberculosis
ucgcgccgacccgcccgc

SEQ ID NO: 3009813 - RNA, 14 nt, Mycobacterium avium subsp. paratuberculosis
ucgcgccgaggugg

SEQ ID NO: 3009814 - RNA, 22 nt, Mycobacterium avium subsp. paratuberculosis
ucgcgccgaucugaccgagcag

SEQ ID NO: 3009815 - RNA, 23 nt, Mycobacterium avium subsp. paratuberculosis
ucgcgccgaucugaccgagcagc

SEQ ID NO: 3009816 - RNA, 18 nt, Mycobacterium avium subsp. paratuberculosis
ucgcgccgccacgcggcg

SEQ ID NO: 3009817 - RNA, 20 nt, Mycobacterium avium subsp. paratuberculosis
ucgcgccgcgaucucggcgg

SEQ ID NO: 3009818 - RNA, 13 nt, Mycobacterium avium subsp. paratuberculosis
ucgcgccgcggcg

SEQ ID NO: 3009819 - RNA, 21 nt, Mycobacterium avium subsp. paratuberculosis
ucgcgccgcgucgcgccgccg

SEQ ID NO: 3009820 - RNA, 14 nt, Mycobacterium avium subsp. paratuberculosis
ucgcgccgcucggc

SEQ ID NO: 3009821 - RNA, 16 nt, Mycobacterium avium subsp. paratuberculosis
ucgcgccgcucggcca

SEQ ID NO: 3009822 - RNA, 18 nt, Mycobacterium avium subsp. paratuberculosis
ucgcgccgcucggccagc

SEQ ID NO: 3009823 - RNA, 19 nt, Mycobacterium avium subsp. paratuberculosis
ucgcgccgcucggccagca

SEQ ID NO: 3009824 - RNA, 15 nt, Mycobacterium avium subsp. paratuberculosis
ucgcgccggagccgg

SEQ ID NO: 3009825 - RNA, 13 nt, Mycobacterium avium subsp. paratuberculosis
ucgcgccggccgc

SEQ ID NO: 3009826 - RNA, 15 nt, Mycobacterium avium subsp. paratuberculosis
ucgcgccggccgccg

SEQ ID NO: 3009827 - RNA, 12 nt, Mycobacterium avium subsp. paratuberculosis
ucgcgccgggcg

SEQ ID NO: 3009828 - RNA, 14 nt, Mycobacterium avium subsp. paratuberculosis
ucgcgccgggcggc

SEQ ID NO: 3009829 - RNA, 20 nt, Mycobacterium avium subsp. paratuberculosis
ucgcgccgguaggcggccag

SEQ ID NO: 3009830 - RNA, 20 nt, Mycobacterium avium subsp. paratuberculosis
ucgcgccugcaccggcgacg

SEQ ID NO: 3009831 - RNA, 16 nt, Mycobacterium avium subsp. paratuberculosis
ucgcgccuugggccau

SEQ ID NO: 3009832 - RNA, 18 nt, Mycobacterium avium subsp. paratuberculosis
ucgcgcgaacagccgacc

SEQ ID NO: 3009833 - RNA, 19 nt, Mycobacterium avium subsp. paratuberculosis
ucgcgcgaacagccgaccg

SEQ ID NO: 3009834 - RNA, 15 nt, Mycobacterium avium subsp. paratuberculosis
ucgcgcgacugggcg

SEQ ID NO: 3009835 - RNA, 12 nt, Mycobacterium avium subsp. paratuberculosis
ucgcgcgccggc

SEQ ID NO: 3009836 - RNA, 14 nt, Mycobacterium avium subsp. paratuberculosis
ucgcgcgccggcgc

SEQ ID NO: 3009837 - RNA, 16 nt, Mycobacterium avium subsp. paratuberculosis
ucgcgcgcggcgacgg

SEQ ID NO: 3009838 - RNA, 17 nt, Mycobacterium avium subsp. paratuberculosis
ucgcgcgcggcgacggu

SEQ ID NO: 3009839 - RNA, 15 nt, Mycobacterium avium subsp. paratuberculosis
ucgcgcgcggcggcc

SEQ ID NO: 3009840 - RNA, 20 nt, Mycobacterium avium subsp. paratuberculosis
ucgcgcgcggcggccaccgc

SEQ ID NO: 3009841 - RNA, 21 nt, Mycobacterium avium subsp. paratuberculosis
ucgcgcgcggcggccaccgcg

SEQ ID NO: 3009842 - RNA, 14 nt, Mycobacterium avium subsp. paratuberculosis
ucgcgcggcaccac

SEQ ID NO: 3009843 - RNA, 17 nt, Mycobacterium avium subsp. paratuberculosis
ucgcgcggcaccaccag

SEQ ID NO: 3009844 - RNA, 14 nt, Mycobacterium avium subsp. paratuberculosis
ucgcgcggcaucgu

SEQ ID NO: 3009845 - RNA, 16 nt, Mycobacterium avium subsp. paratuberculosis
ucgcgcggcugcucga

SEQ ID NO: 3009846 - RNA, 17 nt, Mycobacterium avium subsp. paratuberculosis
ucgcgcggggcggccgc

SEQ ID NO: 3009847 - RNA, 22 nt, Mycobacterium avium subsp. paratuberculosis
ucgcgcggggcggccgccgggc

SEQ ID NO: 3009848 - RNA, 19 nt, Mycobacterium avium subsp. paratuberculosis
ucgcgcggggucgggccgg

SEQ ID NO: 3009849 - RNA, 19 nt, Mycobacterium avium subsp. paratuberculosis
ucgcgcggggugacgcccg

SEQ ID NO: 3009850 - RNA, 21 nt, Mycobacterium avium subsp. paratuberculosis
ucgcgcggggugacgcccguc

SEQ ID NO: 3009851 - RNA, 16 nt, Mycobacterium avium subsp. paratuberculosis
ucgcgcgggucgagca

SEQ ID NO: 3009852 - RNA, 13 nt, Mycobacterium avium subsp. paratuberculosis
ucgcgcgguguuu

SEQ ID NO: 3009853 - RNA, 20 nt, Mycobacterium avium subsp. paratuberculosis
ucgcgcgguguuuggccgcg

SEQ ID NO: 3009854 - RNA, 21 nt, Mycobacterium avium subsp. paratuberculosis
ucgcgcgucacgcuggcguga

SEQ ID NO: 3009855 - RNA, 18 nt, Mycobacterium avium subsp. paratuberculosis
ucgcgcuaggacgcgggc

SEQ ID NO: 3009856 - RNA, 19 nt, Mycobacterium avium subsp. paratuberculosis
ucgcgcucauaucccguca

SEQ ID NO: 3009857 - RNA, 13 nt, Mycobacterium avium subsp. paratuberculosis
ucgcgcucccggc

SEQ ID NO: 3009858 - RNA, 14 nt, Mycobacterium avium subsp. paratuberculosis
ucgcgcucgacgau

SEQ ID NO: 3009859 - RNA, 12 nt, Mycobacterium avium subsp. paratuberculosis
ucgcgcucgucc

SEQ ID NO: 3009860 - RNA, 13 nt, Mycobacterium avium subsp. paratuberculosis
ucgcgcucgucca

SEQ ID NO: 3009861 - RNA, 12 nt, Mycobacterium avium subsp. paratuberculosis
ucgcgcugacca

SEQ ID NO: 3009862 - RNA, 13 nt, Mycobacterium avium subsp. paratuberculosis
ucgcgcugaccag

SEQ ID NO: 3009863 - RNA, 15 nt, Mycobacterium avium subsp. paratuberculosis
ucgcgcugccagggc

SEQ ID NO: 3009864 - RNA, 16 nt, Mycobacterium avium subsp. paratuberculosis
ucgcgcugccagggcc

SEQ ID NO: 3009865 - RNA, 20 nt, Mycobacterium avium subsp. paratuberculosis
ucgcgcugccagggccgggc

SEQ ID NO: 3009866 - RNA, 20 nt, Mycobacterium avium subsp. paratuberculosis
ucgcgcugccgcgcgccgac

SEQ ID NO: 3009867 - RNA, 22 nt, Mycobacterium avium subsp. paratuberculosis
ucgcgcugccgcgcgccgacag

SEQ ID NO: 3009868 - RNA, 17 nt, Mycobacterium avium subsp. paratuberculosis
ucgcgcugccggcccga

SEQ ID NO: 3009869 - RNA, 18 nt, Mycobacterium avium subsp. paratuberculosis
ucgcgcugccggcccgau

SEQ ID NO: 3009870 - RNA, 12 nt, Mycobacterium avium subsp. paratuberculosis
ucgcgcuggcgg

SEQ ID NO: 3009871 - RNA, 21 nt, Mycobacterium avium subsp. paratuberculosis
ucgcgcuggggugcucgauca

SEQ ID NO: 3009872 - RNA, 15 nt, Mycobacterium avium subsp. paratuberculosis
ucgcggaaccggccg

SEQ ID NO: 3009873 - RNA, 23 nt, Mycobacterium avium subsp. paratuberculosis
ucgcggaacugcucccaggcguc

SEQ ID NO: 3009874 - RNA, 18 nt, Mycobacterium avium subsp. paratuberculosis
ucgcggacccuggccagc

SEQ ID NO: 3009875 - RNA, 19 nt, Mycobacterium avium subsp. paratuberculosis
ucgcggacccuggccagca

SEQ ID NO: 3009876 - RNA, 23 nt, Mycobacterium avium subsp. paratuberculosis
ucgcggacccuggccagcaccgc

SEQ ID NO: 3009877 - RNA, 17 nt, Mycobacterium avium subsp. paratuberculosis
ucgcggauacgcccggc

SEQ ID NO: 3009878 - RNA, 20 nt, Mycobacterium avium subsp. paratuberculosis
ucgcggauacgcccggccac

SEQ ID NO: 3009879 - RNA, 21 nt, Mycobacterium avium subsp. paratuberculosis
ucgcggaucaugauccggaag

SEQ ID NO: 3009880 - RNA, 14 nt, Mycobacterium avium subsp. paratuberculosis
ucgcggauccgcag

SEQ ID NO: 3009881 - RNA, 16 nt, Mycobacterium avium subsp. paratuberculosis
ucgcggauccgggccg

SEQ ID NO: 3009882 - RNA, 18 nt, Mycobacterium avium subsp. paratuberculosis
ucgcggauccgggccgcc

SEQ ID NO: 3009883 - RNA, 20 nt, Mycobacterium avium subsp. paratuberculosis
ucgcggaucgaacagggcgg

SEQ ID NO: 3009884 - RNA, 22 nt, Mycobacterium avium subsp. paratuberculosis
ucgcggaucgaacagggcggcg

SEQ ID NO: 3009885 - RNA, 14 nt, Mycobacterium avium subsp. paratuberculosis
ucgcggaucgaguu

SEQ ID NO: 3009886 - RNA, 19 nt, Mycobacterium avium subsp. paratuberculosis
ucgcggaucucggugagca

SEQ ID NO: 3009887 - RNA, 18 nt, Mycobacterium avium subsp. paratuberculosis
ucgcggaucucgucgggc

SEQ ID NO: 3009888 - RNA, 17 nt, Mycobacterium avium subsp. paratuberculosis
ucgcggaugcgggcgcu

SEQ ID NO: 3009889 - RNA, 15 nt, Mycobacterium avium subsp. paratuberculosis
ucgcggcaaggcgca

SEQ ID NO: 3009890 - RNA, 20 nt, Mycobacterium avium subsp. paratuberculosis
ucgcggcaaggcgcagaagc

SEQ ID NO: 3009891 - RNA, 21 nt, Mycobacterium avium subsp. paratuberculosis
ucgcggcagccuuuccacauc

SEQ ID NO: 3009892 - RNA, 21 nt, Mycobacterium avium subsp. paratuberculosis
ucgcggccaccacgacgccgg

SEQ ID NO: 3009893 - RNA, 13 nt, Mycobacterium avium subsp. paratuberculosis
ucgcggccagcgu

SEQ ID NO: 3009894 - RNA, 17 nt, Mycobacterium avium subsp. paratuberculosis
ucgcggccagcgugaac

SEQ ID NO: 3009895 - RNA, 22 nt, Mycobacterium avium subsp. paratuberculosis
ucgcggccagcgugaacaccgc

SEQ ID NO: 3009896 - RNA, 15 nt, Mycobacterium avium subsp. paratuberculosis
ucgcggcccacccgc

SEQ ID NO: 3009897 - RNA, 22 nt, Mycobacterium avium subsp. paratuberculosis
ucgcggcccacccgcagggcgc

SEQ ID NO: 3009898 - RNA, 13 nt, Mycobacterium avium subsp. paratuberculosis
ucgcggcccagca

SEQ ID NO: 3009899 - RNA, 16 nt, Mycobacterium avium subsp. paratuberculosis
ucgcggcccagcacca

SEQ ID NO: 3009900 - RNA, 17 nt, Mycobacterium avium subsp. paratuberculosis
ucgcggcccagcaccac

SEQ ID NO: 3009901 - RNA, 18 nt, Mycobacterium avium subsp. paratuberculosis
ucgcggcccccacgcagc

SEQ ID NO: 3009902 - RNA, 16 nt, Mycobacterium avium subsp. paratuberculosis
ucgcggcccgccgcuc

SEQ ID NO: 3009903 - RNA, 23 nt, Mycobacterium avium subsp. paratuberculosis
ucgcggcccgccgcucaccgccg

SEQ ID NO: 3009904 - RNA, 12 nt, Mycobacterium avium subsp. paratuberculosis
ucgcggcccgcg

SEQ ID NO: 3009905 - RNA, 17 nt, Mycobacterium avium subsp. paratuberculosis
ucgcggcccgcggggcg

SEQ ID NO: 3009906 - RNA, 13 nt, Mycobacterium avium subsp. paratuberculosis
ucgcggcccugga

SEQ ID NO: 3009907 - RNA, 15 nt, Mycobacterium avium subsp. paratuberculosis
ucgcggccgcccggu

SEQ ID NO: 3009908 - RNA, 13 nt, Mycobacterium avium subsp. paratuberculosis
ucgcggccgccgg

SEQ ID NO: 3009909 - RNA, 14 nt, Mycobacterium avium subsp. paratuberculosis
ucgcggccggcgag

SEQ ID NO: 3009910 - RNA, 20 nt, Mycobacterium avium subsp. paratuberculosis
ucgcggccguguacagcagg

SEQ ID NO: 3009911 - RNA, 23 nt, Mycobacterium avium subsp. paratuberculosis
ucgcggccguguacagcaggguc

SEQ ID NO: 3009912 - RNA, 19 nt, Mycobacterium avium subsp. paratuberculosis
ucgcggccuccgagcggcg

SEQ ID NO: 3009913 - RNA, 16 nt, Mycobacterium avium subsp. paratuberculosis
ucgcggccugcgggcg

SEQ ID NO: 3009914 - RNA, 17 nt, Mycobacterium avium subsp. paratuberculosis
ucgcggccuugcgggcc

SEQ ID NO: 3009915 - RNA, 18 nt, Mycobacterium avium subsp. paratuberculosis
ucgcggccuugcgggccg

SEQ ID NO: 3009916 - RNA, 14 nt, Mycobacterium avium subsp. paratuberculosis
ucgcggcgaaccag

SEQ ID NO: 3009917 - RNA, 16 nt, Mycobacterium avium subsp. paratuberculosis
ucgcggcgagcagcgc

SEQ ID NO: 3009918 - RNA, 18 nt, Mycobacterium avium subsp. paratuberculosis
ucgcggcgagcagcgcga

SEQ ID NO: 3009919 - RNA, 19 nt, Mycobacterium avium subsp. paratuberculosis
ucgcggcgagcagcgcgau

SEQ ID NO: 3009920 - RNA, 13 nt, Mycobacterium avium subsp. paratuberculosis
ucgcggcgaucag

SEQ ID NO: 3009921 - RNA, 19 nt, Mycobacterium avium subsp. paratuberculosis
ucgcggcgaucagcccggc

SEQ ID NO: 3009922 - RNA, 16 nt, Mycobacterium avium subsp. paratuberculosis
ucgcggcgaugguguc

SEQ ID NO: 3009923 - RNA, 18 nt, Mycobacterium avium subsp. paratuberculosis
ucgcggcgcacccgggca

SEQ ID NO: 3009924 - RNA, 22 nt, Mycobacterium avium subsp. paratuberculosis
ucgcggcgcacccgggcagcuu

SEQ ID NO: 3009925 - RNA, 15 nt, Mycobacterium avium subsp. paratuberculosis
ucgcggcgcacggug

SEQ ID NO: 3009926 - RNA, 22 nt, Mycobacterium avium subsp. paratuberculosis
ucgcggcgcacggugcccgucg

SEQ ID NO: 3009927 - RNA, 17 nt, Mycobacterium avium subsp. paratuberculosis
ucgcggcgcagcacggc

SEQ ID NO: 3009928 - RNA, 13 nt, Mycobacterium avium subsp. paratuberculosis
ucgcggcgcagcu

SEQ ID NO: 3009929 - RNA, 13 nt, Mycobacterium avium subsp. paratuberculosis
ucgcggcgccggu

SEQ ID NO: 3009930 - RNA, 22 nt, Mycobacterium avium subsp. paratuberculosis
ucgcggcgccgguuuccaggac

SEQ ID NO: 3009931 - RNA, 18 nt, Mycobacterium avium subsp. paratuberculosis
ucgcggcgcugccgccgg

SEQ ID NO: 3009932 - RNA, 13 nt, Mycobacterium avium subsp. paratuberculosis
ucgcggcgcugcg

SEQ ID NO: 3009933 - RNA, 15 nt, Mycobacterium avium subsp. paratuberculosis
ucgcggcggacagca

SEQ ID NO: 3009934 - RNA, 14 nt, Mycobacterium avium subsp. paratuberculosis
ucgcggcggcccgu

SEQ ID NO: 3009935 - RNA, 15 nt, Mycobacterium avium subsp. paratuberculosis
ucgcggcggcccguc

SEQ ID NO: 3009936 - RNA, 16 nt, Mycobacterium avium subsp. paratuberculosis
ucgcggcggcccgucg

SEQ ID NO: 3009937 - RNA, 21 nt, Mycobacterium avium subsp. paratuberculosis
ucgcggcggccgacgcgccgu

SEQ ID NO: 3009938 - RNA, 15 nt, Mycobacterium avium subsp. paratuberculosis
ucgcggcggccggcg

SEQ ID NO: 3009939 - RNA, 16 nt, Mycobacterium avium subsp. paratuberculosis
ucgcggcggccggcgc

SEQ ID NO: 3009940 - RNA, 16 nt, Mycobacterium avium subsp. paratuberculosis
ucgcggcggcgccgca

SEQ ID NO: 3009941 - RNA, 18 nt, Mycobacterium avium subsp. paratuberculosis
ucgcggcggcgccgcagc

SEQ ID NO: 3009942 - RNA, 22 nt, Mycobacterium avium subsp. paratuberculosis
ucgcggcggcgccgcagcacgc

SEQ ID NO: 3009943 - RNA, 20 nt, Mycobacterium avium subsp. paratuberculosis
ucgcggcggcgcuggucggc

SEQ ID NO: 3009944 - RNA, 24 nt, Mycobacterium avium subsp. paratuberculosis
ucgcggcggcguacgcgauggcgg

SEQ ID NO: 3009945 - RNA, 23 nt, Mycobacterium avium subsp. paratuberculosis
ucgcggcgggccuugagcaccgc

SEQ ID NO: 3009946 - RNA, 18 nt, Mycobacterium avium subsp. paratuberculosis
ucgcggcggucacgcccg

SEQ ID NO: 3009947 - RNA, 22 nt, Mycobacterium avium subsp. paratuberculosis
ucgcggcguaggugggcagcgc

SEQ ID NO: 3009948 - RNA, 19 nt, Mycobacterium avium subsp. paratuberculosis
ucgcggcguuguggccacc

SEQ ID NO: 3009949 - RNA, 20 nt, Mycobacterium avium subsp. paratuberculosis
ucgcggcuggccgcggcgau

SEQ ID NO: 3009950 - RNA, 19 nt, Mycobacterium avium subsp. paratuberculosis
ucgcggcuggugccgccgg

SEQ ID NO: 3009951 - RNA, 19 nt, Mycobacterium avium subsp. paratuberculosis
ucgcgggacaacacgaucg

SEQ ID NO: 3009952 - RNA, 14 nt, Mycobacterium avium subsp. paratuberculosis
ucgcgggacggcgg

SEQ ID NO: 3009953 - RNA, 16 nt, Mycobacterium avium subsp. paratuberculosis
ucgcgggacggcggcg

SEQ ID NO: 3009954 - RNA, 18 nt, Mycobacterium avium subsp. paratuberculosis
ucgcgggaggacagcgcg

SEQ ID NO: 3009955 - RNA, 20 nt, Mycobacterium avium subsp. paratuberculosis
ucgcgggaucggccggcgag

SEQ ID NO: 3009956 - RNA, 17 nt, Mycobacterium avium subsp. paratuberculosis
ucgcgggcagccggcgc

SEQ ID NO: 3009957 - RNA, 18 nt, Mycobacterium avium subsp. paratuberculosis
ucgcgggccacagcggcg

SEQ ID NO: 3009958 - RNA, 17 nt, Mycobacterium avium subsp. paratuberculosis
ucgcgggccaccgcggc

SEQ ID NO: 3009959 - RNA, 14 nt, Mycobacterium avium subsp. paratuberculosis
ucgcgggccaccgg

SEQ ID NO: 3009960 - RNA, 15 nt, Mycobacterium avium subsp. paratuberculosis
ucgcgggccaccggc

SEQ ID NO: 3009961 - RNA, 22 nt, Mycobacterium avium subsp. paratuberculosis
ucgcgggcccgcgccgcgucgu

SEQ ID NO: 3009962 - RNA, 20 nt, Mycobacterium avium subsp. paratuberculosis
ucgcgggcccgcgcggcggu

SEQ ID NO: 3009963 - RNA, 17 nt, Mycobacterium avium subsp. paratuberculosis
ucgcgggcccgcguaac

SEQ ID NO: 3009964 - RNA, 22 nt, Mycobacterium avium subsp. paratuberculosis
ucgcgggcccgcguaaccggcg

SEQ ID NO: 3009965 - RNA, 17 nt, Mycobacterium avium subsp. paratuberculosis
ucgcgggcgaccuggug

SEQ ID NO: 3009966 - RNA, 13 nt, Mycobacterium avium subsp. paratuberculosis
ucgcgggcgagcc

SEQ ID NO: 3009967 - RNA, 15 nt, Mycobacterium avium subsp. paratuberculosis
ucgcgggcgaugcgg

SEQ ID NO: 3009968 - RNA, 21 nt, Mycobacterium avium subsp. paratuberculosis
ucgcgggcgaugcggcccggc

SEQ ID NO: 3009969 - RNA, 20 nt, Mycobacterium avium subsp. paratuberculosis
ucgcgggcgccgaagauggc

SEQ ID NO: 3009970 - RNA, 13 nt, Mycobacterium avium subsp. paratuberculosis
ucgcgggcggcgc

SEQ ID NO: 3009971 - RNA, 14 nt, Mycobacterium avium subsp. paratuberculosis
ucgcgggcggcgca

SEQ ID NO: 3009972 - RNA, 17 nt, Mycobacterium avium subsp. paratuberculosis
ucgcgggcgucgggcag

SEQ ID NO: 3009973 - RNA, 19 nt, Mycobacterium avium subsp. paratuberculosis
ucgcgggcgucgggcagca

SEQ ID NO: 3009974 - RNA, 16 nt, Mycobacterium avium subsp. paratuberculosis
ucgcgggcugcggcga

SEQ ID NO: 3009975 - RNA, 20 nt, Mycobacterium avium subsp. paratuberculosis
ucgcgggggccgcgaugagg

SEQ ID NO: 3009976 - RNA, 22 nt, Mycobacterium avium subsp. paratuberculosis
ucgcgggucuggcucggcacca

SEQ ID NO: 3009977 - RNA, 17 nt, Mycobacterium avium subsp. paratuberculosis
ucgcgggugaccggcgc

SEQ ID NO: 3009978 - RNA, 20 nt, Mycobacterium avium subsp. paratuberculosis
ucgcgggugaccggcgccgg

SEQ ID NO: 3009979 - RNA, 15 nt, Mycobacterium avium subsp. paratuberculosis
ucgcgggugccuucu

SEQ ID NO: 3009980 - RNA, 14 nt, Mycobacterium avium subsp. paratuberculosis
ucgcgggugcggcg

SEQ ID NO: 3009981 - RNA, 16 nt, Mycobacterium avium subsp. paratuberculosis
ucgcgggugcggcgcu

SEQ ID NO: 3009982 - RNA, 16 nt, Mycobacterium avium subsp. paratuberculosis
ucgcgggugcugggcg

SEQ ID NO: 3009983 - RNA, 18 nt, Mycobacterium avium subsp. paratuberculosis
ucgcgggugucgagccac

SEQ ID NO: 3009984 - RNA, 21 nt, Mycobacterium avium subsp. paratuberculosis
ucgcgggugucgagccaccac

SEQ ID NO: 3009985 - RNA, 23 nt, Mycobacterium avium subsp. paratuberculosis
ucgcgguagaucgacagggcguc

SEQ ID NO: 3009986 - RNA, 18 nt, Mycobacterium avium subsp. paratuberculosis
ucgcgguagcgcucgguc

SEQ ID NO: 3009987 - RNA, 22 nt, Mycobacterium avium subsp. paratuberculosis
ucgcgguagcgcucggucaggc

SEQ ID NO: 3009988 - RNA, 20 nt, Mycobacterium avium subsp. paratuberculosis
ucgcgguagucgggauaggg

SEQ ID NO: 3009989 - RNA, 18 nt, Mycobacterium avium subsp. paratuberculosis
ucgcgguaguuguccccg

SEQ ID NO: 3009990 - RNA, 15 nt, Mycobacterium avium subsp. paratuberculosis
ucgcggucagccggc

SEQ ID NO: 3009991 - RNA, 21 nt, Mycobacterium avium subsp. paratuberculosis
ucgcggucagcgucuggcggg

SEQ ID NO: 3009992 - RNA, 14 nt, Mycobacterium avium subsp. paratuberculosis
ucgcggucagcucg

SEQ ID NO: 3009993 - RNA, 14 nt, Mycobacterium avium subsp. paratuberculosis
ucgcgguccaccag

SEQ ID NO: 3009994 - RNA, 14 nt, Mycobacterium avium subsp. paratuberculosis
ucgcgguccacgcc

SEQ ID NO: 3009995 - RNA, 15 nt, Mycobacterium avium subsp. paratuberculosis
ucgcgguccacgccg

SEQ ID NO: 3009996 - RNA, 16 nt, Mycobacterium avium subsp. paratuberculosis
ucgcgguccacgccgg

SEQ ID NO: 3009997 - RNA, 14 nt, Mycobacterium avium subsp. paratuberculosis
ucgcgguccaggau

SEQ ID NO: 3009998 - RNA, 23 nt, Mycobacterium avium subsp. paratuberculosis
ucgcgguccaucuccagcuccgc

SEQ ID NO: 3009999 - RNA, 21 nt, Mycobacterium avium subsp. paratuberculosis
ucgcggucccaggugcugggc

SEQ ID NO: 3010000 - RNA, 18 nt, Mycobacterium avium subsp. paratuberculosis
ucgcggucggcaacccga

SEQ ID NO: 3010001 - RNA, 17 nt, Mycobacterium avium subsp. paratuberculosis
ucgcggucggcgucgcu

SEQ ID NO: 3010002 - RNA, 22 nt, Mycobacterium avium subsp. paratuberculosis
ucgcggugaaguugccgccgcc

SEQ ID NO: 3010003 - RNA, 16 nt, Mycobacterium avium subsp. paratuberculosis
ucgcggugaccgccgc

SEQ ID NO: 3010004 - RNA, 19 nt, Mycobacterium avium subsp. paratuberculosis
ucgcggugaccgccgccau

SEQ ID NO: 3010005 - RNA, 18 nt, Mycobacterium avium subsp. paratuberculosis
ucgcggugcaacgccgcc

SEQ ID NO: 3010006 - RNA, 13 nt, Mycobacterium avium subsp. paratuberculosis
ucgcggugcccag

SEQ ID NO: 3010007 - RNA, 16 nt, Mycobacterium avium subsp. paratuberculosis
ucgcggugcggggccg

SEQ ID NO: 3010008 - RNA, 19 nt, Mycobacterium avium subsp. paratuberculosis
ucgcggugcggggccgcgg

SEQ ID NO: 3010009 - RNA, 20 nt, Mycobacterium avium subsp. paratuberculosis
ucgcggugcggggccgcggc

SEQ ID NO: 3010010 - RNA, 22 nt, Mycobacterium avium subsp. paratuberculosis
ucgcggugcggggccgcggccg

SEQ ID NO: 3010011 - RNA, 21 nt, Mycobacterium avium subsp. paratuberculosis
ucgcggugcugcagauccgcu

SEQ ID NO: 3010012 - RNA, 17 nt, Mycobacterium avium subsp. paratuberculosis
ucgcgguggagcacagc

SEQ ID NO: 3010013 - RNA, 22 nt, Mycobacterium avium subsp. paratuberculosis
ucgcgguggagcacagcacggc

SEQ ID NO: 3010014 - RNA, 21 nt, Mycobacterium avium subsp. paratuberculosis
ucgcgguggcgaacugcacca

SEQ ID NO: 3010015 - RNA, 17 nt, Mycobacterium avium subsp. paratuberculosis
ucgcggugggcucggcg

SEQ ID NO: 3010016 - RNA, 18 nt, Mycobacterium avium subsp. paratuberculosis
ucgcggugggcucgucga

SEQ ID NO: 3010017 - RNA, 16 nt, Mycobacterium avium subsp. paratuberculosis
ucgcggugugcggcag

SEQ ID NO: 3010018 - RNA, 20 nt, Mycobacterium avium subsp. paratuberculosis
ucgcggugugcggcagcucg

SEQ ID NO: 3010019 - RNA, 23 nt, Mycobacterium avium subsp. paratuberculosis
ucgcgguugaugaucuuggugaa

SEQ ID NO: 3010020 - RNA, 20 nt, Mycobacterium avium subsp. paratuberculosis
ucgcgguugcggguggcggc

SEQ ID NO: 3010021 - RNA, 21 nt, Mycobacterium avium subsp. paratuberculosis
ucgcgguugggccgccggccg

SEQ ID NO: 3010022 - RNA, 15 nt, Mycobacterium avium subsp. paratuberculosis
ucgcguacccgggca

SEQ ID NO: 3010023 - RNA, 19 nt, Mycobacterium avium subsp. paratuberculosis
ucgcguacccgggcaauga

SEQ ID NO: 3010024 - RNA, 15 nt, Mycobacterium avium subsp. paratuberculosis
ucgcguagcgccggu

SEQ ID NO: 3010025 - RNA, 15 nt, Mycobacterium avium subsp. paratuberculosis
ucgcguaguccagca

SEQ ID NO: 3010026 - RNA, 19 nt, Mycobacterium avium subsp. paratuberculosis
ucgcguaguccagcacggc

SEQ ID NO: 3010027 - RNA, 20 nt, Mycobacterium avium subsp. paratuberculosis
ucgcguaguccagcacggcg

SEQ ID NO: 3010028 - RNA, 20 nt, Mycobacterium avium subsp. paratuberculosis
ucgcguaguggugccggaag

SEQ ID NO: 3010029 - RNA, 16 nt, Mycobacterium avium subsp. paratuberculosis
ucgcgucaaccaccgg

SEQ ID NO: 3010030 - RNA, 20 nt, Mycobacterium avium subsp. paratuberculosis
ucgcguccagcaugcccacg

SEQ ID NO: 3010031 - RNA, 17 nt, Mycobacterium avium subsp. paratuberculosis
ucgcguccccgcgccgg

SEQ ID NO: 3010032 - RNA, 21 nt, Mycobacterium avium subsp. paratuberculosis
ucgcguccccgcgccgggcaa

SEQ ID NO: 3010033 - RNA, 18 nt, Mycobacterium avium subsp. paratuberculosis
ucgcgucccuggcgauga

SEQ ID NO: 3010034 - RNA, 13 nt, Mycobacterium avium subsp. paratuberculosis
ucgcguccgagca

SEQ ID NO: 3010035 - RNA, 16 nt, Mycobacterium avium subsp. paratuberculosis
ucgcguccgcgaucgu

SEQ ID NO: 3010036 - RNA, 21 nt, Mycobacterium avium subsp. paratuberculosis
ucgcgucgaaugcgcucaucg

SEQ ID NO: 3010037 - RNA, 17 nt, Mycobacterium avium subsp. paratuberculosis
ucgcgucgacggcgccg

SEQ ID NO: 3010038 - RNA, 13 nt, Mycobacterium avium subsp. paratuberculosis
ucgcgucgacguc

SEQ ID NO: 3010039 - RNA, 17 nt, Mycobacterium avium subsp. paratuberculosis
ucgcgucgacgucgggc

SEQ ID NO: 3010040 - RNA, 18 nt, Mycobacterium avium subsp. paratuberculosis
ucgcgucgacgucgggca

SEQ ID NO: 3010041 - RNA, 15 nt, Mycobacterium avium subsp. paratuberculosis
ucgcgucgaugccgg

SEQ ID NO: 3010042 - RNA, 17 nt, Mycobacterium avium subsp. paratuberculosis
ucgcgucgaugccggcg

SEQ ID NO: 3010043 - RNA, 16 nt, Mycobacterium avium subsp. paratuberculosis
ucgcgucggugucgcc

SEQ ID NO: 3010044 - RNA, 17 nt, Mycobacterium avium subsp. paratuberculosis
ucgcgucggugucgccg

SEQ ID NO: 3010045 - RNA, 15 nt, Mycobacterium avium subsp. paratuberculosis
ucgcgucgucggcgg

SEQ ID NO: 3010046 - RNA, 21 nt, Mycobacterium avium subsp. paratuberculosis
ucgcgucugcucgccggcuac

SEQ ID NO: 3010047 - RNA, 18 nt, Mycobacterium avium subsp. paratuberculosis
ucgcgugaccggcggugc

SEQ ID NO: 3010048 - RNA, 13 nt, Mycobacterium avium subsp. paratuberculosis
ucgcgugcgucac

SEQ ID NO: 3010049 - RNA, 17 nt, Mycobacterium avium subsp. paratuberculosis
ucgcgugcgucacgcug

SEQ ID NO: 3010050 - RNA, 23 nt, Mycobacterium avium subsp. paratuberculosis
ucgcgugcgucacgcuggugacg

SEQ ID NO: 3010051 - RNA, 20 nt, Mycobacterium avium subsp. paratuberculosis
ucgcguggcaauucgaccgu

SEQ ID NO: 3010052 - RNA, 12 nt, Mycobacterium avium subsp. paratuberculosis
ucgcguggccug

SEQ ID NO: 3010053 - RNA, 20 nt, Mycobacterium avium subsp. paratuberculosis
ucgcguggccugggcgacca

SEQ ID NO: 3010054 - RNA, 20 nt, Mycobacterium avium subsp. paratuberculosis
ucgcgugugcccagcacgac

SEQ ID NO: 3010055 - RNA, 21 nt, Mycobacterium avium subsp. paratuberculosis
ucgcgugugcccagcacgacg

SEQ ID NO: 3010056 - RNA, 22 nt, Mycobacterium avium subsp. paratuberculosis
ucgcgugugcccagcacgacgc

SEQ ID NO: 3010057 - RNA, 16 nt, Mycobacterium avium subsp. paratuberculosis
ucgcguucccgggccc

SEQ ID NO: 3010058 - RNA, 21 nt, Mycobacterium avium subsp. paratuberculosis
ucgcguucgcuuucgccgggc

SEQ ID NO: 3010059 - RNA, 22 nt, Mycobacterium avium subsp. paratuberculosis
ucgcguucgcuuucgccgggcg

SEQ ID NO: 3010060 - RNA, 14 nt, Mycobacterium avium subsp. paratuberculosis
ucgcguucgggcag

SEQ ID NO: 3010061 - RNA, 20 nt, Mycobacterium avium subsp. paratuberculosis
ucgcguucgggcagcgccuc

SEQ ID NO: 3010062 - RNA, 14 nt, Mycobacterium avium subsp. paratuberculosis
ucgcguucgggccc

SEQ ID NO: 3010063 - RNA, 19 nt, Mycobacterium avium subsp. paratuberculosis
ucgcguucgggcccggccg

SEQ ID NO: 3010064 - RNA, 20 nt, Mycobacterium avium subsp. paratuberculosis
ucgcguucugcaccagcucg

SEQ ID NO: 3010065 - RNA, 19 nt, Mycobacterium avium subsp. paratuberculosis
ucgcguugaaagccgcgaa

SEQ ID NO: 3010066 - RNA, 15 nt, Mycobacterium avium subsp. paratuberculosis
ucgcguugagcgucg

SEQ ID NO: 3010067 - RNA, 14 nt, Mycobacterium avium subsp. paratuberculosis
ucgcuaaucgccgc

SEQ ID NO: 3010068 - RNA, 17 nt, Mycobacterium avium subsp. paratuberculosis
ucgcuacgcgagcugcu

SEQ ID NO: 3010069 - RNA, 18 nt, Mycobacterium avium subsp. paratuberculosis
ucgcuacgcgagcugcuu

SEQ ID NO: 3010070 - RNA, 20 nt, Mycobacterium avium subsp. paratuberculosis
ucgcuaguugcacuuucgcg

SEQ ID NO: 3010071 - RNA, 19 nt, Mycobacterium avium subsp. paratuberculosis
ucgcuauaucgcaccggcg

SEQ ID NO: 3010072 - RNA, 17 nt, Mycobacterium avium subsp. paratuberculosis
ucgcucaaaggcgggca

SEQ ID NO: 3010073 - RNA, 20 nt, Mycobacterium avium subsp. paratuberculosis
ucgcucaacggcuccaggua

SEQ ID NO: 3010074 - RNA, 17 nt, Mycobacterium avium subsp. paratuberculosis
ucgcucagaggcgggca

SEQ ID NO: 3010075 - RNA, 19 nt, Mycobacterium avium subsp. paratuberculosis
ucgcucagaggcgggcacu

SEQ ID NO: 3010076 - RNA, 20 nt, Mycobacterium avium subsp. paratuberculosis
ucgcucagaggcgggcacuu

SEQ ID NO: 3010077 - RNA, 17 nt, Mycobacterium avium subsp. paratuberculosis
ucgcucccgcgcgggca

SEQ ID NO: 3010078 - RNA, 14 nt, Mycobacterium avium subsp. paratuberculosis
ucgcucgucggcgc

SEQ ID NO: 3010079 - RNA, 15 nt, Mycobacterium avium subsp. paratuberculosis
ucgcucugccgggcc

SEQ ID NO: 3010080 - RNA, 16 nt, Mycobacterium avium subsp. paratuberculosis
ucgcucugccgggccg

SEQ ID NO: 3010081 - RNA, 14 nt, Mycobacterium avium subsp. paratuberculosis
ucgcucuucucguu

SEQ ID NO: 3010082 - RNA, 18 nt, Mycobacterium avium subsp. paratuberculosis
ucgcugacccgccgcaac

SEQ ID NO: 3010083 - RNA, 19 nt, Mycobacterium avium subsp. paratuberculosis
ucgcugacccgccgcaaca

SEQ ID NO: 3010084 - RNA, 22 nt, Mycobacterium avium subsp. paratuberculosis
ucgcugaccucgacacgggccg

SEQ ID NO: 3010085 - RNA, 14 nt, Mycobacterium avium subsp. paratuberculosis
ucgcugaccuucuu

SEQ ID NO: 3010086 - RNA, 13 nt, Mycobacterium avium subsp. paratuberculosis
ucgcugacgccga

SEQ ID NO: 3010087 - RNA, 17 nt, Mycobacterium avium subsp. paratuberculosis
ucgcugacgccgagcag

SEQ ID NO: 3010088 - RNA, 21 nt, Mycobacterium avium subsp. paratuberculosis
ucgcugagcaauucggugacg

SEQ ID NO: 3010089 - RNA, 19 nt, Mycobacterium avium subsp. paratuberculosis
ucgcugaucucgacggugg

SEQ ID NO: 3010090 - RNA, 17 nt, Mycobacterium avium subsp. paratuberculosis
ucgcugaucugcggcac

SEQ ID NO: 3010091 - RNA, 12 nt, Mycobacterium avium subsp. paratuberculosis
ucgcugaucuuc

SEQ ID NO: 3010092 - RNA, 14 nt, Mycobacterium avium subsp. paratuberculosis
ucgcugcagcggcg

SEQ ID NO: 3010093 - RNA, 16 nt, Mycobacterium avium subsp. paratuberculosis
ucgcugcagcggcggc

SEQ ID NO: 3010094 - RNA, 17 nt, Mycobacterium avium subsp. paratuberculosis
ucgcugcagcggcggcc

SEQ ID NO: 3010095 - RNA, 20 nt, Mycobacterium avium subsp. paratuberculosis
ucgcugcaguagccggccag

SEQ ID NO: 3010096 - RNA, 18 nt, Mycobacterium avium subsp. paratuberculosis
ucgcugcccaacgucgac

SEQ ID NO: 3010097 - RNA, 13 nt, Mycobacterium avium subsp. paratuberculosis
ucgcugccccggc

SEQ ID NO: 3010098 - RNA, 14 nt, Mycobacterium avium subsp. paratuberculosis
ucgcugccccggcg

SEQ ID NO: 3010099 - RNA, 12 nt, Mycobacterium avium subsp. paratuberculosis
ucgcugcccggc

SEQ ID NO: 3010100 - RNA, 18 nt, Mycobacterium avium subsp. paratuberculosis
ucgcugccgccgccggcg

SEQ ID NO: 3010101 - RNA, 13 nt, Mycobacterium avium subsp. paratuberculosis
ucgcugccggccg

SEQ ID NO: 3010102 - RNA, 18 nt, Mycobacterium avium subsp. paratuberculosis
ucgcugccggccggggcg

SEQ ID NO: 3010103 - RNA, 22 nt, Mycobacterium avium subsp. paratuberculosis
ucgcugccguagcgcuggguga

SEQ ID NO: 3010104 - RNA, 17 nt, Mycobacterium avium subsp. paratuberculosis
ucgcugccguccacccg

SEQ ID NO: 3010105 - RNA, 20 nt, Mycobacterium avium subsp. paratuberculosis
ucgcugccguccacccggcc

SEQ ID NO: 3010106 - RNA, 16 nt, Mycobacterium avium subsp. paratuberculosis
ucgcugcgagcccggc

SEQ ID NO: 3010107 - RNA, 23 nt, Mycobacterium avium subsp. paratuberculosis
ucgcugcgauugguggcccgguc

SEQ ID NO: 3010108 - RNA, 12 nt, Mycobacterium avium subsp. paratuberculosis
ucgcugcgcccg

SEQ ID NO: 3010109 - RNA, 13 nt, Mycobacterium avium subsp. paratuberculosis
ucgcugcgcccgc

SEQ ID NO: 3010110 - RNA, 16 nt, Mycobacterium avium subsp. paratuberculosis
ucgcugcgccgaacgu

SEQ ID NO: 3010111 - RNA, 12 nt, Mycobacterium avium subsp. paratuberculosis
ucgcugcgccgg

SEQ ID NO: 3010112 - RNA, 24 nt, Mycobacterium avium subsp. paratuberculosis
ucgcugcgcucgccgucggccagc

SEQ ID NO: 3010113 - RNA, 13 nt, Mycobacterium avium subsp. paratuberculosis
ucgcugcggcgca

SEQ ID NO: 3010114 - RNA, 17 nt, Mycobacterium avium subsp. paratuberculosis
ucgcugcucaugagccc

SEQ ID NO: 3010115 - RNA, 17 nt, Mycobacterium avium subsp. paratuberculosis
ucgcugcucugcgcgcg

SEQ ID NO: 3010116 - RNA, 19 nt, Mycobacterium avium subsp. paratuberculosis
ucgcugcucugcgcgcggu

SEQ ID NO: 3010117 - RNA, 22 nt, Mycobacterium avium subsp. paratuberculosis
ucgcuggaaaccucuugcggcg

SEQ ID NO: 3010118 - RNA, 23 nt, Mycobacterium avium subsp. paratuberculosis
ucgcuggaaaccucuugcggcgc

SEQ ID NO: 3010119 - RNA, 21 nt, Mycobacterium avium subsp. paratuberculosis
ucgcuggacagccacagcucg

SEQ ID NO: 3010120 - RNA, 13 nt, Mycobacterium avium subsp. paratuberculosis
ucgcuggccgcga

SEQ ID NO: 3010121 - RNA, 22 nt, Mycobacterium avium subsp. paratuberculosis
ucgcugggcucgagugccggca

SEQ ID NO: 3010122 - RNA, 21 nt, Mycobacterium avium subsp. paratuberculosis
ucgcuggggugcccaccagca

SEQ ID NO: 3010123 - RNA, 21 nt, Mycobacterium avium subsp. paratuberculosis
ucgcugguggccgacgugccg

SEQ ID NO: 3010124 - RNA, 16 nt, Mycobacterium avium subsp. paratuberculosis
ucgcuguaggccagcc

SEQ ID NO: 3010125 - RNA, 20 nt, Mycobacterium avium subsp. paratuberculosis
ucgcuguccucgagcgcguc

SEQ ID NO: 3010126 - RNA, 13 nt, Mycobacterium avium subsp. paratuberculosis
ucgcugucggcga

SEQ ID NO: 3010127 - RNA, 20 nt, Mycobacterium avium subsp. paratuberculosis
ucgcuguuagccucgccagc

SEQ ID NO: 3010128 - RNA, 20 nt, Mycobacterium avium subsp. paratuberculosis
ucgcuguuggcgacggcgcu

SEQ ID NO: 3010129 - RNA, 20 nt, Mycobacterium avium subsp. paratuberculosis
ucgcuucggccagcgcgucg

SEQ ID NO: 3010130 - RNA, 20 nt, Mycobacterium avium subsp. paratuberculosis
ucgcuugccagccgggccga

SEQ ID NO: 3010131 - RNA, 18 nt, Mycobacterium avium subsp. paratuberculosis
ucgcuugcgccgcagcgg

SEQ ID NO: 3010132 - RNA, 22 nt, Mycobacterium avium subsp. paratuberculosis
ucggaaaagugggucagccacg

SEQ ID NO: 3010133 - RNA, 15 nt, Mycobacterium avium subsp. paratuberculosis
ucggaauacagcagc

SEQ ID NO: 3010134 - RNA, 16 nt, Mycobacterium avium subsp. paratuberculosis
ucggaauacagcagcu

SEQ ID NO: 3010135 - RNA, 13 nt, Mycobacterium avium subsp. paratuberculosis
ucggaaucggcgc

SEQ ID NO: 3010136 - RNA, 15 nt, Mycobacterium avium subsp. paratuberculosis
ucggaaucggcgccg

SEQ ID NO: 3010137 - RNA, 21 nt, Mycobacterium avium subsp. paratuberculosis
ucggaaugaacugccgcggca

SEQ ID NO: 3010138 - RNA, 19 nt, Mycobacterium avium subsp. paratuberculosis
ucggacaccucggccagcg

SEQ ID NO: 3010139 - RNA, 15 nt, Mycobacterium avium subsp. paratuberculosis
ucggacacggcgccg

SEQ ID NO: 3010140 - RNA, 19 nt, Mycobacterium avium subsp. paratuberculosis
ucggacagcagcaccggca

SEQ ID NO: 3010141 - RNA, 15 nt, Mycobacterium avium subsp. paratuberculosis
ucggacaugccggcg

SEQ ID NO: 3010142 - RNA, 16 nt, Mycobacterium avium subsp. paratuberculosis
ucggacaugccggcgc

SEQ ID NO: 3010143 - RNA, 17 nt, Mycobacterium avium subsp. paratuberculosis
ucggacaugccggcgcc

SEQ ID NO: 3010144 - RNA, 18 nt, Mycobacterium avium subsp. paratuberculosis
ucggacaugccggcgccg

SEQ ID NO: 3010145 - RNA, 16 nt, Mycobacterium avium subsp. paratuberculosis
ucggacccagcccgau

SEQ ID NO: 3010146 - RNA, 21 nt, Mycobacterium avium subsp. paratuberculosis
ucggacccagcccggcgacga

SEQ ID NO: 3010147 - RNA, 13 nt, Mycobacterium avium subsp. paratuberculosis
ucggaccccgaug

SEQ ID NO: 3010148 - RNA, 22 nt, Mycobacterium avium subsp. paratuberculosis
ucggaccccgaugcgcucaccc

SEQ ID NO: 3010149 - RNA, 20 nt, Mycobacterium avium subsp. paratuberculosis
ucggaccgguaggcgcaccg

SEQ ID NO: 3010150 - RNA, 15 nt, Mycobacterium avium subsp. paratuberculosis
ucggacgagccgucg

SEQ ID NO: 3010151 - RNA, 16 nt, Mycobacterium avium subsp. paratuberculosis
ucggacgccggcagcc

SEQ ID NO: 3010152 - RNA, 18 nt, Mycobacterium avium subsp. paratuberculosis
ucggacgcggccgagccg

SEQ ID NO: 3010153 - RNA, 15 nt, Mycobacterium avium subsp. paratuberculosis
ucggacggcgacggc

SEQ ID NO: 3010154 - RNA, 14 nt, Mycobacterium avium subsp. paratuberculosis
ucggacucgcgccg

SEQ ID NO: 3010155 - RNA, 15 nt, Mycobacterium avium subsp. paratuberculosis
ucggacucgcgccgg

SEQ ID NO: 3010156 - RNA, 18 nt, Mycobacterium avium subsp. paratuberculosis
ucggagaccuuggcgcug

SEQ ID NO: 3010157 - RNA, 19 nt, Mycobacterium avium subsp. paratuberculosis
ucggagaccuuggcgcuga

SEQ ID NO: 3010158 - RNA, 15 nt, Mycobacterium avium subsp. paratuberculosis
ucggagacguggcgg

SEQ ID NO: 3010159 - RNA, 21 nt, Mycobacterium avium subsp. paratuberculosis
ucggagacguugccgcacacc

SEQ ID NO: 3010160 - RNA, 21 nt, Mycobacterium avium subsp. paratuberculosis
ucggagagcuugccgcggauc

SEQ ID NO: 3010161 - RNA, 14 nt, Mycobacterium avium subsp. paratuberculosis
ucggagaucaccgg

SEQ ID NO: 3010162 - RNA, 15 nt, Mycobacterium avium subsp. paratuberculosis
ucggagaucaccggc

SEQ ID NO: 3010163 - RNA, 20 nt, Mycobacterium avium subsp. paratuberculosis
ucggagaucaccggcacccc

SEQ ID NO: 3010164 - RNA, 15 nt, Mycobacterium avium subsp. paratuberculosis
ucggagaugcgggcc

SEQ ID NO: 3010165 - RNA, 20 nt, Mycobacterium avium subsp. paratuberculosis
ucggagaugcgggccaccgu

SEQ ID NO: 3010166 - RNA, 18 nt, Mycobacterium avium subsp. paratuberculosis
ucggagcaaauccggcag

SEQ ID NO: 3010167 - RNA, 19 nt, Mycobacterium avium subsp. paratuberculosis
ucggagcaaauccggcagc

SEQ ID NO: 3010168 - RNA, 12 nt, Mycobacterium avium subsp. paratuberculosis
ucggagccgucg

SEQ ID NO: 3010169 - RNA, 16 nt, Mycobacterium avium subsp. paratuberculosis
ucggaggaaccgugcg

SEQ ID NO: 3010170 - RNA, 20 nt, Mycobacterium avium subsp. paratuberculosis
ucggaggucagcagggugac

SEQ ID NO: 3010171 - RNA, 14 nt, Mycobacterium avium subsp. paratuberculosis
ucggaggugccgcg

SEQ ID NO: 3010172 - RNA, 18 nt, Mycobacterium avium subsp. paratuberculosis
ucggaguaguccagcacc

SEQ ID NO: 3010173 - RNA, 21 nt, Mycobacterium avium subsp. paratuberculosis
ucggaguaguccagcaccgcc

SEQ ID NO: 3010174 - RNA, 15 nt, Mycobacterium avium subsp. paratuberculosis
ucggaguccaccggc

SEQ ID NO: 3010175 - RNA, 18 nt, Mycobacterium avium subsp. paratuberculosis
ucggaguccagcacgccc

SEQ ID NO: 3010176 - RNA, 22 nt, Mycobacterium avium subsp. paratuberculosis
ucggaguggaacagccggauca

SEQ ID NO: 3010177 - RNA, 23 nt, Mycobacterium avium subsp. paratuberculosis
ucggaguggaacagccggaucag

SEQ ID NO: 3010178 - RNA, 23 nt, Mycobacterium avium subsp. paratuberculosis
ucggaguucgcccgcagcacgcc

SEQ ID NO: 3010179 - RNA, 19 nt, Mycobacterium avium subsp. paratuberculosis
ucggaguugcgcagccggg

SEQ ID NO: 3010180 - RNA, 15 nt, Mycobacterium avium subsp. paratuberculosis
ucggauccgccugcc

SEQ ID NO: 3010181 - RNA, 18 nt, Mycobacterium avium subsp. paratuberculosis
ucggaugaccaagccccg

SEQ ID NO: 3010182 - RNA, 14 nt, Mycobacterium avium subsp. paratuberculosis
ucggauggugccca

SEQ ID NO: 3010183 - RNA, 22 nt, Mycobacterium avium subsp. paratuberculosis
ucggauggugcccaccgggcag

SEQ ID NO: 3010184 - RNA, 15 nt, Mycobacterium avium subsp. paratuberculosis
ucggauucggguggc

SEQ ID NO: 3010185 - RNA, 14 nt, Mycobacterium avium subsp. paratuberculosis
ucggauucgucggu

SEQ ID NO: 3010186 - RNA, 17 nt, Mycobacterium avium subsp. paratuberculosis
ucggauucgucggucac

SEQ ID NO: 3010187 - RNA, 20 nt, Mycobacterium avium subsp. paratuberculosis
ucggauuugguugcggcacc

SEQ ID NO: 3010188 - RNA, 21 nt, Mycobacterium avium subsp. paratuberculosis
ucggauuugguugcggcaccg

SEQ ID NO: 3010189 - RNA, 21 nt, Mycobacterium avium subsp. paratuberculosis
ucggcaacccgaccucgucga

SEQ ID NO: 3010190 - RNA, 13 nt, Mycobacterium avium subsp. paratuberculosis
ucggcaacgccgg

SEQ ID NO: 3010191 - RNA, 17 nt, Mycobacterium avium subsp. paratuberculosis
ucggcaaugaccggcac

SEQ ID NO: 3010192 - RNA, 18 nt, Mycobacterium avium subsp. paratuberculosis
ucggcaaugaccggcacc

SEQ ID NO: 3010193 - RNA, 19 nt, Mycobacterium avium subsp. paratuberculosis
ucggcaaugaccggcacca

SEQ ID NO: 3010194 - RNA, 18 nt, Mycobacterium avium subsp. paratuberculosis
ucggcacaccagguaggc

SEQ ID NO: 3010195 - RNA, 21 nt, Mycobacterium avium subsp. paratuberculosis
ucggcacaccagguaggcggu

SEQ ID NO: 3010196 - RNA, 18 nt, Mycobacterium avium subsp. paratuberculosis
ucggcaccagagcgccgg

SEQ ID NO: 3010197 - RNA, 19 nt, Mycobacterium avium subsp. paratuberculosis
ucggcaccagcggcaucgc

SEQ ID NO: 3010198 - RNA, 14 nt, Mycobacterium avium subsp. paratuberculosis
ucggcaccgugccg

SEQ ID NO: 3010199 - RNA, 21 nt, Mycobacterium avium subsp. paratuberculosis
ucggcaccgugccgcgcggcg

SEQ ID NO: 3010200 - RNA, 22 nt, Mycobacterium avium subsp. paratuberculosis
ucggcaccgugccgcgcggcgg

SEQ ID NO: 3010201 - RNA, 13 nt, Mycobacterium avium subsp. paratuberculosis
ucggcacgccggg

SEQ ID NO: 3010202 - RNA, 15 nt, Mycobacterium avium subsp. paratuberculosis
ucggcagacccagca

SEQ ID NO: 3010203 - RNA, 22 nt, Mycobacterium avium subsp. paratuberculosis
ucggcagaccggugagcaccgg

SEQ ID NO: 3010204 - RNA, 22 nt, Mycobacterium avium subsp. paratuberculosis
ucggcagaucguugggcauguc

SEQ ID NO: 3010205 - RNA, 14 nt, Mycobacterium avium subsp. paratuberculosis
ucggcagcaccggc

SEQ ID NO: 3010206 - RNA, 16 nt, Mycobacterium avium subsp. paratuberculosis
ucggcagcaccggcag

SEQ ID NO: 3010207 - RNA, 17 nt, Mycobacterium avium subsp. paratuberculosis
ucggcagcaccggcagc

SEQ ID NO: 3010208 - RNA, 20 nt, Mycobacterium avium subsp. paratuberculosis
ucggcagcaccggcagcaac

SEQ ID NO: 3010209 - RNA, 17 nt, Mycobacterium avium subsp. paratuberculosis
ucggcagcccggaggcg

SEQ ID NO: 3010210 - RNA, 15 nt, Mycobacterium avium subsp. paratuberculosis
ucggcagcgccaaca

SEQ ID NO: 3010211 - RNA, 13 nt, Mycobacterium avium subsp. paratuberculosis
ucggcagcgcgcc

SEQ ID NO: 3010212 - RNA, 23 nt, Mycobacterium avium subsp. paratuberculosis
ucggcagcugaagugcacucggc

SEQ ID NO: 3010213 - RNA, 13 nt, Mycobacterium avium subsp. paratuberculosis
ucggcaggauccg

SEQ ID NO: 3010214 - RNA, 19 nt, Mycobacterium avium subsp. paratuberculosis
ucggcaggauccggacgac

SEQ ID NO: 3010215 - RNA, 21 nt, Mycobacterium avium subsp. paratuberculosis
ucggcaggauccggacgaccu

SEQ ID NO: 3010216 - RNA, 22 nt, Mycobacterium avium subsp. paratuberculosis
ucggcaggauccggacgaccug

SEQ ID NO: 3010217 - RNA, 21 nt, Mycobacterium avium subsp. paratuberculosis
ucggcaggauccggucgauca

SEQ ID NO: 3010218 - RNA, 23 nt, Mycobacterium avium subsp. paratuberculosis
ucggcaggauccggucgaucacc

SEQ ID NO: 3010219 - RNA, 12 nt, Mycobacterium avium subsp. paratuberculosis
ucggcaggcggg

SEQ ID NO: 3010220 - RNA, 14 nt, Mycobacterium avium subsp. paratuberculosis
ucggcaggucgucg

SEQ ID NO: 3010221 - RNA, 18 nt, Mycobacterium avium subsp. paratuberculosis
ucggcaggucgucgacgu

SEQ ID NO: 3010222 - RNA, 19 nt, Mycobacterium avium subsp. paratuberculosis
ucggcaggucgucgacguc

SEQ ID NO: 3010223 - RNA, 17 nt, Mycobacterium avium subsp. paratuberculosis
ucggcagguugucgcug

SEQ ID NO: 3010224 - RNA, 20 nt, Mycobacterium avium subsp. paratuberculosis
ucggcaguagcacuuucgcg

SEQ ID NO: 3010225 - RNA, 14 nt, Mycobacterium avium subsp. paratuberculosis
ucggcaguccgcgc

SEQ ID NO: 3010226 - RNA, 17 nt, Mycobacterium avium subsp. paratuberculosis
ucggcaguccgcgccgg

SEQ ID NO: 3010227 - RNA, 20 nt, Mycobacterium avium subsp. paratuberculosis
ucggcaguugcacuuucgcg

SEQ ID NO: 3010228 - RNA, 19 nt, Mycobacterium avium subsp. paratuberculosis
ucggcaucucggccggaag

SEQ ID NO: 3010229 - RNA, 17 nt, Mycobacterium avium subsp. paratuberculosis
ucggcaugacgcccagc

SEQ ID NO: 3010230 - RNA, 15 nt, Mycobacterium avium subsp. paratuberculosis
ucggccaacagugcg

SEQ ID NO: 3010231 - RNA, 16 nt, Mycobacterium avium subsp. paratuberculosis
ucggccaacagugcgc

SEQ ID NO: 3010232 - RNA, 17 nt, Mycobacterium avium subsp. paratuberculosis
ucggccaacagugcgca

SEQ ID NO: 3010233 - RNA, 21 nt, Mycobacterium avium subsp. paratuberculosis
ucggccaacagugcgcaggcg

SEQ ID NO: 3010234 - RNA, 20 nt, Mycobacterium avium subsp. paratuberculosis
ucggccaacggauagcgucc

SEQ ID NO: 3010235 - RNA, 21 nt, Mycobacterium avium subsp. paratuberculosis
ucggccaauuccucagcccgg

SEQ ID NO: 3010236 - RNA, 20 nt, Mycobacterium avium subsp. paratuberculosis
ucggccaccaccucgcgggc

SEQ ID NO: 3010237 - RNA, 21 nt, Mycobacterium avium subsp. paratuberculosis
ucggccaccaugucggcgucg

SEQ ID NO: 3010238 - RNA, 22 nt, Mycobacterium avium subsp. paratuberculosis
ucggccaccaugucggcgucgc

SEQ ID NO: 3010239 - RNA, 13 nt, Mycobacterium avium subsp. paratuberculosis
ucggccaccgacu

SEQ ID NO: 3010240 - RNA, 18 nt, Mycobacterium avium subsp. paratuberculosis
ucggccaccgacugcgac

SEQ ID NO: 3010241 - RNA, 13 nt, Mycobacterium avium subsp. paratuberculosis
ucggccaccgcgc

SEQ ID NO: 3010242 - RNA, 17 nt, Mycobacterium avium subsp. paratuberculosis
ucggccaccgcgcggcg

SEQ ID NO: 3010243 - RNA, 19 nt, Mycobacterium avium subsp. paratuberculosis
ucggccaccgcgcggcggu

SEQ ID NO: 3010244 - RNA, 16 nt, Mycobacterium avium subsp. paratuberculosis
ucggccaccgcgcggu

SEQ ID NO: 3010245 - RNA, 20 nt, Mycobacterium avium subsp. paratuberculosis
ucggccaccgcggucgacgg

SEQ ID NO: 3010246 - RNA, 15 nt, Mycobacterium avium subsp. paratuberculosis
ucggccaccgucagc

SEQ ID NO: 3010247 - RNA, 15 nt, Mycobacterium avium subsp. paratuberculosis
ucggccacgacgcgg

SEQ ID NO: 3010248 - RNA, 15 nt, Mycobacterium avium subsp. paratuberculosis
ucggccacgccgggc

SEQ ID NO: 3010249 - RNA, 17 nt, Mycobacterium avium subsp. paratuberculosis
ucggccacgcucgccag

SEQ ID NO: 3010250 - RNA, 13 nt, Mycobacterium avium subsp. paratuberculosis
ucggccacguugc

SEQ ID NO: 3010251 - RNA, 22 nt, Mycobacterium avium subsp. paratuberculosis
ucggccagauagaugagccgca

SEQ ID NO: 3010252 - RNA, 14 nt, Mycobacterium avium subsp. paratuberculosis
ucggccagcaccac

SEQ ID NO: 3010253 - RNA, 24 nt, Mycobacterium avium subsp. paratuberculosis
ucggccagcaccagcagccggucg

SEQ ID NO: 3010254 - RNA, 23 nt, Mycobacterium avium subsp. paratuberculosis
ucggccagcaccaggaaggcgac

SEQ ID NO: 3010255 - RNA, 13 nt, Mycobacterium avium subsp. paratuberculosis
ucggccagcagca

SEQ ID NO: 3010256 - RNA, 19 nt, Mycobacterium avium subsp. paratuberculosis
ucggccagcaggucgaagg

SEQ ID NO: 3010257 - RNA, 22 nt, Mycobacterium avium subsp. paratuberculosis
ucggccagcaggucgucgacgu

SEQ ID NO: 3010258 - RNA, 14 nt, Mycobacterium avium subsp. paratuberculosis
ucggccagccacgc

SEQ ID NO: 3010259 - RNA, 19 nt, Mycobacterium avium subsp. paratuberculosis
ucggccagccacuccaggg

SEQ ID NO: 3010260 - RNA, 15 nt, Mycobacterium avium subsp. paratuberculosis
ucggccagccaggcc

SEQ ID NO: 3010261 - RNA, 12 nt, Mycobacterium avium subsp. paratuberculosis
ucggccagcccc

SEQ ID NO: 3010262 - RNA, 19 nt, Mycobacterium avium subsp. paratuberculosis
ucggccagccccaccaccg

SEQ ID NO: 3010263 - RNA, 23 nt, Mycobacterium avium subsp. paratuberculosis
ucggccagccccaccaccgccac

SEQ ID NO: 3010264 - RNA, 11 nt, Mycobacterium avium subsp. paratuberculosis
ucggccagcgc

SEQ ID NO: 3010265 - RNA, 14 nt, Mycobacterium avium subsp. paratuberculosis
ucggccagcgcagc

SEQ ID NO: 3010266 - RNA, 13 nt, Mycobacterium avium subsp. paratuberculosis
ucggccagcgccg

SEQ ID NO: 3010267 - RNA, 21 nt, Mycobacterium avium subsp. paratuberculosis
ucggccagcgccgccagccgc

SEQ ID NO: 3010268 - RNA, 16 nt, Mycobacterium avium subsp. paratuberculosis
ucggccagcgccgccc

SEQ ID NO: 3010269 - RNA, 23 nt, Mycobacterium avium subsp. paratuberculosis
ucggccagcgccgcccgggcggc

SEQ ID NO: 3010270 - RNA, 15 nt, Mycobacterium avium subsp. paratuberculosis
ucggccagcgccgcg

SEQ ID NO: 3010271 - RNA, 13 nt, Mycobacterium avium subsp. paratuberculosis
ucggccagcgcgc

SEQ ID NO: 3010272 - RNA, 14 nt, Mycobacterium avium subsp. paratuberculosis
ucggccagcgcgcc

SEQ ID NO: 3010273 - RNA, 17 nt, Mycobacterium avium subsp. paratuberculosis
ucggccagcgcgccgca

SEQ ID NO: 3010274 - RNA, 20 nt, Mycobacterium avium subsp. paratuberculosis
ucggccagcgcgccgcacag

SEQ ID NO: 3010275 - RNA, 17 nt, Mycobacterium avium subsp. paratuberculosis
ucggccagcgcgcgcag

SEQ ID NO: 3010276 - RNA, 21 nt, Mycobacterium avium subsp. paratuberculosis
ucggccagcgcgcgcagcgcu

SEQ ID NO: 3010277 - RNA, 22 nt, Mycobacterium avium subsp. paratuberculosis
ucggccagcgcgcgggcgcgcg

SEQ ID NO: 3010278 - RNA, 24 nt, Mycobacterium avium subsp. paratuberculosis
ucggccagcgcgcgggcgcgcgcc

SEQ ID NO: 3010279 - RNA, 15 nt, Mycobacterium avium subsp. paratuberculosis
ucggccagcgcggcc

SEQ ID NO: 3010280 - RNA, 17 nt, Mycobacterium avium subsp. paratuberculosis
ucggccagcgcggcggc

SEQ ID NO: 3010281 - RNA, 22 nt, Mycobacterium avium subsp. paratuberculosis
ucggccagcgcggcggccagcu

SEQ ID NO: 3010282 - RNA, 14 nt, Mycobacterium avium subsp. paratuberculosis
ucggccagcgcggu

SEQ ID NO: 3010283 - RNA, 15 nt, Mycobacterium avium subsp. paratuberculosis
ucggccagcgcgucg

SEQ ID NO: 3010284 - RNA, 17 nt, Mycobacterium avium subsp. paratuberculosis
ucggccagcgcgucggc

SEQ ID NO: 3010285 - RNA, 12 nt, Mycobacterium avium subsp. paratuberculosis
ucggccagcggc

SEQ ID NO: 3010286 - RNA, 13 nt, Mycobacterium avium subsp. paratuberculosis
ucggccagcggca

SEQ ID NO: 3010287 - RNA, 14 nt, Mycobacterium avium subsp. paratuberculosis
ucggccagcgggcg

SEQ ID NO: 3010288 - RNA, 16 nt, Mycobacterium avium subsp. paratuberculosis
ucggccagcgggcggc

SEQ ID NO: 3010289 - RNA, 14 nt, Mycobacterium avium subsp. paratuberculosis
ucggccagcgggug

SEQ ID NO: 3010290 - RNA, 13 nt, Mycobacterium avium subsp. paratuberculosis
ucggccagcgguu

SEQ ID NO: 3010291 - RNA, 14 nt, Mycobacterium avium subsp. paratuberculosis
ucggccagcgguug

SEQ ID NO: 3010292 - RNA, 20 nt, Mycobacterium avium subsp. paratuberculosis
ucggccagcgguugcacggu

SEQ ID NO: 3010293 - RNA, 21 nt, Mycobacterium avium subsp. paratuberculosis
ucggccagcgguugcacgguc

SEQ ID NO: 3010294 - RNA, 22 nt, Mycobacterium avium subsp. paratuberculosis
ucggccagcucaccggccaggg

SEQ ID NO: 3010295 - RNA, 15 nt, Mycobacterium avium subsp. paratuberculosis
ucggccagcuggucg

SEQ ID NO: 3010296 - RNA, 23 nt, Mycobacterium avium subsp. paratuberculosis
ucggccaggaugaacacccgggu

SEQ ID NO: 3010297 - RNA, 13 nt, Mycobacterium avium subsp. paratuberculosis
ucggccagggcgu

SEQ ID NO: 3010298 - RNA, 17 nt, Mycobacterium avium subsp. paratuberculosis
ucggccagggugacggu

SEQ ID NO: 3010299 - RNA, 22 nt, Mycobacterium avium subsp. paratuberculosis
ucggccagucguacucccaggc

SEQ ID NO: 3010300 - RNA, 21 nt, Mycobacterium avium subsp. paratuberculosis
ucggccaguucaccgcgcucc

SEQ ID NO: 3010301 - RNA, 22 nt, Mycobacterium avium subsp. paratuberculosis
ucggccaucccggugccgcugg

SEQ ID NO: 3010302 - RNA, 17 nt, Mycobacterium avium subsp. paratuberculosis
ucggccauccgggcggc

SEQ ID NO: 3010303 - RNA, 22 nt, Mycobacterium avium subsp. paratuberculosis
ucggccaucgacuccaccaccu

SEQ ID NO: 3010304 - RNA, 13 nt, Mycobacterium avium subsp. paratuberculosis
ucggccaugccgc

SEQ ID NO: 3010305 - RNA, 23 nt, Mycobacterium avium subsp. paratuberculosis
ucggcccaggccaacagcagcag

SEQ ID NO: 3010306 - RNA, 23 nt, Mycobacterium avium subsp. paratuberculosis
ucggcccaguccagucgcgccga

SEQ ID NO: 3010307 - RNA, 15 nt, Mycobacterium avium subsp. paratuberculosis
ucggcccccgggccc

SEQ ID NO: 3010308 - RNA, 17 nt, Mycobacterium avium subsp. paratuberculosis
ucggcccccgggcccga

SEQ ID NO: 3010309 - RNA, 19 nt, Mycobacterium avium subsp. paratuberculosis
ucggcccccgggcccgaag

SEQ ID NO: 3010310 - RNA, 15 nt, Mycobacterium avium subsp. paratuberculosis
ucggccccgcgcauc

SEQ ID NO: 3010311 - RNA, 13 nt, Mycobacterium avium subsp. paratuberculosis
ucggccccggccg

SEQ ID NO: 3010312 - RNA, 16 nt, Mycobacterium avium subsp. paratuberculosis
ucggccccggccgagc

SEQ ID NO: 3010313 - RNA, 23 nt, Mycobacterium avium subsp. paratuberculosis
ucggcccgacggguucgcgcagc

SEQ ID NO: 3010314 - RNA, 21 nt, Mycobacterium avium subsp. paratuberculosis
ucggcccgagugugcauccug

SEQ ID NO: 3010315 - RNA, 14 nt, Mycobacterium avium subsp. paratuberculosis
ucggcccgccaccc

SEQ ID NO: 3010316 - RNA, 23 nt, Mycobacterium avium subsp. paratuberculosis
ucggcccgccaguucccggccag

SEQ ID NO: 3010317 - RNA, 13 nt, Mycobacterium avium subsp. paratuberculosis
ucggcccgccggg

SEQ ID NO: 3010318 - RNA, 15 nt, Mycobacterium avium subsp. paratuberculosis
ucggcccgccgggcc

SEQ ID NO: 3010319 - RNA, 22 nt, Mycobacterium avium subsp. paratuberculosis
ucggcccgccgggcgccacgcu

SEQ ID NO: 3010320 - RNA, 23 nt, Mycobacterium avium subsp. paratuberculosis
ucggcccgcuccccguugcggag

SEQ ID NO: 3010321 - RNA, 18 nt, Mycobacterium avium subsp. paratuberculosis
ucggcccgcugcgcggcc

SEQ ID NO: 3010322 - RNA, 16 nt, Mycobacterium avium subsp. paratuberculosis
ucggcccgcugcggcu

SEQ ID NO: 3010323 - RNA, 20 nt, Mycobacterium avium subsp. paratuberculosis
ucggcccgcugcggcuggga

SEQ ID NO: 3010324 - RNA, 22 nt, Mycobacterium avium subsp. paratuberculosis
ucggcccgcuucaggcagcgca

SEQ ID NO: 3010325 - RNA, 15 nt, Mycobacterium avium subsp. paratuberculosis
ucggccgagucgacg

SEQ ID NO: 3010326 - RNA, 12 nt, Mycobacterium avium subsp. paratuberculosis
ucggccgaugag

SEQ ID NO: 3010327 - RNA, 17 nt, Mycobacterium avium subsp. paratuberculosis
ucggccgcaagcgaagc

SEQ ID NO: 3010328 - RNA, 18 nt, Mycobacterium avium subsp. paratuberculosis
ucggccgcacgucccgcc

SEQ ID NO: 3010329 - RNA, 15 nt, Mycobacterium avium subsp. paratuberculosis
ucggccgccaccgag

SEQ ID NO: 3010330 - RNA, 14 nt, Mycobacterium avium subsp. paratuberculosis
ucggccgccagggc

SEQ ID NO: 3010331 - RNA, 13 nt, Mycobacterium avium subsp. paratuberculosis
ucggccgcccguc

SEQ ID NO: 3010332 - RNA, 14 nt, Mycobacterium avium subsp. paratuberculosis
ucggccgccgacac

SEQ ID NO: 3010333 - RNA, 20 nt, Mycobacterium avium subsp. paratuberculosis
ucggccgccgacaccaccac

SEQ ID NO: 3010334 - RNA, 18 nt, Mycobacterium avium subsp. paratuberculosis
ucggccgcgacgaccgcc

SEQ ID NO: 3010335 - RNA, 20 nt, Mycobacterium avium subsp. paratuberculosis
ucggccgcgcgugcccgcgg

SEQ ID NO: 3010336 - RNA, 22 nt, Mycobacterium avium subsp. paratuberculosis
ucggccgcgcgugcccgcgguc

SEQ ID NO: 3010337 - RNA, 18 nt, Mycobacterium avium subsp. paratuberculosis
ucggccgcggauggugac

SEQ ID NO: 3010338 - RNA, 15 nt, Mycobacterium avium subsp. paratuberculosis
ucggccgcggccggc

SEQ ID NO: 3010339 - RNA, 16 nt, Mycobacterium avium subsp. paratuberculosis
ucggccgcggccggcg

SEQ ID NO: 3010340 - RNA, 18 nt, Mycobacterium avium subsp. paratuberculosis
ucggccgcggccggcggc

SEQ ID NO: 3010341 - RNA, 19 nt, Mycobacterium avium subsp. paratuberculosis
ucggccgcggccggcggca

SEQ ID NO: 3010342 - RNA, 20 nt, Mycobacterium avium subsp. paratuberculosis
ucggccgcggccggcggcag

SEQ ID NO: 3010343 - RNA, 21 nt, Mycobacterium avium subsp. paratuberculosis
ucggccgcggggccggcgcug

SEQ ID NO: 3010344 - RNA, 14 nt, Mycobacterium avium subsp. paratuberculosis
ucggccgcgugcac

SEQ ID NO: 3010345 - RNA, 14 nt, Mycobacterium avium subsp. paratuberculosis
ucggccgcucgggu

SEQ ID NO: 3010346 - RNA, 23 nt, Mycobacterium avium subsp. paratuberculosis
ucggccgcugcccgggcaucccg

SEQ ID NO: 3010347 - RNA, 20 nt, Mycobacterium avium subsp. paratuberculosis
ucggccggauucucgcccgg

SEQ ID NO: 3010348 - RNA, 21 nt, Mycobacterium avium subsp. paratuberculosis
ucggccggauucucgcccggc

SEQ ID NO: 3010349 - RNA, 12 nt, Mycobacterium avium subsp. paratuberculosis
ucggccggcacc

SEQ ID NO: 3010350 - RNA, 14 nt, Mycobacterium avium subsp. paratuberculosis
ucggccggcaccuc

SEQ ID NO: 3010351 - RNA, 13 nt, Mycobacterium avium subsp. paratuberculosis
ucggccggcagcg

SEQ ID NO: 3010352 - RNA, 13 nt, Mycobacterium avium subsp. paratuberculosis
ucggccggcaggc

SEQ ID NO: 3010353 - RNA, 14 nt, Mycobacterium avium subsp. paratuberculosis
ucggccggccccgc

SEQ ID NO: 3010354 - RNA, 19 nt, Mycobacterium avium subsp. paratuberculosis
ucggccggccccgcccggc

SEQ ID NO: 3010355 - RNA, 20 nt, Mycobacterium avium subsp. paratuberculosis
ucggccggccccgcccggcg

SEQ ID NO: 3010356 - RNA, 22 nt, Mycobacterium avium subsp. paratuberculosis
ucggccggccccgcccggcgcg

SEQ ID NO: 3010357 - RNA, 15 nt, Mycobacterium avium subsp. paratuberculosis
ucggccggcugcagc

SEQ ID NO: 3010358 - RNA, 22 nt, Mycobacterium avium subsp. paratuberculosis
ucggccggcuugaucucgaccu

SEQ ID NO: 3010359 - RNA, 18 nt, Mycobacterium avium subsp. paratuberculosis
ucggccgggaaacccucg

SEQ ID NO: 3010360 - RNA, 13 nt, Mycobacterium avium subsp. paratuberculosis
ucggccgggccgg

SEQ ID NO: 3010361 - RNA, 19 nt, Mycobacterium avium subsp. paratuberculosis
ucggccgggccggcgguga

SEQ ID NO: 3010362 - RNA, 16 nt, Mycobacterium avium subsp. paratuberculosis
ucggccgggcugccca

SEQ ID NO: 3010363 - RNA, 23 nt, Mycobacterium avium subsp. paratuberculosis
ucggccgggcugcccaccaccag

SEQ ID NO: 3010364 - RNA, 13 nt, Mycobacterium avium subsp. paratuberculosis
ucggccggggcga

SEQ ID NO: 3010365 - RNA, 14 nt, Mycobacterium avium subsp. paratuberculosis
ucggccggggcgac

SEQ ID NO: 3010366 - RNA, 13 nt, Mycobacterium avium subsp. paratuberculosis
ucggccgggggcg

SEQ ID NO: 3010367 - RNA, 19 nt, Mycobacterium avium subsp. paratuberculosis
ucggccgggggcgcgggcg

SEQ ID NO: 3010368 - RNA, 22 nt, Mycobacterium avium subsp. paratuberculosis
ucggccgggggcgcgggcggca

SEQ ID NO: 3010369 - RNA, 16 nt, Mycobacterium avium subsp. paratuberculosis
ucggccggguccugga

SEQ ID NO: 3010370 - RNA, 21 nt, Mycobacterium avium subsp. paratuberculosis
ucggccgggucgcaggcagca

SEQ ID NO: 3010371 - RNA, 22 nt, Mycobacterium avium subsp. paratuberculosis
ucggccggguuguccuggcccu

SEQ ID NO: 3010372 - RNA, 18 nt, Mycobacterium avium subsp. paratuberculosis
ucggccgguccgugcacg

SEQ ID NO: 3010373 - RNA, 21 nt, Mycobacterium avium subsp. paratuberculosis
ucggccgguccgugcacggcc

SEQ ID NO: 3010374 - RNA, 13 nt, Mycobacterium avium subsp. paratuberculosis
ucggccgucggcg

SEQ ID NO: 3010375 - RNA, 19 nt, Mycobacterium avium subsp. paratuberculosis
ucggccgucggcgccgccg

SEQ ID NO: 3010376 - RNA, 20 nt, Mycobacterium avium subsp. paratuberculosis
ucggccgugaucucgugccg

SEQ ID NO: 3010377 - RNA, 21 nt, Mycobacterium avium subsp. paratuberculosis
ucggccgugaucucgugccgc

SEQ ID NO: 3010378 - RNA, 19 nt, Mycobacterium avium subsp. paratuberculosis
ucggccguggccgucacgc

SEQ ID NO: 3010379 - RNA, 14 nt, Mycobacterium avium subsp. paratuberculosis
ucggccucaggcgu

SEQ ID NO: 3010380 - RNA, 18 nt, Mycobacterium avium subsp. paratuberculosis
ucggccucaggcgucggu

SEQ ID NO: 3010381 - RNA, 22 nt, Mycobacterium avium subsp. paratuberculosis
ucggccucaggcgucggucagc

SEQ ID NO: 3010382 - RNA, 16 nt, Mycobacterium avium subsp. paratuberculosis
ucggccuccagccggc

SEQ ID NO: 3010383 - RNA, 21 nt, Mycobacterium avium subsp. paratuberculosis
ucggccucccgguaggcggcg

SEQ ID NO: 3010384 - RNA, 14 nt, Mycobacterium avium subsp. paratuberculosis
ucggccucggcggu

SEQ ID NO: 3010385 - RNA, 16 nt, Mycobacterium avium subsp. paratuberculosis
ucggccucgucgacgu

SEQ ID NO: 3010386 - RNA, 17 nt, Mycobacterium avium subsp. paratuberculosis
ucggccucgucgacguc

SEQ ID NO: 3010387 - RNA, 18 nt, Mycobacterium avium subsp. paratuberculosis
ucggccucgucgacgucg

SEQ ID NO: 3010388 - RNA, 21 nt, Mycobacterium avium subsp. paratuberculosis
ucggccucgucgacgucgggg

SEQ ID NO: 3010389 - RNA, 19 nt, Mycobacterium avium subsp. paratuberculosis
ucggccugcacgucggcgc

SEQ ID NO: 3010390 - RNA, 21 nt, Mycobacterium avium subsp. paratuberculosis
ucggccugcacgucggcgcgc

SEQ ID NO: 3010391 - RNA, 22 nt, Mycobacterium avium subsp. paratuberculosis
ucggccugcacgucggcgcgca

SEQ ID NO: 3010392 - RNA, 17 nt, Mycobacterium avium subsp. paratuberculosis
ucggccugcccgcgggu

SEQ ID NO: 3010393 - RNA, 23 nt, Mycobacterium avium subsp. paratuberculosis
ucggccugcccgcggguggccuu

SEQ ID NO: 3010394 - RNA, 16 nt, Mycobacterium avium subsp. paratuberculosis
ucggccugcgcccggc

SEQ ID NO: 3010395 - RNA, 14 nt, Mycobacterium avium subsp. paratuberculosis
ucggccugcgcugc

SEQ ID NO: 3010396 - RNA, 20 nt, Mycobacterium avium subsp. paratuberculosis
ucggccugcgcugcggccaa

SEQ ID NO: 3010397 - RNA, 22 nt, Mycobacterium avium subsp. paratuberculosis
ucggccuuacgcugcgcgaccu

SEQ ID NO: 3010398 - RNA, 21 nt, Mycobacterium avium subsp. paratuberculosis
ucggccuucagcguccacgau

SEQ ID NO: 3010399 - RNA, 21 nt, Mycobacterium avium subsp. paratuberculosis
ucggccuucgggguggucacc

SEQ ID NO: 3010400 - RNA, 21 nt, Mycobacterium avium subsp. paratuberculosis
ucggccuugagccggucgugc

SEQ ID NO: 3010401 - RNA, 17 nt, Mycobacterium avium subsp. paratuberculosis
ucggccuuggccaccgc

SEQ ID NO: 3010402 - RNA, 14 nt, Mycobacterium avium subsp. paratuberculosis
ucggcgaacagugc

SEQ ID NO: 3010403 - RNA, 23 nt, Mycobacterium avium subsp. paratuberculosis
ucggcgaacagugcacugccgac

SEQ ID NO: 3010404 - RNA, 16 nt, Mycobacterium avium subsp. paratuberculosis
ucggcgaaccagggca

SEQ ID NO: 3010405 - RNA, 23 nt, Mycobacterium avium subsp. paratuberculosis
ucggcgaaccagggcagccagcc

SEQ ID NO: 3010406 - RNA, 16 nt, Mycobacterium avium subsp. paratuberculosis
ucggcgaacgcccggu

SEQ ID NO: 3010407 - RNA, 21 nt, Mycobacterium avium subsp. paratuberculosis
ucggcgaacggccaguccagg

SEQ ID NO: 3010408 - RNA, 15 nt, Mycobacterium avium subsp. paratuberculosis
ucggcgaaggcgcgc

SEQ ID NO: 3010409 - RNA, 17 nt, Mycobacterium avium subsp. paratuberculosis
ucggcgaaggcgcgcag

SEQ ID NO: 3010410 - RNA, 21 nt, Mycobacterium avium subsp. paratuberculosis
ucggcgaaggugccccgcugg

SEQ ID NO: 3010411 - RNA, 20 nt, Mycobacterium avium subsp. paratuberculosis
ucggcgaagucaucaccggg

SEQ ID NO: 3010412 - RNA, 22 nt, Mycobacterium avium subsp. paratuberculosis
ucggcgaagucaucaccgggga

SEQ ID NO: 3010413 - RNA, 16 nt, Mycobacterium avium subsp. paratuberculosis
ucggcgacaacagcgc

SEQ ID NO: 3010414 - RNA, 20 nt, Mycobacterium avium subsp. paratuberculosis
ucggcgacaacagcgccgag

SEQ ID NO: 3010415 - RNA, 15 nt, Mycobacterium avium subsp. paratuberculosis
ucggcgaccaauugc

SEQ ID NO: 3010416 - RNA, 13 nt, Mycobacterium avium subsp. paratuberculosis
ucggcgaccagcg

SEQ ID NO: 3010417 - RNA, 18 nt, Mycobacterium avium subsp. paratuberculosis
ucggcgaccagcgacggc

SEQ ID NO: 3010418 - RNA, 20 nt, Mycobacterium avium subsp. paratuberculosis
ucggcgaccagcgacggcag

SEQ ID NO: 3010419 - RNA, 17 nt, Mycobacterium avium subsp. paratuberculosis
ucggcgacccgcacgau

SEQ ID NO: 3010420 - RNA, 12 nt, Mycobacterium avium subsp. paratuberculosis
ucggcgaccgcc

SEQ ID NO: 3010421 - RNA, 13 nt, Mycobacterium avium subsp. paratuberculosis
ucggcgaccgccc

SEQ ID NO: 3010422 - RNA, 19 nt, Mycobacterium avium subsp. paratuberculosis
ucggcgaccgcccggggcg

SEQ ID NO: 3010423 - RNA, 21 nt, Mycobacterium avium subsp. paratuberculosis
ucggcgaccgccgguggggug

SEQ ID NO: 3010424 - RNA, 20 nt, Mycobacterium avium subsp. paratuberculosis
ucggcgaccgcgcgcggcgc

SEQ ID NO: 3010425 - RNA, 22 nt, Mycobacterium avium subsp. paratuberculosis
ucggcgaccgcgcgcggcgccg

SEQ ID NO: 3010426 - RNA, 20 nt, Mycobacterium avium subsp. paratuberculosis
ucggcgaccuccugcaaggc

SEQ ID NO: 3010427 - RNA, 12 nt, Mycobacterium avium subsp. paratuberculosis
ucggcgacgacc

SEQ ID NO: 3010428 - RNA, 22 nt, Mycobacterium avium subsp. paratuberculosis
ucggcgacgaccuucuggccuu

SEQ ID NO: 3010429 - RNA, 22 nt, Mycobacterium avium subsp. paratuberculosis
ucggcgacgauggccaggccca

SEQ ID NO: 3010430 - RNA, 12 nt, Mycobacterium avium subsp. paratuberculosis
ucggcgacgccg

SEQ ID NO: 3010431 - RNA, 13 nt, Mycobacterium avium subsp. paratuberculosis
ucggcgacgccgc

SEQ ID NO: 3010432 - RNA, 16 nt, Mycobacterium avium subsp. paratuberculosis
ucggcgacgccgccgu

SEQ ID NO: 3010433 - RNA, 15 nt, Mycobacterium avium subsp. paratuberculosis
gguggaacuggacgc

SEQ ID NO: 3010434 - RNA, 21 nt, Mycobacterium avium subsp. paratuberculosis
gguggaacuggacgccgugga

SEQ ID NO: 3010435 - RNA, 17 nt, Mycobacterium avium subsp. paratuberculosis
gguggaaggugacgucg

SEQ ID NO: 3010436 - RNA, 18 nt, Mycobacterium avium subsp. paratuberculosis
gguggaauaggccgcgua

SEQ ID NO: 3010437 - RNA, 22 nt, Mycobacterium avium subsp. paratuberculosis
gguggaauucuggccgaccgcc

SEQ ID NO: 3010438 - RNA, 20 nt, Mycobacterium avium subsp. paratuberculosis
gguggacagaugccagacga

SEQ ID NO: 3010439 - RNA, 20 nt, Mycobacterium avium subsp. paratuberculosis
gguggacagcgcgacgggca

SEQ ID NO: 3010440 - RNA, 20 nt, Mycobacterium avium subsp. paratuberculosis
gguggacgaggugaccggcg

SEQ ID NO: 3010441 - RNA, 14 nt, Mycobacterium avium subsp. paratuberculosis
gguggacgcccgcg

SEQ ID NO: 3010442 - RNA, 19 nt, Mycobacterium avium subsp. paratuberculosis
gguggacgcccgcgaggug

SEQ ID NO: 3010443 - RNA, 14 nt, Mycobacterium avium subsp. paratuberculosis
gguggacgccgcgc

SEQ ID NO: 3010444 - RNA, 23 nt, Mycobacterium avium subsp. paratuberculosis
gguggacgcgaccaggcccagcg

SEQ ID NO: 3010445 - RNA, 23 nt, Mycobacterium avium subsp. paratuberculosis
gguggacuccagcaccagcacgg

SEQ ID NO: 3010446 - RNA, 13 nt, Mycobacterium avium subsp. paratuberculosis
gguggagcacagc

SEQ ID NO: 3010447 - RNA, 20 nt, Mycobacterium avium subsp. paratuberculosis
gguggagcacagcacggcau

SEQ ID NO: 3010448 - RNA, 22 nt, Mycobacterium avium subsp. paratuberculosis
gguggagcgcggcaugccgccc

SEQ ID NO: 3010449 - RNA, 19 nt, Mycobacterium avium subsp. paratuberculosis
gguggauauuucgcggccg

SEQ ID NO: 3010450 - RNA, 20 nt, Mycobacterium avium subsp. paratuberculosis
gguggauauuucgcggccga

SEQ ID NO: 3010451 - RNA, 19 nt, Mycobacterium avium subsp. paratuberculosis
gguggauccggugaccgcg

SEQ ID NO: 3010452 - RNA, 23 nt, Mycobacterium avium subsp. paratuberculosis
gguggaucuugacggcgacggcg

SEQ ID NO: 3010453 - RNA, 17 nt, Mycobacterium avium subsp. paratuberculosis
gguggaugaugccggcg

SEQ ID NO: 3010454 - RNA, 18 nt, Mycobacterium avium subsp. paratuberculosis
gguggaugaugccggcgg

SEQ ID NO: 3010455 - RNA, 13 nt, Mycobacterium avium subsp. paratuberculosis
gguggaugggcuc

SEQ ID NO: 3010456 - RNA, 21 nt, Mycobacterium avium subsp. paratuberculosis
gguggauugucggccgcccgu

SEQ ID NO: 3010457 - RNA, 16 nt, Mycobacterium avium subsp. paratuberculosis
gguggcaccccgcgcc

SEQ ID NO: 3010458 - RNA, 21 nt, Mycobacterium avium subsp. paratuberculosis
gguggcaccccgcgccgggcg

SEQ ID NO: 3010459 - RNA, 14 nt, Mycobacterium avium subsp. paratuberculosis
gguggcacgccacu

SEQ ID NO: 3010460 - RNA, 18 nt, Mycobacterium avium subsp. paratuberculosis
gguggcagcggacccggu

SEQ ID NO: 3010461 - RNA, 22 nt, Mycobacterium avium subsp. paratuberculosis
gguggcagcggacccggucggc

SEQ ID NO: 3010462 - RNA, 12 nt, Mycobacterium avium subsp. paratuberculosis
gguggccaccgc

SEQ ID NO: 3010463 - RNA, 14 nt, Mycobacterium avium subsp. paratuberculosis
gguggccaccgcga

SEQ ID NO: 3010464 - RNA, 18 nt, Mycobacterium avium subsp. paratuberculosis
gguggccaccgcgacgcc

SEQ ID NO: 3010465 - RNA, 14 nt, Mycobacterium avium subsp. paratuberculosis
gguggccagcacca

SEQ ID NO: 3010466 - RNA, 20 nt, Mycobacterium avium subsp. paratuberculosis
gguggccagcaccagcccga

SEQ ID NO: 3010467 - RNA, 16 nt, Mycobacterium avium subsp. paratuberculosis
gguggccagcaccgcg

SEQ ID NO: 3010468 - RNA, 19 nt, Mycobacterium avium subsp. paratuberculosis
gguggccagcaccgcgucg

SEQ ID NO: 3010469 - RNA, 12 nt, Mycobacterium avium subsp. paratuberculosis
gguggccagcag

SEQ ID NO: 3010470 - RNA, 13 nt, Mycobacterium avium subsp. paratuberculosis
gguggccagccgg

SEQ ID NO: 3010471 - RNA, 16 nt, Mycobacterium avium subsp. paratuberculosis
gguggccagccgggcg

SEQ ID NO: 3010472 - RNA, 19 nt, Mycobacterium avium subsp. paratuberculosis
gguggccagccgggcgacc

SEQ ID NO: 3010473 - RNA, 21 nt, Mycobacterium avium subsp. paratuberculosis
gguggccagcuucaccggucg

SEQ ID NO: 3010474 - RNA, 16 nt, Mycobacterium avium subsp. paratuberculosis
gguggccaucgcggcc

SEQ ID NO: 3010475 - RNA, 16 nt, Mycobacterium avium subsp. paratuberculosis
gguggcccaaucggug

SEQ ID NO: 3010476 - RNA, 18 nt, Mycobacterium avium subsp. paratuberculosis
gguggcccaaucggugcg

SEQ ID NO: 3010477 - RNA, 14 nt, Mycobacterium avium subsp. paratuberculosis
gguggcccagccgc

SEQ ID NO: 3010478 - RNA, 22 nt, Mycobacterium avium subsp. paratuberculosis
gguggcccaggcagacccccag

SEQ ID NO: 3010479 - RNA, 14 nt, Mycobacterium avium subsp. paratuberculosis
gguggccccagccc

SEQ ID NO: 3010480 - RNA, 17 nt, Mycobacterium avium subsp. paratuberculosis
gguggccccagcccggg

SEQ ID NO: 3010481 - RNA, 23 nt, Mycobacterium avium subsp. paratuberculosis
gguggccccagcccggggguggc

SEQ ID NO: 3010482 - RNA, 17 nt, Mycobacterium avium subsp. paratuberculosis
gguggccccgggccgca

SEQ ID NO: 3010483 - RNA, 23 nt, Mycobacterium avium subsp. paratuberculosis
gguggccccgggccgcagggugg

SEQ ID NO: 3010484 - RNA, 17 nt, Mycobacterium avium subsp. paratuberculosis
gguggcccgcccgggca

SEQ ID NO: 3010485 - RNA, 18 nt, Mycobacterium avium subsp. paratuberculosis
gguggcccgguacagcgc

SEQ ID NO: 3010486 - RNA, 15 nt, Mycobacterium avium subsp. paratuberculosis
gguggcccggucguc

SEQ ID NO: 3010487 - RNA, 24 nt, Mycobacterium avium subsp. paratuberculosis
gguggccgaacgggucggcgacca

SEQ ID NO: 3010488 - RNA, 13 nt, Mycobacterium avium subsp. paratuberculosis
gguggccgagggu

SEQ ID NO: 3010489 - RNA, 18 nt, Mycobacterium avium subsp. paratuberculosis
gguggccgaucagcggcg

SEQ ID NO: 3010490 - RNA, 17 nt, Mycobacterium avium subsp. paratuberculosis
gguggccgccaccaaca

SEQ ID NO: 3010491 - RNA, 15 nt, Mycobacterium avium subsp. paratuberculosis
gguggccgccaccag

SEQ ID NO: 3010492 - RNA, 13 nt, Mycobacterium avium subsp. paratuberculosis
gguggccgccagc

SEQ ID NO: 3010493 - RNA, 16 nt, Mycobacterium avium subsp. paratuberculosis
gguggccgcgcugguc

SEQ ID NO: 3010494 - RNA, 17 nt, Mycobacterium avium subsp. paratuberculosis
gguggccgcgcugguca

SEQ ID NO: 3010495 - RNA, 12 nt, Mycobacterium avium subsp. paratuberculosis
gguggccgcggc

SEQ ID NO: 3010496 - RNA, 14 nt, Mycobacterium avium subsp. paratuberculosis
gguggccgcggccg

SEQ ID NO: 3010497 - RNA, 19 nt, Mycobacterium avium subsp. paratuberculosis
gguggccgcgucgaccagc

SEQ ID NO: 3010498 - RNA, 17 nt, Mycobacterium avium subsp. paratuberculosis
gguggccggccagcaca

SEQ ID NO: 3010499 - RNA, 13 nt, Mycobacterium avium subsp. paratuberculosis
gguggccggggcc

SEQ ID NO: 3010500 - RNA, 14 nt, Mycobacterium avium subsp. paratuberculosis
gguggccgggucgc

SEQ ID NO: 3010501 - RNA, 19 nt, Mycobacterium avium subsp. paratuberculosis
gguggccggugggcggcgc

SEQ ID NO: 3010502 - RNA, 20 nt, Mycobacterium avium subsp. paratuberculosis
gguggccggugggcggcgcc

SEQ ID NO: 3010503 - RNA, 16 nt, Mycobacterium avium subsp. paratuberculosis
gguggccgucgccucg

SEQ ID NO: 3010504 - RNA, 19 nt, Mycobacterium avium subsp. paratuberculosis
gguggccgucgccucgccc

SEQ ID NO: 3010505 - RNA, 23 nt, Mycobacterium avium subsp. paratuberculosis
gguggccgucgccucgcccucgg

SEQ ID NO: 3010506 - RNA, 19 nt, Mycobacterium avium subsp. paratuberculosis
gguggccgucggccugcgc

SEQ ID NO: 3010507 - RNA, 23 nt, Mycobacterium avium subsp. paratuberculosis
gguggccgucucgucggccgcga

SEQ ID NO: 3010508 - RNA, 18 nt, Mycobacterium avium subsp. paratuberculosis
gguggccgugaagggguc

SEQ ID NO: 3010509 - RNA, 23 nt, Mycobacterium avium subsp. paratuberculosis
gguggccuccggagugacgucgc

SEQ ID NO: 3010510 - RNA, 15 nt, Mycobacterium avium subsp. paratuberculosis
gguggccucggcgcu

SEQ ID NO: 3010511 - RNA, 14 nt, Mycobacterium avium subsp. paratuberculosis
gguggccucgucgg

SEQ ID NO: 3010512 - RNA, 17 nt, Mycobacterium avium subsp. paratuberculosis
gguggccugcccggcgg

SEQ ID NO: 3010513 - RNA, 19 nt, Mycobacterium avium subsp. paratuberculosis
gguggccuucaucaccgcc

SEQ ID NO: 3010514 - RNA, 21 nt, Mycobacterium avium subsp. paratuberculosis
gguggccuucaucaccgcccc

SEQ ID NO: 3010515 - RNA, 23 nt, Mycobacterium avium subsp. paratuberculosis
gguggccuucaucaccgccccga

SEQ ID NO: 3010516 - RNA, 22 nt, Mycobacterium avium subsp. paratuberculosis
gguggccuugcugauccccagc

SEQ ID NO: 3010517 - RNA, 17 nt, Mycobacterium avium subsp. paratuberculosis
gguggccuuggccacca

SEQ ID NO: 3010518 - RNA, 17 nt, Mycobacterium avium subsp. paratuberculosis
gguggcgaacagcgggu

SEQ ID NO: 3010519 - RNA, 23 nt, Mycobacterium avium subsp. paratuberculosis
gguggcgaacugcaccagcacga

SEQ ID NO: 3010520 - RNA, 14 nt, Mycobacterium avium subsp. paratuberculosis
gguggcgaagcacg

SEQ ID NO: 3010521 - RNA, 15 nt, Mycobacterium avium subsp. paratuberculosis
gguggcgaagcacga

SEQ ID NO: 3010522 - RNA, 23 nt, Mycobacterium avium subsp. paratuberculosis
gguggcgacaacaggcgaccucg

SEQ ID NO: 3010523 - RNA, 18 nt, Mycobacterium avium subsp. paratuberculosis
gguggcgaucaccgcggc

SEQ ID NO: 3010524 - RNA, 23 nt, Mycobacterium avium subsp. paratuberculosis
gguggcgaugacgaauuccgcac

SEQ ID NO: 3010525 - RNA, 15 nt, Mycobacterium avium subsp. paratuberculosis
gguggcgaugaucac

SEQ ID NO: 3010526 - RNA, 22 nt, Mycobacterium avium subsp. paratuberculosis
gguggcgauggugcugcccggc

SEQ ID NO: 3010527 - RNA, 23 nt, Mycobacterium avium subsp. paratuberculosis
gguggcgcacaacccggacagcg

SEQ ID NO: 3010528 - RNA, 13 nt, Mycobacterium avium subsp. paratuberculosis
gguggcgcccagc

SEQ ID NO: 3010529 - RNA, 13 nt, Mycobacterium avium subsp. paratuberculosis
gguggcgcccgcg

SEQ ID NO: 3010530 - RNA, 18 nt, Mycobacterium avium subsp. paratuberculosis
gguggcgcccgcggugga

SEQ ID NO: 3010531 - RNA, 14 nt, Mycobacterium avium subsp. paratuberculosis
gguggcgccgcgca

SEQ ID NO: 3010532 - RNA, 16 nt, Mycobacterium avium subsp. paratuberculosis
gguggcgccgcgcagc

SEQ ID NO: 3010533 - RNA, 12 nt, Mycobacterium avium subsp. paratuberculosis
gguggcgccggc

SEQ ID NO: 3010534 - RNA, 17 nt, Mycobacterium avium subsp. paratuberculosis
gguggcgccggcaucga

SEQ ID NO: 3010535 - RNA, 18 nt, Mycobacterium avium subsp. paratuberculosis
gguggcgccggccagcac

SEQ ID NO: 3010536 - RNA, 20 nt, Mycobacterium avium subsp. paratuberculosis
gguggcgccggccagcacca

SEQ ID NO: 3010537 - RNA, 13 nt, Mycobacterium avium subsp. paratuberculosis
gguggcgccggua

SEQ ID NO: 3010538 - RNA, 17 nt, Mycobacterium avium subsp. paratuberculosis
gguggcgccgguaggcg

SEQ ID NO: 3010539 - RNA, 19 nt, Mycobacterium avium subsp. paratuberculosis
gguggcgccuccgcccggg

SEQ ID NO: 3010540 - RNA, 14 nt, Mycobacterium avium subsp. paratuberculosis
gguggcggccacca

SEQ ID NO: 3010541 - RNA, 13 nt, Mycobacterium avium subsp. paratuberculosis
gguggcggccacg

SEQ ID NO: 3010542 - RNA, 15 nt, Mycobacterium avium subsp. paratuberculosis
gguggcggccggggu

SEQ ID NO: 3010543 - RNA, 10 nt, Mycobacterium avium subsp. paratuberculosis
gguggcggcg

SEQ ID NO: 3010544 - RNA, 20 nt, Mycobacterium avium subsp. paratuberculosis
gguggcggcgaacgcgcggu

SEQ ID NO: 3010545 - RNA, 14 nt, Mycobacterium avium subsp. paratuberculosis
gguggcggcgagga

SEQ ID NO: 3010546 - RNA, 16 nt, Mycobacterium avium subsp. paratuberculosis
gguggcggcgaugucg

SEQ ID NO: 3010547 - RNA, 11 nt, Mycobacterium avium subsp. paratuberculosis
gguggcggucc

SEQ ID NO: 3010548 - RNA, 12 nt, Mycobacterium avium subsp. paratuberculosis
gguggcgguccc

SEQ ID NO: 3010549 - RNA, 18 nt, Mycobacterium avium subsp. paratuberculosis
gguggcggucccggcgga

SEQ ID NO: 3010550 - RNA, 13 nt, Mycobacterium avium subsp. paratuberculosis
gguggcggugccg

SEQ ID NO: 3010551 - RNA, 16 nt, Mycobacterium avium subsp. paratuberculosis
gguggcggugccgcgg

SEQ ID NO: 3010552 - RNA, 15 nt, Mycobacterium avium subsp. paratuberculosis
gguggcggugcgguc

SEQ ID NO: 3010553 - RNA, 15 nt, Mycobacterium avium subsp. paratuberculosis
gguggcgguguucga

SEQ ID NO: 3010554 - RNA, 21 nt, Mycobacterium avium subsp. paratuberculosis
gguggcguccagcggguugcc

SEQ ID NO: 3010555 - RNA, 17 nt, Mycobacterium avium subsp. paratuberculosis
gguggcguccuugccga

SEQ ID NO: 3010556 - RNA, 13 nt, Mycobacterium avium subsp. paratuberculosis
gguggcgucgacg

SEQ ID NO: 3010557 - RNA, 18 nt, Mycobacterium avium subsp. paratuberculosis
gguggcgucgccgccggu

SEQ ID NO: 3010558 - RNA, 23 nt, Mycobacterium avium subsp. paratuberculosis
gguggcgucgccgccggugccga

SEQ ID NO: 3010559 - RNA, 14 nt, Mycobacterium avium subsp. paratuberculosis
gguggcgucggcgu

SEQ ID NO: 3010560 - RNA, 17 nt, Mycobacterium avium subsp. paratuberculosis
gguggcgucggcgucga

SEQ ID NO: 3010561 - RNA, 15 nt, Mycobacterium avium subsp. paratuberculosis
gguggcgugcagcgc

SEQ ID NO: 3010562 - RNA, 15 nt, Mycobacterium avium subsp. paratuberculosis
ggugggcaccagcag

SEQ ID NO: 3010563 - RNA, 20 nt, Mycobacterium avium subsp. paratuberculosis
ggugggcaccagcagcgcga

SEQ ID NO: 3010564 - RNA, 22 nt, Mycobacterium avium subsp. paratuberculosis
ggugggcaccagcagcgcgacg

SEQ ID NO: 3010565 - RNA, 19 nt, Mycobacterium avium subsp. paratuberculosis
ggugggcaccagcugcgga

SEQ ID NO: 3010566 - RNA, 23 nt, Mycobacterium avium subsp. paratuberculosis
ggugggcaccuggccgucggugg

SEQ ID NO: 3010567 - RNA, 14 nt, Mycobacterium avium subsp. paratuberculosis
ggugggcagaugcc

SEQ ID NO: 3010568 - RNA, 16 nt, Mycobacterium avium subsp. paratuberculosis
ggugggcagccccagc

SEQ ID NO: 3010569 - RNA, 15 nt, Mycobacterium avium subsp. paratuberculosis
ggugggcagccggca

SEQ ID NO: 3010570 - RNA, 20 nt, Mycobacterium avium subsp. paratuberculosis
ggugggcagcucgguggccg

SEQ ID NO: 3010571 - RNA, 22 nt, Mycobacterium avium subsp. paratuberculosis
ggugggcagcucgucggcgcgc

SEQ ID NO: 3010572 - RNA, 24 nt, Mycobacterium avium subsp. paratuberculosis
ggugggcagcucgucggcgcgcca

SEQ ID NO: 3010573 - RNA, 15 nt, Mycobacterium avium subsp. paratuberculosis
ggugggccaucgcca

SEQ ID NO: 3010574 - RNA, 17 nt, Mycobacterium avium subsp. paratuberculosis
ggugggcccgccgucga

SEQ ID NO: 3010575 - RNA, 21 nt, Mycobacterium avium subsp. paratuberculosis
ggugggccgaccugcacgcug

SEQ ID NO: 3010576 - RNA, 13 nt, Mycobacterium avium subsp. paratuberculosis
ggugggcgacgag

SEQ ID NO: 3010577 - RNA, 18 nt, Mycobacterium avium subsp. paratuberculosis
ggugggcgcgggccgcgu

SEQ ID NO: 3010578 - RNA, 13 nt, Mycobacterium avium subsp. paratuberculosis
ggugggcggccac

SEQ ID NO: 3010579 - RNA, 16 nt, Mycobacterium avium subsp. paratuberculosis
ggugggcggcgggagc

SEQ ID NO: 3010580 - RNA, 18 nt, Mycobacterium avium subsp. paratuberculosis
ggugggcgucguggucga

SEQ ID NO: 3010581 - RNA, 20 nt, Mycobacterium avium subsp. paratuberculosis
ggugggcgucguggucgacg

SEQ ID NO: 3010582 - RNA, 17 nt, Mycobacterium avium subsp. paratuberculosis
ggugggcgugcaggccg

SEQ ID NO: 3010583 - RNA, 20 nt, Mycobacterium avium subsp. paratuberculosis
ggugggcgugcaggccgcgg

SEQ ID NO: 3010584 - RNA, 15 nt, Mycobacterium avium subsp. paratuberculosis
ggugggcgugccggg

SEQ ID NO: 3010585 - RNA, 13 nt, Mycobacterium avium subsp. paratuberculosis
ggugggcguggcg

SEQ ID NO: 3010586 - RNA, 18 nt, Mycobacterium avium subsp. paratuberculosis
ggugggcguggcgggcca

SEQ ID NO: 3010587 - RNA, 14 nt, Mycobacterium avium subsp. paratuberculosis
ggugggcucggcgc

SEQ ID NO: 3010588 - RNA, 17 nt, Mycobacterium avium subsp. paratuberculosis
ggugggcuuagcggggu

SEQ ID NO: 3010589 - RNA, 16 nt, Mycobacterium avium subsp. paratuberculosis
gguggggaucacgucg

SEQ ID NO: 3010590 - RNA, 19 nt, Mycobacterium avium subsp. paratuberculosis
gguggggaucacgucggcg

SEQ ID NO: 3010591 - RNA, 20 nt, Mycobacterium avium subsp. paratuberculosis
gguggggcagcaccucgcgc

SEQ ID NO: 3010592 - RNA, 21 nt, Mycobacterium avium subsp. paratuberculosis
gguggggccgaugaccgcggc

SEQ ID NO: 3010593 - RNA, 13 nt, Mycobacterium avium subsp. paratuberculosis
gguggggccgccg

SEQ ID NO: 3010594 - RNA, 15 nt, Mycobacterium avium subsp. paratuberculosis
gguggggcuggccgc

SEQ ID NO: 3010595 - RNA, 13 nt, Mycobacterium avium subsp. paratuberculosis
ggugggggucugg

SEQ ID NO: 3010596 - RNA, 16 nt, Mycobacterium avium subsp. paratuberculosis
ggugggguagacggca

SEQ ID NO: 3010597 - RNA, 13 nt, Mycobacterium avium subsp. paratuberculosis
ggugggguggugg

SEQ ID NO: 3010598 - RNA, 14 nt, Mycobacterium avium subsp. paratuberculosis
ggugggguggugga

SEQ ID NO: 3010599 - RNA, 19 nt, Mycobacterium avium subsp. paratuberculosis
gguggguccgccgggcgcg

SEQ ID NO: 3010600 - RNA, 17 nt, Mycobacterium avium subsp. paratuberculosis
ggugggugcucaccccg

SEQ ID NO: 3010601 - RNA, 19 nt, Mycobacterium avium subsp. paratuberculosis
ggugggugcucaccccggc

SEQ ID NO: 3010602 - RNA, 22 nt, Mycobacterium avium subsp. paratuberculosis
ggugguagacagcguggucgcg

SEQ ID NO: 3010603 - RNA, 23 nt, Mycobacterium avium subsp. paratuberculosis
ggugguagacagcguggucgcgc

SEQ ID NO: 3010604 - RNA, 14 nt, Mycobacterium avium subsp. paratuberculosis
gguggucaccagcg

SEQ ID NO: 3010605 - RNA, 19 nt, Mycobacterium avium subsp. paratuberculosis
gguggucaccagcgcgguc

SEQ ID NO: 3010606 - RNA, 13 nt, Mycobacterium avium subsp. paratuberculosis
gguggucaccgug

SEQ ID NO: 3010607 - RNA, 17 nt, Mycobacterium avium subsp. paratuberculosis
gguggucagcaccggcg

SEQ ID NO: 3010608 - RNA, 15 nt, Mycobacterium avium subsp. paratuberculosis
gguggucagcgcggu

SEQ ID NO: 3010609 - RNA, 16 nt, Mycobacterium avium subsp. paratuberculosis
gguggucagcggcgcc

SEQ ID NO: 3010610 - RNA, 14 nt, Mycobacterium avium subsp. paratuberculosis
ggugguccacccag

SEQ ID NO: 3010611 - RNA, 16 nt, Mycobacterium avium subsp. paratuberculosis
ggugguccacccagaa

SEQ ID NO: 3010612 - RNA, 19 nt, Mycobacterium avium subsp. paratuberculosis
ggugguccuggcgguggcc

SEQ ID NO: 3010613 - RNA, 17 nt, Mycobacterium avium subsp. paratuberculosis
gguggucgaacuggcgc

SEQ ID NO: 3010614 - RNA, 13 nt, Mycobacterium avium subsp. paratuberculosis
gguggucgacgag

SEQ ID NO: 3010615 - RNA, 19 nt, Mycobacterium avium subsp. paratuberculosis
gguggucgagcuccuccgg

SEQ ID NO: 3010616 - RNA, 14 nt, Mycobacterium avium subsp. paratuberculosis
gguggucgccgucg

SEQ ID NO: 3010617 - RNA, 12 nt, Mycobacterium avium subsp. paratuberculosis
gguggucgucga

SEQ ID NO: 3010618 - RNA, 23 nt, Mycobacterium avium subsp. paratuberculosis
gguggucugccagaacggcggca

SEQ ID NO: 3010619 - RNA, 17 nt, Mycobacterium avium subsp. paratuberculosis
gguggugaucacccagc

SEQ ID NO: 3010620 - RNA, 19 nt, Mycobacterium avium subsp. paratuberculosis
gguggugaucggccaggcg

SEQ ID NO: 3010621 - RNA, 20 nt, Mycobacterium avium subsp. paratuberculosis
gguggugauuguaggugugc

SEQ ID NO: 3010622 - RNA, 14 nt, Mycobacterium avium subsp. paratuberculosis
gguggugccgccgu

SEQ ID NO: 3010623 - RNA, 17 nt, Mycobacterium avium subsp. paratuberculosis
gguggugccgccgucga

SEQ ID NO: 3010624 - RNA, 14 nt, Mycobacterium avium subsp. paratuberculosis
gguggugcggcccu

SEQ ID NO: 3010625 - RNA, 14 nt, Mycobacterium avium subsp. paratuberculosis
ggugguggaaggug

SEQ ID NO: 3010626 - RNA, 14 nt, Mycobacterium avium subsp. paratuberculosis
ggugguggcguugg

SEQ ID NO: 3010627 - RNA, 15 nt, Mycobacterium avium subsp. paratuberculosis
gguggugggcgcggu

SEQ ID NO: 3010628 - RNA, 16 nt, Mycobacterium avium subsp. paratuberculosis
gguggugugcaaggcg

SEQ ID NO: 3010629 - RNA, 14 nt, Mycobacterium avium subsp. paratuberculosis
ggugguguggcagg

SEQ ID NO: 3010630 - RNA, 14 nt, Mycobacterium avium subsp. paratuberculosis
ggugguucgcgcga

SEQ ID NO: 3010631 - RNA, 14 nt, Mycobacterium avium subsp. paratuberculosis
ggugguugaucacg

SEQ ID NO: 3010632 - RNA, 18 nt, Mycobacterium avium subsp. paratuberculosis
ggugguugaucacgggca

SEQ ID NO: 3010633 - RNA, 20 nt, Mycobacterium avium subsp. paratuberculosis
ggugguugaucacgggcaca

SEQ ID NO: 3010634 - RNA, 14 nt, Mycobacterium avium subsp. paratuberculosis
ggugguuggccgcc

SEQ ID NO: 3010635 - RNA, 17 nt, Mycobacterium avium subsp. paratuberculosis
gguguaacgcgucgacg

SEQ ID NO: 3010636 - RNA, 20 nt, Mycobacterium avium subsp. paratuberculosis
gguguacagcgcgccgcgga

SEQ ID NO: 3010637 - RNA, 17 nt, Mycobacterium avium subsp. paratuberculosis
gguguagacgcgggccg

SEQ ID NO: 3010638 - RNA, 22 nt, Mycobacterium avium subsp. paratuberculosis
gguguagcgagugccggccagc

SEQ ID NO: 3010639 - RNA, 14 nt, Mycobacterium avium subsp. paratuberculosis
gguguagcggcggc

SEQ ID NO: 3010640 - RNA, 22 nt, Mycobacterium avium subsp. paratuberculosis
gguguaguccugcuucagcucg

SEQ ID NO: 3010641 - RNA, 19 nt, Mycobacterium avium subsp. paratuberculosis
gguguauucgcccaccccg

SEQ ID NO: 3010642 - RNA, 15 nt, Mycobacterium avium subsp. paratuberculosis
ggugucaccgacgcc

SEQ ID NO: 3010643 - RNA, 19 nt, Mycobacterium avium subsp. paratuberculosis
ggugucacgcuggcgugac

SEQ ID NO: 3010644 - RNA, 22 nt, Mycobacterium avium subsp. paratuberculosis
ggugucacguccacgccgcggg

SEQ ID NO: 3010645 - RNA, 14 nt, Mycobacterium avium subsp. paratuberculosis
ggugucagcgcgac

SEQ ID NO: 3010646 - RNA, 18 nt, Mycobacterium avium subsp. paratuberculosis
ggugucagcgcgaccucg

SEQ ID NO: 3010647 - RNA, 17 nt, Mycobacterium avium subsp. paratuberculosis
ggugucaggucggcgau

SEQ ID NO: 3010648 - RNA, 17 nt, Mycobacterium avium subsp. paratuberculosis
gguguccacccgcgccc

SEQ ID NO: 3010649 - RNA, 19 nt, Mycobacterium avium subsp. paratuberculosis
gguguccacgaugcggugc

SEQ ID NO: 3010650 - RNA, 15 nt, Mycobacterium avium subsp. paratuberculosis
gguguccacgucgcc

SEQ ID NO: 3010651 - RNA, 17 nt, Mycobacterium avium subsp. paratuberculosis
gguguccagccgcacga

SEQ ID NO: 3010652 - RNA, 13 nt, Mycobacterium avium subsp. paratuberculosis
gguguccagcggc

SEQ ID NO: 3010653 - RNA, 15 nt, Mycobacterium avium subsp. paratuberculosis
ggugucccagcgcca

SEQ ID NO: 3010654 - RNA, 19 nt, Mycobacterium avium subsp. paratuberculosis
ggugucccaguucccggcg

SEQ ID NO: 3010655 - RNA, 23 nt, Mycobacterium avium subsp. paratuberculosis
ggugucccaguucccggcgggca

SEQ ID NO: 3010656 - RNA, 17 nt, Mycobacterium avium subsp. paratuberculosis
ggugucccgcgcccgcg

SEQ ID NO: 3010657 - RNA, 18 nt, Mycobacterium avium subsp. paratuberculosis
ggugucccgcgcccgcga

SEQ ID NO: 3010658 - RNA, 20 nt, Mycobacterium avium subsp. paratuberculosis
ggugucccgcguggccgcca

SEQ ID NO: 3010659 - RNA, 16 nt, Mycobacterium avium subsp. paratuberculosis
gguguccgcggcgucg

SEQ ID NO: 3010660 - RNA, 14 nt, Mycobacterium avium subsp. paratuberculosis
gguguccggcccga

SEQ ID NO: 3010661 - RNA, 22 nt, Mycobacterium avium subsp. paratuberculosis
ggugucgaagcugcgcagccgu

SEQ ID NO: 3010662 - RNA, 17 nt, Mycobacterium avium subsp. paratuberculosis
ggugucgacgccgggcu

SEQ ID NO: 3010663 - RNA, 12 nt, Mycobacterium avium subsp. paratuberculosis
ggugucgacgcu

SEQ ID NO: 3010664 - RNA, 22 nt, Mycobacterium avium subsp. paratuberculosis
ggugucgacgcugagcacccgc

SEQ ID NO: 3010665 - RNA, 23 nt, Mycobacterium avium subsp. paratuberculosis
ggugucgacgguugccucggcca

SEQ ID NO: 3010666 - RNA, 20 nt, Mycobacterium avium subsp. paratuberculosis
ggugucgagccaccacugcg

SEQ ID NO: 3010667 - RNA, 16 nt, Mycobacterium avium subsp. paratuberculosis
ggugucgagccggugc

SEQ ID NO: 3010668 - RNA, 23 nt, Mycobacterium avium subsp. paratuberculosis
ggugucgagccggugccgaggca

SEQ ID NO: 3010669 - RNA, 13 nt, Mycobacterium avium subsp. paratuberculosis
ggugucgaggucg

SEQ ID NO: 3010670 - RNA, 19 nt, Mycobacterium avium subsp. paratuberculosis
ggugucgaggucgucggcc

SEQ ID NO: 3010671 - RNA, 16 nt, Mycobacterium avium subsp. paratuberculosis
ggugucgcacagcaug

SEQ ID NO: 3010672 - RNA, 12 nt, Mycobacterium avium subsp. paratuberculosis
ggugucgcccuc

SEQ ID NO: 3010673 - RNA, 15 nt, Mycobacterium avium subsp. paratuberculosis
ggugucgcccucgcg

SEQ ID NO: 3010674 - RNA, 21 nt, Mycobacterium avium subsp. paratuberculosis
ggugucgcccucgcgcagggc

SEQ ID NO: 3010675 - RNA, 14 nt, Mycobacterium avium subsp. paratuberculosis
ggugucgcccucgg

SEQ ID NO: 3010676 - RNA, 13 nt, Mycobacterium avium subsp. paratuberculosis
ggugucgccgucg

SEQ ID NO: 3010677 - RNA, 13 nt, Mycobacterium avium subsp. paratuberculosis
ggugucggcgaag

SEQ ID NO: 3010678 - RNA, 14 nt, Mycobacterium avium subsp. paratuberculosis
ggugucggcgacca

SEQ ID NO: 3010679 - RNA, 12 nt, Mycobacterium avium subsp. paratuberculosis
ggugucggcgag

SEQ ID NO: 3010680 - RNA, 18 nt, Mycobacterium avium subsp. paratuberculosis
ggugucggcgagcuuggc

SEQ ID NO: 3010681 - RNA, 13 nt, Mycobacterium avium subsp. paratuberculosis
ggugucggcggca

SEQ ID NO: 3010682 - RNA, 16 nt, Mycobacterium avium subsp. paratuberculosis
ggugucggcggggccg

SEQ ID NO: 3010683 - RNA, 13 nt, Mycobacterium avium subsp. paratuberculosis
ggugucggcggug

SEQ ID NO: 3010684 - RNA, 19 nt, Mycobacterium avium subsp. paratuberculosis
ggugucggcgucgaucgcc

SEQ ID NO: 3010685 - RNA, 13 nt, Mycobacterium avium subsp. paratuberculosis
ggugucggggucg

SEQ ID NO: 3010686 - RNA, 20 nt, Mycobacterium avium subsp. paratuberculosis
ggugucggugcccaggucgc

SEQ ID NO: 3010687 - RNA, 17 nt, Mycobacterium avium subsp. paratuberculosis
ggugucggugccgagca

SEQ ID NO: 3010688 - RNA, 22 nt, Mycobacterium avium subsp. paratuberculosis
ggugucguagacgacgucgacc

SEQ ID NO: 3010689 - RNA, 13 nt, Mycobacterium avium subsp. paratuberculosis
ggugucgucgacc

SEQ ID NO: 3010690 - RNA, 18 nt, Mycobacterium avium subsp. paratuberculosis
ggugucgucgaccucgau

SEQ ID NO: 3010691 - RNA, 11 nt, Mycobacterium avium subsp. paratuberculosis
ggugucgucgu

SEQ ID NO: 3010692 - RNA, 13 nt, Mycobacterium avium subsp. paratuberculosis
ggugucgucgucg

SEQ ID NO: 3010693 - RNA, 18 nt, Mycobacterium avium subsp. paratuberculosis
ggugucgugcauucaggu

SEQ ID NO: 3010694 - RNA, 23 nt, Mycobacterium avium subsp. paratuberculosis
ggugucgugcauucaggucaccg

SEQ ID NO: 3010695 - RNA, 17 nt, Mycobacterium avium subsp. paratuberculosis
ggugucugaccucgcgc

SEQ ID NO: 3010696 - RNA, 18 nt, Mycobacterium avium subsp. paratuberculosis
ggugucugaccucgcgcc

SEQ ID NO: 3010697 - RNA, 23 nt, Mycobacterium avium subsp. paratuberculosis
ggugucugaccucgcgccgcgau

SEQ ID NO: 3010698 - RNA, 17 nt, Mycobacterium avium subsp. paratuberculosis
ggugugacgcucgcggu

SEQ ID NO: 3010699 - RNA, 15 nt, Mycobacterium avium subsp. paratuberculosis
ggugugcaaggcgau

SEQ ID NO: 3010700 - RNA, 16 nt, Mycobacterium avium subsp. paratuberculosis
ggugugcaaggcgaug

SEQ ID NO: 3010701 - RNA, 14 nt, Mycobacterium avium subsp. paratuberculosis
ggugugcaccagcg

SEQ ID NO: 3010702 - RNA, 23 nt, Mycobacterium avium subsp. paratuberculosis
ggugugcagccacccgucgguga

SEQ ID NO: 3010703 - RNA, 17 nt, Mycobacterium avium subsp. paratuberculosis
ggugugcagccaggugg

SEQ ID NO: 3010704 - RNA, 21 nt, Mycobacterium avium subsp. paratuberculosis
ggugugcccgaacgcgcgucg

SEQ ID NO: 3010705 - RNA, 17 nt, Mycobacterium avium subsp. paratuberculosis
ggugugcccggcguugg

SEQ ID NO: 3010706 - RNA, 13 nt, Mycobacterium avium subsp. paratuberculosis
ggugugccgaagg

SEQ ID NO: 3010707 - RNA, 15 nt, Mycobacterium avium subsp. paratuberculosis
ggugugccgaagggc

SEQ ID NO: 3010708 - RNA, 14 nt, Mycobacterium avium subsp. paratuberculosis
ggugugccgcugca

SEQ ID NO: 3010709 - RNA, 20 nt, Mycobacterium avium subsp. paratuberculosis
ggugugccgcugcauccgca

SEQ ID NO: 3010710 - RNA, 14 nt, Mycobacterium avium subsp. paratuberculosis
ggugugccgcuggu

SEQ ID NO: 3010711 - RNA, 22 nt, Mycobacterium avium subsp. paratuberculosis
ggugugccgcugguaggcggcg

SEQ ID NO: 3010712 - RNA, 21 nt, Mycobacterium avium subsp. paratuberculosis
ggugugccuggcuccccggcg

SEQ ID NO: 3010713 - RNA, 14 nt, Mycobacterium avium subsp. paratuberculosis
ggugugcggcacga

SEQ ID NO: 3010714 - RNA, 14 nt, Mycobacterium avium subsp. paratuberculosis
ggugugcggcacgg

SEQ ID NO: 3010715 - RNA, 17 nt, Mycobacterium avium subsp. paratuberculosis
ggugugcggcagcucgg

SEQ ID NO: 3010716 - RNA, 23 nt, Mycobacterium avium subsp. paratuberculosis
ggugugcggcagcucggcggccc

SEQ ID NO: 3010717 - RNA, 15 nt, Mycobacterium avium subsp. paratuberculosis
ggugugcgggucggu

SEQ ID NO: 3010718 - RNA, 16 nt, Mycobacterium avium subsp. paratuberculosis
ggugugcucggcggcg

SEQ ID NO: 3010719 - RNA, 16 nt, Mycobacterium avium subsp. paratuberculosis
gguguggaucuccagc

SEQ ID NO: 3010720 - RNA, 12 nt, Mycobacterium avium subsp. paratuberculosis
gguguggcaggu

SEQ ID NO: 3010721 - RNA, 14 nt, Mycobacterium avium subsp. paratuberculosis
gguguggccgcggu

SEQ ID NO: 3010722 - RNA, 16 nt, Mycobacterium avium subsp. paratuberculosis
gguguggccgcggugg

SEQ ID NO: 3010723 - RNA, 21 nt, Mycobacterium avium subsp. paratuberculosis
gguguggcgucggccgggggc

SEQ ID NO: 3010724 - RNA, 23 nt, Mycobacterium avium subsp. paratuberculosis
gguguggcgucggccgggggcgc

SEQ ID NO: 3010725 - RNA, 22 nt, Mycobacterium avium subsp. paratuberculosis
ggugugggcgauggcggcgucg

SEQ ID NO: 3010726 - RNA, 17 nt, Mycobacterium avium subsp. paratuberculosis
gguguggucaucugguu

SEQ ID NO: 3010727 - RNA, 15 nt, Mycobacterium avium subsp. paratuberculosis
gguguucaccgcgcc

SEQ ID NO: 3010728 - RNA, 20 nt, Mycobacterium avium subsp. paratuberculosis
gguguucaccgcgccgggca

SEQ ID NO: 3010729 - RNA, 23 nt, Mycobacterium avium subsp. paratuberculosis
gguguucaccgcgccgggcacca

SEQ ID NO: 3010730 - RNA, 15 nt, Mycobacterium avium subsp. paratuberculosis
gguguuccccgggcg

SEQ ID NO: 3010731 - RNA, 18 nt, Mycobacterium avium subsp. paratuberculosis
gguguuccccgggcgagc

SEQ ID NO: 3010732 - RNA, 19 nt, Mycobacterium avium subsp. paratuberculosis
gguguuccccgggcgagcg

SEQ ID NO: 3010733 - RNA, 16 nt, Mycobacterium avium subsp. paratuberculosis
gguguucgagggcgcg

SEQ ID NO: 3010734 - RNA, 13 nt, Mycobacterium avium subsp. paratuberculosis
gguguucggcgcc

SEQ ID NO: 3010735 - RNA, 23 nt, Mycobacterium avium subsp. paratuberculosis
gguguucgggcaguugccggcca

SEQ ID NO: 3010736 - RNA, 20 nt, Mycobacterium avium subsp. paratuberculosis
gguguucuugaacggcgcgu

SEQ ID NO: 3010737 - RNA, 18 nt, Mycobacterium avium subsp. paratuberculosis
gguguugaucagguucac

SEQ ID NO: 3010738 - RNA, 18 nt, Mycobacterium avium subsp. paratuberculosis
gguguugaucauccggcg

SEQ ID NO: 3010739 - RNA, 16 nt, Mycobacterium avium subsp. paratuberculosis
gguguugccgacggcg

SEQ ID NO: 3010740 - RNA, 16 nt, Mycobacterium avium subsp. paratuberculosis
gguguugcgcacccgc

SEQ ID NO: 3010741 - RNA, 17 nt, Mycobacterium avium subsp. paratuberculosis
gguguugcgcacccgcg

SEQ ID NO: 3010742 - RNA, 19 nt, Mycobacterium avium subsp. paratuberculosis
gguguuggugcgggguugg

SEQ ID NO: 3010743 - RNA, 13 nt, Mycobacterium avium subsp. paratuberculosis
gguuaccggugca

SEQ ID NO: 3010744 - RNA, 13 nt, Mycobacterium avium subsp. paratuberculosis
gguuagggcguca

SEQ ID NO: 3010745 - RNA, 18 nt, Mycobacterium avium subsp. paratuberculosis
gguuaguaaccggaggcc

SEQ ID NO: 3010746 - RNA, 15 nt, Mycobacterium avium subsp. paratuberculosis
gguuauccacgaauu

SEQ ID NO: 3010747 - RNA, 19 nt, Mycobacterium avium subsp. paratuberculosis
gguucacaaaggccgaaga

SEQ ID NO: 3010748 - RNA, 15 nt, Mycobacterium avium subsp. paratuberculosis
gguucacccuggcga

SEQ ID NO: 3010749 - RNA, 22 nt, Mycobacterium avium subsp. paratuberculosis
gguucacccuggcgaaccgcgg

SEQ ID NO: 3010750 - RNA, 14 nt, Mycobacterium avium subsp. paratuberculosis
gguucaccgccacc

SEQ ID NO: 3010751 - RNA, 14 nt, Mycobacterium avium subsp. paratuberculosis
gguucagcccggcg

SEQ ID NO: 3010752 - RNA, 14 nt, Mycobacterium avium subsp. paratuberculosis
gguucagccguucu

SEQ ID NO: 3010753 - RNA, 23 nt, Mycobacterium avium subsp. paratuberculosis
gguucaggcccgcgccgacggcc

SEQ ID NO: 3010754 - RNA, 20 nt, Mycobacterium avium subsp. paratuberculosis
gguucaggcugaucuggaug

SEQ ID NO: 3010755 - RNA, 16 nt, Mycobacterium avium subsp. paratuberculosis
gguucauccacucggc

SEQ ID NO: 3010756 - RNA, 17 nt, Mycobacterium avium subsp. paratuberculosis
gguucauccccgcggcc

SEQ ID NO: 3010757 - RNA, 22 nt, Mycobacterium avium subsp. paratuberculosis
gguuccaaccaccguggcccca

SEQ ID NO: 3010758 - RNA, 15 nt, Mycobacterium avium subsp. paratuberculosis
gguuccacaccacca

SEQ ID NO: 3010759 - RNA, 19 nt, Mycobacterium avium subsp. paratuberculosis
gguuccacagcugcaggcu

SEQ ID NO: 3010760 - RNA, 11 nt, Mycobacterium avium subsp. paratuberculosis
gguuccaccgg

SEQ ID NO: 3010761 - RNA, 17 nt, Mycobacterium avium subsp. paratuberculosis
gguuccaccgggccgcc

SEQ ID NO: 3010762 - RNA, 18 nt, Mycobacterium avium subsp. paratuberculosis
gguuccaccgggccgcca

SEQ ID NO: 3010763 - RNA, 22 nt, Mycobacterium avium subsp. paratuberculosis
gguuccaccgggccgccaucac

SEQ ID NO: 3010764 - RNA, 19 nt, Mycobacterium avium subsp. paratuberculosis
gguuccagccauucgucgg

SEQ ID NO: 3010765 - RNA, 23 nt, Mycobacterium avium subsp. paratuberculosis
gguuccccccauacacgggccgu

SEQ ID NO: 3010766 - RNA, 16 nt, Mycobacterium avium subsp. paratuberculosis
gguucccggcaccacc

SEQ ID NO: 3010767 - RNA, 18 nt, Mycobacterium avium subsp. paratuberculosis
gguucccggccgguggcc

SEQ ID NO: 3010768 - RNA, 17 nt, Mycobacterium avium subsp. paratuberculosis
gguucccgugcuggcca

SEQ ID NO: 3010769 - RNA, 18 nt, Mycobacterium avium subsp. paratuberculosis
gguuccggaucaaccaca

SEQ ID NO: 3010770 - RNA, 14 nt, Mycobacterium avium subsp. paratuberculosis
gguuccgggcgacc

SEQ ID NO: 3010771 - RNA, 20 nt, Mycobacterium avium subsp. paratuberculosis
gguuccgggcgaccccggcc

SEQ ID NO: 3010772 - RNA, 19 nt, Mycobacterium avium subsp. paratuberculosis
gguuccgggcgcucuucgg

SEQ ID NO: 3010773 - RNA, 22 nt, Mycobacterium avium subsp. paratuberculosis
gguuccgguggacuccagcacc

SEQ ID NO: 3010774 - RNA, 14 nt, Mycobacterium avium subsp. paratuberculosis
gguuccggugucga

SEQ ID NO: 3010775 - RNA, 16 nt, Mycobacterium avium subsp. paratuberculosis
gguuccuaaccgggca

SEQ ID NO: 3010776 - RNA, 13 nt, Mycobacterium avium subsp. paratuberculosis
gguuccucggcgu

SEQ ID NO: 3010777 - RNA, 18 nt, Mycobacterium avium subsp. paratuberculosis
gguucgacagcgaaccga

SEQ ID NO: 3010778 - RNA, 19 nt, Mycobacterium avium subsp. paratuberculosis
gguucgacgccucggugcg

SEQ ID NO: 3010779 - RNA, 19 nt, Mycobacterium avium subsp. paratuberculosis
gguucgaucuccucggcgu

SEQ ID NO: 3010780 - RNA, 22 nt, Mycobacterium avium subsp. paratuberculosis
gguucgaucuccucggcguaga

SEQ ID NO: 3010781 - RNA, 23 nt, Mycobacterium avium subsp. paratuberculosis
gguucgcccuccccggccagcac

SEQ ID NO: 3010782 - RNA, 13 nt, Mycobacterium avium subsp. paratuberculosis
gguucgccgccca

SEQ ID NO: 3010783 - RNA, 19 nt, Mycobacterium avium subsp. paratuberculosis
gguucgcgcagccaccgcc

SEQ ID NO: 3010784 - RNA, 16 nt, Mycobacterium avium subsp. paratuberculosis
gguucgcuggcggcca

SEQ ID NO: 3010785 - RNA, 17 nt, Mycobacterium avium subsp. paratuberculosis
gguucgcuggcggccag

SEQ ID NO: 3010786 - RNA, 18 nt, Mycobacterium avium subsp. paratuberculosis
gguucgcuggcggccagc

SEQ ID NO: 3010787 - RNA, 18 nt, Mycobacterium avium subsp. paratuberculosis
gguucggacacggcgccg

SEQ ID NO: 3010788 - RNA, 20 nt, Mycobacterium avium subsp. paratuberculosis
gguucggcgacgcugguggc

SEQ ID NO: 3010789 - RNA, 12 nt, Mycobacterium avium subsp. paratuberculosis
gguucggcggca

SEQ ID NO: 3010790 - RNA, 14 nt, Mycobacterium avium subsp. paratuberculosis
gguucggcgggccu

SEQ ID NO: 3010791 - RNA, 16 nt, Mycobacterium avium subsp. paratuberculosis
gguucgggccccaugg

SEQ ID NO: 3010792 - RNA, 16 nt, Mycobacterium avium subsp. paratuberculosis
gguucggucucggcgg

SEQ ID NO: 3010793 - RNA, 18 nt, Mycobacterium avium subsp. paratuberculosis
gguucggucucggcggcg

SEQ ID NO: 3010794 - RNA, 16 nt, Mycobacterium avium subsp. paratuberculosis
gguucgguggccccgg

SEQ ID NO: 3010795 - RNA, 16 nt, Mycobacterium avium subsp. paratuberculosis
gguucgucaacgcccc

SEQ ID NO: 3010796 - RNA, 16 nt, Mycobacterium avium subsp. paratuberculosis
gguucgucgcggcggc

SEQ ID NO: 3010797 - RNA, 17 nt, Mycobacterium avium subsp. paratuberculosis
gguucgucgcggcggcc

SEQ ID NO: 3010798 - RNA, 16 nt, Mycobacterium avium subsp. paratuberculosis
gguucgucguggccga

SEQ ID NO: 3010799 - RNA, 20 nt, Mycobacterium avium subsp. paratuberculosis
gguucgucgugucguguucg

SEQ ID NO: 3010800 - RNA, 18 nt, Mycobacterium avium subsp. paratuberculosis
gguucguugcgccgccag

SEQ ID NO: 3010801 - RNA, 14 nt, Mycobacterium avium subsp. paratuberculosis
gguucuccgcgaca

SEQ ID NO: 3010802 - RNA, 13 nt, Mycobacterium avium subsp. paratuberculosis
gguucuccuccca

SEQ ID NO: 3010803 - RNA, 14 nt, Mycobacterium avium subsp. paratuberculosis
gguucuccucccag

SEQ ID NO: 3010804 - RNA, 15 nt, Mycobacterium avium subsp. paratuberculosis
gguucucgcggcggc

SEQ ID NO: 3010805 - RNA, 17 nt, Mycobacterium avium subsp. paratuberculosis
gguucucgcggcggccg

SEQ ID NO: 3010806 - RNA, 18 nt, Mycobacterium avium subsp. paratuberculosis
gguucucgcggcggccga

SEQ ID NO: 3010807 - RNA, 19 nt, Mycobacterium avium subsp. paratuberculosis
gguucugggcgggcucgag

SEQ ID NO: 3010808 - RNA, 13 nt, Mycobacterium avium subsp. paratuberculosis
gguucuucgacca

SEQ ID NO: 3010809 - RNA, 13 nt, Mycobacterium avium subsp. paratuberculosis
gguugaagcuggc

SEQ ID NO: 3010810 - RNA, 17 nt, Mycobacterium avium subsp. paratuberculosis
gguugaccccggccccg

SEQ ID NO: 3010811 - RNA, 15 nt, Mycobacterium avium subsp. paratuberculosis
gguugacccggccgg

SEQ ID NO: 3010812 - RNA, 22 nt, Mycobacterium avium subsp. paratuberculosis
gguugacccggccggucgccug

SEQ ID NO: 3010813 - RNA, 17 nt, Mycobacterium avium subsp. paratuberculosis
gguugacccucagcagg

SEQ ID NO: 3010814 - RNA, 15 nt, Mycobacterium avium subsp. paratuberculosis
gguugaccuugacca

SEQ ID NO: 3010815 - RNA, 17 nt, Mycobacterium avium subsp. paratuberculosis
gguugacgugcaccggc

SEQ ID NO: 3010816 - RNA, 17 nt, Mycobacterium avium subsp. paratuberculosis
gguugagcaggucagcc

SEQ ID NO: 3010817 - RNA, 21 nt, Mycobacterium avium subsp. paratuberculosis
gguugaucacaccgucggcga

SEQ ID NO: 3010818 - RNA, 16 nt, Mycobacterium avium subsp. paratuberculosis
gguugauccggauccg

SEQ ID NO: 3010819 - RNA, 24 nt, Mycobacterium avium subsp. paratuberculosis
gguugauccggaucgggcggucca

SEQ ID NO: 3010820 - RNA, 17 nt, Mycobacterium avium subsp. paratuberculosis
gguugcacaggucgaug

SEQ ID NO: 3010821 - RNA, 15 nt, Mycobacterium avium subsp. paratuberculosis
gguugccccacacga

SEQ ID NO: 3010822 - RNA, 22 nt, Mycobacterium avium subsp. paratuberculosis
gguugccccagcugucgggugg

SEQ ID NO: 3010823 - RNA, 15 nt, Mycobacterium avium subsp. paratuberculosis
gguugccgcccucgg

SEQ ID NO: 3010824 - RNA, 18 nt, Mycobacterium avium subsp. paratuberculosis
gguugccgcccucggccg

SEQ ID NO: 3010825 - RNA, 15 nt, Mycobacterium avium subsp. paratuberculosis
gguugccggcggcca

SEQ ID NO: 3010826 - RNA, 15 nt, Mycobacterium avium subsp. paratuberculosis
gguugccgucgacga

SEQ ID NO: 3010827 - RNA, 22 nt, Mycobacterium avium subsp. paratuberculosis
gguugccuuuccgcgcggcggg

SEQ ID NO: 3010828 - RNA, 18 nt, Mycobacterium avium subsp. paratuberculosis
gguugcgaaagcccaggc

SEQ ID NO: 3010829 - RNA, 14 nt, Mycobacterium avium subsp. paratuberculosis
gguugcgccgaggu

SEQ ID NO: 3010830 - RNA, 17 nt, Mycobacterium avium subsp. paratuberculosis
gguugcgccgaggucac

SEQ ID NO: 3010831 - RNA, 20 nt, Mycobacterium avium subsp. paratuberculosis
gguugcgcggaaugcucgac

SEQ ID NO: 3010832 - RNA, 14 nt, Mycobacterium avium subsp. paratuberculosis
gguugcggaucaug

SEQ ID NO: 3010833 - RNA, 18 nt, Mycobacterium avium subsp. paratuberculosis
gguugcggaucggugcag

SEQ ID NO: 3010834 - RNA, 15 nt, Mycobacterium avium subsp. paratuberculosis
gguugcggccccgcc

SEQ ID NO: 3010835 - RNA, 18 nt, Mycobacterium avium subsp. paratuberculosis
gguugcggccccgccagc

SEQ ID NO: 3010836 - RNA, 19 nt, Mycobacterium avium subsp. paratuberculosis
gguugcggccccgccagca

SEQ ID NO: 3010837 - RNA, 14 nt, Mycobacterium avium subsp. paratuberculosis
gguugcggcgaacg

SEQ ID NO: 3010838 - RNA, 15 nt, Mycobacterium avium subsp. paratuberculosis
gguugcggcgggccg

SEQ ID NO: 3010839 - RNA, 12 nt, Mycobacterium avium subsp. paratuberculosis
gguugcgggccg

SEQ ID NO: 3010840 - RNA, 13 nt, Mycobacterium avium subsp. paratuberculosis
gguugcgggccga

SEQ ID NO: 3010841 - RNA, 17 nt, Mycobacterium avium subsp. paratuberculosis
gguugcgguacaucccg

SEQ ID NO: 3010842 - RNA, 13 nt, Mycobacterium avium subsp. paratuberculosis
gguugcuccucgg

SEQ ID NO: 3010843 - RNA, 21 nt, Mycobacterium avium subsp. paratuberculosis
gguuggacaguucgguggggc

SEQ ID NO: 3010844 - RNA, 23 nt, Mycobacterium avium subsp. paratuberculosis
gguuggacaguucgguggggccg

SEQ ID NO: 3010845 - RNA, 19 nt, Mycobacterium avium subsp. paratuberculosis
gguuggcccuucgaccucg

SEQ ID NO: 3010846 - RNA, 15 nt, Mycobacterium avium subsp. paratuberculosis
gguuggccgccaagu

SEQ ID NO: 3010847 - RNA, 13 nt, Mycobacterium avium subsp. paratuberculosis
gguuggccgucga

SEQ ID NO: 3010848 - RNA, 15 nt, Mycobacterium avium subsp. paratuberculosis
gguuggcgaucaggg

SEQ ID NO: 3010849 - RNA, 16 nt, Mycobacterium avium subsp. paratuberculosis
gguuggcgaucagggc

SEQ ID NO: 3010850 - RNA, 15 nt, Mycobacterium avium subsp. paratuberculosis
gguuggcggcggccc

SEQ ID NO: 3010851 - RNA, 17 nt, Mycobacterium avium subsp. paratuberculosis
gguugggcgccagcagc

SEQ ID NO: 3010852 - RNA, 13 nt, Mycobacterium avium subsp. paratuberculosis
gguuggucggcgc

SEQ ID NO: 3010853 - RNA, 14 nt, Mycobacterium avium subsp. paratuberculosis
gguuggucggcgcg

SEQ ID NO: 3010854 - RNA, 21 nt, Mycobacterium avium subsp. paratuberculosis
gguugguuucgguccaggugg

SEQ ID NO: 3010855 - RNA, 16 nt, Mycobacterium avium subsp. paratuberculosis
gguuguagucggcgcc

SEQ ID NO: 3010856 - RNA, 22 nt, Mycobacterium avium subsp. paratuberculosis
gguuguagucggcgccgacggc

SEQ ID NO: 3010857 - RNA, 16 nt, Mycobacterium avium subsp. paratuberculosis
gguuguccagccggug

SEQ ID NO: 3010858 - RNA, 16 nt, Mycobacterium avium subsp. paratuberculosis
gguugucgacgcugca

SEQ ID NO: 3010859 - RNA, 22 nt, Mycobacterium avium subsp. paratuberculosis
gguugucgacguggugcaccgc

SEQ ID NO: 3010860 - RNA, 16 nt, Mycobacterium avium subsp. paratuberculosis
gguugucgccgcgcca

SEQ ID NO: 3010861 - RNA, 15 nt, Mycobacterium avium subsp. paratuberculosis
gguugucgucgggca

SEQ ID NO: 3010862 - RNA, 18 nt, Mycobacterium avium subsp. paratuberculosis
gguugucgucgucggcga

SEQ ID NO: 3010863 - RNA, 16 nt, Mycobacterium avium subsp. paratuberculosis
gguuguucagcccggu

SEQ ID NO: 3010864 - RNA, 16 nt, Mycobacterium avium subsp. paratuberculosis
gguuguucugcucgaa

SEQ ID NO: 3010865 - RNA, 17 nt, Mycobacterium avium subsp. paratuberculosis
gguuucaccgugcgcgc

SEQ ID NO: 3010866 - RNA, 18 nt, Mycobacterium avium subsp. paratuberculosis
gguuucaugcacggcgcu

SEQ ID NO: 3010867 - RNA, 17 nt, Mycobacterium avium subsp. paratuberculosis
gguuucauucaccgcgg

SEQ ID NO: 3010868 - RNA, 22 nt, Mycobacterium avium subsp. paratuberculosis
gguuuccacgugcacggcgccg

SEQ ID NO: 3010869 - RNA, 22 nt, Mycobacterium avium subsp. paratuberculosis
gguuuccaggacgaugcgcgcc

SEQ ID NO: 3010870 - RNA, 18 nt, Mycobacterium avium subsp. paratuberculosis
gguuuccaguccggcgcc

SEQ ID NO: 3010871 - RNA, 18 nt, Mycobacterium avium subsp. paratuberculosis
gguuucgaccugcgggug

SEQ ID NO: 3010872 - RNA, 17 nt, Mycobacterium avium subsp. paratuberculosis
gguuucggggucgccgu

SEQ ID NO: 3010873 - RNA, 15 nt, Mycobacterium avium subsp. paratuberculosis
gguuucggucgcggu

SEQ ID NO: 3010874 - RNA, 16 nt, Mycobacterium avium subsp. paratuberculosis
gguuucggucgcggug

SEQ ID NO: 3010875 - RNA, 18 nt, Mycobacterium avium subsp. paratuberculosis
gguuucggugccggccca

SEQ ID NO: 3010876 - RNA, 17 nt, Mycobacterium avium subsp. paratuberculosis
gguuucgugugcucagc

SEQ ID NO: 3010877 - RNA, 23 nt, Mycobacterium avium subsp. paratuberculosis
gguuugcccggcgaugucgggca

SEQ ID NO: 3010878 - RNA, 19 nt, Mycobacterium avium subsp. paratuberculosis
gguuuggucagcgcccccg

SEQ ID NO: 3010879 - RNA, 22 nt, Mycobacterium avium subsp. paratuberculosis
gguuuucccgcgagcugccccu

SEQ ID NO: 3010880 - RNA, 17 nt, Mycobacterium avium subsp. paratuberculosis
gguuuucccggccgccg

SEQ ID NO: 3010881 - RNA, 15 nt, Mycobacterium avium subsp. paratuberculosis
gguuuucgccucggu

SEQ ID NO: 3010882 - RNA, 14 nt, Mycobacterium avium subsp. paratuberculosis
gguuuucggcgcgc

SEQ ID NO: 3010883 - RNA, 19 nt, Mycobacterium avium subsp. paratuberculosis
gguuuugcgucugcucggc

SEQ ID NO: 3010884 - RNA, 13 nt, Mycobacterium avium subsp. paratuberculosis
guaaaccagcagc

SEQ ID NO: 3010885 - RNA, 17 nt, Mycobacterium avium subsp. paratuberculosis
guaaaccgccagcagcg

SEQ ID NO: 3010886 - RNA, 16 nt, Mycobacterium avium subsp. paratuberculosis
guaaauugaacgccgc

SEQ ID NO: 3010887 - RNA, 18 nt, Mycobacterium avium subsp. paratuberculosis
guaaauugaacgccgcca

SEQ ID NO: 3010888 - RNA, 15 nt, Mycobacterium avium subsp. paratuberculosis
guaacaacucgccgg

SEQ ID NO: 3010889 - RNA, 19 nt, Mycobacterium avium subsp. paratuberculosis
guaacacgaucucggucgc

SEQ ID NO: 3010890 - RNA, 13 nt, Mycobacterium avium subsp. paratuberculosis
guaaccacccgug

SEQ ID NO: 3010891 - RNA, 15 nt, Mycobacterium avium subsp. paratuberculosis
guaaccgcagccggg

SEQ ID NO: 3010892 - RNA, 15 nt, Mycobacterium avium subsp. paratuberculosis
guaaccgccguuggc

SEQ ID NO: 3010893 - RNA, 15 nt, Mycobacterium avium subsp. paratuberculosis
guaaccggcggcggu

SEQ ID NO: 3010894 - RNA, 18 nt, Mycobacterium avium subsp. paratuberculosis
guaacgccacggcggccg

SEQ ID NO: 3010895 - RNA, 13 nt, Mycobacterium avium subsp. paratuberculosis
guaacgcgucgac

SEQ ID NO: 3010896 - RNA, 20 nt, Mycobacterium avium subsp. paratuberculosis
guaacgguaggcgcggucgg

SEQ ID NO: 3010897 - RNA, 19 nt, Mycobacterium avium subsp. paratuberculosis
guaagccauggcggcccgc

SEQ ID NO: 3010898 - RNA, 17 nt, Mycobacterium avium subsp. paratuberculosis
guaagcgacgaggugau

SEQ ID NO: 3010899 - RNA, 15 nt, Mycobacterium avium subsp. paratuberculosis
guaaggccgaggcga

SEQ ID NO: 3010900 - RNA, 21 nt, Mycobacterium avium subsp. paratuberculosis
guaaggccgaggcgagugagg

SEQ ID NO: 3010901 - RNA, 17 nt, Mycobacterium avium subsp. paratuberculosis
guaaguggcgccgcggu

SEQ ID NO: 3010902 - RNA, 13 nt, Mycobacterium avium subsp. paratuberculosis
guaaucgaaggcc

SEQ ID NO: 3010903 - RNA, 16 nt, Mycobacterium avium subsp. paratuberculosis
guaaucgaugacgugg

SEQ ID NO: 3010904 - RNA, 15 nt, Mycobacterium avium subsp. paratuberculosis
guaaucggcgguggu

SEQ ID NO: 3010905 - RNA, 17 nt, Mycobacterium avium subsp. paratuberculosis
guacaaggugauggccc

SEQ ID NO: 3010906 - RNA, 19 nt, Mycobacterium avium subsp. paratuberculosis
guacaagugaugaccugga

SEQ ID NO: 3010907 - RNA, 16 nt, Mycobacterium avium subsp. paratuberculosis
guacaccaccgcggcg

SEQ ID NO: 3010908 - RNA, 21 nt, Mycobacterium avium subsp. paratuberculosis
guacaccgcgaguucgcgcac

SEQ ID NO: 3010909 - RNA, 24 nt, Mycobacterium avium subsp. paratuberculosis
guacaccgcgaguucgcgcacgcu

SEQ ID NO: 3010910 - RNA, 19 nt, Mycobacterium avium subsp. paratuberculosis
guacaccggcugaccggcg

SEQ ID NO: 3010911 - RNA, 15 nt, Mycobacterium avium subsp. paratuberculosis
guacaccgggcuggu

SEQ ID NO: 3010912 - RNA, 19 nt, Mycobacterium avium subsp. paratuberculosis
guacaccgggcuggugucc

SEQ ID NO: 3010913 - RNA, 20 nt, Mycobacterium avium subsp. paratuberculosis
guacaccgguugcgccgagg

SEQ ID NO: 3010914 - RNA, 15 nt, Mycobacterium avium subsp. paratuberculosis
guacaccucgagcuu

SEQ ID NO: 3010915 - RNA, 16 nt, Mycobacterium avium subsp. paratuberculosis
guacacggcccgcggc

SEQ ID NO: 3010916 - RNA, 18 nt, Mycobacterium avium subsp. paratuberculosis
guacacggcccgcggcac

SEQ ID NO: 3010917 - RNA, 19 nt, Mycobacterium avium subsp. paratuberculosis
guacacgucgcgggugacc

SEQ ID NO: 3010918 - RNA, 11 nt, Mycobacterium avium subsp. paratuberculosis
guacagcagcc

SEQ ID NO: 3010919 - RNA, 17 nt, Mycobacterium avium subsp. paratuberculosis
guacagcagccccugca

SEQ ID NO: 3010920 - RNA, 21 nt, Mycobacterium avium subsp. paratuberculosis
guacagcagccccugcaccac

SEQ ID NO: 3010921 - RNA, 11 nt, Mycobacterium avium subsp. paratuberculosis
guacagcagcu

SEQ ID NO: 3010922 - RNA, 13 nt, Mycobacterium avium subsp. paratuberculosis
guacagccagccc

SEQ ID NO: 3010923 - RNA, 19 nt, Mycobacterium avium subsp. paratuberculosis
guacagcgacagcagcgug

SEQ ID NO: 3010924 - RNA, 20 nt, Mycobacterium avium subsp. paratuberculosis
guacagcgacuccagcgcga

SEQ ID NO: 3010925 - RNA, 23 nt, Mycobacterium avium subsp. paratuberculosis
guacagcgacuccagcgcgauca

SEQ ID NO: 3010926 - RNA, 15 nt, Mycobacterium avium subsp. paratuberculosis
guacagcgccagcgg

SEQ ID NO: 3010927 - RNA, 17 nt, Mycobacterium avium subsp. paratuberculosis
guacagcgccauguccu

SEQ ID NO: 3010928 - RNA, 16 nt, Mycobacterium avium subsp. paratuberculosis
guacagcgccgcggcc

SEQ ID NO: 3010929 - RNA, 18 nt, Mycobacterium avium subsp. paratuberculosis
guacagcgccgcggccag

SEQ ID NO: 3010930 - RNA, 15 nt, Mycobacterium avium subsp. paratuberculosis
guacagcgcgccgcg

SEQ ID NO: 3010931 - RNA, 15 nt, Mycobacterium avium subsp. paratuberculosis
guacagcuaggccag

SEQ ID NO: 3010932 - RNA, 16 nt, Mycobacterium avium subsp. paratuberculosis
guacagcuaggccagc

SEQ ID NO: 3010933 - RNA, 20 nt, Mycobacterium avium subsp. paratuberculosis
guacagcuaggccagcagcg

SEQ ID NO: 3010934 - RNA, 22 nt, Mycobacterium avium subsp. paratuberculosis
guacagcuaggccagcagcgcg

SEQ ID NO: 3010935 - RNA, 20 nt, Mycobacterium avium subsp. paratuberculosis
guacagcugguccggccggc

SEQ ID NO: 3010936 - RNA, 22 nt, Mycobacterium avium subsp. paratuberculosis
guacagcugguccggccggccg

SEQ ID NO: 3010937 - RNA, 20 nt, Mycobacterium avium subsp. paratuberculosis
guacaggaucaacucgucgg

SEQ ID NO: 3010938 - RNA, 23 nt, Mycobacterium avium subsp. paratuberculosis
guacaggccgucggggaugccga

SEQ ID NO: 3010939 - RNA, 14 nt, Mycobacterium avium subsp. paratuberculosis
guacagggcgucgg

SEQ ID NO: 3010940 - RNA, 18 nt, Mycobacterium avium subsp. paratuberculosis
guacagggucaucgcgcc

SEQ ID NO: 3010941 - RNA, 13 nt, Mycobacterium avium subsp. paratuberculosis
guacaggucgacc

SEQ ID NO: 3010942 - RNA, 22 nt, Mycobacterium avium subsp. paratuberculosis
guacaggucgaccaucugccgg

SEQ ID NO: 3010943 - RNA, 16 nt, Mycobacterium avium subsp. paratuberculosis
guacaggucgcacagg

SEQ ID NO: 3010944 - RNA, 18 nt, Mycobacterium avium subsp. paratuberculosis
guacaggucgcacaggau

SEQ ID NO: 3010945 - RNA, 18 nt, Mycobacterium avium subsp. paratuberculosis
guacaggucgcugcccgg

SEQ ID NO: 3010946 - RNA, 14 nt, Mycobacterium avium subsp. paratuberculosis
guacaucccgccgg

SEQ ID NO: 3010947 - RNA, 16 nt, Mycobacterium avium subsp. paratuberculosis
guacaucgacgcgacc

SEQ ID NO: 3010948 - RNA, 17 nt, Mycobacterium avium subsp. paratuberculosis
guacaucgacgcgaccg

SEQ ID NO: 3010949 - RNA, 21 nt, Mycobacterium avium subsp. paratuberculosis
guacaucguucccugcgcggc

SEQ ID NO: 3010950 - RNA, 17 nt, Mycobacterium avium subsp. paratuberculosis
guacauggugaccagcg

SEQ ID NO: 3010951 - RNA, 14 nt, Mycobacterium avium subsp. paratuberculosis
guaccaccaccagu

SEQ ID NO: 3010952 - RNA, 20 nt, Mycobacterium avium subsp. paratuberculosis
guaccaccaccagucggcgc

SEQ ID NO: 3010953 - RNA, 15 nt, Mycobacterium avium subsp. paratuberculosis
guaccacgccgucga

SEQ ID NO: 3010954 - RNA, 23 nt, Mycobacterium avium subsp. paratuberculosis
guaccacuugaaggaggcggucg

SEQ ID NO: 3010955 - RNA, 13 nt, Mycobacterium avium subsp. paratuberculosis
guaccagcgccac

SEQ ID NO: 3010956 - RNA, 24 nt, Mycobacterium avium subsp. paratuberculosis
guaccagcgcucgacgaggcgggc

SEQ ID NO: 3010957 - RNA, 20 nt, Mycobacterium avium subsp. paratuberculosis
guaccagcugcccaccagca

SEQ ID NO: 3010958 - RNA, 22 nt, Mycobacterium avium subsp. paratuberculosis
guaccagcugcccaccagcagg

SEQ ID NO: 3010959 - RNA, 17 nt, Mycobacterium avium subsp. paratuberculosis
guaccagggcagcgccu

SEQ ID NO: 3010960 - RNA, 23 nt, Mycobacterium avium subsp. paratuberculosis
guaccagggcagcgccucggcgg

SEQ ID NO: 3010961 - RNA, 16 nt, Mycobacterium avium subsp. paratuberculosis
guacccaggucggcgu

SEQ ID NO: 3010962 - RNA, 12 nt, Mycobacterium avium subsp. paratuberculosis
guaccccagcaa

SEQ ID NO: 3010963 - RNA, 23 nt, Mycobacterium avium subsp. paratuberculosis
guaccccagcaaaaccccgccgu

SEQ ID NO: 3010964 - RNA, 19 nt, Mycobacterium avium subsp. paratuberculosis
guacccccgcacgccagca

SEQ ID NO: 3010965 - RNA, 19 nt, Mycobacterium avium subsp. paratuberculosis
guacccgauggugaaccac

SEQ ID NO: 3010966 - RNA, 14 nt, Mycobacterium avium subsp. paratuberculosis
guacccgcaggcca

SEQ ID NO: 3010967 - RNA, 23 nt, Mycobacterium avium subsp. paratuberculosis
guacccgcaggccaugaucgaaa

SEQ ID NO: 3010968 - RNA, 17 nt, Mycobacterium avium subsp. paratuberculosis
guacccgcccaugcacg

SEQ ID NO: 3010969 - RNA, 21 nt, Mycobacterium avium subsp. paratuberculosis
guacccggucugaucgcccag

SEQ ID NO: 3010970 - RNA, 20 nt, Mycobacterium avium subsp. paratuberculosis
guaccgaggaugaccgcggc

SEQ ID NO: 3010971 - RNA, 14 nt, Mycobacterium avium subsp. paratuberculosis
guaccgauccgcgg

SEQ ID NO: 3010972 - RNA, 13 nt, Mycobacterium avium subsp. paratuberculosis
guaccgcaacacc

SEQ ID NO: 3010973 - RNA, 22 nt, Mycobacterium avium subsp. paratuberculosis
guaccgcaauccuguuccccgg

SEQ ID NO: 3010974 - RNA, 16 nt, Mycobacterium avium subsp. paratuberculosis
guaccgccggccaggc

SEQ ID NO: 3010975 - RNA, 17 nt, Mycobacterium avium subsp. paratuberculosis
guaccgccggccaggcg

SEQ ID NO: 3010976 - RNA, 19 nt, Mycobacterium avium subsp. paratuberculosis
guaccgcgagaucagcgcc

SEQ ID NO: 3010977 - RNA, 17 nt, Mycobacterium avium subsp. paratuberculosis
guaccgcggcggcgucg

SEQ ID NO: 3010978 - RNA, 18 nt, Mycobacterium avium subsp. paratuberculosis
guaccgcggcggcgucga

SEQ ID NO: 3010979 - RNA, 23 nt, Mycobacterium avium subsp. paratuberculosis
guaccgcggcggcgucgaccgcc

SEQ ID NO: 3010980 - RNA, 14 nt, Mycobacterium avium subsp. paratuberculosis
guaccgcuuggccc

SEQ ID NO: 3010981 - RNA, 21 nt, Mycobacterium avium subsp. paratuberculosis
guaccggaacggcuugcgcuc

SEQ ID NO: 3010982 - RNA, 16 nt, Mycobacterium avium subsp. paratuberculosis
guaccggcgccaggcc

SEQ ID NO: 3010983 - RNA, 22 nt, Mycobacterium avium subsp. paratuberculosis
guaccggcgccaggccggcgac

SEQ ID NO: 3010984 - RNA, 22 nt, Mycobacterium avium subsp. paratuberculosis
guaccggcgggcgaaaucgcgg

SEQ ID NO: 3010985 - RNA, 14 nt, Mycobacterium avium subsp. paratuberculosis
guaccggguggccg

SEQ ID NO: 3010986 - RNA, 20 nt, Mycobacterium avium subsp. paratuberculosis
guaccgguacagcgacucca

SEQ ID NO: 3010987 - RNA, 21 nt, Mycobacterium avium subsp. paratuberculosis
guaccgguuccgggcgacccc

SEQ ID NO: 3010988 - RNA, 16 nt, Mycobacterium avium subsp. paratuberculosis
guaccucugcgcgagc

SEQ ID NO: 3010989 - RNA, 20 nt, Mycobacterium avium subsp. paratuberculosis
guaccucugcgcgagcagcu

SEQ ID NO: 3010990 - RNA, 16 nt, Mycobacterium avium subsp. paratuberculosis
guaccugccccacacg

SEQ ID NO: 3010991 - RNA, 17 nt, Mycobacterium avium subsp. paratuberculosis
guacgaccgcgacgugg

SEQ ID NO: 3010992 - RNA, 20 nt, Mycobacterium avium subsp. paratuberculosis
guacgaccgcgacguggcgc

SEQ ID NO: 3010993 - RNA, 22 nt, Mycobacterium avium subsp. paratuberculosis
guacgaccguagccggucggcc

SEQ ID NO: 3010994 - RNA, 20 nt, Mycobacterium avium subsp. paratuberculosis
guacgccaugaacucgucca

SEQ ID NO: 3010995 - RNA, 15 nt, Mycobacterium avium subsp. paratuberculosis
guacgcgagaagcgc

SEQ ID NO: 3010996 - RNA, 13 nt, Mycobacterium avium subsp. paratuberculosis
guacgcgccgcgc

SEQ ID NO: 3010997 - RNA, 15 nt, Mycobacterium avium subsp. paratuberculosis
guacgcgccgcgcgc

SEQ ID NO: 3010998 - RNA, 14 nt, Mycobacterium avium subsp. paratuberculosis
guacgcgccggcca

SEQ ID NO: 3010999 - RNA, 16 nt, Mycobacterium avium subsp. paratuberculosis
guacgcgccggccagc

SEQ ID NO: 3011000 - RNA, 17 nt, Mycobacterium avium subsp. paratuberculosis
guacgcgccgucgucgu

SEQ ID NO: 3011001 - RNA, 20 nt, Mycobacterium avium subsp. paratuberculosis
guacgcggcguugccgccgg

SEQ ID NO: 3011002 - RNA, 15 nt, Mycobacterium avium subsp. paratuberculosis
guacgcggcuggcgg

SEQ ID NO: 3011003 - RNA, 22 nt, Mycobacterium avium subsp. paratuberculosis
guacggcccgggaagccgcagc

SEQ ID NO: 3011004 - RNA, 14 nt, Mycobacterium avium subsp. paratuberculosis
guacggccgacgcc

SEQ ID NO: 3011005 - RNA, 17 nt, Mycobacterium avium subsp. paratuberculosis
guacggccgacgcccag

SEQ ID NO: 3011006 - RNA, 14 nt, Mycobacterium avium subsp. paratuberculosis
guacggcggccgcg

SEQ ID NO: 3011007 - RNA, 18 nt, Mycobacterium avium subsp. paratuberculosis
guacggcggccgcggacc

SEQ ID NO: 3011008 - RNA, 16 nt, Mycobacterium avium subsp. paratuberculosis
guacggcucaacggcc

SEQ ID NO: 3011009 - RNA, 19 nt, Mycobacterium avium subsp. paratuberculosis
guacggcucaacggccggc

SEQ ID NO: 3011010 - RNA, 21 nt, Mycobacterium avium subsp. paratuberculosis
guacggcucguggguggucug

SEQ ID NO: 3011011 - RNA, 14 nt, Mycobacterium avium subsp. paratuberculosis
guacgggcgcagcg

SEQ ID NO: 3011012 - RNA, 23 nt, Mycobacterium avium subsp. paratuberculosis
guacgggcgcagcgccgucucga

SEQ ID NO: 3011013 - RNA, 19 nt, Mycobacterium avium subsp. paratuberculosis
guacgggcugaagaucaac

SEQ ID NO: 3011014 - RNA, 17 nt, Mycobacterium avium subsp. paratuberculosis
guacggguugccgucga

SEQ ID NO: 3011015 - RNA, 16 nt, Mycobacterium avium subsp. paratuberculosis
guacgucuugcgcacc

SEQ ID NO: 3011016 - RNA, 14 nt, Mycobacterium avium subsp. paratuberculosis
guacgugcgccggc

SEQ ID NO: 3011017 - RNA, 16 nt, Mycobacterium avium subsp. paratuberculosis
guacgugcgccggcgg

SEQ ID NO: 3011018 - RNA, 16 nt, Mycobacterium avium subsp. paratuberculosis
guacucccaggccgcg

SEQ ID NO: 3011019 - RNA, 19 nt, Mycobacterium avium subsp. paratuberculosis
guacucccaggccgcggcc

SEQ ID NO: 3011020 - RNA, 11 nt, Mycobacterium avium subsp. paratuberculosis
guacuccugcg

SEQ ID NO: 3011021 - RNA, 13 nt, Mycobacterium avium subsp. paratuberculosis
guacuccugcgcg

SEQ ID NO: 3011022 - RNA, 19 nt, Mycobacterium avium subsp. paratuberculosis
guacucgcacagccggcgc

SEQ ID NO: 3011023 - RNA, 22 nt, Mycobacterium avium subsp. paratuberculosis
guacucgcacagccggcgcgcg

SEQ ID NO: 3011024 - RNA, 17 nt, Mycobacterium avium subsp. paratuberculosis
guacucggcggcgggca

SEQ ID NO: 3011025 - RNA, 19 nt, Mycobacterium avium subsp. paratuberculosis
guacucggcgucgccgagc

SEQ ID NO: 3011026 - RNA, 23 nt, Mycobacterium avium subsp. paratuberculosis
guacucgggugaguaguccagca

SEQ ID NO: 3011027 - RNA, 21 nt, Mycobacterium avium subsp. paratuberculosis
guacucgggugggggcguggu

SEQ ID NO: 3011028 - RNA, 22 nt, Mycobacterium avium subsp. paratuberculosis
guacucgggugggggcguggug

SEQ ID NO: 3011029 - RNA, 20 nt, Mycobacterium avium subsp. paratuberculosis
guacucggucaccucgucga

SEQ ID NO: 3011030 - RNA, 22 nt, Mycobacterium avium subsp. paratuberculosis
guacugaccagcccgcucagag

SEQ ID NO: 3011031 - RNA, 15 nt, Mycobacterium avium subsp. paratuberculosis
guacugcagcagucc

SEQ ID NO: 3011032 - RNA, 15 nt, Mycobacterium avium subsp. paratuberculosis
guacugcucggcgcg

SEQ ID NO: 3011033 - RNA, 18 nt, Mycobacterium avium subsp. paratuberculosis
guacugcucggcgcggcu

SEQ ID NO: 3011034 - RNA, 17 nt, Mycobacterium avium subsp. paratuberculosis
guacugcuugccgccgg

SEQ ID NO: 3011035 - RNA, 15 nt, Mycobacterium avium subsp. paratuberculosis
guacugggccgucgc

SEQ ID NO: 3011036 - RNA, 19 nt, Mycobacterium avium subsp. paratuberculosis
guacuggggugucagcgcg

SEQ ID NO: 3011037 - RNA, 23 nt, Mycobacterium avium subsp. paratuberculosis
guacuggggugucagcgcgaccu

SEQ ID NO: 3011038 - RNA, 23 nt, Mycobacterium avium subsp. paratuberculosis
guacugguugcagaugucggugg

SEQ ID NO: 3011039 - RNA, 15 nt, Mycobacterium avium subsp. paratuberculosis
guacuucucgaagaa

SEQ ID NO: 3011040 - RNA, 23 nt, Mycobacterium avium subsp. paratuberculosis
guagaacauccacggcaugguga

SEQ ID NO: 3011041 - RNA, 18 nt, Mycobacterium avium subsp. paratuberculosis
guagaaccaacgcggcgc

SEQ ID NO: 3011042 - RNA, 22 nt, Mycobacterium avium subsp. paratuberculosis
guagaaccaacgcggcgccggu

SEQ ID NO: 3011043 - RNA, 16 nt, Mycobacterium avium subsp. paratuberculosis
guagaaccggcccagc

SEQ ID NO: 3011044 - RNA, 17 nt, Mycobacterium avium subsp. paratuberculosis
guagaagaucagcgcca

SEQ ID NO: 3011045 - RNA, 18 nt, Mycobacterium avium subsp. paratuberculosis
guagaagaucagcgccag

SEQ ID NO: 3011046 - RNA, 14 nt, Mycobacterium avium subsp. paratuberculosis
guagacagcguggu

SEQ ID NO: 3011047 - RNA, 22 nt, Mycobacterium avium subsp. paratuberculosis
guagacagcguggucgcgcagc

SEQ ID NO: 3011048 - RNA, 15 nt, Mycobacterium avium subsp. paratuberculosis
guagaccuugaccac

SEQ ID NO: 3011049 - RNA, 20 nt, Mycobacterium avium subsp. paratuberculosis
guagaccuuguccggcgucc

SEQ ID NO: 3011050 - RNA, 16 nt, Mycobacterium avium subsp. paratuberculosis
guagacgacgucgacc

SEQ ID NO: 3011051 - RNA, 20 nt, Mycobacterium avium subsp. paratuberculosis
guagacgagcucaccgccga

SEQ ID NO: 3011052 - RNA, 23 nt, Mycobacterium avium subsp. paratuberculosis
guagacgagcucaccgccgauga

SEQ ID NO: 3011053 - RNA, 16 nt, Mycobacterium avium subsp. paratuberculosis
guagacgaugcccagc

SEQ ID NO: 3011054 - RNA, 17 nt, Mycobacterium avium subsp. paratuberculosis
guagacgaugcccagcc

SEQ ID NO: 3011055 - RNA, 14 nt, Mycobacterium avium subsp. paratuberculosis
guagacgccgccgu

SEQ ID NO: 3011056 - RNA, 19 nt, Mycobacterium avium subsp. paratuberculosis
guagacgccgccguggacg

SEQ ID NO: 3011057 - RNA, 14 nt, Mycobacterium avium subsp. paratuberculosis
guagacgccggacg

SEQ ID NO: 3011058 - RNA, 14 nt, Mycobacterium avium subsp. paratuberculosis
guagacgcgggccg

SEQ ID NO: 3011059 - RNA, 15 nt, Mycobacterium avium subsp. paratuberculosis
guagacggcaugccg

SEQ ID NO: 3011060 - RNA, 19 nt, Mycobacterium avium subsp. paratuberculosis
guagacggcaugccgggcc

SEQ ID NO: 3011061 - RNA, 17 nt, Mycobacterium avium subsp. paratuberculosis
guagacguugccgaucc

SEQ ID NO: 3011062 - RNA, 18 nt, Mycobacterium avium subsp. paratuberculosis
guagacucagcgucgaug

SEQ ID NO: 3011063 - RNA, 20 nt, Mycobacterium avium subsp. paratuberculosis
guagagcaggaccgagccgc

SEQ ID NO: 3011064 - RNA, 15 nt, Mycobacterium avium subsp. paratuberculosis
guagagccgcugcac

SEQ ID NO: 3011065 - RNA, 17 nt, Mycobacterium avium subsp. paratuberculosis
guagagccgcugcacgc

SEQ ID NO: 3011066 - RNA, 21 nt, Mycobacterium avium subsp. paratuberculosis
guagagccguuuggcgccgcc

SEQ ID NO: 3011067 - RNA, 22 nt, Mycobacterium avium subsp. paratuberculosis
guagagcgccagggucuggccc

SEQ ID NO: 3011068 - RNA, 19 nt, Mycobacterium avium subsp. paratuberculosis
guagagcgggauccccacc

SEQ ID NO: 3011069 - RNA, 20 nt, Mycobacterium avium subsp. paratuberculosis
guagagcgggauccccaccg

SEQ ID NO: 3011070 - RNA, 14 nt, Mycobacterium avium subsp. paratuberculosis
guagagcugacggg

SEQ ID NO: 3011071 - RNA, 20 nt, Mycobacterium avium subsp. paratuberculosis
guagaggcuguccagcagcg

SEQ ID NO: 3011072 - RNA, 18 nt, Mycobacterium avium subsp. paratuberculosis
guagaggugcagcgggcu

SEQ ID NO: 3011073 - RNA, 15 nt, Mycobacterium avium subsp. paratuberculosis
guagauaagcggauu

SEQ ID NO: 3011074 - RNA, 15 nt, Mycobacterium avium subsp. paratuberculosis
guagaucacgccggu

SEQ ID NO: 3011075 - RNA, 14 nt, Mycobacterium avium subsp. paratuberculosis
guagaucagcgccu

SEQ ID NO: 3011076 - RNA, 17 nt, Mycobacterium avium subsp. paratuberculosis
guagaucagcgccuggu

SEQ ID NO: 3011077 - RNA, 12 nt, Mycobacterium avium subsp. paratuberculosis
guagaucgccag

SEQ ID NO: 3011078 - RNA, 16 nt, Mycobacterium avium subsp. paratuberculosis
guagaucgccagcgcc

SEQ ID NO: 3011079 - RNA, 20 nt, Mycobacterium avium subsp. paratuberculosis
guagaucgccagcgccccca

SEQ ID NO: 3011080 - RNA, 16 nt, Mycobacterium avium subsp. paratuberculosis
guagaucggcucaccg

SEQ ID NO: 3011081 - RNA, 18 nt, Mycobacterium avium subsp. paratuberculosis
guagaucggcucaccgaa

SEQ ID NO: 3011082 - RNA, 13 nt, Mycobacterium avium subsp. paratuberculosis
guagaucucgcgc

SEQ ID NO: 3011083 - RNA, 16 nt, Mycobacterium avium subsp. paratuberculosis
guagaucucgcgccgc

SEQ ID NO: 3011084 - RNA, 22 nt, Mycobacterium avium subsp. paratuberculosis
guagaugccgguacggccgacg

SEQ ID NO: 3011085 - RNA, 17 nt, Mycobacterium avium subsp. paratuberculosis
guagaugcggcccagcc

SEQ ID NO: 3011086 - RNA, 16 nt, Mycobacterium avium subsp. paratuberculosis
guagcacccggccggc

SEQ ID NO: 3011087 - RNA, 18 nt, Mycobacterium avium subsp. paratuberculosis
guagcacccggccggcga

SEQ ID NO: 3011088 - RNA, 23 nt, Mycobacterium avium subsp. paratuberculosis
guagcagacggacacccgcgcgg

SEQ ID NO: 3011089 - RNA, 22 nt, Mycobacterium avium subsp. paratuberculosis
guagcagacgguaugcccgccg

SEQ ID NO: 3011090 - RNA, 14 nt, Mycobacterium avium subsp. paratuberculosis
guagcagcagaccg

SEQ ID NO: 3011091 - RNA, 23 nt, Mycobacterium avium subsp. paratuberculosis
guagcagcgcggcuuggccacca

SEQ ID NO: 3011092 - RNA, 16 nt, Mycobacterium avium subsp. paratuberculosis
guagcaggcgcgcagc

SEQ ID NO: 3011093 - RNA, 17 nt, Mycobacterium avium subsp. paratuberculosis
guagcaggcgcgcagca

SEQ ID NO: 3011094 - RNA, 13 nt, Mycobacterium avium subsp. paratuberculosis
guagcaggcggug

SEQ ID NO: 3011095 - RNA, 16 nt, Mycobacterium avium subsp. paratuberculosis
guagcagucggccugc

SEQ ID NO: 3011096 - RNA, 19 nt, Mycobacterium avium subsp. paratuberculosis
guagcagucggccugcagc

SEQ ID NO: 3011097 - RNA, 13 nt, Mycobacterium avium subsp. paratuberculosis
guagccagcaccg

SEQ ID NO: 3011098 - RNA, 16 nt, Mycobacterium avium subsp. paratuberculosis
guagccagcaccgccc

SEQ ID NO: 3011099 - RNA, 20 nt, Mycobacterium avium subsp. paratuberculosis
guagccaugggucucggcga

SEQ ID NO: 3011100 - RNA, 19 nt, Mycobacterium avium subsp. paratuberculosis
guagcccaccucgagcacg

SEQ ID NO: 3011101 - RNA, 23 nt, Mycobacterium avium subsp. paratuberculosis
guagcccaggauucccgaccccg

SEQ ID NO: 3011102 - RNA, 19 nt, Mycobacterium avium subsp. paratuberculosis
guagcccaugucgccggug

SEQ ID NO: 3011103 - RNA, 13 nt, Mycobacterium avium subsp. paratuberculosis
guagcccgccgaa

SEQ ID NO: 3011104 - RNA, 13 nt, Mycobacterium avium subsp. paratuberculosis
guagcccggugcc

SEQ ID NO: 3011105 - RNA, 14 nt, Mycobacterium avium subsp. paratuberculosis
guagcccgucgacg

SEQ ID NO: 3011106 - RNA, 19 nt, Mycobacterium avium subsp. paratuberculosis
guagcccuaccggcucggc

SEQ ID NO: 3011107 - RNA, 20 nt, Mycobacterium avium subsp. paratuberculosis
guagcccuaccggcucggcc

SEQ ID NO: 3011108 - RNA, 15 nt, Mycobacterium avium subsp. paratuberculosis
guagcccugcaggua

SEQ ID NO: 3011109 - RNA, 13 nt, Mycobacterium avium subsp. paratuberculosis
guagccgaacgug

SEQ ID NO: 3011110 - RNA, 17 nt, Mycobacterium avium subsp. paratuberculosis
guagccgaccaacgggc

SEQ ID NO: 3011111 - RNA, 20 nt, Mycobacterium avium subsp. paratuberculosis
guagccgaccaacgggcggc

SEQ ID NO: 3011112 - RNA, 21 nt, Mycobacterium avium subsp. paratuberculosis
guagccgaccaacgggcggcg

SEQ ID NO: 3011113 - RNA, 14 nt, Mycobacterium avium subsp. paratuberculosis
guagccgaccgacc

SEQ ID NO: 3011114 - RNA, 16 nt, Mycobacterium avium subsp. paratuberculosis
guagccgaccgacccg

SEQ ID NO: 3011115 - RNA, 22 nt, Mycobacterium avium subsp. paratuberculosis
guagccgaccgacccggccagc

SEQ ID NO: 3011116 - RNA, 21 nt, Mycobacterium avium subsp. paratuberculosis
guagccgaucuccaccgagug

SEQ ID NO: 3011117 - RNA, 14 nt, Mycobacterium avium subsp. paratuberculosis
guagccgccgggcg

SEQ ID NO: 3011118 - RNA, 13 nt, Mycobacterium avium subsp. paratuberculosis
guagccgccggug

SEQ ID NO: 3011119 - RNA, 12 nt, Mycobacterium avium subsp. paratuberculosis
guagccgcgcac

SEQ ID NO: 3011120 - RNA, 14 nt, Mycobacterium avium subsp. paratuberculosis
guagccgcgcacca

SEQ ID NO: 3011121 - RNA, 16 nt, Mycobacterium avium subsp. paratuberculosis
guagccgcucgcccag

SEQ ID NO: 3011122 - RNA, 20 nt, Mycobacterium avium subsp. paratuberculosis
guagccgcucgcccagcgcg

SEQ ID NO: 3011123 - RNA, 13 nt, Mycobacterium avium subsp. paratuberculosis
guagccggccagc

SEQ ID NO: 3011124 - RNA, 20 nt, Mycobacterium avium subsp. paratuberculosis
guagccggccagcucgagca

SEQ ID NO: 3011125 - RNA, 13 nt, Mycobacterium avium subsp. paratuberculosis
guagccggcccgc

SEQ ID NO: 3011126 - RNA, 15 nt, Mycobacterium avium subsp. paratuberculosis
guagccggcgaucgu

SEQ ID NO: 3011127 - RNA, 14 nt, Mycobacterium avium subsp. paratuberculosis
guagccggggacgg

SEQ ID NO: 3011128 - RNA, 20 nt, Mycobacterium avium subsp. paratuberculosis
guagccgguauccauccgcc

SEQ ID NO: 3011129 - RNA, 17 nt, Mycobacterium avium subsp. paratuberculosis
guagccggucggcccgc

SEQ ID NO: 3011130 - RNA, 21 nt, Mycobacterium avium subsp. paratuberculosis
guagccggucggcccgcuccc

SEQ ID NO: 3011131 - RNA, 20 nt, Mycobacterium avium subsp. paratuberculosis
guagccgguggucaacgcgc

SEQ ID NO: 3011132 - RNA, 18 nt, Mycobacterium avium subsp. paratuberculosis
guagccgguucgucccgc

SEQ ID NO: 3011133 - RNA, 18 nt, Mycobacterium avium subsp. paratuberculosis
guagccguaacgaugccg

SEQ ID NO: 3011134 - RNA, 14 nt, Mycobacterium avium subsp. paratuberculosis
guagccugcagugu

SEQ ID NO: 3011135 - RNA, 15 nt, Mycobacterium avium subsp. paratuberculosis
guagccugcggccug

SEQ ID NO: 3011136 - RNA, 14 nt, Mycobacterium avium subsp. paratuberculosis
guagcgagguguga

SEQ ID NO: 3011137 - RNA, 20 nt, Mycobacterium avium subsp. paratuberculosis
guagcgaggugugaggaguc

SEQ ID NO: 3011138 - RNA, 22 nt, Mycobacterium avium subsp. paratuberculosis
guagcgaggugugaggagucgg

SEQ ID NO: 3011139 - RNA, 19 nt, Mycobacterium avium subsp. paratuberculosis
guagcgagugccggccagc

SEQ ID NO: 3011140 - RNA, 13 nt, Mycobacterium avium subsp. paratuberculosis
guagcgcaacacc

SEQ ID NO: 3011141 - RNA, 15 nt, Mycobacterium avium subsp. paratuberculosis
guagcgcaccgguca

SEQ ID NO: 3011142 - RNA, 13 nt, Mycobacterium avium subsp. paratuberculosis
guagcgcagcacc

SEQ ID NO: 3011143 - RNA, 14 nt, Mycobacterium avium subsp. paratuberculosis
guagcgcagcacca

SEQ ID NO: 3011144 - RNA, 14 nt, Mycobacterium avium subsp. paratuberculosis
guagcgcagcauca

SEQ ID NO: 3011145 - RNA, 13 nt, Mycobacterium avium subsp. paratuberculosis
guagcgcagcccg

SEQ ID NO: 3011146 - RNA, 14 nt, Mycobacterium avium subsp. paratuberculosis
guagcgcagcccgg

SEQ ID NO: 3011147 - RNA, 17 nt, Mycobacterium avium subsp. paratuberculosis
guagcgcagcccgguuu

SEQ ID NO: 3011148 - RNA, 19 nt, Mycobacterium avium subsp. paratuberculosis
guagcgcauaggccgcgag

SEQ ID NO: 3011149 - RNA, 23 nt, Mycobacterium avium subsp. paratuberculosis
guagcgccacaucagcucggcgg

SEQ ID NO: 3011150 - RNA, 12 nt, Mycobacterium avium subsp. paratuberculosis
guagcgccgccc

SEQ ID NO: 3011151 - RNA, 17 nt, Mycobacterium avium subsp. paratuberculosis
guagcgccgcccgucca

SEQ ID NO: 3011152 - RNA, 15 nt, Mycobacterium avium subsp. paratuberculosis
guagcgccgccgggg

SEQ ID NO: 3011153 - RNA, 12 nt, Mycobacterium avium subsp. paratuberculosis
guagcgccggca

SEQ ID NO: 3011154 - RNA, 23 nt, Mycobacterium avium subsp. paratuberculosis
guagcgcuccaccagguucgcgc

SEQ ID NO: 3011155 - RNA, 14 nt, Mycobacterium avium subsp. paratuberculosis
guagcgcucgguca

SEQ ID NO: 3011156 - RNA, 15 nt, Mycobacterium avium subsp. paratuberculosis
guagcgcugggugaa

SEQ ID NO: 3011157 - RNA, 19 nt, Mycobacterium avium subsp. paratuberculosis
guagcggacgacggccagc

SEQ ID NO: 3011158 - RNA, 20 nt, Mycobacterium avium subsp. paratuberculosis
guagcggacgacggccagcu

SEQ ID NO: 3011159 - RNA, 13 nt, Mycobacterium avium subsp. paratuberculosis
guagcggauggcg

SEQ ID NO: 3011160 - RNA, 21 nt, Mycobacterium avium subsp. paratuberculosis
guagcggcagauggucucgau

SEQ ID NO: 3011161 - RNA, 23 nt, Mycobacterium avium subsp. paratuberculosis
guagcggcagauggucucgaucu

SEQ ID NO: 3011162 - RNA, 20 nt, Mycobacterium avium subsp. paratuberculosis
guagcggcccgaaaacgccc

SEQ ID NO: 3011163 - RNA, 21 nt, Mycobacterium avium subsp. paratuberculosis
guagcggccgcacgcgaacac

SEQ ID NO: 3011164 - RNA, 13 nt, Mycobacterium avium subsp. paratuberculosis
guagcggcggaac

SEQ ID NO: 3011165 - RNA, 12 nt, Mycobacterium avium subsp. paratuberculosis
guagcggcggcu

SEQ ID NO: 3011166 - RNA, 12 nt, Mycobacterium avium subsp. paratuberculosis
guagcggcgguc

SEQ ID NO: 3011167 - RNA, 15 nt, Mycobacterium avium subsp. paratuberculosis
guagcggcggucggc

SEQ ID NO: 3011168 - RNA, 17 nt, Mycobacterium avium subsp. paratuberculosis
guagcggcggucggcgc

SEQ ID NO: 3011169 - RNA, 22 nt, Mycobacterium avium subsp. paratuberculosis
guagcggcggucggcgccgauc

SEQ ID NO: 3011170 - RNA, 21 nt, Mycobacterium avium subsp. paratuberculosis
guagcggcugaccgagcggcg

SEQ ID NO: 3011171 - RNA, 22 nt, Mycobacterium avium subsp. paratuberculosis
guagcgggcgaacgaccgggug

SEQ ID NO: 3011172 - RNA, 17 nt, Mycobacterium avium subsp. paratuberculosis
guagcgguauccgauca

SEQ ID NO: 3011173 - RNA, 14 nt, Mycobacterium avium subsp. paratuberculosis
guagcgguccagcg

SEQ ID NO: 3011174 - RNA, 17 nt, Mycobacterium avium subsp. paratuberculosis
guagcggucgccccaga

SEQ ID NO: 3011175 - RNA, 17 nt, Mycobacterium avium subsp. paratuberculosis
guagcggucgugcggga

SEQ ID NO: 3011176 - RNA, 22 nt, Mycobacterium avium subsp. paratuberculosis
guagcggucgugcgggaugccg

SEQ ID NO: 3011177 - RNA, 21 nt, Mycobacterium avium subsp. paratuberculosis
guagcggugaaacgccugcac

SEQ ID NO: 3011178 - RNA, 22 nt, Mycobacterium avium subsp. paratuberculosis
guagcggugaaacgccugcacc

SEQ ID NO: 3011179 - RNA, 17 nt, Mycobacterium avium subsp. paratuberculosis
guagcgugcgcccgacg

SEQ ID NO: 3011180 - RNA, 16 nt, Mycobacterium avium subsp. paratuberculosis
guagcguugccggccg

SEQ ID NO: 3011181 - RNA, 19 nt, Mycobacterium avium subsp. paratuberculosis
guagcucagccacgccggc

SEQ ID NO: 3011182 - RNA, 23 nt, Mycobacterium avium subsp. paratuberculosis
guagcucagccacgccggcacac

SEQ ID NO: 3011183 - RNA, 23 nt, Mycobacterium avium subsp. paratuberculosis
guagcucagugguagagcucugg

SEQ ID NO: 3011184 - RNA, 15 nt, Mycobacterium avium subsp. paratuberculosis
guagcucgccgcggc

SEQ ID NO: 3011185 - RNA, 16 nt, Mycobacterium avium subsp. paratuberculosis
guagcucgccgcggcc

SEQ ID NO: 3011186 - RNA, 22 nt, Mycobacterium avium subsp. paratuberculosis
guagcucgccgcggccacgcuc

SEQ ID NO: 3011187 - RNA, 15 nt, Mycobacterium avium subsp. paratuberculosis
guagcucgcgccgac

SEQ ID NO: 3011188 - RNA, 13 nt, Mycobacterium avium subsp. paratuberculosis
guagcugaccgau

SEQ ID NO: 3011189 - RNA, 23 nt, Mycobacterium avium subsp. paratuberculosis
guagcugagcagcaggucggcgu

SEQ ID NO: 3011190 - RNA, 23 nt, Mycobacterium avium subsp. paratuberculosis
guagcugauggcacccucggugc

SEQ ID NO: 3011191 - RNA, 17 nt, Mycobacterium avium subsp. paratuberculosis
guagcugcaggcgacga

SEQ ID NO: 3011192 - RNA, 21 nt, Mycobacterium avium subsp. paratuberculosis
guagcugcccugaagcugggc

SEQ ID NO: 3011193 - RNA, 13 nt, Mycobacterium avium subsp. paratuberculosis
guagcugcggguc

SEQ ID NO: 3011194 - RNA, 21 nt, Mycobacterium avium subsp. paratuberculosis
guagcugcgggucucgcccac

SEQ ID NO: 3011195 - RNA, 20 nt, Mycobacterium avium subsp. paratuberculosis
guagcugcugucgaacaccg

SEQ ID NO: 3011196 - RNA, 23 nt, Mycobacterium avium subsp. paratuberculosis
guagcugggccccuccagccgcc

SEQ ID NO: 3011197 - RNA, 17 nt, Mycobacterium avium subsp. paratuberculosis
guagcuggugcgcagcc

SEQ ID NO: 3011198 - RNA, 20 nt, Mycobacterium avium subsp. paratuberculosis
guagcuggugcgcagcccgc

SEQ ID NO: 3011199 - RNA, 22 nt, Mycobacterium avium subsp. paratuberculosis
guagcuggugcgcagcccgccg

SEQ ID NO: 3011200 - RNA, 12 nt, Mycobacterium avium subsp. paratuberculosis
guaggacaccac

SEQ ID NO: 3011201 - RNA, 18 nt, Mycobacterium avium subsp. paratuberculosis
guaggacaccacgguggc

SEQ ID NO: 3011202 - RNA, 13 nt, Mycobacterium avium subsp. paratuberculosis
guaggacagcacc

SEQ ID NO: 3011203 - RNA, 16 nt, Mycobacterium avium subsp. paratuberculosis
guaggacagcaccaca

SEQ ID NO: 3011204 - RNA, 14 nt, Mycobacterium avium subsp. paratuberculosis
guaggacagcagcc

SEQ ID NO: 3011205 - RNA, 12 nt, Mycobacterium avium subsp. paratuberculosis
guaggacaggaa

SEQ ID NO: 3011206 - RNA, 17 nt, Mycobacterium avium subsp. paratuberculosis
guaggacaggucgcggu

SEQ ID NO: 3011207 - RNA, 22 nt, Mycobacterium avium subsp. paratuberculosis
guaggacccuucgaacgcgacg

SEQ ID NO: 3011208 - RNA, 13 nt, Mycobacterium avium subsp. paratuberculosis
guaggacgccgca

SEQ ID NO: 3011209 - RNA, 13 nt, Mycobacterium avium subsp. paratuberculosis
guaggacgccgug

SEQ ID NO: 3011210 - RNA, 21 nt, Mycobacterium avium subsp. paratuberculosis
guaggacgccgugcaggaggc

SEQ ID NO: 3011211 - RNA, 23 nt, Mycobacterium avium subsp. paratuberculosis
guaggagaacgucaggcccagcg

SEQ ID NO: 3011212 - RNA, 16 nt, Mycobacterium avium subsp. paratuberculosis
guaggccagcccggcg

SEQ ID NO: 3011213 - RNA, 22 nt, Mycobacterium avium subsp. paratuberculosis
guaggccagcccggcgugcagg

SEQ ID NO: 3011214 - RNA, 23 nt, Mycobacterium avium subsp. paratuberculosis
guaggccauccugaagaagcggc

SEQ ID NO: 3011215 - RNA, 16 nt, Mycobacterium avium subsp. paratuberculosis
guaggcccauucgucu

SEQ ID NO: 3011216 - RNA, 18 nt, Mycobacterium avium subsp. paratuberculosis
guaggcccgaucaggguc

SEQ ID NO: 3011217 - RNA, 15 nt, Mycobacterium avium subsp. paratuberculosis
guaggccgccgcgac

SEQ ID NO: 3011218 - RNA, 23 nt, Mycobacterium avium subsp. paratuberculosis
guaggccgccgcgaccgucagca

SEQ ID NO: 3011219 - RNA, 14 nt, Mycobacterium avium subsp. paratuberculosis
guaggccgcgcggu

SEQ ID NO: 3011220 - RNA, 19 nt, Mycobacterium avium subsp. paratuberculosis
guaggccgcguagcucgcc

SEQ ID NO: 3011221 - RNA, 14 nt, Mycobacterium avium subsp. paratuberculosis
guaggccggccgca

SEQ ID NO: 3011222 - RNA, 16 nt, Mycobacterium avium subsp. paratuberculosis
guaggccggccgcagc

SEQ ID NO: 3011223 - RNA, 22 nt, Mycobacterium avium subsp. paratuberculosis
guaggccuugcugagccggccc

SEQ ID NO: 3011224 - RNA, 22 nt, Mycobacterium avium subsp. paratuberculosis
guaggcgaaauaacccaccccg

SEQ ID NO: 3011225 - RNA, 20 nt, Mycobacterium avium subsp. paratuberculosis
guaggcgaagagcggcacga

SEQ ID NO: 3011226 - RNA, 19 nt, Mycobacterium avium subsp. paratuberculosis
guaggcgaccacaccgccg

SEQ ID NO: 3011227 - RNA, 20 nt, Mycobacterium avium subsp. paratuberculosis
guaggcgaccacaccgccgg

SEQ ID NO: 3011228 - RNA, 20 nt, Mycobacterium avium subsp. paratuberculosis
guaggcgaccaugcccagca

SEQ ID NO: 3011229 - RNA, 21 nt, Mycobacterium avium subsp. paratuberculosis
guaggcgagaucaacaccgcg

SEQ ID NO: 3011230 - RNA, 23 nt, Mycobacterium avium subsp. paratuberculosis
guaggcgagaucaacaccgcgca

SEQ ID NO: 3011231 - RNA, 17 nt, Mycobacterium avium subsp. paratuberculosis
guaggcgaucagcgcgc

SEQ ID NO: 3011232 - RNA, 19 nt, Mycobacterium avium subsp. paratuberculosis
guaggcgaucagcgcgcac

SEQ ID NO: 3011233 - RNA, 20 nt, Mycobacterium avium subsp. paratuberculosis
guaggcgaucagcgcgcaca

SEQ ID NO: 3011234 - RNA, 22 nt, Mycobacterium avium subsp. paratuberculosis
guaggcgaucagcgcgcacagc

SEQ ID NO: 3011235 - RNA, 15 nt, Mycobacterium avium subsp. paratuberculosis
guaggcgcaccgccg

SEQ ID NO: 3011236 - RNA, 16 nt, Mycobacterium avium subsp. paratuberculosis
guaggcgcaccgccgg

SEQ ID NO: 3011237 - RNA, 14 nt, Mycobacterium avium subsp. paratuberculosis
guaggcgcccugcg

SEQ ID NO: 3011238 - RNA, 12 nt, Mycobacterium avium subsp. paratuberculosis
guaggcgccgau

SEQ ID NO: 3011239 - RNA, 13 nt, Mycobacterium avium subsp. paratuberculosis
guaggcgccgcuc

SEQ ID NO: 3011240 - RNA, 17 nt, Mycobacterium avium subsp. paratuberculosis
guaggcgcggucggugg

SEQ ID NO: 3011241 - RNA, 14 nt, Mycobacterium avium subsp. paratuberculosis
guaggcggccagca

SEQ ID NO: 3011242 - RNA, 16 nt, Mycobacterium avium subsp. paratuberculosis
guaggcggccagcagc

SEQ ID NO: 3011243 - RNA, 19 nt, Mycobacterium avium subsp. paratuberculosis
guaggcggccagcgcccgc

SEQ ID NO: 3011244 - RNA, 15 nt, Mycobacterium avium subsp. paratuberculosis
guaggcggcgcagcc

SEQ ID NO: 3011245 - RNA, 19 nt, Mycobacterium avium subsp. paratuberculosis
guaggcggcgcagccagcg

SEQ ID NO: 3011246 - RNA, 12 nt, Mycobacterium avium subsp. paratuberculosis
guaggcggcgug

SEQ ID NO: 3011247 - RNA, 15 nt, Mycobacterium avium subsp. paratuberculosis
guaggcggcugucga

SEQ ID NO: 3011248 - RNA, 17 nt, Mycobacterium avium subsp. paratuberculosis
guaggcgguggcgcaca

SEQ ID NO: 3011249 - RNA, 15 nt, Mycobacterium avium subsp. paratuberculosis
guaggcgucgcgcag

SEQ ID NO: 3011250 - RNA, 20 nt, Mycobacterium avium subsp. paratuberculosis
guaggcgucgcgcagcagcg

SEQ ID NO: 3011251 - RNA, 23 nt, Mycobacterium avium subsp. paratuberculosis
guaggcgucgcgcagcagcggga

SEQ ID NO: 3011252 - RNA, 16 nt, Mycobacterium avium subsp. paratuberculosis
guagggcacaccggug

SEQ ID NO: 3011253 - RNA, 18 nt, Mycobacterium avium subsp. paratuberculosis
guagggcagauaggcggc

SEQ ID NO: 3011254 - RNA, 19 nt, Mycobacterium avium subsp. paratuberculosis
guagggccaccacgccagc

SEQ ID NO: 3011255 - RNA, 12 nt, Mycobacterium avium subsp. paratuberculosis
guagggccgcuu

SEQ ID NO: 3011256 - RNA, 16 nt, Mycobacterium avium subsp. paratuberculosis
guagggcucggcgucg

SEQ ID NO: 3011257 - RNA, 20 nt, Mycobacterium avium subsp. paratuberculosis
guagggguccuccagcggca

SEQ ID NO: 3011258 - RNA, 22 nt, Mycobacterium avium subsp. paratuberculosis
guaggguucgccgauguccccg

SEQ ID NO: 3011259 - RNA, 17 nt, Mycobacterium avium subsp. paratuberculosis
guaggucacccgguccc

SEQ ID NO: 3011260 - RNA, 17 nt, Mycobacterium avium subsp. paratuberculosis
guaggucaucagcgacg

SEQ ID NO: 3011261 - RNA, 19 nt, Mycobacterium avium subsp. paratuberculosis
guaggucaucagcgacguc

SEQ ID NO: 3011262 - RNA, 19 nt, Mycobacterium avium subsp. paratuberculosis
guaggugaucgccucgacc

SEQ ID NO: 3011263 - RNA, 20 nt, Mycobacterium avium subsp. paratuberculosis
guaggugaucgccucgacca

SEQ ID NO: 3011264 - RNA, 14 nt, Mycobacterium avium subsp. paratuberculosis
guaggugcacagcc

SEQ ID NO: 3011265 - RNA, 15 nt, Mycobacterium avium subsp. paratuberculosis
guaggugccggccgc

SEQ ID NO: 3011266 - RNA, 14 nt, Mycobacterium avium subsp. paratuberculosis
guaggugcgcgagg

SEQ ID NO: 3011267 - RNA, 13 nt, Mycobacterium avium subsp. paratuberculosis
guaggugugcagc

SEQ ID NO: 3011268 - RNA, 16 nt, Mycobacterium avium subsp. paratuberculosis
guaguacgaccgcgac

SEQ ID NO: 3011269 - RNA, 17 nt, Mycobacterium avium subsp. paratuberculosis
guaguacgaccgcgacg

SEQ ID NO: 3011270 - RNA, 20 nt, Mycobacterium avium subsp. paratuberculosis
guaguagaccuugaccaccg

SEQ ID NO: 3011271 - RNA, 22 nt, Mycobacterium avium subsp. paratuberculosis
guaguagaccuugaccaccgag

SEQ ID NO: 3011272 - RNA, 22 nt, Mycobacterium avium subsp. paratuberculosis
guaguagccggggacggugcag

SEQ ID NO: 3011273 - RNA, 12 nt, Mycobacterium avium subsp. paratuberculosis
guagucacccgg

SEQ ID NO: 3011274 - RNA, 17 nt, Mycobacterium avium subsp. paratuberculosis
guaguccagcacggcga

SEQ ID NO: 3011275 - RNA, 18 nt, Mycobacterium avium subsp. paratuberculosis
guaguccagcacggcgaa

SEQ ID NO: 3011276 - RNA, 15 nt, Mycobacterium avium subsp. paratuberculosis
guaguccaggguguc

SEQ ID NO: 3011277 - RNA, 12 nt, Mycobacterium avium subsp. paratuberculosis
guaguccagguc

SEQ ID NO: 3011278 - RNA, 16 nt, Mycobacterium avium subsp. paratuberculosis
guaguccggccagucc

SEQ ID NO: 3011279 - RNA, 20 nt, Mycobacterium avium subsp. paratuberculosis
guaguccgggaugacaccgc

SEQ ID NO: 3011280 - RNA, 16 nt, Mycobacterium avium subsp. paratuberculosis
guagucgaccacccgc

SEQ ID NO: 3011281 - RNA, 19 nt, Mycobacterium avium subsp. paratuberculosis
guagucgaccacccgcagc

SEQ ID NO: 3011282 - RNA, 21 nt, Mycobacterium avium subsp. paratuberculosis
guagucgauucaucgccgaac

SEQ ID NO: 3011283 - RNA, 12 nt, Mycobacterium avium subsp. paratuberculosis
guagucgcgcac

SEQ ID NO: 3011284 - RNA, 13 nt, Mycobacterium avium subsp. paratuberculosis
guagucgcgcacc

SEQ ID NO: 3011285 - RNA, 14 nt, Mycobacterium avium subsp. paratuberculosis
guagucgcgcacca

SEQ ID NO: 3011286 - RNA, 14 nt, Mycobacterium avium subsp. paratuberculosis
guagucgcgcagcu

SEQ ID NO: 3011287 - RNA, 16 nt, Mycobacterium avium subsp. paratuberculosis
guagucgcucggcggc

SEQ ID NO: 3011288 - RNA, 17 nt, Mycobacterium avium subsp. paratuberculosis
guagucgcucggcggcg

SEQ ID NO: 3011289 - RNA, 21 nt, Mycobacterium avium subsp. paratuberculosis
guagucgcucggcggcgacgg

SEQ ID NO: 3011290 - RNA, 14 nt, Mycobacterium avium subsp. paratuberculosis
guagucggcccagg

SEQ ID NO: 3011291 - RNA, 15 nt, Mycobacterium avium subsp. paratuberculosis
guagucggcccaggc

SEQ ID NO: 3011292 - RNA, 14 nt, Mycobacterium avium subsp. paratuberculosis
guagucggcccgcc

SEQ ID NO: 3011293 - RNA, 23 nt, Mycobacterium avium subsp. paratuberculosis
guagucggcccgccgggccggau

SEQ ID NO: 3011294 - RNA, 17 nt, Mycobacterium avium subsp. paratuberculosis
guagucggcgcagcgca

SEQ ID NO: 3011295 - RNA, 21 nt, Mycobacterium avium subsp. paratuberculosis
guagucggcgcagcgcacguc

SEQ ID NO: 3011296 - RNA, 16 nt, Mycobacterium avium subsp. paratuberculosis
guagucggcgccgacg

SEQ ID NO: 3011297 - RNA, 18 nt, Mycobacterium avium subsp. paratuberculosis
guagucggcguccgugcc

SEQ ID NO: 3011298 - RNA, 20 nt, Mycobacterium avium subsp. paratuberculosis
guagucgucgaucucgguga

SEQ ID NO: 3011299 - RNA, 14 nt, Mycobacterium avium subsp. paratuberculosis
guagugcucggcgu

SEQ ID NO: 3011300 - RNA, 15 nt, Mycobacterium avium subsp. paratuberculosis
guaguggcgugcggc

SEQ ID NO: 3011301 - RNA, 14 nt, Mycobacterium avium subsp. paratuberculosis
guagugggucggcg

SEQ ID NO: 3011302 - RNA, 19 nt, Mycobacterium avium subsp. paratuberculosis
guagugguccaccgccgcg

SEQ ID NO: 3011303 - RNA, 14 nt, Mycobacterium avium subsp. paratuberculosis
guaguggugcaggu

SEQ ID NO: 3011304 - RNA, 16 nt, Mycobacterium avium subsp. paratuberculosis
guaguggugcaggugc

SEQ ID NO: 3011305 - RNA, 19 nt, Mycobacterium avium subsp. paratuberculosis
guaguucaccccguaugcg

SEQ ID NO: 3011306 - RNA, 14 nt, Mycobacterium avium subsp. paratuberculosis
guaguucagcagcc

SEQ ID NO: 3011307 - RNA, 19 nt, Mycobacterium avium subsp. paratuberculosis
guaguuguucgacugcagg

SEQ ID NO: 3011308 - RNA, 16 nt, Mycobacterium avium subsp. paratuberculosis
guauauuugccugacu

SEQ ID NO: 3011309 - RNA, 19 nt, Mycobacterium avium subsp. paratuberculosis
guaucaacugagcgcccgg

SEQ ID NO: 3011310 - RNA, 21 nt, Mycobacterium avium subsp. paratuberculosis
guaucccguugggguccucga

SEQ ID NO: 3011311 - RNA, 16 nt, Mycobacterium avium subsp. paratuberculosis
guaucccugccagggg

SEQ ID NO: 3011312 - RNA, 13 nt, Mycobacterium avium subsp. paratuberculosis
guauccgccgcca

SEQ ID NO: 3011313 - RNA, 19 nt, Mycobacterium avium subsp. paratuberculosis
guauccgccgccagcgcca

SEQ ID NO: 3011314 - RNA, 13 nt, Mycobacterium avium subsp. paratuberculosis
guauccgcgcagc

SEQ ID NO: 3011315 - RNA, 14 nt, Mycobacterium avium subsp. paratuberculosis
guauccgcgcagcg

SEQ ID NO: 3011316 - RNA, 16 nt, Mycobacterium avium subsp. paratuberculosis
guauccggccagccgg

SEQ ID NO: 3011317 - RNA, 17 nt, Mycobacterium avium subsp. paratuberculosis
guauccggccagccggg

SEQ ID NO: 3011318 - RNA, 19 nt, Mycobacterium avium subsp. paratuberculosis
guauccggucagcgccagc

SEQ ID NO: 3011319 - RNA, 22 nt, Mycobacterium avium subsp. paratuberculosis
guauccggucagcgccagcaug

SEQ ID NO: 3011320 - RNA, 14 nt, Mycobacterium avium subsp. paratuberculosis
guaucgccacgccg

SEQ ID NO: 3011321 - RNA, 15 nt, Mycobacterium avium subsp. paratuberculosis
guaucgcgccugcac

SEQ ID NO: 3011322 - RNA, 16 nt, Mycobacterium avium subsp. paratuberculosis
guaucggccccggccg

SEQ ID NO: 3011323 - RNA, 15 nt, Mycobacterium avium subsp. paratuberculosis
guaucgggucaccgu

SEQ ID NO: 3011324 - RNA, 19 nt, Mycobacterium avium subsp. paratuberculosis
guaugcccgccgcgucagc

SEQ ID NO: 3011325 - RNA, 14 nt, Mycobacterium avium subsp. paratuberculosis
guaugccuccucgg

SEQ ID NO: 3011326 - RNA, 18 nt, Mycobacterium avium subsp. paratuberculosis
guaugccuuggcccgcgc

SEQ ID NO: 3011327 - RNA, 20 nt, Mycobacterium avium subsp. paratuberculosis
guaugccuuggcccgcgcgg

SEQ ID NO: 3011328 - RNA, 15 nt, Mycobacterium avium subsp. paratuberculosis
guaugcgguccucga

SEQ ID NO: 3011329 - RNA, 14 nt, Mycobacterium avium subsp. paratuberculosis
guauuccagcgcca

SEQ ID NO: 3011330 - RNA, 14 nt, Mycobacterium avium subsp. paratuberculosis
guauucgacggcga

SEQ ID NO: 3011331 - RNA, 13 nt, Mycobacterium avium subsp. paratuberculosis
guauucgauggug

SEQ ID NO: 3011332 - RNA, 19 nt, Mycobacterium avium subsp. paratuberculosis
guauucgucaccccaccag

SEQ ID NO: 3011333 - RNA, 16 nt, Mycobacterium avium subsp. paratuberculosis
guauucgucgucggcc

SEQ ID NO: 3011334 - RNA, 15 nt, Mycobacterium avium subsp. paratuberculosis
guauugcacggcggc

SEQ ID NO: 3011335 - RNA, 17 nt, Mycobacterium avium subsp. paratuberculosis
guauugcacggcggcga

SEQ ID NO: 3011336 - RNA, 13 nt, Mycobacterium avium subsp. paratuberculosis
guauuggccacgc

SEQ ID NO: 3011337 - RNA, 18 nt, Mycobacterium avium subsp. paratuberculosis
guauuggccacgcuggcg

SEQ ID NO: 3011338 - RNA, 20 nt, Mycobacterium avium subsp. paratuberculosis
gucaaacccauugucgccgu

SEQ ID NO: 3011339 - RNA, 19 nt, Mycobacterium avium subsp. paratuberculosis
gucaaagccguucgcgccg

SEQ ID NO: 3011340 - RNA, 19 nt, Mycobacterium avium subsp. paratuberculosis
gucaacccgcucaggucgg

SEQ ID NO: 3011341 - RNA, 16 nt, Mycobacterium avium subsp. paratuberculosis
gucaacgagacacccu

SEQ ID NO: 3011342 - RNA, 23 nt, Mycobacterium avium subsp. paratuberculosis
gucaacgagacacccucgcgcag

SEQ ID NO: 3011343 - RNA, 15 nt, Mycobacterium avium subsp. paratuberculosis
gucaacgccgcgcgc

SEQ ID NO: 3011344 - RNA, 16 nt, Mycobacterium avium subsp. paratuberculosis
gucaacgccgcgcgca

SEQ ID NO: 3011345 - RNA, 19 nt, Mycobacterium avium subsp. paratuberculosis
gucaacgccgcgcgcagca

SEQ ID NO: 3011346 - RNA, 20 nt, Mycobacterium avium subsp. paratuberculosis
gucaacgccgcgcgcagcac

SEQ ID NO: 3011347 - RNA, 14 nt, Mycobacterium avium subsp. paratuberculosis
gucaacggcaccga

SEQ ID NO: 3011348 - RNA, 19 nt, Mycobacterium avium subsp. paratuberculosis
gucaacggcuugcgcaggu

SEQ ID NO: 3011349 - RNA, 17 nt, Mycobacterium avium subsp. paratuberculosis
gucaacucgacccgcac

SEQ ID NO: 3011350 - RNA, 15 nt, Mycobacterium avium subsp. paratuberculosis
gucaacucgucggcg

SEQ ID NO: 3011351 - RNA, 16 nt, Mycobacterium avium subsp. paratuberculosis
gucaacucgucggcga

SEQ ID NO: 3011352 - RNA, 21 nt, Mycobacterium avium subsp. paratuberculosis
gucaagaacgaaucgucgccg

SEQ ID NO: 3011353 - RNA, 16 nt, Mycobacterium avium subsp. paratuberculosis
gucaagauaccggccg

SEQ ID NO: 3011354 - RNA, 17 nt, Mycobacterium avium subsp. paratuberculosis
gucaagauaccggccgg

SEQ ID NO: 3011355 - RNA, 21 nt, Mycobacterium avium subsp. paratuberculosis
gucaagauaccggccggcgcg

SEQ ID NO: 3011356 - RNA, 16 nt, Mycobacterium avium subsp. paratuberculosis
gucaagccggcauggu

SEQ ID NO: 3011357 - RNA, 13 nt, Mycobacterium avium subsp. paratuberculosis
gucaagccggcca

SEQ ID NO: 3011358 - RNA, 15 nt, Mycobacterium avium subsp. paratuberculosis
gucaagccggccagc

SEQ ID NO: 3011359 - RNA, 19 nt, Mycobacterium avium subsp. paratuberculosis
gucaagccggccagcagcg

SEQ ID NO: 3011360 - RNA, 22 nt, Mycobacterium avium subsp. paratuberculosis
gucaagccggccagcagcggcu

SEQ ID NO: 3011361 - RNA, 15 nt, Mycobacterium avium subsp. paratuberculosis
gucaaggugcugaac

SEQ ID NO: 3011362 - RNA, 17 nt, Mycobacterium avium subsp. paratuberculosis
gucaaugauggucagcc

SEQ ID NO: 3011363 - RNA, 18 nt, Mycobacterium avium subsp. paratuberculosis
gucaaugauggucagccg

SEQ ID NO: 3011364 - RNA, 20 nt, Mycobacterium avium subsp. paratuberculosis
gucaaugauggucagccgca

SEQ ID NO: 3011365 - RNA, 23 nt, Mycobacterium avium subsp. paratuberculosis
gucaauugccaacugcagcaacg

SEQ ID NO: 3011366 - RNA, 19 nt, Mycobacterium avium subsp. paratuberculosis
gucaauugccacagccggu

SEQ ID NO: 3011367 - RNA, 15 nt, Mycobacterium avium subsp. paratuberculosis
gucacacccucggcc

SEQ ID NO: 3011368 - RNA, 20 nt, Mycobacterium avium subsp. paratuberculosis
gucacaccgcggccagcgcg

SEQ ID NO: 3011369 - RNA, 22 nt, Mycobacterium avium subsp. paratuberculosis
gucacaccgcggccagcgcgcg

SEQ ID NO: 3011370 - RNA, 14 nt, Mycobacterium avium subsp. paratuberculosis
gucacagccgcgau

SEQ ID NO: 3011371 - RNA, 14 nt, Mycobacterium avium subsp. paratuberculosis
gucacaggccgccu

SEQ ID NO: 3011372 - RNA, 16 nt, Mycobacterium avium subsp. paratuberculosis
gucacauacgccucac

SEQ ID NO: 3011373 - RNA, 20 nt, Mycobacterium avium subsp. paratuberculosis
gucaccaacaugaucggcgc

SEQ ID NO: 3011374 - RNA, 17 nt, Mycobacterium avium subsp. paratuberculosis
gucaccaaugcgccggc

SEQ ID NO: 3011375 - RNA, 20 nt, Mycobacterium avium subsp. paratuberculosis
gucaccaaugcgccggcggc

SEQ ID NO: 3011376 - RNA, 15 nt, Mycobacterium avium subsp. paratuberculosis
gucaccaccaccagu

SEQ ID NO: 3011377 - RNA, 14 nt, Mycobacterium avium subsp. paratuberculosis
gucaccaccggguc

SEQ ID NO: 3011378 - RNA, 19 nt, Mycobacterium avium subsp. paratuberculosis
gucaccaccgggucgucgc

SEQ ID NO: 3011379 - RNA, 11 nt, Mycobacterium avium subsp. paratuberculosis
gucaccacggu

SEQ ID NO: 3011380 - RNA, 13 nt, Mycobacterium avium subsp. paratuberculosis
gucaccagcggcc

SEQ ID NO: 3011381 - RNA, 16 nt, Mycobacterium avium subsp. paratuberculosis
gucaccagcggcccgc

SEQ ID NO: 3011382 - RNA, 22 nt, Mycobacterium avium subsp. paratuberculosis
gucaccagcggcccgcuguggu

SEQ ID NO: 3011383 - RNA, 13 nt, Mycobacterium avium subsp. paratuberculosis
gucaccagcucgc

SEQ ID NO: 3011384 - RNA, 14 nt, Mycobacterium avium subsp. paratuberculosis
gucaccagcucgcc

SEQ ID NO: 3011385 - RNA, 17 nt, Mycobacterium avium subsp. paratuberculosis
gucaccaggcugcucgg

SEQ ID NO: 3011386 - RNA, 17 nt, Mycobacterium avium subsp. paratuberculosis
gucaccaggucgcggua

SEQ ID NO: 3011387 - RNA, 16 nt, Mycobacterium avium subsp. paratuberculosis
gucaccaucagcaccg

SEQ ID NO: 3011388 - RNA, 18 nt, Mycobacterium avium subsp. paratuberculosis
gucacccacuggcggccg

SEQ ID NO: 3011389 - RNA, 21 nt, Mycobacterium avium subsp. paratuberculosis
gucacccacuggcggccggcc

SEQ ID NO: 3011390 - RNA, 22 nt, Mycobacterium avium subsp. paratuberculosis
gucacccagaucgcccgggcgg

SEQ ID NO: 3011391 - RNA, 14 nt, Mycobacterium avium subsp. paratuberculosis
gucacccaggccga

SEQ ID NO: 3011392 - RNA, 21 nt, Mycobacterium avium subsp. paratuberculosis
gucacccccggcgcgacggca

SEQ ID NO: 3011393 - RNA, 13 nt, Mycobacterium avium subsp. paratuberculosis
gucacccgcagcc

SEQ ID NO: 3011394 - RNA, 16 nt, Mycobacterium avium subsp. paratuberculosis
gucacccgcagcccga

SEQ ID NO: 3011395 - RNA, 17 nt, Mycobacterium avium subsp. paratuberculosis
gucacccgcagcccgac

SEQ ID NO: 3011396 - RNA, 14 nt, Mycobacterium avium subsp. paratuberculosis
gucacccggcuggc

SEQ ID NO: 3011397 - RNA, 17 nt, Mycobacterium avium subsp. paratuberculosis
gucacccgguugagcac

SEQ ID NO: 3011398 - RNA, 18 nt, Mycobacterium avium subsp. paratuberculosis
gucacccgguugagcacc

SEQ ID NO: 3011399 - RNA, 15 nt, Mycobacterium avium subsp. paratuberculosis
gucacccgugggccg

SEQ ID NO: 3011400 - RNA, 21 nt, Mycobacterium avium subsp. paratuberculosis
gucacccgugggccgaccggc

SEQ ID NO: 3011401 - RNA, 23 nt, Mycobacterium avium subsp. paratuberculosis
gucacccgugggccgaccggccg

SEQ ID NO: 3011402 - RNA, 15 nt, Mycobacterium avium subsp. paratuberculosis
gucacccucgaggcc

SEQ ID NO: 3011403 - RNA, 13 nt, Mycobacterium avium subsp. paratuberculosis
gucaccgacgcca

SEQ ID NO: 3011404 - RNA, 12 nt, Mycobacterium avium subsp. paratuberculosis
gucaccgacggc

SEQ ID NO: 3011405 - RNA, 14 nt, Mycobacterium avium subsp. paratuberculosis
gucaccgagcggcc

SEQ ID NO: 3011406 - RNA, 15 nt, Mycobacterium avium subsp. paratuberculosis
gucaccgagcggccg

SEQ ID NO: 3011407 - RNA, 17 nt, Mycobacterium avium subsp. paratuberculosis
gucaccgagcggccguc

SEQ ID NO: 3011408 - RNA, 15 nt, Mycobacterium avium subsp. paratuberculosis
gucaccgagcggggu

SEQ ID NO: 3011409 - RNA, 21 nt, Mycobacterium avium subsp. paratuberculosis
gucaccgagguagggccgggu

SEQ ID NO: 3011410 - RNA, 18 nt, Mycobacterium avium subsp. paratuberculosis
gucaccgccaggaccacc

SEQ ID NO: 3011411 - RNA, 12 nt, Mycobacterium avium subsp. paratuberculosis
gucaccgcccac

SEQ ID NO: 3011412 - RNA, 12 nt, Mycobacterium avium subsp. paratuberculosis
gucaccgccgca

SEQ ID NO: 3011413 - RNA, 13 nt, Mycobacterium avium subsp. paratuberculosis
gucaccgccgcac

SEQ ID NO: 3011414 - RNA, 22 nt, Mycobacterium avium subsp. paratuberculosis
gucaccgccgcaccgucgugcc

SEQ ID NO: 3011415 - RNA, 20 nt, Mycobacterium avium subsp. paratuberculosis
gucaccgccuccuggcugga

SEQ ID NO: 3011416 - RNA, 11 nt, Mycobacterium avium subsp. paratuberculosis
gucaccgcgcu

SEQ ID NO: 3011417 - RNA, 19 nt, Mycobacterium avium subsp. paratuberculosis
gucaccgcgcuugccgcga

SEQ ID NO: 3011418 - RNA, 21 nt, Mycobacterium avium subsp. paratuberculosis
gucaccgcgcuugccgcgacc

SEQ ID NO: 3011419 - RNA, 23 nt, Mycobacterium avium subsp. paratuberculosis
gucaccgcgggaauggccgcgcc

SEQ ID NO: 3011420 - RNA, 19 nt, Mycobacterium avium subsp. paratuberculosis
gucaccgcgggugaucugc

SEQ ID NO: 3011421 - RNA, 15 nt, Mycobacterium avium subsp. paratuberculosis
gucaccgcugaugcc

SEQ ID NO: 3011422 - RNA, 20 nt, Mycobacterium avium subsp. paratuberculosis
gucaccgcugaugccgccga

SEQ ID NO: 3011423 - RNA, 21 nt, Mycobacterium avium subsp. paratuberculosis
gucaccggaugcaccggcagc

SEQ ID NO: 3011424 - RNA, 21 nt, Mycobacterium avium subsp. paratuberculosis
gucaccggcaaggugccgucc

SEQ ID NO: 3011425 - RNA, 13 nt, Mycobacterium avium subsp. paratuberculosis
gucaccggcaggc

SEQ ID NO: 3011426 - RNA, 15 nt, Mycobacterium avium subsp. paratuberculosis
gucaccggcaggcgg

SEQ ID NO: 3011427 - RNA, 14 nt, Mycobacterium avium subsp. paratuberculosis
gucaccggccaucc

SEQ ID NO: 3011428 - RNA, 17 nt, Mycobacterium avium subsp. paratuberculosis
gucaccggcucgcgggg

SEQ ID NO: 3011429 - RNA, 17 nt, Mycobacterium avium subsp. paratuberculosis
gucaccggcugcccgac

SEQ ID NO: 3011430 - RNA, 13 nt, Mycobacterium avium subsp. paratuberculosis
gucaccggggugc

SEQ ID NO: 3011431 - RNA, 15 nt, Mycobacterium avium subsp. paratuberculosis
gucaccggggugccg

SEQ ID NO: 3011432 - RNA, 21 nt, Mycobacterium avium subsp. paratuberculosis
gucaccggggugccgcccaac

SEQ ID NO: 3011433 - RNA, 21 nt, Mycobacterium avium subsp. paratuberculosis
gucaccgggugaugucgccga

SEQ ID NO: 3011434 - RNA, 23 nt, Mycobacterium avium subsp. paratuberculosis
gucaccgggugaugucgccgacc

SEQ ID NO: 3011435 - RNA, 24 nt, Mycobacterium avium subsp. paratuberculosis
gucaccgggugaugucgccgacca

SEQ ID NO: 3011436 - RNA, 15 nt, Mycobacterium avium subsp. paratuberculosis
gucaccggucgcguu

SEQ ID NO: 3011437 - RNA, 19 nt, Mycobacterium avium subsp. paratuberculosis
gucaccggugucacgcugg

SEQ ID NO: 3011438 - RNA, 19 nt, Mycobacterium avium subsp. paratuberculosis
gucaccgucguacucgacc

SEQ ID NO: 3011439 - RNA, 16 nt, Mycobacterium avium subsp. paratuberculosis
gucaccgugccgucgc

SEQ ID NO: 3011440 - RNA, 18 nt, Mycobacterium avium subsp. paratuberculosis
gucaccgugggcggcgcg

SEQ ID NO: 3011441 - RNA, 23 nt, Mycobacterium avium subsp. paratuberculosis
gucaccguggugugcccgcgggc

SEQ ID NO: 3011442 - RNA, 16 nt, Mycobacterium avium subsp. paratuberculosis
gucaccgugucggcgg

SEQ ID NO: 3011443 - RNA, 21 nt, Mycobacterium avium subsp. paratuberculosis
gucaccucgagcacucgcggg

SEQ ID NO: 3011444 - RNA, 14 nt, Mycobacterium avium subsp. paratuberculosis
gucaccugacgcuc

SEQ ID NO: 3011445 - RNA, 17 nt, Mycobacterium avium subsp. paratuberculosis
gucaccuucaccacggc

SEQ ID NO: 3011446 - RNA, 18 nt, Mycobacterium avium subsp. paratuberculosis
gucaccuucaccacggcc

SEQ ID NO: 3011447 - RNA, 20 nt, Mycobacterium avium subsp. paratuberculosis
gucaccuucaccacggccau

SEQ ID NO: 3011448 - RNA, 22 nt, Mycobacterium avium subsp. paratuberculosis
gucaccuucaccacggccauca

SEQ ID NO: 3011449 - RNA, 16 nt, Mycobacterium avium subsp. paratuberculosis
gucaccuuggccggau

SEQ ID NO: 3011450 - RNA, 20 nt, Mycobacterium avium subsp. paratuberculosis
gucacgacggucacggccgc

SEQ ID NO: 3011451 - RNA, 22 nt, Mycobacterium avium subsp. paratuberculosis
gucacgacggucacggccgcca

SEQ ID NO: 3011452 - RNA, 13 nt, Mycobacterium avium subsp. paratuberculosis
gucacgcaucagg

SEQ ID NO: 3011453 - RNA, 19 nt, Mycobacterium avium subsp. paratuberculosis
gucacgcaucagggccagc

SEQ ID NO: 3011454 - RNA, 20 nt, Mycobacterium avium subsp. paratuberculosis
gucacgcaucagggccagcc

SEQ ID NO: 3011455 - RNA, 22 nt, Mycobacterium avium subsp. paratuberculosis
gucacgcaucagggccagccga

SEQ ID NO: 3011456 - RNA, 13 nt, Mycobacterium avium subsp. paratuberculosis
gucacgccagcgu

SEQ ID NO: 3011457 - RNA, 20 nt, Mycobacterium avium subsp. paratuberculosis
gucacgccagcgugacgcuc

SEQ ID NO: 3011458 - RNA, 21 nt, Mycobacterium avium subsp. paratuberculosis
gucacgccaguguggccgcgg

SEQ ID NO: 3011459 - RNA, 22 nt, Mycobacterium avium subsp. paratuberculosis
gucacgcccggguacaccgacu

SEQ ID NO: 3011460 - RNA, 21 nt, Mycobacterium avium subsp. paratuberculosis
gucacgcccgucccugcgcgg

SEQ ID NO: 3011461 - RNA, 20 nt, Mycobacterium avium subsp. paratuberculosis
gucacgcuagcgugacaguc

SEQ ID NO: 3011462 - RNA, 19 nt, Mycobacterium avium subsp. paratuberculosis
gucacgcugaacggugccg

SEQ ID NO: 3011463 - RNA, 18 nt, Mycobacterium avium subsp. paratuberculosis
gucacgcugcgcgccgau

SEQ ID NO: 3011464 - RNA, 20 nt, Mycobacterium avium subsp. paratuberculosis
gucacgcuggcgugacaguc

SEQ ID NO: 3011465 - RNA, 23 nt, Mycobacterium avium subsp. paratuberculosis
gucacgcuggcgugacgcucggc

SEQ ID NO: 3011466 - RNA, 20 nt, Mycobacterium avium subsp. paratuberculosis
gucacgcuggcgugacgguc

SEQ ID NO: 3011467 - RNA, 22 nt, Mycobacterium avium subsp. paratuberculosis
gucacgcuggcguggcgccggc

SEQ ID NO: 3011468 - RNA, 20 nt, Mycobacterium avium subsp. paratuberculosis
gucacgcuggcguggcucgg

SEQ ID NO: 3011469 - RNA, 16 nt, Mycobacterium avium subsp. paratuberculosis
gucacggacagccggc

SEQ ID NO: 3011470 - RNA, 16 nt, Mycobacterium avium subsp. paratuberculosis
gucacggccgccagca

SEQ ID NO: 3011471 - RNA, 22 nt, Mycobacterium avium subsp. paratuberculosis
gucacggccgccagcagcacgg

SEQ ID NO: 3011472 - RNA, 13 nt, Mycobacterium avium subsp. paratuberculosis
gucacggccgucc

SEQ ID NO: 3011473 - RNA, 17 nt, Mycobacterium avium subsp. paratuberculosis
gucacggccguccaggc

SEQ ID NO: 3011474 - RNA, 19 nt, Mycobacterium avium subsp. paratuberculosis
gucacggccguccaggcgc

SEQ ID NO: 3011475 - RNA, 15 nt, Mycobacterium avium subsp. paratuberculosis
gucacggcgggucgg

SEQ ID NO: 3011476 - RNA, 16 nt, Mycobacterium avium subsp. paratuberculosis
gucacggcugccgacc

SEQ ID NO: 3011477 - RNA, 15 nt, Mycobacterium avium subsp. paratuberculosis
gucacgggccaggcg

SEQ ID NO: 3011478 - RNA, 17 nt, Mycobacterium avium subsp. paratuberculosis
gucacgggccaggcgcg

SEQ ID NO: 3011479 - RNA, 18 nt, Mycobacterium avium subsp. paratuberculosis
gucacgggccaggcgcgc

SEQ ID NO: 3011480 - RNA, 20 nt, Mycobacterium avium subsp. paratuberculosis
gucacgggccaggcgcgcgc

SEQ ID NO: 3011481 - RNA, 19 nt, Mycobacterium avium subsp. paratuberculosis
gucacgggcugaccgccag

SEQ ID NO: 3011482 - RNA, 21 nt, Mycobacterium avium subsp. paratuberculosis
gucacgggcugaccgccagga

SEQ ID NO: 3011483 - RNA, 17 nt, Mycobacterium avium subsp. paratuberculosis
gucacgguccagguccu

SEQ ID NO: 3011484 - RNA, 14 nt, Mycobacterium avium subsp. paratuberculosis
gucacguagcgcgg

SEQ ID NO: 3011485 - RNA, 16 nt, Mycobacterium avium subsp. paratuberculosis
gucacgucauuucggu

SEQ ID NO: 3011486 - RNA, 22 nt, Mycobacterium avium subsp. paratuberculosis
gucacgucauuucggucggcag

SEQ ID NO: 3011487 - RNA, 17 nt, Mycobacterium avium subsp. paratuberculosis
gucacguccacgccgcg

SEQ ID NO: 3011488 - RNA, 19 nt, Mycobacterium avium subsp. paratuberculosis
gucacguccaucauggcgc

SEQ ID NO: 3011489 - RNA, 16 nt, Mycobacterium avium subsp. paratuberculosis
gucacgucggccugca

SEQ ID NO: 3011490 - RNA, 20 nt, Mycobacterium avium subsp. paratuberculosis
gucacgugcacccacgccag

SEQ ID NO: 3011491 - RNA, 16 nt, Mycobacterium avium subsp. paratuberculosis
gucacguucaccaccg

SEQ ID NO: 3011492 - RNA, 17 nt, Mycobacterium avium subsp. paratuberculosis
gucacguugaugaucgc

SEQ ID NO: 3011493 - RNA, 16 nt, Mycobacterium avium subsp. paratuberculosis
gucacuccucgaucug

SEQ ID NO: 3011494 - RNA, 18 nt, Mycobacterium avium subsp. paratuberculosis
gucacucgaccuucgagc

SEQ ID NO: 3011495 - RNA, 17 nt, Mycobacterium avium subsp. paratuberculosis
gucacugcacgcacggc

SEQ ID NO: 3011496 - RNA, 13 nt, Mycobacterium avium subsp. paratuberculosis
gucacugcccagc

SEQ ID NO: 3011497 - RNA, 16 nt, Mycobacterium avium subsp. paratuberculosis
gucacugucggcgcgg

SEQ ID NO: 3011498 - RNA, 15 nt, Mycobacterium avium subsp. paratuberculosis
gucagaaccggggcc

SEQ ID NO: 3011499 - RNA, 19 nt, Mycobacterium avium subsp. paratuberculosis
gucagaccccguaccagcg

SEQ ID NO: 3011500 - RNA, 24 nt, Mycobacterium avium subsp. paratuberculosis
gucagacccugugggucgacagaa

SEQ ID NO: 3011501 - RNA, 15 nt, Mycobacterium avium subsp. paratuberculosis
gucagaccgcggcgg

SEQ ID NO: 3011502 - RNA, 18 nt, Mycobacterium avium subsp. paratuberculosis
gucagaccgcggcggucg

SEQ ID NO: 3011503 - RNA, 21 nt, Mycobacterium avium subsp. paratuberculosis
gucagacgaugggccgcccgc

SEQ ID NO: 3011504 - RNA, 22 nt, Mycobacterium avium subsp. paratuberculosis
gucagacgaugggccgcccgcu

SEQ ID NO: 3011505 - RNA, 23 nt, Mycobacterium avium subsp. paratuberculosis
gucagagcccgaacacgggcggc

SEQ ID NO: 3011506 - RNA, 22 nt, Mycobacterium avium subsp. paratuberculosis
gucagaucguugaugucggugg

SEQ ID NO: 3011507 - RNA, 13 nt, Mycobacterium avium subsp. paratuberculosis
gucagcaccacca

SEQ ID NO: 3011508 - RNA, 14 nt, Mycobacterium avium subsp. paratuberculosis
gucagcaccgcgcg

SEQ ID NO: 3011509 - RNA, 15 nt, Mycobacterium avium subsp. paratuberculosis
gucagcaccgcgcgg

SEQ ID NO: 3011510 - RNA, 16 nt, Mycobacterium avium subsp. paratuberculosis
gucagcaccgcgcggc

SEQ ID NO: 3011511 - RNA, 13 nt, Mycobacterium avium subsp. paratuberculosis
gucagcaccgcgg

SEQ ID NO: 3011512 - RNA, 14 nt, Mycobacterium avium subsp. paratuberculosis
gucagcaccgcgga

SEQ ID NO: 3011513 - RNA, 18 nt, Mycobacterium avium subsp. paratuberculosis
gucagcaccgucaccgcc

SEQ ID NO: 3011514 - RNA, 18 nt, Mycobacterium avium subsp. paratuberculosis
gucagcacgcugaucacc

SEQ ID NO: 3011515 - RNA, 13 nt, Mycobacterium avium subsp. paratuberculosis
gucagcacgucgg

SEQ ID NO: 3011516 - RNA, 19 nt, Mycobacterium avium subsp. paratuberculosis
gucagcacgucggucagcg

SEQ ID NO: 3011517 - RNA, 20 nt, Mycobacterium avium subsp. paratuberculosis
gucagcacgucggucagcga

SEQ ID NO: 3011518 - RNA, 13 nt, Mycobacterium avium subsp. paratuberculosis
gucagcagcaccc

SEQ ID NO: 3011519 - RNA, 17 nt, Mycobacterium avium subsp. paratuberculosis
gucagcagcacccgguc

SEQ ID NO: 3011520 - RNA, 21 nt, Mycobacterium avium subsp. paratuberculosis
gucagcagcacccggucgccg

SEQ ID NO: 3011521 - RNA, 14 nt, Mycobacterium avium subsp. paratuberculosis
gucagcagcagcgc

SEQ ID NO: 3011522 - RNA, 21 nt, Mycobacterium avium subsp. paratuberculosis
gucagcagcgacaugaccacc

SEQ ID NO: 3011523 - RNA, 14 nt, Mycobacterium avium subsp. paratuberculosis
gucagcaggcgccg

SEQ ID NO: 3011524 - RNA, 18 nt, Mycobacterium avium subsp. paratuberculosis
gucagcagggccucgccg

SEQ ID NO: 3011525 - RNA, 17 nt, Mycobacterium avium subsp. paratuberculosis
gucagcagggugacguc

SEQ ID NO: 3011526 - RNA, 15 nt, Mycobacterium avium subsp. paratuberculosis
gucagccacgggcgg

SEQ ID NO: 3011527 - RNA, 23 nt, Mycobacterium avium subsp. paratuberculosis
gucagccacgggcggucggacgc

SEQ ID NO: 3011528 - RNA, 17 nt, Mycobacterium avium subsp. paratuberculosis
gucagccacucgccgug

SEQ ID NO: 3011529 - RNA, 19 nt, Mycobacterium avium subsp. paratuberculosis
gucagccagguguagacca

SEQ ID NO: 3011530 - RNA, 15 nt, Mycobacterium avium subsp. paratuberculosis
gucagcccccaccgc

SEQ ID NO: 3011531 - RNA, 21 nt, Mycobacterium avium subsp. paratuberculosis
gucagcccccaccgcgccgug

SEQ ID NO: 3011532 - RNA, 13 nt, Mycobacterium avium subsp. paratuberculosis
gucagccccgagu

SEQ ID NO: 3011533 - RNA, 16 nt, Mycobacterium avium subsp. paratuberculosis
gucagccgcaccaggu

SEQ ID NO: 3011534 - RNA, 21 nt, Mycobacterium avium subsp. paratuberculosis
gucagccgcccuuguugaugg

SEQ ID NO: 3011535 - RNA, 14 nt, Mycobacterium avium subsp. paratuberculosis
gucagccgcggcgg

SEQ ID NO: 3011536 - RNA, 20 nt, Mycobacterium avium subsp. paratuberculosis
gucagccgcggcucgaugga

SEQ ID NO: 3011537 - RNA, 17 nt, Mycobacterium avium subsp. paratuberculosis
gucagccggccugcuuu

SEQ ID NO: 3011538 - RNA, 13 nt, Mycobacterium avium subsp. paratuberculosis
gucagccggcucg

SEQ ID NO: 3011539 - RNA, 16 nt, Mycobacterium avium subsp. paratuberculosis
gucagccggcucggua

SEQ ID NO: 3011540 - RNA, 19 nt, Mycobacterium avium subsp. paratuberculosis
gucagccgggccagcccgg

SEQ ID NO: 3011541 - RNA, 17 nt, Mycobacterium avium subsp. paratuberculosis
gucagccgggcggccuc

SEQ ID NO: 3011542 - RNA, 18 nt, Mycobacterium avium subsp. paratuberculosis
gucagcgacaacggcccc

SEQ ID NO: 3011543 - RNA, 19 nt, Mycobacterium avium subsp. paratuberculosis
gucagcgagugguaccggg

SEQ ID NO: 3011544 - RNA, 17 nt, Mycobacterium avium subsp. paratuberculosis
gucagcgccagcaugcc

SEQ ID NO: 3011545 - RNA, 12 nt, Mycobacterium avium subsp. paratuberculosis
gucagcgccgcc

SEQ ID NO: 3011546 - RNA, 15 nt, Mycobacterium avium subsp. paratuberculosis
gucagcgccgcccgc

SEQ ID NO: 3011547 - RNA, 16 nt, Mycobacterium avium subsp. paratuberculosis
gucagcgccgcccgca

SEQ ID NO: 3011548 - RNA, 18 nt, Mycobacterium avium subsp. paratuberculosis
gucagcgccgcccgcagu

SEQ ID NO: 3011549 - RNA, 20 nt, Mycobacterium avium subsp. paratuberculosis
gucagcgcgacaucgccggc

SEQ ID NO: 3011550 - RNA, 13 nt, Mycobacterium avium subsp. paratuberculosis
gucagcgcgccgu

SEQ ID NO: 3011551 - RNA, 15 nt, Mycobacterium avium subsp. paratuberculosis
gucagcgcgccgucg

SEQ ID NO: 3011552 - RNA, 16 nt, Mycobacterium avium subsp. paratuberculosis
gucagcgcgccgucgg

SEQ ID NO: 3011553 - RNA, 16 nt, Mycobacterium avium subsp. paratuberculosis
gucagcgcggcccgcg

SEQ ID NO: 3011554 - RNA, 14 nt, Mycobacterium avium subsp. paratuberculosis
gucagcgcgggcca

SEQ ID NO: 3011555 - RNA, 17 nt, Mycobacterium avium subsp. paratuberculosis
gucagcgcgggccagca

SEQ ID NO: 3011556 - RNA, 18 nt, Mycobacterium avium subsp. paratuberculosis
gucagcgcggucagcccg

SEQ ID NO: 3011557 - RNA, 20 nt, Mycobacterium avium subsp. paratuberculosis
gucagcgcguccaggugcgc

SEQ ID NO: 3011558 - RNA, 22 nt, Mycobacterium avium subsp. paratuberculosis
gucagcgcguccaggugcgccg

SEQ ID NO: 3011559 - RNA, 14 nt, Mycobacterium avium subsp. paratuberculosis
gucagcgcgucggc

SEQ ID NO: 3011560 - RNA, 16 nt, Mycobacterium avium subsp. paratuberculosis
gucagcgcgucggcga

SEQ ID NO: 3011561 - RNA, 21 nt, Mycobacterium avium subsp. paratuberculosis
gucagcgcgucggcgaccgcg

SEQ ID NO: 3011562 - RNA, 15 nt, Mycobacterium avium subsp. paratuberculosis
gucagcggcaacacg

SEQ ID NO: 3011563 - RNA, 18 nt, Mycobacterium avium subsp. paratuberculosis
gucagcggcaacacgccg

SEQ ID NO: 3011564 - RNA, 20 nt, Mycobacterium avium subsp. paratuberculosis
gucagcggcaacacgccggc

SEQ ID NO: 3011565 - RNA, 23 nt, Mycobacterium avium subsp. paratuberculosis
gucagcggcaacacgccggcggc

SEQ ID NO: 3011566 - RNA, 21 nt, Mycobacterium avium subsp. paratuberculosis
gucagcggcaggucccaggcc

SEQ ID NO: 3011567 - RNA, 13 nt, Mycobacterium avium subsp. paratuberculosis
gucagcggcccga

SEQ ID NO: 3011568 - RNA, 14 nt, Mycobacterium avium subsp. paratuberculosis
gucagcggcccgau

SEQ ID NO: 3011569 - RNA, 23 nt, Mycobacterium avium subsp. paratuberculosis
gucagcggcccgaucaccaggcc

SEQ ID NO: 3011570 - RNA, 13 nt, Mycobacterium avium subsp. paratuberculosis
gucagcggccucg

SEQ ID NO: 3011571 - RNA, 13 nt, Mycobacterium avium subsp. paratuberculosis
gucagcggcguca

SEQ ID NO: 3011572 - RNA, 15 nt, Mycobacterium avium subsp. paratuberculosis
gucagcgucagcacg

SEQ ID NO: 3011573 - RNA, 16 nt, Mycobacterium avium subsp. paratuberculosis
gucagcgucagcacgu

SEQ ID NO: 3011574 - RNA, 19 nt, Mycobacterium avium subsp. paratuberculosis
gucagcgucgccgccccga

SEQ ID NO: 3011575 - RNA, 16 nt, Mycobacterium avium subsp. paratuberculosis
gucagcgucucgccgg

SEQ ID NO: 3011576 - RNA, 15 nt, Mycobacterium avium subsp. paratuberculosis
gucagcgucucggcg

SEQ ID NO: 3011577 - RNA, 18 nt, Mycobacterium avium subsp. paratuberculosis
gucagcgucucggcgauc

SEQ ID NO: 3011578 - RNA, 19 nt, Mycobacterium avium subsp. paratuberculosis
gucagcgucucggcgauca

SEQ ID NO: 3011579 - RNA, 16 nt, Mycobacterium avium subsp. paratuberculosis
gucagcguggcgucgg

SEQ ID NO: 3011580 - RNA, 21 nt, Mycobacterium avium subsp. paratuberculosis
gucagcguggcgucggcgcgc

SEQ ID NO: 3011581 - RNA, 19 nt, Mycobacterium avium subsp. paratuberculosis
gucagcucaggaacggccg

SEQ ID NO: 3011582 - RNA, 22 nt, Mycobacterium avium subsp. paratuberculosis
gucagcucaggaacggccggau

SEQ ID NO: 3011583 - RNA, 18 nt, Mycobacterium avium subsp. paratuberculosis
gucagcuccaccugcggc

SEQ ID NO: 3011584 - RNA, 18 nt, Mycobacterium avium subsp. paratuberculosis
gucagcucgaucgccgcg

SEQ ID NO: 3011585 - RNA, 19 nt, Mycobacterium avium subsp. paratuberculosis
gucagcucgaucgccgcgc

SEQ ID NO: 3011586 - RNA, 21 nt, Mycobacterium avium subsp. paratuberculosis
gucagcucgaucgccgcgccc

SEQ ID NO: 3011587 - RNA, 14 nt, Mycobacterium avium subsp. paratuberculosis
gucagcucgccguc

SEQ ID NO: 3011588 - RNA, 16 nt, Mycobacterium avium subsp. paratuberculosis
gucagcucgccguccg

SEQ ID NO: 3011589 - RNA, 15 nt, Mycobacterium avium subsp. paratuberculosis
gucagcucgcgcccg

SEQ ID NO: 3011590 - RNA, 20 nt, Mycobacterium avium subsp. paratuberculosis
gucagcucgcgcccggccag

SEQ ID NO: 3011591 - RNA, 22 nt, Mycobacterium avium subsp. paratuberculosis
gucagcucgggguaguucagcg

SEQ ID NO: 3011592 - RNA, 14 nt, Mycobacterium avium subsp. paratuberculosis
gucagcugccgcac

SEQ ID NO: 3011593 - RNA, 16 nt, Mycobacterium avium subsp. paratuberculosis
gucagcugccgcaccg

SEQ ID NO: 3011594 - RNA, 17 nt, Mycobacterium avium subsp. paratuberculosis
gucagcugccgcaccgc

SEQ ID NO: 3011595 - RNA, 24 nt, Mycobacterium avium subsp. paratuberculosis
gucagcuggugcagauaggugguc

SEQ ID NO: 3011596 - RNA, 22 nt, Mycobacterium avium subsp. paratuberculosis
gucagcuuggagccgagcaccg

SEQ ID NO: 3011597 - RNA, 15 nt, Mycobacterium avium subsp. paratuberculosis
gucaggaacgccggc

SEQ ID NO: 3011598 - RNA, 15 nt, Mycobacterium avium subsp. paratuberculosis
gucaggagugcucgg

SEQ ID NO: 3011599 - RNA, 20 nt, Mycobacterium avium subsp. paratuberculosis
gucaggagugcucggcguug

SEQ ID NO: 3011600 - RNA, 23 nt, Mycobacterium avium subsp. paratuberculosis
gucaggagugcucggcguugagc

SEQ ID NO: 3011601 - RNA, 19 nt, Mycobacterium avium subsp. paratuberculosis
gucaggauccaguuccagu

SEQ ID NO: 3011602 - RNA, 16 nt, Mycobacterium avium subsp. paratuberculosis
gucaggaucgccgguc

SEQ ID NO: 3011603 - RNA, 16 nt, Mycobacterium avium subsp. paratuberculosis
gucaggcacucgauca

SEQ ID NO: 3011604 - RNA, 17 nt, Mycobacterium avium subsp. paratuberculosis
gucaggcauuccaccgc

SEQ ID NO: 3011605 - RNA, 18 nt, Mycobacterium avium subsp. paratuberculosis
gucaggcauuccaccgcg

SEQ ID NO: 3011606 - RNA, 19 nt, Mycobacterium avium subsp. paratuberculosis
gucaggcauuccaccgcgc

SEQ ID NO: 3011607 - RNA, 22 nt, Mycobacterium avium subsp. paratuberculosis
gucaggcauuccaccgcgcggc

SEQ ID NO: 3011608 - RNA, 23 nt, Mycobacterium avium subsp. paratuberculosis
gucaggcauuccaccgcgcggcg

SEQ ID NO: 3011609 - RNA, 14 nt, Mycobacterium avium subsp. paratuberculosis
gucaggcccagcga

SEQ ID NO: 3011610 - RNA, 16 nt, Mycobacterium avium subsp. paratuberculosis
gucaggcccagcgagg

SEQ ID NO: 3011611 - RNA, 17 nt, Mycobacterium avium subsp. paratuberculosis
gucaggcccagcgaggc

SEQ ID NO: 3011612 - RNA, 15 nt, Mycobacterium avium subsp. paratuberculosis
gucaggccgaaugac

SEQ ID NO: 3011613 - RNA, 16 nt, Mycobacterium avium subsp. paratuberculosis
gucaggccggucagcg

SEQ ID NO: 3011614 - RNA, 19 nt, Mycobacterium avium subsp. paratuberculosis
gucaggccguagcggcucg

SEQ ID NO: 3011615 - RNA, 21 nt, Mycobacterium avium subsp. paratuberculosis
gucaggccgucucgagccggc

SEQ ID NO: 3011616 - RNA, 21 nt, Mycobacterium avium subsp. paratuberculosis
gucaggccgugaucggccagc

SEQ ID NO: 3011617 - RNA, 14 nt, Mycobacterium avium subsp. paratuberculosis
gucaggccucgagg

SEQ ID NO: 3011618 - RNA, 21 nt, Mycobacterium avium subsp. paratuberculosis
gucaggccucgaggaucgcgg

SEQ ID NO: 3011619 - RNA, 20 nt, Mycobacterium avium subsp. paratuberculosis
gucaggccugguaggccgcc

SEQ ID NO: 3011620 - RNA, 16 nt, Mycobacterium avium subsp. paratuberculosis
gucaggcgcugggugc

SEQ ID NO: 3011621 - RNA, 20 nt, Mycobacterium avium subsp. paratuberculosis
gucagggcagcggugucacc

SEQ ID NO: 3011622 - RNA, 22 nt, Mycobacterium avium subsp. paratuberculosis
gucagggccagcaacaccagcu

SEQ ID NO: 3011623 - RNA, 20 nt, Mycobacterium avium subsp. paratuberculosis
gucagggcgacuccggcgcc

SEQ ID NO: 3011624 - RNA, 22 nt, Mycobacterium avium subsp. paratuberculosis
gucagggcgcucaucaggcggc

SEQ ID NO: 3011625 - RNA, 18 nt, Mycobacterium avium subsp. paratuberculosis
gucaggggugccggaggc

SEQ ID NO: 3011626 - RNA, 22 nt, Mycobacterium avium subsp. paratuberculosis
gucaggggugccggaggcggcg

SEQ ID NO: 3011627 - RNA, 13 nt, Mycobacterium avium subsp. paratuberculosis
gucagggucagcu

SEQ ID NO: 3011628 - RNA, 21 nt, Mycobacterium avium subsp. paratuberculosis
gucagggugacguggcggccg

SEQ ID NO: 3011629 - RNA, 18 nt, Mycobacterium avium subsp. paratuberculosis
gucaggguguaggccgcg

SEQ ID NO: 3011630 - RNA, 19 nt, Mycobacterium avium subsp. paratuberculosis
gucaggguguaggccgcgu

SEQ ID NO: 3011631 - RNA, 20 nt, Mycobacterium avium subsp. paratuberculosis
gucagggugugacggauccg

SEQ ID NO: 3011632 - RNA, 16 nt, Mycobacterium avium subsp. paratuberculosis
gucagguaggcgucga

SEQ ID NO: 3011633 - RNA, 18 nt, Mycobacterium avium subsp. paratuberculosis
gucaggucaaccaggccu

SEQ ID NO: 3011634 - RNA, 13 nt, Mycobacterium avium subsp. paratuberculosis
gucaggucaccga

SEQ ID NO: 3011635 - RNA, 17 nt, Mycobacterium avium subsp. paratuberculosis
gucagguccgcgaguug

SEQ ID NO: 3011636 - RNA, 21 nt, Mycobacterium avium subsp. paratuberculosis
gucaggucgaagcccgccguc

SEQ ID NO: 3011637 - RNA, 18 nt, Mycobacterium avium subsp. paratuberculosis
gucaggucgaccggcucg

SEQ ID NO: 3011638 - RNA, 19 nt, Mycobacterium avium subsp. paratuberculosis
gucaggucgcugcgcucgc

SEQ ID NO: 3011639 - RNA, 12 nt, Mycobacterium avium subsp. paratuberculosis
gucaggucggcg

SEQ ID NO: 3011640 - RNA, 13 nt, Mycobacterium avium subsp. paratuberculosis
gucaggucggcga

SEQ ID NO: 3011641 - RNA, 17 nt, Mycobacterium avium subsp. paratuberculosis
gucagguucgccacgau

SEQ ID NO: 3011642 - RNA, 16 nt, Mycobacterium avium subsp. paratuberculosis
gucaguacagcuaggc

SEQ ID NO: 3011643 - RNA, 15 nt, Mycobacterium avium subsp. paratuberculosis
gucagucgcgccgcc

SEQ ID NO: 3011644 - RNA, 22 nt, Mycobacterium avium subsp. paratuberculosis
gucagugccccacaagcgaggu

SEQ ID NO: 3011645 - RNA, 19 nt, Mycobacterium avium subsp. paratuberculosis
gucaguucguagaucacgg

SEQ ID NO: 3011646 - RNA, 16 nt, Mycobacterium avium subsp. paratuberculosis
gucaguuggucgaugu

SEQ ID NO: 3011647 - RNA, 17 nt, Mycobacterium avium subsp. paratuberculosis
gucaguuggucgauguc

SEQ ID NO: 3011648 - RNA, 22 nt, Mycobacterium avium subsp. paratuberculosis
gucauaccagccguucucgucc

SEQ ID NO: 3011649 - RNA, 17 nt, Mycobacterium avium subsp. paratuberculosis
gucauaggccgcgcaga

SEQ ID NO: 3011650 - RNA, 20 nt, Mycobacterium avium subsp. paratuberculosis
gucauagggcucguccucga

SEQ ID NO: 3011651 - RNA, 16 nt, Mycobacterium avium subsp. paratuberculosis
gucaucagugaccgca

SEQ ID NO: 3011652 - RNA, 16 nt, Mycobacterium avium subsp. paratuberculosis
gucaucaucaccggga

SEQ ID NO: 3011653 - RNA, 12 nt, Mycobacterium avium subsp. paratuberculosis
gucaucauggug

SEQ ID NO: 3011654 - RNA, 20 nt, Mycobacterium avium subsp. paratuberculosis
gucauccccuggccgaaggu

SEQ ID NO: 3011655 - RNA, 16 nt, Mycobacterium avium subsp. paratuberculosis
gucauccgggccacca

SEQ ID NO: 3011656 - RNA, 23 nt, Mycobacterium avium subsp. paratuberculosis
gucauccgggccaccaccacggc

SEQ ID NO: 3011657 - RNA, 17 nt, Mycobacterium avium subsp. paratuberculosis
gucauccgucgcccgcg

SEQ ID NO: 3011658 - RNA, 20 nt, Mycobacterium avium subsp. paratuberculosis
gucauccgucgcccgcgugg

SEQ ID NO: 3011659 - RNA, 18 nt, Mycobacterium avium subsp. paratuberculosis
gucauccucgccgcgcca

SEQ ID NO: 3011660 - RNA, 17 nt, Mycobacterium avium subsp. paratuberculosis
gucaucgacuugccgcc

SEQ ID NO: 3011661 - RNA, 19 nt, Mycobacterium avium subsp. paratuberculosis
gucaucgacuugccgccgc

SEQ ID NO: 3011662 - RNA, 20 nt, Mycobacterium avium subsp. paratuberculosis
gucaucgacuugccgccgca

SEQ ID NO: 3011663 - RNA, 19 nt, Mycobacterium avium subsp. paratuberculosis
gucaucgagccgagcaccg

SEQ ID NO: 3011664 - RNA, 21 nt, Mycobacterium avium subsp. paratuberculosis
gucaucgagccgagcaccggc

SEQ ID NO: 3011665 - RNA, 14 nt, Mycobacterium avium subsp. paratuberculosis
gucaucgagccggu

SEQ ID NO: 3011666 - RNA, 12 nt, Mycobacterium avium subsp. paratuberculosis
gucaucgccgac

SEQ ID NO: 3011667 - RNA, 16 nt, Mycobacterium avium subsp. paratuberculosis
gucaucgccgacggug

SEQ ID NO: 3011668 - RNA, 14 nt, Mycobacterium avium subsp. paratuberculosis
gucaucgcgccgga

SEQ ID NO: 3011669 - RNA, 12 nt, Mycobacterium avium subsp. paratuberculosis
gucaucgcggcg

SEQ ID NO: 3011670 - RNA, 23 nt, Mycobacterium avium subsp. paratuberculosis
gucaucgcggcgaacaacgccac

SEQ ID NO: 3011671 - RNA, 22 nt, Mycobacterium avium subsp. paratuberculosis
gucaucgcguaguggugccgga

SEQ ID NO: 3011672 - RNA, 13 nt, Mycobacterium avium subsp. paratuberculosis
gucaucggcggaa

SEQ ID NO: 3011673 - RNA, 14 nt, Mycobacterium avium subsp. paratuberculosis
gucaucgggcccga

SEQ ID NO: 3011674 - RNA, 19 nt, Mycobacterium avium subsp. paratuberculosis
gucaucgugaucgcccacc

SEQ ID NO: 3011675 - RNA, 19 nt, Mycobacterium avium subsp. paratuberculosis
gucaucgugugggcgcccg

SEQ ID NO: 3011676 - RNA, 20 nt, Mycobacterium avium subsp. paratuberculosis
gucaucgugugggcgcccgc

SEQ ID NO: 3011677 - RNA, 20 nt, Mycobacterium avium subsp. paratuberculosis
gucaucuccgacucgaugua

SEQ ID NO: 3011678 - RNA, 22 nt, Mycobacterium avium subsp. paratuberculosis
gucaucucggugguggccaucg

SEQ ID NO: 3011679 - RNA, 18 nt, Mycobacterium avium subsp. paratuberculosis
gucaugaaggcgacgucg

SEQ ID NO: 3011680 - RNA, 20 nt, Mycobacterium avium subsp. paratuberculosis
gucaugaaggcgacgucggu

SEQ ID NO: 3011681 - RNA, 19 nt, Mycobacterium avium subsp. paratuberculosis
gucaugccgcgcucgucga

SEQ ID NO: 3011682 - RNA, 15 nt, Mycobacterium avium subsp. paratuberculosis
gucaugccgucgacg

SEQ ID NO: 3011683 - RNA, 16 nt, Mycobacterium avium subsp. paratuberculosis
gucaugccgucgacga

SEQ ID NO: 3011684 - RNA, 14 nt, Mycobacterium avium subsp. paratuberculosis
gucaugcgcgggca

SEQ ID NO: 3011685 - RNA, 17 nt, Mycobacterium avium subsp. paratuberculosis
gucauggacagccaccg

SEQ ID NO: 3011686 - RNA, 17 nt, Mycobacterium avium subsp. paratuberculosis
gucauggagaucaccgc

SEQ ID NO: 3011687 - RNA, 23 nt, Mycobacterium avium subsp. paratuberculosis
gucauggugucccauucgugguu

SEQ ID NO: 3011688 - RNA, 17 nt, Mycobacterium avium subsp. paratuberculosis
gucauguaccaggcgac

SEQ ID NO: 3011689 - RNA, 16 nt, Mycobacterium avium subsp. paratuberculosis
gucauuccgccgcgcc

SEQ ID NO: 3011690 - RNA, 13 nt, Mycobacterium avium subsp. paratuberculosis
gucauugaucucc

SEQ ID NO: 3011691 - RNA, 17 nt, Mycobacterium avium subsp. paratuberculosis
guccaaaacaucccgga

SEQ ID NO: 3011692 - RNA, 20 nt, Mycobacterium avium subsp. paratuberculosis
guccaaagacguugaccgcg

SEQ ID NO: 3011693 - RNA, 22 nt, Mycobacterium avium subsp. paratuberculosis
guccaacaggugcuuggucagc

SEQ ID NO: 3011694 - RNA, 20 nt, Mycobacterium avium subsp. paratuberculosis
guccaacgggcucagcacca

SEQ ID NO: 3011695 - RNA, 18 nt, Mycobacterium avium subsp. paratuberculosis
guccaacguggguggccc

SEQ ID NO: 3011696 - RNA, 15 nt, Mycobacterium avium subsp. paratuberculosis
guccacacguccugg

SEQ ID NO: 3011697 - RNA, 16 nt, Mycobacterium avium subsp. paratuberculosis
guccacagccggcggc

SEQ ID NO: 3011698 - RNA, 21 nt, Mycobacterium avium subsp. paratuberculosis
guccaccaccacacccgcggc

SEQ ID NO: 3011699 - RNA, 23 nt, Mycobacterium avium subsp. paratuberculosis
guccaccaccacacccgcggccg

SEQ ID NO: 3011700 - RNA, 14 nt, Mycobacterium avium subsp. paratuberculosis
guccaccagaucgc

SEQ ID NO: 3011701 - RNA, 14 nt, Mycobacterium avium subsp. paratuberculosis
guccaccagcacca

SEQ ID NO: 3011702 - RNA, 18 nt, Mycobacterium avium subsp. paratuberculosis
guccaccagcacgccguu

SEQ ID NO: 3011703 - RNA, 20 nt, Mycobacterium avium subsp. paratuberculosis
guccaccaggguggccgcca

SEQ ID NO: 3011704 - RNA, 15 nt, Mycobacterium avium subsp. paratuberculosis
guccacccccgcggu

SEQ ID NO: 3011705 - RNA, 16 nt, Mycobacterium avium subsp. paratuberculosis
guccacccccgcggug

SEQ ID NO: 3011706 - RNA, 19 nt, Mycobacterium avium subsp. paratuberculosis
guccacccccgcggugagu

SEQ ID NO: 3011707 - RNA, 14 nt, Mycobacterium avium subsp. paratuberculosis
guccaccccgccaa

SEQ ID NO: 3011708 - RNA, 16 nt, Mycobacterium avium subsp. paratuberculosis
guccacccgccccgcc

SEQ ID NO: 3011709 - RNA, 23 nt, Mycobacterium avium subsp. paratuberculosis
guccacccgccccgccgcggcca

SEQ ID NO: 3011710 - RNA, 13 nt, Mycobacterium avium subsp. paratuberculosis
guccacccgcgcc

SEQ ID NO: 3011711 - RNA, 23 nt, Mycobacterium avium subsp. paratuberculosis
guccaccgacaucgaaugcagcg

SEQ ID NO: 3011712 - RNA, 14 nt, Mycobacterium avium subsp. paratuberculosis
guccaccgacgcca

SEQ ID NO: 3011713 - RNA, 14 nt, Mycobacterium avium subsp. paratuberculosis
guccaccgccgcgc

SEQ ID NO: 3011714 - RNA, 17 nt, Mycobacterium avium subsp. paratuberculosis
guccaccgccgcgccga

SEQ ID NO: 3011715 - RNA, 20 nt, Mycobacterium avium subsp. paratuberculosis
guccaccggauggcgcccgg

SEQ ID NO: 3011716 - RNA, 13 nt, Mycobacterium avium subsp. paratuberculosis
guccaccggccga

SEQ ID NO: 3011717 - RNA, 16 nt, Mycobacterium avium subsp. paratuberculosis
guccaccggccgaugg

SEQ ID NO: 3011718 - RNA, 23 nt, Mycobacterium avium subsp. paratuberculosis
guccaccggccgauggcccaggc

SEQ ID NO: 3011719 - RNA, 24 nt, Mycobacterium avium subsp. paratuberculosis
guccaccggcggauucucgcucug

SEQ ID NO: 3011720 - RNA, 22 nt, Mycobacterium avium subsp. paratuberculosis
guccaccguugucucggcgccg

SEQ ID NO: 3011721 - RNA, 18 nt, Mycobacterium avium subsp. paratuberculosis
guccacgaccccggcggc

SEQ ID NO: 3011722 - RNA, 19 nt, Mycobacterium avium subsp. paratuberculosis
guccacgacguccucgacg

SEQ ID NO: 3011723 - RNA, 22 nt, Mycobacterium avium subsp. paratuberculosis
guccacgcaguguccgaucgcc

SEQ ID NO: 3011724 - RNA, 15 nt, Mycobacterium avium subsp. paratuberculosis
guccacgccgagggc

SEQ ID NO: 3011725 - RNA, 19 nt, Mycobacterium avium subsp. paratuberculosis
guccacgccgagggcggcg

SEQ ID NO: 3011726 - RNA, 13 nt, Mycobacterium avium subsp. paratuberculosis
guccacgccgcgg

SEQ ID NO: 3011727 - RNA, 13 nt, Mycobacterium avium subsp. paratuberculosis
guccacgccggcg

SEQ ID NO: 3011728 - RNA, 14 nt, Mycobacterium avium subsp. paratuberculosis
guccacgccggcga

SEQ ID NO: 3011729 - RNA, 12 nt, Mycobacterium avium subsp. paratuberculosis
guccacgcuggc

SEQ ID NO: 3011730 - RNA, 13 nt, Mycobacterium avium subsp. paratuberculosis
guccacgcuggcg

SEQ ID NO: 3011731 - RNA, 17 nt, Mycobacterium avium subsp. paratuberculosis
guccacgcuggcggugu

SEQ ID NO: 3011732 - RNA, 19 nt, Mycobacterium avium subsp. paratuberculosis
guccacgcuggcggugucg

SEQ ID NO: 3011733 - RNA, 17 nt, Mycobacterium avium subsp. paratuberculosis
guccacgggucgccgug

SEQ ID NO: 3011734 - RNA, 20 nt, Mycobacterium avium subsp. paratuberculosis
guccacgggucgccguggcc

SEQ ID NO: 3011735 - RNA, 16 nt, Mycobacterium avium subsp. paratuberculosis
guccacggucagcgcg

SEQ ID NO: 3011736 - RNA, 13 nt, Mycobacterium avium subsp. paratuberculosis
guccacggugucg

SEQ ID NO: 3011737 - RNA, 20 nt, Mycobacterium avium subsp. paratuberculosis
guccacguccugccaguugu

SEQ ID NO: 3011738 - RNA, 14 nt, Mycobacterium avium subsp. paratuberculosis
guccacgucgccca

SEQ ID NO: 3011739 - RNA, 16 nt, Mycobacterium avium subsp. paratuberculosis
guccacgucgcccagc

SEQ ID NO: 3011740 - RNA, 17 nt, Mycobacterium avium subsp. paratuberculosis
guccacgucgcccagcg

SEQ ID NO: 3011741 - RNA, 18 nt, Mycobacterium avium subsp. paratuberculosis
guccacgucgcccagcgu

SEQ ID NO: 3011742 - RNA, 19 nt, Mycobacterium avium subsp. paratuberculosis
guccacguugaugccgccc

SEQ ID NO: 3011743 - RNA, 20 nt, Mycobacterium avium subsp. paratuberculosis
guccacguugaugccgccca

SEQ ID NO: 3011744 - RNA, 22 nt, Mycobacterium avium subsp. paratuberculosis
guccacguugaugccgcccagc

SEQ ID NO: 3011745 - RNA, 22 nt, Mycobacterium avium subsp. paratuberculosis
guccacuccaauacggcccggc

SEQ ID NO: 3011746 - RNA, 16 nt, Mycobacterium avium subsp. paratuberculosis
guccacucgucggcgg

SEQ ID NO: 3011747 - RNA, 18 nt, Mycobacterium avium subsp. paratuberculosis
guccacucgucggcgguu

SEQ ID NO: 3011748 - RNA, 17 nt, Mycobacterium avium subsp. paratuberculosis
guccacuuccgcgcagg

SEQ ID NO: 3011749 - RNA, 16 nt, Mycobacterium avium subsp. paratuberculosis
guccagaccggccggg

SEQ ID NO: 3011750 - RNA, 20 nt, Mycobacterium avium subsp. paratuberculosis
guccagaccggccggggcgg

SEQ ID NO: 3011751 - RNA, 22 nt, Mycobacterium avium subsp. paratuberculosis
guccagaccggccggggcgggc

SEQ ID NO: 3011752 - RNA, 15 nt, Mycobacterium avium subsp. paratuberculosis
guccagaucggccag

SEQ ID NO: 3011753 - RNA, 20 nt, Mycobacterium avium subsp. paratuberculosis
guccagaucggccagcgcgg

SEQ ID NO: 3011754 - RNA, 13 nt, Mycobacterium avium subsp. paratuberculosis
guccagaucggcg

SEQ ID NO: 3011755 - RNA, 14 nt, Mycobacterium avium subsp. paratuberculosis
guccagaucggcgc

SEQ ID NO: 3011756 - RNA, 15 nt, Mycobacterium avium subsp. paratuberculosis
guccagaucggcgcg

SEQ ID NO: 3011757 - RNA, 17 nt, Mycobacterium avium subsp. paratuberculosis
guccagaucggcgcgcg

SEQ ID NO: 3011758 - RNA, 18 nt, Mycobacterium avium subsp. paratuberculosis
guccagaucggcgcgcgg

SEQ ID NO: 3011759 - RNA, 14 nt, Mycobacterium avium subsp. paratuberculosis
guccagaugccguu

SEQ ID NO: 3011760 - RNA, 16 nt, Mycobacterium avium subsp. paratuberculosis
guccagaugccguucc

SEQ ID NO: 3011761 - RNA, 15 nt, Mycobacterium avium subsp. paratuberculosis
guccagcaacgccga

SEQ ID NO: 3011762 - RNA, 15 nt, Mycobacterium avium subsp. paratuberculosis
guccagcacagcauc

SEQ ID NO: 3011763 - RNA, 17 nt, Mycobacterium avium subsp. paratuberculosis
guccagcaccgccacgu

SEQ ID NO: 3011764 - RNA, 13 nt, Mycobacterium avium subsp. paratuberculosis
guccagcaccggc

SEQ ID NO: 3011765 - RNA, 15 nt, Mycobacterium avium subsp. paratuberculosis
guccagcaccggcgc

SEQ ID NO: 3011766 - RNA, 22 nt, Mycobacterium avium subsp. paratuberculosis
guccagcaccugaccgucggcc

SEQ ID NO: 3011767 - RNA, 14 nt, Mycobacterium avium subsp. paratuberculosis
guccagcaccugcu

SEQ ID NO: 3011768 - RNA, 13 nt, Mycobacterium avium subsp. paratuberculosis
guccagcacggcg

SEQ ID NO: 3011769 - RNA, 21 nt, Mycobacterium avium subsp. paratuberculosis
guccagcacgugcccagcccg

SEQ ID NO: 3011770 - RNA, 11 nt, Mycobacterium avium subsp. paratuberculosis
guccagcagca

SEQ ID NO: 3011771 - RNA, 16 nt, Mycobacterium avium subsp. paratuberculosis
guccagcagcagcgcg

SEQ ID NO: 3011772 - RNA, 18 nt, Mycobacterium avium subsp. paratuberculosis
guccagcagcagcgcgcg

SEQ ID NO: 3011773 - RNA, 19 nt, Mycobacterium avium subsp. paratuberculosis
guccagcagcgagaaccgg

SEQ ID NO: 3011774 - RNA, 14 nt, Mycobacterium avium subsp. paratuberculosis
guccagcagcgccg

SEQ ID NO: 3011775 - RNA, 15 nt, Mycobacterium avium subsp. paratuberculosis
guccagcagcgccgg

SEQ ID NO: 3011776 - RNA, 17 nt, Mycobacterium avium subsp. paratuberculosis
guccagcagcgccggca

SEQ ID NO: 3011777 - RNA, 17 nt, Mycobacterium avium subsp. paratuberculosis
guccagcaugcccacgc

SEQ ID NO: 3011778 - RNA, 12 nt, Mycobacterium avium subsp. paratuberculosis
guccagccagcc

SEQ ID NO: 3011779 - RNA, 17 nt, Mycobacterium avium subsp. paratuberculosis
guccagccagccgcgcc

SEQ ID NO: 3011780 - RNA, 12 nt, Mycobacterium avium subsp. paratuberculosis
guccagcccgau

SEQ ID NO: 3011781 - RNA, 17 nt, Mycobacterium avium subsp. paratuberculosis
guccagcccgcgccagc

SEQ ID NO: 3011782 - RNA, 23 nt, Mycobacterium avium subsp. paratuberculosis
guccagcccgcgccagcucggcg

SEQ ID NO: 3011783 - RNA, 14 nt, Mycobacterium avium subsp. paratuberculosis
guccagccgcacga

SEQ ID NO: 3011784 - RNA, 13 nt, Mycobacterium avium subsp. paratuberculosis
guccagccgccgg

SEQ ID NO: 3011785 - RNA, 14 nt, Mycobacterium avium subsp. paratuberculosis
guccagccgccggc

SEQ ID NO: 3011786 - RNA, 15 nt, Mycobacterium avium subsp. paratuberculosis
guccagccgccggcg

SEQ ID NO: 3011787 - RNA, 17 nt, Mycobacterium avium subsp. paratuberculosis
guccagccggugcacca

SEQ ID NO: 3011788 - RNA, 15 nt, Mycobacterium avium subsp. paratuberculosis
guccagccgugcggc

SEQ ID NO: 3011789 - RNA, 21 nt, Mycobacterium avium subsp. paratuberculosis
guccagccgugcggcacgccg

SEQ ID NO: 3011790 - RNA, 19 nt, Mycobacterium avium subsp. paratuberculosis
guccagcgaaucgaccggg

SEQ ID NO: 3011791 - RNA, 12 nt, Mycobacterium avium subsp. paratuberculosis
guccagcgccga

SEQ ID NO: 3011792 - RNA, 13 nt, Mycobacterium avium subsp. paratuberculosis
guccagcgccgcc

SEQ ID NO: 3011793 - RNA, 14 nt, Mycobacterium avium subsp. paratuberculosis
guccagcgccgcca

SEQ ID NO: 3011794 - RNA, 19 nt, Mycobacterium avium subsp. paratuberculosis
guccagcgccgccacggcc

SEQ ID NO: 3011795 - RNA, 14 nt, Mycobacterium avium subsp. paratuberculosis
guccagcgcgaggu

SEQ ID NO: 3011796 - RNA, 17 nt, Mycobacterium avium subsp. paratuberculosis
guccagcgcgagguccu

SEQ ID NO: 3011797 - RNA, 20 nt, Mycobacterium avium subsp. paratuberculosis
guccagcgcggugagcagca

SEQ ID NO: 3011798 - RNA, 13 nt, Mycobacterium avium subsp. paratuberculosis
guccagcgcgucg

SEQ ID NO: 3011799 - RNA, 14 nt, Mycobacterium avium subsp. paratuberculosis
guccagcgcgucgc

SEQ ID NO: 3011800 - RNA, 13 nt, Mycobacterium avium subsp. paratuberculosis
guccagcggcucg

SEQ ID NO: 3011801 - RNA, 17 nt, Mycobacterium avium subsp. paratuberculosis
guccagcggcucggugu

SEQ ID NO: 3011802 - RNA, 16 nt, Mycobacterium avium subsp. paratuberculosis
guccagcggguugccg

SEQ ID NO: 3011803 - RNA, 22 nt, Mycobacterium avium subsp. paratuberculosis
guccagcggguugccgcuggcg

SEQ ID NO: 3011804 - RNA, 17 nt, Mycobacterium avium subsp. paratuberculosis
guccagcguccgggcgu

SEQ ID NO: 3011805 - RNA, 18 nt, Mycobacterium avium subsp. paratuberculosis
guccagcguccgggcgua

SEQ ID NO: 3011806 - RNA, 21 nt, Mycobacterium avium subsp. paratuberculosis
guccagcgucgacugcaccga

SEQ ID NO: 3011807 - RNA, 19 nt, Mycobacterium avium subsp. paratuberculosis
guccagcgucgcggccggg

SEQ ID NO: 3011808 - RNA, 19 nt, Mycobacterium avium subsp. paratuberculosis
guccagcgucuggcagccg

SEQ ID NO: 3011809 - RNA, 20 nt, Mycobacterium avium subsp. paratuberculosis
guccagcgucuggcagccgg

SEQ ID NO: 3011810 - RNA, 22 nt, Mycobacterium avium subsp. paratuberculosis
guccagcgucuggcagccggcc

SEQ ID NO: 3011811 - RNA, 12 nt, Mycobacterium avium subsp. paratuberculosis
guccagcgugcc

SEQ ID NO: 3011812 - RNA, 14 nt, Mycobacterium avium subsp. paratuberculosis
guccagcgugccgc

SEQ ID NO: 3011813 - RNA, 20 nt, Mycobacterium avium subsp. paratuberculosis
guccagcgugccgcgcacca

SEQ ID NO: 3011814 - RNA, 23 nt, Mycobacterium avium subsp. paratuberculosis
guccagcgugugcgugguggggc

SEQ ID NO: 3011815 - RNA, 15 nt, Mycobacterium avium subsp. paratuberculosis
guccagcucagcgcg

SEQ ID NO: 3011816 - RNA, 16 nt, Mycobacterium avium subsp. paratuberculosis
guccagcucagcgcgc

SEQ ID NO: 3011817 - RNA, 17 nt, Mycobacterium avium subsp. paratuberculosis
guccagcucagcgcgca

SEQ ID NO: 3011818 - RNA, 18 nt, Mycobacterium avium subsp. paratuberculosis
guccagcucccaggacgc

SEQ ID NO: 3011819 - RNA, 16 nt, Mycobacterium avium subsp. paratuberculosis
guccagcuccgccgac

SEQ ID NO: 3011820 - RNA, 19 nt, Mycobacterium avium subsp. paratuberculosis
guccagcuccgccgacacc

SEQ ID NO: 3011821 - RNA, 20 nt, Mycobacterium avium subsp. paratuberculosis
guccagcucgcgaagcgcga

SEQ ID NO: 3011822 - RNA, 21 nt, Mycobacterium avium subsp. paratuberculosis
guccagcucgcgaagcgcgau

SEQ ID NO: 3011823 - RNA, 18 nt, Mycobacterium avium subsp. paratuberculosis
guccagcucucgagcaca

SEQ ID NO: 3011824 - RNA, 16 nt, Mycobacterium avium subsp. paratuberculosis
guccagcugcgcgccg

SEQ ID NO: 3011825 - RNA, 20 nt, Mycobacterium avium subsp. paratuberculosis
guccagcugcgcgccggcgg

SEQ ID NO: 3011826 - RNA, 22 nt, Mycobacterium avium subsp. paratuberculosis
guccagcugcgcgccggcggcc

SEQ ID NO: 3011827 - RNA, 19 nt, Mycobacterium avium subsp. paratuberculosis
guccaggaucacgcggcgg

SEQ ID NO: 3011828 - RNA, 20 nt, Mycobacterium avium subsp. paratuberculosis
guccaggaucacgcggcggg

SEQ ID NO: 3011829 - RNA, 20 nt, Mycobacterium avium subsp. paratuberculosis
guccaggauccccguccagc

SEQ ID NO: 3011830 - RNA, 21 nt, Mycobacterium avium subsp. paratuberculosis
guccaggauccgcaccgggca

SEQ ID NO: 3011831 - RNA, 18 nt, Mycobacterium avium subsp. paratuberculosis
guccaggaucugcagcac

SEQ ID NO: 3011832 - RNA, 19 nt, Mycobacterium avium subsp. paratuberculosis
guccaggaucugcagcacg

SEQ ID NO: 3011833 - RNA, 14 nt, Mycobacterium avium subsp. paratuberculosis
guccaggaugggga

SEQ ID NO: 3011834 - RNA, 15 nt, Mycobacterium avium subsp. paratuberculosis
guccaggccgccgug

SEQ ID NO: 3011835 - RNA, 14 nt, Mycobacterium avium subsp. paratuberculosis
guccaggccgcgcc

SEQ ID NO: 3011836 - RNA, 15 nt, Mycobacterium avium subsp. paratuberculosis
guccaggccggcgcc

SEQ ID NO: 3011837 - RNA, 16 nt, Mycobacterium avium subsp. paratuberculosis
guccaggccggcgccg

SEQ ID NO: 3011838 - RNA, 17 nt, Mycobacterium avium subsp. paratuberculosis
guccaggccggcgccgc

SEQ ID NO: 3011839 - RNA, 15 nt, Mycobacterium avium subsp. paratuberculosis
guccaggccgucgag

SEQ ID NO: 3011840 - RNA, 17 nt, Mycobacterium avium subsp. paratuberculosis
guccaggccgucgaggc

SEQ ID NO: 3011841 - RNA, 23 nt, Mycobacterium avium subsp. paratuberculosis
guccaggccgucgaggcgcugca

SEQ ID NO: 3011842 - RNA, 15 nt, Mycobacterium avium subsp. paratuberculosis
guccaggcgaccggc

SEQ ID NO: 3011843 - RNA, 16 nt, Mycobacterium avium subsp. paratuberculosis
guccaggcgaccggcc

SEQ ID NO: 3011844 - RNA, 17 nt, Mycobacterium avium subsp. paratuberculosis
guccaggcgaccggccc

SEQ ID NO: 3011845 - RNA, 17 nt, Mycobacterium avium subsp. paratuberculosis
guccaggcgcaccgcca

SEQ ID NO: 3011846 - RNA, 19 nt, Mycobacterium avium subsp. paratuberculosis
guccaggcgcaccgccacc

SEQ ID NO: 3011847 - RNA, 14 nt, Mycobacterium avium subsp. paratuberculosis
guccaggcgccggg

SEQ ID NO: 3011848 - RNA, 17 nt, Mycobacterium avium subsp. paratuberculosis
guccaggcguucgaccc

SEQ ID NO: 3011849 - RNA, 13 nt, Mycobacterium avium subsp. paratuberculosis
guccagggccacc

SEQ ID NO: 3011850 - RNA, 14 nt, Mycobacterium avium subsp. paratuberculosis
guccagggccaccg

SEQ ID NO: 3011851 - RNA, 19 nt, Mycobacterium avium subsp. paratuberculosis
guccagggccaccgcgucg

SEQ ID NO: 3011852 - RNA, 15 nt, Mycobacterium avium subsp. paratuberculosis
guccagggcgggucg

SEQ ID NO: 3011853 - RNA, 17 nt, Mycobacterium avium subsp. paratuberculosis
guccagggugccgaugu

SEQ ID NO: 3011854 - RNA, 16 nt, Mycobacterium avium subsp. paratuberculosis
guccaggguggccagc

SEQ ID NO: 3011855 - RNA, 15 nt, Mycobacterium avium subsp. paratuberculosis
guccagggugguggu

SEQ ID NO: 3011856 - RNA, 20 nt, Mycobacterium avium subsp. paratuberculosis
guccaggguggugguggugc

SEQ ID NO: 3011857 - RNA, 14 nt, Mycobacterium avium subsp. paratuberculosis
guccagggugucgu

SEQ ID NO: 3011858 - RNA, 15 nt, Mycobacterium avium subsp. paratuberculosis
guccagggugucguc

SEQ ID NO: 3011859 - RNA, 22 nt, Mycobacterium avium subsp. paratuberculosis
guccagguagcccaugucgccg

SEQ ID NO: 3011860 - RNA, 20 nt, Mycobacterium avium subsp. paratuberculosis
guccagguccuugaggaugc

SEQ ID NO: 3011861 - RNA, 22 nt, Mycobacterium avium subsp. paratuberculosis
guccaggucgaucucggccagc

SEQ ID NO: 3011862 - RNA, 22 nt, Mycobacterium avium subsp. paratuberculosis
guccaggugcacccgcggcgcg

SEQ ID NO: 3011863 - RNA, 17 nt, Mycobacterium avium subsp. paratuberculosis
guccaggugcgccgccg

SEQ ID NO: 3011864 - RNA, 20 nt, Mycobacterium avium subsp. paratuberculosis
guccaggugcgccgccgcgu

SEQ ID NO: 3011865 - RNA, 23 nt, Mycobacterium avium subsp. paratuberculosis
guccaggugcgccgccgcgucgc

SEQ ID NO: 3011866 - RNA, 18 nt, Mycobacterium avium subsp. paratuberculosis
guccaggugggguggugg

SEQ ID NO: 3011867 - RNA, 16 nt, Mycobacterium avium subsp. paratuberculosis
guccaguacaccgcga

SEQ ID NO: 3011868 - RNA, 17 nt, Mycobacterium avium subsp. paratuberculosis
guccaguccggccguga

SEQ ID NO: 3011869 - RNA, 18 nt, Mycobacterium avium subsp. paratuberculosis
guccaguccggccgugau

SEQ ID NO: 3011870 - RNA, 16 nt, Mycobacterium avium subsp. paratuberculosis
guccaguccggcgugc

SEQ ID NO: 3011871 - RNA, 22 nt, Mycobacterium avium subsp. paratuberculosis
guccagucgaugucgguggcgc

SEQ ID NO: 3011872 - RNA, 14 nt, Mycobacterium avium subsp. paratuberculosis
guccagucgcgccg

SEQ ID NO: 3011873 - RNA, 16 nt, Mycobacterium avium subsp. paratuberculosis
guccagucggccguga

SEQ ID NO: 3011874 - RNA, 17 nt, Mycobacterium avium subsp. paratuberculosis
guccagucggccgugaa

SEQ ID NO: 3011875 - RNA, 16 nt, Mycobacterium avium subsp. paratuberculosis
guccagugacgccugc

SEQ ID NO: 3011876 - RNA, 20 nt, Mycobacterium avium subsp. paratuberculosis
guccagugacgccugcggcc

SEQ ID NO: 3011877 - RNA, 17 nt, Mycobacterium avium subsp. paratuberculosis
guccagugcaugccggc

SEQ ID NO: 3011878 - RNA, 18 nt, Mycobacterium avium subsp. paratuberculosis
guccagugccggcgagug

SEQ ID NO: 3011879 - RNA, 19 nt, Mycobacterium avium subsp. paratuberculosis
guccagugccggcgagugc

SEQ ID NO: 3011880 - RNA, 14 nt, Mycobacterium avium subsp. paratuberculosis
guccaguucggcca

SEQ ID NO: 3011881 - RNA, 15 nt, Mycobacterium avium subsp. paratuberculosis
guccaguucggccag

SEQ ID NO: 3011882 - RNA, 16 nt, Mycobacterium avium subsp. paratuberculosis
guccaguucggccagc

SEQ ID NO: 3011883 - RNA, 16 nt, Mycobacterium avium subsp. paratuberculosis
guccaguugcggcacg

SEQ ID NO: 3011884 - RNA, 21 nt, Mycobacterium avium subsp. paratuberculosis
guccaguugcggcacgccgac

SEQ ID NO: 3011885 - RNA, 13 nt, Mycobacterium avium subsp. paratuberculosis
guccaucagcagc

SEQ ID NO: 3011886 - RNA, 17 nt, Mycobacterium avium subsp. paratuberculosis
guccaucauggcgcugc

SEQ ID NO: 3011887 - RNA, 19 nt, Mycobacterium avium subsp. paratuberculosis
guccauccagcgccgcagc

SEQ ID NO: 3011888 - RNA, 18 nt, Mycobacterium avium subsp. paratuberculosis
guccaucgccgcgcaccc

SEQ ID NO: 3011889 - RNA, 16 nt, Mycobacterium avium subsp. paratuberculosis
guccaucgggaccgcg

SEQ ID NO: 3011890 - RNA, 18 nt, Mycobacterium avium subsp. paratuberculosis
guccaucgggaccgcggg

SEQ ID NO: 3011891 - RNA, 21 nt, Mycobacterium avium subsp. paratuberculosis
guccaucgggaccgcgggcgc

SEQ ID NO: 3011892 - RNA, 18 nt, Mycobacterium avium subsp. paratuberculosis
guccaucguccucgcgcc

SEQ ID NO: 3011893 - RNA, 15 nt, Mycobacterium avium subsp. paratuberculosis
guccaucuccagcuc

SEQ ID NO: 3011894 - RNA, 23 nt, Mycobacterium avium subsp. paratuberculosis
guccaucuccagcuccgcggcca

SEQ ID NO: 3011895 - RNA, 17 nt, Mycobacterium avium subsp. paratuberculosis
guccaugcccgcccacg

SEQ ID NO: 3011896 - RNA, 19 nt, Mycobacterium avium subsp. paratuberculosis
guccauguaguucagcagc

SEQ ID NO: 3011897 - RNA, 14 nt, Mycobacterium avium subsp. paratuberculosis
guccaugugccgca

SEQ ID NO: 3011898 - RNA, 22 nt, Mycobacterium avium subsp. paratuberculosis
guccaugugccgcaucugguau

SEQ ID NO: 3011899 - RNA, 14 nt, Mycobacterium avium subsp. paratuberculosis
gucccacaccacca

SEQ ID NO: 3011900 - RNA, 23 nt, Mycobacterium avium subsp. paratuberculosis
gucccacacgggugugacauccc

SEQ ID NO: 3011901 - RNA, 17 nt, Mycobacterium avium subsp. paratuberculosis
gucccacagcggggucg

SEQ ID NO: 3011902 - RNA, 16 nt, Mycobacterium avium subsp. paratuberculosis
gucccaccggcgaugu

SEQ ID NO: 3011903 - RNA, 17 nt, Mycobacterium avium subsp. paratuberculosis
gucccaccggcgaugug

SEQ ID NO: 3011904 - RNA, 15 nt, Mycobacterium avium subsp. paratuberculosis
gucccacucgggaaa

SEQ ID NO: 3011905 - RNA, 13 nt, Mycobacterium avium subsp. paratuberculosis
gucccacugcccg

SEQ ID NO: 3011906 - RNA, 20 nt, Mycobacterium avium subsp. paratuberculosis
gucccagaucguagggcucg

SEQ ID NO: 3011907 - RNA, 18 nt, Mycobacterium avium subsp. paratuberculosis
gucccagaugcgcgacgg

SEQ ID NO: 3011908 - RNA, 19 nt, Mycobacterium avium subsp. paratuberculosis
gucccagaugcgcgacggc

SEQ ID NO: 3011909 - RNA, 20 nt, Mycobacterium avium subsp. paratuberculosis
gucccagaugcgcgacggcc

SEQ ID NO: 3011910 - RNA, 23 nt, Mycobacterium avium subsp. paratuberculosis
gucccagaugcgcgacggccucg

SEQ ID NO: 3011911 - RNA, 16 nt, Mycobacterium avium subsp. paratuberculosis
gucccagcacaacgcc

SEQ ID NO: 3011912 - RNA, 16 nt, Mycobacterium avium subsp. paratuberculosis
gucccagcacagccgu

SEQ ID NO: 3011913 - RNA, 16 nt, Mycobacterium avium subsp. paratuberculosis
gucccagccggacagc

SEQ ID NO: 3011914 - RNA, 18 nt, Mycobacterium avium subsp. paratuberculosis
gucccagccggacagcgg

SEQ ID NO: 3011915 - RNA, 14 nt, Mycobacterium avium subsp. paratuberculosis
gucccaggacauca

SEQ ID NO: 3011916 - RNA, 12 nt, Mycobacterium avium subsp. paratuberculosis
gucccaggccag

SEQ ID NO: 3011917 - RNA, 14 nt, Mycobacterium avium subsp. paratuberculosis
gucccaggccagga

SEQ ID NO: 3011918 - RNA, 15 nt, Mycobacterium avium subsp. paratuberculosis
gucccaggccaggau

SEQ ID NO: 3011919 - RNA, 14 nt, Mycobacterium avium subsp. paratuberculosis
gucccaggcguggu

SEQ ID NO: 3011920 - RNA, 16 nt, Mycobacterium avium subsp. paratuberculosis
gucccaggcguggucg

SEQ ID NO: 3011921 - RNA, 20 nt, Mycobacterium avium subsp. paratuberculosis
gucccaggcguggucggcgc

SEQ ID NO: 3011922 - RNA, 21 nt, Mycobacterium avium subsp. paratuberculosis
gucccaggcguggucggcgcg

SEQ ID NO: 3011923 - RNA, 15 nt, Mycobacterium avium subsp. paratuberculosis
gucccaggguugccg

SEQ ID NO: 3011924 - RNA, 18 nt, Mycobacterium avium subsp. paratuberculosis
gucccaggugggcgcgca

SEQ ID NO: 3011925 - RNA, 21 nt, Mycobacterium avium subsp. paratuberculosis
gucccaggugggcgcgcagca

SEQ ID NO: 3011926 - RNA, 18 nt, Mycobacterium avium subsp. paratuberculosis
gucccagugcgugaccug

SEQ ID NO: 3011927 - RNA, 21 nt, Mycobacterium avium subsp. paratuberculosis
gucccaguuguuuccccagcc

SEQ ID NO: 3011928 - RNA, 19 nt, Mycobacterium avium subsp. paratuberculosis
gucccaucgcugccacgua

SEQ ID NO: 3011929 - RNA, 15 nt, Mycobacterium avium subsp. paratuberculosis
guccccaccaccgac

SEQ ID NO: 3011930 - RNA, 16 nt, Mycobacterium avium subsp. paratuberculosis
guccccaccaccgaca

SEQ ID NO: 3011931 - RNA, 17 nt, Mycobacterium avium subsp. paratuberculosis
gucccccgagcgggccu

SEQ ID NO: 3011932 - RNA, 20 nt, Mycobacterium avium subsp. paratuberculosis
gucccccgagcgggccuuca

SEQ ID NO: 3011933 - RNA, 12 nt, Mycobacterium avium subsp. paratuberculosis
gucccccgccga

SEQ ID NO: 3011934 - RNA, 23 nt, Mycobacterium avium subsp. paratuberculosis
guccccgaccaucauggccuccc

SEQ ID NO: 3011935 - RNA, 20 nt, Mycobacterium avium subsp. paratuberculosis
guccccgccgccgugcaucc

SEQ ID NO: 3011936 - RNA, 19 nt, Mycobacterium avium subsp. paratuberculosis
guccccgccuucgaugccc

SEQ ID NO: 3011937 - RNA, 23 nt, Mycobacterium avium subsp. paratuberculosis
guccccgccuucgaugcccucca

SEQ ID NO: 3011938 - RNA, 16 nt, Mycobacterium avium subsp. paratuberculosis
guccccgcgcccgccg

SEQ ID NO: 3011939 - RNA, 17 nt, Mycobacterium avium subsp. paratuberculosis
guccccgcgcccgccgc

SEQ ID NO: 3011940 - RNA, 19 nt, Mycobacterium avium subsp. paratuberculosis
guccccgcgcccgccgcgu

SEQ ID NO: 3011941 - RNA, 16 nt, Mycobacterium avium subsp. paratuberculosis
guccccgcgccgggca

SEQ ID NO: 3011942 - RNA, 13 nt, Mycobacterium avium subsp. paratuberculosis
guccccggagagc

SEQ ID NO: 3011943 - RNA, 12 nt, Mycobacterium avium subsp. paratuberculosis
guccccggaguc

SEQ ID NO: 3011944 - RNA, 17 nt, Mycobacterium avium subsp. paratuberculosis
guccccggagucgucga

SEQ ID NO: 3011945 - RNA, 12 nt, Mycobacterium avium subsp. paratuberculosis
guccccggcgac

SEQ ID NO: 3011946 - RNA, 12 nt, Mycobacterium avium subsp. paratuberculosis
guccccggcggu

SEQ ID NO: 3011947 - RNA, 18 nt, Mycobacterium avium subsp. paratuberculosis
guccccgggcaccccggu

SEQ ID NO: 3011948 - RNA, 22 nt, Mycobacterium avium subsp. paratuberculosis
guccccgggcccagcaccacca

SEQ ID NO: 3011949 - RNA, 12 nt, Mycobacterium avium subsp. paratuberculosis
guccccgggugg

SEQ ID NO: 3011950 - RNA, 16 nt, Mycobacterium avium subsp. paratuberculosis
guccccgguucaccag

SEQ ID NO: 3011951 - RNA, 14 nt, Mycobacterium avium subsp. paratuberculosis
gucccgacgcggcg

SEQ ID NO: 3011952 - RNA, 16 nt, Mycobacterium avium subsp. paratuberculosis
gucccgacgcggcgcg

SEQ ID NO: 3011953 - RNA, 17 nt, Mycobacterium avium subsp. paratuberculosis
gucccgacgcggcgcga

SEQ ID NO: 3011954 - RNA, 13 nt, Mycobacterium avium subsp. paratuberculosis
gucccgcaugucc

SEQ ID NO: 3011955 - RNA, 18 nt, Mycobacterium avium subsp. paratuberculosis
gucccgcccggcgccggc

SEQ ID NO: 3011956 - RNA, 19 nt, Mycobacterium avium subsp. paratuberculosis
gucccgcccggcgccggcc

SEQ ID NO: 3011957 - RNA, 12 nt, Mycobacterium avium subsp. paratuberculosis
gucccgccggug

SEQ ID NO: 3011958 - RNA, 21 nt, Mycobacterium avium subsp. paratuberculosis
gucccgcgccacguaucgcgc

SEQ ID NO: 3011959 - RNA, 13 nt, Mycobacterium avium subsp. paratuberculosis
gucccgcgccgga

SEQ ID NO: 3011960 - RNA, 18 nt, Mycobacterium avium subsp. paratuberculosis
gucccgcgccuggcgcag

SEQ ID NO: 3011961 - RNA, 14 nt, Mycobacterium avium subsp. paratuberculosis
gucccgcgcggcgc

SEQ ID NO: 3011962 - RNA, 15 nt, Mycobacterium avium subsp. paratuberculosis
gucccgcgcgggggc

SEQ ID NO: 3011963 - RNA, 21 nt, Mycobacterium avium subsp. paratuberculosis
gucccgcgcgggggccgccgc

SEQ ID NO: 3011964 - RNA, 22 nt, Mycobacterium avium subsp. paratuberculosis
gucccgcgcgggggccgccgcg

SEQ ID NO: 3011965 - RNA, 23 nt, Mycobacterium avium subsp. paratuberculosis
gucccgcgcgggggccgccgcga

SEQ ID NO: 3011966 - RNA, 14 nt, Mycobacterium avium subsp. paratuberculosis
gucccgcggcggcg

SEQ ID NO: 3011967 - RNA, 15 nt, Mycobacterium avium subsp. paratuberculosis
gucccgcggcggcgc

SEQ ID NO: 3011968 - RNA, 17 nt, Mycobacterium avium subsp. paratuberculosis
gucccgcguggccgcca

SEQ ID NO: 3011969 - RNA, 19 nt, Mycobacterium avium subsp. paratuberculosis
gucccggaagugccggcga

SEQ ID NO: 3011970 - RNA, 20 nt, Mycobacterium avium subsp. paratuberculosis
gucccggaagugccggcgaa

SEQ ID NO: 3011971 - RNA, 19 nt, Mycobacterium avium subsp. paratuberculosis
gucccggauggagcgcgac

SEQ ID NO: 3011972 - RNA, 23 nt, Mycobacterium avium subsp. paratuberculosis
gucccggauggagcgcgacgggc

SEQ ID NO: 3011973 - RNA, 21 nt, Mycobacterium avium subsp. paratuberculosis
gucccggcaacaccggcggcg

SEQ ID NO: 3011974 - RNA, 13 nt, Mycobacterium avium subsp. paratuberculosis
gucccggccgcga

SEQ ID NO: 3011975 - RNA, 14 nt, Mycobacterium avium subsp. paratuberculosis
gucccggcgcacca

SEQ ID NO: 3011976 - RNA, 19 nt, Mycobacterium avium subsp. paratuberculosis
gucccggcgcaccaggcgc

SEQ ID NO: 3011977 - RNA, 20 nt, Mycobacterium avium subsp. paratuberculosis
gucccggcgcaccaggcgcc

SEQ ID NO: 3011978 - RNA, 13 nt, Mycobacterium avium subsp. paratuberculosis
gucccggcgcccu

SEQ ID NO: 3011979 - RNA, 16 nt, Mycobacterium avium subsp. paratuberculosis
gucccggcggacccgg

SEQ ID NO: 3011980 - RNA, 14 nt, Mycobacterium avium subsp. paratuberculosis
gucccggcgggggc

SEQ ID NO: 3011981 - RNA, 20 nt, Mycobacterium avium subsp. paratuberculosis
gucccggcgggggcggcggg

SEQ ID NO: 3011982 - RNA, 23 nt, Mycobacterium avium subsp. paratuberculosis
gucccgggccuuggccaacgcgu

SEQ ID NO: 3011983 - RNA, 22 nt, Mycobacterium avium subsp. paratuberculosis
gucccgggcgaacgucgggucg

SEQ ID NO: 3011984 - RNA, 16 nt, Mycobacterium avium subsp. paratuberculosis
gucccggggcucgaca

SEQ ID NO: 3011985 - RNA, 22 nt, Mycobacterium avium subsp. paratuberculosis
gucccggggcucgacaggcagc

SEQ ID NO: 3011986 - RNA, 23 nt, Mycobacterium avium subsp. paratuberculosis
gucccggggcucgacaggcagcc

SEQ ID NO: 3011987 - RNA, 18 nt, Mycobacterium avium subsp. paratuberculosis
gucccggguaccucugcg

SEQ ID NO: 3011988 - RNA, 18 nt, Mycobacterium avium subsp. paratuberculosis
gucccgguacaggucgcu

SEQ ID NO: 3011989 - RNA, 21 nt, Mycobacterium avium subsp. paratuberculosis
gucccgguacaggucgcugcc

SEQ ID NO: 3011990 - RNA, 22 nt, Mycobacterium avium subsp. paratuberculosis
gucccggucagguugacgccga

SEQ ID NO: 3011991 - RNA, 14 nt, Mycobacterium avium subsp. paratuberculosis
gucccggucgaaca

SEQ ID NO: 3011992 - RNA, 19 nt, Mycobacterium avium subsp. paratuberculosis
gucccggugucgccgucgc

SEQ ID NO: 3011993 - RNA, 18 nt, Mycobacterium avium subsp. paratuberculosis
gucccgguugaccccggc

SEQ ID NO: 3011994 - RNA, 20 nt, Mycobacterium avium subsp. paratuberculosis
gucccgguugaccccggccc

SEQ ID NO: 3011995 - RNA, 19 nt, Mycobacterium avium subsp. paratuberculosis
gucccgucacggcugccga

SEQ ID NO: 3011996 - RNA, 16 nt, Mycobacterium avium subsp. paratuberculosis
gucccguccaucgccg

SEQ ID NO: 3011997 - RNA, 18 nt, Mycobacterium avium subsp. paratuberculosis
gucccguccaucgccgcg

SEQ ID NO: 3011998 - RNA, 19 nt, Mycobacterium avium subsp. paratuberculosis
gucccguccaucgccgcgc

SEQ ID NO: 3011999 - RNA, 18 nt, Mycobacterium avium subsp. paratuberculosis
gucccguccgacggcuac

SEQ ID NO: 3012000 - RNA, 17 nt, Mycobacterium avium subsp. paratuberculosis
gucccguccugggccug

SEQ ID NO: 3012001 - RNA, 22 nt, Mycobacterium avium subsp. paratuberculosis
guccgcgaacucgucgacgccc

SEQ ID NO: 3012002 - RNA, 13 nt, Mycobacterium avium subsp. paratuberculosis
guccgcgacgcug

SEQ ID NO: 3012003 - RNA, 15 nt, Mycobacterium avium subsp. paratuberculosis
guccgcgaggaaucg

SEQ ID NO: 3012004 - RNA, 17 nt, Mycobacterium avium subsp. paratuberculosis
guccgcgaggaaucgcg

SEQ ID NO: 3012005 - RNA, 20 nt, Mycobacterium avium subsp. paratuberculosis
guccgcgaggaaucgcggca

SEQ ID NO: 3012006 - RNA, 12 nt, Mycobacterium avium subsp. paratuberculosis
guccgcgaucgu

SEQ ID NO: 3012007 - RNA, 12 nt, Mycobacterium avium subsp. paratuberculosis
guccgcgccggc

SEQ ID NO: 3012008 - RNA, 12 nt, Mycobacterium avium subsp. paratuberculosis
guccgcgccggu

SEQ ID NO: 3012009 - RNA, 13 nt, Mycobacterium avium subsp. paratuberculosis
guccgcgccgguc

SEQ ID NO: 3012010 - RNA, 17 nt, Mycobacterium avium subsp. paratuberculosis
guccgcgccggucccgc

SEQ ID NO: 3012011 - RNA, 22 nt, Mycobacterium avium subsp. paratuberculosis
guccgcgccggucccgcggcgg

SEQ ID NO: 3012012 - RNA, 20 nt, Mycobacterium avium subsp. paratuberculosis
guccgcgcgaccaucagccc

SEQ ID NO: 3012013 - RNA, 22 nt, Mycobacterium avium subsp. paratuberculosis
guccgcgcgaccaucagcccgg

SEQ ID NO: 3012014 - RNA, 20 nt, Mycobacterium avium subsp. paratuberculosis
guccgcgcgagaguaucgcc

SEQ ID NO: 3012015 - RNA, 14 nt, Mycobacterium avium subsp. paratuberculosis
guccgcgcguagug

SEQ ID NO: 3012016 - RNA, 17 nt, Mycobacterium avium subsp. paratuberculosis
guccgcggaggcgagca

SEQ ID NO: 3012017 - RNA, 20 nt, Mycobacterium avium subsp. paratuberculosis
guccgcggaggcgagcagcc

SEQ ID NO: 3012018 - RNA, 15 nt, Mycobacterium avium subsp. paratuberculosis
guccgcggccgcggc

SEQ ID NO: 3012019 - RNA, 13 nt, Mycobacterium avium subsp. paratuberculosis
guccgcggcggcc

SEQ ID NO: 3012020 - RNA, 14 nt, Mycobacterium avium subsp. paratuberculosis
guccgcggcggcgu

SEQ ID NO: 3012021 - RNA, 22 nt, Mycobacterium avium subsp. paratuberculosis
guccgcggcggcgugccgcccg

SEQ ID NO: 3012022 - RNA, 16 nt, Mycobacterium avium subsp. paratuberculosis
guccgcgggcggggcc

SEQ ID NO: 3012023 - RNA, 22 nt, Mycobacterium avium subsp. paratuberculosis
guccgcggugagcaccggaucg

SEQ ID NO: 3012024 - RNA, 23 nt, Mycobacterium avium subsp. paratuberculosis
guccgcggugagcaccggaucga

SEQ ID NO: 3012025 - RNA, 20 nt, Mycobacterium avium subsp. paratuberculosis
guccgcgguuuggucagcgc

SEQ ID NO: 3012026 - RNA, 22 nt, Mycobacterium avium subsp. paratuberculosis
guccgcgguuuggucagcgccc

SEQ ID NO: 3012027 - RNA, 13 nt, Mycobacterium avium subsp. paratuberculosis
guccgcgucggcg

SEQ ID NO: 3012028 - RNA, 18 nt, Mycobacterium avium subsp. paratuberculosis
guccgcgucggcgccggc

SEQ ID NO: 3012029 - RNA, 15 nt, Mycobacterium avium subsp. paratuberculosis
guccgcgugaaugcc

SEQ ID NO: 3012030 - RNA, 20 nt, Mycobacterium avium subsp. paratuberculosis
guccgcgugacaagccggcg

SEQ ID NO: 3012031 - RNA, 22 nt, Mycobacterium avium subsp. paratuberculosis
guccgcucaucgucguuggcgc

SEQ ID NO: 3012032 - RNA, 13 nt, Mycobacterium avium subsp. paratuberculosis
guccgcuccacca

SEQ ID NO: 3012033 - RNA, 18 nt, Mycobacterium avium subsp. paratuberculosis
guccgcuccaccagcgcg

SEQ ID NO: 3012034 - RNA, 17 nt, Mycobacterium avium subsp. paratuberculosis
guccgcugugcggcccg

SEQ ID NO: 3012035 - RNA, 19 nt, Mycobacterium avium subsp. paratuberculosis
guccgcugugcggcccggc

SEQ ID NO: 3012036 - RNA, 13 nt, Mycobacterium avium subsp. paratuberculosis
guccggaaccgcg

SEQ ID NO: 3012037 - RNA, 22 nt, Mycobacterium avium subsp. paratuberculosis
guccggaagcccuugcagcaca

SEQ ID NO: 3012038 - RNA, 20 nt, Mycobacterium avium subsp. paratuberculosis
guccggacacggccagcgcc

SEQ ID NO: 3012039 - RNA, 18 nt, Mycobacterium avium subsp. paratuberculosis
guccggagaaccgcucga

SEQ ID NO: 3012040 - RNA, 23 nt, Mycobacterium avium subsp. paratuberculosis
guccggagaaccgcucgauggcg

SEQ ID NO: 3012041 - RNA, 15 nt, Mycobacterium avium subsp. paratuberculosis
guccggagcgaaggu

SEQ ID NO: 3012042 - RNA, 19 nt, Mycobacterium avium subsp. paratuberculosis
guccggagcgaaggugccg

SEQ ID NO: 3012043 - RNA, 17 nt, Mycobacterium avium subsp. paratuberculosis
guccggaggugccggcc

SEQ ID NO: 3012044 - RNA, 19 nt, Mycobacterium avium subsp. paratuberculosis
guccggauagccgucggcg

SEQ ID NO: 3012045 - RNA, 20 nt, Mycobacterium avium subsp. paratuberculosis
guccggauagccgucggcgg

SEQ ID NO: 3012046 - RNA, 15 nt, Mycobacterium avium subsp. paratuberculosis
guccggaugcggcgc

SEQ ID NO: 3012047 - RNA, 18 nt, Mycobacterium avium subsp. paratuberculosis
guccggaugcggcgccca

SEQ ID NO: 3012048 - RNA, 19 nt, Mycobacterium avium subsp. paratuberculosis
guccggaugcggcgcccac

SEQ ID NO: 3012049 - RNA, 21 nt, Mycobacterium avium subsp. paratuberculosis
guccggaugcggcgcccacag

SEQ ID NO: 3012050 - RNA, 14 nt, Mycobacterium avium subsp. paratuberculosis
guccggcagcagcg

SEQ ID NO: 3012051 - RNA, 15 nt, Mycobacterium avium subsp. paratuberculosis
guccggcagcagcga

SEQ ID NO: 3012052 - RNA, 19 nt, Mycobacterium avium subsp. paratuberculosis
guccggcagcagcgagucg

SEQ ID NO: 3012053 - RNA, 16 nt, Mycobacterium avium subsp. paratuberculosis
guccggcaggcucagc

SEQ ID NO: 3012054 - RNA, 20 nt, Mycobacterium avium subsp. paratuberculosis
guccggcaggcucagcagca

SEQ ID NO: 3012055 - RNA, 21 nt, Mycobacterium avium subsp. paratuberculosis
guccggcaggcucagcagcac

SEQ ID NO: 3012056 - RNA, 13 nt, Mycobacterium avium subsp. paratuberculosis
guccggccagcgu

SEQ ID NO: 3012057 - RNA, 15 nt, Mycobacterium avium subsp. paratuberculosis
guccggccaggucgc

SEQ ID NO: 3012058 - RNA, 18 nt, Mycobacterium avium subsp. paratuberculosis
guccggccaggucgccgc

SEQ ID NO: 3012059 - RNA, 19 nt, Mycobacterium avium subsp. paratuberculosis
guccggccaggucgccgcg

SEQ ID NO: 3012060 - RNA, 21 nt, Mycobacterium avium subsp. paratuberculosis
guccggccaggucgccgcgca

SEQ ID NO: 3012061 - RNA, 13 nt, Mycobacterium avium subsp. paratuberculosis
guccggcccggcg

SEQ ID NO: 3012062 - RNA, 15 nt, Mycobacterium avium subsp. paratuberculosis
guccggcccggcguc

SEQ ID NO: 3012063 - RNA, 18 nt, Mycobacterium avium subsp. paratuberculosis
guccggcccuggucggcc

SEQ ID NO: 3012064 - RNA, 14 nt, Mycobacterium avium subsp. paratuberculosis
guccggccggccga

SEQ ID NO: 3012065 - RNA, 21 nt, Mycobacterium avium subsp. paratuberculosis
guccggccgugaugcgccggc

SEQ ID NO: 3012066 - RNA, 15 nt, Mycobacterium avium subsp. paratuberculosis
guccggcgaauccga

SEQ ID NO: 3012067 - RNA, 20 nt, Mycobacterium avium subsp. paratuberculosis
guccggcgaauccgaccggc

SEQ ID NO: 3012068 - RNA, 13 nt, Mycobacterium avium subsp. paratuberculosis
guccggcgacaug

SEQ ID NO: 3012069 - RNA, 19 nt, Mycobacterium avium subsp. paratuberculosis
guccggcgaguacccgccg

SEQ ID NO: 3012070 - RNA, 14 nt, Mycobacterium avium subsp. paratuberculosis
guccggcgccacga

SEQ ID NO: 3012071 - RNA, 16 nt, Mycobacterium avium subsp. paratuberculosis
guccggcgccacgacu

SEQ ID NO: 3012072 - RNA, 14 nt, Mycobacterium avium subsp. paratuberculosis
guccggcgccagcc

SEQ ID NO: 3012073 - RNA, 17 nt, Mycobacterium avium subsp. paratuberculosis
guccggcgccagcccgg

SEQ ID NO: 3012074 - RNA, 14 nt, Mycobacterium avium subsp. paratuberculosis
guccggcgcccgau

SEQ ID NO: 3012075 - RNA, 13 nt, Mycobacterium avium subsp. paratuberculosis
guccggcgccgac

SEQ ID NO: 3012076 - RNA, 18 nt, Mycobacterium avium subsp. paratuberculosis
guccggcgcgaccagguu

SEQ ID NO: 3012077 - RNA, 16 nt, Mycobacterium avium subsp. paratuberculosis
guccggcgcgcccgga

SEQ ID NO: 3012078 - RNA, 21 nt, Mycobacterium avium subsp. paratuberculosis
guccggcgcuacgccggcucg

SEQ ID NO: 3012079 - RNA, 20 nt, Mycobacterium avium subsp. paratuberculosis
guccggcggcaccacccgcg

SEQ ID NO: 3012080 - RNA, 14 nt, Mycobacterium avium subsp. paratuberculosis
guccggcggucagc

SEQ ID NO: 3012081 - RNA, 21 nt, Mycobacterium avium subsp. paratuberculosis
guccggcggucagcaccguca

SEQ ID NO: 3012082 - RNA, 18 nt, Mycobacterium avium subsp. paratuberculosis
guccggcggucgcugcag

SEQ ID NO: 3012083 - RNA, 15 nt, Mycobacterium avium subsp. paratuberculosis
guccggcgugccacc

SEQ ID NO: 3012084 - RNA, 16 nt, Mycobacterium avium subsp. paratuberculosis
guccggcgugccaccg

SEQ ID NO: 3012085 - RNA, 14 nt, Mycobacterium avium subsp. paratuberculosis
guccggcucggugc

SEQ ID NO: 3012086 - RNA, 14 nt, Mycobacterium avium subsp. paratuberculosis
guccugcagcagcc

SEQ ID NO: 3012087 - RNA, 15 nt, Mycobacterium avium subsp. paratuberculosis
guccugcagcgccgu

SEQ ID NO: 3012088 - RNA, 18 nt, Mycobacterium avium subsp. paratuberculosis
guccugcagcgccguccg

SEQ ID NO: 3012089 - RNA, 16 nt, Mycobacterium avium subsp. paratuberculosis
guccugcagcucgccg

SEQ ID NO: 3012090 - RNA, 18 nt, Mycobacterium avium subsp. paratuberculosis
guccugcagcucgccggc

SEQ ID NO: 3012091 - RNA, 17 nt, Mycobacterium avium subsp. paratuberculosis
guccugcaggcaggccg

SEQ ID NO: 3012092 - RNA, 19 nt, Mycobacterium avium subsp. paratuberculosis
guccugcaggcaggccggc

SEQ ID NO: 3012093 - RNA, 21 nt, Mycobacterium avium subsp. paratuberculosis
guccugcaggcaggccggcag

SEQ ID NO: 3012094 - RNA, 13 nt, Mycobacterium avium subsp. paratuberculosis
guccugcgccgcg

SEQ ID NO: 3012095 - RNA, 21 nt, Mycobacterium avium subsp. paratuberculosis
guccugcggggaggucgucgc

SEQ ID NO: 3012096 - RNA, 18 nt, Mycobacterium avium subsp. paratuberculosis
guccugcgguucgggccc

SEQ ID NO: 3012097 - RNA, 14 nt, Mycobacterium avium subsp. paratuberculosis
guccugcucggcga

SEQ ID NO: 3012098 - RNA, 17 nt, Mycobacterium avium subsp. paratuberculosis
guccugcucggcgacgc

SEQ ID NO: 3012099 - RNA, 23 nt, Mycobacterium avium subsp. paratuberculosis
guccuggacgucgucgcuguccu

SEQ ID NO: 3012100 - RNA, 16 nt, Mycobacterium avium subsp. paratuberculosis
guccuggaucagccag

SEQ ID NO: 3012101 - RNA, 23 nt, Mycobacterium avium subsp. paratuberculosis
guccuggaugaacagcacgugcc

SEQ ID NO: 3012102 - RNA, 21 nt, Mycobacterium avium subsp. paratuberculosis
guccuggcccccgccccagcc

SEQ ID NO: 3012103 - RNA, 13 nt, Mycobacterium avium subsp. paratuberculosis
guccuggcgccag

SEQ ID NO: 3012104 - RNA, 16 nt, Mycobacterium avium subsp. paratuberculosis
guccuggcgguggccc

SEQ ID NO: 3012105 - RNA, 15 nt, Mycobacterium avium subsp. paratuberculosis
guccuucuccgccgg

SEQ ID NO: 3012106 - RNA, 14 nt, Mycobacterium avium subsp. paratuberculosis
guccuugaaccgca

SEQ ID NO: 3012107 - RNA, 13 nt, Mycobacterium avium subsp. paratuberculosis
guccuugaacuuc

SEQ ID NO: 3012108 - RNA, 16 nt, Mycobacterium avium subsp. paratuberculosis
guccuugaccagcugc

SEQ ID NO: 3012109 - RNA, 20 nt, Mycobacterium avium subsp. paratuberculosis
guccuugaggaugcgcacca

SEQ ID NO: 3012110 - RNA, 20 nt, Mycobacterium avium subsp. paratuberculosis
guccuugagguagucgcgca

SEQ ID NO: 3012111 - RNA, 15 nt, Mycobacterium avium subsp. paratuberculosis
guccuugccggcggc

SEQ ID NO: 3012112 - RNA, 15 nt, Mycobacterium avium subsp. paratuberculosis
guccuugcgcaccac

SEQ ID NO: 3012113 - RNA, 16 nt, Mycobacterium avium subsp. paratuberculosis
guccuugcgcaccacg

SEQ ID NO: 3012114 - RNA, 23 nt, Mycobacterium avium subsp. paratuberculosis
guccuugcgccccggcgggcggc

SEQ ID NO: 3012115 - RNA, 16 nt, Mycobacterium avium subsp. paratuberculosis
guccuugcgcgccgcg

SEQ ID NO: 3012116 - RNA, 18 nt, Mycobacterium avium subsp. paratuberculosis
guccuugcgcgccgcgac

SEQ ID NO: 3012117 - RNA, 22 nt, Mycobacterium avium subsp. paratuberculosis
guccuugcggaaccgcugcaug

SEQ ID NO: 3012118 - RNA, 23 nt, Mycobacterium avium subsp. paratuberculosis
guccuugcggaaccgcugcaugc

SEQ ID NO: 3012119 - RNA, 17 nt, Mycobacterium avium subsp. paratuberculosis
guccuugggcuccucga

SEQ ID NO: 3012120 - RNA, 24 nt, Mycobacterium avium subsp. paratuberculosis
guccuugggcuccucgaccacgca

SEQ ID NO: 3012121 - RNA, 20 nt, Mycobacterium avium subsp. paratuberculosis
guccuuggugaugucgguga

SEQ ID NO: 3012122 - RNA, 18 nt, Mycobacterium avium subsp. paratuberculosis
guccuuguaggugaucgu

SEQ ID NO: 3012123 - RNA, 15 nt, Mycobacterium avium subsp. paratuberculosis
guccuugucgcgcac

SEQ ID NO: 3012124 - RNA, 17 nt, Mycobacterium avium subsp. paratuberculosis
guccuugucgcgcaccg

SEQ ID NO: 3012125 - RNA, 17 nt, Mycobacterium avium subsp. paratuberculosis
guccuuguggcccaggc

SEQ ID NO: 3012126 - RNA, 17 nt, Mycobacterium avium subsp. paratuberculosis
guccuuguggucgaugc

SEQ ID NO: 3012127 - RNA, 13 nt, Mycobacterium avium subsp. paratuberculosis
gucgaaaaaugcg

SEQ ID NO: 3012128 - RNA, 21 nt, Mycobacterium avium subsp. paratuberculosis
gucgaaacccaggaacacggg

SEQ ID NO: 3012129 - RNA, 14 nt, Mycobacterium avium subsp. paratuberculosis
gucgaaaccgccca

SEQ ID NO: 3012130 - RNA, 21 nt, Mycobacterium avium subsp. paratuberculosis
gucgaaacggcugcugcgcgg

SEQ ID NO: 3012131 - RNA, 23 nt, Mycobacterium avium subsp. paratuberculosis
gucgaaacggcugcugcgcggca

SEQ ID NO: 3012132 - RNA, 16 nt, Mycobacterium avium subsp. paratuberculosis
gucgaaauagcggcgc

SEQ ID NO: 3012133 - RNA, 20 nt, Mycobacterium avium subsp. paratuberculosis
gucgaaauagcggcgcaccu

SEQ ID NO: 3012134 - RNA, 23 nt, Mycobacterium avium subsp. paratuberculosis
gucgaaaucggguccagcgccga

SEQ ID NO: 3012135 - RNA, 21 nt, Mycobacterium avium subsp. paratuberculosis
gucgaacaacgcggugaccgc

SEQ ID NO: 3012136 - RNA, 22 nt, Mycobacterium avium subsp. paratuberculosis
gucgaacacggcgcugagcgac

SEQ ID NO: 3012137 - RNA, 17 nt, Mycobacterium avium subsp. paratuberculosis
gucgaacagcacgccgg

SEQ ID NO: 3012138 - RNA, 13 nt, Mycobacterium avium subsp. paratuberculosis
gucgaacagcagg

SEQ ID NO: 3012139 - RNA, 14 nt, Mycobacterium avium subsp. paratuberculosis
gucgaacagcaggc

SEQ ID NO: 3012140 - RNA, 16 nt, Mycobacterium avium subsp. paratuberculosis
gucgaacagccgggcc

SEQ ID NO: 3012141 - RNA, 14 nt, Mycobacterium avium subsp. paratuberculosis
gucgaacagccggu

SEQ ID NO: 3012142 - RNA, 20 nt, Mycobacterium avium subsp. paratuberculosis
gucgaacagccgguccuggg

SEQ ID NO: 3012143 - RNA, 15 nt, Mycobacterium avium subsp. paratuberculosis
gucgaacagcgcgcc

SEQ ID NO: 3012144 - RNA, 14 nt, Mycobacterium avium subsp. paratuberculosis
gucgaacagcucga

SEQ ID NO: 3012145 - RNA, 15 nt, Mycobacterium avium subsp. paratuberculosis
gucgaacaggaugca

SEQ ID NO: 3012146 - RNA, 21 nt, Mycobacterium avium subsp. paratuberculosis
gucgaacaggaugcagccggc

SEQ ID NO: 3012147 - RNA, 12 nt, Mycobacterium avium subsp. paratuberculosis
gucgaaccacgc

SEQ ID NO: 3012148 - RNA, 15 nt, Mycobacterium avium subsp. paratuberculosis
gucgaaccacgcggc

SEQ ID NO: 3012149 - RNA, 19 nt, Mycobacterium avium subsp. paratuberculosis
gucgaaccacgcggcggcg

SEQ ID NO: 3012150 - RNA, 22 nt, Mycobacterium avium subsp. paratuberculosis
gucgaaccacgcggcggcggug

SEQ ID NO: 3012151 - RNA, 18 nt, Mycobacterium avium subsp. paratuberculosis
gucgaacccgaccccggc

SEQ ID NO: 3012152 - RNA, 21 nt, Mycobacterium avium subsp. paratuberculosis
gucgaacccgaccccggcgag

SEQ ID NO: 3012153 - RNA, 14 nt, Mycobacterium avium subsp. paratuberculosis
gucgaaccgcgagc

SEQ ID NO: 3012154 - RNA, 19 nt, Mycobacterium avium subsp. paratuberculosis
gucgaaccgcgagcgcgcg

SEQ ID NO: 3012155 - RNA, 16 nt, Mycobacterium avium subsp. paratuberculosis
gucgaacgccagcgcc

SEQ ID NO: 3012156 - RNA, 17 nt, Mycobacterium avium subsp. paratuberculosis
gucgaacgccagcgccg

SEQ ID NO: 3012157 - RNA, 18 nt, Mycobacterium avium subsp. paratuberculosis
gucgaacgccagcgccgc

SEQ ID NO: 3012158 - RNA, 21 nt, Mycobacterium avium subsp. paratuberculosis
gucgaacgccagcgccgcaac

SEQ ID NO: 3012159 - RNA, 13 nt, Mycobacterium avium subsp. paratuberculosis
gucgaacgcggcg

SEQ ID NO: 3012160 - RNA, 16 nt, Mycobacterium avium subsp. paratuberculosis
gucgaacgcggcgaag

SEQ ID NO: 3012161 - RNA, 18 nt, Mycobacterium avium subsp. paratuberculosis
gucgaacgcggcgccgac

SEQ ID NO: 3012162 - RNA, 20 nt, Mycobacterium avium subsp. paratuberculosis
gucgaacgcguacacggccc

SEQ ID NO: 3012163 - RNA, 23 nt, Mycobacterium avium subsp. paratuberculosis
gucgaacgcguacacggcccgcg

SEQ ID NO: 3012164 - RNA, 15 nt, Mycobacterium avium subsp. paratuberculosis
gucgaacggcaaccu

SEQ ID NO: 3012165 - RNA, 18 nt, Mycobacterium avium subsp. paratuberculosis
gucgaacggcaaccuggg

SEQ ID NO: 3012166 - RNA, 15 nt, Mycobacterium avium subsp. paratuberculosis
gucgaacgggccggg

SEQ ID NO: 3012167 - RNA, 20 nt, Mycobacterium avium subsp. paratuberculosis
gucgaacgggccgggcaccg

SEQ ID NO: 3012168 - RNA, 15 nt, Mycobacterium avium subsp. paratuberculosis
gucgaagaagcggcc

SEQ ID NO: 3012169 - RNA, 19 nt, Mycobacterium avium subsp. paratuberculosis
gucgaagaagcggccgacg

SEQ ID NO: 3012170 - RNA, 14 nt, Mycobacterium avium subsp. paratuberculosis
gucgaccgcggccu

SEQ ID NO: 3012171 - RNA, 20 nt, Mycobacterium avium subsp. paratuberculosis
gucgaccgcggccuggguga

SEQ ID NO: 3012172 - RNA, 23 nt, Mycobacterium avium subsp. paratuberculosis
gucgaccgcggccugggugaccg

SEQ ID NO: 3012173 - RNA, 13 nt, Mycobacterium avium subsp. paratuberculosis
gucgaccgcggcu

SEQ ID NO: 3012174 - RNA, 18 nt, Mycobacterium avium subsp. paratuberculosis
gucgaccggcucgccguu

SEQ ID NO: 3012175 - RNA, 19 nt, Mycobacterium avium subsp. paratuberculosis
gucgaccggcucgccguug

SEQ ID NO: 3012176 - RNA, 14 nt, Mycobacterium avium subsp. paratuberculosis
gucgaccggggcgc

SEQ ID NO: 3012177 - RNA, 14 nt, Mycobacterium avium subsp. paratuberculosis
gucgaccggguccg

SEQ ID NO: 3012178 - RNA, 19 nt, Mycobacterium avium subsp. paratuberculosis
gucgaccgucacgcuggcg

SEQ ID NO: 3012179 - RNA, 18 nt, Mycobacterium avium subsp. paratuberculosis
gucgaccuccucgacccc

SEQ ID NO: 3012180 - RNA, 21 nt, Mycobacterium avium subsp. paratuberculosis
gucgaccucgaugcgcagggc

SEQ ID NO: 3012181 - RNA, 16 nt, Mycobacterium avium subsp. paratuberculosis
gucgaccucgcgcguc

SEQ ID NO: 3012182 - RNA, 23 nt, Mycobacterium avium subsp. paratuberculosis
gucgaccucgcgcgucacgcugg

SEQ ID NO: 3012183 - RNA, 13 nt, Mycobacterium avium subsp. paratuberculosis
gucgaccucggcc

SEQ ID NO: 3012184 - RNA, 20 nt, Mycobacterium avium subsp. paratuberculosis
gucgaccucggccaccaccu

SEQ ID NO: 3012185 - RNA, 21 nt, Mycobacterium avium subsp. paratuberculosis
gucgaccucggccaccaccuc

SEQ ID NO: 3012186 - RNA, 17 nt, Mycobacterium avium subsp. paratuberculosis
gucgaccugcucgucgg

SEQ ID NO: 3012187 - RNA, 20 nt, Mycobacterium avium subsp. paratuberculosis
gucgaccuugcagcccgcgu

SEQ ID NO: 3012188 - RNA, 22 nt, Mycobacterium avium subsp. paratuberculosis
gucgaccuugcagcccgcgucc

SEQ ID NO: 3012189 - RNA, 20 nt, Mycobacterium avium subsp. paratuberculosis
gucgacgaagaaggacgccu

SEQ ID NO: 3012190 - RNA, 23 nt, Mycobacterium avium subsp. paratuberculosis
gucgacgacggucuucccgccgc

SEQ ID NO: 3012191 - RNA, 14 nt, Mycobacterium avium subsp. paratuberculosis
gucgacgacguugc

SEQ ID NO: 3012192 - RNA, 14 nt, Mycobacterium avium subsp. paratuberculosis
gucgacgagcaggc

SEQ ID NO: 3012193 - RNA, 17 nt, Mycobacterium avium subsp. paratuberculosis
gucgacgagcaggcuga

SEQ ID NO: 3012194 - RNA, 19 nt, Mycobacterium avium subsp. paratuberculosis
gucgacgagcccgccggcg

SEQ ID NO: 3012195 - RNA, 20 nt, Mycobacterium avium subsp. paratuberculosis
gucgacgagcccgccggcgg

SEQ ID NO: 3012196 - RNA, 16 nt, Mycobacterium avium subsp. paratuberculosis
gucgacgaucugcaca

SEQ ID NO: 3012197 - RNA, 17 nt, Mycobacterium avium subsp. paratuberculosis
gucgacgaugcgcugcu

SEQ ID NO: 3012198 - RNA, 18 nt, Mycobacterium avium subsp. paratuberculosis
gucgacgaugcgcugcug

SEQ ID NO: 3012199 - RNA, 18 nt, Mycobacterium avium subsp. paratuberculosis
gucgacgaugcguucggg

SEQ ID NO: 3012200 - RNA, 16 nt, Mycobacterium avium subsp. paratuberculosis
gucgacgauggcccgg

SEQ ID NO: 3012201 - RNA, 17 nt, Mycobacterium avium subsp. paratuberculosis
gucgacgauggcccgga

SEQ ID NO: 3012202 - RNA, 19 nt, Mycobacterium avium subsp. paratuberculosis
gucgacgauggcccgggcc

SEQ ID NO: 3012203 - RNA, 16 nt, Mycobacterium avium subsp. paratuberculosis
gucgacgauggcgucc

SEQ ID NO: 3012204 - RNA, 15 nt, Mycobacterium avium subsp. paratuberculosis
gucgacgauggucug

SEQ ID NO: 3012205 - RNA, 15 nt, Mycobacterium avium subsp. paratuberculosis
gucgacgcccaccug

SEQ ID NO: 3012206 - RNA, 16 nt, Mycobacterium avium subsp. paratuberculosis
gucgacgcccaccugg

SEQ ID NO: 3012207 - RNA, 16 nt, Mycobacterium avium subsp. paratuberculosis
gucgacgccccgcgcc

SEQ ID NO: 3012208 - RNA, 14 nt, Mycobacterium avium subsp. paratuberculosis
gucgacgcccugcc

SEQ ID NO: 3012209 - RNA, 20 nt, Mycobacterium avium subsp. paratuberculosis
gucgacgcccugccacagcg

SEQ ID NO: 3012210 - RNA, 14 nt, Mycobacterium avium subsp. paratuberculosis
gucgacgccgaugg

SEQ ID NO: 3012211 - RNA, 13 nt, Mycobacterium avium subsp. paratuberculosis
gucgacgccgcug

SEQ ID NO: 3012212 - RNA, 15 nt, Mycobacterium avium subsp. paratuberculosis
gucgacgccgcugcc

SEQ ID NO: 3012213 - RNA, 12 nt, Mycobacterium avium subsp. paratuberculosis
gucgacgccggg

SEQ ID NO: 3012214 - RNA, 14 nt, Mycobacterium avium subsp. paratuberculosis
gucgacgccguggu

SEQ ID NO: 3012215 - RNA, 13 nt, Mycobacterium avium subsp. paratuberculosis
gucgacgcgccgc

SEQ ID NO: 3012216 - RNA, 14 nt, Mycobacterium avium subsp. paratuberculosis
gucgacgcgccgca

SEQ ID NO: 3012217 - RNA, 13 nt, Mycobacterium avium subsp. paratuberculosis
gucgacgcggggc

SEQ ID NO: 3012218 - RNA, 19 nt, Mycobacterium avium subsp. paratuberculosis
gucgacgcggggcggcggc

SEQ ID NO: 3012219 - RNA, 12 nt, Mycobacterium avium subsp. paratuberculosis
gucgacgcggug

SEQ ID NO: 3012220 - RNA, 20 nt, Mycobacterium avium subsp. paratuberculosis
gucgacgcggugacaugccc

SEQ ID NO: 3012221 - RNA, 14 nt, Mycobacterium avium subsp. paratuberculosis
gucgacgcugcagg

SEQ ID NO: 3012222 - RNA, 17 nt, Mycobacterium avium subsp. paratuberculosis
gucgacgcugcaggugg

SEQ ID NO: 3012223 - RNA, 20 nt, Mycobacterium avium subsp. paratuberculosis
gucgacgcugcagguggccc

SEQ ID NO: 3012224 - RNA, 23 nt, Mycobacterium avium subsp. paratuberculosis
gucgacgcugcagguggcccaca

SEQ ID NO: 3012225 - RNA, 21 nt, Mycobacterium avium subsp. paratuberculosis
gucgacgcugugcgccuugcc

SEQ ID NO: 3012226 - RNA, 17 nt, Mycobacterium avium subsp. paratuberculosis
gucgacggaagccgagc

SEQ ID NO: 3012227 - RNA, 16 nt, Mycobacterium avium subsp. paratuberculosis
gucgacggacgggucg

SEQ ID NO: 3012228 - RNA, 17 nt, Mycobacterium avium subsp. paratuberculosis
gucgacggagucgucgg

SEQ ID NO: 3012229 - RNA, 14 nt, Mycobacterium avium subsp. paratuberculosis
gucgacggccgccg

SEQ ID NO: 3012230 - RNA, 16 nt, Mycobacterium avium subsp. paratuberculosis
gucgacggccgccgcg

SEQ ID NO: 3012231 - RNA, 18 nt, Mycobacterium avium subsp. paratuberculosis
gucgacggccgcgccgaa

SEQ ID NO: 3012232 - RNA, 19 nt, Mycobacterium avium subsp. paratuberculosis
gucgacggccgcgccgaac

SEQ ID NO: 3012233 - RNA, 20 nt, Mycobacterium avium subsp. paratuberculosis
gucgacggccgcgccgaaca

SEQ ID NO: 3012234 - RNA, 15 nt, Mycobacterium avium subsp. paratuberculosis
gucgacggcgccgga

SEQ ID NO: 3012235 - RNA, 16 nt, Mycobacterium avium subsp. paratuberculosis
gucgacggcgccggac

SEQ ID NO: 3012236 - RNA, 14 nt, Mycobacterium avium subsp. paratuberculosis
gucgacggcggcgu

SEQ ID NO: 3012237 - RNA, 16 nt, Mycobacterium avium subsp. paratuberculosis
gucgacggcggcgucc

SEQ ID NO: 3012238 - RNA, 19 nt, Mycobacterium avium subsp. paratuberculosis
gucgacggcggugacguuc

SEQ ID NO: 3012239 - RNA, 14 nt, Mycobacterium avium subsp. paratuberculosis
gucgacgggccacc

SEQ ID NO: 3012240 - RNA, 15 nt, Mycobacterium avium subsp. paratuberculosis
gucgacgggccacca

SEQ ID NO: 3012241 - RNA, 16 nt, Mycobacterium avium subsp. paratuberculosis
gucgacgggccaccag

SEQ ID NO: 3012242 - RNA, 18 nt, Mycobacterium avium subsp. paratuberculosis
gucgacgggccaccagcg

SEQ ID NO: 3012243 - RNA, 21 nt, Mycobacterium avium subsp. paratuberculosis
gucgacgggccaccagcgcag

SEQ ID NO: 3012244 - RNA, 17 nt, Mycobacterium avium subsp. paratuberculosis
gucgacggggucggaca

SEQ ID NO: 3012245 - RNA, 19 nt, Mycobacterium avium subsp. paratuberculosis
gucgacgguugccucggcc

SEQ ID NO: 3012246 - RNA, 23 nt, Mycobacterium avium subsp. paratuberculosis
gucgacgguuugcccggcgaugu

SEQ ID NO: 3012247 - RNA, 18 nt, Mycobacterium avium subsp. paratuberculosis
gucgacgucaacaccgug

SEQ ID NO: 3012248 - RNA, 22 nt, Mycobacterium avium subsp. paratuberculosis
gucgacgucaacaccguggugg

SEQ ID NO: 3012249 - RNA, 16 nt, Mycobacterium avium subsp. paratuberculosis
gucgacguccucgccc

SEQ ID NO: 3012250 - RNA, 19 nt, Mycobacterium avium subsp. paratuberculosis
gucgacguccucgcccggg

SEQ ID NO: 3012251 - RNA, 23 nt, Mycobacterium avium subsp. paratuberculosis
gucgacgucgagaaaggccagca

SEQ ID NO: 3012252 - RNA, 15 nt, Mycobacterium avium subsp. paratuberculosis
gucgacgucgagggc

SEQ ID NO: 3012253 - RNA, 19 nt, Mycobacterium avium subsp. paratuberculosis
gucgacgucggacgcggcc

SEQ ID NO: 3012254 - RNA, 20 nt, Mycobacterium avium subsp. paratuberculosis
gucgacgucggacgcggccg

SEQ ID NO: 3012255 - RNA, 20 nt, Mycobacterium avium subsp. paratuberculosis
gucgagcggcuugccgccgc

SEQ ID NO: 3012256 - RNA, 21 nt, Mycobacterium avium subsp. paratuberculosis
gucgagcggcuugccgccgca

SEQ ID NO: 3012257 - RNA, 22 nt, Mycobacterium avium subsp. paratuberculosis
gucgagcggcuugccgccgcag

SEQ ID NO: 3012258 - RNA, 23 nt, Mycobacterium avium subsp. paratuberculosis
gucgagcggcuugccgccgcagc

SEQ ID NO: 3012259 - RNA, 24 nt, Mycobacterium avium subsp. paratuberculosis
gucgagcggcuugccgccgcagcg

SEQ ID NO: 3012260 - RNA, 19 nt, Mycobacterium avium subsp. paratuberculosis
gucgagcgucacgccgcgc

SEQ ID NO: 3012261 - RNA, 20 nt, Mycobacterium avium subsp. paratuberculosis
gucgagcgucacgccgcgcc

SEQ ID NO: 3012262 - RNA, 23 nt, Mycobacterium avium subsp. paratuberculosis
gucgagcgucacgccgcgcccgu

SEQ ID NO: 3012263 - RNA, 20 nt, Mycobacterium avium subsp. paratuberculosis
gucgagcgucauuccgccgc

SEQ ID NO: 3012264 - RNA, 21 nt, Mycobacterium avium subsp. paratuberculosis
gucgagcgucauuccgccgcg

SEQ ID NO: 3012265 - RNA, 22 nt, Mycobacterium avium subsp. paratuberculosis
gucgagcgucauuccgccgcgc

SEQ ID NO: 3012266 - RNA, 23 nt, Mycobacterium avium subsp. paratuberculosis
gucgagcgucauuccgccgcgcc

SEQ ID NO: 3012267 - RNA, 17 nt, Mycobacterium avium subsp. paratuberculosis
gucgagcguggggccug

SEQ ID NO: 3012268 - RNA, 16 nt, Mycobacterium avium subsp. paratuberculosis
gucgagcuccucggcc

SEQ ID NO: 3012269 - RNA, 19 nt, Mycobacterium avium subsp. paratuberculosis
gucgagcuccucggccagc

SEQ ID NO: 3012270 - RNA, 13 nt, Mycobacterium avium subsp. paratuberculosis
gucgagcucgaag

SEQ ID NO: 3012271 - RNA, 17 nt, Mycobacterium avium subsp. paratuberculosis
gucgaggaauccggucc

SEQ ID NO: 3012272 - RNA, 23 nt, Mycobacterium avium subsp. paratuberculosis
gucgaggacugggucaccgucac

SEQ ID NO: 3012273 - RNA, 19 nt, Mycobacterium avium subsp. paratuberculosis
gucgaggcccucgacaccg

SEQ ID NO: 3012274 - RNA, 22 nt, Mycobacterium avium subsp. paratuberculosis
gucgaggcccucgacaccggug

SEQ ID NO: 3012275 - RNA, 17 nt, Mycobacterium avium subsp. paratuberculosis
gucgaggccggccagcg

SEQ ID NO: 3012276 - RNA, 23 nt, Mycobacterium avium subsp. paratuberculosis
gucgaggcggaucuucucgcugc

SEQ ID NO: 3012277 - RNA, 13 nt, Mycobacterium avium subsp. paratuberculosis
gucgagggccauc

SEQ ID NO: 3012278 - RNA, 16 nt, Mycobacterium avium subsp. paratuberculosis
gucgagggcgccguug

SEQ ID NO: 3012279 - RNA, 21 nt, Mycobacterium avium subsp. paratuberculosis
gucgagggcguucgcgguggg

SEQ ID NO: 3012280 - RNA, 19 nt, Mycobacterium avium subsp. paratuberculosis
gucgagggcuaaccaccgg

SEQ ID NO: 3012281 - RNA, 20 nt, Mycobacterium avium subsp. paratuberculosis
gucgaggggcuugagcgcgu

SEQ ID NO: 3012282 - RNA, 18 nt, Mycobacterium avium subsp. paratuberculosis
gucgagggggagcaggac

SEQ ID NO: 3012283 - RNA, 14 nt, Mycobacterium avium subsp. paratuberculosis
gucgagggucgcca

SEQ ID NO: 3012284 - RNA, 17 nt, Mycobacterium avium subsp. paratuberculosis
gucgagggucgccaggc

SEQ ID NO: 3012285 - RNA, 18 nt, Mycobacterium avium subsp. paratuberculosis
gucgagggucgccaggcc

SEQ ID NO: 3012286 - RNA, 22 nt, Mycobacterium avium subsp. paratuberculosis
gucgagggucgccaggccaccg

SEQ ID NO: 3012287 - RNA, 16 nt, Mycobacterium avium subsp. paratuberculosis
gucgagggugacccgg

SEQ ID NO: 3012288 - RNA, 22 nt, Mycobacterium avium subsp. paratuberculosis
gucgagggugaugucgcugccg

SEQ ID NO: 3012289 - RNA, 16 nt, Mycobacterium avium subsp. paratuberculosis
gucgagguacugcagc

SEQ ID NO: 3012290 - RNA, 20 nt, Mycobacterium avium subsp. paratuberculosis
gucgagguacugcagcaguc

SEQ ID NO: 3012291 - RNA, 15 nt, Mycobacterium avium subsp. paratuberculosis
gucgagguagugcgc

SEQ ID NO: 3012292 - RNA, 17 nt, Mycobacterium avium subsp. paratuberculosis
gucgagguagugcgcga

SEQ ID NO: 3012293 - RNA, 23 nt, Mycobacterium avium subsp. paratuberculosis
gucgagguagugcgcgauggcgu

SEQ ID NO: 3012294 - RNA, 14 nt, Mycobacterium avium subsp. paratuberculosis
gucgaggucgccga

SEQ ID NO: 3012295 - RNA, 15 nt, Mycobacterium avium subsp. paratuberculosis
gucgaggucgccgac

SEQ ID NO: 3012296 - RNA, 16 nt, Mycobacterium avium subsp. paratuberculosis
gucgaggucgccgaca

SEQ ID NO: 3012297 - RNA, 13 nt, Mycobacterium avium subsp. paratuberculosis
gucgaggucgcgc

SEQ ID NO: 3012298 - RNA, 18 nt, Mycobacterium avium subsp. paratuberculosis
gucgaggucgcgcagcac

SEQ ID NO: 3012299 - RNA, 19 nt, Mycobacterium avium subsp. paratuberculosis
gucgaggucgcgcagcacc

SEQ ID NO: 3012300 - RNA, 15 nt, Mycobacterium avium subsp. paratuberculosis
gucgaggucggacgc

SEQ ID NO: 3012301 - RNA, 13 nt, Mycobacterium avium subsp. paratuberculosis
gucgaggucggcc

SEQ ID NO: 3012302 - RNA, 15 nt, Mycobacterium avium subsp. paratuberculosis
gucgaggucggccag

SEQ ID NO: 3012303 - RNA, 12 nt, Mycobacterium avium subsp. paratuberculosis
gucgaggucggu

SEQ ID NO: 3012304 - RNA, 14 nt, Mycobacterium avium subsp. paratuberculosis
gucgaggucgguga

SEQ ID NO: 3012305 - RNA, 21 nt, Mycobacterium avium subsp. paratuberculosis
gucgaggucggugaggcuggg

SEQ ID NO: 3012306 - RNA, 17 nt, Mycobacterium avium subsp. paratuberculosis
gucgaggucgucggcca

SEQ ID NO: 3012307 - RNA, 16 nt, Mycobacterium avium subsp. paratuberculosis
gucgaggucgucgggc

SEQ ID NO: 3012308 - RNA, 22 nt, Mycobacterium avium subsp. paratuberculosis
gucgaggucgucgggcgccggu

SEQ ID NO: 3012309 - RNA, 23 nt, Mycobacterium avium subsp. paratuberculosis
gucgagguucauguggaagccgc

SEQ ID NO: 3012310 - RNA, 22 nt, Mycobacterium avium subsp. paratuberculosis
gucgagguucucgaacgggucg

SEQ ID NO: 3012311 - RNA, 22 nt, Mycobacterium avium subsp. paratuberculosis
gucgagguugaugccgacgucg

SEQ ID NO: 3012312 - RNA, 19 nt, Mycobacterium avium subsp. paratuberculosis
gucgaguccguggucaggg

SEQ ID NO: 3012313 - RNA, 14 nt, Mycobacterium avium subsp. paratuberculosis
gucgagucggccac

SEQ ID NO: 3012314 - RNA, 16 nt, Mycobacterium avium subsp. paratuberculosis
gucgagucggccaccg

SEQ ID NO: 3012315 - RNA, 13 nt, Mycobacterium avium subsp. paratuberculosis
gucgagugcucga

SEQ ID NO: 3012316 - RNA, 20 nt, Mycobacterium avium subsp. paratuberculosis
gucgagugcucgauggccag

SEQ ID NO: 3012317 - RNA, 16 nt, Mycobacterium avium subsp. paratuberculosis
gucgaguuccuccacg

SEQ ID NO: 3012318 - RNA, 16 nt, Mycobacterium avium subsp. paratuberculosis
gucgaguucgccgucg

SEQ ID NO: 3012319 - RNA, 17 nt, Mycobacterium avium subsp. paratuberculosis
gucgaguucgccgucga

SEQ ID NO: 3012320 - RNA, 19 nt, Mycobacterium avium subsp. paratuberculosis
gucgaguucgccgucgacg

SEQ ID NO: 3012321 - RNA, 22 nt, Mycobacterium avium subsp. paratuberculosis
gucgaguucgccgucgacggug

SEQ ID NO: 3012322 - RNA, 16 nt, Mycobacterium avium subsp. paratuberculosis
gucgaguucgcggcgc

SEQ ID NO: 3012323 - RNA, 20 nt, Mycobacterium avium subsp. paratuberculosis
gucgaguucgcggcgcagca

SEQ ID NO: 3012324 - RNA, 21 nt, Mycobacterium avium subsp. paratuberculosis
gucgauaugcugcaacggcug

SEQ ID NO: 3012325 - RNA, 21 nt, Mycobacterium avium subsp. paratuberculosis
gucgaucaacaccaacgacag

SEQ ID NO: 3012326 - RNA, 23 nt, Mycobacterium avium subsp. paratuberculosis
gucgaucaacaccaacgacagcg

SEQ ID NO: 3012327 - RNA, 12 nt, Mycobacterium avium subsp. paratuberculosis
gucgaucaagaa

SEQ ID NO: 3012328 - RNA, 13 nt, Mycobacterium avium subsp. paratuberculosis
gucgaucaccucg

SEQ ID NO: 3012329 - RNA, 13 nt, Mycobacterium avium subsp. paratuberculosis
gucgaucaccugc

SEQ ID NO: 3012330 - RNA, 14 nt, Mycobacterium avium subsp. paratuberculosis
gucgaucacgccgc

SEQ ID NO: 3012331 - RNA, 15 nt, Mycobacterium avium subsp. paratuberculosis
gucgaucagcgcgcc

SEQ ID NO: 3012332 - RNA, 18 nt, Mycobacterium avium subsp. paratuberculosis
gucgaucagcgguccacc

SEQ ID NO: 3012333 - RNA, 19 nt, Mycobacterium avium subsp. paratuberculosis
gucgaucagcgguccaccc

SEQ ID NO: 3012334 - RNA, 20 nt, Mycobacterium avium subsp. paratuberculosis
gucgaucagcgguccacccg

SEQ ID NO: 3012335 - RNA, 21 nt, Mycobacterium avium subsp. paratuberculosis
gucgaucagcgguccacccga

SEQ ID NO: 3012336 - RNA, 22 nt, Mycobacterium avium subsp. paratuberculosis
gucgaucagcgguccacccgaa

SEQ ID NO: 3012337 - RNA, 20 nt, Mycobacterium avium subsp. paratuberculosis
gucgaucauguagcgcuggu

SEQ ID NO: 3012338 - RNA, 19 nt, Mycobacterium avium subsp. paratuberculosis
gucgauccacccaccggca

SEQ ID NO: 3012339 - RNA, 15 nt, Mycobacterium avium subsp. paratuberculosis
gucgcacagccgcag

SEQ ID NO: 3012340 - RNA, 19 nt, Mycobacterium avium subsp. paratuberculosis
gucgcacagccgcagcagc

SEQ ID NO: 3012341 - RNA, 20 nt, Mycobacterium avium subsp. paratuberculosis
gucgcacagccgcagcagcc

SEQ ID NO: 3012342 - RNA, 16 nt, Mycobacterium avium subsp. paratuberculosis
gucgcacagcgccgcg

SEQ ID NO: 3012343 - RNA, 18 nt, Mycobacterium avium subsp. paratuberculosis
gucgcacaggaugcccaa

SEQ ID NO: 3012344 - RNA, 14 nt, Mycobacterium avium subsp. paratuberculosis
gucgcaccgccucc

SEQ ID NO: 3012345 - RNA, 15 nt, Mycobacterium avium subsp. paratuberculosis
gucgcaccggcagug

SEQ ID NO: 3012346 - RNA, 22 nt, Mycobacterium avium subsp. paratuberculosis
gucgcaccggcagugaucggcg

SEQ ID NO: 3012347 - RNA, 18 nt, Mycobacterium avium subsp. paratuberculosis
gucgcacuagguccggcg

SEQ ID NO: 3012348 - RNA, 19 nt, Mycobacterium avium subsp. paratuberculosis
gucgcacuagguccggcgc

SEQ ID NO: 3012349 - RNA, 12 nt, Mycobacterium avium subsp. paratuberculosis
gucgcacugcuu

SEQ ID NO: 3012350 - RNA, 22 nt, Mycobacterium avium subsp. paratuberculosis
gucgcacugcuucgggucgccg

SEQ ID NO: 3012351 - RNA, 16 nt, Mycobacterium avium subsp. paratuberculosis
gucgcacuugaagcug

SEQ ID NO: 3012352 - RNA, 19 nt, Mycobacterium avium subsp. paratuberculosis
gucgcagaucccgccggcg

SEQ ID NO: 3012353 - RNA, 20 nt, Mycobacterium avium subsp. paratuberculosis
gucgcagaucccgccggcgg

SEQ ID NO: 3012354 - RNA, 22 nt, Mycobacterium avium subsp. paratuberculosis
gucgcagaucccgccggcggcc

SEQ ID NO: 3012355 - RNA, 23 nt, Mycobacterium avium subsp. paratuberculosis
gucgcagaucccgccggcggcca

SEQ ID NO: 3012356 - RNA, 18 nt, Mycobacterium avium subsp. paratuberculosis
gucgcagcagcagcccga

SEQ ID NO: 3012357 - RNA, 19 nt, Mycobacterium avium subsp. paratuberculosis
gucgcagcagcagcccgaa

SEQ ID NO: 3012358 - RNA, 15 nt, Mycobacterium avium subsp. paratuberculosis
gucgcagcccgggug

SEQ ID NO: 3012359 - RNA, 16 nt, Mycobacterium avium subsp. paratuberculosis
gucgcagcccgggugc

SEQ ID NO: 3012360 - RNA, 20 nt, Mycobacterium avium subsp. paratuberculosis
gucgcagcggcacgucgccg

SEQ ID NO: 3012361 - RNA, 13 nt, Mycobacterium avium subsp. paratuberculosis
gucgcaggcagca

SEQ ID NO: 3012362 - RNA, 16 nt, Mycobacterium avium subsp. paratuberculosis
gucgcaggcagcagca

SEQ ID NO: 3012363 - RNA, 22 nt, Mycobacterium avium subsp. paratuberculosis
gucgcaggcagcagcaccccga

SEQ ID NO: 3012364 - RNA, 15 nt, Mycobacterium avium subsp. paratuberculosis
gucgcaggccccgga

SEQ ID NO: 3012365 - RNA, 17 nt, Mycobacterium avium subsp. paratuberculosis
gucgcaggccgcccggc

SEQ ID NO: 3012366 - RNA, 20 nt, Mycobacterium avium subsp. paratuberculosis
gucgcaggccgcccggccca

SEQ ID NO: 3012367 - RNA, 14 nt, Mycobacterium avium subsp. paratuberculosis
gucgcagugcccgc

SEQ ID NO: 3012368 - RNA, 18 nt, Mycobacterium avium subsp. paratuberculosis
gucgcagugcccgcccag

SEQ ID NO: 3012369 - RNA, 22 nt, Mycobacterium avium subsp. paratuberculosis
gucgcauaugcgugggcccuca

SEQ ID NO: 3012370 - RNA, 15 nt, Mycobacterium avium subsp. paratuberculosis
gucgcaucagcucgg

SEQ ID NO: 3012371 - RNA, 17 nt, Mycobacterium avium subsp. paratuberculosis
gucgccaauccggcggg

SEQ ID NO: 3012372 - RNA, 20 nt, Mycobacterium avium subsp. paratuberculosis
gucgccaauccggcgggccu

SEQ ID NO: 3012373 - RNA, 22 nt, Mycobacterium avium subsp. paratuberculosis
gucgccaauccggcgggccucg

SEQ ID NO: 3012374 - RNA, 20 nt, Mycobacterium avium subsp. paratuberculosis
gucgccaccaccacggggcg

SEQ ID NO: 3012375 - RNA, 23 nt, Mycobacterium avium subsp. paratuberculosis
gucgccaccaccacggggcgggu

SEQ ID NO: 3012376 - RNA, 15 nt, Mycobacterium avium subsp. paratuberculosis
gucgccaccaccagc

SEQ ID NO: 3012377 - RNA, 20 nt, Mycobacterium avium subsp. paratuberculosis
gucgccaccaccagcgggcu

SEQ ID NO: 3012378 - RNA, 14 nt, Mycobacterium avium subsp. paratuberculosis
gucgccaccaccgc

SEQ ID NO: 3012379 - RNA, 15 nt, Mycobacterium avium subsp. paratuberculosis
gucgccaccaccgcg

SEQ ID NO: 3012380 - RNA, 18 nt, Mycobacterium avium subsp. paratuberculosis
gucgccaccaccgcgccg

SEQ ID NO: 3012381 - RNA, 15 nt, Mycobacterium avium subsp. paratuberculosis
gucgccaccaccuuc

SEQ ID NO: 3012382 - RNA, 18 nt, Mycobacterium avium subsp. paratuberculosis
gucgccaccagaccggcg

SEQ ID NO: 3012383 - RNA, 19 nt, Mycobacterium avium subsp. paratuberculosis
gucgccaccagaccggcga

SEQ ID NO: 3012384 - RNA, 18 nt, Mycobacterium avium subsp. paratuberculosis
gucgccaccgagucgcgc

SEQ ID NO: 3012385 - RNA, 21 nt, Mycobacterium avium subsp. paratuberculosis
gucgccaccgagucgcgcgac

SEQ ID NO: 3012386 - RNA, 17 nt, Mycobacterium avium subsp. paratuberculosis
gucgccacgaucaccac

SEQ ID NO: 3012387 - RNA, 23 nt, Mycobacterium avium subsp. paratuberculosis
gucgccacgaucaccaccaccgc

SEQ ID NO: 3012388 - RNA, 17 nt, Mycobacterium avium subsp. paratuberculosis
gucgccacucgggcggc

SEQ ID NO: 3012389 - RNA, 20 nt, Mycobacterium avium subsp. paratuberculosis
gucgccacucgggcggccgc

SEQ ID NO: 3012390 - RNA, 13 nt, Mycobacterium avium subsp. paratuberculosis
gucgccagcacca

SEQ ID NO: 3012391 - RNA, 14 nt, Mycobacterium avium subsp. paratuberculosis
gucgccagcaccac

SEQ ID NO: 3012392 - RNA, 17 nt, Mycobacterium avium subsp. paratuberculosis
gucgccagcaccaccuc

SEQ ID NO: 3012393 - RNA, 16 nt, Mycobacterium avium subsp. paratuberculosis
gucgccagcaccgugc

SEQ ID NO: 3012394 - RNA, 13 nt, Mycobacterium avium subsp. paratuberculosis
gucgccagccgcc

SEQ ID NO: 3012395 - RNA, 16 nt, Mycobacterium avium subsp. paratuberculosis
gucgccagccgccggc

SEQ ID NO: 3012396 - RNA, 13 nt, Mycobacterium avium subsp. paratuberculosis
gucgccagcgcca

SEQ ID NO: 3012397 - RNA, 14 nt, Mycobacterium avium subsp. paratuberculosis
gucgccagcgccac

SEQ ID NO: 3012398 - RNA, 11 nt, Mycobacterium avium subsp. paratuberculosis
gucgccaggcc

SEQ ID NO: 3012399 - RNA, 14 nt, Mycobacterium avium subsp. paratuberculosis
gucgccaggccacc

SEQ ID NO: 3012400 - RNA, 15 nt, Mycobacterium avium subsp. paratuberculosis
gucgccaggccaccg

SEQ ID NO: 3012401 - RNA, 16 nt, Mycobacterium avium subsp. paratuberculosis
gucgccaggccaccgc

SEQ ID NO: 3012402 - RNA, 18 nt, Mycobacterium avium subsp. paratuberculosis
gucgccaggccaccgcac

SEQ ID NO: 3012403 - RNA, 20 nt, Mycobacterium avium subsp. paratuberculosis
gucgccaguugcacuuucgg

SEQ ID NO: 3012404 - RNA, 20 nt, Mycobacterium avium subsp. paratuberculosis
gucgccaucgcaccgcgagc

SEQ ID NO: 3012405 - RNA, 18 nt, Mycobacterium avium subsp. paratuberculosis
gucgccaugccgucgcgc

SEQ ID NO: 3012406 - RNA, 19 nt, Mycobacterium avium subsp. paratuberculosis
gucgccaugccgucgcgca

SEQ ID NO: 3012407 - RNA, 20 nt, Mycobacterium avium subsp. paratuberculosis
gucgccaugccgucgcgcac

SEQ ID NO: 3012408 - RNA, 22 nt, Mycobacterium avium subsp. paratuberculosis
gucgccaugccgucgcgcaccg

SEQ ID NO: 3012409 - RNA, 15 nt, Mycobacterium avium subsp. paratuberculosis
gucgcccacaccgga

SEQ ID NO: 3012410 - RNA, 17 nt, Mycobacterium avium subsp. paratuberculosis
gucgcccacaccggaug

SEQ ID NO: 3012411 - RNA, 23 nt, Mycobacterium avium subsp. paratuberculosis
gucgcccaccacgacgacguggu

SEQ ID NO: 3012412 - RNA, 12 nt, Mycobacterium avium subsp. paratuberculosis
gucgcccacccg

SEQ ID NO: 3012413 - RNA, 14 nt, Mycobacterium avium subsp. paratuberculosis
gucgcccacccgcc

SEQ ID NO: 3012414 - RNA, 15 nt, Mycobacterium avium subsp. paratuberculosis
gucgcccacccgcca

SEQ ID NO: 3012415 - RNA, 16 nt, Mycobacterium avium subsp. paratuberculosis
gucgcccacccggggc

SEQ ID NO: 3012416 - RNA, 14 nt, Mycobacterium avium subsp. paratuberculosis
gucgcccaccgacg

SEQ ID NO: 3012417 - RNA, 21 nt, Mycobacterium avium subsp. paratuberculosis
gucgcccaccgacgcggcggc

SEQ ID NO: 3012418 - RNA, 14 nt, Mycobacterium avium subsp. paratuberculosis
gucgcccaccgugu

SEQ ID NO: 3012419 - RNA, 15 nt, Mycobacterium avium subsp. paratuberculosis
gucgcccacgccggu

SEQ ID NO: 3012420 - RNA, 17 nt, Mycobacterium avium subsp. paratuberculosis
gucgcccacgccggugg

SEQ ID NO: 3012421 - RNA, 14 nt, Mycobacterium avium subsp. paratuberculosis
gucgcccagcagcc

SEQ ID NO: 3012422 - RNA, 15 nt, Mycobacterium avium subsp. paratuberculosis
gucgcccagcagccc

SEQ ID NO: 3012423 - RNA, 19 nt, Mycobacterium avium subsp. paratuberculosis
gucgcccagcagcccggcc

SEQ ID NO: 3012424 - RNA, 19 nt, Mycobacterium avium subsp. paratuberculosis
ggucagcggcgugcugcgc

SEQ ID NO: 3012425 - RNA, 13 nt, Mycobacterium avium subsp. paratuberculosis
ggucagcgucgcc

SEQ ID NO: 3012426 - RNA, 16 nt, Mycobacterium avium subsp. paratuberculosis
ggucagcgucgccgcc

SEQ ID NO: 3012427 - RNA, 16 nt, Mycobacterium avium subsp. paratuberculosis
ggucagcgucucgccg

SEQ ID NO: 3012428 - RNA, 20 nt, Mycobacterium avium subsp. paratuberculosis
ggucagcgucucgccgggga

SEQ ID NO: 3012429 - RNA, 22 nt, Mycobacterium avium subsp. paratuberculosis
ggucagcgucucggcgaucagc

SEQ ID NO: 3012430 - RNA, 18 nt, Mycobacterium avium subsp. paratuberculosis
ggucagcguggcgucggc

SEQ ID NO: 3012431 - RNA, 20 nt, Mycobacterium avium subsp. paratuberculosis
ggucagcguggcgucggcgc

SEQ ID NO: 3012432 - RNA, 19 nt, Mycobacterium avium subsp. paratuberculosis
ggucagcuccaccugcggc

SEQ ID NO: 3012433 - RNA, 13 nt, Mycobacterium avium subsp. paratuberculosis
ggucagcucccgg

SEQ ID NO: 3012434 - RNA, 15 nt, Mycobacterium avium subsp. paratuberculosis
ggucagcucccggca

SEQ ID NO: 3012435 - RNA, 17 nt, Mycobacterium avium subsp. paratuberculosis
ggucagcucccggcaga

SEQ ID NO: 3012436 - RNA, 22 nt, Mycobacterium avium subsp. paratuberculosis
ggucagcucgaaaagcuucuug

SEQ ID NO: 3012437 - RNA, 23 nt, Mycobacterium avium subsp. paratuberculosis
ggucagcucgaaggugcccgcau

SEQ ID NO: 3012438 - RNA, 17 nt, Mycobacterium avium subsp. paratuberculosis
ggucagcucgaucgccg

SEQ ID NO: 3012439 - RNA, 14 nt, Mycobacterium avium subsp. paratuberculosis
ggucagcucgccgu

SEQ ID NO: 3012440 - RNA, 13 nt, Mycobacterium avium subsp. paratuberculosis
ggucagcucgggg

SEQ ID NO: 3012441 - RNA, 16 nt, Mycobacterium avium subsp. paratuberculosis
ggucagcuuggagccg

SEQ ID NO: 3012442 - RNA, 19 nt, Mycobacterium avium subsp. paratuberculosis
ggucagcuuggagccgagc

SEQ ID NO: 3012443 - RNA, 21 nt, Mycobacterium avium subsp. paratuberculosis
ggucaggaucgacuccgggug

SEQ ID NO: 3012444 - RNA, 14 nt, Mycobacterium avium subsp. paratuberculosis
ggucaggcccaggc

SEQ ID NO: 3012445 - RNA, 20 nt, Mycobacterium avium subsp. paratuberculosis
ggucaggcccaggucgugaa

SEQ ID NO: 3012446 - RNA, 15 nt, Mycobacterium avium subsp. paratuberculosis
ggucaggccggcgcc

SEQ ID NO: 3012447 - RNA, 14 nt, Mycobacterium avium subsp. paratuberculosis
ggucagggccagca

SEQ ID NO: 3012448 - RNA, 20 nt, Mycobacterium avium subsp. paratuberculosis
ggucaggguguuguccgagc

SEQ ID NO: 3012449 - RNA, 22 nt, Mycobacterium avium subsp. paratuberculosis
ggucagguagccgaggucgccg

SEQ ID NO: 3012450 - RNA, 16 nt, Mycobacterium avium subsp. paratuberculosis
ggucagguaggcgucg

SEQ ID NO: 3012451 - RNA, 20 nt, Mycobacterium avium subsp. paratuberculosis
ggucaggucgaagcccgccg

SEQ ID NO: 3012452 - RNA, 16 nt, Mycobacterium avium subsp. paratuberculosis
ggucaguacagcuagg

SEQ ID NO: 3012453 - RNA, 21 nt, Mycobacterium avium subsp. paratuberculosis
ggucaguacagcuaggccagc

SEQ ID NO: 3012454 - RNA, 22 nt, Mycobacterium avium subsp. paratuberculosis
ggucaguacagcuaggccagca

SEQ ID NO: 3012455 - RNA, 21 nt, Mycobacterium avium subsp. paratuberculosis
ggucaguccggguugggcgcc

SEQ ID NO: 3012456 - RNA, 22 nt, Mycobacterium avium subsp. paratuberculosis
ggucagucgaucuugcgccaga

SEQ ID NO: 3012457 - RNA, 12 nt, Mycobacterium avium subsp. paratuberculosis
ggucagucgcgc

SEQ ID NO: 3012458 - RNA, 17 nt, Mycobacterium avium subsp. paratuberculosis
ggucagucgcgccgcca

SEQ ID NO: 3012459 - RNA, 15 nt, Mycobacterium avium subsp. paratuberculosis
ggucaguucgucggu

SEQ ID NO: 3012460 - RNA, 18 nt, Mycobacterium avium subsp. paratuberculosis
ggucaguucgucggucac

SEQ ID NO: 3012461 - RNA, 12 nt, Mycobacterium avium subsp. paratuberculosis
ggucaucagcga

SEQ ID NO: 3012462 - RNA, 15 nt, Mycobacterium avium subsp. paratuberculosis
ggucaucagugaccg

SEQ ID NO: 3012463 - RNA, 14 nt, Mycobacterium avium subsp. paratuberculosis
ggucauccgggcca

SEQ ID NO: 3012464 - RNA, 16 nt, Mycobacterium avium subsp. paratuberculosis
ggucauccucgccgcg

SEQ ID NO: 3012465 - RNA, 22 nt, Mycobacterium avium subsp. paratuberculosis
ggucauccucgccgcgccagca

SEQ ID NO: 3012466 - RNA, 23 nt, Mycobacterium avium subsp. paratuberculosis
ggucaucgacucgaagaaccgca

SEQ ID NO: 3012467 - RNA, 20 nt, Mycobacterium avium subsp. paratuberculosis
ggucaucgagccgagcaccg

SEQ ID NO: 3012468 - RNA, 14 nt, Mycobacterium avium subsp. paratuberculosis
ggucaucgagccgg

SEQ ID NO: 3012469 - RNA, 22 nt, Mycobacterium avium subsp. paratuberculosis
ggucaucgggguuuugaucagc

SEQ ID NO: 3012470 - RNA, 10 nt, Mycobacterium avium subsp. paratuberculosis
ggucaucgug

SEQ ID NO: 3012471 - RNA, 18 nt, Mycobacterium avium subsp. paratuberculosis
gguccgcccggaccaggg

SEQ ID NO: 3012472 - RNA, 21 nt, Mycobacterium avium subsp. paratuberculosis
gguccgcccggaccagggugg

SEQ ID NO: 3012473 - RNA, 17 nt, Mycobacterium avium subsp. paratuberculosis
gguccgccgcagcggcg

SEQ ID NO: 3012474 - RNA, 15 nt, Mycobacterium avium subsp. paratuberculosis
gguccgccgccggcg

SEQ ID NO: 3012475 - RNA, 16 nt, Mycobacterium avium subsp. paratuberculosis
gguccgccgggcgcga

SEQ ID NO: 3012476 - RNA, 14 nt, Mycobacterium avium subsp. paratuberculosis
gguccgccggugcc

SEQ ID NO: 3012477 - RNA, 14 nt, Mycobacterium avium subsp. paratuberculosis
gguccgcggugaug

SEQ ID NO: 3012478 - RNA, 15 nt, Mycobacterium avium subsp. paratuberculosis
gguccgcggugaugc

SEQ ID NO: 3012479 - RNA, 14 nt, Mycobacterium avium subsp. paratuberculosis
gguccgcgguggug

SEQ ID NO: 3012480 - RNA, 23 nt, Mycobacterium avium subsp. paratuberculosis
gguccgcgguucgaucuccucgg

SEQ ID NO: 3012481 - RNA, 24 nt, Mycobacterium avium subsp. paratuberculosis
gguccgcgguucgaucuccucggc

SEQ ID NO: 3012482 - RNA, 22 nt, Mycobacterium avium subsp. paratuberculosis
gguccgcgguuuggucagcgcc

SEQ ID NO: 3012483 - RNA, 15 nt, Mycobacterium avium subsp. paratuberculosis
gguccgcuccaccag

SEQ ID NO: 3012484 - RNA, 17 nt, Mycobacterium avium subsp. paratuberculosis
gguccgcuccaccagcg

SEQ ID NO: 3012485 - RNA, 18 nt, Mycobacterium avium subsp. paratuberculosis
gguccgcuccaccagcgc

SEQ ID NO: 3012486 - RNA, 13 nt, Mycobacterium avium subsp. paratuberculosis
gguccggaaccgc

SEQ ID NO: 3012487 - RNA, 20 nt, Mycobacterium avium subsp. paratuberculosis
gguccggaagcccuugcagc

SEQ ID NO: 3012488 - RNA, 15 nt, Mycobacterium avium subsp. paratuberculosis
gguccggcagcgcgc

SEQ ID NO: 3012489 - RNA, 13 nt, Mycobacterium avium subsp. paratuberculosis
gguccggccggcc

SEQ ID NO: 3012490 - RNA, 15 nt, Mycobacterium avium subsp. paratuberculosis
gguccggccggccga

SEQ ID NO: 3012491 - RNA, 14 nt, Mycobacterium avium subsp. paratuberculosis
gguccggcgcccga

SEQ ID NO: 3012492 - RNA, 18 nt, Mycobacterium avium subsp. paratuberculosis
gguccggcgcgaccaggu

SEQ ID NO: 3012493 - RNA, 18 nt, Mycobacterium avium subsp. paratuberculosis
gguccggcggcaccaccc

SEQ ID NO: 3012494 - RNA, 17 nt, Mycobacterium avium subsp. paratuberculosis
gguccggcuggucggcc

SEQ ID NO: 3012495 - RNA, 13 nt, Mycobacterium avium subsp. paratuberculosis
gguccgggcugcg

SEQ ID NO: 3012496 - RNA, 15 nt, Mycobacterium avium subsp. paratuberculosis
gguccgggucgcuga

SEQ ID NO: 3012497 - RNA, 19 nt, Mycobacterium avium subsp. paratuberculosis
gguccggucagcaccgcgc

SEQ ID NO: 3012498 - RNA, 23 nt, Mycobacterium avium subsp. paratuberculosis
gguccggucagcaccgcgcggcg

SEQ ID NO: 3012499 - RNA, 13 nt, Mycobacterium avium subsp. paratuberculosis
gguccgugcacgg

SEQ ID NO: 3012500 - RNA, 16 nt, Mycobacterium avium subsp. paratuberculosis
gguccgugccacggcc

SEQ ID NO: 3012501 - RNA, 19 nt, Mycobacterium avium subsp. paratuberculosis
gguccgugccacggccgcg

SEQ ID NO: 3012502 - RNA, 22 nt, Mycobacterium avium subsp. paratuberculosis
gguccgugccacggccgcggcc

SEQ ID NO: 3012503 - RNA, 14 nt, Mycobacterium avium subsp. paratuberculosis
gguccguggugauc

SEQ ID NO: 3012504 - RNA, 22 nt, Mycobacterium avium subsp. paratuberculosis
gguccguuggaggugaucgcca

SEQ ID NO: 3012505 - RNA, 14 nt, Mycobacterium avium subsp. paratuberculosis
gguccuccagcggc

SEQ ID NO: 3012506 - RNA, 23 nt, Mycobacterium avium subsp. paratuberculosis
gguccuccccgcuggcgccggcg

SEQ ID NO: 3012507 - RNA, 14 nt, Mycobacterium avium subsp. paratuberculosis
gguccucccgggug

SEQ ID NO: 3012508 - RNA, 18 nt, Mycobacterium avium subsp. paratuberculosis
gguccucgaccucuucgg

SEQ ID NO: 3012509 - RNA, 21 nt, Mycobacterium avium subsp. paratuberculosis
gguccucgaccucuucggcgc

SEQ ID NO: 3012510 - RNA, 15 nt, Mycobacterium avium subsp. paratuberculosis
gguccucgaucgaca

SEQ ID NO: 3012511 - RNA, 21 nt, Mycobacterium avium subsp. paratuberculosis
gguccucgaucgacaccucgg

SEQ ID NO: 3012512 - RNA, 14 nt, Mycobacterium avium subsp. paratuberculosis
gguccucgauggcg

SEQ ID NO: 3012513 - RNA, 17 nt, Mycobacterium avium subsp. paratuberculosis
gguccucgauggcggcg

SEQ ID NO: 3012514 - RNA, 19 nt, Mycobacterium avium subsp. paratuberculosis
gguccucgauggcggcggc

SEQ ID NO: 3012515 - RNA, 20 nt, Mycobacterium avium subsp. paratuberculosis
gguccucggacucgucgcug

SEQ ID NO: 3012516 - RNA, 19 nt, Mycobacterium avium subsp. paratuberculosis
gguccucucggcgccgucc

SEQ ID NO: 3012517 - RNA, 21 nt, Mycobacterium avium subsp. paratuberculosis
gguccucugcgaccacccgga

SEQ ID NO: 3012518 - RNA, 14 nt, Mycobacterium avium subsp. paratuberculosis
gguccugcaccgag

SEQ ID NO: 3012519 - RNA, 14 nt, Mycobacterium avium subsp. paratuberculosis
gguccuggcggugg

SEQ ID NO: 3012520 - RNA, 20 nt, Mycobacterium avium subsp. paratuberculosis
gguccuggcgguggcccggu

SEQ ID NO: 3012521 - RNA, 21 nt, Mycobacterium avium subsp. paratuberculosis
gguccuuaaucgggacguuga

SEQ ID NO: 3012522 - RNA, 19 nt, Mycobacterium avium subsp. paratuberculosis
gguccuucucgcacagcac

SEQ ID NO: 3012523 - RNA, 20 nt, Mycobacterium avium subsp. paratuberculosis
gguccuugagguagucgcgc

SEQ ID NO: 3012524 - RNA, 16 nt, Mycobacterium avium subsp. paratuberculosis
gguccuugcccagcag

SEQ ID NO: 3012525 - RNA, 17 nt, Mycobacterium avium subsp. paratuberculosis
gguccuugccggcggcg

SEQ ID NO: 3012526 - RNA, 19 nt, Mycobacterium avium subsp. paratuberculosis
gguccuugccggcggcggg

SEQ ID NO: 3012527 - RNA, 13 nt, Mycobacterium avium subsp. paratuberculosis
gguccuugcgcgc

SEQ ID NO: 3012528 - RNA, 19 nt, Mycobacterium avium subsp. paratuberculosis
gguccuugcggaaccgcug

SEQ ID NO: 3012529 - RNA, 17 nt, Mycobacterium avium subsp. paratuberculosis
ggucgaacaacgcggug

SEQ ID NO: 3012530 - RNA, 16 nt, Mycobacterium avium subsp. paratuberculosis
ggucgaacacggcgcu

SEQ ID NO: 3012531 - RNA, 18 nt, Mycobacterium avium subsp. paratuberculosis
ggucgaacacggcgcuga

SEQ ID NO: 3012532 - RNA, 20 nt, Mycobacterium avium subsp. paratuberculosis
ggucgaacagcacgccggcc

SEQ ID NO: 3012533 - RNA, 19 nt, Mycobacterium avium subsp. paratuberculosis
ggucgaacagcgcgcccga

SEQ ID NO: 3012534 - RNA, 22 nt, Mycobacterium avium subsp. paratuberculosis
ggucgaacagcgcgcccgacgg

SEQ ID NO: 3012535 - RNA, 21 nt, Mycobacterium avium subsp. paratuberculosis
ggucgaacagcucgaccagcc

SEQ ID NO: 3012536 - RNA, 17 nt, Mycobacterium avium subsp. paratuberculosis
ggucgaaccacgcggcg

SEQ ID NO: 3012537 - RNA, 20 nt, Mycobacterium avium subsp. paratuberculosis
ggucgaaccacgcggcggcg

SEQ ID NO: 3012538 - RNA, 18 nt, Mycobacterium avium subsp. paratuberculosis
ggucgaaccgcgagcgcg

SEQ ID NO: 3012539 - RNA, 19 nt, Mycobacterium avium subsp. paratuberculosis
ggucgaaccgcgagcgcgc

SEQ ID NO: 3012540 - RNA, 15 nt, Mycobacterium avium subsp. paratuberculosis
ggucgaacgccagcg

SEQ ID NO: 3012541 - RNA, 18 nt, Mycobacterium avium subsp. paratuberculosis
ggucgaacgccagcgccg

SEQ ID NO: 3012542 - RNA, 14 nt, Mycobacterium avium subsp. paratuberculosis
ggucgaacgcggcg

SEQ ID NO: 3012543 - RNA, 17 nt, Mycobacterium avium subsp. paratuberculosis
ggucgaagaggugcucg

SEQ ID NO: 3012544 - RNA, 20 nt, Mycobacterium avium subsp. paratuberculosis
ggucgaagcccgccgucacg

SEQ ID NO: 3012545 - RNA, 18 nt, Mycobacterium avium subsp. paratuberculosis
ggucgaaggaggccagcu

SEQ ID NO: 3012546 - RNA, 15 nt, Mycobacterium avium subsp. paratuberculosis
ggucgaaggcggccg

SEQ ID NO: 3012547 - RNA, 17 nt, Mycobacterium avium subsp. paratuberculosis
ggucgaaggcggccgcg

SEQ ID NO: 3012548 - RNA, 18 nt, Mycobacterium avium subsp. paratuberculosis
ggucgaaguccugcgccg

SEQ ID NO: 3012549 - RNA, 16 nt, Mycobacterium avium subsp. paratuberculosis
ggucgaagugcucgag

SEQ ID NO: 3012550 - RNA, 18 nt, Mycobacterium avium subsp. paratuberculosis
ggucgacacgaucggcau

SEQ ID NO: 3012551 - RNA, 19 nt, Mycobacterium avium subsp. paratuberculosis
ggucgacacgaucggcaug

SEQ ID NO: 3012552 - RNA, 16 nt, Mycobacterium avium subsp. paratuberculosis
ggucgacagccugacc

SEQ ID NO: 3012553 - RNA, 20 nt, Mycobacterium avium subsp. paratuberculosis
ggucgacagccugaccgcgg

SEQ ID NO: 3012554 - RNA, 13 nt, Mycobacterium avium subsp. paratuberculosis
ggucgaccaagac

SEQ ID NO: 3012555 - RNA, 22 nt, Mycobacterium avium subsp. paratuberculosis
ggucgaccaagacggugggccc

SEQ ID NO: 3012556 - RNA, 19 nt, Mycobacterium avium subsp. paratuberculosis
ggucgccgacguagacgag

SEQ ID NO: 3012557 - RNA, 20 nt, Mycobacterium avium subsp. paratuberculosis
ggucgccgacucgcaggugc

SEQ ID NO: 3012558 - RNA, 10 nt, Mycobacterium avium subsp. paratuberculosis
ggucgccgau

SEQ ID NO: 3012559 - RNA, 12 nt, Mycobacterium avium subsp. paratuberculosis
ggucgccgauca

SEQ ID NO: 3012560 - RNA, 19 nt, Mycobacterium avium subsp. paratuberculosis
ggucgccgauccagccguc

SEQ ID NO: 3012561 - RNA, 18 nt, Mycobacterium avium subsp. paratuberculosis
ggucgccgaucucggcca

SEQ ID NO: 3012562 - RNA, 16 nt, Mycobacterium avium subsp. paratuberculosis
ggucgccgcccacgcc

SEQ ID NO: 3012563 - RNA, 18 nt, Mycobacterium avium subsp. paratuberculosis
ggucgccgcccacgccgu

SEQ ID NO: 3012564 - RNA, 14 nt, Mycobacterium avium subsp. paratuberculosis
ggucgccgcgccgc

SEQ ID NO: 3012565 - RNA, 15 nt, Mycobacterium avium subsp. paratuberculosis
ggucgccgcgccgcc

SEQ ID NO: 3012566 - RNA, 16 nt, Mycobacterium avium subsp. paratuberculosis
ggucgccggcggccga

SEQ ID NO: 3012567 - RNA, 13 nt, Mycobacterium avium subsp. paratuberculosis
ggucgccgggcag

SEQ ID NO: 3012568 - RNA, 15 nt, Mycobacterium avium subsp. paratuberculosis
ggucgccgggccggc

SEQ ID NO: 3012569 - RNA, 17 nt, Mycobacterium avium subsp. paratuberculosis
ggucgccgggccggccg

SEQ ID NO: 3012570 - RNA, 14 nt, Mycobacterium avium subsp. paratuberculosis
ggucgccgguguca

SEQ ID NO: 3012571 - RNA, 20 nt, Mycobacterium avium subsp. paratuberculosis
ggucgccggugugaucgagc

SEQ ID NO: 3012572 - RNA, 15 nt, Mycobacterium avium subsp. paratuberculosis
ggucgccguggccga

SEQ ID NO: 3012573 - RNA, 14 nt, Mycobacterium avium subsp. paratuberculosis
ggucgccuccaggu

SEQ ID NO: 3012574 - RNA, 14 nt, Mycobacterium avium subsp. paratuberculosis
ggucgccugcacga

SEQ ID NO: 3012575 - RNA, 13 nt, Mycobacterium avium subsp. paratuberculosis
ggucgccugcugg

SEQ ID NO: 3012576 - RNA, 20 nt, Mycobacterium avium subsp. paratuberculosis
ggucgccugcuggacguugg

SEQ ID NO: 3012577 - RNA, 16 nt, Mycobacterium avium subsp. paratuberculosis
ggucgcgaagacgcug

SEQ ID NO: 3012578 - RNA, 21 nt, Mycobacterium avium subsp. paratuberculosis
ggucgcgaagcguaugccggu

SEQ ID NO: 3012579 - RNA, 22 nt, Mycobacterium avium subsp. paratuberculosis
ggucgcgaagcguaugccggug

SEQ ID NO: 3012580 - RNA, 14 nt, Mycobacterium avium subsp. paratuberculosis
ggucgcgacccggu

SEQ ID NO: 3012581 - RNA, 20 nt, Mycobacterium avium subsp. paratuberculosis
ggucgcgcagccgggcggcg

SEQ ID NO: 3012582 - RNA, 23 nt, Mycobacterium avium subsp. paratuberculosis
ggucgcgcaucgccucggcggcc

SEQ ID NO: 3012583 - RNA, 20 nt, Mycobacterium avium subsp. paratuberculosis
ggucgcgccagacguccagc

SEQ ID NO: 3012584 - RNA, 22 nt, Mycobacterium avium subsp. paratuberculosis
ggucgcgccagacguccagcgc

SEQ ID NO: 3012585 - RNA, 21 nt, Mycobacterium avium subsp. paratuberculosis
ggucgcgccgaccuggucgcc

SEQ ID NO: 3012586 - RNA, 17 nt, Mycobacterium avium subsp. paratuberculosis
ggucgcgcgccggcgca

SEQ ID NO: 3012587 - RNA, 14 nt, Mycobacterium avium subsp. paratuberculosis
ggucgcgcugcggg

SEQ ID NO: 3012588 - RNA, 15 nt, Mycobacterium avium subsp. paratuberculosis
ggucgcggagcgggu

SEQ ID NO: 3012589 - RNA, 23 nt, Mycobacterium avium subsp. paratuberculosis
ggucgcggauacgcccggccacc

SEQ ID NO: 3012590 - RNA, 22 nt, Mycobacterium avium subsp. paratuberculosis
ggucgcggaucucgucgggcca

SEQ ID NO: 3012591 - RNA, 20 nt, Mycobacterium avium subsp. paratuberculosis
ggucgcggcaucccugguga

SEQ ID NO: 3012592 - RNA, 12 nt, Mycobacterium avium subsp. paratuberculosis
ggucgcggccgu

SEQ ID NO: 3012593 - RNA, 15 nt, Mycobacterium avium subsp. paratuberculosis
ggucgcggcgccggu

SEQ ID NO: 3012594 - RNA, 14 nt, Mycobacterium avium subsp. paratuberculosis
ggucgcggcguugc

SEQ ID NO: 3012595 - RNA, 19 nt, Mycobacterium avium subsp. paratuberculosis
ggucgcggcguugcccgcu

SEQ ID NO: 3012596 - RNA, 15 nt, Mycobacterium avium subsp. paratuberculosis
ggucgcgguagaugu

SEQ ID NO: 3012597 - RNA, 14 nt, Mycobacterium avium subsp. paratuberculosis
ggucgcggugauca

SEQ ID NO: 3012598 - RNA, 16 nt, Mycobacterium avium subsp. paratuberculosis
ggucgcggugcccagc

SEQ ID NO: 3012599 - RNA, 21 nt, Mycobacterium avium subsp. paratuberculosis
ggucgcggugcccagccgcag

SEQ ID NO: 3012600 - RNA, 15 nt, Mycobacterium avium subsp. paratuberculosis
ggucgcggugggcgc

SEQ ID NO: 3012601 - RNA, 21 nt, Mycobacterium avium subsp. paratuberculosis
ggucgcggugggcucggcgcc

SEQ ID NO: 3012602 - RNA, 14 nt, Mycobacterium avium subsp. paratuberculosis
ggucgcggugucgg

SEQ ID NO: 3012603 - RNA, 18 nt, Mycobacterium avium subsp. paratuberculosis
ggucgcggugucggcguc

SEQ ID NO: 3012604 - RNA, 19 nt, Mycobacterium avium subsp. paratuberculosis
ggucgcggugucggcgucg

SEQ ID NO: 3012605 - RNA, 18 nt, Mycobacterium avium subsp. paratuberculosis
ggucgcguagggcagggu

SEQ ID NO: 3012606 - RNA, 14 nt, Mycobacterium avium subsp. paratuberculosis
ggucgcgucgugcg

SEQ ID NO: 3012607 - RNA, 16 nt, Mycobacterium avium subsp. paratuberculosis
ggucgcgucgugcggc

SEQ ID NO: 3012608 - RNA, 17 nt, Mycobacterium avium subsp. paratuberculosis
ggucgcgucgugcggcc

SEQ ID NO: 3012609 - RNA, 16 nt, Mycobacterium avium subsp. paratuberculosis
ggucgcgugaccggcg

SEQ ID NO: 3012610 - RNA, 18 nt, Mycobacterium avium subsp. paratuberculosis
ggucgcgugaccggcggu

SEQ ID NO: 3012611 - RNA, 20 nt, Mycobacterium avium subsp. paratuberculosis
ggucgcguugaaagccgcga

SEQ ID NO: 3012612 - RNA, 21 nt, Mycobacterium avium subsp. paratuberculosis
ggucgcugaccccgcucggcg

SEQ ID NO: 3012613 - RNA, 16 nt, Mycobacterium avium subsp. paratuberculosis
ggucgcugacccgccg

SEQ ID NO: 3012614 - RNA, 14 nt, Mycobacterium avium subsp. paratuberculosis
ggucgcugacgaug

SEQ ID NO: 3012615 - RNA, 16 nt, Mycobacterium avium subsp. paratuberculosis
ggucgcugcagcggcg

SEQ ID NO: 3012616 - RNA, 22 nt, Mycobacterium avium subsp. paratuberculosis
ggucgcugcagcggcggccagu

SEQ ID NO: 3012617 - RNA, 15 nt, Mycobacterium avium subsp. paratuberculosis
ggucgcugcccggcg

SEQ ID NO: 3012618 - RNA, 23 nt, Mycobacterium avium subsp. paratuberculosis
ggucgcugcgaugauggucaccg

SEQ ID NO: 3012619 - RNA, 18 nt, Mycobacterium avium subsp. paratuberculosis
ggucgcugugcagcgggu

SEQ ID NO: 3012620 - RNA, 18 nt, Mycobacterium avium subsp. paratuberculosis
ggucggaaaaguggguca

SEQ ID NO: 3012621 - RNA, 13 nt, Mycobacterium avium subsp. paratuberculosis
ggucggacgccuc

SEQ ID NO: 3012622 - RNA, 22 nt, Mycobacterium avium subsp. paratuberculosis
ggucggacgccucccccacccg

SEQ ID NO: 3012623 - RNA, 21 nt, Mycobacterium avium subsp. paratuberculosis
ggucggaggccuuggugaugg

SEQ ID NO: 3012624 - RNA, 15 nt, Mycobacterium avium subsp. paratuberculosis
ggucggaguccagca

SEQ ID NO: 3012625 - RNA, 17 nt, Mycobacterium avium subsp. paratuberculosis
ggucggaucgagcucgc

SEQ ID NO: 3012626 - RNA, 15 nt, Mycobacterium avium subsp. paratuberculosis
ggucggcaacccgac

SEQ ID NO: 3012627 - RNA, 23 nt, Mycobacterium avium subsp. paratuberculosis
ggucggcaacccgaccucgucga

SEQ ID NO: 3012628 - RNA, 17 nt, Mycobacterium avium subsp. paratuberculosis
ggucggcagcaccggca

SEQ ID NO: 3012629 - RNA, 18 nt, Mycobacterium avium subsp. paratuberculosis
ggucggcagcaccggcag

SEQ ID NO: 3012630 - RNA, 20 nt, Mycobacterium avium subsp. paratuberculosis
ggucggcagcaccggcagca

SEQ ID NO: 3012631 - RNA, 24 nt, Mycobacterium avium subsp. paratuberculosis
ggucggcauagcgccgcucggccg

SEQ ID NO: 3012632 - RNA, 15 nt, Mycobacterium avium subsp. paratuberculosis
ggucggccacgacgc

SEQ ID NO: 3012633 - RNA, 14 nt, Mycobacterium avium subsp. paratuberculosis
ggucggccagcagg

SEQ ID NO: 3012634 - RNA, 14 nt, Mycobacterium avium subsp. paratuberculosis
ggucggccagcgcc

SEQ ID NO: 3012635 - RNA, 15 nt, Mycobacterium avium subsp. paratuberculosis
ggucggccagcgccg

SEQ ID NO: 3012636 - RNA, 17 nt, Mycobacterium avium subsp. paratuberculosis
ggucggccagcgccgcc

SEQ ID NO: 3012637 - RNA, 21 nt, Mycobacterium avium subsp. paratuberculosis
ggucggccagcgccgcccggg

SEQ ID NO: 3012638 - RNA, 12 nt, Mycobacterium avium subsp. paratuberculosis
ggucggccagcu

SEQ ID NO: 3012639 - RNA, 15 nt, Mycobacterium avium subsp. paratuberculosis
ggucggccagcugcg

SEQ ID NO: 3012640 - RNA, 17 nt, Mycobacterium avium subsp. paratuberculosis
ggucggccagcugcggg

SEQ ID NO: 3012641 - RNA, 20 nt, Mycobacterium avium subsp. paratuberculosis
ggucgucgacgagcccgccg

SEQ ID NO: 3012642 - RNA, 14 nt, Mycobacterium avium subsp. paratuberculosis
ggucgucgacggcc

SEQ ID NO: 3012643 - RNA, 14 nt, Mycobacterium avium subsp. paratuberculosis
ggucgucgacgucg

SEQ ID NO: 3012644 - RNA, 19 nt, Mycobacterium avium subsp. paratuberculosis
ggucgucgagcaccggcug

SEQ ID NO: 3012645 - RNA, 20 nt, Mycobacterium avium subsp. paratuberculosis
ggucgucgagcaccggcugg

SEQ ID NO: 3012646 - RNA, 15 nt, Mycobacterium avium subsp. paratuberculosis
ggucgucgagggcca

SEQ ID NO: 3012647 - RNA, 18 nt, Mycobacterium avium subsp. paratuberculosis
ggucgucgagggccaccg

SEQ ID NO: 3012648 - RNA, 15 nt, Mycobacterium avium subsp. paratuberculosis
ggucgucgcccaccg

SEQ ID NO: 3012649 - RNA, 13 nt, Mycobacterium avium subsp. paratuberculosis
ggucgucgcccgu

SEQ ID NO: 3012650 - RNA, 20 nt, Mycobacterium avium subsp. paratuberculosis
ggucgucgcccgucucggcg

SEQ ID NO: 3012651 - RNA, 12 nt, Mycobacterium avium subsp. paratuberculosis
ggucgucgccgg

SEQ ID NO: 3012652 - RNA, 13 nt, Mycobacterium avium subsp. paratuberculosis
ggucgucgcggcc

SEQ ID NO: 3012653 - RNA, 14 nt, Mycobacterium avium subsp. paratuberculosis
ggucgucgcggcca

SEQ ID NO: 3012654 - RNA, 17 nt, Mycobacterium avium subsp. paratuberculosis
ggucgucgcggccaacg

SEQ ID NO: 3012655 - RNA, 15 nt, Mycobacterium avium subsp. paratuberculosis
ggucgucgcggucca

SEQ ID NO: 3012656 - RNA, 19 nt, Mycobacterium avium subsp. paratuberculosis
ggucgucgcguccagcaug

SEQ ID NO: 3012657 - RNA, 14 nt, Mycobacterium avium subsp. paratuberculosis
ggucgucggccagu

SEQ ID NO: 3012658 - RNA, 16 nt, Mycobacterium avium subsp. paratuberculosis
ggucgucgggccgggg

SEQ ID NO: 3012659 - RNA, 17 nt, Mycobacterium avium subsp. paratuberculosis
ggucgucgggccgggga

SEQ ID NO: 3012660 - RNA, 22 nt, Mycobacterium avium subsp. paratuberculosis
ggucgucggguuggccagggcg

SEQ ID NO: 3012661 - RNA, 15 nt, Mycobacterium avium subsp. paratuberculosis
ggucgucggugccga

SEQ ID NO: 3012662 - RNA, 16 nt, Mycobacterium avium subsp. paratuberculosis
ggucgucgucgucggu

SEQ ID NO: 3012663 - RNA, 18 nt, Mycobacterium avium subsp. paratuberculosis
ggucgucgucgucgguga

SEQ ID NO: 3012664 - RNA, 20 nt, Mycobacterium avium subsp. paratuberculosis
ggucgucgucgucggugaug

SEQ ID NO: 3012665 - RNA, 21 nt, Mycobacterium avium subsp. paratuberculosis
ggucgucuucuuggccgcggc

SEQ ID NO: 3012666 - RNA, 19 nt, Mycobacterium avium subsp. paratuberculosis
ggucgugcagcaccgccag

SEQ ID NO: 3012667 - RNA, 19 nt, Mycobacterium avium subsp. paratuberculosis
ggucgugcggcggcggugc

SEQ ID NO: 3012668 - RNA, 19 nt, Mycobacterium avium subsp. paratuberculosis
ggucgugcugggccgggcg

SEQ ID NO: 3012669 - RNA, 14 nt, Mycobacterium avium subsp. paratuberculosis
ggucguggcgccga

SEQ ID NO: 3012670 - RNA, 16 nt, Mycobacterium avium subsp. paratuberculosis
ggucguggcgccgagg

SEQ ID NO: 3012671 - RNA, 15 nt, Mycobacterium avium subsp. paratuberculosis
ggucgugucagggau

SEQ ID NO: 3012672 - RNA, 15 nt, Mycobacterium avium subsp. paratuberculosis
ggucguugcacaccc

SEQ ID NO: 3012673 - RNA, 20 nt, Mycobacterium avium subsp. paratuberculosis
ggucguugcacacccggugc

SEQ ID NO: 3012674 - RNA, 14 nt, Mycobacterium avium subsp. paratuberculosis
ggucguugccggug

SEQ ID NO: 3012675 - RNA, 17 nt, Mycobacterium avium subsp. paratuberculosis
ggucguuggcggcggug

SEQ ID NO: 3012676 - RNA, 18 nt, Mycobacterium avium subsp. paratuberculosis
ggucguuggcggcggugg

SEQ ID NO: 3012677 - RNA, 20 nt, Mycobacterium avium subsp. paratuberculosis
ggucguuguuguugccgguc

SEQ ID NO: 3012678 - RNA, 16 nt, Mycobacterium avium subsp. paratuberculosis
ggucguuucggccggc

SEQ ID NO: 3012679 - RNA, 19 nt, Mycobacterium avium subsp. paratuberculosis
ggucguuucggccggcccc

SEQ ID NO: 3012680 - RNA, 18 nt, Mycobacterium avium subsp. paratuberculosis
ggucguuuggugguggcg

SEQ ID NO: 3012681 - RNA, 21 nt, Mycobacterium avium subsp. paratuberculosis
ggucguuuggugguggcgugg

SEQ ID NO: 3012682 - RNA, 18 nt, Mycobacterium avium subsp. paratuberculosis
ggucuagaucuccaggcu

SEQ ID NO: 3012683 - RNA, 20 nt, Mycobacterium avium subsp. paratuberculosis
ggucucagcgcccgcccggc

SEQ ID NO: 3012684 - RNA, 18 nt, Mycobacterium avium subsp. paratuberculosis
ggucucaucccgccgacc

SEQ ID NO: 3012685 - RNA, 19 nt, Mycobacterium avium subsp. paratuberculosis
ggucucaucccgccgaccc

SEQ ID NO: 3012686 - RNA, 16 nt, Mycobacterium avium subsp. paratuberculosis
ggucuccaugucgucg

SEQ ID NO: 3012687 - RNA, 21 nt, Mycobacterium avium subsp. paratuberculosis
ggucuccgggcugugggcgca

SEQ ID NO: 3012688 - RNA, 20 nt, Mycobacterium avium subsp. paratuberculosis
ggucuccguagcccugcagg

SEQ ID NO: 3012689 - RNA, 15 nt, Mycobacterium avium subsp. paratuberculosis
ggucuccgucggcgc

SEQ ID NO: 3012690 - RNA, 23 nt, Mycobacterium avium subsp. paratuberculosis
ggucuccuccaggaaacggccca

SEQ ID NO: 3012691 - RNA, 15 nt, Mycobacterium avium subsp. paratuberculosis
ggucuccuggccgcc

SEQ ID NO: 3012692 - RNA, 16 nt, Mycobacterium avium subsp. paratuberculosis
ggucuccuggccgccg

SEQ ID NO: 3012693 - RNA, 15 nt, Mycobacterium avium subsp. paratuberculosis
ggucucgaaccgggc

SEQ ID NO: 3012694 - RNA, 16 nt, Mycobacterium avium subsp. paratuberculosis
ggucucgacaccggcg

SEQ ID NO: 3012695 - RNA, 14 nt, Mycobacterium avium subsp. paratuberculosis
ggucucgacguugg

SEQ ID NO: 3012696 - RNA, 13 nt, Mycobacterium avium subsp. paratuberculosis
ggucucgaucgag

SEQ ID NO: 3012697 - RNA, 16 nt, Mycobacterium avium subsp. paratuberculosis
ggucucgaucugcacc

SEQ ID NO: 3012698 - RNA, 18 nt, Mycobacterium avium subsp. paratuberculosis
ggucucgaucugcaccag

SEQ ID NO: 3012699 - RNA, 21 nt, Mycobacterium avium subsp. paratuberculosis
ggucucgaucugcaccagcgc

SEQ ID NO: 3012700 - RNA, 23 nt, Mycobacterium avium subsp. paratuberculosis
ggucucgcccaccuuggcgucga

SEQ ID NO: 3012701 - RNA, 13 nt, Mycobacterium avium subsp. paratuberculosis
ggucucgcgcagc

SEQ ID NO: 3012702 - RNA, 16 nt, Mycobacterium avium subsp. paratuberculosis
ggucucggcgaggcgc

SEQ ID NO: 3012703 - RNA, 13 nt, Mycobacterium avium subsp. paratuberculosis
ggucucggcggcg

SEQ ID NO: 3012704 - RNA, 17 nt, Mycobacterium avium subsp. paratuberculosis
ggucucgggaucgccga

SEQ ID NO: 3012705 - RNA, 14 nt, Mycobacterium avium subsp. paratuberculosis
ggucucgggcacca

SEQ ID NO: 3012706 - RNA, 17 nt, Mycobacterium avium subsp. paratuberculosis
ggucucgggcaccacgc

SEQ ID NO: 3012707 - RNA, 21 nt, Mycobacterium avium subsp. paratuberculosis
ggucucgggcagcagcaccag

SEQ ID NO: 3012708 - RNA, 19 nt, Mycobacterium avium subsp. paratuberculosis
ggucucguacaaggugaug

SEQ ID NO: 3012709 - RNA, 20 nt, Mycobacterium avium subsp. paratuberculosis
ggucucguacaaggugaugg

SEQ ID NO: 3012710 - RNA, 21 nt, Mycobacterium avium subsp. paratuberculosis
ggucugaaagugacggguugg

SEQ ID NO: 3012711 - RNA, 14 nt, Mycobacterium avium subsp. paratuberculosis
ggucugcaccggga

SEQ ID NO: 3012712 - RNA, 14 nt, Mycobacterium avium subsp. paratuberculosis
ggucugcagcagcc

SEQ ID NO: 3012713 - RNA, 16 nt, Mycobacterium avium subsp. paratuberculosis
ggucugcagcagccgc

SEQ ID NO: 3012714 - RNA, 15 nt, Mycobacterium avium subsp. paratuberculosis
ggucugcagcgacgg

SEQ ID NO: 3012715 - RNA, 23 nt, Mycobacterium avium subsp. paratuberculosis
ggucugcagcgacggaucggccg

SEQ ID NO: 3012716 - RNA, 13 nt, Mycobacterium avium subsp. paratuberculosis
ggucugccacgcc

SEQ ID NO: 3012717 - RNA, 21 nt, Mycobacterium avium subsp. paratuberculosis
ggucugccacgcccaccggug

SEQ ID NO: 3012718 - RNA, 22 nt, Mycobacterium avium subsp. paratuberculosis
ggucugccagaacggcggcagc

SEQ ID NO: 3012719 - RNA, 16 nt, Mycobacterium avium subsp. paratuberculosis
ggucugcccgccgccg

SEQ ID NO: 3012720 - RNA, 17 nt, Mycobacterium avium subsp. paratuberculosis
ggucugcccgccgccga

SEQ ID NO: 3012721 - RNA, 23 nt, Mycobacterium avium subsp. paratuberculosis
ggucugcccgccgccgaugcuga

SEQ ID NO: 3012722 - RNA, 14 nt, Mycobacterium avium subsp. paratuberculosis
ggucugcgccggcg

SEQ ID NO: 3012723 - RNA, 17 nt, Mycobacterium avium subsp. paratuberculosis
ggucugcgccggcggug

SEQ ID NO: 3012724 - RNA, 17 nt, Mycobacterium avium subsp. paratuberculosis
ggucugcgcgagcagau

SEQ ID NO: 3012725 - RNA, 19 nt, Mycobacterium avium subsp. paratuberculosis
ggucugcggccgcgacugc

SEQ ID NO: 3012726 - RNA, 20 nt, Mycobacterium avium subsp. paratuberculosis
ggugaccgucgccgaccagc

SEQ ID NO: 3012727 - RNA, 14 nt, Mycobacterium avium subsp. paratuberculosis
ggugaccucccgga

SEQ ID NO: 3012728 - RNA, 16 nt, Mycobacterium avium subsp. paratuberculosis
ggugaccucccggaca

SEQ ID NO: 3012729 - RNA, 20 nt, Mycobacterium avium subsp. paratuberculosis
ggugaccucgagcaccggcg

SEQ ID NO: 3012730 - RNA, 24 nt, Mycobacterium avium subsp. paratuberculosis
ggugaccucgagcaccggcggcag

SEQ ID NO: 3012731 - RNA, 18 nt, Mycobacterium avium subsp. paratuberculosis
ggugaccucgagcagcgc

SEQ ID NO: 3012732 - RNA, 20 nt, Mycobacterium avium subsp. paratuberculosis
ggugaccucgagcagcgcgc

SEQ ID NO: 3012733 - RNA, 14 nt, Mycobacterium avium subsp. paratuberculosis
ggugaccugcagcg

SEQ ID NO: 3012734 - RNA, 13 nt, Mycobacterium avium subsp. paratuberculosis
ggugaccugcgga

SEQ ID NO: 3012735 - RNA, 19 nt, Mycobacterium avium subsp. paratuberculosis
ggugacgaacccgccgcgg

SEQ ID NO: 3012736 - RNA, 13 nt, Mycobacterium avium subsp. paratuberculosis
ggugacgaccggc

SEQ ID NO: 3012737 - RNA, 13 nt, Mycobacterium avium subsp. paratuberculosis
ggugacgacgcuc

SEQ ID NO: 3012738 - RNA, 19 nt, Mycobacterium avium subsp. paratuberculosis
ggugacgauccggucgaug

SEQ ID NO: 3012739 - RNA, 12 nt, Mycobacterium avium subsp. paratuberculosis
ggugacgaucug

SEQ ID NO: 3012740 - RNA, 22 nt, Mycobacterium avium subsp. paratuberculosis
ggugacgaugaugucggccggc

SEQ ID NO: 3012741 - RNA, 17 nt, Mycobacterium avium subsp. paratuberculosis
ggugacgaugucgauga

SEQ ID NO: 3012742 - RNA, 13 nt, Mycobacterium avium subsp. paratuberculosis
ggugacgcccguc

SEQ ID NO: 3012743 - RNA, 19 nt, Mycobacterium avium subsp. paratuberculosis
ggugacgcccgucccgccg

SEQ ID NO: 3012744 - RNA, 22 nt, Mycobacterium avium subsp. paratuberculosis
ggugacgcgaaugucgaccacc

SEQ ID NO: 3012745 - RNA, 22 nt, Mycobacterium avium subsp. paratuberculosis
ggugacggauguggucggccac

SEQ ID NO: 3012746 - RNA, 23 nt, Mycobacterium avium subsp. paratuberculosis
ggugacggauguggucggccacg

SEQ ID NO: 3012747 - RNA, 21 nt, Mycobacterium avium subsp. paratuberculosis
ggugacggccgugaugccggg

SEQ ID NO: 3012748 - RNA, 23 nt, Mycobacterium avium subsp. paratuberculosis
ggugacggccgugaugccgggca

SEQ ID NO: 3012749 - RNA, 13 nt, Mycobacterium avium subsp. paratuberculosis
ggugacggccucc

SEQ ID NO: 3012750 - RNA, 23 nt, Mycobacterium avium subsp. paratuberculosis
ggugacggccucccacucgucga

SEQ ID NO: 3012751 - RNA, 14 nt, Mycobacterium avium subsp. paratuberculosis
ggugacgggcgucg

SEQ ID NO: 3012752 - RNA, 18 nt, Mycobacterium avium subsp. paratuberculosis
ggugacgggcgucggcgg

SEQ ID NO: 3012753 - RNA, 19 nt, Mycobacterium avium subsp. paratuberculosis
ggugacggucaugccgagc

SEQ ID NO: 3012754 - RNA, 22 nt, Mycobacterium avium subsp. paratuberculosis
ggugacggugaacuucaccguc

SEQ ID NO: 3012755 - RNA, 17 nt, Mycobacterium avium subsp. paratuberculosis
ggugacggugccgccgu

SEQ ID NO: 3012756 - RNA, 21 nt, Mycobacterium avium subsp. paratuberculosis
ggugacggugccgccgugcgc

SEQ ID NO: 3012757 - RNA, 16 nt, Mycobacterium avium subsp. paratuberculosis
ggugacgguggcgucc

SEQ ID NO: 3012758 - RNA, 20 nt, Mycobacterium avium subsp. paratuberculosis
ggugacgguggcguccucga

SEQ ID NO: 3012759 - RNA, 23 nt, Mycobacterium avium subsp. paratuberculosis
ggugacgguuucggaguggaaca

SEQ ID NO: 3012760 - RNA, 17 nt, Mycobacterium avium subsp. paratuberculosis
ggugacguacgggcuga

SEQ ID NO: 3012761 - RNA, 15 nt, Mycobacterium avium subsp. paratuberculosis
ggugacgucgccgau

SEQ ID NO: 3012762 - RNA, 17 nt, Mycobacterium avium subsp. paratuberculosis
ggugacgugcaccugca

SEQ ID NO: 3012763 - RNA, 19 nt, Mycobacterium avium subsp. paratuberculosis
ggugacgugcaccugcagc

SEQ ID NO: 3012764 - RNA, 22 nt, Mycobacterium avium subsp. paratuberculosis
ggugacgugcaccugcagccgg

SEQ ID NO: 3012765 - RNA, 24 nt, Mycobacterium avium subsp. paratuberculosis
ggugacgugcaccugcagccgguc

SEQ ID NO: 3012766 - RNA, 19 nt, Mycobacterium avium subsp. paratuberculosis
ggugacguggcggccgucg

SEQ ID NO: 3012767 - RNA, 20 nt, Mycobacterium avium subsp. paratuberculosis
ggugacuccuccucggccag

SEQ ID NO: 3012768 - RNA, 16 nt, Mycobacterium avium subsp. paratuberculosis
ggugacuucgagccgg

SEQ ID NO: 3012769 - RNA, 22 nt, Mycobacterium avium subsp. paratuberculosis
ggugacuucgagccgggcgcgg

SEQ ID NO: 3012770 - RNA, 23 nt, Mycobacterium avium subsp. paratuberculosis
ggugagaaaagcgaccagcgcgc

SEQ ID NO: 3012771 - RNA, 17 nt, Mycobacterium avium subsp. paratuberculosis
ggugagaaagucgaucu

SEQ ID NO: 3012772 - RNA, 14 nt, Mycobacterium avium subsp. paratuberculosis
ggugagacggccag

SEQ ID NO: 3012773 - RNA, 18 nt, Mycobacterium avium subsp. paratuberculosis
ggugagacggccagcagc

SEQ ID NO: 3012774 - RNA, 17 nt, Mycobacterium avium subsp. paratuberculosis
ggugagcaacaccggca

SEQ ID NO: 3012775 - RNA, 20 nt, Mycobacterium avium subsp. paratuberculosis
ggugagcaacaccggcacga

SEQ ID NO: 3012776 - RNA, 17 nt, Mycobacterium avium subsp. paratuberculosis
ggugagcaacgccagcg

SEQ ID NO: 3012777 - RNA, 13 nt, Mycobacterium avium subsp. paratuberculosis
ggugagcaccgcg

SEQ ID NO: 3012778 - RNA, 14 nt, Mycobacterium avium subsp. paratuberculosis
ggugagcaccgcga

SEQ ID NO: 3012779 - RNA, 15 nt, Mycobacterium avium subsp. paratuberculosis
ggugagcaccgcgau

SEQ ID NO: 3012780 - RNA, 15 nt, Mycobacterium avium subsp. paratuberculosis
ggugagcaccgggaa

SEQ ID NO: 3012781 - RNA, 20 nt, Mycobacterium avium subsp. paratuberculosis
ggugagcagcaugccgagca

SEQ ID NO: 3012782 - RNA, 22 nt, Mycobacterium avium subsp. paratuberculosis
ggugagcagcaugccgagcacc

SEQ ID NO: 3012783 - RNA, 22 nt, Mycobacterium avium subsp. paratuberculosis
ggugagcagcucggucaccagc

SEQ ID NO: 3012784 - RNA, 23 nt, Mycobacterium avium subsp. paratuberculosis
ggugagcagcucggucaccagcg

SEQ ID NO: 3012785 - RNA, 18 nt, Mycobacterium avium subsp. paratuberculosis
ggugagcagggccagcgg

SEQ ID NO: 3012786 - RNA, 13 nt, Mycobacterium avium subsp. paratuberculosis
ggugagcaucggg

SEQ ID NO: 3012787 - RNA, 21 nt, Mycobacterium avium subsp. paratuberculosis
ggugagccaguucgccagcau

SEQ ID NO: 3012788 - RNA, 18 nt, Mycobacterium avium subsp. paratuberculosis
ggugagcccgaugcuggc

SEQ ID NO: 3012789 - RNA, 14 nt, Mycobacterium avium subsp. paratuberculosis
ggugagccgccaca

SEQ ID NO: 3012790 - RNA, 14 nt, Mycobacterium avium subsp. paratuberculosis
ggugagccgggugc

SEQ ID NO: 3012791 - RNA, 19 nt, Mycobacterium avium subsp. paratuberculosis
ggugagccgggugcccgcg

SEQ ID NO: 3012792 - RNA, 23 nt, Mycobacterium avium subsp. paratuberculosis
ggugagcgacaccaggucgaggu

SEQ ID NO: 3012793 - RNA, 12 nt, Mycobacterium avium subsp. paratuberculosis
ggugagcgccac

SEQ ID NO: 3012794 - RNA, 16 nt, Mycobacterium avium subsp. paratuberculosis
ggugagcgcgccggcc

SEQ ID NO: 3012795 - RNA, 21 nt, Mycobacterium avium subsp. paratuberculosis
ggugagcgcgucgagcaccug

SEQ ID NO: 3012796 - RNA, 16 nt, Mycobacterium avium subsp. paratuberculosis
ggugagcggcgcgucc

SEQ ID NO: 3012797 - RNA, 19 nt, Mycobacterium avium subsp. paratuberculosis
ggugagcuaucagcucgcg

SEQ ID NO: 3012798 - RNA, 17 nt, Mycobacterium avium subsp. paratuberculosis
ggugaggacaccacgau

SEQ ID NO: 3012799 - RNA, 15 nt, Mycobacterium avium subsp. paratuberculosis
ggugaggacgcccgg

SEQ ID NO: 3012800 - RNA, 16 nt, Mycobacterium avium subsp. paratuberculosis
ggugaggacgcccggc

SEQ ID NO: 3012801 - RNA, 23 nt, Mycobacterium avium subsp. paratuberculosis
ggugaggccaggcguuuggugug

SEQ ID NO: 3012802 - RNA, 18 nt, Mycobacterium avium subsp. paratuberculosis
ggugaggggcgcgcgccg

SEQ ID NO: 3012803 - RNA, 13 nt, Mycobacterium avium subsp. paratuberculosis
ggugaggucgcgc

SEQ ID NO: 3012804 - RNA, 16 nt, Mycobacterium avium subsp. paratuberculosis
ggugaguucgucggcg

SEQ ID NO: 3012805 - RNA, 18 nt, Mycobacterium avium subsp. paratuberculosis
ggugaguucgucggcgau

SEQ ID NO: 3012806 - RNA, 22 nt, Mycobacterium avium subsp. paratuberculosis
ggugauagaucaucccggccac

SEQ ID NO: 3012807 - RNA, 23 nt, Mycobacterium avium subsp. paratuberculosis
ggugauagaucaucccggccacc

SEQ ID NO: 3012808 - RNA, 19 nt, Mycobacterium avium subsp. paratuberculosis
ggugaucaaagccgguggc

SEQ ID NO: 3012809 - RNA, 22 nt, Mycobacterium avium subsp. paratuberculosis
ggugaucaaagccgguggcagc

SEQ ID NO: 3012810 - RNA, 13 nt, Mycobacterium avium subsp. paratuberculosis
ggugcacccgcgg

SEQ ID NO: 3012811 - RNA, 14 nt, Mycobacterium avium subsp. paratuberculosis
ggugcacccgcggc

SEQ ID NO: 3012812 - RNA, 14 nt, Mycobacterium avium subsp. paratuberculosis
ggugcaccgccagc

SEQ ID NO: 3012813 - RNA, 20 nt, Mycobacterium avium subsp. paratuberculosis
ggugcaccgccagcgcggcg

SEQ ID NO: 3012814 - RNA, 22 nt, Mycobacterium avium subsp. paratuberculosis
ggugcaccgccagcgcggcggc

SEQ ID NO: 3012815 - RNA, 16 nt, Mycobacterium avium subsp. paratuberculosis
ggugcaccgcgcgcac

SEQ ID NO: 3012816 - RNA, 20 nt, Mycobacterium avium subsp. paratuberculosis
ggugcaccgcgcgcaccacg

SEQ ID NO: 3012817 - RNA, 16 nt, Mycobacterium avium subsp. paratuberculosis
ggugcaccgcggcgcg

SEQ ID NO: 3012818 - RNA, 17 nt, Mycobacterium avium subsp. paratuberculosis
ggugcaccgcggcgcgc

SEQ ID NO: 3012819 - RNA, 14 nt, Mycobacterium avium subsp. paratuberculosis
ggugcacgcccaga

SEQ ID NO: 3012820 - RNA, 15 nt, Mycobacterium avium subsp. paratuberculosis
ggugcacgccgagca

SEQ ID NO: 3012821 - RNA, 17 nt, Mycobacterium avium subsp. paratuberculosis
ggugcacgccgagcagc

SEQ ID NO: 3012822 - RNA, 15 nt, Mycobacterium avium subsp. paratuberculosis
ggugcacggcgccac

SEQ ID NO: 3012823 - RNA, 20 nt, Mycobacterium avium subsp. paratuberculosis
ggugcacggcgccaccagcc

SEQ ID NO: 3012824 - RNA, 19 nt, Mycobacterium avium subsp. paratuberculosis
ggugcacggucagcucgcg

SEQ ID NO: 3012825 - RNA, 16 nt, Mycobacterium avium subsp. paratuberculosis
ggugcagaccccggcg

SEQ ID NO: 3012826 - RNA, 18 nt, Mycobacterium avium subsp. paratuberculosis
ggugcagaccggacagcu

SEQ ID NO: 3012827 - RNA, 24 nt, Mycobacterium avium subsp. paratuberculosis
ggugcagaccggacagcugggcgu

SEQ ID NO: 3012828 - RNA, 20 nt, Mycobacterium avium subsp. paratuberculosis
ggugcagacgugacgugccc

SEQ ID NO: 3012829 - RNA, 16 nt, Mycobacterium avium subsp. paratuberculosis
ggugcagauagguggu

SEQ ID NO: 3012830 - RNA, 18 nt, Mycobacterium avium subsp. paratuberculosis
ggugcagcacgugcgcgg

SEQ ID NO: 3012831 - RNA, 22 nt, Mycobacterium avium subsp. paratuberculosis
ggugcagcagcagccacgccag

SEQ ID NO: 3012832 - RNA, 14 nt, Mycobacterium avium subsp. paratuberculosis
ggugcagcagcgcc

SEQ ID NO: 3012833 - RNA, 13 nt, Mycobacterium avium subsp. paratuberculosis
ggugcagcagcug

SEQ ID NO: 3012834 - RNA, 16 nt, Mycobacterium avium subsp. paratuberculosis
ggugcagcagggcgcg

SEQ ID NO: 3012835 - RNA, 12 nt, Mycobacterium avium subsp. paratuberculosis
ggugcagccccg

SEQ ID NO: 3012836 - RNA, 13 nt, Mycobacterium avium subsp. paratuberculosis
ggugcagccgggg

SEQ ID NO: 3012837 - RNA, 18 nt, Mycobacterium avium subsp. paratuberculosis
ggugcagccgggugcggu

SEQ ID NO: 3012838 - RNA, 22 nt, Mycobacterium avium subsp. paratuberculosis
ggugcagcgacucguuggccgg

SEQ ID NO: 3012839 - RNA, 14 nt, Mycobacterium avium subsp. paratuberculosis
ggugcaggcccagc

SEQ ID NO: 3012840 - RNA, 16 nt, Mycobacterium avium subsp. paratuberculosis
ggugcaggcccagcug

SEQ ID NO: 3012841 - RNA, 20 nt, Mycobacterium avium subsp. paratuberculosis
ggugcaggcccgggcggcga

SEQ ID NO: 3012842 - RNA, 22 nt, Mycobacterium avium subsp. paratuberculosis
ggugcaggcccgggcggcgagu

SEQ ID NO: 3012843 - RNA, 24 nt, Mycobacterium avium subsp. paratuberculosis
ggugcaggcgaaggugggcagcgc

SEQ ID NO: 3012844 - RNA, 15 nt, Mycobacterium avium subsp. paratuberculosis
ggugcagggucagca

SEQ ID NO: 3012845 - RNA, 18 nt, Mycobacterium avium subsp. paratuberculosis
ggugcagggucagcagca

SEQ ID NO: 3012846 - RNA, 19 nt, Mycobacterium avium subsp. paratuberculosis
ggugcagggucagcagcac

SEQ ID NO: 3012847 - RNA, 22 nt, Mycobacterium avium subsp. paratuberculosis
ggugcagggucagcagcacccg

SEQ ID NO: 3012848 - RNA, 16 nt, Mycobacterium avium subsp. paratuberculosis
ggugcaggugcccguc

SEQ ID NO: 3012849 - RNA, 17 nt, Mycobacterium avium subsp. paratuberculosis
ggugcaggugcccgucg

SEQ ID NO: 3012850 - RNA, 20 nt, Mycobacterium avium subsp. paratuberculosis
ggugcaggugcccgucggcc

SEQ ID NO: 3012851 - RNA, 18 nt, Mycobacterium avium subsp. paratuberculosis
ggugcaucgaccggcgga

SEQ ID NO: 3012852 - RNA, 19 nt, Mycobacterium avium subsp. paratuberculosis
ggugcaucgucgcggcggu

SEQ ID NO: 3012853 - RNA, 21 nt, Mycobacterium avium subsp. paratuberculosis
ggugcaucgucgcggcgguca

SEQ ID NO: 3012854 - RNA, 23 nt, Mycobacterium avium subsp. paratuberculosis
ggugccaaugaaauucaggccac

SEQ ID NO: 3012855 - RNA, 15 nt, Mycobacterium avium subsp. paratuberculosis
ggugccacgaugaug

SEQ ID NO: 3012856 - RNA, 15 nt, Mycobacterium avium subsp. paratuberculosis
ggugccacggucagg

SEQ ID NO: 3012857 - RNA, 20 nt, Mycobacterium avium subsp. paratuberculosis
ggugccagccgugcggcggc

SEQ ID NO: 3012858 - RNA, 17 nt, Mycobacterium avium subsp. paratuberculosis
ggugccaucgugggcgc

SEQ ID NO: 3012859 - RNA, 18 nt, Mycobacterium avium subsp. paratuberculosis
ggugccaucgugggcgcc

SEQ ID NO: 3012860 - RNA, 15 nt, Mycobacterium avium subsp. paratuberculosis
ggugccaugccgggu

SEQ ID NO: 3012861 - RNA, 13 nt, Mycobacterium avium subsp. paratuberculosis
ggugcccaccggg

SEQ ID NO: 3012862 - RNA, 19 nt, Mycobacterium avium subsp. paratuberculosis
ggugcccaccgggcagccg

SEQ ID NO: 3012863 - RNA, 17 nt, Mycobacterium avium subsp. paratuberculosis
ggugcccagcaccgccg

SEQ ID NO: 3012864 - RNA, 14 nt, Mycobacterium avium subsp. paratuberculosis
ggugcccagccgca

SEQ ID NO: 3012865 - RNA, 15 nt, Mycobacterium avium subsp. paratuberculosis
ggugcccagccgcag

SEQ ID NO: 3012866 - RNA, 22 nt, Mycobacterium avium subsp. paratuberculosis
ggugcccagccgcaggugcagc

SEQ ID NO: 3012867 - RNA, 13 nt, Mycobacterium avium subsp. paratuberculosis
ggugcccagcgcg

SEQ ID NO: 3012868 - RNA, 23 nt, Mycobacterium avium subsp. paratuberculosis
ggugcccagcgcgaggucgacgg

SEQ ID NO: 3012869 - RNA, 18 nt, Mycobacterium avium subsp. paratuberculosis
ggugcccaucugcacagc

SEQ ID NO: 3012870 - RNA, 13 nt, Mycobacterium avium subsp. paratuberculosis
ggugccccacgcc

SEQ ID NO: 3012871 - RNA, 19 nt, Mycobacterium avium subsp. paratuberculosis
ggugccccgcgaccgcagc

SEQ ID NO: 3012872 - RNA, 14 nt, Mycobacterium avium subsp. paratuberculosis
ggugcccgagcuga

SEQ ID NO: 3012873 - RNA, 23 nt, Mycobacterium avium subsp. paratuberculosis
ggugcccgauuggaagagggcca

SEQ ID NO: 3012874 - RNA, 13 nt, Mycobacterium avium subsp. paratuberculosis
ggugcccgcagca

SEQ ID NO: 3012875 - RNA, 12 nt, Mycobacterium avium subsp. paratuberculosis
ggugcccgccga

SEQ ID NO: 3012876 - RNA, 18 nt, Mycobacterium avium subsp. paratuberculosis
ggugcccgccgaucgauc

SEQ ID NO: 3012877 - RNA, 12 nt, Mycobacterium avium subsp. paratuberculosis
ggugcccgccgc

SEQ ID NO: 3012878 - RNA, 16 nt, Mycobacterium avium subsp. paratuberculosis
ggugcccgccgcgacc

SEQ ID NO: 3012879 - RNA, 19 nt, Mycobacterium avium subsp. paratuberculosis
ggugcccgccgcgaccgcg

SEQ ID NO: 3012880 - RNA, 16 nt, Mycobacterium avium subsp. paratuberculosis
ggugcccgcggguagc

SEQ ID NO: 3012881 - RNA, 21 nt, Mycobacterium avium subsp. paratuberculosis
ggugcccgcguacagcggguc

SEQ ID NO: 3012882 - RNA, 21 nt, Mycobacterium avium subsp. paratuberculosis
ggugcccggaacggcgggccc

SEQ ID NO: 3012883 - RNA, 22 nt, Mycobacterium avium subsp. paratuberculosis
ggugcccggaacggcgggcccg

SEQ ID NO: 3012884 - RNA, 14 nt, Mycobacterium avium subsp. paratuberculosis
ggugcccggcgagg

SEQ ID NO: 3012885 - RNA, 15 nt, Mycobacterium avium subsp. paratuberculosis
ggugcccggcgagga

SEQ ID NO: 3012886 - RNA, 20 nt, Mycobacterium avium subsp. paratuberculosis
ggugcccggcugggcgcgca

SEQ ID NO: 3012887 - RNA, 22 nt, Mycobacterium avium subsp. paratuberculosis
ggugcccggcugggcgcgcaac

SEQ ID NO: 3012888 - RNA, 14 nt, Mycobacterium avium subsp. paratuberculosis
ggugcccgggccgc

SEQ ID NO: 3012889 - RNA, 17 nt, Mycobacterium avium subsp. paratuberculosis
ggugcccgggccgcagc

SEQ ID NO: 3012890 - RNA, 21 nt, Mycobacterium avium subsp. paratuberculosis
ggugcccgggguccaccggcc

SEQ ID NO: 3012891 - RNA, 23 nt, Mycobacterium avium subsp. paratuberculosis
ggugcccgggucgugcggcggcg

SEQ ID NO: 3012892 - RNA, 21 nt, Mycobacterium avium subsp. paratuberculosis
ggugcccucaauagcgggcua

SEQ ID NO: 3012893 - RNA, 13 nt, Mycobacterium avium subsp. paratuberculosis
ggugcccuccucg

SEQ ID NO: 3012894 - RNA, 14 nt, Mycobacterium avium subsp. paratuberculosis
ggugcccuccucgc

SEQ ID NO: 3012895 - RNA, 14 nt, Mycobacterium avium subsp. paratuberculosis
ggugcgccagaucg

SEQ ID NO: 3012896 - RNA, 21 nt, Mycobacterium avium subsp. paratuberculosis
ggugcgccagaucgcugaugc

SEQ ID NO: 3012897 - RNA, 16 nt, Mycobacterium avium subsp. paratuberculosis
ggugcgccagcgccgg

SEQ ID NO: 3012898 - RNA, 18 nt, Mycobacterium avium subsp. paratuberculosis
ggugcgccagcgccgggu

SEQ ID NO: 3012899 - RNA, 14 nt, Mycobacterium avium subsp. paratuberculosis
ggugcgccaggcag

SEQ ID NO: 3012900 - RNA, 15 nt, Mycobacterium avium subsp. paratuberculosis
ggugcgccaggcagg

SEQ ID NO: 3012901 - RNA, 18 nt, Mycobacterium avium subsp. paratuberculosis
ggugcgccaggcaggcgg

SEQ ID NO: 3012902 - RNA, 21 nt, Mycobacterium avium subsp. paratuberculosis
ggugcgccaggcaggcggcca

SEQ ID NO: 3012903 - RNA, 22 nt, Mycobacterium avium subsp. paratuberculosis
ggugcgccaggcaggcggccag

SEQ ID NO: 3012904 - RNA, 22 nt, Mycobacterium avium subsp. paratuberculosis
ggugcgcccagguacuccucgg

SEQ ID NO: 3012905 - RNA, 13 nt, Mycobacterium avium subsp. paratuberculosis
ggugcgcccgucg

SEQ ID NO: 3012906 - RNA, 14 nt, Mycobacterium avium subsp. paratuberculosis
ggugcgcccgucgg

SEQ ID NO: 3012907 - RNA, 19 nt, Mycobacterium avium subsp. paratuberculosis
ggugcgcccgucgucgccg

SEQ ID NO: 3012908 - RNA, 21 nt, Mycobacterium avium subsp. paratuberculosis
ggugcgccgaccgcgaucgag

SEQ ID NO: 3012909 - RNA, 15 nt, Mycobacterium avium subsp. paratuberculosis
ggugcgccgccgcgu

SEQ ID NO: 3012910 - RNA, 19 nt, Mycobacterium avium subsp. paratuberculosis
ggugcgccgccgcgucgcc

SEQ ID NO: 3012911 - RNA, 22 nt, Mycobacterium avium subsp. paratuberculosis
ggugcgccgcucgucggccagc

SEQ ID NO: 3012912 - RNA, 18 nt, Mycobacterium avium subsp. paratuberculosis
ggugcgccggcagcggcc

SEQ ID NO: 3012913 - RNA, 20 nt, Mycobacterium avium subsp. paratuberculosis
ggugcgcgaguaggcgaaga

SEQ ID NO: 3012914 - RNA, 23 nt, Mycobacterium avium subsp. paratuberculosis
ggugcgcgcaccaggccgacgcu

SEQ ID NO: 3012915 - RNA, 16 nt, Mycobacterium avium subsp. paratuberculosis
ggugcgcgggcgcccg

SEQ ID NO: 3012916 - RNA, 17 nt, Mycobacterium avium subsp. paratuberculosis
ggugcgcggucagcgcg

SEQ ID NO: 3012917 - RNA, 16 nt, Mycobacterium avium subsp. paratuberculosis
ggugcgcgucgcggug

SEQ ID NO: 3012918 - RNA, 14 nt, Mycobacterium avium subsp. paratuberculosis
ggugcgcucaccgc

SEQ ID NO: 3012919 - RNA, 19 nt, Mycobacterium avium subsp. paratuberculosis
ggugcgcucgugaccggcg

SEQ ID NO: 3012920 - RNA, 20 nt, Mycobacterium avium subsp. paratuberculosis
ggugcgcucgugaccggcgg

SEQ ID NO: 3012921 - RNA, 21 nt, Mycobacterium avium subsp. paratuberculosis
ggugcgcucgugaccggcggu

SEQ ID NO: 3012922 - RNA, 17 nt, Mycobacterium avium subsp. paratuberculosis
ggugcgcuggccgaccc

SEQ ID NO: 3012923 - RNA, 17 nt, Mycobacterium avium subsp. paratuberculosis
ggugcggaaaagucggg

SEQ ID NO: 3012924 - RNA, 18 nt, Mycobacterium avium subsp. paratuberculosis
ggugcggaaggcccccgg

SEQ ID NO: 3012925 - RNA, 19 nt, Mycobacterium avium subsp. paratuberculosis
ggugcggaugaagugcgcc

SEQ ID NO: 3012926 - RNA, 13 nt, Mycobacterium avium subsp. paratuberculosis
ggugcggaugaug

SEQ ID NO: 3012927 - RNA, 20 nt, Mycobacterium avium subsp. paratuberculosis
ggugcggaugaugguggcca

SEQ ID NO: 3012928 - RNA, 12 nt, Mycobacterium avium subsp. paratuberculosis
ggugcggccagc

SEQ ID NO: 3012929 - RNA, 13 nt, Mycobacterium avium subsp. paratuberculosis
ggugcggccagcg

SEQ ID NO: 3012930 - RNA, 14 nt, Mycobacterium avium subsp. paratuberculosis
ggugcggccagcgc

SEQ ID NO: 3012931 - RNA, 15 nt, Mycobacterium avium subsp. paratuberculosis
ggugcggccagcgca

SEQ ID NO: 3012932 - RNA, 21 nt, Mycobacterium avium subsp. paratuberculosis
ggugcggccgcauuuggcgua

SEQ ID NO: 3012933 - RNA, 14 nt, Mycobacterium avium subsp. paratuberculosis
ggugcggccgcgca

SEQ ID NO: 3012934 - RNA, 11 nt, Mycobacterium avium subsp. paratuberculosis
ggugcggccuc

SEQ ID NO: 3012935 - RNA, 17 nt, Mycobacterium avium subsp. paratuberculosis
ggugcggccucgacgau

SEQ ID NO: 3012936 - RNA, 15 nt, Mycobacterium avium subsp. paratuberculosis
ggugcggcgcucggu

SEQ ID NO: 3012937 - RNA, 19 nt, Mycobacterium avium subsp. paratuberculosis
ggugcggcgcucggugugc

SEQ ID NO: 3012938 - RNA, 15 nt, Mycobacterium avium subsp. paratuberculosis
ggugcggcgcugccg

SEQ ID NO: 3012939 - RNA, 16 nt, Mycobacterium avium subsp. paratuberculosis
ggugcggcgcugccgg

SEQ ID NO: 3012940 - RNA, 18 nt, Mycobacterium avium subsp. paratuberculosis
ggugcggcggugacgaug

SEQ ID NO: 3012941 - RNA, 17 nt, Mycobacterium avium subsp. paratuberculosis
ggugcggcgguguucga

SEQ ID NO: 3012942 - RNA, 22 nt, Mycobacterium avium subsp. paratuberculosis
ggugcggcucacaugggcgcgu

SEQ ID NO: 3012943 - RNA, 17 nt, Mycobacterium avium subsp. paratuberculosis
ggugcggcucgggcggu

SEQ ID NO: 3012944 - RNA, 19 nt, Mycobacterium avium subsp. paratuberculosis
ggugcggcuuugcugccaa

SEQ ID NO: 3012945 - RNA, 17 nt, Mycobacterium avium subsp. paratuberculosis
ggugcgggccagcacga

SEQ ID NO: 3012946 - RNA, 22 nt, Mycobacterium avium subsp. paratuberculosis
ggugcgggccagcacgaccccg

SEQ ID NO: 3012947 - RNA, 16 nt, Mycobacterium avium subsp. paratuberculosis
ggugcgggccagcagc

SEQ ID NO: 3012948 - RNA, 20 nt, Mycobacterium avium subsp. paratuberculosis
ggugcgggccagcagccgcg

SEQ ID NO: 3012949 - RNA, 15 nt, Mycobacterium avium subsp. paratuberculosis
ggugcgggcgcugca

SEQ ID NO: 3012950 - RNA, 16 nt, Mycobacterium avium subsp. paratuberculosis
ggugcgggcggggccc

SEQ ID NO: 3012951 - RNA, 22 nt, Mycobacterium avium subsp. paratuberculosis
ggugcgggcguccuugaccagc

SEQ ID NO: 3012952 - RNA, 13 nt, Mycobacterium avium subsp. paratuberculosis
ggugcgggcugca

SEQ ID NO: 3012953 - RNA, 15 nt, Mycobacterium avium subsp. paratuberculosis
ggugcggggccgcgg

SEQ ID NO: 3012954 - RNA, 14 nt, Mycobacterium avium subsp. paratuberculosis
ggugcgggugccga

SEQ ID NO: 3012955 - RNA, 20 nt, Mycobacterium avium subsp. paratuberculosis
ggugcgguaggugccggccg

SEQ ID NO: 3012956 - RNA, 14 nt, Mycobacterium avium subsp. paratuberculosis
ggugcggucccggu

SEQ ID NO: 3012957 - RNA, 13 nt, Mycobacterium avium subsp. paratuberculosis
ggugcggucgaug

SEQ ID NO: 3012958 - RNA, 14 nt, Mycobacterium avium subsp. paratuberculosis
ggugcggucgauga

SEQ ID NO: 3012959 - RNA, 13 nt, Mycobacterium avium subsp. paratuberculosis
ggugcggucgcgc

SEQ ID NO: 3012960 - RNA, 14 nt, Mycobacterium avium subsp. paratuberculosis
ggugcggucgcgca

SEQ ID NO: 3012961 - RNA, 16 nt, Mycobacterium avium subsp. paratuberculosis
ggugcggucggcgacg

SEQ ID NO: 3012962 - RNA, 15 nt, Mycobacterium avium subsp. paratuberculosis
ggugcggugcaccgc

SEQ ID NO: 3012963 - RNA, 16 nt, Mycobacterium avium subsp. paratuberculosis
ggugcggugcaccgcg

SEQ ID NO: 3012964 - RNA, 19 nt, Mycobacterium avium subsp. paratuberculosis
ggugcggugcaccgcggcg

SEQ ID NO: 3012965 - RNA, 18 nt, Mycobacterium avium subsp. paratuberculosis
ggugcggugcagccgcgg

SEQ ID NO: 3012966 - RNA, 13 nt, Mycobacterium avium subsp. paratuberculosis
ggugcggugcgcc

SEQ ID NO: 3012967 - RNA, 22 nt, Mycobacterium avium subsp. paratuberculosis
ggugcggugcgccgcauuggug

SEQ ID NO: 3012968 - RNA, 13 nt, Mycobacterium avium subsp. paratuberculosis
ggugcggugcggc

SEQ ID NO: 3012969 - RNA, 17 nt, Mycobacterium avium subsp. paratuberculosis
ggugcggugcggccgcg

SEQ ID NO: 3012970 - RNA, 19 nt, Mycobacterium avium subsp. paratuberculosis
ggugcgguugagcaccagc

SEQ ID NO: 3012971 - RNA, 20 nt, Mycobacterium avium subsp. paratuberculosis
ggugcgguugagcaccagcc

SEQ ID NO: 3012972 - RNA, 19 nt, Mycobacterium avium subsp. paratuberculosis
ggugcguccagaccggccg

SEQ ID NO: 3012973 - RNA, 21 nt, Mycobacterium avium subsp. paratuberculosis
ggugcguccagaccggccggg

SEQ ID NO: 3012974 - RNA, 18 nt, Mycobacterium avium subsp. paratuberculosis
ggugcguccgccggcggu

SEQ ID NO: 3012975 - RNA, 19 nt, Mycobacterium avium subsp. paratuberculosis
ggugcguccgccggcggug

SEQ ID NO: 3012976 - RNA, 20 nt, Mycobacterium avium subsp. paratuberculosis
ggugcgucgaaucacaaggg

SEQ ID NO: 3012977 - RNA, 21 nt, Mycobacterium avium subsp. paratuberculosis
ggugcgucgaaucacaaggga

SEQ ID NO: 3012978 - RNA, 15 nt, Mycobacterium avium subsp. paratuberculosis
ggugcgucgggcgcc

SEQ ID NO: 3012979 - RNA, 19 nt, Mycobacterium avium subsp. paratuberculosis
ggugcgucgggcgccggcg

SEQ ID NO: 3012980 - RNA, 17 nt, Mycobacterium avium subsp. paratuberculosis
gggccgggggcggcggc

SEQ ID NO: 3012981 - RNA, 18 nt, Mycobacterium avium subsp. paratuberculosis
gggccgggggcggcggcg

SEQ ID NO: 3012982 - RNA, 16 nt, Mycobacterium avium subsp. paratuberculosis
gggccggguccacgcc

SEQ ID NO: 3012983 - RNA, 15 nt, Mycobacterium avium subsp. paratuberculosis
gggccgggucgaacg

SEQ ID NO: 3012984 - RNA, 16 nt, Mycobacterium avium subsp. paratuberculosis
gggccggucaccgguc

SEQ ID NO: 3012985 - RNA, 17 nt, Mycobacterium avium subsp. paratuberculosis
gggccggugcagcacgu

SEQ ID NO: 3012986 - RNA, 20 nt, Mycobacterium avium subsp. paratuberculosis
gggccggugcagcacgugcg

SEQ ID NO: 3012987 - RNA, 14 nt, Mycobacterium avium subsp. paratuberculosis
gggccggugcguga

SEQ ID NO: 3012988 - RNA, 22 nt, Mycobacterium avium subsp. paratuberculosis
gggccguaucggccccggccga

SEQ ID NO: 3012989 - RNA, 24 nt, Mycobacterium avium subsp. paratuberculosis
gggccguaucggccccggccgagc

SEQ ID NO: 3012990 - RNA, 15 nt, Mycobacterium avium subsp. paratuberculosis
gggccgucacaggcc

SEQ ID NO: 3012991 - RNA, 13 nt, Mycobacterium avium subsp. paratuberculosis
gggccgucaucgc

SEQ ID NO: 3012992 - RNA, 14 nt, Mycobacterium avium subsp. paratuberculosis
gggccguccgccgg

SEQ ID NO: 3012993 - RNA, 17 nt, Mycobacterium avium subsp. paratuberculosis
gggccguccgggugcgg

SEQ ID NO: 3012994 - RNA, 22 nt, Mycobacterium avium subsp. paratuberculosis
gggccguccgggugcgggcuga

SEQ ID NO: 3012995 - RNA, 14 nt, Mycobacterium avium subsp. paratuberculosis
gggccguggcaccg

SEQ ID NO: 3012996 - RNA, 15 nt, Mycobacterium avium subsp. paratuberculosis
gggccguggcaccgg

SEQ ID NO: 3012997 - RNA, 18 nt, Mycobacterium avium subsp. paratuberculosis
gggccguucagcgggcgg

SEQ ID NO: 3012998 - RNA, 13 nt, Mycobacterium avium subsp. paratuberculosis
gggccguugcggc

SEQ ID NO: 3012999 - RNA, 16 nt, Mycobacterium avium subsp. paratuberculosis
gggccuagugccgggg

SEQ ID NO: 3013000 - RNA, 14 nt, Mycobacterium avium subsp. paratuberculosis
gggccuaugccgcg

SEQ ID NO: 3013001 - RNA, 13 nt, Mycobacterium avium subsp. paratuberculosis
gggccuccaccac

SEQ ID NO: 3013002 - RNA, 15 nt, Mycobacterium avium subsp. paratuberculosis
gggccuccaccacca

SEQ ID NO: 3013003 - RNA, 18 nt, Mycobacterium avium subsp. paratuberculosis
gggccuccaccagcggcg

SEQ ID NO: 3013004 - RNA, 14 nt, Mycobacterium avium subsp. paratuberculosis
gggccuccagccag

SEQ ID NO: 3013005 - RNA, 22 nt, Mycobacterium avium subsp. paratuberculosis
gggccuccagccagcgcgcgau

SEQ ID NO: 3013006 - RNA, 14 nt, Mycobacterium avium subsp. paratuberculosis
gggccuccggcggc

SEQ ID NO: 3013007 - RNA, 15 nt, Mycobacterium avium subsp. paratuberculosis
gggccuccggcggca

SEQ ID NO: 3013008 - RNA, 13 nt, Mycobacterium avium subsp. paratuberculosis
gggccucgccgcu

SEQ ID NO: 3013009 - RNA, 14 nt, Mycobacterium avium subsp. paratuberculosis
gggccucggcgacc

SEQ ID NO: 3013010 - RNA, 15 nt, Mycobacterium avium subsp. paratuberculosis
gggccucguccaggg

SEQ ID NO: 3013011 - RNA, 18 nt, Mycobacterium avium subsp. paratuberculosis
gggccugcagcaccaggc

SEQ ID NO: 3013012 - RNA, 13 nt, Mycobacterium avium subsp. paratuberculosis
gggccugcgcgcc

SEQ ID NO: 3013013 - RNA, 14 nt, Mycobacterium avium subsp. paratuberculosis
gggccugcgcgccg

SEQ ID NO: 3013014 - RNA, 15 nt, Mycobacterium avium subsp. paratuberculosis
gggccugcgcgccga

SEQ ID NO: 3013015 - RNA, 12 nt, Mycobacterium avium subsp. paratuberculosis
gggccugcggcg

SEQ ID NO: 3013016 - RNA, 18 nt, Mycobacterium avium subsp. paratuberculosis
gggccugcggcgcggcca

SEQ ID NO: 3013017 - RNA, 19 nt, Mycobacterium avium subsp. paratuberculosis
gggccugcggcgcggccac

SEQ ID NO: 3013018 - RNA, 16 nt, Mycobacterium avium subsp. paratuberculosis
gggccugcggcggccg

SEQ ID NO: 3013019 - RNA, 17 nt, Mycobacterium avium subsp. paratuberculosis
gggccugcggcggccgc

SEQ ID NO: 3013020 - RNA, 18 nt, Mycobacterium avium subsp. paratuberculosis
gggccugcggcggccgca

SEQ ID NO: 3013021 - RNA, 19 nt, Mycobacterium avium subsp. paratuberculosis
gggccugcggcggccgcag

SEQ ID NO: 3013022 - RNA, 17 nt, Mycobacterium avium subsp. paratuberculosis
gggccuggacuugcguc

SEQ ID NO: 3013023 - RNA, 18 nt, Mycobacterium avium subsp. paratuberculosis
gggccuggcgcuccagcc

SEQ ID NO: 3013024 - RNA, 20 nt, Mycobacterium avium subsp. paratuberculosis
gggccuggcgcuccagccac

SEQ ID NO: 3013025 - RNA, 15 nt, Mycobacterium avium subsp. paratuberculosis
gggccuguccagccg

SEQ ID NO: 3013026 - RNA, 17 nt, Mycobacterium avium subsp. paratuberculosis
gggccuguuucugcgcc

SEQ ID NO: 3013027 - RNA, 18 nt, Mycobacterium avium subsp. paratuberculosis
gggccuucuucucgacgu

SEQ ID NO: 3013028 - RNA, 19 nt, Mycobacterium avium subsp. paratuberculosis
gggccuucuucucgacgua

SEQ ID NO: 3013029 - RNA, 21 nt, Mycobacterium avium subsp. paratuberculosis
gggccuucuuggcggcggccu

SEQ ID NO: 3013030 - RNA, 15 nt, Mycobacterium avium subsp. paratuberculosis
gggccuugacggccu

SEQ ID NO: 3013031 - RNA, 14 nt, Mycobacterium avium subsp. paratuberculosis
gggccuuggcgagg

SEQ ID NO: 3013032 - RNA, 15 nt, Mycobacterium avium subsp. paratuberculosis
gggccuuguugcggc

SEQ ID NO: 3013033 - RNA, 18 nt, Mycobacterium avium subsp. paratuberculosis
gggccuuguugcggcgca

SEQ ID NO: 3013034 - RNA, 20 nt, Mycobacterium avium subsp. paratuberculosis
gggccuuguugcggcgcacc

SEQ ID NO: 3013035 - RNA, 17 nt, Mycobacterium avium subsp. paratuberculosis
gggcgaacagcagcacc

SEQ ID NO: 3013036 - RNA, 20 nt, Mycobacterium avium subsp. paratuberculosis
gggcgaacagcagcacccgg

SEQ ID NO: 3013037 - RNA, 14 nt, Mycobacterium avium subsp. paratuberculosis
gggcgaacgaccgg

SEQ ID NO: 3013038 - RNA, 18 nt, Mycobacterium avium subsp. paratuberculosis
gggcgaacgucgggucga

SEQ ID NO: 3013039 - RNA, 21 nt, Mycobacterium avium subsp. paratuberculosis
gggcgaacuugcuggccgagu

SEQ ID NO: 3013040 - RNA, 20 nt, Mycobacterium avium subsp. paratuberculosis
gggcgaaggagaagacacgc

SEQ ID NO: 3013041 - RNA, 17 nt, Mycobacterium avium subsp. paratuberculosis
gggcgaaucugucgaug

SEQ ID NO: 3013042 - RNA, 21 nt, Mycobacterium avium subsp. paratuberculosis
gggcgaaucugucgauggcgg

SEQ ID NO: 3013043 - RNA, 20 nt, Mycobacterium avium subsp. paratuberculosis
gggcgacaccccgcgaguca

SEQ ID NO: 3013044 - RNA, 15 nt, Mycobacterium avium subsp. paratuberculosis
gggcgacaucggcac

SEQ ID NO: 3013045 - RNA, 17 nt, Mycobacterium avium subsp. paratuberculosis
gggcgacauguccggga

SEQ ID NO: 3013046 - RNA, 17 nt, Mycobacterium avium subsp. paratuberculosis
gggcgaccacguccagc

SEQ ID NO: 3013047 - RNA, 21 nt, Mycobacterium avium subsp. paratuberculosis
gggcgaccacguccagcuggg

SEQ ID NO: 3013048 - RNA, 22 nt, Mycobacterium avium subsp. paratuberculosis
gggcgaccaguaggccagcauc

SEQ ID NO: 3013049 - RNA, 17 nt, Mycobacterium avium subsp. paratuberculosis
gggcgaccccggccagg

SEQ ID NO: 3013050 - RNA, 18 nt, Mycobacterium avium subsp. paratuberculosis
gggcgaccccggccagga

SEQ ID NO: 3013051 - RNA, 12 nt, Mycobacterium avium subsp. paratuberculosis
gggcgaccgccg

SEQ ID NO: 3013052 - RNA, 23 nt, Mycobacterium avium subsp. paratuberculosis
gggcgaccgccgcguacagccag

SEQ ID NO: 3013053 - RNA, 14 nt, Mycobacterium avium subsp. paratuberculosis
gggcgaccugcggg

SEQ ID NO: 3013054 - RNA, 19 nt, Mycobacterium avium subsp. paratuberculosis
gggcgaccuggacgccgca

SEQ ID NO: 3013055 - RNA, 14 nt, Mycobacterium avium subsp. paratuberculosis
gggcgacgccgcgg

SEQ ID NO: 3013056 - RNA, 17 nt, Mycobacterium avium subsp. paratuberculosis
gggcgacgccgcggaag

SEQ ID NO: 3013057 - RNA, 13 nt, Mycobacterium avium subsp. paratuberculosis
gggcgacggcggc

SEQ ID NO: 3013058 - RNA, 14 nt, Mycobacterium avium subsp. paratuberculosis
gggcgacggcggcg

SEQ ID NO: 3013059 - RNA, 15 nt, Mycobacterium avium subsp. paratuberculosis
gggcgacggcggcga

SEQ ID NO: 3013060 - RNA, 17 nt, Mycobacterium avium subsp. paratuberculosis
gggcgacggcggcgacg

SEQ ID NO: 3013061 - RNA, 14 nt, Mycobacterium avium subsp. paratuberculosis
gggcgacgucgggg

SEQ ID NO: 3013062 - RNA, 15 nt, Mycobacterium avium subsp. paratuberculosis
gggcgacgucggggu

SEQ ID NO: 3013063 - RNA, 24 nt, Mycobacterium avium subsp. paratuberculosis
gggcgacgucggggucgucgcggu

SEQ ID NO: 3013064 - RNA, 15 nt, Mycobacterium avium subsp. paratuberculosis
gggcgacuccggcgc

SEQ ID NO: 3013065 - RNA, 18 nt, Mycobacterium avium subsp. paratuberculosis
gggcgacuccggcgccgg

SEQ ID NO: 3013066 - RNA, 23 nt, Mycobacterium avium subsp. paratuberculosis
gggcgacuccggcgccggucagc

SEQ ID NO: 3013067 - RNA, 18 nt, Mycobacterium avium subsp. paratuberculosis
gggcgacuucguuggugg

SEQ ID NO: 3013068 - RNA, 19 nt, Mycobacterium avium subsp. paratuberculosis
gggcgacuucuucgccggc

SEQ ID NO: 3013069 - RNA, 17 nt, Mycobacterium avium subsp. paratuberculosis
gggcgagaccgucggug

SEQ ID NO: 3013070 - RNA, 15 nt, Mycobacterium avium subsp. paratuberculosis
gggcgagccgacagu

SEQ ID NO: 3013071 - RNA, 16 nt, Mycobacterium avium subsp. paratuberculosis
gggcgagccggcccgg

SEQ ID NO: 3013072 - RNA, 18 nt, Mycobacterium avium subsp. paratuberculosis
gggcgagcuggccgccca

SEQ ID NO: 3013073 - RNA, 19 nt, Mycobacterium avium subsp. paratuberculosis
gggcgagcuggccgcccac

SEQ ID NO: 3013074 - RNA, 15 nt, Mycobacterium avium subsp. paratuberculosis
gggcgagggcaacgu

SEQ ID NO: 3013075 - RNA, 18 nt, Mycobacterium avium subsp. paratuberculosis
gggcgauaaccucggcgg

SEQ ID NO: 3013076 - RNA, 21 nt, Mycobacterium avium subsp. paratuberculosis
gggcgauaaccucggcggcgg

SEQ ID NO: 3013077 - RNA, 22 nt, Mycobacterium avium subsp. paratuberculosis
gggcgauaaccucggcggcggc

SEQ ID NO: 3013078 - RNA, 15 nt, Mycobacterium avium subsp. paratuberculosis
gggcgaucaccgcgg

SEQ ID NO: 3013079 - RNA, 15 nt, Mycobacterium avium subsp. paratuberculosis
gggcgaucagcccgc

SEQ ID NO: 3013080 - RNA, 18 nt, Mycobacterium avium subsp. paratuberculosis
gggcgaucagcccgccca

SEQ ID NO: 3013081 - RNA, 13 nt, Mycobacterium avium subsp. paratuberculosis
gggcgauccgcag

SEQ ID NO: 3013082 - RNA, 23 nt, Mycobacterium avium subsp. paratuberculosis
gggcgauccgcaggccgucgccg

SEQ ID NO: 3013083 - RNA, 19 nt, Mycobacterium avium subsp. paratuberculosis
gggcgaucgacaccagcgu

SEQ ID NO: 3013084 - RNA, 23 nt, Mycobacterium avium subsp. paratuberculosis
gggcgaucgaucccuuggcggcg

SEQ ID NO: 3013085 - RNA, 14 nt, Mycobacterium avium subsp. paratuberculosis
gggcgaucuccagc

SEQ ID NO: 3013086 - RNA, 22 nt, Mycobacterium avium subsp. paratuberculosis
gggcgaucucuucgaugccggu

SEQ ID NO: 3013087 - RNA, 14 nt, Mycobacterium avium subsp. paratuberculosis
gggcgaugccgaca

SEQ ID NO: 3013088 - RNA, 15 nt, Mycobacterium avium subsp. paratuberculosis
gggcgaugccgacac

SEQ ID NO: 3013089 - RNA, 14 nt, Mycobacterium avium subsp. paratuberculosis
gggcgaugcggccc

SEQ ID NO: 3013090 - RNA, 20 nt, Mycobacterium avium subsp. paratuberculosis
gggcgaugcggcccggccac

SEQ ID NO: 3013091 - RNA, 14 nt, Mycobacterium avium subsp. paratuberculosis
gggcgauggcgggc

SEQ ID NO: 3013092 - RNA, 15 nt, Mycobacterium avium subsp. paratuberculosis
gggcgauugcguuga

SEQ ID NO: 3013093 - RNA, 17 nt, Mycobacterium avium subsp. paratuberculosis
gggcgauugcguugauc

SEQ ID NO: 3013094 - RNA, 18 nt, Mycobacterium avium subsp. paratuberculosis
gggcgauuucgucggcgg

SEQ ID NO: 3013095 - RNA, 19 nt, Mycobacterium avium subsp. paratuberculosis
gggcgauuucgucggcggu

SEQ ID NO: 3013096 - RNA, 20 nt, Mycobacterium avium subsp. paratuberculosis
gggcgauuucgucggcggug

SEQ ID NO: 3013097 - RNA, 23 nt, Mycobacterium avium subsp. paratuberculosis
gggcgcaccacgaccuccgugcc

SEQ ID NO: 3013098 - RNA, 14 nt, Mycobacterium avium subsp. paratuberculosis
gggcgcaccgccug

SEQ ID NO: 3013099 - RNA, 18 nt, Mycobacterium avium subsp. paratuberculosis
gggcgcaccgcgcgccag

SEQ ID NO: 3013100 - RNA, 20 nt, Mycobacterium avium subsp. paratuberculosis
gggcgcacgaucgggcgcag

SEQ ID NO: 3013101 - RNA, 13 nt, Mycobacterium avium subsp. paratuberculosis
gggcgcagcccgg

SEQ ID NO: 3013102 - RNA, 14 nt, Mycobacterium avium subsp. paratuberculosis
gggcgcagcccggc

SEQ ID NO: 3013103 - RNA, 17 nt, Mycobacterium avium subsp. paratuberculosis
gggcgcagcccggcggu

SEQ ID NO: 3013104 - RNA, 19 nt, Mycobacterium avium subsp. paratuberculosis
gggcgcagcgccgucucga

SEQ ID NO: 3013105 - RNA, 19 nt, Mycobacterium avium subsp. paratuberculosis
gggcgcagcugcagcuccu

SEQ ID NO: 3013106 - RNA, 23 nt, Mycobacterium avium subsp. paratuberculosis
gggcgcagguccacccgccccgc

SEQ ID NO: 3013107 - RNA, 14 nt, Mycobacterium avium subsp. paratuberculosis
gggcgcauaccagc

SEQ ID NO: 3013108 - RNA, 21 nt, Mycobacterium avium subsp. paratuberculosis
gggcgccacuucuccacgccg

SEQ ID NO: 3013109 - RNA, 12 nt, Mycobacterium avium subsp. paratuberculosis
gggcgccagcag

SEQ ID NO: 3013110 - RNA, 12 nt, Mycobacterium avium subsp. paratuberculosis
gggcgccagccg

SEQ ID NO: 3013111 - RNA, 13 nt, Mycobacterium avium subsp. paratuberculosis
gggcgccagccgu

SEQ ID NO: 3013112 - RNA, 15 nt, Mycobacterium avium subsp. paratuberculosis
gggcgccauccgcag

SEQ ID NO: 3013113 - RNA, 16 nt, Mycobacterium avium subsp. paratuberculosis
gggcgccauccgccac

SEQ ID NO: 3013114 - RNA, 12 nt, Mycobacterium avium subsp. paratuberculosis
gggcgcccagca

SEQ ID NO: 3013115 - RNA, 18 nt, Mycobacterium avium subsp. paratuberculosis
gggcgccccuggcgucgg

SEQ ID NO: 3013116 - RNA, 13 nt, Mycobacterium avium subsp. paratuberculosis
gggcgcccgagcc

SEQ ID NO: 3013117 - RNA, 18 nt, Mycobacterium avium subsp. paratuberculosis
gggcgcccgagccgcaca

SEQ ID NO: 3013118 - RNA, 12 nt, Mycobacterium avium subsp. paratuberculosis
gggcgcccgcgg

SEQ ID NO: 3013119 - RNA, 22 nt, Mycobacterium avium subsp. paratuberculosis
gggcgccgaacgucgagcgcgg

SEQ ID NO: 3013120 - RNA, 20 nt, Mycobacterium avium subsp. paratuberculosis
gggcgccgacgaucccggcg

SEQ ID NO: 3013121 - RNA, 13 nt, Mycobacterium avium subsp. paratuberculosis
gggcgccgagaac

SEQ ID NO: 3013122 - RNA, 19 nt, Mycobacterium avium subsp. paratuberculosis
gggcgccgaguccgggccg

SEQ ID NO: 3013123 - RNA, 20 nt, Mycobacterium avium subsp. paratuberculosis
gggcgccgaguccgggccgc

SEQ ID NO: 3013124 - RNA, 12 nt, Mycobacterium avium subsp. paratuberculosis
gggcgccgccgg

SEQ ID NO: 3013125 - RNA, 13 nt, Mycobacterium avium subsp. paratuberculosis
gggcgccgccggc

SEQ ID NO: 3013126 - RNA, 14 nt, Mycobacterium avium subsp. paratuberculosis
gggcgccgccggcg

SEQ ID NO: 3013127 - RNA, 23 nt, Mycobacterium avium subsp. paratuberculosis
gggcgccgccggcgucgacgucg

SEQ ID NO: 3013128 - RNA, 12 nt, Mycobacterium avium subsp. paratuberculosis
gggcgccgcggc

SEQ ID NO: 3013129 - RNA, 13 nt, Mycobacterium avium subsp. paratuberculosis
gggcgccgcggcg

SEQ ID NO: 3013130 - RNA, 12 nt, Mycobacterium avium subsp. paratuberculosis
gggcgccggccg

SEQ ID NO: 3013131 - RNA, 13 nt, Mycobacterium avium subsp. paratuberculosis
gggcgccggccgg

SEQ ID NO: 3013132 - RNA, 14 nt, Mycobacterium avium subsp. paratuberculosis
gggcgccggccggc

SEQ ID NO: 3013133 - RNA, 17 nt, Mycobacterium avium subsp. paratuberculosis
gggcgccggcugcccgc

SEQ ID NO: 3013134 - RNA, 12 nt, Mycobacterium avium subsp. paratuberculosis
gggcgccggucg

SEQ ID NO: 3013135 - RNA, 20 nt, Mycobacterium avium subsp. paratuberculosis
gggcgccggucggcggaacg

SEQ ID NO: 3013136 - RNA, 12 nt, Mycobacterium avium subsp. paratuberculosis
gggcgccgucgc

SEQ ID NO: 3013137 - RNA, 14 nt, Mycobacterium avium subsp. paratuberculosis
gggcgccgucgccg

SEQ ID NO: 3013138 - RNA, 16 nt, Mycobacterium avium subsp. paratuberculosis
gggcgccgucggcggg

SEQ ID NO: 3013139 - RNA, 14 nt, Mycobacterium avium subsp. paratuberculosis
gggcgccgucgggg

SEQ ID NO: 3013140 - RNA, 12 nt, Mycobacterium avium subsp. paratuberculosis
gggcgccguugu

SEQ ID NO: 3013141 - RNA, 22 nt, Mycobacterium avium subsp. paratuberculosis
gggcgccuaccggguggccagc

SEQ ID NO: 3013142 - RNA, 14 nt, Mycobacterium avium subsp. paratuberculosis
gggcgccucgaaca

SEQ ID NO: 3013143 - RNA, 14 nt, Mycobacterium avium subsp. paratuberculosis
gggcgccugcggug

SEQ ID NO: 3013144 - RNA, 22 nt, Mycobacterium avium subsp. paratuberculosis
gggcgccuucuuggccgcgccc

SEQ ID NO: 3013145 - RNA, 20 nt, Mycobacterium avium subsp. paratuberculosis
gggcgccuucuuggcggcgg

SEQ ID NO: 3013146 - RNA, 21 nt, Mycobacterium avium subsp. paratuberculosis
gggcgccuucuuggcggcggu

SEQ ID NO: 3013147 - RNA, 15 nt, Mycobacterium avium subsp. paratuberculosis
gggcgcgaacagcgc

SEQ ID NO: 3013148 - RNA, 20 nt, Mycobacterium avium subsp. paratuberculosis
gggcgcgaacagcgccgacu

SEQ ID NO: 3013149 - RNA, 12 nt, Mycobacterium avium subsp. paratuberculosis
gggcgcgaucag

SEQ ID NO: 3013150 - RNA, 16 nt, Mycobacterium avium subsp. paratuberculosis
gggcacguacgcgcug

SEQ ID NO: 3013151 - RNA, 16 nt, Mycobacterium avium subsp. paratuberculosis
gggcacguccagcccg

SEQ ID NO: 3013152 - RNA, 20 nt, Mycobacterium avium subsp. paratuberculosis
gggcacguccagcccgcgcc

SEQ ID NO: 3013153 - RNA, 16 nt, Mycobacterium avium subsp. paratuberculosis
gggcacgucgcgcggg

SEQ ID NO: 3013154 - RNA, 19 nt, Mycobacterium avium subsp. paratuberculosis
gggcacgucggccaggauc

SEQ ID NO: 3013155 - RNA, 13 nt, Mycobacterium avium subsp. paratuberculosis
gggcacucccuug

SEQ ID NO: 3013156 - RNA, 22 nt, Mycobacterium avium subsp. paratuberculosis
gggcacucccuuguugccgagu

SEQ ID NO: 3013157 - RNA, 21 nt, Mycobacterium avium subsp. paratuberculosis
gggcacuuaacaccucgccuc

SEQ ID NO: 3013158 - RNA, 19 nt, Mycobacterium avium subsp. paratuberculosis
gggcagaccgugugccagc

SEQ ID NO: 3013159 - RNA, 20 nt, Mycobacterium avium subsp. paratuberculosis
gggcagaccgugugccagcc

SEQ ID NO: 3013160 - RNA, 19 nt, Mycobacterium avium subsp. paratuberculosis
gggcagauaggcggcgacg

SEQ ID NO: 3013161 - RNA, 17 nt, Mycobacterium avium subsp. paratuberculosis
gggcagaugcccgcuga

SEQ ID NO: 3013162 - RNA, 16 nt, Mycobacterium avium subsp. paratuberculosis
gggcagauggucgccg

SEQ ID NO: 3013163 - RNA, 17 nt, Mycobacterium avium subsp. paratuberculosis
gggcagcaaccggguca

SEQ ID NO: 3013164 - RNA, 17 nt, Mycobacterium avium subsp. paratuberculosis
gggcagcacccgcaccg

SEQ ID NO: 3013165 - RNA, 14 nt, Mycobacterium avium subsp. paratuberculosis
gggcagcagcacca

SEQ ID NO: 3013166 - RNA, 16 nt, Mycobacterium avium subsp. paratuberculosis
gggcagcagcaccagc

SEQ ID NO: 3013167 - RNA, 18 nt, Mycobacterium avium subsp. paratuberculosis
gggcagcagcaccagcgc

SEQ ID NO: 3013168 - RNA, 22 nt, Mycobacterium avium subsp. paratuberculosis
gggcagcagcaccagcgccgcg

SEQ ID NO: 3013169 - RNA, 13 nt, Mycobacterium avium subsp. paratuberculosis
gggcagcagcauc

SEQ ID NO: 3013170 - RNA, 14 nt, Mycobacterium avium subsp. paratuberculosis
gggcagcagcucga

SEQ ID NO: 3013171 - RNA, 19 nt, Mycobacterium avium subsp. paratuberculosis
gggcagcagcuuggcgaag

SEQ ID NO: 3013172 - RNA, 17 nt, Mycobacterium avium subsp. paratuberculosis
gggcagccaaccgccgg

SEQ ID NO: 3013173 - RNA, 13 nt, Mycobacterium avium subsp. paratuberculosis
gggcagccacauc

SEQ ID NO: 3013174 - RNA, 19 nt, Mycobacterium avium subsp. paratuberculosis
gggcagccacgcgcaacca

SEQ ID NO: 3013175 - RNA, 14 nt, Mycobacterium avium subsp. paratuberculosis
gggcagccagcccg

SEQ ID NO: 3013176 - RNA, 20 nt, Mycobacterium avium subsp. paratuberculosis
gggcagcccagguaaucgaa

SEQ ID NO: 3013177 - RNA, 16 nt, Mycobacterium avium subsp. paratuberculosis
gggcagccccagcgag

SEQ ID NO: 3013178 - RNA, 19 nt, Mycobacterium avium subsp. paratuberculosis
gggcagccccagcgagcag

SEQ ID NO: 3013179 - RNA, 20 nt, Mycobacterium avium subsp. paratuberculosis
gggcagcccgaacagccggg

SEQ ID NO: 3013180 - RNA, 15 nt, Mycobacterium avium subsp. paratuberculosis
gggcagcccgagcaa

SEQ ID NO: 3013181 - RNA, 12 nt, Mycobacterium avium subsp. paratuberculosis
gggcagcccgcc

SEQ ID NO: 3013182 - RNA, 17 nt, Mycobacterium avium subsp. paratuberculosis
gggcagcccgccgacca

SEQ ID NO: 3013183 - RNA, 18 nt, Mycobacterium avium subsp. paratuberculosis
gggcagcccgccgaccac

SEQ ID NO: 3013184 - RNA, 21 nt, Mycobacterium avium subsp. paratuberculosis
gggcagcccgccgcggaucgg

SEQ ID NO: 3013185 - RNA, 13 nt, Mycobacterium avium subsp. paratuberculosis
gggcagcccgggu

SEQ ID NO: 3013186 - RNA, 19 nt, Mycobacterium avium subsp. paratuberculosis
gggcagcccgggucuagau

SEQ ID NO: 3013187 - RNA, 21 nt, Mycobacterium avium subsp. paratuberculosis
gggcagccgcacaccgcggcg

SEQ ID NO: 3013188 - RNA, 12 nt, Mycobacterium avium subsp. paratuberculosis
gggcagccgcgc

SEQ ID NO: 3013189 - RNA, 16 nt, Mycobacterium avium subsp. paratuberculosis
gggcagccgcgcgugc

SEQ ID NO: 3013190 - RNA, 17 nt, Mycobacterium avium subsp. paratuberculosis
gggcagccggcgcccgc

SEQ ID NO: 3013191 - RNA, 13 nt, Mycobacterium avium subsp. paratuberculosis
gggcagcgagcac

SEQ ID NO: 3013192 - RNA, 15 nt, Mycobacterium avium subsp. paratuberculosis
gggcagcgagcacag

SEQ ID NO: 3013193 - RNA, 22 nt, Mycobacterium avium subsp. paratuberculosis
gggcagcgagucgaaggcgcgg

SEQ ID NO: 3013194 - RNA, 13 nt, Mycobacterium avium subsp. paratuberculosis
gggcagcgccccg

SEQ ID NO: 3013195 - RNA, 23 nt, Mycobacterium avium subsp. paratuberculosis
gggcagcgccccgguccggcuga

SEQ ID NO: 3013196 - RNA, 16 nt, Mycobacterium avium subsp. paratuberculosis
gggcagcgccucggcg

SEQ ID NO: 3013197 - RNA, 18 nt, Mycobacterium avium subsp. paratuberculosis
gggcagcgccucggcggg

SEQ ID NO: 3013198 - RNA, 13 nt, Mycobacterium avium subsp. paratuberculosis
gggcagcgcgaca

SEQ ID NO: 3013199 - RNA, 17 nt, Mycobacterium avium subsp. paratuberculosis
gggcagcgcgaccagcc

SEQ ID NO: 3013200 - RNA, 19 nt, Mycobacterium avium subsp. paratuberculosis
gggcagcgcgaccagcccg

SEQ ID NO: 3013201 - RNA, 14 nt, Mycobacterium avium subsp. paratuberculosis
gggcagcgcggcca

SEQ ID NO: 3013202 - RNA, 15 nt, Mycobacterium avium subsp. paratuberculosis
gggcagcgcggccag

SEQ ID NO: 3013203 - RNA, 17 nt, Mycobacterium avium subsp. paratuberculosis
gggcagcgcggccagca

SEQ ID NO: 3013204 - RNA, 14 nt, Mycobacterium avium subsp. paratuberculosis
gggcagcggcccca

SEQ ID NO: 3013205 - RNA, 13 nt, Mycobacterium avium subsp. paratuberculosis
gggcagcgguguc

SEQ ID NO: 3013206 - RNA, 18 nt, Mycobacterium avium subsp. paratuberculosis
gggcagcgucccgucggc

SEQ ID NO: 3013207 - RNA, 22 nt, Mycobacterium avium subsp. paratuberculosis
gggcagcucggcgggcucccuc

SEQ ID NO: 3013208 - RNA, 19 nt, Mycobacterium avium subsp. paratuberculosis
gggcagcucgucggcgcgc

SEQ ID NO: 3013209 - RNA, 20 nt, Mycobacterium avium subsp. paratuberculosis
gggcagcucgucggcgcgcc

SEQ ID NO: 3013210 - RNA, 21 nt, Mycobacterium avium subsp. paratuberculosis
gggcagcucgucggcgcgcca

SEQ ID NO: 3013211 - RNA, 20 nt, Mycobacterium avium subsp. paratuberculosis
gggcagcugauagcccgccg

SEQ ID NO: 3013212 - RNA, 18 nt, Mycobacterium avium subsp. paratuberculosis
gggcaggcucagguaggc

SEQ ID NO: 3013213 - RNA, 22 nt, Mycobacterium avium subsp. paratuberculosis
gggcaggcucagguaggcgcgg

SEQ ID NO: 3013214 - RNA, 17 nt, Mycobacterium avium subsp. paratuberculosis
gggcagggaauucagcc

SEQ ID NO: 3013215 - RNA, 14 nt, Mycobacterium avium subsp. paratuberculosis
gggcagggucgcgg

SEQ ID NO: 3013216 - RNA, 20 nt, Mycobacterium avium subsp. paratuberculosis
gggcaggguuuucacgucga

SEQ ID NO: 3013217 - RNA, 23 nt, Mycobacterium avium subsp. paratuberculosis
gggcagguacugcuugccgccgg

SEQ ID NO: 3013218 - RNA, 21 nt, Mycobacterium avium subsp. paratuberculosis
gggcagguucauccccgcggc

SEQ ID NO: 3013219 - RNA, 16 nt, Mycobacterium avium subsp. paratuberculosis
gggcaguagcgacgcg

SEQ ID NO: 3013220 - RNA, 17 nt, Mycobacterium avium subsp. paratuberculosis
gggcaguagcgacgcga

SEQ ID NO: 3013221 - RNA, 20 nt, Mycobacterium avium subsp. paratuberculosis
gggcagucugccgguggccu

SEQ ID NO: 3013222 - RNA, 22 nt, Mycobacterium avium subsp. paratuberculosis
gggcagugcacgacgaccgcgu

SEQ ID NO: 3013223 - RNA, 15 nt, Mycobacterium avium subsp. paratuberculosis
gggcagugcgcggcg

SEQ ID NO: 3013224 - RNA, 16 nt, Mycobacterium avium subsp. paratuberculosis
gggcaucaucggcacg

SEQ ID NO: 3013225 - RNA, 17 nt, Mycobacterium avium subsp. paratuberculosis
gggcaucaucggcacgc

SEQ ID NO: 3013226 - RNA, 14 nt, Mycobacterium avium subsp. paratuberculosis
gggcaucccugaca

SEQ ID NO: 3013227 - RNA, 22 nt, Mycobacterium avium subsp. paratuberculosis
gggcaucccugacacgaccgcc

SEQ ID NO: 3013228 - RNA, 17 nt, Mycobacterium avium subsp. paratuberculosis
gggcauccgcucgccgc

SEQ ID NO: 3013229 - RNA, 19 nt, Mycobacterium avium subsp. paratuberculosis
gggcauccgcucgccgcgg

SEQ ID NO: 3013230 - RNA, 22 nt, Mycobacterium avium subsp. paratuberculosis
gggcauccgcucgccgcgggug

SEQ ID NO: 3013231 - RNA, 12 nt, Mycobacterium avium subsp. paratuberculosis
gggcauccggga

SEQ ID NO: 3013232 - RNA, 18 nt, Mycobacterium avium subsp. paratuberculosis
gggcauccgggaggccag

SEQ ID NO: 3013233 - RNA, 19 nt, Mycobacterium avium subsp. paratuberculosis
gggcauccgggaggccagc

SEQ ID NO: 3013234 - RNA, 20 nt, Mycobacterium avium subsp. paratuberculosis
gggcaucgcagcgcgcggcg

SEQ ID NO: 3013235 - RNA, 14 nt, Mycobacterium avium subsp. paratuberculosis
gggcaucggcuggu

SEQ ID NO: 3013236 - RNA, 13 nt, Mycobacterium avium subsp. paratuberculosis
gggcaucgggucg

SEQ ID NO: 3013237 - RNA, 17 nt, Mycobacterium avium subsp. paratuberculosis
gggcaucgucucggacc

SEQ ID NO: 3013238 - RNA, 18 nt, Mycobacterium avium subsp. paratuberculosis
gggcaugaaccaggccgc

SEQ ID NO: 3013239 - RNA, 15 nt, Mycobacterium avium subsp. paratuberculosis
gggcaugccggccgg

SEQ ID NO: 3013240 - RNA, 23 nt, Mycobacterium avium subsp. paratuberculosis
gggcaugccguucagcgcggcca

SEQ ID NO: 3013241 - RNA, 17 nt, Mycobacterium avium subsp. paratuberculosis
gggcaugcucaggauga

SEQ ID NO: 3013242 - RNA, 16 nt, Mycobacterium avium subsp. paratuberculosis
gggcauggucaccgga

SEQ ID NO: 3013243 - RNA, 15 nt, Mycobacterium avium subsp. paratuberculosis
gggcauggugaagcc

SEQ ID NO: 3013244 - RNA, 20 nt, Mycobacterium avium subsp. paratuberculosis
gggcauggugaagcccagcg

SEQ ID NO: 3013245 - RNA, 21 nt, Mycobacterium avium subsp. paratuberculosis
gggcauggugaagcccagcgc

SEQ ID NO: 3013246 - RNA, 15 nt, Mycobacterium avium subsp. paratuberculosis
gggcaugucgccgaa

SEQ ID NO: 3013247 - RNA, 17 nt, Mycobacterium avium subsp. paratuberculosis
gggcaugucgccgaacg

SEQ ID NO: 3013248 - RNA, 22 nt, Mycobacterium avium subsp. paratuberculosis
gggcaugucgccgaacgccacc

SEQ ID NO: 3013249 - RNA, 23 nt, Mycobacterium avium subsp. paratuberculosis
gggcaugucgccgaacgccacca

SEQ ID NO: 3013250 - RNA, 19 nt, Mycobacterium avium subsp. paratuberculosis
gggcauugcccaucgccac

SEQ ID NO: 3013251 - RNA, 20 nt, Mycobacterium avium subsp. paratuberculosis
gggcauugcccaucgccacg

SEQ ID NO: 3013252 - RNA, 17 nt, Mycobacterium avium subsp. paratuberculosis
gggcauuggcagcucgg

SEQ ID NO: 3013253 - RNA, 23 nt, Mycobacterium avium subsp. paratuberculosis
gggcauuucggcuuccaccugcg

SEQ ID NO: 3013254 - RNA, 16 nt, Mycobacterium avium subsp. paratuberculosis
gggccaaagagcuugg

SEQ ID NO: 3013255 - RNA, 19 nt, Mycobacterium avium subsp. paratuberculosis
gggccaaagagcuuggcau

SEQ ID NO: 3013256 - RNA, 21 nt, Mycobacterium avium subsp. paratuberculosis
gggccaaaucgcuugcgccgc

SEQ ID NO: 3013257 - RNA, 19 nt, Mycobacterium avium subsp. paratuberculosis
gggccaacgguucggccgc

SEQ ID NO: 3013258 - RNA, 20 nt, Mycobacterium avium subsp. paratuberculosis
gggccaacgguucggccgcu

SEQ ID NO: 3013259 - RNA, 17 nt, Mycobacterium avium subsp. paratuberculosis
gggccaacuccggcggc

SEQ ID NO: 3013260 - RNA, 18 nt, Mycobacterium avium subsp. paratuberculosis
gggccaacuccggcggca

SEQ ID NO: 3013261 - RNA, 16 nt, Mycobacterium avium subsp. paratuberculosis
gggccaacuggguggg

SEQ ID NO: 3013262 - RNA, 19 nt, Mycobacterium avium subsp. paratuberculosis
gggccaacugggugggugc

SEQ ID NO: 3013263 - RNA, 13 nt, Mycobacterium avium subsp. paratuberculosis
gggccaagcaccg

SEQ ID NO: 3013264 - RNA, 15 nt, Mycobacterium avium subsp. paratuberculosis
gggccaagcaccggg

SEQ ID NO: 3013265 - RNA, 19 nt, Mycobacterium avium subsp. paratuberculosis
gggccaauuacgcugcggc

SEQ ID NO: 3013266 - RNA, 20 nt, Mycobacterium avium subsp. paratuberculosis
gggccaauuacgcugcggcg

SEQ ID NO: 3013267 - RNA, 23 nt, Mycobacterium avium subsp. paratuberculosis
gggccaauuacgcugcggcgccg

SEQ ID NO: 3013268 - RNA, 17 nt, Mycobacterium avium subsp. paratuberculosis
gggccaccaccacggcc

SEQ ID NO: 3013269 - RNA, 19 nt, Mycobacterium avium subsp. paratuberculosis
gggccaccaccacggccgc

SEQ ID NO: 3013270 - RNA, 13 nt, Mycobacterium avium subsp. paratuberculosis
gggccaccacgcc

SEQ ID NO: 3013271 - RNA, 16 nt, Mycobacterium avium subsp. paratuberculosis
gggccaccacgccagc

SEQ ID NO: 3013272 - RNA, 17 nt, Mycobacterium avium subsp. paratuberculosis
gggccaccacgccagcc

SEQ ID NO: 3013273 - RNA, 19 nt, Mycobacterium avium subsp. paratuberculosis
gggccaccacgccagccuc

SEQ ID NO: 3013274 - RNA, 12 nt, Mycobacterium avium subsp. paratuberculosis
gggccaccacgu

SEQ ID NO: 3013275 - RNA, 16 nt, Mycobacterium avium subsp. paratuberculosis
gggccaccagcgcagg

SEQ ID NO: 3013276 - RNA, 20 nt, Mycobacterium avium subsp. paratuberculosis
gggccaccagcgcagguccu

SEQ ID NO: 3013277 - RNA, 18 nt, Mycobacterium avium subsp. paratuberculosis
gggccaccaggccgaaga

SEQ ID NO: 3013278 - RNA, 20 nt, Mycobacterium avium subsp. paratuberculosis
gggccaccaggccgaagacg

SEQ ID NO: 3013279 - RNA, 20 nt, Mycobacterium avium subsp. paratuberculosis
gggccacccgcgaucggaug

SEQ ID NO: 3013280 - RNA, 12 nt, Mycobacterium avium subsp. paratuberculosis
gggccaccgcgg

SEQ ID NO: 3013281 - RNA, 14 nt, Mycobacterium avium subsp. paratuberculosis
gggccaccgcggcg

SEQ ID NO: 3013282 - RNA, 16 nt, Mycobacterium avium subsp. paratuberculosis
gggccaccgcgucgcu

SEQ ID NO: 3013283 - RNA, 22 nt, Mycobacterium avium subsp. paratuberculosis
gggccaccgcgucgcugcccag

SEQ ID NO: 3013284 - RNA, 12 nt, Mycobacterium avium subsp. paratuberculosis
gggccaccggcg

SEQ ID NO: 3013285 - RNA, 14 nt, Mycobacterium avium subsp. paratuberculosis
gggccaccggcgcc

SEQ ID NO: 3013286 - RNA, 15 nt, Mycobacterium avium subsp. paratuberculosis
gggccaccggcgcca

SEQ ID NO: 3013287 - RNA, 16 nt, Mycobacterium avium subsp. paratuberculosis
gggccaccggcgccag

SEQ ID NO: 3013288 - RNA, 17 nt, Mycobacterium avium subsp. paratuberculosis
gggccaccggcgccagg

SEQ ID NO: 3013289 - RNA, 12 nt, Mycobacterium avium subsp. paratuberculosis
gggccaccggcu

SEQ ID NO: 3013290 - RNA, 19 nt, Mycobacterium avium subsp. paratuberculosis
gggccaccgucccgguguc

SEQ ID NO: 3013291 - RNA, 17 nt, Mycobacterium avium subsp. paratuberculosis
gggccacgauccgcgcg

SEQ ID NO: 3013292 - RNA, 22 nt, Mycobacterium avium subsp. paratuberculosis
gggccacgauccgcgcggccac

SEQ ID NO: 3013293 - RNA, 20 nt, Mycobacterium avium subsp. paratuberculosis
gggccacgcagucgucgaug

SEQ ID NO: 3013294 - RNA, 21 nt, Mycobacterium avium subsp. paratuberculosis
gggccagacugcgcaccgcca

SEQ ID NO: 3013295 - RNA, 23 nt, Mycobacterium avium subsp. paratuberculosis
gggccagacugcgcaccgccagc

SEQ ID NO: 3013296 - RNA, 15 nt, Mycobacterium avium subsp. paratuberculosis
gggccagcaacacca

SEQ ID NO: 3013297 - RNA, 18 nt, Mycobacterium avium subsp. paratuberculosis
gggccagcaacagcagcg

SEQ ID NO: 3013298 - RNA, 19 nt, Mycobacterium avium subsp. paratuberculosis
gggccagcaacagcagcgg

SEQ ID NO: 3013299 - RNA, 13 nt, Mycobacterium avium subsp. paratuberculosis
gggccagcaccca

SEQ ID NO: 3013300 - RNA, 14 nt, Mycobacterium avium subsp. paratuberculosis
gggccagcacccag

SEQ ID NO: 3013301 - RNA, 15 nt, Mycobacterium avium subsp. paratuberculosis
gggccagcacccaga

SEQ ID NO: 3013302 - RNA, 16 nt, Mycobacterium avium subsp. paratuberculosis
gggccagcagccagcu

SEQ ID NO: 3013303 - RNA, 21 nt, Mycobacterium avium subsp. paratuberculosis
gggccagcagccagcugguga

SEQ ID NO: 3013304 - RNA, 15 nt, Mycobacterium avium subsp. paratuberculosis
gggccagcagcccgg

SEQ ID NO: 3013305 - RNA, 13 nt, Mycobacterium avium subsp. paratuberculosis
gggccagcagccg

SEQ ID NO: 3013306 - RNA, 15 nt, Mycobacterium avium subsp. paratuberculosis
gggccagcagccgcg

SEQ ID NO: 3013307 - RNA, 21 nt, Mycobacterium avium subsp. paratuberculosis
gggccagcagccgcgcgagca

SEQ ID NO: 3013308 - RNA, 16 nt, Mycobacterium avium subsp. paratuberculosis
gggccagcagccgggu

SEQ ID NO: 3013309 - RNA, 12 nt, Mycobacterium avium subsp. paratuberculosis
gggccagcagga

SEQ ID NO: 3013310 - RNA, 23 nt, Mycobacterium avium subsp. paratuberculosis
gggccagcaguucguccacgcug

SEQ ID NO: 3013311 - RNA, 19 nt, Mycobacterium avium subsp. paratuberculosis
gggccagccgaugcgcccg

SEQ ID NO: 3013312 - RNA, 20 nt, Mycobacterium avium subsp. paratuberculosis
gggccagccgaugcgcccgc

SEQ ID NO: 3013313 - RNA, 17 nt, Mycobacterium avium subsp. paratuberculosis
gggccagccguuguuga

SEQ ID NO: 3013314 - RNA, 19 nt, Mycobacterium avium subsp. paratuberculosis
gggccagcgccaugccgcc

SEQ ID NO: 3013315 - RNA, 14 nt, Mycobacterium avium subsp. paratuberculosis
gggccagcgccgag

SEQ ID NO: 3013316 - RNA, 16 nt, Mycobacterium avium subsp. paratuberculosis
gggccagcgccgagcc

SEQ ID NO: 3013317 - RNA, 13 nt, Mycobacterium avium subsp. paratuberculosis
gggccagcgccuc

SEQ ID NO: 3013318 - RNA, 23 nt, Mycobacterium avium subsp. paratuberculosis
gggccagcgccuucggcgccagc

SEQ ID NO: 3013319 - RNA, 24 nt, Mycobacterium avium subsp. paratuberculosis
gggccagcgccuucggcgccagcc

SEQ ID NO: 3013320 - RNA, 14 nt, Mycobacterium avium subsp. paratuberculosis
gggccagcgcggug

SEQ ID NO: 3013321 - RNA, 15 nt, Mycobacterium avium subsp. paratuberculosis
gggccagcgcggugg

SEQ ID NO: 3013322 - RNA, 15 nt, Mycobacterium avium subsp. paratuberculosis
gggccagcggcgccg

SEQ ID NO: 3013323 - RNA, 21 nt, Mycobacterium avium subsp. paratuberculosis
gggccaggaccggauccacca

SEQ ID NO: 3013324 - RNA, 13 nt, Mycobacterium avium subsp. paratuberculosis
gggccaggaugac

SEQ ID NO: 3013325 - RNA, 21 nt, Mycobacterium avium subsp. paratuberculosis
gggccaggaugaccgcccagg

SEQ ID NO: 3013326 - RNA, 22 nt, Mycobacterium avium subsp. paratuberculosis
gggccaggaugaccgcccagga

SEQ ID NO: 3013327 - RNA, 20 nt, Mycobacterium avium subsp. paratuberculosis
gggccaggauguucaccccg

SEQ ID NO: 3013328 - RNA, 23 nt, Mycobacterium avium subsp. paratuberculosis
gggccaggauguucaccccggcg

SEQ ID NO: 3013329 - RNA, 18 nt, Mycobacterium avium subsp. paratuberculosis
gggccaggcacggcccgu

SEQ ID NO: 3013330 - RNA, 22 nt, Mycobacterium avium subsp. paratuberculosis
gggccaggcccaccgucgccac

SEQ ID NO: 3013331 - RNA, 13 nt, Mycobacterium avium subsp. paratuberculosis
gggccaggcggau

SEQ ID NO: 3013332 - RNA, 15 nt, Mycobacterium avium subsp. paratuberculosis
gggccaggcgggacg

SEQ ID NO: 3013333 - RNA, 14 nt, Mycobacterium avium subsp. paratuberculosis
gggccagggcgagg

SEQ ID NO: 3013334 - RNA, 16 nt, Mycobacterium avium subsp. paratuberculosis
gggccaggucccaggc

SEQ ID NO: 3013335 - RNA, 21 nt, Mycobacterium avium subsp. paratuberculosis
gggccaggucccaggcguggu

SEQ ID NO: 3013336 - RNA, 23 nt, Mycobacterium avium subsp. paratuberculosis
gggccaggucccaggcguggucg

SEQ ID NO: 3013337 - RNA, 21 nt, Mycobacterium avium subsp. paratuberculosis
gggccaggucgaagcgcagca

SEQ ID NO: 3013338 - RNA, 24 nt, Mycobacterium avium subsp. paratuberculosis
gggccaggucgaagcgcagcaccu

SEQ ID NO: 3013339 - RNA, 14 nt, Mycobacterium avium subsp. paratuberculosis
gggccaggucggug

SEQ ID NO: 3013340 - RNA, 17 nt, Mycobacterium avium subsp. paratuberculosis
gggccaggugugcccgc

SEQ ID NO: 3013341 - RNA, 20 nt, Mycobacterium avium subsp. paratuberculosis
gggccaggugugcccgcccu

SEQ ID NO: 3013342 - RNA, 19 nt, Mycobacterium avium subsp. paratuberculosis
gggccagguucaggcccgc

SEQ ID NO: 3013343 - RNA, 24 nt, Mycobacterium avium subsp. paratuberculosis
gggccaucccggggacaccgggca

SEQ ID NO: 3013344 - RNA, 18 nt, Mycobacterium avium subsp. paratuberculosis
gggccaucgacuccagca

SEQ ID NO: 3013345 - RNA, 19 nt, Mycobacterium avium subsp. paratuberculosis
gggccaucgacuccagcac

SEQ ID NO: 3013346 - RNA, 14 nt, Mycobacterium avium subsp. paratuberculosis
gggccaucgccagg

SEQ ID NO: 3013347 - RNA, 15 nt, Mycobacterium avium subsp. paratuberculosis
gggccaucgccagga

SEQ ID NO: 3013348 - RNA, 23 nt, Mycobacterium avium subsp. paratuberculosis
gggccaucggcagacccagcagc

SEQ ID NO: 3013349 - RNA, 19 nt, Mycobacterium avium subsp. paratuberculosis
gggccaugccucuucggcg

SEQ ID NO: 3013350 - RNA, 20 nt, Mycobacterium avium subsp. paratuberculosis
gggccaugccucuucggcgc

SEQ ID NO: 3013351 - RNA, 22 nt, Mycobacterium avium subsp. paratuberculosis
gggccaugccucuucggcgcgc

SEQ ID NO: 3013352 - RNA, 18 nt, Mycobacterium avium subsp. paratuberculosis
gggccauguccccgacca

SEQ ID NO: 3013353 - RNA, 14 nt, Mycobacterium avium subsp. paratuberculosis
gggcccaccgccac

SEQ ID NO: 3013354 - RNA, 16 nt, Mycobacterium avium subsp. paratuberculosis
gggcccaccgcgcgcu

SEQ ID NO: 3013355 - RNA, 22 nt, Mycobacterium avium subsp. paratuberculosis
gggcccaccgcgcgcugcagca

SEQ ID NO: 3013356 - RNA, 14 nt, Mycobacterium avium subsp. paratuberculosis
gggcccacgcucga

SEQ ID NO: 3013357 - RNA, 13 nt, Mycobacterium avium subsp. paratuberculosis
gggcccagcacca

SEQ ID NO: 3013358 - RNA, 17 nt, Mycobacterium avium subsp. paratuberculosis
gggcccagcaccaccac

SEQ ID NO: 3013359 - RNA, 18 nt, Mycobacterium avium subsp. paratuberculosis
gggcccagcaccaccacg

SEQ ID NO: 3013360 - RNA, 19 nt, Mycobacterium avium subsp. paratuberculosis
gggcccagcaccaccacgu

SEQ ID NO: 3013361 - RNA, 21 nt, Mycobacterium avium subsp. paratuberculosis
gggcccagcagauagcccagc

SEQ ID NO: 3013362 - RNA, 22 nt, Mycobacterium avium subsp. paratuberculosis
gggcccagcagauagcccagcc

SEQ ID NO: 3013363 - RNA, 18 nt, Mycobacterium avium subsp. paratuberculosis
gggcccagcgcgacgucg

SEQ ID NO: 3013364 - RNA, 22 nt, Mycobacterium avium subsp. paratuberculosis
gggcccagcuccaaugcggccg

SEQ ID NO: 3013365 - RNA, 13 nt, Mycobacterium avium subsp. paratuberculosis
gggcccagcucgg

SEQ ID NO: 3013366 - RNA, 14 nt, Mycobacterium avium subsp. paratuberculosis
gggccccacgccag

SEQ ID NO: 3013367 - RNA, 14 nt, Mycobacterium avium subsp. paratuberculosis
gggccccggcaucg

SEQ ID NO: 3013368 - RNA, 21 nt, Mycobacterium avium subsp. paratuberculosis
gggccccggcaucgacaugcc

SEQ ID NO: 3013369 - RNA, 14 nt, Mycobacterium avium subsp. paratuberculosis
gggccccuccagcc

SEQ ID NO: 3013370 - RNA, 17 nt, Mycobacterium avium subsp. paratuberculosis
gggccccuccagccgcc

SEQ ID NO: 3013371 - RNA, 19 nt, Mycobacterium avium subsp. paratuberculosis
gggccccuccagccgccgg

SEQ ID NO: 3013372 - RNA, 23 nt, Mycobacterium avium subsp. paratuberculosis
gggccccuccagccgccggucca

SEQ ID NO: 3013373 - RNA, 20 nt, Mycobacterium avium subsp. paratuberculosis
gggcccgaagcgcuuucccu

SEQ ID NO: 3013374 - RNA, 13 nt, Mycobacterium avium subsp. paratuberculosis
gggcccgacgacg

SEQ ID NO: 3013375 - RNA, 14 nt, Mycobacterium avium subsp. paratuberculosis
gggcccgacgacga

SEQ ID NO: 3013376 - RNA, 22 nt, Mycobacterium avium subsp. paratuberculosis
gggcccgauggcggccugcagg

SEQ ID NO: 3013377 - RNA, 12 nt, Mycobacterium avium subsp. paratuberculosis
gggcccgcagcc

SEQ ID NO: 3013378 - RNA, 14 nt, Mycobacterium avium subsp. paratuberculosis
gggcccgcagccgc

SEQ ID NO: 3013379 - RNA, 17 nt, Mycobacterium avium subsp. paratuberculosis
gggcccgcccgcagcgg

SEQ ID NO: 3013380 - RNA, 20 nt, Mycobacterium avium subsp. paratuberculosis
gggcccgcccgcagcggcgg

SEQ ID NO: 3013381 - RNA, 19 nt, Mycobacterium avium subsp. paratuberculosis
gggcccgccguagcgccgg

SEQ ID NO: 3013382 - RNA, 19 nt, Mycobacterium avium subsp. paratuberculosis
gggcccgccgucgaccacg

SEQ ID NO: 3013383 - RNA, 13 nt, Mycobacterium avium subsp. paratuberculosis
gggcccgcgcacc

SEQ ID NO: 3013384 - RNA, 14 nt, Mycobacterium avium subsp. paratuberculosis
gggcccgcgggauc

SEQ ID NO: 3013385 - RNA, 23 nt, Mycobacterium avium subsp. paratuberculosis
gggcccgcguaaccggcggcggu

SEQ ID NO: 3013386 - RNA, 17 nt, Mycobacterium avium subsp. paratuberculosis
gggcccgcucaccugcg

SEQ ID NO: 3013387 - RNA, 14 nt, Mycobacterium avium subsp. paratuberculosis
gggcccgcugcagc

SEQ ID NO: 3013388 - RNA, 16 nt, Mycobacterium avium subsp. paratuberculosis
gggcccgcugcagcgc

SEQ ID NO: 3013389 - RNA, 12 nt, Mycobacterium avium subsp. paratuberculosis
gggcccggcccg

SEQ ID NO: 3013390 - RNA, 13 nt, Mycobacterium avium subsp. paratuberculosis
gggcccggcccgg

SEQ ID NO: 3013391 - RNA, 12 nt, Mycobacterium avium subsp. paratuberculosis
gggcccggccgc

SEQ ID NO: 3013392 - RNA, 13 nt, Mycobacterium avium subsp. paratuberculosis
gggcccggcgcca

SEQ ID NO: 3013393 - RNA, 20 nt, Mycobacterium avium subsp. paratuberculosis
gggcccgggaugggccugga

SEQ ID NO: 3013394 - RNA, 19 nt, Mycobacterium avium subsp. paratuberculosis
gggcccggguggcguccag

SEQ ID NO: 3013395 - RNA, 16 nt, Mycobacterium avium subsp. paratuberculosis
gggcccggucccgcgu

SEQ ID NO: 3013396 - RNA, 13 nt, Mycobacterium avium subsp. paratuberculosis
gggcccgguccgc

SEQ ID NO: 3013397 - RNA, 17 nt, Mycobacterium avium subsp. paratuberculosis
gggcccggucgucgccg

SEQ ID NO: 3013398 - RNA, 19 nt, Mycobacterium avium subsp. paratuberculosis
gggcccguagcucgcgccg

SEQ ID NO: 3013399 - RNA, 19 nt, Mycobacterium avium subsp. paratuberculosis
gggcccguccccaccaccg

SEQ ID NO: 3013400 - RNA, 22 nt, Mycobacterium avium subsp. paratuberculosis
gggcccguccccaccaccgaca

SEQ ID NO: 3013401 - RNA, 14 nt, Mycobacterium avium subsp. paratuberculosis
gggcccgugcgggu

SEQ ID NO: 3013402 - RNA, 19 nt, Mycobacterium avium subsp. paratuberculosis
gggcccgugcggguggucc

SEQ ID NO: 3013403 - RNA, 23 nt, Mycobacterium avium subsp. paratuberculosis
gggcccucggacgggagacgcug

SEQ ID NO: 3013404 - RNA, 19 nt, Mycobacterium avium subsp. paratuberculosis
gggccgaacugccgaugcu

SEQ ID NO: 3013405 - RNA, 19 nt, Mycobacterium avium subsp. paratuberculosis
gggccgaaggcggcgccgg

SEQ ID NO: 3013406 - RNA, 18 nt, Mycobacterium avium subsp. paratuberculosis
gggccgacagcacgccgg

SEQ ID NO: 3013407 - RNA, 16 nt, Mycobacterium avium subsp. paratuberculosis
gggccgacccggccga

SEQ ID NO: 3013408 - RNA, 16 nt, Mycobacterium avium subsp. paratuberculosis
gggccgaccggccggu

SEQ ID NO: 3013409 - RNA, 16 nt, Mycobacterium avium subsp. paratuberculosis
gggccgaccuggcggc

SEQ ID NO: 3013410 - RNA, 19 nt, Mycobacterium avium subsp. paratuberculosis
gggccgaccuggcggccgg

SEQ ID NO: 3013411 - RNA, 15 nt, Mycobacterium avium subsp. paratuberculosis
gggccgagcgcgccg

SEQ ID NO: 3013412 - RNA, 17 nt, Mycobacterium avium subsp. paratuberculosis
gggccgagcgcgccgcc

SEQ ID NO: 3013413 - RNA, 22 nt, Mycobacterium avium subsp. paratuberculosis
gggccgaucagugccgcgccaa

SEQ ID NO: 3013414 - RNA, 14 nt, Mycobacterium avium subsp. paratuberculosis
gggccgaugaccgc

SEQ ID NO: 3013415 - RNA, 16 nt, Mycobacterium avium subsp. paratuberculosis
gggccgaugaccgcgg

SEQ ID NO: 3013416 - RNA, 23 nt, Mycobacterium avium subsp. paratuberculosis
gggccgcaauacggugcccgccg

SEQ ID NO: 3013417 - RNA, 15 nt, Mycobacterium avium subsp. paratuberculosis
gggccgcacccccuc

SEQ ID NO: 3013418 - RNA, 17 nt, Mycobacterium avium subsp. paratuberculosis
gggccgcacccccucca

SEQ ID NO: 3013419 - RNA, 14 nt, Mycobacterium avium subsp. paratuberculosis
gggccgcagcacgg

SEQ ID NO: 3013420 - RNA, 14 nt, Mycobacterium avium subsp. paratuberculosis
gggccgcagccgcg

SEQ ID NO: 3013421 - RNA, 18 nt, Mycobacterium avium subsp. paratuberculosis
gggccgcagccgcgcggc

SEQ ID NO: 3013422 - RNA, 19 nt, Mycobacterium avium subsp. paratuberculosis
gggccgcagccgcgcggcc

SEQ ID NO: 3013423 - RNA, 21 nt, Mycobacterium avium subsp. paratuberculosis
gggccgcagccgcgcggccgg

SEQ ID NO: 3013424 - RNA, 16 nt, Mycobacterium avium subsp. paratuberculosis
gggccgcagcgcgcgg

SEQ ID NO: 3013425 - RNA, 17 nt, Mycobacterium avium subsp. paratuberculosis
gggccgcagcgcggcga

SEQ ID NO: 3013426 - RNA, 20 nt, Mycobacterium avium subsp. paratuberculosis
gggccgcagcucgcccagca

SEQ ID NO: 3013427 - RNA, 19 nt, Mycobacterium avium subsp. paratuberculosis
gggccgcaggguggccagc

SEQ ID NO: 3013428 - RNA, 18 nt, Mycobacterium avium subsp. paratuberculosis
gggccgcauccagcgccg

SEQ ID NO: 3013429 - RNA, 20 nt, Mycobacterium avium subsp. paratuberculosis
gggccgcauccagcgccgcc

SEQ ID NO: 3013430 - RNA, 21 nt, Mycobacterium avium subsp. paratuberculosis
gggccgcauccagcgccgcca

SEQ ID NO: 3013431 - RNA, 15 nt, Mycobacterium avium subsp. paratuberculosis
gggccgcccgcgcgu

SEQ ID NO: 3013432 - RNA, 14 nt, Mycobacterium avium subsp. paratuberculosis
gggccgcccggcgc

SEQ ID NO: 3013433 - RNA, 20 nt, Mycobacterium avium subsp. paratuberculosis
gggccgcccggcgcgccgca

SEQ ID NO: 3013434 - RNA, 12 nt, Mycobacterium avium subsp. paratuberculosis
gggccgccgagc

SEQ ID NO: 3013435 - RNA, 14 nt, Mycobacterium avium subsp. paratuberculosis
gggccgccgagcag

SEQ ID NO: 3013436 - RNA, 20 nt, Mycobacterium avium subsp. paratuberculosis
gggccgccgaugcgcccgcu

SEQ ID NO: 3013437 - RNA, 21 nt, Mycobacterium avium subsp. paratuberculosis
gggccgccgaugcgcccgcug

SEQ ID NO: 3013438 - RNA, 21 nt, Mycobacterium avium subsp. paratuberculosis
gggccgccgcauaccgcccgc

SEQ ID NO: 3013439 - RNA, 22 nt, Mycobacterium avium subsp. paratuberculosis
gggccgccgcauaccgcccgcg

SEQ ID NO: 3013440 - RNA, 14 nt, Mycobacterium avium subsp. paratuberculosis
gggccgccgcggac

SEQ ID NO: 3013441 - RNA, 13 nt, Mycobacterium avium subsp. paratuberculosis
gggccgccgcggc

SEQ ID NO: 3013442 - RNA, 14 nt, Mycobacterium avium subsp. paratuberculosis
gggccgccggccgc

SEQ ID NO: 3013443 - RNA, 15 nt, Mycobacterium avium subsp. paratuberculosis
gggccgccggccgcg

SEQ ID NO: 3013444 - RNA, 16 nt, Mycobacterium avium subsp. paratuberculosis
gggccgccggguggcg

SEQ ID NO: 3013445 - RNA, 22 nt, Mycobacterium avium subsp. paratuberculosis
gggccgccucacgcagggccaa

SEQ ID NO: 3013446 - RNA, 15 nt, Mycobacterium avium subsp. paratuberculosis
gggccgcgagcgcua

SEQ ID NO: 3013447 - RNA, 13 nt, Mycobacterium avium subsp. paratuberculosis
gggccgcgcccag

SEQ ID NO: 3013448 - RNA, 15 nt, Mycobacterium avium subsp. paratuberculosis
gggccgcgccgaggc

SEQ ID NO: 3013449 - RNA, 16 nt, Mycobacterium avium subsp. paratuberculosis
gggccgcgccgaggcg

SEQ ID NO: 3013450 - RNA, 13 nt, Mycobacterium avium subsp. paratuberculosis
gggccgcgcgggc

SEQ ID NO: 3013451 - RNA, 13 nt, Mycobacterium avium subsp. paratuberculosis
gggccgcggccgc

SEQ ID NO: 3013452 - RNA, 14 nt, Mycobacterium avium subsp. paratuberculosis
gggccgcggccggc

SEQ ID NO: 3013453 - RNA, 13 nt, Mycobacterium avium subsp. paratuberculosis
gggccgcggcggu

SEQ ID NO: 3013454 - RNA, 14 nt, Mycobacterium avium subsp. paratuberculosis
gggccgcggcucgc

SEQ ID NO: 3013455 - RNA, 12 nt, Mycobacterium avium subsp. paratuberculosis
gggccgcgggcc

SEQ ID NO: 3013456 - RNA, 18 nt, Mycobacterium avium subsp. paratuberculosis
gggccgcuacgccgaggc

SEQ ID NO: 3013457 - RNA, 17 nt, Mycobacterium avium subsp. paratuberculosis
gggccgcuuguucgggc

SEQ ID NO: 3013458 - RNA, 16 nt, Mycobacterium avium subsp. paratuberculosis
gggccggaacgcccga

SEQ ID NO: 3013459 - RNA, 18 nt, Mycobacterium avium subsp. paratuberculosis
gggccggacacggcugca

SEQ ID NO: 3013460 - RNA, 18 nt, Mycobacterium avium subsp. paratuberculosis
gggccggacagcggcccc

SEQ ID NO: 3013461 - RNA, 16 nt, Mycobacterium avium subsp. paratuberculosis
gggccggagccuucuu

SEQ ID NO: 3013462 - RNA, 14 nt, Mycobacterium avium subsp. paratuberculosis
gggccggcacccgg

SEQ ID NO: 3013463 - RNA, 20 nt, Mycobacterium avium subsp. paratuberculosis
gggccggcacuucgaucauc

SEQ ID NO: 3013464 - RNA, 22 nt, Mycobacterium avium subsp. paratuberculosis
gggccggcacuucgaucaucuc

SEQ ID NO: 3013465 - RNA, 13 nt, Mycobacterium avium subsp. paratuberculosis
gggccggcagccg

SEQ ID NO: 3013466 - RNA, 21 nt, Mycobacterium avium subsp. paratuberculosis
gggccggcagccggccaccuc

SEQ ID NO: 3013467 - RNA, 13 nt, Mycobacterium avium subsp. paratuberculosis
gggccggcgcccg

SEQ ID NO: 3013468 - RNA, 12 nt, Mycobacterium avium subsp. paratuberculosis
gggccggcgccg

SEQ ID NO: 3013469 - RNA, 13 nt, Mycobacterium avium subsp. paratuberculosis
gggccggcgccga

SEQ ID NO: 3013470 - RNA, 19 nt, Mycobacterium avium subsp. paratuberculosis
gggccggcgccgacgacgu

SEQ ID NO: 3013471 - RNA, 14 nt, Mycobacterium avium subsp. paratuberculosis
gggccggcgccggu

SEQ ID NO: 3013472 - RNA, 16 nt, Mycobacterium avium subsp. paratuberculosis
gggccggcgccggugc

SEQ ID NO: 3013473 - RNA, 17 nt, Mycobacterium avium subsp. paratuberculosis
gggccggcgcggugcuc

SEQ ID NO: 3013474 - RNA, 14 nt, Mycobacterium avium subsp. paratuberculosis
gggccggcggccag

SEQ ID NO: 3013475 - RNA, 17 nt, Mycobacterium avium subsp. paratuberculosis
gggccggcggcggccag

SEQ ID NO: 3013476 - RNA, 18 nt, Mycobacterium avium subsp. paratuberculosis
gggccggcggcggccagc

SEQ ID NO: 3013477 - RNA, 14 nt, Mycobacterium avium subsp. paratuberculosis
gggccggcgggggc

SEQ ID NO: 3013478 - RNA, 15 nt, Mycobacterium avium subsp. paratuberculosis
gggccggcgggggcg

SEQ ID NO: 3013479 - RNA, 18 nt, Mycobacterium avium subsp. paratuberculosis
gggccggcgggggcgcgu

SEQ ID NO: 3013480 - RNA, 13 nt, Mycobacterium avium subsp. paratuberculosis
gggccggcggggu

SEQ ID NO: 3013481 - RNA, 15 nt, Mycobacterium avium subsp. paratuberculosis
gggccggcggugauc

SEQ ID NO: 3013482 - RNA, 16 nt, Mycobacterium avium subsp. paratuberculosis
gggccggcgucgcggu

SEQ ID NO: 3013483 - RNA, 22 nt, Mycobacterium avium subsp. paratuberculosis
gggccggcgucgucgagcaccg

SEQ ID NO: 3013484 - RNA, 17 nt, Mycobacterium avium subsp. paratuberculosis
gggccgggcaccgcgcc

SEQ ID NO: 3013485 - RNA, 20 nt, Mycobacterium avium subsp. paratuberculosis
gggccgggcaccgcgcccgc

SEQ ID NO: 3013486 - RNA, 16 nt, Mycobacterium avium subsp. paratuberculosis
gggccgggcgcuggcc

SEQ ID NO: 3013487 - RNA, 17 nt, Mycobacterium avium subsp. paratuberculosis
gggccgggcgggcaccc

SEQ ID NO: 3013488 - RNA, 18 nt, Mycobacterium avium subsp. paratuberculosis
gggccgggcgugcccggc

SEQ ID NO: 3013489 - RNA, 19 nt, Mycobacterium avium subsp. paratuberculosis
gggccgggcgugcccggcg

SEQ ID NO: 3013490 - RNA, 18 nt, Mycobacterium avium subsp. paratuberculosis
gggccggggcuucgaacg

SEQ ID NO: 3013491 - RNA, 16 nt, Mycobacterium avium subsp. paratuberculosis
ggcgcucgcgggugcg

SEQ ID NO: 3013492 - RNA, 17 nt, Mycobacterium avium subsp. paratuberculosis
ggcgcucgcgggugcgc

SEQ ID NO: 3013493 - RNA, 14 nt, Mycobacterium avium subsp. paratuberculosis
ggcgcucggcccgc

SEQ ID NO: 3013494 - RNA, 14 nt, Mycobacterium avium subsp. paratuberculosis
ggcgcucgucgaug

SEQ ID NO: 3013495 - RNA, 22 nt, Mycobacterium avium subsp. paratuberculosis
ggcgcugaacugcucgaccagc

SEQ ID NO: 3013496 - RNA, 22 nt, Mycobacterium avium subsp. paratuberculosis
ggcgcugaucgaguccucgcgg

SEQ ID NO: 3013497 - RNA, 12 nt, Mycobacterium avium subsp. paratuberculosis
ggcgcugaugcc

SEQ ID NO: 3013498 - RNA, 21 nt, Mycobacterium avium subsp. paratuberculosis
ggcgcugcagcagcccgauca

SEQ ID NO: 3013499 - RNA, 17 nt, Mycobacterium avium subsp. paratuberculosis
ggcgcugccccagccac

SEQ ID NO: 3013500 - RNA, 14 nt, Mycobacterium avium subsp. paratuberculosis
ggcgcugcccgccg

SEQ ID NO: 3013501 - RNA, 16 nt, Mycobacterium avium subsp. paratuberculosis
ggcgcugcccgccgcg

SEQ ID NO: 3013502 - RNA, 13 nt, Mycobacterium avium subsp. paratuberculosis
ggcgcugcccgcg

SEQ ID NO: 3013503 - RNA, 14 nt, Mycobacterium avium subsp. paratuberculosis
ggcgcugcccgcga

SEQ ID NO: 3013504 - RNA, 19 nt, Mycobacterium avium subsp. paratuberculosis
ggcgcugcccgcgaucgcc

SEQ ID NO: 3013505 - RNA, 14 nt, Mycobacterium avium subsp. paratuberculosis
ggcgcugcccgucg

SEQ ID NO: 3013506 - RNA, 17 nt, Mycobacterium avium subsp. paratuberculosis
ggcgcugcccgucgacc

SEQ ID NO: 3013507 - RNA, 20 nt, Mycobacterium avium subsp. paratuberculosis
ggcgcugcccgucgaccucc

SEQ ID NO: 3013508 - RNA, 14 nt, Mycobacterium avium subsp. paratuberculosis
ggcgcugccgagca

SEQ ID NO: 3013509 - RNA, 16 nt, Mycobacterium avium subsp. paratuberculosis
ggcgcugccgagcacc

SEQ ID NO: 3013510 - RNA, 17 nt, Mycobacterium avium subsp. paratuberculosis
ggcgcugccgccggccu

SEQ ID NO: 3013511 - RNA, 12 nt, Mycobacterium avium subsp. paratuberculosis
ggcgcugccggc

SEQ ID NO: 3013512 - RNA, 20 nt, Mycobacterium avium subsp. paratuberculosis
ggcgcugccggcgcacccgc

SEQ ID NO: 3013513 - RNA, 13 nt, Mycobacterium avium subsp. paratuberculosis
ggcgcugccggug

SEQ ID NO: 3013514 - RNA, 12 nt, Mycobacterium avium subsp. paratuberculosis
ggcgcugccguc

SEQ ID NO: 3013515 - RNA, 14 nt, Mycobacterium avium subsp. paratuberculosis
ggcgcugccguccu

SEQ ID NO: 3013516 - RNA, 23 nt, Mycobacterium avium subsp. paratuberculosis
ggcgcugcgccguugauugcgcc

SEQ ID NO: 3013517 - RNA, 15 nt, Mycobacterium avium subsp. paratuberculosis
ggcgcugcgcgacac

SEQ ID NO: 3013518 - RNA, 15 nt, Mycobacterium avium subsp. paratuberculosis
ggcgcugcgcggugg

SEQ ID NO: 3013519 - RNA, 19 nt, Mycobacterium avium subsp. paratuberculosis
ggcgcugcgcgguggcgcg

SEQ ID NO: 3013520 - RNA, 15 nt, Mycobacterium avium subsp. paratuberculosis
ggcgcugcucggagg

SEQ ID NO: 3013521 - RNA, 22 nt, Mycobacterium avium subsp. paratuberculosis
ggcgcuggaucugcccgaccug

SEQ ID NO: 3013522 - RNA, 23 nt, Mycobacterium avium subsp. paratuberculosis
ggcgcuggccgcgaacggcccgc

SEQ ID NO: 3013523 - RNA, 21 nt, Mycobacterium avium subsp. paratuberculosis
ggcgcuggccgcggccagcug

SEQ ID NO: 3013524 - RNA, 14 nt, Mycobacterium avium subsp. paratuberculosis
ggcgcuggcgaugg

SEQ ID NO: 3013525 - RNA, 16 nt, Mycobacterium avium subsp. paratuberculosis
ggcgcugggagcgggc

SEQ ID NO: 3013526 - RNA, 17 nt, Mycobacterium avium subsp. paratuberculosis
ggcgcugggagcgggcc

SEQ ID NO: 3013527 - RNA, 18 nt, Mycobacterium avium subsp. paratuberculosis
ggcgcugggagcgggcca

SEQ ID NO: 3013528 - RNA, 15 nt, Mycobacterium avium subsp. paratuberculosis
ggcgcugggugcggg

SEQ ID NO: 3013529 - RNA, 19 nt, Mycobacterium avium subsp. paratuberculosis
ggcgcugggugcgggcugc

SEQ ID NO: 3013530 - RNA, 19 nt, Mycobacterium avium subsp. paratuberculosis
ggcgcugguaguggcgugc

SEQ ID NO: 3013531 - RNA, 20 nt, Mycobacterium avium subsp. paratuberculosis
ggcgcugguaguggcgugcg

SEQ ID NO: 3013532 - RNA, 15 nt, Mycobacterium avium subsp. paratuberculosis
ggcgcugguccucgg

SEQ ID NO: 3013533 - RNA, 17 nt, Mycobacterium avium subsp. paratuberculosis
ggcgcugguccucgggg

SEQ ID NO: 3013534 - RNA, 17 nt, Mycobacterium avium subsp. paratuberculosis
ggcgcuggugcagcagg

SEQ ID NO: 3013535 - RNA, 18 nt, Mycobacterium avium subsp. paratuberculosis
ggcgcuggugcagcaggg

SEQ ID NO: 3013536 - RNA, 20 nt, Mycobacterium avium subsp. paratuberculosis
ggcgcuguaggcggcgugcc

SEQ ID NO: 3013537 - RNA, 21 nt, Mycobacterium avium subsp. paratuberculosis
ggcgcuguaggcggcgugcca

SEQ ID NO: 3013538 - RNA, 17 nt, Mycobacterium avium subsp. paratuberculosis
ggcgcuguccuggucgc

SEQ ID NO: 3013539 - RNA, 17 nt, Mycobacterium avium subsp. paratuberculosis
ggcgcuucugcgccggu

SEQ ID NO: 3013540 - RNA, 17 nt, Mycobacterium avium subsp. paratuberculosis
ggcgcuugaccucgccg

SEQ ID NO: 3013541 - RNA, 18 nt, Mycobacterium avium subsp. paratuberculosis
ggcgcuugaccucgccga

SEQ ID NO: 3013542 - RNA, 20 nt, Mycobacterium avium subsp. paratuberculosis
ggcgcuugaccucgccgagc

SEQ ID NO: 3013543 - RNA, 15 nt, Mycobacterium avium subsp. paratuberculosis
ggcgcuugacgaacg

SEQ ID NO: 3013544 - RNA, 21 nt, Mycobacterium avium subsp. paratuberculosis
ggcgcuugacgaacgccacca

SEQ ID NO: 3013545 - RNA, 19 nt, Mycobacterium avium subsp. paratuberculosis
ggcgcuugcguucccagcc

SEQ ID NO: 3013546 - RNA, 21 nt, Mycobacterium avium subsp. paratuberculosis
ggcgcuugcguucccagcccg

SEQ ID NO: 3013547 - RNA, 20 nt, Mycobacterium avium subsp. paratuberculosis
ggcgcuuucgaagugacgcc

SEQ ID NO: 3013548 - RNA, 14 nt, Mycobacterium avium subsp. paratuberculosis
ggcggaacccgggu

SEQ ID NO: 3013549 - RNA, 21 nt, Mycobacterium avium subsp. paratuberculosis
ggcggaacccggguggcccgc

SEQ ID NO: 3013550 - RNA, 23 nt, Mycobacterium avium subsp. paratuberculosis
ggcggaaccgggccgcuggccgc

SEQ ID NO: 3013551 - RNA, 16 nt, Mycobacterium avium subsp. paratuberculosis
ggcggaaggccgcgcg

SEQ ID NO: 3013552 - RNA, 17 nt, Mycobacterium avium subsp. paratuberculosis
ggcggaaguagcccgga

SEQ ID NO: 3013553 - RNA, 15 nt, Mycobacterium avium subsp. paratuberculosis
ggcggaaucgcaacc

SEQ ID NO: 3013554 - RNA, 19 nt, Mycobacterium avium subsp. paratuberculosis
ggcggaauuuucgccguca

SEQ ID NO: 3013555 - RNA, 15 nt, Mycobacterium avium subsp. paratuberculosis
ggcggacaucgccuc

SEQ ID NO: 3013556 - RNA, 19 nt, Mycobacterium avium subsp. paratuberculosis
ggcggacaucgccucggcg

SEQ ID NO: 3013557 - RNA, 13 nt, Mycobacterium avium subsp. paratuberculosis
ggcggacccagcu

SEQ ID NO: 3013558 - RNA, 22 nt, Mycobacterium avium subsp. paratuberculosis
ggcggacccagcuccucggcca

SEQ ID NO: 3013559 - RNA, 14 nt, Mycobacterium avium subsp. paratuberculosis
ggcggaccggcggc

SEQ ID NO: 3013560 - RNA, 18 nt, Mycobacterium avium subsp. paratuberculosis
ggcggaccggcggccgcc

SEQ ID NO: 3013561 - RNA, 20 nt, Mycobacterium avium subsp. paratuberculosis
ggcggacgauguccgccggc

SEQ ID NO: 3013562 - RNA, 22 nt, Mycobacterium avium subsp. paratuberculosis
ggcggacgauguccgccggccg

SEQ ID NO: 3013563 - RNA, 14 nt, Mycobacterium avium subsp. paratuberculosis
ggcggacgcggcca

SEQ ID NO: 3013564 - RNA, 22 nt, Mycobacterium avium subsp. paratuberculosis
ggcggacgcggccagcgcccgc

SEQ ID NO: 3013565 - RNA, 15 nt, Mycobacterium avium subsp. paratuberculosis
ggcggacggcaccga

SEQ ID NO: 3013566 - RNA, 12 nt, Mycobacterium avium subsp. paratuberculosis
ggcggacggcga

SEQ ID NO: 3013567 - RNA, 12 nt, Mycobacterium avium subsp. paratuberculosis
ggcggacgggac

SEQ ID NO: 3013568 - RNA, 14 nt, Mycobacterium avium subsp. paratuberculosis
ggcggacgggacca

SEQ ID NO: 3013569 - RNA, 18 nt, Mycobacterium avium subsp. paratuberculosis
ggcggacgggaccacccg

SEQ ID NO: 3013570 - RNA, 19 nt, Mycobacterium avium subsp. paratuberculosis
ggcggacggucccgacgcu

SEQ ID NO: 3013571 - RNA, 20 nt, Mycobacterium avium subsp. paratuberculosis
ggcggacggucccgacgcug

SEQ ID NO: 3013572 - RNA, 13 nt, Mycobacterium avium subsp. paratuberculosis
ggcggacucggcg

SEQ ID NO: 3013573 - RNA, 22 nt, Mycobacterium avium subsp. paratuberculosis
ggcggacucggcgaagucauca

SEQ ID NO: 3013574 - RNA, 22 nt, Mycobacterium avium subsp. paratuberculosis
ggcggacucguuggggccacca

SEQ ID NO: 3013575 - RNA, 23 nt, Mycobacterium avium subsp. paratuberculosis
ggcggacucguuggggccaccag

SEQ ID NO: 3013576 - RNA, 21 nt, Mycobacterium avium subsp. paratuberculosis
ggcggccaccgcggccagcug

SEQ ID NO: 3013577 - RNA, 17 nt, Mycobacterium avium subsp. paratuberculosis
ggcggccaccucgccgc

SEQ ID NO: 3013578 - RNA, 21 nt, Mycobacterium avium subsp. paratuberculosis
ggcggccaccucgccgcaggc

SEQ ID NO: 3013579 - RNA, 19 nt, Mycobacterium avium subsp. paratuberculosis
ggcggccaccucggcggca

SEQ ID NO: 3013580 - RNA, 17 nt, Mycobacterium avium subsp. paratuberculosis
ggcggccacgacggcgc

SEQ ID NO: 3013581 - RNA, 23 nt, Mycobacterium avium subsp. paratuberculosis
ggcggccacgacggcgcuggccg

SEQ ID NO: 3013582 - RNA, 14 nt, Mycobacterium avium subsp. paratuberculosis
ggcggccacgaucg

SEQ ID NO: 3013583 - RNA, 17 nt, Mycobacterium avium subsp. paratuberculosis
ggcggccacgaucgcgg

SEQ ID NO: 3013584 - RNA, 22 nt, Mycobacterium avium subsp. paratuberculosis
ggcggccacgaucgcggccagc

SEQ ID NO: 3013585 - RNA, 14 nt, Mycobacterium avium subsp. paratuberculosis
ggcggccacgaugg

SEQ ID NO: 3013586 - RNA, 13 nt, Mycobacterium avium subsp. paratuberculosis
ggcggccacgcag

SEQ ID NO: 3013587 - RNA, 15 nt, Mycobacterium avium subsp. paratuberculosis
ggcggccacgcaggc

SEQ ID NO: 3013588 - RNA, 20 nt, Mycobacterium avium subsp. paratuberculosis
ggcggccacgcaggcgucca

SEQ ID NO: 3013589 - RNA, 21 nt, Mycobacterium avium subsp. paratuberculosis
ggcggccacgcuagcgugacg

SEQ ID NO: 3013590 - RNA, 11 nt, Mycobacterium avium subsp. paratuberculosis
ggcggccagca

SEQ ID NO: 3013591 - RNA, 13 nt, Mycobacterium avium subsp. paratuberculosis
ggcggccagcacc

SEQ ID NO: 3013592 - RNA, 14 nt, Mycobacterium avium subsp. paratuberculosis
ggcggccagcacca

SEQ ID NO: 3013593 - RNA, 12 nt, Mycobacterium avium subsp. paratuberculosis
ggcggccagcag

SEQ ID NO: 3013594 - RNA, 11 nt, Mycobacterium avium subsp. paratuberculosis
ggcggccagcc

SEQ ID NO: 3013595 - RNA, 19 nt, Mycobacterium avium subsp. paratuberculosis
ggcggccagccgcgcggcg

SEQ ID NO: 3013596 - RNA, 20 nt, Mycobacterium avium subsp. paratuberculosis
ggcggccagccgcgcggcgu

SEQ ID NO: 3013597 - RNA, 14 nt, Mycobacterium avium subsp. paratuberculosis
ggcggccagcgagu

SEQ ID NO: 3013598 - RNA, 18 nt, Mycobacterium avium subsp. paratuberculosis
ggcggccagcgagucgau

SEQ ID NO: 3013599 - RNA, 12 nt, Mycobacterium avium subsp. paratuberculosis
ggcggccagcgc

SEQ ID NO: 3013600 - RNA, 21 nt, Mycobacterium avium subsp. paratuberculosis
ggcggccagcgcccgcgggug

SEQ ID NO: 3013601 - RNA, 22 nt, Mycobacterium avium subsp. paratuberculosis
ggcggccagcgcccgcgggugc

SEQ ID NO: 3013602 - RNA, 13 nt, Mycobacterium avium subsp. paratuberculosis
ggcggccagcgcg

SEQ ID NO: 3013603 - RNA, 14 nt, Mycobacterium avium subsp. paratuberculosis
ggcggccagcgcga

SEQ ID NO: 3013604 - RNA, 16 nt, Mycobacterium avium subsp. paratuberculosis
ggcggccagcgcgacg

SEQ ID NO: 3013605 - RNA, 17 nt, Mycobacterium avium subsp. paratuberculosis
ggcggccagcgcgccgc

SEQ ID NO: 3013606 - RNA, 19 nt, Mycobacterium avium subsp. paratuberculosis
ggcggccagcgcgccgccg

SEQ ID NO: 3013607 - RNA, 15 nt, Mycobacterium avium subsp. paratuberculosis
ggcggccagcguggc

SEQ ID NO: 3013608 - RNA, 16 nt, Mycobacterium avium subsp. paratuberculosis
ggcggccagcucccgg

SEQ ID NO: 3013609 - RNA, 22 nt, Mycobacterium avium subsp. paratuberculosis
ggcggccagcucccgggcggcg

SEQ ID NO: 3013610 - RNA, 20 nt, Mycobacterium avium subsp. paratuberculosis
ggcggccagcucggcccgcu

SEQ ID NO: 3013611 - RNA, 16 nt, Mycobacterium avium subsp. paratuberculosis
ggcggccaggccggcg

SEQ ID NO: 3013612 - RNA, 19 nt, Mycobacterium avium subsp. paratuberculosis
ggcggccaggccggcgacg

SEQ ID NO: 3013613 - RNA, 16 nt, Mycobacterium avium subsp. paratuberculosis
ggcggccagggcggcg

SEQ ID NO: 3013614 - RNA, 18 nt, Mycobacterium avium subsp. paratuberculosis
ggcggccagggcggcgcc

SEQ ID NO: 3013615 - RNA, 19 nt, Mycobacterium avium subsp. paratuberculosis
ggcggccagggcggcgccg

SEQ ID NO: 3013616 - RNA, 15 nt, Mycobacterium avium subsp. paratuberculosis
ggcggccaggguguc

SEQ ID NO: 3013617 - RNA, 20 nt, Mycobacterium avium subsp. paratuberculosis
ggcggccaguucgagcgccg

SEQ ID NO: 3013618 - RNA, 21 nt, Mycobacterium avium subsp. paratuberculosis
ggcggccaguugacguugauc

SEQ ID NO: 3013619 - RNA, 22 nt, Mycobacterium avium subsp. paratuberculosis
ggcggccauauaggggugggcg

SEQ ID NO: 3013620 - RNA, 14 nt, Mycobacterium avium subsp. paratuberculosis
ggcggccaucgccg

SEQ ID NO: 3013621 - RNA, 15 nt, Mycobacterium avium subsp. paratuberculosis
ggcggccaucgccgc

SEQ ID NO: 3013622 - RNA, 18 nt, Mycobacterium avium subsp. paratuberculosis
ggcggccaucgccgcggu

SEQ ID NO: 3013623 - RNA, 22 nt, Mycobacterium avium subsp. paratuberculosis
ggcggccaucucgugcccgggc

SEQ ID NO: 3013624 - RNA, 20 nt, Mycobacterium avium subsp. paratuberculosis
ggcggccauggucgcggccg

SEQ ID NO: 3013625 - RNA, 17 nt, Mycobacterium avium subsp. paratuberculosis
ggcggccauucaucgcg

SEQ ID NO: 3013626 - RNA, 21 nt, Mycobacterium avium subsp. paratuberculosis
ggcggccauucaucgcgcacc

SEQ ID NO: 3013627 - RNA, 22 nt, Mycobacterium avium subsp. paratuberculosis
ggcggccauucaucgcgcacca

SEQ ID NO: 3013628 - RNA, 20 nt, Mycobacterium avium subsp. paratuberculosis
ggcggccccgguagccagca

SEQ ID NO: 3013629 - RNA, 22 nt, Mycobacterium avium subsp. paratuberculosis
ggcggccccuucgaugucgccg

SEQ ID NO: 3013630 - RNA, 17 nt, Mycobacterium avium subsp. paratuberculosis
ggcggcccgaccagcgg

SEQ ID NO: 3013631 - RNA, 21 nt, Mycobacterium avium subsp. paratuberculosis
ggcggcccgaccagcgggccg

SEQ ID NO: 3013632 - RNA, 12 nt, Mycobacterium avium subsp. paratuberculosis
ggcggcccgcac

SEQ ID NO: 3013633 - RNA, 14 nt, Mycobacterium avium subsp. paratuberculosis
ggcggcccgcacgg

SEQ ID NO: 3013634 - RNA, 17 nt, Mycobacterium avium subsp. paratuberculosis
ggcggcccgcacggccg

SEQ ID NO: 3013635 - RNA, 14 nt, Mycobacterium avium subsp. paratuberculosis
ggcggcccgcagga

SEQ ID NO: 3013636 - RNA, 12 nt, Mycobacterium avium subsp. paratuberculosis
ggcggcccgcau

SEQ ID NO: 3013637 - RNA, 17 nt, Mycobacterium avium subsp. paratuberculosis
ggcggcccgccgcgccc

SEQ ID NO: 3013638 - RNA, 19 nt, Mycobacterium avium subsp. paratuberculosis
ggcggcccgccgcgcccgg

SEQ ID NO: 3013639 - RNA, 20 nt, Mycobacterium avium subsp. paratuberculosis
ggcggcccgccgcgcccggc

SEQ ID NO: 3013640 - RNA, 14 nt, Mycobacterium avium subsp. paratuberculosis
ggcggcccgccgga

SEQ ID NO: 3013641 - RNA, 15 nt, Mycobacterium avium subsp. paratuberculosis
ggcggcccgccucgg

SEQ ID NO: 3013642 - RNA, 21 nt, Mycobacterium avium subsp. paratuberculosis
ggcggcccgcgccggcguguc

SEQ ID NO: 3013643 - RNA, 18 nt, Mycobacterium avium subsp. paratuberculosis
ggcggcccgcgcgggguc

SEQ ID NO: 3013644 - RNA, 20 nt, Mycobacterium avium subsp. paratuberculosis
ggcggcccgcgcgggguccc

SEQ ID NO: 3013645 - RNA, 14 nt, Mycobacterium avium subsp. paratuberculosis
ggcggcccgcucga

SEQ ID NO: 3013646 - RNA, 16 nt, Mycobacterium avium subsp. paratuberculosis
ggcggcccgcuugccg

SEQ ID NO: 3013647 - RNA, 15 nt, Mycobacterium avium subsp. paratuberculosis
ggcggcccggcguca

SEQ ID NO: 3013648 - RNA, 21 nt, Mycobacterium avium subsp. paratuberculosis
ggcggcccggcgucacgcugg

SEQ ID NO: 3013649 - RNA, 19 nt, Mycobacterium avium subsp. paratuberculosis
ggcggcccguccgccccgc

SEQ ID NO: 3013650 - RNA, 14 nt, Mycobacterium avium subsp. paratuberculosis
ggcggcccgucgcc

SEQ ID NO: 3013651 - RNA, 15 nt, Mycobacterium avium subsp. paratuberculosis
ggcggcccgucgcca

SEQ ID NO: 3013652 - RNA, 23 nt, Mycobacterium avium subsp. paratuberculosis
ggcggcccgucgccaccacggcg

SEQ ID NO: 3013653 - RNA, 18 nt, Mycobacterium avium subsp. paratuberculosis
ggcggccgaauccggccg

SEQ ID NO: 3013654 - RNA, 17 nt, Mycobacterium avium subsp. paratuberculosis
ggcggccgacccugcgu

SEQ ID NO: 3013655 - RNA, 18 nt, Mycobacterium avium subsp. paratuberculosis
ggcggccgacgcgccguc

SEQ ID NO: 3013656 - RNA, 21 nt, Mycobacterium avium subsp. paratuberculosis
ggcggccgagcgcaccgcgga

SEQ ID NO: 3013657 - RNA, 17 nt, Mycobacterium avium subsp. paratuberculosis
ggcggccgccacgcugg

SEQ ID NO: 3013658 - RNA, 20 nt, Mycobacterium avium subsp. paratuberculosis
ggcggccgccacgcuggugu

SEQ ID NO: 3013659 - RNA, 14 nt, Mycobacterium avium subsp. paratuberculosis
ggcggccgccagcg

SEQ ID NO: 3013660 - RNA, 14 nt, Mycobacterium avium subsp. paratuberculosis
ggcggccgccauca

SEQ ID NO: 3013661 - RNA, 15 nt, Mycobacterium avium subsp. paratuberculosis
ggcggcgaccgcgac

SEQ ID NO: 3013662 - RNA, 14 nt, Mycobacterium avium subsp. paratuberculosis
ggcggcgacgaugc

SEQ ID NO: 3013663 - RNA, 19 nt, Mycobacterium avium subsp. paratuberculosis
ggcggcgacgaugcggccg

SEQ ID NO: 3013664 - RNA, 23 nt, Mycobacterium avium subsp. paratuberculosis
ggcggcgacgaugcggccguugg

SEQ ID NO: 3013665 - RNA, 16 nt, Mycobacterium avium subsp. paratuberculosis
ggcggcgacggcaccg

SEQ ID NO: 3013666 - RNA, 22 nt, Mycobacterium avium subsp. paratuberculosis
ggcggcgacggcaccgccggcg

SEQ ID NO: 3013667 - RNA, 14 nt, Mycobacterium avium subsp. paratuberculosis
ggcggcgacggcga

SEQ ID NO: 3013668 - RNA, 15 nt, Mycobacterium avium subsp. paratuberculosis
ggcggcgacggcgac

SEQ ID NO: 3013669 - RNA, 20 nt, Mycobacterium avium subsp. paratuberculosis
ggcggcgacggcgaccacac

SEQ ID NO: 3013670 - RNA, 20 nt, Mycobacterium avium subsp. paratuberculosis
ggcggcgacggcgacggcca

SEQ ID NO: 3013671 - RNA, 13 nt, Mycobacterium avium subsp. paratuberculosis
ggcggcgacgucg

SEQ ID NO: 3013672 - RNA, 18 nt, Mycobacterium avium subsp. paratuberculosis
ggcggcgacgucgacggc

SEQ ID NO: 3013673 - RNA, 22 nt, Mycobacterium avium subsp. paratuberculosis
ggcggcgacgucgacggcagcg

SEQ ID NO: 3013674 - RNA, 14 nt, Mycobacterium avium subsp. paratuberculosis
ggcggcgacgugcc

SEQ ID NO: 3013675 - RNA, 18 nt, Mycobacterium avium subsp. paratuberculosis
ggcggcgacgugccggcg

SEQ ID NO: 3013676 - RNA, 21 nt, Mycobacterium avium subsp. paratuberculosis
ggcggcgacgugccggcggca

SEQ ID NO: 3013677 - RNA, 19 nt, Mycobacterium avium subsp. paratuberculosis
ggcggcgagcugaucggcg

SEQ ID NO: 3013678 - RNA, 21 nt, Mycobacterium avium subsp. paratuberculosis
ggcggcgagcugaucggcguu

SEQ ID NO: 3013679 - RNA, 20 nt, Mycobacterium avium subsp. paratuberculosis
ggcggcgaggacgucgucga

SEQ ID NO: 3013680 - RNA, 21 nt, Mycobacterium avium subsp. paratuberculosis
ggcggcgaggacgucgucgac

SEQ ID NO: 3013681 - RNA, 13 nt, Mycobacterium avium subsp. paratuberculosis
ggcggcgaguccg

SEQ ID NO: 3013682 - RNA, 17 nt, Mycobacterium avium subsp. paratuberculosis
ggcggcgaguccggcca

SEQ ID NO: 3013683 - RNA, 17 nt, Mycobacterium avium subsp. paratuberculosis
ggcggcgaguucggcgg

SEQ ID NO: 3013684 - RNA, 18 nt, Mycobacterium avium subsp. paratuberculosis
ggcggcgaucaccgccgc

SEQ ID NO: 3013685 - RNA, 22 nt, Mycobacterium avium subsp. paratuberculosis
ggcggcgaucaccgccgcggcg

SEQ ID NO: 3013686 - RNA, 19 nt, Mycobacterium avium subsp. paratuberculosis
ggcggcgauccggccggcg

SEQ ID NO: 3013687 - RNA, 20 nt, Mycobacterium avium subsp. paratuberculosis
ggcggcgauccggccggcgg

SEQ ID NO: 3013688 - RNA, 22 nt, Mycobacterium avium subsp. paratuberculosis
ggcggcgauccggccggcggcg

SEQ ID NO: 3013689 - RNA, 13 nt, Mycobacterium avium subsp. paratuberculosis
ggcggcgaucgcc

SEQ ID NO: 3013690 - RNA, 14 nt, Mycobacterium avium subsp. paratuberculosis
ggcggcgaucgccg

SEQ ID NO: 3013691 - RNA, 19 nt, Mycobacterium avium subsp. paratuberculosis
ggcggcgaucggcgcggcg

SEQ ID NO: 3013692 - RNA, 16 nt, Mycobacterium avium subsp. paratuberculosis
ggcggcgaugaucggg

SEQ ID NO: 3013693 - RNA, 12 nt, Mycobacterium avium subsp. paratuberculosis
ggcggcgcagcc

SEQ ID NO: 3013694 - RNA, 16 nt, Mycobacterium avium subsp. paratuberculosis
ggcggcgcagccagcg

SEQ ID NO: 3013695 - RNA, 17 nt, Mycobacterium avium subsp. paratuberculosis
ggcggcgcaggcgcgca

SEQ ID NO: 3013696 - RNA, 14 nt, Mycobacterium avium subsp. paratuberculosis
ggcggcgcccgaca

SEQ ID NO: 3013697 - RNA, 14 nt, Mycobacterium avium subsp. paratuberculosis
ggcggcgcccgcgg

SEQ ID NO: 3013698 - RNA, 20 nt, Mycobacterium avium subsp. paratuberculosis
ggcggcgcccgcggccucca

SEQ ID NO: 3013699 - RNA, 14 nt, Mycobacterium avium subsp. paratuberculosis
ggcggcgcccugcg

SEQ ID NO: 3013700 - RNA, 12 nt, Mycobacterium avium subsp. paratuberculosis
ggcggcgccgaa

SEQ ID NO: 3013701 - RNA, 23 nt, Mycobacterium avium subsp. paratuberculosis
ggcggcgccgaaccgggugacga

SEQ ID NO: 3013702 - RNA, 19 nt, Mycobacterium avium subsp. paratuberculosis
ggcggcgccgaacucggcg

SEQ ID NO: 3013703 - RNA, 18 nt, Mycobacterium avium subsp. paratuberculosis
ggcggcgccgacgggccc

SEQ ID NO: 3013704 - RNA, 23 nt, Mycobacterium avium subsp. paratuberculosis
ggcggcgccgacgggcccgcgcc

SEQ ID NO: 3013705 - RNA, 12 nt, Mycobacterium avium subsp. paratuberculosis
ggcggcgccgca

SEQ ID NO: 3013706 - RNA, 15 nt, Mycobacterium avium subsp. paratuberculosis
ggcggcgccgcagca

SEQ ID NO: 3013707 - RNA, 16 nt, Mycobacterium avium subsp. paratuberculosis
ggcggcgccgcagcac

SEQ ID NO: 3013708 - RNA, 18 nt, Mycobacterium avium subsp. paratuberculosis
ggcggcgccgcagcacgc

SEQ ID NO: 3013709 - RNA, 13 nt, Mycobacterium avium subsp. paratuberculosis
ggcggcgccgcgg

SEQ ID NO: 3013710 - RNA, 14 nt, Mycobacterium avium subsp. paratuberculosis
ggcggcgccgcggc

SEQ ID NO: 3013711 - RNA, 18 nt, Mycobacterium avium subsp. paratuberculosis
ggcggcgccgcggcccug

SEQ ID NO: 3013712 - RNA, 22 nt, Mycobacterium avium subsp. paratuberculosis
ggcggcgccgcgguagcggacc

SEQ ID NO: 3013713 - RNA, 17 nt, Mycobacterium avium subsp. paratuberculosis
ggcggcgccggaggcca

SEQ ID NO: 3013714 - RNA, 21 nt, Mycobacterium avium subsp. paratuberculosis
ggcggcgccggaugccagcag

SEQ ID NO: 3013715 - RNA, 23 nt, Mycobacterium avium subsp. paratuberculosis
ggcggcgccggaugccagcaggu

SEQ ID NO: 3013716 - RNA, 19 nt, Mycobacterium avium subsp. paratuberculosis
ggcggcgccggcacugcug

SEQ ID NO: 3013717 - RNA, 18 nt, Mycobacterium avium subsp. paratuberculosis
ggcggcgccggccgggcu

SEQ ID NO: 3013718 - RNA, 16 nt, Mycobacterium avium subsp. paratuberculosis
ggcggcgccggggcuc

SEQ ID NO: 3013719 - RNA, 22 nt, Mycobacterium avium subsp. paratuberculosis
ggcggcgccgucgaccagcuug

SEQ ID NO: 3013720 - RNA, 21 nt, Mycobacterium avium subsp. paratuberculosis
ggcggcgccgucgccgaucac

SEQ ID NO: 3013721 - RNA, 11 nt, Mycobacterium avium subsp. paratuberculosis
ggcggcgcgca

SEQ ID NO: 3013722 - RNA, 13 nt, Mycobacterium avium subsp. paratuberculosis
ggcggcgcgcagc

SEQ ID NO: 3013723 - RNA, 12 nt, Mycobacterium avium subsp. paratuberculosis
ggcggcgcgcca

SEQ ID NO: 3013724 - RNA, 13 nt, Mycobacterium avium subsp. paratuberculosis
ggcggcgcgccag

SEQ ID NO: 3013725 - RNA, 14 nt, Mycobacterium avium subsp. paratuberculosis
ggcggcgcgccagc

SEQ ID NO: 3013726 - RNA, 16 nt, Mycobacterium avium subsp. paratuberculosis
ggcggcgcgccagcgu

SEQ ID NO: 3013727 - RNA, 16 nt, Mycobacterium avium subsp. paratuberculosis
ggcggcgcgccggccg

SEQ ID NO: 3013728 - RNA, 14 nt, Mycobacterium avium subsp. paratuberculosis
ggcggcgcgcgcca

SEQ ID NO: 3013729 - RNA, 13 nt, Mycobacterium avium subsp. paratuberculosis
ggcggcgcgcugc

SEQ ID NO: 3013730 - RNA, 22 nt, Mycobacterium avium subsp. paratuberculosis
ggcggcgcgcugcaggcccggg

SEQ ID NO: 3013731 - RNA, 14 nt, Mycobacterium avium subsp. paratuberculosis
ggcggcgcgcugcg

SEQ ID NO: 3013732 - RNA, 19 nt, Mycobacterium avium subsp. paratuberculosis
ggcggcgcggaucucgcgc

SEQ ID NO: 3013733 - RNA, 15 nt, Mycobacterium avium subsp. paratuberculosis
ggcggcgcggcagga

SEQ ID NO: 3013734 - RNA, 17 nt, Mycobacterium avium subsp. paratuberculosis
ggcggcgcggcaggaau

SEQ ID NO: 3013735 - RNA, 13 nt, Mycobacterium avium subsp. paratuberculosis
ggcggcgcggccc

SEQ ID NO: 3013736 - RNA, 19 nt, Mycobacterium avium subsp. paratuberculosis
ggcggcgcggcccagggcg

SEQ ID NO: 3013737 - RNA, 12 nt, Mycobacterium avium subsp. paratuberculosis
ggcggcgcggcg

SEQ ID NO: 3013738 - RNA, 14 nt, Mycobacterium avium subsp. paratuberculosis
ggcggcgcggcgca

SEQ ID NO: 3013739 - RNA, 20 nt, Mycobacterium avium subsp. paratuberculosis
ggcggcgcggcgcagcgcga

SEQ ID NO: 3013740 - RNA, 13 nt, Mycobacterium avium subsp. paratuberculosis
ggcggcgcggcgg

SEQ ID NO: 3013741 - RNA, 20 nt, Mycobacterium avium subsp. paratuberculosis
ggcggcgcgugcgccgcggc

SEQ ID NO: 3013742 - RNA, 22 nt, Mycobacterium avium subsp. paratuberculosis
ggcggcgcgugcgccgcggcgg

SEQ ID NO: 3013743 - RNA, 19 nt, Mycobacterium avium subsp. paratuberculosis
ggcggcgcucagcgcggcg

SEQ ID NO: 3013744 - RNA, 17 nt, Mycobacterium avium subsp. paratuberculosis
ggcggcgcugccccagc

SEQ ID NO: 3013745 - RNA, 17 nt, Mycobacterium avium subsp. paratuberculosis
ggcggcgcuggucggcg

SEQ ID NO: 3013746 - RNA, 18 nt, Mycobacterium avium subsp. paratuberculosis
ggcggcugggccgcggcg

SEQ ID NO: 3013747 - RNA, 21 nt, Mycobacterium avium subsp. paratuberculosis
ggcggcugggccgcggcgccg

SEQ ID NO: 3013748 - RNA, 17 nt, Mycobacterium avium subsp. paratuberculosis
ggcggcugugaucgcug

SEQ ID NO: 3013749 - RNA, 21 nt, Mycobacterium avium subsp. paratuberculosis
ggcgggaaaccaccugccgca

SEQ ID NO: 3013750 - RNA, 20 nt, Mycobacterium avium subsp. paratuberculosis
ggcgggaacucgaugcggca

SEQ ID NO: 3013751 - RNA, 12 nt, Mycobacterium avium subsp. paratuberculosis
ggcgggaaucac

SEQ ID NO: 3013752 - RNA, 23 nt, Mycobacterium avium subsp. paratuberculosis
ggcgggaaucacgccccaggcgc

SEQ ID NO: 3013753 - RNA, 16 nt, Mycobacterium avium subsp. paratuberculosis
ggcgggacccgcgacc

SEQ ID NO: 3013754 - RNA, 19 nt, Mycobacterium avium subsp. paratuberculosis
ggcgggacgaaugucucga

SEQ ID NO: 3013755 - RNA, 20 nt, Mycobacterium avium subsp. paratuberculosis
ggcgggacgaaugucucgau

SEQ ID NO: 3013756 - RNA, 14 nt, Mycobacterium avium subsp. paratuberculosis
ggcgggagccggcg

SEQ ID NO: 3013757 - RNA, 17 nt, Mycobacterium avium subsp. paratuberculosis
ggcgggagccggcggcg

SEQ ID NO: 3013758 - RNA, 21 nt, Mycobacterium avium subsp. paratuberculosis
ggcgggagccggcggcggugc

SEQ ID NO: 3013759 - RNA, 16 nt, Mycobacterium avium subsp. paratuberculosis
ggcgggaucgcggcgg

SEQ ID NO: 3013760 - RNA, 17 nt, Mycobacterium avium subsp. paratuberculosis
ggcgggaucgcggcggu

SEQ ID NO: 3013761 - RNA, 14 nt, Mycobacterium avium subsp. paratuberculosis
ggcgggaucggacc

SEQ ID NO: 3013762 - RNA, 16 nt, Mycobacterium avium subsp. paratuberculosis
ggcgggaucggaccgc

SEQ ID NO: 3013763 - RNA, 16 nt, Mycobacterium avium subsp. paratuberculosis
ggcgggcaccccaucg

SEQ ID NO: 3013764 - RNA, 24 nt, Mycobacterium avium subsp. paratuberculosis
ggcgggcaccucgaugccgugccg

SEQ ID NO: 3013765 - RNA, 17 nt, Mycobacterium avium subsp. paratuberculosis
ggcgggcaccucggcca

SEQ ID NO: 3013766 - RNA, 14 nt, Mycobacterium avium subsp. paratuberculosis
ggcgggcacgucgc

SEQ ID NO: 3013767 - RNA, 22 nt, Mycobacterium avium subsp. paratuberculosis
ggcgggcacgucgcgcgggguc

SEQ ID NO: 3013768 - RNA, 19 nt, Mycobacterium avium subsp. paratuberculosis
ggcgggcagcaccagcggc

SEQ ID NO: 3013769 - RNA, 20 nt, Mycobacterium avium subsp. paratuberculosis
ggcgggcaggcccgagcccg

SEQ ID NO: 3013770 - RNA, 23 nt, Mycobacterium avium subsp. paratuberculosis
ggcgggcaggcccgagcccgacg

SEQ ID NO: 3013771 - RNA, 13 nt, Mycobacterium avium subsp. paratuberculosis
ggcgggcauacug

SEQ ID NO: 3013772 - RNA, 22 nt, Mycobacterium avium subsp. paratuberculosis
ggcgggcauacugcuugccguc

SEQ ID NO: 3013773 - RNA, 15 nt, Mycobacterium avium subsp. paratuberculosis
ggcgggccagcucga

SEQ ID NO: 3013774 - RNA, 19 nt, Mycobacterium avium subsp. paratuberculosis
ggcgggccagcucgaacac

SEQ ID NO: 3013775 - RNA, 14 nt, Mycobacterium avium subsp. paratuberculosis
ggcgggccaggcgg

SEQ ID NO: 3013776 - RNA, 15 nt, Mycobacterium avium subsp. paratuberculosis
ggcgggccagucgcc

SEQ ID NO: 3013777 - RNA, 15 nt, Mycobacterium avium subsp. paratuberculosis
ggcgggcccagcaga

SEQ ID NO: 3013778 - RNA, 16 nt, Mycobacterium avium subsp. paratuberculosis
ggcgggcccgcagcuc

SEQ ID NO: 3013779 - RNA, 15 nt, Mycobacterium avium subsp. paratuberculosis
ggcgggcccggcgau

SEQ ID NO: 3013780 - RNA, 20 nt, Mycobacterium avium subsp. paratuberculosis
ggcgggcccggcgaugcgca

SEQ ID NO: 3013781 - RNA, 12 nt, Mycobacterium avium subsp. paratuberculosis
ggcgggcccggg

SEQ ID NO: 3013782 - RNA, 14 nt, Mycobacterium avium subsp. paratuberculosis
ggcgggcccgggcg

SEQ ID NO: 3013783 - RNA, 12 nt, Mycobacterium avium subsp. paratuberculosis
ggcgggcccguc

SEQ ID NO: 3013784 - RNA, 15 nt, Mycobacterium avium subsp. paratuberculosis
ggcgggcccgucgcc

SEQ ID NO: 3013785 - RNA, 16 nt, Mycobacterium avium subsp. paratuberculosis
ggcgggcccgucgccg

SEQ ID NO: 3013786 - RNA, 19 nt, Mycobacterium avium subsp. paratuberculosis
ggcgggcccgucgccggcg

SEQ ID NO: 3013787 - RNA, 21 nt, Mycobacterium avium subsp. paratuberculosis
ggcgggcccgucgccggcgcg

SEQ ID NO: 3013788 - RNA, 23 nt, Mycobacterium avium subsp. paratuberculosis
ggcgggcccgucgccggcgcgca

SEQ ID NO: 3013789 - RNA, 21 nt, Mycobacterium avium subsp. paratuberculosis
ggcgggccgcaauacggugcc

SEQ ID NO: 3013790 - RNA, 15 nt, Mycobacterium avium subsp. paratuberculosis
ggcgggccgccaggu

SEQ ID NO: 3013791 - RNA, 23 nt, Mycobacterium avium subsp. paratuberculosis
ggcgggccgccagguuggcggcg

SEQ ID NO: 3013792 - RNA, 15 nt, Mycobacterium avium subsp. paratuberculosis
ggcgggccgcccggc

SEQ ID NO: 3013793 - RNA, 12 nt, Mycobacterium avium subsp. paratuberculosis
ggcgggccgccg

SEQ ID NO: 3013794 - RNA, 13 nt, Mycobacterium avium subsp. paratuberculosis
ggcgggccgccgg

SEQ ID NO: 3013795 - RNA, 14 nt, Mycobacterium avium subsp. paratuberculosis
ggcgggccgccggg

SEQ ID NO: 3013796 - RNA, 14 nt, Mycobacterium avium subsp. paratuberculosis
ggcgggccggcgcc

SEQ ID NO: 3013797 - RNA, 15 nt, Mycobacterium avium subsp. paratuberculosis
ggcgggccggcgccg

SEQ ID NO: 3013798 - RNA, 14 nt, Mycobacterium avium subsp. paratuberculosis
ggcgggccgguccc

SEQ ID NO: 3013799 - RNA, 19 nt, Mycobacterium avium subsp. paratuberculosis
ggcgggccgguccccggcg

SEQ ID NO: 3013800 - RNA, 11 nt, Mycobacterium avium subsp. paratuberculosis
ggcgggccucg

SEQ ID NO: 3013801 - RNA, 14 nt, Mycobacterium avium subsp. paratuberculosis
ggcgggccucgccg

SEQ ID NO: 3013802 - RNA, 15 nt, Mycobacterium avium subsp. paratuberculosis
ggcgggccucgccgc

SEQ ID NO: 3013803 - RNA, 20 nt, Mycobacterium avium subsp. paratuberculosis
ggcgggccuugagcaccgcg

SEQ ID NO: 3013804 - RNA, 21 nt, Mycobacterium avium subsp. paratuberculosis
ggcgggccuugagcaccgcgu

SEQ ID NO: 3013805 - RNA, 12 nt, Mycobacterium avium subsp. paratuberculosis
ggcgggcgaagc

SEQ ID NO: 3013806 - RNA, 14 nt, Mycobacterium avium subsp. paratuberculosis
ggcgggcgaagcga

SEQ ID NO: 3013807 - RNA, 20 nt, Mycobacterium avium subsp. paratuberculosis
ggcgggcgaaguagccggcg

SEQ ID NO: 3013808 - RNA, 15 nt, Mycobacterium avium subsp. paratuberculosis
ggcgggcgccggucg

SEQ ID NO: 3013809 - RNA, 17 nt, Mycobacterium avium subsp. paratuberculosis
ggcgggcgccggucggc

SEQ ID NO: 3013810 - RNA, 18 nt, Mycobacterium avium subsp. paratuberculosis
ggcgggcgccggucggcg

SEQ ID NO: 3013811 - RNA, 20 nt, Mycobacterium avium subsp. paratuberculosis
ggcgggcgccuucuuggcgg

SEQ ID NO: 3013812 - RNA, 12 nt, Mycobacterium avium subsp. paratuberculosis
ggcgggcgcgcc

SEQ ID NO: 3013813 - RNA, 13 nt, Mycobacterium avium subsp. paratuberculosis
ggcgggcgcgccg

SEQ ID NO: 3013814 - RNA, 23 nt, Mycobacterium avium subsp. paratuberculosis
ggcgggcgcgcgccucgcguacc

SEQ ID NO: 3013815 - RNA, 11 nt, Mycobacterium avium subsp. paratuberculosis
ggcgggcgcgu

SEQ ID NO: 3013816 - RNA, 23 nt, Mycobacterium avium subsp. paratuberculosis
ggcgggcgcguugaugccgugcg

SEQ ID NO: 3013817 - RNA, 16 nt, Mycobacterium avium subsp. paratuberculosis
ggcgggcggcaucgcg

SEQ ID NO: 3013818 - RNA, 17 nt, Mycobacterium avium subsp. paratuberculosis
ggcgggcggcccgcacg

SEQ ID NO: 3013819 - RNA, 12 nt, Mycobacterium avium subsp. paratuberculosis
ggcgggcggcgg

SEQ ID NO: 3013820 - RNA, 13 nt, Mycobacterium avium subsp. paratuberculosis
ggcgggcggcggc

SEQ ID NO: 3013821 - RNA, 14 nt, Mycobacterium avium subsp. paratuberculosis
ggcgggcggcggcg

SEQ ID NO: 3013822 - RNA, 17 nt, Mycobacterium avium subsp. paratuberculosis
ggcgggcgggcggggga

SEQ ID NO: 3013823 - RNA, 17 nt, Mycobacterium avium subsp. paratuberculosis
ggcgggcgucacgucca

SEQ ID NO: 3013824 - RNA, 19 nt, Mycobacterium avium subsp. paratuberculosis
ggcgggcguccugcgggga

SEQ ID NO: 3013825 - RNA, 17 nt, Mycobacterium avium subsp. paratuberculosis
ggcgggcgugccgaacg

SEQ ID NO: 3013826 - RNA, 18 nt, Mycobacterium avium subsp. paratuberculosis
ggcgggcucgagccccag

SEQ ID NO: 3013827 - RNA, 13 nt, Mycobacterium avium subsp. paratuberculosis
ggcgggcucgcgc

SEQ ID NO: 3013828 - RNA, 15 nt, Mycobacterium avium subsp. paratuberculosis
ggcgggcucgcgcug

SEQ ID NO: 3013829 - RNA, 15 nt, Mycobacterium avium subsp. paratuberculosis
ggcgggcugcgggca

SEQ ID NO: 3013830 - RNA, 16 nt, Mycobacterium avium subsp. paratuberculosis
ggcggggaugcccggg

SEQ ID NO: 3013831 - RNA, 21 nt, Mycobacterium avium subsp. paratuberculosis
ggcggucgcugaccccgcucg

SEQ ID NO: 3013832 - RNA, 18 nt, Mycobacterium avium subsp. paratuberculosis
ggcggucgcugcagcggc

SEQ ID NO: 3013833 - RNA, 23 nt, Mycobacterium avium subsp. paratuberculosis
ggcggucgcugcagcggcggcca

SEQ ID NO: 3013834 - RNA, 18 nt, Mycobacterium avium subsp. paratuberculosis
ggcggucggacgcgggga

SEQ ID NO: 3013835 - RNA, 21 nt, Mycobacterium avium subsp. paratuberculosis
ggcggucggaucgagcucgca

SEQ ID NO: 3013836 - RNA, 22 nt, Mycobacterium avium subsp. paratuberculosis
ggcggucggaucgagcucgcag

SEQ ID NO: 3013837 - RNA, 23 nt, Mycobacterium avium subsp. paratuberculosis
ggcggucggcauagcgccgcucg

SEQ ID NO: 3013838 - RNA, 12 nt, Mycobacterium avium subsp. paratuberculosis
ggcggucggcgc

SEQ ID NO: 3013839 - RNA, 13 nt, Mycobacterium avium subsp. paratuberculosis
ggcggucggcgcc

SEQ ID NO: 3013840 - RNA, 14 nt, Mycobacterium avium subsp. paratuberculosis
ggcggucggcgccg

SEQ ID NO: 3013841 - RNA, 14 nt, Mycobacterium avium subsp. paratuberculosis
ggcggucggcggag

SEQ ID NO: 3013842 - RNA, 20 nt, Mycobacterium avium subsp. paratuberculosis
ggcggucgugcggcugccca

SEQ ID NO: 3013843 - RNA, 21 nt, Mycobacterium avium subsp. paratuberculosis
ggcggucugcgcccgaucggc

SEQ ID NO: 3013844 - RNA, 22 nt, Mycobacterium avium subsp. paratuberculosis
ggcggucuucuuggccgcgccg

SEQ ID NO: 3013845 - RNA, 16 nt, Mycobacterium avium subsp. paratuberculosis
ggcggucuuggcggcc

SEQ ID NO: 3013846 - RNA, 17 nt, Mycobacterium avium subsp. paratuberculosis
ggcggucuuggcggcca

SEQ ID NO: 3013847 - RNA, 20 nt, Mycobacterium avium subsp. paratuberculosis
ggcggucuuggcggccagcg

SEQ ID NO: 3013848 - RNA, 20 nt, Mycobacterium avium subsp. paratuberculosis
ggcggucuuugccaucccgg

SEQ ID NO: 3013849 - RNA, 14 nt, Mycobacterium avium subsp. paratuberculosis
ggcggugaccacgc

SEQ ID NO: 3013850 - RNA, 20 nt, Mycobacterium avium subsp. paratuberculosis
ggcggugacgaacccgccgc

SEQ ID NO: 3013851 - RNA, 23 nt, Mycobacterium avium subsp. paratuberculosis
ggcggugacguuccagccgugcu

SEQ ID NO: 3013852 - RNA, 20 nt, Mycobacterium avium subsp. paratuberculosis
ggcggugagccgccacagcg

SEQ ID NO: 3013853 - RNA, 21 nt, Mycobacterium avium subsp. paratuberculosis
ggcggugaucucgucggcggc

SEQ ID NO: 3013854 - RNA, 21 nt, Mycobacterium avium subsp. paratuberculosis
ggcggugaugcgcgccgacga

SEQ ID NO: 3013855 - RNA, 21 nt, Mycobacterium avium subsp. paratuberculosis
ggcggugccgaaccggaucug

SEQ ID NO: 3013856 - RNA, 14 nt, Mycobacterium avium subsp. paratuberculosis
ggcggugccgagcc

SEQ ID NO: 3013857 - RNA, 17 nt, Mycobacterium avium subsp. paratuberculosis
ggcggugccgagcccgc

SEQ ID NO: 3013858 - RNA, 15 nt, Mycobacterium avium subsp. paratuberculosis
ggcggugccgcggcg

SEQ ID NO: 3013859 - RNA, 16 nt, Mycobacterium avium subsp. paratuberculosis
ggcggugccgcggcgg

SEQ ID NO: 3013860 - RNA, 12 nt, Mycobacterium avium subsp. paratuberculosis
ggcggugccggc

SEQ ID NO: 3013861 - RNA, 16 nt, Mycobacterium avium subsp. paratuberculosis
ggcggugccggccaga

SEQ ID NO: 3013862 - RNA, 22 nt, Mycobacterium avium subsp. paratuberculosis
ggcggugccgguguugccgacg

SEQ ID NO: 3013863 - RNA, 23 nt, Mycobacterium avium subsp. paratuberculosis
ggcggugccguccucggccgcca

SEQ ID NO: 3013864 - RNA, 16 nt, Mycobacterium avium subsp. paratuberculosis
ggcggugcgcagucgc

SEQ ID NO: 3013865 - RNA, 19 nt, Mycobacterium avium subsp. paratuberculosis
ggcggugcgcagucgcugg

SEQ ID NO: 3013866 - RNA, 14 nt, Mycobacterium avium subsp. paratuberculosis
ggcggugcggcggg

SEQ ID NO: 3013867 - RNA, 21 nt, Mycobacterium avium subsp. paratuberculosis
ggcggugcggucgcgcagccg

SEQ ID NO: 3013868 - RNA, 15 nt, Mycobacterium avium subsp. paratuberculosis
ggcggugcgucgggc

SEQ ID NO: 3013869 - RNA, 14 nt, Mycobacterium avium subsp. paratuberculosis
ggcggugcucgcgc

SEQ ID NO: 3013870 - RNA, 21 nt, Mycobacterium avium subsp. paratuberculosis
ggcggugcucuuggugguggu

SEQ ID NO: 3013871 - RNA, 15 nt, Mycobacterium avium subsp. paratuberculosis
ggcgguggccgaacc

SEQ ID NO: 3013872 - RNA, 15 nt, Mycobacterium avium subsp. paratuberculosis
ggcgguggccucggg

SEQ ID NO: 3013873 - RNA, 16 nt, Mycobacterium avium subsp. paratuberculosis
ggcgguggccugcccg

SEQ ID NO: 3013874 - RNA, 18 nt, Mycobacterium avium subsp. paratuberculosis
ggcgguggccugcccggc

SEQ ID NO: 3013875 - RNA, 19 nt, Mycobacterium avium subsp. paratuberculosis
ggcgguggccugcccggcg

SEQ ID NO: 3013876 - RNA, 22 nt, Mycobacterium avium subsp. paratuberculosis
ggcgguggccugcccggcggug

SEQ ID NO: 3013877 - RNA, 14 nt, Mycobacterium avium subsp. paratuberculosis
ggcgguggcgcaca

SEQ ID NO: 3013878 - RNA, 13 nt, Mycobacterium avium subsp. paratuberculosis
ggcgguggcgccg

SEQ ID NO: 3013879 - RNA, 14 nt, Mycobacterium avium subsp. paratuberculosis
ggcgguggcgccgg

SEQ ID NO: 3013880 - RNA, 14 nt, Mycobacterium avium subsp. paratuberculosis
ggcgguggcggcga

SEQ ID NO: 3013881 - RNA, 13 nt, Mycobacterium avium subsp. paratuberculosis
ggcggugggcgca

SEQ ID NO: 3013882 - RNA, 19 nt, Mycobacterium avium subsp. paratuberculosis
ggcgguggggccgaagccg

SEQ ID NO: 3013883 - RNA, 22 nt, Mycobacterium avium subsp. paratuberculosis
ggcgguggggccgaagccgaca

SEQ ID NO: 3013884 - RNA, 19 nt, Mycobacterium avium subsp. paratuberculosis
ggcggugguccgcgcgacc

SEQ ID NO: 3013885 - RNA, 12 nt, Mycobacterium avium subsp. paratuberculosis
ggcgguggugcc

SEQ ID NO: 3013886 - RNA, 14 nt, Mycobacterium avium subsp. paratuberculosis
ggcggugucgaaga

SEQ ID NO: 3013887 - RNA, 19 nt, Mycobacterium avium subsp. paratuberculosis
ggcggugucgaagaccggu

SEQ ID NO: 3013888 - RNA, 18 nt, Mycobacterium avium subsp. paratuberculosis
ggcggugucgcccagcug

SEQ ID NO: 3013889 - RNA, 18 nt, Mycobacterium avium subsp. paratuberculosis
ggcggugucggcgccccg

SEQ ID NO: 3013890 - RNA, 22 nt, Mycobacterium avium subsp. paratuberculosis
ggcggugucggcgccccggcgc

SEQ ID NO: 3013891 - RNA, 14 nt, Mycobacterium avium subsp. paratuberculosis
ggcggugucggcgg

SEQ ID NO: 3013892 - RNA, 16 nt, Mycobacterium avium subsp. paratuberculosis
ggcggugucggcggca

SEQ ID NO: 3013893 - RNA, 14 nt, Mycobacterium avium subsp. paratuberculosis
ggcggugucggugc

SEQ ID NO: 3013894 - RNA, 15 nt, Mycobacterium avium subsp. paratuberculosis
ggcggugucggugcc

SEQ ID NO: 3013895 - RNA, 17 nt, Mycobacterium avium subsp. paratuberculosis
ggcggugucggugccca

SEQ ID NO: 3013896 - RNA, 22 nt, Mycobacterium avium subsp. paratuberculosis
ggcgguguucgagggcgcggcg

SEQ ID NO: 3013897 - RNA, 16 nt, Mycobacterium avium subsp. paratuberculosis
ggcgguuccgguggcg

SEQ ID NO: 3013898 - RNA, 17 nt, Mycobacterium avium subsp. paratuberculosis
ggcgguuccgguggcgc

SEQ ID NO: 3013899 - RNA, 18 nt, Mycobacterium avium subsp. paratuberculosis
ggcgguuccgguggcgcg

SEQ ID NO: 3013900 - RNA, 23 nt, Mycobacterium avium subsp. paratuberculosis
ggcgguuggacaggccggcgacg

SEQ ID NO: 3013901 - RNA, 15 nt, Mycobacterium avium subsp. paratuberculosis
ggcgguuucggugcc

SEQ ID NO: 3013902 - RNA, 23 nt, Mycobacterium avium subsp. paratuberculosis
ggcgguuucggugccggcccagu

SEQ ID NO: 3013903 - RNA, 18 nt, Mycobacterium avium subsp. paratuberculosis
ggcgguuuuggucggcac

SEQ ID NO: 3013904 - RNA, 21 nt, Mycobacterium avium subsp. paratuberculosis
ggcguacaccagggugccgcc

SEQ ID NO: 3013905 - RNA, 22 nt, Mycobacterium avium subsp. paratuberculosis
ggcguacaccagggugccgccg

SEQ ID NO: 3013906 - RNA, 16 nt, Mycobacterium avium subsp. paratuberculosis
ggcguacagcggcgcc

SEQ ID NO: 3013907 - RNA, 17 nt, Mycobacterium avium subsp. paratuberculosis
ggcguacagcggcgcca

SEQ ID NO: 3013908 - RNA, 20 nt, Mycobacterium avium subsp. paratuberculosis
ggcguacagcggcgccaggu

SEQ ID NO: 3013909 - RNA, 15 nt, Mycobacterium avium subsp. paratuberculosis
ggcguacaggccguc

SEQ ID NO: 3013910 - RNA, 21 nt, Mycobacterium avium subsp. paratuberculosis
ggcguacgacaucucgacggu

SEQ ID NO: 3013911 - RNA, 19 nt, Mycobacterium avium subsp. paratuberculosis
ggcguacgcgcugccgacg

SEQ ID NO: 3013912 - RNA, 20 nt, Mycobacterium avium subsp. paratuberculosis
ggcguacgcgcugccgacga

SEQ ID NO: 3013913 - RNA, 16 nt, Mycobacterium avium subsp. paratuberculosis
ggcguacugcgcgagc

SEQ ID NO: 3013914 - RNA, 14 nt, Mycobacterium avium subsp. paratuberculosis
ggcguacugcucgg

SEQ ID NO: 3013915 - RNA, 18 nt, Mycobacterium avium subsp. paratuberculosis
ggcguccgcggcggaggg

SEQ ID NO: 3013916 - RNA, 21 nt, Mycobacterium avium subsp. paratuberculosis
ggcguccgggcgcugcgcggu

SEQ ID NO: 3013917 - RNA, 16 nt, Mycobacterium avium subsp. paratuberculosis
ggcguccgugccgucc

SEQ ID NO: 3013918 - RNA, 17 nt, Mycobacterium avium subsp. paratuberculosis
ggcguccgugccguccg

SEQ ID NO: 3013919 - RNA, 13 nt, Mycobacterium avium subsp. paratuberculosis
ggcguccuccucg

SEQ ID NO: 3013920 - RNA, 23 nt, Mycobacterium avium subsp. paratuberculosis
ggcguccuccucguccgcggcgg

SEQ ID NO: 3013921 - RNA, 16 nt, Mycobacterium avium subsp. paratuberculosis
ggcguccucgaccacc

SEQ ID NO: 3013922 - RNA, 24 nt, Mycobacterium avium subsp. paratuberculosis
ggcguccucgaccacccgcugguc

SEQ ID NO: 3013923 - RNA, 15 nt, Mycobacterium avium subsp. paratuberculosis
ggcguccucgacgcc

SEQ ID NO: 3013924 - RNA, 18 nt, Mycobacterium avium subsp. paratuberculosis
ggcguccucgacgccgcg

SEQ ID NO: 3013925 - RNA, 15 nt, Mycobacterium avium subsp. paratuberculosis
ggcguccucgacggu

SEQ ID NO: 3013926 - RNA, 17 nt, Mycobacterium avium subsp. paratuberculosis
ggcguccucgucggcga

SEQ ID NO: 3013927 - RNA, 19 nt, Mycobacterium avium subsp. paratuberculosis
ggcguccucgucggcgaag

SEQ ID NO: 3013928 - RNA, 14 nt, Mycobacterium avium subsp. paratuberculosis
ggcguccugcgggg

SEQ ID NO: 3013929 - RNA, 16 nt, Mycobacterium avium subsp. paratuberculosis
ggcguccugcggggag

SEQ ID NO: 3013930 - RNA, 20 nt, Mycobacterium avium subsp. paratuberculosis
ggcguccuugaccagcugcg

SEQ ID NO: 3013931 - RNA, 21 nt, Mycobacterium avium subsp. paratuberculosis
ggcguccuugauccgggcgcc

SEQ ID NO: 3013932 - RNA, 22 nt, Mycobacterium avium subsp. paratuberculosis
ggcguccuugauccgggcgcca

SEQ ID NO: 3013933 - RNA, 19 nt, Mycobacterium avium subsp. paratuberculosis
ggcgucgaaauagcggcgc

SEQ ID NO: 3013934 - RNA, 20 nt, Mycobacterium avium subsp. paratuberculosis
ggcgucgaaauagcggcgca

SEQ ID NO: 3013935 - RNA, 19 nt, Mycobacterium avium subsp. paratuberculosis
ggcgucgaacggcgucugg

SEQ ID NO: 3013936 - RNA, 23 nt, Mycobacterium avium subsp. paratuberculosis
ggcgucgaacggcgucuggccgg

SEQ ID NO: 3013937 - RNA, 23 nt, Mycobacterium avium subsp. paratuberculosis
ggcgucgaacgggccgggcaccg

SEQ ID NO: 3013938 - RNA, 19 nt, Mycobacterium avium subsp. paratuberculosis
ggcgucgaacgugcucgcg

SEQ ID NO: 3013939 - RNA, 14 nt, Mycobacterium avium subsp. paratuberculosis
ggcgucgaagcgca

SEQ ID NO: 3013940 - RNA, 16 nt, Mycobacterium avium subsp. paratuberculosis
ggcgucgaagcgcaug

SEQ ID NO: 3013941 - RNA, 19 nt, Mycobacterium avium subsp. paratuberculosis
ggcgucgaagcgcaugccg

SEQ ID NO: 3013942 - RNA, 13 nt, Mycobacterium avium subsp. paratuberculosis
ggcgucgaaggau

SEQ ID NO: 3013943 - RNA, 17 nt, Mycobacterium avium subsp. paratuberculosis
ggcgucgacacccgggc

SEQ ID NO: 3013944 - RNA, 18 nt, Mycobacterium avium subsp. paratuberculosis
ggcgucgacagccggucg

SEQ ID NO: 3013945 - RNA, 22 nt, Mycobacterium avium subsp. paratuberculosis
ggcgucgacagccggucgcgca

SEQ ID NO: 3013946 - RNA, 13 nt, Mycobacterium avium subsp. paratuberculosis
ggcgucgaccgcc

SEQ ID NO: 3013947 - RNA, 22 nt, Mycobacterium avium subsp. paratuberculosis
ggcgucgaccgccccgccggug

SEQ ID NO: 3013948 - RNA, 16 nt, Mycobacterium avium subsp. paratuberculosis
ggcgucgacgacggcg

SEQ ID NO: 3013949 - RNA, 24 nt, Mycobacterium avium subsp. paratuberculosis
ggcgucgacgacggcgccgcgucg

SEQ ID NO: 3013950 - RNA, 14 nt, Mycobacterium avium subsp. paratuberculosis
ggcgucgagcaccu

SEQ ID NO: 3013951 - RNA, 17 nt, Mycobacterium avium subsp. paratuberculosis
ggcgucgagcaccucca

SEQ ID NO: 3013952 - RNA, 14 nt, Mycobacterium avium subsp. paratuberculosis
ggcgucgagcgcgu

SEQ ID NO: 3013953 - RNA, 18 nt, Mycobacterium avium subsp. paratuberculosis
ggcgucgaguucgccguc

SEQ ID NO: 3013954 - RNA, 19 nt, Mycobacterium avium subsp. paratuberculosis
ggcgucgaucagcgcgccg

SEQ ID NO: 3013955 - RNA, 17 nt, Mycobacterium avium subsp. paratuberculosis
ggcgucgaugaccucgc

SEQ ID NO: 3013956 - RNA, 22 nt, Mycobacterium avium subsp. paratuberculosis
ggcgucgaugaccucgcgcagc

SEQ ID NO: 3013957 - RNA, 20 nt, Mycobacterium avium subsp. paratuberculosis
ggcgucgaugaugccggcgg

SEQ ID NO: 3013958 - RNA, 22 nt, Mycobacterium avium subsp. paratuberculosis
ggcgucgaugaugccggcggac

SEQ ID NO: 3013959 - RNA, 11 nt, Mycobacterium avium subsp. paratuberculosis
ggcgucgaugc

SEQ ID NO: 3013960 - RNA, 17 nt, Mycobacterium avium subsp. paratuberculosis
ggcgucgaugcgugaca

SEQ ID NO: 3013961 - RNA, 13 nt, Mycobacterium avium subsp. paratuberculosis
ggcgucgaugucg

SEQ ID NO: 3013962 - RNA, 16 nt, Mycobacterium avium subsp. paratuberculosis
ggcgucgaugucgccc

SEQ ID NO: 3013963 - RNA, 22 nt, Mycobacterium avium subsp. paratuberculosis
ggcgucgaugucgcccggcgcg

SEQ ID NO: 3013964 - RNA, 20 nt, Mycobacterium avium subsp. paratuberculosis
ggcgucgaugucgucgucga

SEQ ID NO: 3013965 - RNA, 20 nt, Mycobacterium avium subsp. paratuberculosis
ggcgucgcacgugguguuga

SEQ ID NO: 3013966 - RNA, 22 nt, Mycobacterium avium subsp. paratuberculosis
ggcgucgcagaucccgccggcg

SEQ ID NO: 3013967 - RNA, 23 nt, Mycobacterium avium subsp. paratuberculosis
ggcgucgcagaucccgccggcgg

SEQ ID NO: 3013968 - RNA, 14 nt, Mycobacterium avium subsp. paratuberculosis
ggcgucgcccgccg

SEQ ID NO: 3013969 - RNA, 19 nt, Mycobacterium avium subsp. paratuberculosis
ggcgucgcccgccgacggc

SEQ ID NO: 3013970 - RNA, 23 nt, Mycobacterium avium subsp. paratuberculosis
ggcgucgcccgccgacggcugcc

SEQ ID NO: 3013971 - RNA, 24 nt, Mycobacterium avium subsp. paratuberculosis
ggcgucgcccgccgacggcugccc

SEQ ID NO: 3013972 - RNA, 11 nt, Mycobacterium avium subsp. paratuberculosis
ggcgucgccga

SEQ ID NO: 3013973 - RNA, 13 nt, Mycobacterium avium subsp. paratuberculosis
ggcgucgccgagc

SEQ ID NO: 3013974 - RNA, 15 nt, Mycobacterium avium subsp. paratuberculosis
ggcgucgccgagccg

SEQ ID NO: 3013975 - RNA, 17 nt, Mycobacterium avium subsp. paratuberculosis
ggcgucgccgagccgcg

SEQ ID NO: 3013976 - RNA, 11 nt, Mycobacterium avium subsp. paratuberculosis
ggcgucgccgc

SEQ ID NO: 3013977 - RNA, 13 nt, Mycobacterium avium subsp. paratuberculosis
ggcgucgccgccg

SEQ ID NO: 3013978 - RNA, 14 nt, Mycobacterium avium subsp. paratuberculosis
ggcgucgccgccgg

SEQ ID NO: 3013979 - RNA, 18 nt, Mycobacterium avium subsp. paratuberculosis
ggcgucgccgccggugcc

SEQ ID NO: 3013980 - RNA, 22 nt, Mycobacterium avium subsp. paratuberculosis
ggcgucgccgcucuucgacgac

SEQ ID NO: 3013981 - RNA, 19 nt, Mycobacterium avium subsp. paratuberculosis
ggcgucgcgcagcagcggg

SEQ ID NO: 3013982 - RNA, 14 nt, Mycobacterium avium subsp. paratuberculosis
ggcgucgcggcgca

SEQ ID NO: 3013983 - RNA, 21 nt, Mycobacterium avium subsp. paratuberculosis
ggcgucgcggcgcacccgggc

SEQ ID NO: 3013984 - RNA, 13 nt, Mycobacterium avium subsp. paratuberculosis
ggcgucgcggucg

SEQ ID NO: 3013985 - RNA, 15 nt, Mycobacterium avium subsp. paratuberculosis
ggcgucgcggucggc

SEQ ID NO: 3013986 - RNA, 19 nt, Mycobacterium avium subsp. paratuberculosis
ggcgucgcggugaaguugc

SEQ ID NO: 3013987 - RNA, 19 nt, Mycobacterium avium subsp. paratuberculosis
ggcgucggacaugccggcg

SEQ ID NO: 3013988 - RNA, 21 nt, Mycobacterium avium subsp. paratuberculosis
ggcgucggacaugccggcgcc

SEQ ID NO: 3013989 - RNA, 14 nt, Mycobacterium avium subsp. paratuberculosis
ggcgucggacgcca

SEQ ID NO: 3013990 - RNA, 15 nt, Mycobacterium avium subsp. paratuberculosis
ggcgucggagaugcg

SEQ ID NO: 3013991 - RNA, 19 nt, Mycobacterium avium subsp. paratuberculosis
ggcgucggagaugcgggcc

SEQ ID NO: 3013992 - RNA, 20 nt, Mycobacterium avium subsp. paratuberculosis
ggcgucggagaugcgggcca

SEQ ID NO: 3013993 - RNA, 16 nt, Mycobacterium avium subsp. paratuberculosis
ggcgucggaggcggcg

SEQ ID NO: 3013994 - RNA, 14 nt, Mycobacterium avium subsp. paratuberculosis
ggcgucggccaccg

SEQ ID NO: 3013995 - RNA, 15 nt, Mycobacterium avium subsp. paratuberculosis
ggcgucggccaccgc

SEQ ID NO: 3013996 - RNA, 16 nt, Mycobacterium avium subsp. paratuberculosis
ggcgucggccaccgcg

SEQ ID NO: 3013997 - RNA, 17 nt, Mycobacterium avium subsp. paratuberculosis
ggcgucggccaccgcgc

SEQ ID NO: 3013998 - RNA, 15 nt, Mycobacterium avium subsp. paratuberculosis
ggcgucggccagcgg

SEQ ID NO: 3013999 - RNA, 13 nt, Mycobacterium avium subsp. paratuberculosis
ggcgugcccgccg

SEQ ID NO: 3014000 - RNA, 14 nt, Mycobacterium avium subsp. paratuberculosis
ggcgugcccgccga

SEQ ID NO: 3014001 - RNA, 16 nt, Mycobacterium avium subsp. paratuberculosis
ggcgugcccgccgacc

SEQ ID NO: 3014002 - RNA, 20 nt, Mycobacterium avium subsp. paratuberculosis
ggcgugcccgcucgcuagca

SEQ ID NO: 3014003 - RNA, 15 nt, Mycobacterium avium subsp. paratuberculosis
ggcgugcccggcgca

SEQ ID NO: 3014004 - RNA, 12 nt, Mycobacterium avium subsp. paratuberculosis
ggcgugccgccc

SEQ ID NO: 3014005 - RNA, 14 nt, Mycobacterium avium subsp. paratuberculosis
ggcgugccgcccgg

SEQ ID NO: 3014006 - RNA, 23 nt, Mycobacterium avium subsp. paratuberculosis
ggcgugccgcccggaccgcgguc

SEQ ID NO: 3014007 - RNA, 14 nt, Mycobacterium avium subsp. paratuberculosis
ggcgugccgcuggg

SEQ ID NO: 3014008 - RNA, 13 nt, Mycobacterium avium subsp. paratuberculosis
ggcgugccggaca

SEQ ID NO: 3014009 - RNA, 18 nt, Mycobacterium avium subsp. paratuberculosis
ggcgugccggacaccggc

SEQ ID NO: 3014010 - RNA, 18 nt, Mycobacterium avium subsp. paratuberculosis
ggcgugccggaugcgguc

SEQ ID NO: 3014011 - RNA, 13 nt, Mycobacterium avium subsp. paratuberculosis
ggcgugccggcgg

SEQ ID NO: 3014012 - RNA, 15 nt, Mycobacterium avium subsp. paratuberculosis
ggcgugccggcggcg

SEQ ID NO: 3014013 - RNA, 17 nt, Mycobacterium avium subsp. paratuberculosis
ggcgugcgcggccgccc

SEQ ID NO: 3014014 - RNA, 13 nt, Mycobacterium avium subsp. paratuberculosis
ggcgugcgcgugg

SEQ ID NO: 3014015 - RNA, 22 nt, Mycobacterium avium subsp. paratuberculosis
ggcgugcgcguggggcgucgcc

SEQ ID NO: 3014016 - RNA, 14 nt, Mycobacterium avium subsp. paratuberculosis
ggcgugcggccgca

SEQ ID NO: 3014017 - RNA, 22 nt, Mycobacterium avium subsp. paratuberculosis
ggcgugcggccgcagcgcccgg

SEQ ID NO: 3014018 - RNA, 13 nt, Mycobacterium avium subsp. paratuberculosis
ggcgugcggcgcg

SEQ ID NO: 3014019 - RNA, 13 nt, Mycobacterium avium subsp. paratuberculosis
ggcgugcgguugg

SEQ ID NO: 3014020 - RNA, 15 nt, Mycobacterium avium subsp. paratuberculosis
ggcgugcgguuggcc

SEQ ID NO: 3014021 - RNA, 19 nt, Mycobacterium avium subsp. paratuberculosis
ggcgugcgguuggcccgcg

SEQ ID NO: 3014022 - RNA, 21 nt, Mycobacterium avium subsp. paratuberculosis
ggcgugcgguuggcccgcggc

SEQ ID NO: 3014023 - RNA, 15 nt, Mycobacterium avium subsp. paratuberculosis
ggcgugcuccagcag

SEQ ID NO: 3014024 - RNA, 17 nt, Mycobacterium avium subsp. paratuberculosis
ggcgugcuccagcaggc

SEQ ID NO: 3014025 - RNA, 22 nt, Mycobacterium avium subsp. paratuberculosis
ggcgugcuccagcaggcgcgcc

SEQ ID NO: 3014026 - RNA, 14 nt, Mycobacterium avium subsp. paratuberculosis
ggcgugcucgaucg

SEQ ID NO: 3014027 - RNA, 16 nt, Mycobacterium avium subsp. paratuberculosis
ggcgugcucgaucgcg

SEQ ID NO: 3014028 - RNA, 11 nt, Mycobacterium avium subsp. paratuberculosis
ggcgugcucgg

SEQ ID NO: 3014029 - RNA, 16 nt, Mycobacterium avium subsp. paratuberculosis
ggcgugcucggccacg

SEQ ID NO: 3014030 - RNA, 18 nt, Mycobacterium avium subsp. paratuberculosis
ggcgugcucgucgcggag

SEQ ID NO: 3014031 - RNA, 16 nt, Mycobacterium avium subsp. paratuberculosis
ggcgugcugcgcagca

SEQ ID NO: 3014032 - RNA, 22 nt, Mycobacterium avium subsp. paratuberculosis
ggcgugcugcgcagcagcgcca

SEQ ID NO: 3014033 - RNA, 20 nt, Mycobacterium avium subsp. paratuberculosis
ggcgugcuugaacgccgccc

SEQ ID NO: 3014034 - RNA, 21 nt, Mycobacterium avium subsp. paratuberculosis
ggcguggaacgcgucgcgcca

SEQ ID NO: 3014035 - RNA, 18 nt, Mycobacterium avium subsp. paratuberculosis
ggcguggauggccggccg

SEQ ID NO: 3014036 - RNA, 19 nt, Mycobacterium avium subsp. paratuberculosis
ggcguggauggccggccgg

SEQ ID NO: 3014037 - RNA, 20 nt, Mycobacterium avium subsp. paratuberculosis
ggcguggcacccgggcgcga

SEQ ID NO: 3014038 - RNA, 18 nt, Mycobacterium avium subsp. paratuberculosis
ggcguggcaggccaucag

SEQ ID NO: 3014039 - RNA, 15 nt, Mycobacterium avium subsp. paratuberculosis
ggcguggcaggcgau

SEQ ID NO: 3014040 - RNA, 17 nt, Mycobacterium avium subsp. paratuberculosis
ggcguggcaggcgaugg

SEQ ID NO: 3014041 - RNA, 12 nt, Mycobacterium avium subsp. paratuberculosis
ggcguggccguc

SEQ ID NO: 3014042 - RNA, 20 nt, Mycobacterium avium subsp. paratuberculosis
ggcguggcgccggcgcgcga

SEQ ID NO: 3014043 - RNA, 17 nt, Mycobacterium avium subsp. paratuberculosis
ggcguggcgcucagcgg

SEQ ID NO: 3014044 - RNA, 18 nt, Mycobacterium avium subsp. paratuberculosis
ggcguggcgcucagcggc

SEQ ID NO: 3014045 - RNA, 13 nt, Mycobacterium avium subsp. paratuberculosis
ggcguggcggugg

SEQ ID NO: 3014046 - RNA, 15 nt, Mycobacterium avium subsp. paratuberculosis
ggcguggcgguggcg

SEQ ID NO: 3014047 - RNA, 18 nt, Mycobacterium avium subsp. paratuberculosis
ggcguggcgguggcggcg

SEQ ID NO: 3014048 - RNA, 19 nt, Mycobacterium avium subsp. paratuberculosis
ggcguggcgguggcggcga

SEQ ID NO: 3014049 - RNA, 23 nt, Mycobacterium avium subsp. paratuberculosis
ggcguggcugaggccgccccggc

SEQ ID NO: 3014050 - RNA, 12 nt, Mycobacterium avium subsp. paratuberculosis
ggcguggcuuga

SEQ ID NO: 3014051 - RNA, 23 nt, Mycobacterium avium subsp. paratuberculosis
ggcguggcuugaucgcacccauc

SEQ ID NO: 3014052 - RNA, 17 nt, Mycobacterium avium subsp. paratuberculosis
ggcgugggaaccaccaa

SEQ ID NO: 3014053 - RNA, 16 nt, Mycobacterium avium subsp. paratuberculosis
ggcgugggccgcagcg

SEQ ID NO: 3014054 - RNA, 16 nt, Mycobacterium avium subsp. paratuberculosis
ggcguggggacccccu

SEQ ID NO: 3014055 - RNA, 22 nt, Mycobacterium avium subsp. paratuberculosis
ggcguggggacccccucgucga

SEQ ID NO: 3014056 - RNA, 14 nt, Mycobacterium avium subsp. paratuberculosis
ggcgugggugucga

SEQ ID NO: 3014057 - RNA, 17 nt, Mycobacterium avium subsp. paratuberculosis
ggcguggguuccgccgu

SEQ ID NO: 3014058 - RNA, 16 nt, Mycobacterium avium subsp. paratuberculosis
ggcgugguagccgccg

SEQ ID NO: 3014059 - RNA, 15 nt, Mycobacterium avium subsp. paratuberculosis
ggcguggucgccguu

SEQ ID NO: 3014060 - RNA, 21 nt, Mycobacterium avium subsp. paratuberculosis
ggcguggugcggugcaccgcg

SEQ ID NO: 3014061 - RNA, 22 nt, Mycobacterium avium subsp. paratuberculosis
ggcguggugcggugcaccgcgg

SEQ ID NO: 3014062 - RNA, 23 nt, Mycobacterium avium subsp. paratuberculosis
ggcguguaguacaggccguagcg

SEQ ID NO: 3014063 - RNA, 21 nt, Mycobacterium avium subsp. paratuberculosis
ggcguguaguacugcucgacg

SEQ ID NO: 3014064 - RNA, 14 nt, Mycobacterium avium subsp. paratuberculosis
ggcgugucggcgcc

SEQ ID NO: 3014065 - RNA, 15 nt, Mycobacterium avium subsp. paratuberculosis
ggcgugucggcgcca

SEQ ID NO: 3014066 - RNA, 13 nt, Mycobacterium avium subsp. paratuberculosis
ggcgugucgguga

SEQ ID NO: 3014067 - RNA, 17 nt, Mycobacterium avium subsp. paratuberculosis
ggcgugugggcucgccc

SEQ ID NO: 3014068 - RNA, 19 nt, Mycobacterium avium subsp. paratuberculosis
ggcgugugggcucgcccgg

SEQ ID NO: 3014069 - RNA, 21 nt, Mycobacterium avium subsp. paratuberculosis
ggcguguuccuugcggccgcc

SEQ ID NO: 3014070 - RNA, 22 nt, Mycobacterium avium subsp. paratuberculosis
ggcguguuccuugcggccgccg

SEQ ID NO: 3014071 - RNA, 17 nt, Mycobacterium avium subsp. paratuberculosis
ggcguguugcaggcgga

SEQ ID NO: 3014072 - RNA, 17 nt, Mycobacterium avium subsp. paratuberculosis
ggcguuacacccgcgga

SEQ ID NO: 3014073 - RNA, 13 nt, Mycobacterium avium subsp. paratuberculosis
ggcguucaucguc

SEQ ID NO: 3014074 - RNA, 21 nt, Mycobacterium avium subsp. paratuberculosis
ggcguucaucguccacaccgg

SEQ ID NO: 3014075 - RNA, 23 nt, Mycobacterium avium subsp. paratuberculosis
ggcguucaucguccacaccggga

SEQ ID NO: 3014076 - RNA, 12 nt, Mycobacterium avium subsp. paratuberculosis
ggcguucgaccc

SEQ ID NO: 3014077 - RNA, 21 nt, Mycobacterium avium subsp. paratuberculosis
ggcguucgaccccaacccgaa

SEQ ID NO: 3014078 - RNA, 12 nt, Mycobacterium avium subsp. paratuberculosis
ggcguucgauug

SEQ ID NO: 3014079 - RNA, 22 nt, Mycobacterium avium subsp. paratuberculosis
ggcguucgcugcccaacgucga

SEQ ID NO: 3014080 - RNA, 19 nt, Mycobacterium avium subsp. paratuberculosis
ggcguucuccagcacccgc

SEQ ID NO: 3014081 - RNA, 15 nt, Mycobacterium avium subsp. paratuberculosis
ggcguucugcaccga

SEQ ID NO: 3014082 - RNA, 17 nt, Mycobacterium avium subsp. paratuberculosis
ggcguucugcaccgacu

SEQ ID NO: 3014083 - RNA, 15 nt, Mycobacterium avium subsp. paratuberculosis
ggcguugagccggcg

SEQ ID NO: 3014084 - RNA, 22 nt, Mycobacterium avium subsp. paratuberculosis
ggcucuucgcggcggggcaugg

SEQ ID NO: 3014085 - RNA, 15 nt, Mycobacterium avium subsp. paratuberculosis
ggcucuucggcgccg

SEQ ID NO: 3014086 - RNA, 21 nt, Mycobacterium avium subsp. paratuberculosis
ggcucuucggcgccgagcguc

SEQ ID NO: 3014087 - RNA, 11 nt, Mycobacterium avium subsp. paratuberculosis
ggcugaacacc

SEQ ID NO: 3014088 - RNA, 14 nt, Mycobacterium avium subsp. paratuberculosis
ggcugaacagcgcg

SEQ ID NO: 3014089 - RNA, 15 nt, Mycobacterium avium subsp. paratuberculosis
ggcugaaccaccgcg

SEQ ID NO: 3014090 - RNA, 22 nt, Mycobacterium avium subsp. paratuberculosis
ggcugaaccaccgcgcccaccc

SEQ ID NO: 3014091 - RNA, 17 nt, Mycobacterium avium subsp. paratuberculosis
ggcugaacgccagcagc

SEQ ID NO: 3014092 - RNA, 20 nt, Mycobacterium avium subsp. paratuberculosis
ggcugaacgccagcagccgc

SEQ ID NO: 3014093 - RNA, 17 nt, Mycobacterium avium subsp. paratuberculosis
ggcugaagaucaacagc

SEQ ID NO: 3014094 - RNA, 18 nt, Mycobacterium avium subsp. paratuberculosis
ggcugaagaucaacagcc

SEQ ID NO: 3014095 - RNA, 20 nt, Mycobacterium avium subsp. paratuberculosis
ggcugaccacgcuccagaug

SEQ ID NO: 3014096 - RNA, 14 nt, Mycobacterium avium subsp. paratuberculosis
ggcugacccgcccg

SEQ ID NO: 3014097 - RNA, 15 nt, Mycobacterium avium subsp. paratuberculosis
ggcugacccgcccgg

SEQ ID NO: 3014098 - RNA, 15 nt, Mycobacterium avium subsp. paratuberculosis
ggcugaccgacggcg

SEQ ID NO: 3014099 - RNA, 16 nt, Mycobacterium avium subsp. paratuberculosis
ggcugaccgacggcga

SEQ ID NO: 3014100 - RNA, 19 nt, Mycobacterium avium subsp. paratuberculosis
ggcugaccgacggcgacca

SEQ ID NO: 3014101 - RNA, 17 nt, Mycobacterium avium subsp. paratuberculosis
ggcugaccgagcggcgc

SEQ ID NO: 3014102 - RNA, 18 nt, Mycobacterium avium subsp. paratuberculosis
ggcugaccgagcggcgcu

SEQ ID NO: 3014103 - RNA, 13 nt, Mycobacterium avium subsp. paratuberculosis
ggcugaccgccag

SEQ ID NO: 3014104 - RNA, 14 nt, Mycobacterium avium subsp. paratuberculosis
ggcugaccgccagg

SEQ ID NO: 3014105 - RNA, 16 nt, Mycobacterium avium subsp. paratuberculosis
ggcugaccggcggugc

SEQ ID NO: 3014106 - RNA, 17 nt, Mycobacterium avium subsp. paratuberculosis
ggcugaccggcggugcc

SEQ ID NO: 3014107 - RNA, 15 nt, Mycobacterium avium subsp. paratuberculosis
ggcugaccgucgacc

SEQ ID NO: 3014108 - RNA, 16 nt, Mycobacterium avium subsp. paratuberculosis
ggcugaccgucgacca

SEQ ID NO: 3014109 - RNA, 21 nt, Mycobacterium avium subsp. paratuberculosis
ggcugaccucgccgcccucgc

SEQ ID NO: 3014110 - RNA, 14 nt, Mycobacterium avium subsp. paratuberculosis
ggcugaccucgcgc

SEQ ID NO: 3014111 - RNA, 19 nt, Mycobacterium avium subsp. paratuberculosis
ggcugaccucgcgcaccgg

SEQ ID NO: 3014112 - RNA, 16 nt, Mycobacterium avium subsp. paratuberculosis
ggcugacgaucgucga

SEQ ID NO: 3014113 - RNA, 20 nt, Mycobacterium avium subsp. paratuberculosis
ggcugacgaucgucgacguc

SEQ ID NO: 3014114 - RNA, 14 nt, Mycobacterium avium subsp. paratuberculosis
ggcugacgccacgc

SEQ ID NO: 3014115 - RNA, 21 nt, Mycobacterium avium subsp. paratuberculosis
ggcugacgcgaccgcgcggcg

SEQ ID NO: 3014116 - RNA, 16 nt, Mycobacterium avium subsp. paratuberculosis
ggcugacggcgucguu

SEQ ID NO: 3014117 - RNA, 23 nt, Mycobacterium avium subsp. paratuberculosis
ggcugacggcgucguugagcagg

SEQ ID NO: 3014118 - RNA, 16 nt, Mycobacterium avium subsp. paratuberculosis
ggcugacugccggcga

SEQ ID NO: 3014119 - RNA, 12 nt, Mycobacterium avium subsp. paratuberculosis
ggcugagcaccg

SEQ ID NO: 3014120 - RNA, 16 nt, Mycobacterium avium subsp. paratuberculosis
ggcugagcagcucgcg

SEQ ID NO: 3014121 - RNA, 17 nt, Mycobacterium avium subsp. paratuberculosis
ggcugagcugugccgcg

SEQ ID NO: 3014122 - RNA, 18 nt, Mycobacterium avium subsp. paratuberculosis
ggcugaggccgccccggc

SEQ ID NO: 3014123 - RNA, 15 nt, Mycobacterium avium subsp. paratuberculosis
ggcugaguucgguga

SEQ ID NO: 3014124 - RNA, 15 nt, Mycobacterium avium subsp. paratuberculosis
ggcugaucagccggc

SEQ ID NO: 3014125 - RNA, 20 nt, Mycobacterium avium subsp. paratuberculosis
ggcugaucagccggcgagcg

SEQ ID NO: 3014126 - RNA, 18 nt, Mycobacterium avium subsp. paratuberculosis
ggcugauccgcgacgcca

SEQ ID NO: 3014127 - RNA, 15 nt, Mycobacterium avium subsp. paratuberculosis
ggcugaucucggcgg

SEQ ID NO: 3014128 - RNA, 17 nt, Mycobacterium avium subsp. paratuberculosis
ggcugaucucggcgguc

SEQ ID NO: 3014129 - RNA, 22 nt, Mycobacterium avium subsp. paratuberculosis
ggcugauguucaguucguccag

SEQ ID NO: 3014130 - RNA, 17 nt, Mycobacterium avium subsp. paratuberculosis
ggcugcaccagggcguc

SEQ ID NO: 3014131 - RNA, 19 nt, Mycobacterium avium subsp. paratuberculosis
ggcugcaccagggcgucga

SEQ ID NO: 3014132 - RNA, 15 nt, Mycobacterium avium subsp. paratuberculosis
ggcugcacccucugc

SEQ ID NO: 3014133 - RNA, 16 nt, Mycobacterium avium subsp. paratuberculosis
ggcugcacccucugcc

SEQ ID NO: 3014134 - RNA, 21 nt, Mycobacterium avium subsp. paratuberculosis
ggcugcacccucugccacggc

SEQ ID NO: 3014135 - RNA, 22 nt, Mycobacterium avium subsp. paratuberculosis
ggcugcacccucugccacggcg

SEQ ID NO: 3014136 - RNA, 23 nt, Mycobacterium avium subsp. paratuberculosis
ggcugcacccucugccacggcgg

SEQ ID NO: 3014137 - RNA, 23 nt, Mycobacterium avium subsp. paratuberculosis
ggcugcacgucacgggccaggcg

SEQ ID NO: 3014138 - RNA, 13 nt, Mycobacterium avium subsp. paratuberculosis
ggcugcagcagau

SEQ ID NO: 3014139 - RNA, 13 nt, Mycobacterium avium subsp. paratuberculosis
ggcugcagcagcg

SEQ ID NO: 3014140 - RNA, 13 nt, Mycobacterium avium subsp. paratuberculosis
ggcugcagccggg

SEQ ID NO: 3014141 - RNA, 14 nt, Mycobacterium avium subsp. paratuberculosis
ggcugcagccgggc

SEQ ID NO: 3014142 - RNA, 15 nt, Mycobacterium avium subsp. paratuberculosis
ggcugcagccgggcg

SEQ ID NO: 3014143 - RNA, 19 nt, Mycobacterium avium subsp. paratuberculosis
ggcugcagcgacuggacca

SEQ ID NO: 3014144 - RNA, 12 nt, Mycobacterium avium subsp. paratuberculosis
ggcugcagggcc

SEQ ID NO: 3014145 - RNA, 18 nt, Mycobacterium avium subsp. paratuberculosis
ggcugcaucuccagccgc

SEQ ID NO: 3014146 - RNA, 13 nt, Mycobacterium avium subsp. paratuberculosis
ggcugcccaccac

SEQ ID NO: 3014147 - RNA, 17 nt, Mycobacterium avium subsp. paratuberculosis
ggcugccccagggacca

SEQ ID NO: 3014148 - RNA, 15 nt, Mycobacterium avium subsp. paratuberculosis
ggcugcccgacccgc

SEQ ID NO: 3014149 - RNA, 19 nt, Mycobacterium avium subsp. paratuberculosis
ggcugcccgacccgcacca

SEQ ID NO: 3014150 - RNA, 23 nt, Mycobacterium avium subsp. paratuberculosis
ggcugcccgacccgcaccaccgc

SEQ ID NO: 3014151 - RNA, 12 nt, Mycobacterium avium subsp. paratuberculosis
ggcugcccgcga

SEQ ID NO: 3014152 - RNA, 22 nt, Mycobacterium avium subsp. paratuberculosis
ggcugcccgcgacugucggcgc

SEQ ID NO: 3014153 - RNA, 17 nt, Mycobacterium avium subsp. paratuberculosis
ggcugcccgcgcggcuc

SEQ ID NO: 3014154 - RNA, 19 nt, Mycobacterium avium subsp. paratuberculosis
ggcugcccggcgccggucg

SEQ ID NO: 3014155 - RNA, 15 nt, Mycobacterium avium subsp. paratuberculosis
ggcugcccucuuccu

SEQ ID NO: 3014156 - RNA, 22 nt, Mycobacterium avium subsp. paratuberculosis
ggcugcccugggaggaagugca

SEQ ID NO: 3014157 - RNA, 14 nt, Mycobacterium avium subsp. paratuberculosis
ggcugccgaccucg

SEQ ID NO: 3014158 - RNA, 20 nt, Mycobacterium avium subsp. paratuberculosis
ggcugccgaccucgauggcg

SEQ ID NO: 3014159 - RNA, 15 nt, Mycobacterium avium subsp. paratuberculosis
ggcugccggccaagg

SEQ ID NO: 3014160 - RNA, 17 nt, Mycobacterium avium subsp. paratuberculosis
ggcugccggccaaggca

SEQ ID NO: 3014161 - RNA, 18 nt, Mycobacterium avium subsp. paratuberculosis
ggcugccguagaaccgcu

SEQ ID NO: 3014162 - RNA, 15 nt, Mycobacterium avium subsp. paratuberculosis
ggcugccucgacgau

SEQ ID NO: 3014163 - RNA, 23 nt, Mycobacterium avium subsp. paratuberculosis
ggcugccucgacgaugggugugg

SEQ ID NO: 3014164 - RNA, 18 nt, Mycobacterium avium subsp. paratuberculosis
ggcugcgcacguagccca

SEQ ID NO: 3014165 - RNA, 23 nt, Mycobacterium avium subsp. paratuberculosis
ggcugcgcacguagcccagcgcg

SEQ ID NO: 3014166 - RNA, 17 nt, Mycobacterium avium subsp. paratuberculosis
ggcugcgcagcgcagca

SEQ ID NO: 3014167 - RNA, 16 nt, Mycobacterium avium subsp. paratuberculosis
ggcugcgcggcuugcu

SEQ ID NO: 3014168 - RNA, 19 nt, Mycobacterium avium subsp. paratuberculosis
ggcugcgcgucgagcagca

SEQ ID NO: 3014169 - RNA, 19 nt, Mycobacterium avium subsp. paratuberculosis
ggcuucgccgcgcuugcga

SEQ ID NO: 3014170 - RNA, 20 nt, Mycobacterium avium subsp. paratuberculosis
ggcuucgggaucagcgggac

SEQ ID NO: 3014171 - RNA, 21 nt, Mycobacterium avium subsp. paratuberculosis
ggcuucgggaucagcgggacg

SEQ ID NO: 3014172 - RNA, 17 nt, Mycobacterium avium subsp. paratuberculosis
ggcuucguacggcccgg

SEQ ID NO: 3014173 - RNA, 22 nt, Mycobacterium avium subsp. paratuberculosis
ggcuucguacggcccgggaagc

SEQ ID NO: 3014174 - RNA, 15 nt, Mycobacterium avium subsp. paratuberculosis
ggcuugaaaguccgc

SEQ ID NO: 3014175 - RNA, 17 nt, Mycobacterium avium subsp. paratuberculosis
ggcuugaaaguccgccg

SEQ ID NO: 3014176 - RNA, 18 nt, Mycobacterium avium subsp. paratuberculosis
ggcuugaaaguccgccga

SEQ ID NO: 3014177 - RNA, 17 nt, Mycobacterium avium subsp. paratuberculosis
ggcuugaccggcucgcc

SEQ ID NO: 3014178 - RNA, 22 nt, Mycobacterium avium subsp. paratuberculosis
ggcuugagcgccagcgcggugc

SEQ ID NO: 3014179 - RNA, 19 nt, Mycobacterium avium subsp. paratuberculosis
ggcuugaugaacgcguuga

SEQ ID NO: 3014180 - RNA, 15 nt, Mycobacterium avium subsp. paratuberculosis
ggcuugccgaucgcc

SEQ ID NO: 3014181 - RNA, 19 nt, Mycobacterium avium subsp. paratuberculosis
ggcuugccgaucgccgcgg

SEQ ID NO: 3014182 - RNA, 13 nt, Mycobacterium avium subsp. paratuberculosis
ggcuugccgccgc

SEQ ID NO: 3014183 - RNA, 14 nt, Mycobacterium avium subsp. paratuberculosis
ggcuugcgcaacag

SEQ ID NO: 3014184 - RNA, 16 nt, Mycobacterium avium subsp. paratuberculosis
ggcuugcgcucggccg

SEQ ID NO: 3014185 - RNA, 14 nt, Mycobacterium avium subsp. paratuberculosis
ggcuuggcccgccg

SEQ ID NO: 3014186 - RNA, 21 nt, Mycobacterium avium subsp. paratuberculosis
ggcuuggccgugcagggggcg

SEQ ID NO: 3014187 - RNA, 23 nt, Mycobacterium avium subsp. paratuberculosis
ggcuuggcgacgaagucgacggc

SEQ ID NO: 3014188 - RNA, 18 nt, Mycobacterium avium subsp. paratuberculosis
ggcuugggcccgucggcg

SEQ ID NO: 3014189 - RNA, 14 nt, Mycobacterium avium subsp. paratuberculosis
ggcuuucggcgcca

SEQ ID NO: 3014190 - RNA, 13 nt, Mycobacterium avium subsp. paratuberculosis
ggcuuuggucgcc

SEQ ID NO: 3014191 - RNA, 19 nt, Mycobacterium avium subsp. paratuberculosis
ggcuuuggugacgccgacg

SEQ ID NO: 3014192 - RNA, 14 nt, Mycobacterium avium subsp. paratuberculosis
gggaaaggcagcag

SEQ ID NO: 3014193 - RNA, 20 nt, Mycobacterium avium subsp. paratuberculosis
gggaaaguuguagcgcagca

SEQ ID NO: 3014194 - RNA, 21 nt, Mycobacterium avium subsp. paratuberculosis
gggaaaguuguagcgcagcau

SEQ ID NO: 3014195 - RNA, 18 nt, Mycobacterium avium subsp. paratuberculosis
gggaaaugcgucgccagu

SEQ ID NO: 3014196 - RNA, 16 nt, Mycobacterium avium subsp. paratuberculosis
gggaacaccacgucgu

SEQ ID NO: 3014197 - RNA, 13 nt, Mycobacterium avium subsp. paratuberculosis
gggaacaccggcg

SEQ ID NO: 3014198 - RNA, 14 nt, Mycobacterium avium subsp. paratuberculosis
gggaacagccaggc

SEQ ID NO: 3014199 - RNA, 14 nt, Mycobacterium avium subsp. paratuberculosis
gggaacagcccgcc

SEQ ID NO: 3014200 - RNA, 19 nt, Mycobacterium avium subsp. paratuberculosis
gggaacagcgacgcccaga

SEQ ID NO: 3014201 - RNA, 13 nt, Mycobacterium avium subsp. paratuberculosis
gggaacgacggug

SEQ ID NO: 3014202 - RNA, 20 nt, Mycobacterium avium subsp. paratuberculosis
gggaacgaucggcuccagcg

SEQ ID NO: 3014203 - RNA, 17 nt, Mycobacterium avium subsp. paratuberculosis
gggaacgccgaucaccg

SEQ ID NO: 3014204 - RNA, 21 nt, Mycobacterium avium subsp. paratuberculosis
gggaacgccgaucaccggcac

SEQ ID NO: 3014205 - RNA, 18 nt, Mycobacterium avium subsp. paratuberculosis
gggaacgucauggccagc

SEQ ID NO: 3014206 - RNA, 18 nt, Mycobacterium avium subsp. paratuberculosis
gggaagagcggcgugacc

SEQ ID NO: 3014207 - RNA, 21 nt, Mycobacterium avium subsp. paratuberculosis
gggaagagcggcgugaccggg

SEQ ID NO: 3014208 - RNA, 21 nt, Mycobacterium avium subsp. paratuberculosis
gggaagcccaccgcggugacc

SEQ ID NO: 3014209 - RNA, 21 nt, Mycobacterium avium subsp. paratuberculosis
gggaagccgagcuugggccgg

SEQ ID NO: 3014210 - RNA, 13 nt, Mycobacterium avium subsp. paratuberculosis
gggaagccggcca

SEQ ID NO: 3014211 - RNA, 22 nt, Mycobacterium avium subsp. paratuberculosis
gggaagcgaagcgggacugcag

SEQ ID NO: 3014212 - RNA, 12 nt, Mycobacterium avium subsp. paratuberculosis
gggaagcugcug

SEQ ID NO: 3014213 - RNA, 16 nt, Mycobacterium avium subsp. paratuberculosis
gggaagcuggugguga

SEQ ID NO: 3014214 - RNA, 13 nt, Mycobacterium avium subsp. paratuberculosis
gggaaggcggccg

SEQ ID NO: 3014215 - RNA, 13 nt, Mycobacterium avium subsp. paratuberculosis
gggaagggcccgg

SEQ ID NO: 3014216 - RNA, 12 nt, Mycobacterium avium subsp. paratuberculosis
gggaagggcgcg

SEQ ID NO: 3014217 - RNA, 17 nt, Mycobacterium avium subsp. paratuberculosis
gggaaggugcgggcggg

SEQ ID NO: 3014218 - RNA, 19 nt, Mycobacterium avium subsp. paratuberculosis
gggaaggugcgggcggggc

SEQ ID NO: 3014219 - RNA, 18 nt, Mycobacterium avium subsp. paratuberculosis
gggaaguagggcagcccg

SEQ ID NO: 3014220 - RNA, 15 nt, Mycobacterium avium subsp. paratuberculosis
gggaaguuggccucc

SEQ ID NO: 3014221 - RNA, 13 nt, Mycobacterium avium subsp. paratuberculosis
gggaaucacgccc

SEQ ID NO: 3014222 - RNA, 17 nt, Mycobacterium avium subsp. paratuberculosis
gggaaucacgccccagg

SEQ ID NO: 3014223 - RNA, 23 nt, Mycobacterium avium subsp. paratuberculosis
gggaaucacgccccaggcgcccu

SEQ ID NO: 3014224 - RNA, 19 nt, Mycobacterium avium subsp. paratuberculosis
gggaaucccacccgcaacg

SEQ ID NO: 3014225 - RNA, 22 nt, Mycobacterium avium subsp. paratuberculosis
gggaaucccacccgcaacgcug

SEQ ID NO: 3014226 - RNA, 21 nt, Mycobacterium avium subsp. paratuberculosis
gggaauccuggccgaugguca

SEQ ID NO: 3014227 - RNA, 15 nt, Mycobacterium avium subsp. paratuberculosis
gggaaugcggcuggg

SEQ ID NO: 3014228 - RNA, 16 nt, Mycobacterium avium subsp. paratuberculosis
gggaauggggcccggu

SEQ ID NO: 3014229 - RNA, 17 nt, Mycobacterium avium subsp. paratuberculosis
gggaaugucgcgcagca

SEQ ID NO: 3014230 - RNA, 20 nt, Mycobacterium avium subsp. paratuberculosis
gggacaccgcuggccgaggc

SEQ ID NO: 3014231 - RNA, 14 nt, Mycobacterium avium subsp. paratuberculosis
gggacagcaccacc

SEQ ID NO: 3014232 - RNA, 16 nt, Mycobacterium avium subsp. paratuberculosis
gggacagcaccaccag

SEQ ID NO: 3014233 - RNA, 17 nt, Mycobacterium avium subsp. paratuberculosis
gggacagccgcgccgac

SEQ ID NO: 3014234 - RNA, 16 nt, Mycobacterium avium subsp. paratuberculosis
gggacagcgucaccaa

SEQ ID NO: 3014235 - RNA, 18 nt, Mycobacterium avium subsp. paratuberculosis
gggacagguagcgcagcc

SEQ ID NO: 3014236 - RNA, 20 nt, Mycobacterium avium subsp. paratuberculosis
gggacagguagcgcagcccg

SEQ ID NO: 3014237 - RNA, 14 nt, Mycobacterium avium subsp. paratuberculosis
gggacauccgugag

SEQ ID NO: 3014238 - RNA, 17 nt, Mycobacterium avium subsp. paratuberculosis
gggacaucgucgcgccc

SEQ ID NO: 3014239 - RNA, 18 nt, Mycobacterium avium subsp. paratuberculosis
gggacaucgucgcgccca

SEQ ID NO: 3014240 - RNA, 15 nt, Mycobacterium avium subsp. paratuberculosis
gggacaugccgagca

SEQ ID NO: 3014241 - RNA, 21 nt, Mycobacterium avium subsp. paratuberculosis
gggaccagcgccucggccugc

SEQ ID NO: 3014242 - RNA, 14 nt, Mycobacterium avium subsp. paratuberculosis
gggaccagcgcggu

SEQ ID NO: 3014243 - RNA, 14 nt, Mycobacterium avium subsp. paratuberculosis
gggacccgcaccgg

SEQ ID NO: 3014244 - RNA, 14 nt, Mycobacterium avium subsp. paratuberculosis
gggacccgcgaccc

SEQ ID NO: 3014245 - RNA, 18 nt, Mycobacterium avium subsp. paratuberculosis
gggaccgaggugccgcgg

SEQ ID NO: 3014246 - RNA, 15 nt, Mycobacterium avium subsp. paratuberculosis
gggaccgcacgccgg

SEQ ID NO: 3014247 - RNA, 18 nt, Mycobacterium avium subsp. paratuberculosis
gggaccgggcccggcgcc

SEQ ID NO: 3014248 - RNA, 17 nt, Mycobacterium avium subsp. paratuberculosis
gggaccggugcgguccc

SEQ ID NO: 3014249 - RNA, 16 nt, Mycobacterium avium subsp. paratuberculosis
gggaccgucgcgcagc

SEQ ID NO: 3014250 - RNA, 17 nt, Mycobacterium avium subsp. paratuberculosis
gggaccgucgcgcagcc

SEQ ID NO: 3014251 - RNA, 19 nt, Mycobacterium avium subsp. paratuberculosis
gggaccugggucugcggcc

SEQ ID NO: 3014252 - RNA, 22 nt, Mycobacterium avium subsp. paratuberculosis
gggaccugggucugcggccggg

SEQ ID NO: 3014253 - RNA, 19 nt, Mycobacterium avium subsp. paratuberculosis
gggacgaaggugcgcacga

SEQ ID NO: 3014254 - RNA, 17 nt, Mycobacterium avium subsp. paratuberculosis
gggauccggcgcgccgc

SEQ ID NO: 3014255 - RNA, 18 nt, Mycobacterium avium subsp. paratuberculosis
gggauccggcgcgccgcg

SEQ ID NO: 3014256 - RNA, 20 nt, Mycobacterium avium subsp. paratuberculosis
gggauccggcgcgccgcgau

SEQ ID NO: 3014257 - RNA, 14 nt, Mycobacterium avium subsp. paratuberculosis
gggauccucgccgc

SEQ ID NO: 3014258 - RNA, 15 nt, Mycobacterium avium subsp. paratuberculosis
gggauccucgccgcg

SEQ ID NO: 3014259 - RNA, 17 nt, Mycobacterium avium subsp. paratuberculosis
gggauccucgccgcggg

SEQ ID NO: 3014260 - RNA, 20 nt, Mycobacterium avium subsp. paratuberculosis
gggauccucgccgcgggcca

SEQ ID NO: 3014261 - RNA, 22 nt, Mycobacterium avium subsp. paratuberculosis
gggaucgaucccgucggccauc

SEQ ID NO: 3014262 - RNA, 11 nt, Mycobacterium avium subsp. paratuberculosis
gggaucgcgca

SEQ ID NO: 3014263 - RNA, 18 nt, Mycobacterium avium subsp. paratuberculosis
gggaucgcgcagccgcgg

SEQ ID NO: 3014264 - RNA, 19 nt, Mycobacterium avium subsp. paratuberculosis
gggaucgcgcagccgcggu

SEQ ID NO: 3014265 - RNA, 21 nt, Mycobacterium avium subsp. paratuberculosis
gggaucgcgcagccgcggugg

SEQ ID NO: 3014266 - RNA, 17 nt, Mycobacterium avium subsp. paratuberculosis
gggaucggaccgcacca

SEQ ID NO: 3014267 - RNA, 19 nt, Mycobacterium avium subsp. paratuberculosis
gggaucggaccgcaccacc

SEQ ID NO: 3014268 - RNA, 20 nt, Mycobacterium avium subsp. paratuberculosis
gggaucggaccgcaccacca

SEQ ID NO: 3014269 - RNA, 14 nt, Mycobacterium avium subsp. paratuberculosis
gggaucggcagcgc

SEQ ID NO: 3014270 - RNA, 15 nt, Mycobacterium avium subsp. paratuberculosis
gggaucggccggcga

SEQ ID NO: 3014271 - RNA, 13 nt, Mycobacterium avium subsp. paratuberculosis
gggaucggcgccc

SEQ ID NO: 3014272 - RNA, 19 nt, Mycobacterium avium subsp. paratuberculosis
gggaucggcgcccaccgcg

SEQ ID NO: 3014273 - RNA, 13 nt, Mycobacterium avium subsp. paratuberculosis
gggaucggcggcg

SEQ ID NO: 3014274 - RNA, 15 nt, Mycobacterium avium subsp. paratuberculosis
gggaucggcggcggg

SEQ ID NO: 3014275 - RNA, 12 nt, Mycobacterium avium subsp. paratuberculosis
gggaucggcggg

SEQ ID NO: 3014276 - RNA, 18 nt, Mycobacterium avium subsp. paratuberculosis
gggaucggcggggcgcgu

SEQ ID NO: 3014277 - RNA, 17 nt, Mycobacterium avium subsp. paratuberculosis
gggaucggggugccgcc

SEQ ID NO: 3014278 - RNA, 22 nt, Mycobacterium avium subsp. paratuberculosis
gggaucgucgccgggcuugguc

SEQ ID NO: 3014279 - RNA, 19 nt, Mycobacterium avium subsp. paratuberculosis
gggaucguguggccgcccu

SEQ ID NO: 3014280 - RNA, 16 nt, Mycobacterium avium subsp. paratuberculosis
gggaugacaccgcgga

SEQ ID NO: 3014281 - RNA, 22 nt, Mycobacterium avium subsp. paratuberculosis
gggaugccaguccugggccggg

SEQ ID NO: 3014282 - RNA, 15 nt, Mycobacterium avium subsp. paratuberculosis
gggaugcccggggga

SEQ ID NO: 3014283 - RNA, 21 nt, Mycobacterium avium subsp. paratuberculosis
gggaugccgaaccgcugcgga

SEQ ID NO: 3014284 - RNA, 21 nt, Mycobacterium avium subsp. paratuberculosis
gggaugccgccggucacggcg

SEQ ID NO: 3014285 - RNA, 21 nt, Mycobacterium avium subsp. paratuberculosis
gggaugccugcccgcgcaggc

SEQ ID NO: 3014286 - RNA, 17 nt, Mycobacterium avium subsp. paratuberculosis
gggaugcgccaccgaca

SEQ ID NO: 3014287 - RNA, 23 nt, Mycobacterium avium subsp. paratuberculosis
gggaugcgccaccgacaccaccg

SEQ ID NO: 3014288 - RNA, 14 nt, Mycobacterium avium subsp. paratuberculosis
gggauggacgacgu

SEQ ID NO: 3014289 - RNA, 23 nt, Mycobacterium avium subsp. paratuberculosis
gggauggcucagcgcaccgccgu

SEQ ID NO: 3014290 - RNA, 18 nt, Mycobacterium avium subsp. paratuberculosis
gggauggugaccagcgcc

SEQ ID NO: 3014291 - RNA, 16 nt, Mycobacterium avium subsp. paratuberculosis
gggauggugagcccga

SEQ ID NO: 3014292 - RNA, 21 nt, Mycobacterium avium subsp. paratuberculosis
gggauguagccgccgguggcg

SEQ ID NO: 3014293 - RNA, 19 nt, Mycobacterium avium subsp. paratuberculosis
gggaugucgucgggcgcgg

SEQ ID NO: 3014294 - RNA, 22 nt, Mycobacterium avium subsp. paratuberculosis
gggaugucgucgggcgcggugu

SEQ ID NO: 3014295 - RNA, 15 nt, Mycobacterium avium subsp. paratuberculosis
gggaugucuagccgc

SEQ ID NO: 3014296 - RNA, 21 nt, Mycobacterium avium subsp. paratuberculosis
gggaugucuagccgccgagcg

SEQ ID NO: 3014297 - RNA, 17 nt, Mycobacterium avium subsp. paratuberculosis
gggauugccgagcaccc

SEQ ID NO: 3014298 - RNA, 14 nt, Mycobacterium avium subsp. paratuberculosis
gggauugccgggca

SEQ ID NO: 3014299 - RNA, 19 nt, Mycobacterium avium subsp. paratuberculosis
gggauugccgggcaccagc

SEQ ID NO: 3014300 - RNA, 22 nt, Mycobacterium avium subsp. paratuberculosis
gggauugccgggcaccagcgac

SEQ ID NO: 3014301 - RNA, 14 nt, Mycobacterium avium subsp. paratuberculosis
gggauuggacagcg

SEQ ID NO: 3014302 - RNA, 14 nt, Mycobacterium avium subsp. paratuberculosis
gggauuggcggcca

SEQ ID NO: 3014303 - RNA, 22 nt, Mycobacterium avium subsp. paratuberculosis
gggauuucacgucugcucggcg

SEQ ID NO: 3014304 - RNA, 22 nt, Mycobacterium avium subsp. paratuberculosis
gggcaacagcgcgccggccggc

SEQ ID NO: 3014305 - RNA, 17 nt, Mycobacterium avium subsp. paratuberculosis
gggcaaccacagcggcg

SEQ ID NO: 3014306 - RNA, 14 nt, Mycobacterium avium subsp. paratuberculosis
gggcaaccgcagca

SEQ ID NO: 3014307 - RNA, 16 nt, Mycobacterium avium subsp. paratuberculosis
gggcaaccgcagcauc

SEQ ID NO: 3014308 - RNA, 20 nt, Mycobacterium avium subsp. paratuberculosis
gggcaacgaacgcggcgccu

SEQ ID NO: 3014309 - RNA, 14 nt, Mycobacterium avium subsp. paratuberculosis
gggcaacgcgccgg

SEQ ID NO: 3014310 - RNA, 14 nt, Mycobacterium avium subsp. paratuberculosis
gggcaagcagcggc

SEQ ID NO: 3014311 - RNA, 22 nt, Mycobacterium avium subsp. paratuberculosis
gggcaauaccggcagcaggugc

SEQ ID NO: 3014312 - RNA, 19 nt, Mycobacterium avium subsp. paratuberculosis
gggcacaccgucguccacg

SEQ ID NO: 3014313 - RNA, 13 nt, Mycobacterium avium subsp. paratuberculosis
gggcacagccagc

SEQ ID NO: 3014314 - RNA, 15 nt, Mycobacterium avium subsp. paratuberculosis
gggcaccaccaccga

SEQ ID NO: 3014315 - RNA, 11 nt, Mycobacterium avium subsp. paratuberculosis
gggcaccacgg

SEQ ID NO: 3014316 - RNA, 13 nt, Mycobacterium avium subsp. paratuberculosis
gggcaccacggcg

SEQ ID NO: 3014317 - RNA, 20 nt, Mycobacterium avium subsp. paratuberculosis
gggcaccacguccaccagca

SEQ ID NO: 3014318 - RNA, 11 nt, Mycobacterium avium subsp. paratuberculosis
gggcaccagcg

SEQ ID NO: 3014319 - RNA, 22 nt, Mycobacterium avium subsp. paratuberculosis
gggcaccagcgacagcacccgc

SEQ ID NO: 3014320 - RNA, 14 nt, Mycobacterium avium subsp. paratuberculosis
gggcaccagcgcga

SEQ ID NO: 3014321 - RNA, 13 nt, Mycobacterium avium subsp. paratuberculosis
gggcacccgcgcg

SEQ ID NO: 3014322 - RNA, 19 nt, Mycobacterium avium subsp. paratuberculosis
gggcacccgcgcgucgcgc

SEQ ID NO: 3014323 - RNA, 20 nt, Mycobacterium avium subsp. paratuberculosis
gggcacccggcgcggccgcc

SEQ ID NO: 3014324 - RNA, 11 nt, Mycobacterium avium subsp. paratuberculosis
gggcaccgacg

SEQ ID NO: 3014325 - RNA, 16 nt, Mycobacterium avium subsp. paratuberculosis
gggcaccgacggccgc

SEQ ID NO: 3014326 - RNA, 17 nt, Mycobacterium avium subsp. paratuberculosis
gggcaccgacggccgca

SEQ ID NO: 3014327 - RNA, 22 nt, Mycobacterium avium subsp. paratuberculosis
gggcaccgccagucugagcccg

SEQ ID NO: 3014328 - RNA, 15 nt, Mycobacterium avium subsp. paratuberculosis
gggcaccgcgcccgc

SEQ ID NO: 3014329 - RNA, 14 nt, Mycobacterium avium subsp. paratuberculosis
gggcaccggcaccg

SEQ ID NO: 3014330 - RNA, 15 nt, Mycobacterium avium subsp. paratuberculosis
gggcaccggcaccgc

SEQ ID NO: 3014331 - RNA, 17 nt, Mycobacterium avium subsp. paratuberculosis
gggcaccggcaccgccc

SEQ ID NO: 3014332 - RNA, 22 nt, Mycobacterium avium subsp. paratuberculosis
gggcaccgucgauuucaagggg

SEQ ID NO: 3014333 - RNA, 17 nt, Mycobacterium avium subsp. paratuberculosis
gggcaccucggccaggu

SEQ ID NO: 3014334 - RNA, 20 nt, Mycobacterium avium subsp. paratuberculosis
gggcaccugauaggggucgg

SEQ ID NO: 3014335 - RNA, 14 nt, Mycobacterium avium subsp. paratuberculosis
gggcacgcgagacg

SEQ ID NO: 3014336 - RNA, 22 nt, Mycobacterium avium subsp. paratuberculosis
gggcacgcgagacgagccgccg

SEQ ID NO: 3014337 - RNA, 15 nt, Mycobacterium avium subsp. paratuberculosis
gggcacgcgcgcccg

SEQ ID NO: 3014338 - RNA, 17 nt, Mycobacterium avium subsp. paratuberculosis
gggcacgcgcgcccggc

SEQ ID NO: 3014339 - RNA, 19 nt, Mycobacterium avium subsp. paratuberculosis
ggcgaugugaucgcggccc

SEQ ID NO: 3014340 - RNA, 21 nt, Mycobacterium avium subsp. paratuberculosis
ggcgaugugaucgcggcccac

SEQ ID NO: 3014341 - RNA, 19 nt, Mycobacterium avium subsp. paratuberculosis
ggcgauguugaccacccgc

SEQ ID NO: 3014342 - RNA, 19 nt, Mycobacterium avium subsp. paratuberculosis
ggcgauuaggucgguggcc

SEQ ID NO: 3014343 - RNA, 23 nt, Mycobacterium avium subsp. paratuberculosis
ggcgauuaggucgguggccacca

SEQ ID NO: 3014344 - RNA, 15 nt, Mycobacterium avium subsp. paratuberculosis
ggcgauucgucgucg

SEQ ID NO: 3014345 - RNA, 20 nt, Mycobacterium avium subsp. paratuberculosis
ggcgauucgucgucguuggc

SEQ ID NO: 3014346 - RNA, 13 nt, Mycobacterium avium subsp. paratuberculosis
ggcgauuucggga

SEQ ID NO: 3014347 - RNA, 14 nt, Mycobacterium avium subsp. paratuberculosis
ggcgauuucgggau

SEQ ID NO: 3014348 - RNA, 18 nt, Mycobacterium avium subsp. paratuberculosis
ggcgauuucgucggcggu

SEQ ID NO: 3014349 - RNA, 21 nt, Mycobacterium avium subsp. paratuberculosis
ggcgauuucgucggcgguggg

SEQ ID NO: 3014350 - RNA, 11 nt, Mycobacterium avium subsp. paratuberculosis
ggcgcaacacc

SEQ ID NO: 3014351 - RNA, 14 nt, Mycobacterium avium subsp. paratuberculosis
ggcgcaacaccgga

SEQ ID NO: 3014352 - RNA, 22 nt, Mycobacterium avium subsp. paratuberculosis
ggcgcaacagcaccucgucgcc

SEQ ID NO: 3014353 - RNA, 21 nt, Mycobacterium avium subsp. paratuberculosis
ggcgcaaccaacucgcgaugu

SEQ ID NO: 3014354 - RNA, 22 nt, Mycobacterium avium subsp. paratuberculosis
ggcgcaaccucuucgggggugg

SEQ ID NO: 3014355 - RNA, 23 nt, Mycobacterium avium subsp. paratuberculosis
ggcgcaacggauuggucagagcc

SEQ ID NO: 3014356 - RNA, 16 nt, Mycobacterium avium subsp. paratuberculosis
ggcgcaacgggauggc

SEQ ID NO: 3014357 - RNA, 22 nt, Mycobacterium avium subsp. paratuberculosis
ggcgcaaucggggccgacccgc

SEQ ID NO: 3014358 - RNA, 21 nt, Mycobacterium avium subsp. paratuberculosis
ggcgcacaucguggcgacgac

SEQ ID NO: 3014359 - RNA, 13 nt, Mycobacterium avium subsp. paratuberculosis
ggcgcaccaccag

SEQ ID NO: 3014360 - RNA, 17 nt, Mycobacterium avium subsp. paratuberculosis
ggcgcaccaccagcucg

SEQ ID NO: 3014361 - RNA, 18 nt, Mycobacterium avium subsp. paratuberculosis
ggcgcaccaccagcucgu

SEQ ID NO: 3014362 - RNA, 20 nt, Mycobacterium avium subsp. paratuberculosis
ggcgcaccaccagcucgucg

SEQ ID NO: 3014363 - RNA, 22 nt, Mycobacterium avium subsp. paratuberculosis
ggcgcaccaccagcucgucgcc

SEQ ID NO: 3014364 - RNA, 17 nt, Mycobacterium avium subsp. paratuberculosis
ggcgcaccacgaccucc

SEQ ID NO: 3014365 - RNA, 12 nt, Mycobacterium avium subsp. paratuberculosis
ggcgcaccagcu

SEQ ID NO: 3014366 - RNA, 16 nt, Mycobacterium avium subsp. paratuberculosis
ggcgcaccaggcgcca

SEQ ID NO: 3014367 - RNA, 18 nt, Mycobacterium avium subsp. paratuberculosis
ggcgcaccaggcgccaca

SEQ ID NO: 3014368 - RNA, 21 nt, Mycobacterium avium subsp. paratuberculosis
ggcgcaccaggcgccacagca

SEQ ID NO: 3014369 - RNA, 16 nt, Mycobacterium avium subsp. paratuberculosis
ggcgcaccaggguguc

SEQ ID NO: 3014370 - RNA, 17 nt, Mycobacterium avium subsp. paratuberculosis
ggcgcaccccgaaccag

SEQ ID NO: 3014371 - RNA, 21 nt, Mycobacterium avium subsp. paratuberculosis
ggcgcaccccgaaccaguucg

SEQ ID NO: 3014372 - RNA, 17 nt, Mycobacterium avium subsp. paratuberculosis
ggcgcaccccguccagg

SEQ ID NO: 3014373 - RNA, 15 nt, Mycobacterium avium subsp. paratuberculosis
ggcgcacccgcacga

SEQ ID NO: 3014374 - RNA, 19 nt, Mycobacterium avium subsp. paratuberculosis
ggcgcacccgcacgaugug

SEQ ID NO: 3014375 - RNA, 17 nt, Mycobacterium avium subsp. paratuberculosis
ggcgcacccgggcagcu

SEQ ID NO: 3014376 - RNA, 14 nt, Mycobacterium avium subsp. paratuberculosis
ggcgcaccgcccgc

SEQ ID NO: 3014377 - RNA, 15 nt, Mycobacterium avium subsp. paratuberculosis
ggcgcaccgccgcgg

SEQ ID NO: 3014378 - RNA, 15 nt, Mycobacterium avium subsp. paratuberculosis
ggcgcaccgccgggc

SEQ ID NO: 3014379 - RNA, 19 nt, Mycobacterium avium subsp. paratuberculosis
ggcgcaccgccgggcaucc

SEQ ID NO: 3014380 - RNA, 15 nt, Mycobacterium avium subsp. paratuberculosis
ggcgcaccgccugug

SEQ ID NO: 3014381 - RNA, 23 nt, Mycobacterium avium subsp. paratuberculosis
ggcgcaccgccugugcgacggcg

SEQ ID NO: 3014382 - RNA, 16 nt, Mycobacterium avium subsp. paratuberculosis
ggcgcaccgcgcgcca

SEQ ID NO: 3014383 - RNA, 18 nt, Mycobacterium avium subsp. paratuberculosis
ggcgcaccgcgcgccagg

SEQ ID NO: 3014384 - RNA, 12 nt, Mycobacterium avium subsp. paratuberculosis
ggcgcaccgcgg

SEQ ID NO: 3014385 - RNA, 15 nt, Mycobacterium avium subsp. paratuberculosis
ggcgcaccgcggccu

SEQ ID NO: 3014386 - RNA, 16 nt, Mycobacterium avium subsp. paratuberculosis
ggcgcaccgcggccuc

SEQ ID NO: 3014387 - RNA, 18 nt, Mycobacterium avium subsp. paratuberculosis
ggcgcaccgcgucgacca

SEQ ID NO: 3014388 - RNA, 19 nt, Mycobacterium avium subsp. paratuberculosis
ggcgcaccgcgucgaugcg

SEQ ID NO: 3014389 - RNA, 21 nt, Mycobacterium avium subsp. paratuberculosis
ggcgcaccgugucgucgcuga

SEQ ID NO: 3014390 - RNA, 22 nt, Mycobacterium avium subsp. paratuberculosis
ggcgcaccgugucgucgcugac

SEQ ID NO: 3014391 - RNA, 13 nt, Mycobacterium avium subsp. paratuberculosis
ggcgcacggcgcc

SEQ ID NO: 3014392 - RNA, 18 nt, Mycobacterium avium subsp. paratuberculosis
ggcgcacggugcccgucg

SEQ ID NO: 3014393 - RNA, 22 nt, Mycobacterium avium subsp. paratuberculosis
ggcgcacguggcugaccgacgg

SEQ ID NO: 3014394 - RNA, 14 nt, Mycobacterium avium subsp. paratuberculosis
ggcgcacuccauca

SEQ ID NO: 3014395 - RNA, 21 nt, Mycobacterium avium subsp. paratuberculosis
ggcgcacuccaucacgaccuc

SEQ ID NO: 3014396 - RNA, 20 nt, Mycobacterium avium subsp. paratuberculosis
ggcgcagaaaaaggccgccg

SEQ ID NO: 3014397 - RNA, 22 nt, Mycobacterium avium subsp. paratuberculosis
ggcgcagaagcuaacgccagcu

SEQ ID NO: 3014398 - RNA, 23 nt, Mycobacterium avium subsp. paratuberculosis
ggcgcagaagcuaacgccagcug

SEQ ID NO: 3014399 - RNA, 16 nt, Mycobacterium avium subsp. paratuberculosis
ggcgcagaugaccggc

SEQ ID NO: 3014400 - RNA, 18 nt, Mycobacterium avium subsp. paratuberculosis
ggcgcagaugaccggccu

SEQ ID NO: 3014401 - RNA, 13 nt, Mycobacterium avium subsp. paratuberculosis
ggcgcagcacggc

SEQ ID NO: 3014402 - RNA, 15 nt, Mycobacterium avium subsp. paratuberculosis
ggcgcagcacggcca

SEQ ID NO: 3014403 - RNA, 17 nt, Mycobacterium avium subsp. paratuberculosis
ggcgcagcacggccacu

SEQ ID NO: 3014404 - RNA, 13 nt, Mycobacterium avium subsp. paratuberculosis
ggcgcagccagcg

SEQ ID NO: 3014405 - RNA, 15 nt, Mycobacterium avium subsp. paratuberculosis
ggcgcagccagcucg

SEQ ID NO: 3014406 - RNA, 16 nt, Mycobacterium avium subsp. paratuberculosis
ggcgcagccagcucgg

SEQ ID NO: 3014407 - RNA, 15 nt, Mycobacterium avium subsp. paratuberculosis
ggcgcagcccgagcg

SEQ ID NO: 3014408 - RNA, 18 nt, Mycobacterium avium subsp. paratuberculosis
ggcgcagcccgagcggca

SEQ ID NO: 3014409 - RNA, 13 nt, Mycobacterium avium subsp. paratuberculosis
ggcgcagcccggc

SEQ ID NO: 3014410 - RNA, 16 nt, Mycobacterium avium subsp. paratuberculosis
ggcgcagcccggcggu

SEQ ID NO: 3014411 - RNA, 19 nt, Mycobacterium avium subsp. paratuberculosis
ggcgcagcccggcgguuga

SEQ ID NO: 3014412 - RNA, 19 nt, Mycobacterium avium subsp. paratuberculosis
ggcgcagccgaucgacgaa

SEQ ID NO: 3014413 - RNA, 15 nt, Mycobacterium avium subsp. paratuberculosis
ggcgcagccggccac

SEQ ID NO: 3014414 - RNA, 16 nt, Mycobacterium avium subsp. paratuberculosis
ggcgcagccggccacc

SEQ ID NO: 3014415 - RNA, 19 nt, Mycobacterium avium subsp. paratuberculosis
ggcgcagccggccaccgcc

SEQ ID NO: 3014416 - RNA, 13 nt, Mycobacterium avium subsp. paratuberculosis
ggcgcagccgguc

SEQ ID NO: 3014417 - RNA, 20 nt, Mycobacterium avium subsp. paratuberculosis
ggcgcagcgcacgucgccgc

SEQ ID NO: 3014418 - RNA, 14 nt, Mycobacterium avium subsp. paratuberculosis
ggcgcagcgccgcg

SEQ ID NO: 3014419 - RNA, 16 nt, Mycobacterium avium subsp. paratuberculosis
ggcgcagcgccgcgcc

SEQ ID NO: 3014420 - RNA, 17 nt, Mycobacterium avium subsp. paratuberculosis
ggcgcagcgccgcgccg

SEQ ID NO: 3014421 - RNA, 18 nt, Mycobacterium avium subsp. paratuberculosis
ggcgcagcgccgcgccga

SEQ ID NO: 3014422 - RNA, 19 nt, Mycobacterium avium subsp. paratuberculosis
ggcgcagcgccgcgccgac

SEQ ID NO: 3014423 - RNA, 20 nt, Mycobacterium avium subsp. paratuberculosis
ggcgcagcgccgcgccgacc

SEQ ID NO: 3014424 - RNA, 17 nt, Mycobacterium avium subsp. paratuberculosis
ggccgucucgucggccg

SEQ ID NO: 3014425 - RNA, 17 nt, Mycobacterium avium subsp. paratuberculosis
ggccgucuugcccggcg

SEQ ID NO: 3014426 - RNA, 14 nt, Mycobacterium avium subsp. paratuberculosis
ggccgugaaccggc

SEQ ID NO: 3014427 - RNA, 17 nt, Mycobacterium avium subsp. paratuberculosis
ggccgugaaccggcguu

SEQ ID NO: 3014428 - RNA, 17 nt, Mycobacterium avium subsp. paratuberculosis
ggccgugaucggccagc

SEQ ID NO: 3014429 - RNA, 15 nt, Mycobacterium avium subsp. paratuberculosis
ggccgugaucggccu

SEQ ID NO: 3014430 - RNA, 18 nt, Mycobacterium avium subsp. paratuberculosis
ggccgugaucucgugccg

SEQ ID NO: 3014431 - RNA, 22 nt, Mycobacterium avium subsp. paratuberculosis
ggccgugaucucgugccgcacc

SEQ ID NO: 3014432 - RNA, 12 nt, Mycobacterium avium subsp. paratuberculosis
ggccgugaugcc

SEQ ID NO: 3014433 - RNA, 14 nt, Mycobacterium avium subsp. paratuberculosis
ggccgugaugcgcc

SEQ ID NO: 3014434 - RNA, 16 nt, Mycobacterium avium subsp. paratuberculosis
ggccgugaugcgccgg

SEQ ID NO: 3014435 - RNA, 18 nt, Mycobacterium avium subsp. paratuberculosis
ggccgugaugcgccggcg

SEQ ID NO: 3014436 - RNA, 20 nt, Mycobacterium avium subsp. paratuberculosis
ggccgugcacgaacagggug

SEQ ID NO: 3014437 - RNA, 18 nt, Mycobacterium avium subsp. paratuberculosis
ggccgugcagggggcgca

SEQ ID NO: 3014438 - RNA, 12 nt, Mycobacterium avium subsp. paratuberculosis
ggccgugccgcc

SEQ ID NO: 3014439 - RNA, 18 nt, Mycobacterium avium subsp. paratuberculosis
ggccgugccguggucggu

SEQ ID NO: 3014440 - RNA, 19 nt, Mycobacterium avium subsp. paratuberculosis
ggccgugcgcgucgacacc

SEQ ID NO: 3014441 - RNA, 13 nt, Mycobacterium avium subsp. paratuberculosis
ggccguggcaccg

SEQ ID NO: 3014442 - RNA, 16 nt, Mycobacterium avium subsp. paratuberculosis
ggccguggcaccgggu

SEQ ID NO: 3014443 - RNA, 14 nt, Mycobacterium avium subsp. paratuberculosis
ggccguggccguca

SEQ ID NO: 3014444 - RNA, 15 nt, Mycobacterium avium subsp. paratuberculosis
ggccguggucggcga

SEQ ID NO: 3014445 - RNA, 16 nt, Mycobacterium avium subsp. paratuberculosis
ggccgugguuggcgau

SEQ ID NO: 3014446 - RNA, 14 nt, Mycobacterium avium subsp. paratuberculosis
ggccguguacagca

SEQ ID NO: 3014447 - RNA, 22 nt, Mycobacterium avium subsp. paratuberculosis
ggccgugugcgcaucggcgacg

SEQ ID NO: 3014448 - RNA, 14 nt, Mycobacterium avium subsp. paratuberculosis
ggccguucagcggg

SEQ ID NO: 3014449 - RNA, 20 nt, Mycobacterium avium subsp. paratuberculosis
ggccguucagcgggcgguug

SEQ ID NO: 3014450 - RNA, 23 nt, Mycobacterium avium subsp. paratuberculosis
ggccguucagguaaucgaugacg

SEQ ID NO: 3014451 - RNA, 15 nt, Mycobacterium avium subsp. paratuberculosis
ggccguucaggucga

SEQ ID NO: 3014452 - RNA, 23 nt, Mycobacterium avium subsp. paratuberculosis
ggccguucaggucgaucagcggu

SEQ ID NO: 3014453 - RNA, 15 nt, Mycobacterium avium subsp. paratuberculosis
ggccguucgccggcc

SEQ ID NO: 3014454 - RNA, 20 nt, Mycobacterium avium subsp. paratuberculosis
ggccguucgccggccagcac

SEQ ID NO: 3014455 - RNA, 17 nt, Mycobacterium avium subsp. paratuberculosis
ggccguucuugcgggug

SEQ ID NO: 3014456 - RNA, 18 nt, Mycobacterium avium subsp. paratuberculosis
ggccguucuugcggguga

SEQ ID NO: 3014457 - RNA, 24 nt, Mycobacterium avium subsp. paratuberculosis
ggccguucuugcgggugauccagc

SEQ ID NO: 3014458 - RNA, 22 nt, Mycobacterium avium subsp. paratuberculosis
ggccguugaucgagcaccgggc

SEQ ID NO: 3014459 - RNA, 15 nt, Mycobacterium avium subsp. paratuberculosis
ggccguugccggucc

SEQ ID NO: 3014460 - RNA, 23 nt, Mycobacterium avium subsp. paratuberculosis
ggccguugccggucccguugauc

SEQ ID NO: 3014461 - RNA, 19 nt, Mycobacterium avium subsp. paratuberculosis
ggccguugcgggugucgcc

SEQ ID NO: 3014462 - RNA, 20 nt, Mycobacterium avium subsp. paratuberculosis
ggccguugcgggugucgccg

SEQ ID NO: 3014463 - RNA, 21 nt, Mycobacterium avium subsp. paratuberculosis
ggccguugcgggugucgccgg

SEQ ID NO: 3014464 - RNA, 19 nt, Mycobacterium avium subsp. paratuberculosis
ggccguugcucucggccuc

SEQ ID NO: 3014465 - RNA, 18 nt, Mycobacterium avium subsp. paratuberculosis
ggccguugggccagcggc

SEQ ID NO: 3014466 - RNA, 19 nt, Mycobacterium avium subsp. paratuberculosis
ggccguugggccagcggcg

SEQ ID NO: 3014467 - RNA, 20 nt, Mycobacterium avium subsp. paratuberculosis
ggccguugggccagcggcgc

SEQ ID NO: 3014468 - RNA, 22 nt, Mycobacterium avium subsp. paratuberculosis
ggccguugggccagcggcgccg

SEQ ID NO: 3014469 - RNA, 19 nt, Mycobacterium avium subsp. paratuberculosis
ggccuaggaccccggcugc

SEQ ID NO: 3014470 - RNA, 14 nt, Mycobacterium avium subsp. paratuberculosis
ggccuagugccggg

SEQ ID NO: 3014471 - RNA, 14 nt, Mycobacterium avium subsp. paratuberculosis
ggccuaugccgcgu

SEQ ID NO: 3014472 - RNA, 17 nt, Mycobacterium avium subsp. paratuberculosis
ggccucaccgcgggcca

SEQ ID NO: 3014473 - RNA, 20 nt, Mycobacterium avium subsp. paratuberculosis
ggccucaggcgucggucagc

SEQ ID NO: 3014474 - RNA, 23 nt, Mycobacterium avium subsp. paratuberculosis
ggccuccaccaccaugucguuga

SEQ ID NO: 3014475 - RNA, 12 nt, Mycobacterium avium subsp. paratuberculosis
ggccuccaccgg

SEQ ID NO: 3014476 - RNA, 22 nt, Mycobacterium avium subsp. paratuberculosis
ggccuccaccggcaaucgggac

SEQ ID NO: 3014477 - RNA, 14 nt, Mycobacterium avium subsp. paratuberculosis
ggccuccagccagc

SEQ ID NO: 3014478 - RNA, 12 nt, Mycobacterium avium subsp. paratuberculosis
ggccuccagccg

SEQ ID NO: 3014479 - RNA, 14 nt, Mycobacterium avium subsp. paratuberculosis
ggccuccagccggc

SEQ ID NO: 3014480 - RNA, 19 nt, Mycobacterium avium subsp. paratuberculosis
ggccuccagcuuugccagc

SEQ ID NO: 3014481 - RNA, 21 nt, Mycobacterium avium subsp. paratuberculosis
ggccuccagcuuugccagcag

SEQ ID NO: 3014482 - RNA, 13 nt, Mycobacterium avium subsp. paratuberculosis
ggccuccaggcug

SEQ ID NO: 3014483 - RNA, 23 nt, Mycobacterium avium subsp. paratuberculosis
ggccucccacagcggaucggccu

SEQ ID NO: 3014484 - RNA, 17 nt, Mycobacterium avium subsp. paratuberculosis
ggccuccccauccgcgg

SEQ ID NO: 3014485 - RNA, 18 nt, Mycobacterium avium subsp. paratuberculosis
ggccuccccauccgcggc

SEQ ID NO: 3014486 - RNA, 20 nt, Mycobacterium avium subsp. paratuberculosis
ggccuccccauccgcggcca

SEQ ID NO: 3014487 - RNA, 19 nt, Mycobacterium avium subsp. paratuberculosis
ggccucccgguaggcggcg

SEQ ID NO: 3014488 - RNA, 17 nt, Mycobacterium avium subsp. paratuberculosis
ggccuccgagcggcgca

SEQ ID NO: 3014489 - RNA, 23 nt, Mycobacterium avium subsp. paratuberculosis
ggccuccgagcggcgcaggccgg

SEQ ID NO: 3014490 - RNA, 15 nt, Mycobacterium avium subsp. paratuberculosis
ggccuccgccaccuc

SEQ ID NO: 3014491 - RNA, 19 nt, Mycobacterium avium subsp. paratuberculosis
ggccuccgccaccuccucc

SEQ ID NO: 3014492 - RNA, 16 nt, Mycobacterium avium subsp. paratuberculosis
ggccuccggagugacg

SEQ ID NO: 3014493 - RNA, 22 nt, Mycobacterium avium subsp. paratuberculosis
ggccuccggagugacgucgcgc

SEQ ID NO: 3014494 - RNA, 17 nt, Mycobacterium avium subsp. paratuberculosis
ggccuccggauggcggu

SEQ ID NO: 3014495 - RNA, 13 nt, Mycobacterium avium subsp. paratuberculosis
ggccuccggcggc

SEQ ID NO: 3014496 - RNA, 13 nt, Mycobacterium avium subsp. paratuberculosis
ggccuccgugcug

SEQ ID NO: 3014497 - RNA, 17 nt, Mycobacterium avium subsp. paratuberculosis
ggccuccgugcuggccg

SEQ ID NO: 3014498 - RNA, 18 nt, Mycobacterium avium subsp. paratuberculosis
ggccuccgugcuggccgg

SEQ ID NO: 3014499 - RNA, 17 nt, Mycobacterium avium subsp. paratuberculosis
ggccuccuccucgcugc

SEQ ID NO: 3014500 - RNA, 21 nt, Mycobacterium avium subsp. paratuberculosis
ggccuccuccucgcugccggc

SEQ ID NO: 3014501 - RNA, 23 nt, Mycobacterium avium subsp. paratuberculosis
ggccuccuccucgcugccggccg

SEQ ID NO: 3014502 - RNA, 21 nt, Mycobacterium avium subsp. paratuberculosis
ggccuccuguuggcccugcuc

SEQ ID NO: 3014503 - RNA, 16 nt, Mycobacterium avium subsp. paratuberculosis
ggccucgaggaucgcg

SEQ ID NO: 3014504 - RNA, 17 nt, Mycobacterium avium subsp. paratuberculosis
ggccucgaggaucgcgg

SEQ ID NO: 3014505 - RNA, 18 nt, Mycobacterium avium subsp. paratuberculosis
ggccucgaggaucgcggc

SEQ ID NO: 3014506 - RNA, 20 nt, Mycobacterium avium subsp. paratuberculosis
ggccucgaggaucgcggcca

SEQ ID NO: 3014507 - RNA, 20 nt, Mycobacterium avium subsp. paratuberculosis
ggccucgagugccugcgccc

SEQ ID NO: 3014508 - RNA, 23 nt, Mycobacterium avium subsp. paratuberculosis
ggcgaacagugcacugccgaccc

SEQ ID NO: 3014509 - RNA, 20 nt, Mycobacterium avium subsp. paratuberculosis
ggcgaacaucuuggucagcc

SEQ ID NO: 3014510 - RNA, 17 nt, Mycobacterium avium subsp. paratuberculosis
ggcgaacauggcggcca

SEQ ID NO: 3014511 - RNA, 18 nt, Mycobacterium avium subsp. paratuberculosis
ggcgaacauggucgccca

SEQ ID NO: 3014512 - RNA, 20 nt, Mycobacterium avium subsp. paratuberculosis
ggcgaacauggucgcccaca

SEQ ID NO: 3014513 - RNA, 20 nt, Mycobacterium avium subsp. paratuberculosis
ggcgaacaugguggucgaac

SEQ ID NO: 3014514 - RNA, 18 nt, Mycobacterium avium subsp. paratuberculosis
ggcgaaccacgggucgcu

SEQ ID NO: 3014515 - RNA, 12 nt, Mycobacterium avium subsp. paratuberculosis
ggcgaaccagca

SEQ ID NO: 3014516 - RNA, 14 nt, Mycobacterium avium subsp. paratuberculosis
ggcgaaccagcaug

SEQ ID NO: 3014517 - RNA, 21 nt, Mycobacterium avium subsp. paratuberculosis
ggcgaaccagcaugcgccaga

SEQ ID NO: 3014518 - RNA, 18 nt, Mycobacterium avium subsp. paratuberculosis
ggcgaaccagcgcccgcu

SEQ ID NO: 3014519 - RNA, 15 nt, Mycobacterium avium subsp. paratuberculosis
ggcgaaccagggcag

SEQ ID NO: 3014520 - RNA, 17 nt, Mycobacterium avium subsp. paratuberculosis
ggcgaaccagggcagcc

SEQ ID NO: 3014521 - RNA, 18 nt, Mycobacterium avium subsp. paratuberculosis
ggcgaaccagggcagcca

SEQ ID NO: 3014522 - RNA, 13 nt, Mycobacterium avium subsp. paratuberculosis
ggcgaacccggcg

SEQ ID NO: 3014523 - RNA, 16 nt, Mycobacterium avium subsp. paratuberculosis
ggcgaacccggcgccc

SEQ ID NO: 3014524 - RNA, 19 nt, Mycobacterium avium subsp. paratuberculosis
ggcgaacccggcgcccggc

SEQ ID NO: 3014525 - RNA, 20 nt, Mycobacterium avium subsp. paratuberculosis
ggcgaacccggcgcccggcc

SEQ ID NO: 3014526 - RNA, 13 nt, Mycobacterium avium subsp. paratuberculosis
ggcgaaccgccgc

SEQ ID NO: 3014527 - RNA, 14 nt, Mycobacterium avium subsp. paratuberculosis
ggcgaaccgccgca

SEQ ID NO: 3014528 - RNA, 18 nt, Mycobacterium avium subsp. paratuberculosis
ggcgaaccgccgcaccca

SEQ ID NO: 3014529 - RNA, 16 nt, Mycobacterium avium subsp. paratuberculosis
ggcgaaccgcggcggc

SEQ ID NO: 3014530 - RNA, 20 nt, Mycobacterium avium subsp. paratuberculosis
ggcgaaccgcggcggcagca

SEQ ID NO: 3014531 - RNA, 23 nt, Mycobacterium avium subsp. paratuberculosis
ggcgaaccgcggcggcagcagcc

SEQ ID NO: 3014532 - RNA, 15 nt, Mycobacterium avium subsp. paratuberculosis
ggcgaaccguucguc

SEQ ID NO: 3014533 - RNA, 18 nt, Mycobacterium avium subsp. paratuberculosis
ggcgaaccguucgucguc

SEQ ID NO: 3014534 - RNA, 22 nt, Mycobacterium avium subsp. paratuberculosis
ggcgaaccguucgucgucgcgc

SEQ ID NO: 3014535 - RNA, 13 nt, Mycobacterium avium subsp. paratuberculosis
ggcgaacgaccgg

SEQ ID NO: 3014536 - RNA, 16 nt, Mycobacterium avium subsp. paratuberculosis
ggcgaacgcccggucg

SEQ ID NO: 3014537 - RNA, 20 nt, Mycobacterium avium subsp. paratuberculosis
ggcgaacgcccggucgauga

SEQ ID NO: 3014538 - RNA, 23 nt, Mycobacterium avium subsp. paratuberculosis
ggcgaacgccucgguggucgacg

SEQ ID NO: 3014539 - RNA, 23 nt, Mycobacterium avium subsp. paratuberculosis
ggcgaacgccuugagguacaucg

SEQ ID NO: 3014540 - RNA, 13 nt, Mycobacterium avium subsp. paratuberculosis
ggcgaacgcgacc

SEQ ID NO: 3014541 - RNA, 15 nt, Mycobacterium avium subsp. paratuberculosis
ggcgaacgcgaccug

SEQ ID NO: 3014542 - RNA, 20 nt, Mycobacterium avium subsp. paratuberculosis
ggcgaacgcgucccgggccu

SEQ ID NO: 3014543 - RNA, 20 nt, Mycobacterium avium subsp. paratuberculosis
ggcgaacggcaacggcggcg

SEQ ID NO: 3014544 - RNA, 14 nt, Mycobacterium avium subsp. paratuberculosis
ggcgaacggccagu

SEQ ID NO: 3014545 - RNA, 14 nt, Mycobacterium avium subsp. paratuberculosis
ggcgaacggccgcg

SEQ ID NO: 3014546 - RNA, 15 nt, Mycobacterium avium subsp. paratuberculosis
ggcgaacggccgcga

SEQ ID NO: 3014547 - RNA, 18 nt, Mycobacterium avium subsp. paratuberculosis
ggcgaacggccgcgaugu

SEQ ID NO: 3014548 - RNA, 15 nt, Mycobacterium avium subsp. paratuberculosis
ggcgaacgucgaugu

SEQ ID NO: 3014549 - RNA, 16 nt, Mycobacterium avium subsp. paratuberculosis
ggcgaacgucgauguc

SEQ ID NO: 3014550 - RNA, 17 nt, Mycobacterium avium subsp. paratuberculosis
ggcgaacgucgauguca

SEQ ID NO: 3014551 - RNA, 22 nt, Mycobacterium avium subsp. paratuberculosis
ggcgaacgucgggucgaagugc

SEQ ID NO: 3014552 - RNA, 18 nt, Mycobacterium avium subsp. paratuberculosis
ggcgaacuccagaucgcc

SEQ ID NO: 3014553 - RNA, 19 nt, Mycobacterium avium subsp. paratuberculosis
ggcgaacuccagaucgccg

SEQ ID NO: 3014554 - RNA, 20 nt, Mycobacterium avium subsp. paratuberculosis
ggcgaacuccagaucgccgc

SEQ ID NO: 3014555 - RNA, 22 nt, Mycobacterium avium subsp. paratuberculosis
ggcgaacuccagaucgccgccc

SEQ ID NO: 3014556 - RNA, 23 nt, Mycobacterium avium subsp. paratuberculosis
ggcgaacuccagaucgccgccca

SEQ ID NO: 3014557 - RNA, 13 nt, Mycobacterium avium subsp. paratuberculosis
ggcgaacucgacg

SEQ ID NO: 3014558 - RNA, 17 nt, Mycobacterium avium subsp. paratuberculosis
ggcgaacucgcggcggg

SEQ ID NO: 3014559 - RNA, 14 nt, Mycobacterium avium subsp. paratuberculosis
ggcgaacugcacca

SEQ ID NO: 3014560 - RNA, 16 nt, Mycobacterium avium subsp. paratuberculosis
ggcgaacugcaccagc

SEQ ID NO: 3014561 - RNA, 17 nt, Mycobacterium avium subsp. paratuberculosis
ggcgaacugcaccagca

SEQ ID NO: 3014562 - RNA, 18 nt, Mycobacterium avium subsp. paratuberculosis
ggcgaacugcaccagcac

SEQ ID NO: 3014563 - RNA, 19 nt, Mycobacterium avium subsp. paratuberculosis
ggcgaacugcaccagcacg

SEQ ID NO: 3014564 - RNA, 23 nt, Mycobacterium avium subsp. paratuberculosis
ggcgaacugcuugaucagguccu

SEQ ID NO: 3014565 - RNA, 17 nt, Mycobacterium avium subsp. paratuberculosis
ggcgaacuuggccgaca

SEQ ID NO: 3014566 - RNA, 16 nt, Mycobacterium avium subsp. paratuberculosis
ggcgaagacgucggcg

SEQ ID NO: 3014567 - RNA, 14 nt, Mycobacterium avium subsp. paratuberculosis
ggcgaagcaggcca

SEQ ID NO: 3014568 - RNA, 23 nt, Mycobacterium avium subsp. paratuberculosis
ggcgaagcaggccaggugcagcu

SEQ ID NO: 3014569 - RNA, 12 nt, Mycobacterium avium subsp. paratuberculosis
ggcgaagccggc

SEQ ID NO: 3014570 - RNA, 16 nt, Mycobacterium avium subsp. paratuberculosis
ggcgaagccggccccg

SEQ ID NO: 3014571 - RNA, 16 nt, Mycobacterium avium subsp. paratuberculosis
ggcgaaggagaagaca

SEQ ID NO: 3014572 - RNA, 18 nt, Mycobacterium avium subsp. paratuberculosis
ggcgaaggugggcagcgc

SEQ ID NO: 3014573 - RNA, 17 nt, Mycobacterium avium subsp. paratuberculosis
ggcgaagguguccucga

SEQ ID NO: 3014574 - RNA, 23 nt, Mycobacterium avium subsp. paratuberculosis
ggcgaagguguccucgagcugca

SEQ ID NO: 3014575 - RNA, 16 nt, Mycobacterium avium subsp. paratuberculosis
ggcgaaguagccggcg

SEQ ID NO: 3014576 - RNA, 20 nt, Mycobacterium avium subsp. paratuberculosis
ggcgaaguagccggcgaucg

SEQ ID NO: 3014577 - RNA, 21 nt, Mycobacterium avium subsp. paratuberculosis
ggcgaaguagcgggcguuggc

SEQ ID NO: 3014578 - RNA, 19 nt, Mycobacterium avium subsp. paratuberculosis
ggcgaaguagucggcgucc

SEQ ID NO: 3014579 - RNA, 16 nt, Mycobacterium avium subsp. paratuberculosis
ggcgaagucaucaccg

SEQ ID NO: 3014580 - RNA, 13 nt, Mycobacterium avium subsp. paratuberculosis
ggcgaagucgccg

SEQ ID NO: 3014581 - RNA, 16 nt, Mycobacterium avium subsp. paratuberculosis
ggcgaagucgccggcc

SEQ ID NO: 3014582 - RNA, 17 nt, Mycobacterium avium subsp. paratuberculosis
ggcgaagucgccggcca

SEQ ID NO: 3014583 - RNA, 17 nt, Mycobacterium avium subsp. paratuberculosis
ggcgaaguucggcaucc

SEQ ID NO: 3014584 - RNA, 21 nt, Mycobacterium avium subsp. paratuberculosis
ggcgaaguucggcaucccgga

SEQ ID NO: 3014585 - RNA, 17 nt, Mycobacterium avium subsp. paratuberculosis
ggcgaaguuggucacca

SEQ ID NO: 3014586 - RNA, 19 nt, Mycobacterium avium subsp. paratuberculosis
ggcgaaguuggucaccacc

SEQ ID NO: 3014587 - RNA, 17 nt, Mycobacterium avium subsp. paratuberculosis
ggcgaauauuucgccga

SEQ ID NO: 3014588 - RNA, 14 nt, Mycobacterium avium subsp. paratuberculosis
ggcgaauauuucgu

SEQ ID NO: 3014589 - RNA, 22 nt, Mycobacterium avium subsp. paratuberculosis
ggcgaauccgaccggcucagcc

SEQ ID NO: 3014590 - RNA, 15 nt, Mycobacterium avium subsp. paratuberculosis
ggcgaauccgagcau

SEQ ID NO: 3014591 - RNA, 18 nt, Mycobacterium avium subsp. paratuberculosis
ggcgaaucgguccggcga

SEQ ID NO: 3014592 - RNA, 21 nt, Mycobacterium avium subsp. paratuberculosis
ggcgacgggccgaucacgcgg

SEQ ID NO: 3014593 - RNA, 13 nt, Mycobacterium avium subsp. paratuberculosis
ggcgacggggugg

SEQ ID NO: 3014594 - RNA, 14 nt, Mycobacterium avium subsp. paratuberculosis
ggcgacggucugcc

SEQ ID NO: 3014595 - RNA, 17 nt, Mycobacterium avium subsp. paratuberculosis
ggcgacgguggcgccca

SEQ ID NO: 3014596 - RNA, 18 nt, Mycobacterium avium subsp. paratuberculosis
ggcgacgguggcgcccag

SEQ ID NO: 3014597 - RNA, 15 nt, Mycobacterium avium subsp. paratuberculosis
ggcgacgguggcggg

SEQ ID NO: 3014598 - RNA, 18 nt, Mycobacterium avium subsp. paratuberculosis
ggcgacgguggcgggccg

SEQ ID NO: 3014599 - RNA, 21 nt, Mycobacterium avium subsp. paratuberculosis
ggcgacgguggcgggccgccg

SEQ ID NO: 3014600 - RNA, 17 nt, Mycobacterium avium subsp. paratuberculosis
ggcgacgguguccgcgg

SEQ ID NO: 3014601 - RNA, 20 nt, Mycobacterium avium subsp. paratuberculosis
ggcgacgguguccgcggcgu

SEQ ID NO: 3014602 - RNA, 20 nt, Mycobacterium avium subsp. paratuberculosis
ggcgacguccuugaucagca

SEQ ID NO: 3014603 - RNA, 15 nt, Mycobacterium avium subsp. paratuberculosis
ggcgacgucgaacgc

SEQ ID NO: 3014604 - RNA, 12 nt, Mycobacterium avium subsp. paratuberculosis
ggcgacgucgcc

SEQ ID NO: 3014605 - RNA, 14 nt, Mycobacterium avium subsp. paratuberculosis
ggcgacgucgccgg

SEQ ID NO: 3014606 - RNA, 21 nt, Mycobacterium avium subsp. paratuberculosis
ggcgacgucggggucgucgcg

SEQ ID NO: 3014607 - RNA, 19 nt, Mycobacterium avium subsp. paratuberculosis
ggcgacgucggucggcagg

SEQ ID NO: 3014608 - RNA, 15 nt, Mycobacterium avium subsp. paratuberculosis
ggcgacgucgucgau

SEQ ID NO: 3014609 - RNA, 21 nt, Mycobacterium avium subsp. paratuberculosis
ggcgacgucgucgaugccgau

SEQ ID NO: 3014610 - RNA, 18 nt, Mycobacterium avium subsp. paratuberculosis
ggcgacgucgucgcccac

SEQ ID NO: 3014611 - RNA, 19 nt, Mycobacterium avium subsp. paratuberculosis
ggcgacgucgugcacgccg

SEQ ID NO: 3014612 - RNA, 15 nt, Mycobacterium avium subsp. paratuberculosis
ggcgacgucguggcc

SEQ ID NO: 3014613 - RNA, 19 nt, Mycobacterium avium subsp. paratuberculosis
ggcgacgucguggcccgga

SEQ ID NO: 3014614 - RNA, 17 nt, Mycobacterium avium subsp. paratuberculosis
ggcgacgugaucggcgg

SEQ ID NO: 3014615 - RNA, 15 nt, Mycobacterium avium subsp. paratuberculosis
ggcgacgugccggcg

SEQ ID NO: 3014616 - RNA, 16 nt, Mycobacterium avium subsp. paratuberculosis
ggcgacgugccggcgg

SEQ ID NO: 3014617 - RNA, 17 nt, Mycobacterium avium subsp. paratuberculosis
ggcgacgugccggcggc

SEQ ID NO: 3014618 - RNA, 20 nt, Mycobacterium avium subsp. paratuberculosis
ggcgacgugccggcggcagg

SEQ ID NO: 3014619 - RNA, 23 nt, Mycobacterium avium subsp. paratuberculosis
ggcgacgugccggcggcagguga

SEQ ID NO: 3014620 - RNA, 19 nt, Mycobacterium avium subsp. paratuberculosis
ggcgacuccagcagcgcca

SEQ ID NO: 3014621 - RNA, 20 nt, Mycobacterium avium subsp. paratuberculosis
ggcgacuccagcagcgccag

SEQ ID NO: 3014622 - RNA, 22 nt, Mycobacterium avium subsp. paratuberculosis
ggcgacuccagcagcgccagca

SEQ ID NO: 3014623 - RNA, 17 nt, Mycobacterium avium subsp. paratuberculosis
ggcgacuccggcgccgg

SEQ ID NO: 3014624 - RNA, 16 nt, Mycobacterium avium subsp. paratuberculosis
ggcgacugcgugcugg

SEQ ID NO: 3014625 - RNA, 22 nt, Mycobacterium avium subsp. paratuberculosis
ggcgacugcgugcugggcaccg

SEQ ID NO: 3014626 - RNA, 19 nt, Mycobacterium avium subsp. paratuberculosis
ggcgacuucguuggugguc

SEQ ID NO: 3014627 - RNA, 18 nt, Mycobacterium avium subsp. paratuberculosis
ggcgacuucuucgccggc

SEQ ID NO: 3014628 - RNA, 17 nt, Mycobacterium avium subsp. paratuberculosis
ggcgagaccgucggugc

SEQ ID NO: 3014629 - RNA, 19 nt, Mycobacterium avium subsp. paratuberculosis
ggcgagaucaacaccgcgc

SEQ ID NO: 3014630 - RNA, 22 nt, Mycobacterium avium subsp. paratuberculosis
ggcgagaucccugcgcucagca

SEQ ID NO: 3014631 - RNA, 19 nt, Mycobacterium avium subsp. paratuberculosis
ggcgagaucuucuccccgc

SEQ ID NO: 3014632 - RNA, 19 nt, Mycobacterium avium subsp. paratuberculosis
ggcgagauuggccucggcg

SEQ ID NO: 3014633 - RNA, 21 nt, Mycobacterium avium subsp. paratuberculosis
ggcgagauuggccucggcgcg

SEQ ID NO: 3014634 - RNA, 23 nt, Mycobacterium avium subsp. paratuberculosis
ggcgagcaaggcgagcacggcac

SEQ ID NO: 3014635 - RNA, 13 nt, Mycobacterium avium subsp. paratuberculosis
ggcgagcaauuaa

SEQ ID NO: 3014636 - RNA, 13 nt, Mycobacterium avium subsp. paratuberculosis
ggcgagcaccgug

SEQ ID NO: 3014637 - RNA, 21 nt, Mycobacterium avium subsp. paratuberculosis
ggcgagcaccgugccgucggc

SEQ ID NO: 3014638 - RNA, 14 nt, Mycobacterium avium subsp. paratuberculosis
ggcgagcacgccgc

SEQ ID NO: 3014639 - RNA, 16 nt, Mycobacterium avium subsp. paratuberculosis
ggcgagcacgccgccg

SEQ ID NO: 3014640 - RNA, 20 nt, Mycobacterium avium subsp. paratuberculosis
ggcgagcacggcacgcccgu

SEQ ID NO: 3014641 - RNA, 17 nt, Mycobacterium avium subsp. paratuberculosis
ggcgagcagcccggcga

SEQ ID NO: 3014642 - RNA, 14 nt, Mycobacterium avium subsp. paratuberculosis
ggcgagcagccgcg

SEQ ID NO: 3014643 - RNA, 21 nt, Mycobacterium avium subsp. paratuberculosis
ggcgagcagccgcgccgggcg

SEQ ID NO: 3014644 - RNA, 23 nt, Mycobacterium avium subsp. paratuberculosis
ggcgagcagccgcgccgggcgga

SEQ ID NO: 3014645 - RNA, 14 nt, Mycobacterium avium subsp. paratuberculosis
ggcgagcagcgcga

SEQ ID NO: 3014646 - RNA, 23 nt, Mycobacterium avium subsp. paratuberculosis
ggcgagcagcgcgaugccggcca

SEQ ID NO: 3014647 - RNA, 21 nt, Mycobacterium avium subsp. paratuberculosis
ggcgagccggcccggggugug

SEQ ID NO: 3014648 - RNA, 17 nt, Mycobacterium avium subsp. paratuberculosis
ggcgagccgggccgggu

SEQ ID NO: 3014649 - RNA, 22 nt, Mycobacterium avium subsp. paratuberculosis
ggcgagcgacgccacggggcug

SEQ ID NO: 3014650 - RNA, 22 nt, Mycobacterium avium subsp. paratuberculosis
ggcgagcgcgugcacgaacgcg

SEQ ID NO: 3014651 - RNA, 23 nt, Mycobacterium avium subsp. paratuberculosis
ggcgagcgcguucuccaccgcgc

SEQ ID NO: 3014652 - RNA, 14 nt, Mycobacterium avium subsp. paratuberculosis
ggcgagcggcccug

SEQ ID NO: 3014653 - RNA, 18 nt, Mycobacterium avium subsp. paratuberculosis
ggcgagcggcccugcgcg

SEQ ID NO: 3014654 - RNA, 23 nt, Mycobacterium avium subsp. paratuberculosis
ggcgagcgguucgaucucgucgg

SEQ ID NO: 3014655 - RNA, 15 nt, Mycobacterium avium subsp. paratuberculosis
ggcgagcgucgccgc

SEQ ID NO: 3014656 - RNA, 20 nt, Mycobacterium avium subsp. paratuberculosis
ggcgagcgucgccgcguggg

SEQ ID NO: 3014657 - RNA, 12 nt, Mycobacterium avium subsp. paratuberculosis
ggcgagcucgcg

SEQ ID NO: 3014658 - RNA, 14 nt, Mycobacterium avium subsp. paratuberculosis
ggcgagcucgcggc

SEQ ID NO: 3014659 - RNA, 20 nt, Mycobacterium avium subsp. paratuberculosis
ggcgagcucguucucggcga

SEQ ID NO: 3014660 - RNA, 15 nt, Mycobacterium avium subsp. paratuberculosis
ggcgagcugaccggc

SEQ ID NO: 3014661 - RNA, 17 nt, Mycobacterium avium subsp. paratuberculosis
ggcgagcugaccggcca

SEQ ID NO: 3014662 - RNA, 13 nt, Mycobacterium avium subsp. paratuberculosis
ggcgagcugcggg

SEQ ID NO: 3014663 - RNA, 16 nt, Mycobacterium avium subsp. paratuberculosis
ggcgagcugcgggugc

SEQ ID NO: 3014664 - RNA, 17 nt, Mycobacterium avium subsp. paratuberculosis
ggcgagcuggccgccca

SEQ ID NO: 3014665 - RNA, 18 nt, Mycobacterium avium subsp. paratuberculosis
ggcgagcuggccgcccac

SEQ ID NO: 3014666 - RNA, 19 nt, Mycobacterium avium subsp. paratuberculosis
ggcgagcuuggcgggcguc

SEQ ID NO: 3014667 - RNA, 19 nt, Mycobacterium avium subsp. paratuberculosis
ggcgagcuuggcgguguuc

SEQ ID NO: 3014668 - RNA, 18 nt, Mycobacterium avium subsp. paratuberculosis
ggcgaggaacccgaccgc

SEQ ID NO: 3014669 - RNA, 19 nt, Mycobacterium avium subsp. paratuberculosis
ggcgaggaacccgaccgcg

SEQ ID NO: 3014670 - RNA, 20 nt, Mycobacterium avium subsp. paratuberculosis
ggcgaggaacucagcgccca

SEQ ID NO: 3014671 - RNA, 19 nt, Mycobacterium avium subsp. paratuberculosis
ggcgaggaaguccggcgcg

SEQ ID NO: 3014672 - RNA, 22 nt, Mycobacterium avium subsp. paratuberculosis
ggcgaggaaguccggcgcgccc

SEQ ID NO: 3014673 - RNA, 20 nt, Mycobacterium avium subsp. paratuberculosis
ggcgaggauggcgaucauca

SEQ ID NO: 3014674 - RNA, 14 nt, Mycobacterium avium subsp. paratuberculosis
ggcgaggccaggcg

SEQ ID NO: 3014675 - RNA, 12 nt, Mycobacterium avium subsp. paratuberculosis
ggcgaggcgguc

SEQ ID NO: 3014676 - RNA, 14 nt, Mycobacterium avium subsp. paratuberculosis
ggcgaggcggucgg

SEQ ID NO: 3014677 - RNA, 18 nt, Mycobacterium avium subsp. paratuberculosis
ggcgaggcggucggcgga

SEQ ID NO: 3014678 - RNA, 18 nt, Mycobacterium avium subsp. paratuberculosis
ggcgagguaauggugggc

SEQ ID NO: 3014679 - RNA, 18 nt, Mycobacterium avium subsp. paratuberculosis
ggcgagguagaccgccga

SEQ ID NO: 3014680 - RNA, 20 nt, Mycobacterium avium subsp. paratuberculosis
ggcgagguagaccgccgagu

SEQ ID NO: 3014681 - RNA, 14 nt, Mycobacterium avium subsp. paratuberculosis
ggcgaggucgucga

SEQ ID NO: 3014682 - RNA, 16 nt, Mycobacterium avium subsp. paratuberculosis
ggcgaggucgucgagg

SEQ ID NO: 3014683 - RNA, 16 nt, Mycobacterium avium subsp. paratuberculosis
ggcgaguaaggccgag

SEQ ID NO: 3014684 - RNA, 20 nt, Mycobacterium avium subsp. paratuberculosis
ggcgaguaaggccgaggcga

SEQ ID NO: 3014685 - RNA, 16 nt, Mycobacterium avium subsp. paratuberculosis
ggcgaguacaccucga

SEQ ID NO: 3014686 - RNA, 15 nt, Mycobacterium avium subsp. paratuberculosis
ggcgaguacccgccg

SEQ ID NO: 3014687 - RNA, 16 nt, Mycobacterium avium subsp. paratuberculosis
ggcgaguacccgccgc

SEQ ID NO: 3014688 - RNA, 16 nt, Mycobacterium avium subsp. paratuberculosis
ggcgagucccggcgca

SEQ ID NO: 3014689 - RNA, 18 nt, Mycobacterium avium subsp. paratuberculosis
ggcgagucccggcgcacc

SEQ ID NO: 3014690 - RNA, 14 nt, Mycobacterium avium subsp. paratuberculosis
ggcgaguccgcgga

SEQ ID NO: 3014691 - RNA, 16 nt, Mycobacterium avium subsp. paratuberculosis
ggcgaguccggccagg

SEQ ID NO: 3014692 - RNA, 21 nt, Mycobacterium avium subsp. paratuberculosis
ggcgaguccggccaggucgcc

SEQ ID NO: 3014693 - RNA, 22 nt, Mycobacterium avium subsp. paratuberculosis
ggcgaguccggccaggucgccg

SEQ ID NO: 3014694 - RNA, 23 nt, Mycobacterium avium subsp. paratuberculosis
ggcgaguccggccaggucgccgc

SEQ ID NO: 3014695 - RNA, 21 nt, Mycobacterium avium subsp. paratuberculosis
ggcgagucgcggaucaugauc

SEQ ID NO: 3014696 - RNA, 23 nt, Mycobacterium avium subsp. paratuberculosis
ggcgagucguacuucgcccccgg

SEQ ID NO: 3014697 - RNA, 16 nt, Mycobacterium avium subsp. paratuberculosis
ggcgagugaggccgag

SEQ ID NO: 3014698 - RNA, 17 nt, Mycobacterium avium subsp. paratuberculosis
ggcgagugaggccgagg

SEQ ID NO: 3014699 - RNA, 21 nt, Mycobacterium avium subsp. paratuberculosis
ggcgagugcgaaacucaccgc

SEQ ID NO: 3014700 - RNA, 23 nt, Mycobacterium avium subsp. paratuberculosis
ggcgagugcgaaacucaccgcgu

SEQ ID NO: 3014701 - RNA, 23 nt, Mycobacterium avium subsp. paratuberculosis
ggcgaguggaagucagcgcguga

SEQ ID NO: 3014702 - RNA, 17 nt, Mycobacterium avium subsp. paratuberculosis
ggcgaguuaugccguca

SEQ ID NO: 3014703 - RNA, 14 nt, Mycobacterium avium subsp. paratuberculosis
ggcgaguucgccug

SEQ ID NO: 3014704 - RNA, 20 nt, Mycobacterium avium subsp. paratuberculosis
ggcgaguucggcggcccgcu

SEQ ID NO: 3014705 - RNA, 21 nt, Mycobacterium avium subsp. paratuberculosis
ggcgaguucugguaggcggcc

SEQ ID NO: 3014706 - RNA, 22 nt, Mycobacterium avium subsp. paratuberculosis
ggcgaguucugguaggcggccg

SEQ ID NO: 3014707 - RNA, 19 nt, Mycobacterium avium subsp. paratuberculosis
ggcgauaaccucggcggcg

SEQ ID NO: 3014708 - RNA, 15 nt, Mycobacterium avium subsp. paratuberculosis
ggcgauaggcggcca

SEQ ID NO: 3014709 - RNA, 15 nt, Mycobacterium avium subsp. paratuberculosis
ggcgaucaccccggc

SEQ ID NO: 3014710 - RNA, 16 nt, Mycobacterium avium subsp. paratuberculosis
ggcgaucaccccggcg

SEQ ID NO: 3014711 - RNA, 20 nt, Mycobacterium avium subsp. paratuberculosis
ggcgaucaccccggcgacgg

SEQ ID NO: 3014712 - RNA, 18 nt, Mycobacterium avium subsp. paratuberculosis
ggcgaucaccgccgcggc

SEQ ID NO: 3014713 - RNA, 13 nt, Mycobacterium avium subsp. paratuberculosis
ggcgaucaccgcg

SEQ ID NO: 3014714 - RNA, 17 nt, Mycobacterium avium subsp. paratuberculosis
ggcgaucaccgcggcca

SEQ ID NO: 3014715 - RNA, 23 nt, Mycobacterium avium subsp. paratuberculosis
ggcgaucaccgcggccaccuggg

SEQ ID NO: 3014716 - RNA, 16 nt, Mycobacterium avium subsp. paratuberculosis
ggcgaucaccgcggcg

SEQ ID NO: 3014717 - RNA, 21 nt, Mycobacterium avium subsp. paratuberculosis
ggcgaucaccgggacaccgcu

SEQ ID NO: 3014718 - RNA, 21 nt, Mycobacterium avium subsp. paratuberculosis
ggcgaucaccuugcggccggc

SEQ ID NO: 3014719 - RNA, 19 nt, Mycobacterium avium subsp. paratuberculosis
ggcgaucagaugcucgucg

SEQ ID NO: 3014720 - RNA, 18 nt, Mycobacterium avium subsp. paratuberculosis
ggcgaucagcccgcccac

SEQ ID NO: 3014721 - RNA, 22 nt, Mycobacterium avium subsp. paratuberculosis
ggcgaucagcccgcccaccacg

SEQ ID NO: 3014722 - RNA, 23 nt, Mycobacterium avium subsp. paratuberculosis
ggcgaucagcccgcccaccacga

SEQ ID NO: 3014723 - RNA, 15 nt, Mycobacterium avium subsp. paratuberculosis
ggcgaucagcccggc

SEQ ID NO: 3014724 - RNA, 16 nt, Mycobacterium avium subsp. paratuberculosis
ggcgaucagcccggcc

SEQ ID NO: 3014725 - RNA, 12 nt, Mycobacterium avium subsp. paratuberculosis
ggcgaucagcgc

SEQ ID NO: 3014726 - RNA, 20 nt, Mycobacterium avium subsp. paratuberculosis
ggcgaucagcgcgcacagcg

SEQ ID NO: 3014727 - RNA, 15 nt, Mycobacterium avium subsp. paratuberculosis
ggcgaucagcuccuc

SEQ ID NO: 3014728 - RNA, 23 nt, Mycobacterium avium subsp. paratuberculosis
ggcgaucagcuccuccugcggug

SEQ ID NO: 3014729 - RNA, 19 nt, Mycobacterium avium subsp. paratuberculosis
ggcgaucagcugcccggag

SEQ ID NO: 3014730 - RNA, 18 nt, Mycobacterium avium subsp. paratuberculosis
ggcgaucagggcggcgcc

SEQ ID NO: 3014731 - RNA, 19 nt, Mycobacterium avium subsp. paratuberculosis
ggcgaucagggcggcgccg

SEQ ID NO: 3014732 - RNA, 20 nt, Mycobacterium avium subsp. paratuberculosis
ggcgaucagggcggcgccgc

SEQ ID NO: 3014733 - RNA, 21 nt, Mycobacterium avium subsp. paratuberculosis
ggcgaucagggcggcgccgcg

SEQ ID NO: 3014734 - RNA, 20 nt, Mycobacterium avium subsp. paratuberculosis
ggcgaucagguggggcagga

SEQ ID NO: 3014735 - RNA, 13 nt, Mycobacterium avium subsp. paratuberculosis
ggcgaucauccag

SEQ ID NO: 3014736 - RNA, 23 nt, Mycobacterium avium subsp. paratuberculosis
ggcgaucauccaggugaacagca

SEQ ID NO: 3014737 - RNA, 13 nt, Mycobacterium avium subsp. paratuberculosis
ggcgaucaucgcc

SEQ ID NO: 3014738 - RNA, 18 nt, Mycobacterium avium subsp. paratuberculosis
ggcgaucaucgccccgga

SEQ ID NO: 3014739 - RNA, 19 nt, Mycobacterium avium subsp. paratuberculosis
ggcgaucaucgccccggag

SEQ ID NO: 3014740 - RNA, 16 nt, Mycobacterium avium subsp. paratuberculosis
ggcgaucaucgucguc

SEQ ID NO: 3014741 - RNA, 14 nt, Mycobacterium avium subsp. paratuberculosis
ggcgauccgcagga

SEQ ID NO: 3014742 - RNA, 17 nt, Mycobacterium avium subsp. paratuberculosis
ggcgauccgcaggccgu

SEQ ID NO: 3014743 - RNA, 21 nt, Mycobacterium avium subsp. paratuberculosis
ggcgauccgcaggccgucgcc

SEQ ID NO: 3014744 - RNA, 19 nt, Mycobacterium avium subsp. paratuberculosis
ggcgauccgcgcggcgacg

SEQ ID NO: 3014745 - RNA, 21 nt, Mycobacterium avium subsp. paratuberculosis
ggcgauccggccggcggcggu

SEQ ID NO: 3014746 - RNA, 17 nt, Mycobacterium avium subsp. paratuberculosis
ggcgauccgggcacgca

SEQ ID NO: 3014747 - RNA, 20 nt, Mycobacterium avium subsp. paratuberculosis
ggcgaucgacaccagcgugu

SEQ ID NO: 3014748 - RNA, 13 nt, Mycobacterium avium subsp. paratuberculosis
ggcgaucgauccc

SEQ ID NO: 3014749 - RNA, 23 nt, Mycobacterium avium subsp. paratuberculosis
ggcgaucgaugcccagcgcgcgg

SEQ ID NO: 3014750 - RNA, 14 nt, Mycobacterium avium subsp. paratuberculosis
ggcgaucgcgagca

SEQ ID NO: 3014751 - RNA, 13 nt, Mycobacterium avium subsp. paratuberculosis
ggcgaucgcgcgc

SEQ ID NO: 3014752 - RNA, 14 nt, Mycobacterium avium subsp. paratuberculosis
ggcgaucgcggcca

SEQ ID NO: 3014753 - RNA, 22 nt, Mycobacterium avium subsp. paratuberculosis
ggcgaucgcggccaccacgacg

SEQ ID NO: 3014754 - RNA, 14 nt, Mycobacterium avium subsp. paratuberculosis
ggcgaucggccgcu

SEQ ID NO: 3014755 - RNA, 16 nt, Mycobacterium avium subsp. paratuberculosis
ggcgaucggccgcugc

SEQ ID NO: 3014756 - RNA, 21 nt, Mycobacterium avium subsp. paratuberculosis
ggcgaucggccgcugcgggcg

SEQ ID NO: 3014757 - RNA, 16 nt, Mycobacterium avium subsp. paratuberculosis
ggcgaucggcgcggcg

SEQ ID NO: 3014758 - RNA, 14 nt, Mycobacterium avium subsp. paratuberculosis
ggcgaucggcgguc

SEQ ID NO: 3014759 - RNA, 17 nt, Mycobacterium avium subsp. paratuberculosis
ggcgaucggcgguccgc

SEQ ID NO: 3014760 - RNA, 14 nt, Mycobacterium avium subsp. paratuberculosis
ggcgaucggcgugc

SEQ ID NO: 3014761 - RNA, 22 nt, Mycobacterium avium subsp. paratuberculosis
ggcgaucggcgugccggacucc

SEQ ID NO: 3014762 - RNA, 18 nt, Mycobacterium avium subsp. paratuberculosis
ggcgaucgggucaccggc

SEQ ID NO: 3014763 - RNA, 19 nt, Mycobacterium avium subsp. paratuberculosis
ggcgaucgggucaccggcc

SEQ ID NO: 3014764 - RNA, 16 nt, Mycobacterium avium subsp. paratuberculosis
ggcgaucgucgccguc

SEQ ID NO: 3014765 - RNA, 12 nt, Mycobacterium avium subsp. paratuberculosis
ggcgaucuccag

SEQ ID NO: 3014766 - RNA, 21 nt, Mycobacterium avium subsp. paratuberculosis
ggcgaucucgauggccacgcu

SEQ ID NO: 3014767 - RNA, 20 nt, Mycobacterium avium subsp. paratuberculosis
ggcgaucucgauguagagcg

SEQ ID NO: 3014768 - RNA, 22 nt, Mycobacterium avium subsp. paratuberculosis
ggcgaucucgauguagagcggg

SEQ ID NO: 3014769 - RNA, 13 nt, Mycobacterium avium subsp. paratuberculosis
ggcgaucucgccg

SEQ ID NO: 3014770 - RNA, 22 nt, Mycobacterium avium subsp. paratuberculosis
ggcgaucucgccgaaggccggg

SEQ ID NO: 3014771 - RNA, 15 nt, Mycobacterium avium subsp. paratuberculosis
ggcgaucucggcggc

SEQ ID NO: 3014772 - RNA, 16 nt, Mycobacterium avium subsp. paratuberculosis
ggcgaucucggucacc

SEQ ID NO: 3014773 - RNA, 21 nt, Mycobacterium avium subsp. paratuberculosis
ggcgaucucggucaccgagcg

SEQ ID NO: 3014774 - RNA, 20 nt, Mycobacterium avium subsp. paratuberculosis
ggcgaucucgucccacggcg

SEQ ID NO: 3014775 - RNA, 14 nt, Mycobacterium avium subsp. paratuberculosis
ggcgaucucgucgc

SEQ ID NO: 3014776 - RNA, 17 nt, Mycobacterium avium subsp. paratuberculosis
ggcgaucucgucgcggu

SEQ ID NO: 3014777 - RNA, 17 nt, Mycobacterium avium subsp. paratuberculosis
ggcgaucugcuccucgg

SEQ ID NO: 3014778 - RNA, 15 nt, Mycobacterium avium subsp. paratuberculosis
ggcgaugaagccccg

SEQ ID NO: 3014779 - RNA, 16 nt, Mycobacterium avium subsp. paratuberculosis
ggcgaugaagccggcg

SEQ ID NO: 3014780 - RNA, 17 nt, Mycobacterium avium subsp. paratuberculosis
ggcgaugaagccggcga

SEQ ID NO: 3014781 - RNA, 20 nt, Mycobacterium avium subsp. paratuberculosis
ggcgaugaagccggcgaacu

SEQ ID NO: 3014782 - RNA, 16 nt, Mycobacterium avium subsp. paratuberculosis
ggcgaugaccagcgcg

SEQ ID NO: 3014783 - RNA, 17 nt, Mycobacterium avium subsp. paratuberculosis
ggcgaugaccagcgcga

SEQ ID NO: 3014784 - RNA, 16 nt, Mycobacterium avium subsp. paratuberculosis
ggcgaugaccgccugc

SEQ ID NO: 3014785 - RNA, 14 nt, Mycobacterium avium subsp. paratuberculosis
ggcgaugaccggac

SEQ ID NO: 3014786 - RNA, 15 nt, Mycobacterium avium subsp. paratuberculosis
ggcgaugaccgggac

SEQ ID NO: 3014787 - RNA, 21 nt, Mycobacterium avium subsp. paratuberculosis
ggcgaugacgucgucgcggcg

SEQ ID NO: 3014788 - RNA, 23 nt, Mycobacterium avium subsp. paratuberculosis
ggcgaugacgucgucgcggcgcu

SEQ ID NO: 3014789 - RNA, 13 nt, Mycobacterium avium subsp. paratuberculosis
ggcgaugaucagg

SEQ ID NO: 3014790 - RNA, 17 nt, Mycobacterium avium subsp. paratuberculosis
ggcgaugaucaggccgg

SEQ ID NO: 3014791 - RNA, 15 nt, Mycobacterium avium subsp. paratuberculosis
ggcgaugauccgcgg

SEQ ID NO: 3014792 - RNA, 17 nt, Mycobacterium avium subsp. paratuberculosis
ggcgaugauccgcggcg

SEQ ID NO: 3014793 - RNA, 22 nt, Mycobacterium avium subsp. paratuberculosis
ggcgaugauccgcggcgccggg

SEQ ID NO: 3014794 - RNA, 17 nt, Mycobacterium avium subsp. paratuberculosis
ggcgaugccagcgcacc

SEQ ID NO: 3014795 - RNA, 12 nt, Mycobacterium avium subsp. paratuberculosis
ggcgaugcccag

SEQ ID NO: 3014796 - RNA, 13 nt, Mycobacterium avium subsp. paratuberculosis
ggcgaugcccgug

SEQ ID NO: 3014797 - RNA, 13 nt, Mycobacterium avium subsp. paratuberculosis
ggcgaugccgaca

SEQ ID NO: 3014798 - RNA, 14 nt, Mycobacterium avium subsp. paratuberculosis
ggcgaugccgacac

SEQ ID NO: 3014799 - RNA, 13 nt, Mycobacterium avium subsp. paratuberculosis
ggcgaugccgccg

SEQ ID NO: 3014800 - RNA, 17 nt, Mycobacterium avium subsp. paratuberculosis
ggcgaugccgccgacga

SEQ ID NO: 3014801 - RNA, 17 nt, Mycobacterium avium subsp. paratuberculosis
ggcgaugccggacucug

SEQ ID NO: 3014802 - RNA, 14 nt, Mycobacterium avium subsp. paratuberculosis
ggcgaugccgugcu

SEQ ID NO: 3014803 - RNA, 20 nt, Mycobacterium avium subsp. paratuberculosis
ggcgaugccgugcugggcgg

SEQ ID NO: 3014804 - RNA, 19 nt, Mycobacterium avium subsp. paratuberculosis
ggcgaugccuuccucggcg

SEQ ID NO: 3014805 - RNA, 20 nt, Mycobacterium avium subsp. paratuberculosis
ggcgaugccuuccucggcgc

SEQ ID NO: 3014806 - RNA, 22 nt, Mycobacterium avium subsp. paratuberculosis
ggcgaugccuuccucggcgcuc

SEQ ID NO: 3014807 - RNA, 15 nt, Mycobacterium avium subsp. paratuberculosis
ggcgaugcgcacguc

SEQ ID NO: 3014808 - RNA, 23 nt, Mycobacterium avium subsp. paratuberculosis
ggcgaugcgcacgucggccgcca

SEQ ID NO: 3014809 - RNA, 14 nt, Mycobacterium avium subsp. paratuberculosis
ggcgaugcgccguc

SEQ ID NO: 3014810 - RNA, 15 nt, Mycobacterium avium subsp. paratuberculosis
ggcgaugcgcggccc

SEQ ID NO: 3014811 - RNA, 20 nt, Mycobacterium avium subsp. paratuberculosis
ggcgaugcgcggcccguuga

SEQ ID NO: 3014812 - RNA, 17 nt, Mycobacterium avium subsp. paratuberculosis
ggcgaugcgcuccagca

SEQ ID NO: 3014813 - RNA, 20 nt, Mycobacterium avium subsp. paratuberculosis
ggcgaugcgcuccagcaggc

SEQ ID NO: 3014814 - RNA, 15 nt, Mycobacterium avium subsp. paratuberculosis
ggcgaugcggcccgg

SEQ ID NO: 3014815 - RNA, 13 nt, Mycobacterium avium subsp. paratuberculosis
ggcgaugcggguc

SEQ ID NO: 3014816 - RNA, 18 nt, Mycobacterium avium subsp. paratuberculosis
ggcgaugcgggucacggu

SEQ ID NO: 3014817 - RNA, 18 nt, Mycobacterium avium subsp. paratuberculosis
ggcgauggccauggccag

SEQ ID NO: 3014818 - RNA, 20 nt, Mycobacterium avium subsp. paratuberculosis
ggcgauggccauggccagga

SEQ ID NO: 3014819 - RNA, 15 nt, Mycobacterium avium subsp. paratuberculosis
ggcgauggcccgcug

SEQ ID NO: 3014820 - RNA, 20 nt, Mycobacterium avium subsp. paratuberculosis
ggcgauggcccgcugcgccg

SEQ ID NO: 3014821 - RNA, 21 nt, Mycobacterium avium subsp. paratuberculosis
ggcgauggcccgcugcgccga

SEQ ID NO: 3014822 - RNA, 23 nt, Mycobacterium avium subsp. paratuberculosis
ggcgauggcccgcugcgccgacu

SEQ ID NO: 3014823 - RNA, 24 nt, Mycobacterium avium subsp. paratuberculosis
ggcgauggccgacaacauccgcga

SEQ ID NO: 3014824 - RNA, 18 nt, Mycobacterium avium subsp. paratuberculosis
ggcgauggccugcucgcg

SEQ ID NO: 3014825 - RNA, 15 nt, Mycobacterium avium subsp. paratuberculosis
ggcgauggcgcggcc

SEQ ID NO: 3014826 - RNA, 18 nt, Mycobacterium avium subsp. paratuberculosis
ggcgauggcgcggccggc

SEQ ID NO: 3014827 - RNA, 15 nt, Mycobacterium avium subsp. paratuberculosis
ggcgauggcggcguc

SEQ ID NO: 3014828 - RNA, 17 nt, Mycobacterium avium subsp. paratuberculosis
ggcgauggcggcgucga

SEQ ID NO: 3014829 - RNA, 19 nt, Mycobacterium avium subsp. paratuberculosis
ggcgauggcgucggccagc

SEQ ID NO: 3014830 - RNA, 22 nt, Mycobacterium avium subsp. paratuberculosis
ggcgauggcgucggccagcggc

SEQ ID NO: 3014831 - RNA, 21 nt, Mycobacterium avium subsp. paratuberculosis
ggcgaugggcaauaccggcag

SEQ ID NO: 3014832 - RNA, 22 nt, Mycobacterium avium subsp. paratuberculosis
ggcgauggugaugugcggcgcg

SEQ ID NO: 3014833 - RNA, 18 nt, Mycobacterium avium subsp. paratuberculosis
ggcgauggugccgaagcg

SEQ ID NO: 3014834 - RNA, 19 nt, Mycobacterium avium subsp. paratuberculosis
ggcgauggugccgaagcgc

SEQ ID NO: 3014835 - RNA, 22 nt, Mycobacterium avium subsp. paratuberculosis
ggcgauggugccgaagcgccgc

SEQ ID NO: 3014836 - RNA, 16 nt, Mycobacterium avium subsp. paratuberculosis
ggcgauggugccgccg

SEQ ID NO: 3014837 - RNA, 17 nt, Mycobacterium avium subsp. paratuberculosis
ggcgauggugccgccgg

SEQ ID NO: 3014838 - RNA, 17 nt, Mycobacterium avium subsp. paratuberculosis
ggcgaugguggcgcugc

SEQ ID NO: 3014839 - RNA, 23 nt, Mycobacterium avium subsp. paratuberculosis
ggcgaugguggcgcugccgagca

SEQ ID NO: 3014840 - RNA, 17 nt, Mycobacterium avium subsp. paratuberculosis
ggcgauggugggcagcc

SEQ ID NO: 3014841 - RNA, 21 nt, Mycobacterium avium subsp. paratuberculosis
ggcgauggugggcagccggca

SEQ ID NO: 3014842 - RNA, 20 nt, Mycobacterium avium subsp. paratuberculosis
ggcgaugucgggcaccugcu

SEQ ID NO: 3014843 - RNA, 13 nt, Mycobacterium avium subsp. paratuberculosis
ggcgaugucgucg

SEQ ID NO: 3014844 - RNA, 17 nt, Mycobacterium avium subsp. paratuberculosis
ggcgaugugaucgcggc

SEQ ID NO: 3014845 - RNA, 18 nt, Mycobacterium avium subsp. paratuberculosis
ggccggacagaucgccca

SEQ ID NO: 3014846 - RNA, 17 nt, Mycobacterium avium subsp. paratuberculosis
ggccggaccacccaggu

SEQ ID NO: 3014847 - RNA, 16 nt, Mycobacterium avium subsp. paratuberculosis
ggccggaccguucggu

SEQ ID NO: 3014848 - RNA, 12 nt, Mycobacterium avium subsp. paratuberculosis
ggccggacgggu

SEQ ID NO: 3014849 - RNA, 20 nt, Mycobacterium avium subsp. paratuberculosis
ggccggacgggucgaccgcc

SEQ ID NO: 3014850 - RNA, 13 nt, Mycobacterium avium subsp. paratuberculosis
ggccggacgguga

SEQ ID NO: 3014851 - RNA, 23 nt, Mycobacterium avium subsp. paratuberculosis
ggccggagaccgccguggcguua

SEQ ID NO: 3014852 - RNA, 17 nt, Mycobacterium avium subsp. paratuberculosis
ggccggagccgaccucg

SEQ ID NO: 3014853 - RNA, 20 nt, Mycobacterium avium subsp. paratuberculosis
ggccggagccuucuucgccg

SEQ ID NO: 3014854 - RNA, 21 nt, Mycobacterium avium subsp. paratuberculosis
ggccggagccuucuucgccgc

SEQ ID NO: 3014855 - RNA, 21 nt, Mycobacterium avium subsp. paratuberculosis
ggccggagccuucuugaccgc

SEQ ID NO: 3014856 - RNA, 15 nt, Mycobacterium avium subsp. paratuberculosis
ggccggagcggaugg

SEQ ID NO: 3014857 - RNA, 15 nt, Mycobacterium avium subsp. paratuberculosis
ggccggagcggugcg

SEQ ID NO: 3014858 - RNA, 13 nt, Mycobacterium avium subsp. paratuberculosis
ggccggaggugcg

SEQ ID NO: 3014859 - RNA, 17 nt, Mycobacterium avium subsp. paratuberculosis
ggccggaggugcggguc

SEQ ID NO: 3014860 - RNA, 13 nt, Mycobacterium avium subsp. paratuberculosis
ggccggaucagca

SEQ ID NO: 3014861 - RNA, 22 nt, Mycobacterium avium subsp. paratuberculosis
ggccggaucagcagugccccgu

SEQ ID NO: 3014862 - RNA, 14 nt, Mycobacterium avium subsp. paratuberculosis
ggccggaucccggu

SEQ ID NO: 3014863 - RNA, 20 nt, Mycobacterium avium subsp. paratuberculosis
ggccggcgagcucgcggccg

SEQ ID NO: 3014864 - RNA, 22 nt, Mycobacterium avium subsp. paratuberculosis
ggccggcgagcucgcggccgua

SEQ ID NO: 3014865 - RNA, 12 nt, Mycobacterium avium subsp. paratuberculosis
ggccggcgaggu

SEQ ID NO: 3014866 - RNA, 12 nt, Mycobacterium avium subsp. paratuberculosis
ggccggcgaugc

SEQ ID NO: 3014867 - RNA, 14 nt, Mycobacterium avium subsp. paratuberculosis
ggccggcgaugccc

SEQ ID NO: 3014868 - RNA, 14 nt, Mycobacterium avium subsp. paratuberculosis
ggccggcgauggcg

SEQ ID NO: 3014869 - RNA, 19 nt, Mycobacterium avium subsp. paratuberculosis
ggccggcgauggcgcggcc

SEQ ID NO: 3014870 - RNA, 13 nt, Mycobacterium avium subsp. paratuberculosis
ggccggcgcagcc

SEQ ID NO: 3014871 - RNA, 18 nt, Mycobacterium avium subsp. paratuberculosis
ggccggcgcagccggcca

SEQ ID NO: 3014872 - RNA, 21 nt, Mycobacterium avium subsp. paratuberculosis
ggccggcgcccgucacgcugg

SEQ ID NO: 3014873 - RNA, 15 nt, Mycobacterium avium subsp. paratuberculosis
ggccggcgccgaccg

SEQ ID NO: 3014874 - RNA, 14 nt, Mycobacterium avium subsp. paratuberculosis
ggccggcgccgacg

SEQ ID NO: 3014875 - RNA, 13 nt, Mycobacterium avium subsp. paratuberculosis
ggccggcgccgcc

SEQ ID NO: 3014876 - RNA, 14 nt, Mycobacterium avium subsp. paratuberculosis
ggccggcgccgccg

SEQ ID NO: 3014877 - RNA, 15 nt, Mycobacterium avium subsp. paratuberculosis
ggccggcgccgccgg

SEQ ID NO: 3014878 - RNA, 14 nt, Mycobacterium avium subsp. paratuberculosis
ggccggcgccgcgg

SEQ ID NO: 3014879 - RNA, 12 nt, Mycobacterium avium subsp. paratuberculosis
ggccggcgccgg

SEQ ID NO: 3014880 - RNA, 13 nt, Mycobacterium avium subsp. paratuberculosis
ggccggcgccggc

SEQ ID NO: 3014881 - RNA, 21 nt, Mycobacterium avium subsp. paratuberculosis
ggccggcgccggcggucagcu

SEQ ID NO: 3014882 - RNA, 16 nt, Mycobacterium avium subsp. paratuberculosis
ggccggcgcgaccagc

SEQ ID NO: 3014883 - RNA, 20 nt, Mycobacterium avium subsp. paratuberculosis
ggccggcgcgaccagcggca

SEQ ID NO: 3014884 - RNA, 23 nt, Mycobacterium avium subsp. paratuberculosis
ggccggcgcgaccagcggcagca

SEQ ID NO: 3014885 - RNA, 14 nt, Mycobacterium avium subsp. paratuberculosis
ggccggcgcggcgg

SEQ ID NO: 3014886 - RNA, 14 nt, Mycobacterium avium subsp. paratuberculosis
ggccggcgcggugc

SEQ ID NO: 3014887 - RNA, 22 nt, Mycobacterium avium subsp. paratuberculosis
ggccggcgcggugcucggcgcg

SEQ ID NO: 3014888 - RNA, 13 nt, Mycobacterium avium subsp. paratuberculosis
ggccggcgcuggc

SEQ ID NO: 3014889 - RNA, 15 nt, Mycobacterium avium subsp. paratuberculosis
ggccggcgcuggcgu

SEQ ID NO: 3014890 - RNA, 18 nt, Mycobacterium avium subsp. paratuberculosis
ggccggcggacgcggcca

SEQ ID NO: 3014891 - RNA, 21 nt, Mycobacterium avium subsp. paratuberculosis
ggccggcggacgcggccagcg

SEQ ID NO: 3014892 - RNA, 22 nt, Mycobacterium avium subsp. paratuberculosis
ggccggcggacgcggccagcgc

SEQ ID NO: 3014893 - RNA, 15 nt, Mycobacterium avium subsp. paratuberculosis
ggccggcggcagugc

SEQ ID NO: 3014894 - RNA, 14 nt, Mycobacterium avium subsp. paratuberculosis
ggccggcggcggcc

SEQ ID NO: 3014895 - RNA, 18 nt, Mycobacterium avium subsp. paratuberculosis
ggccggcggcggccagcg

SEQ ID NO: 3014896 - RNA, 13 nt, Mycobacterium avium subsp. paratuberculosis
ggccggcggcggu

SEQ ID NO: 3014897 - RNA, 14 nt, Mycobacterium avium subsp. paratuberculosis
ggccggcggcgucg

SEQ ID NO: 3014898 - RNA, 22 nt, Mycobacterium avium subsp. paratuberculosis
ggccggcggcgucgugaccgac

SEQ ID NO: 3014899 - RNA, 18 nt, Mycobacterium avium subsp. paratuberculosis
ggccggcgggcagcacgg

SEQ ID NO: 3014900 - RNA, 13 nt, Mycobacterium avium subsp. paratuberculosis
ggccggcggggcg

SEQ ID NO: 3014901 - RNA, 13 nt, Mycobacterium avium subsp. paratuberculosis
ggccggcgggggc

SEQ ID NO: 3014902 - RNA, 22 nt, Mycobacterium avium subsp. paratuberculosis
ggccggcgggggcgcguccgcg

SEQ ID NO: 3014903 - RNA, 13 nt, Mycobacterium avium subsp. paratuberculosis
ggccggcggguuc

SEQ ID NO: 3014904 - RNA, 20 nt, Mycobacterium avium subsp. paratuberculosis
ggccggcggguuggucccga

SEQ ID NO: 3014905 - RNA, 14 nt, Mycobacterium avium subsp. paratuberculosis
ggccggcggucagg

SEQ ID NO: 3014906 - RNA, 18 nt, Mycobacterium avium subsp. paratuberculosis
ggccggcggucaggccgu

SEQ ID NO: 3014907 - RNA, 17 nt, Mycobacterium avium subsp. paratuberculosis
ggccggcggugauccgc

SEQ ID NO: 3014908 - RNA, 18 nt, Mycobacterium avium subsp. paratuberculosis
ggccggcggugauccgcc

SEQ ID NO: 3014909 - RNA, 20 nt, Mycobacterium avium subsp. paratuberculosis
ggccggcgguggugccgccg

SEQ ID NO: 3014910 - RNA, 12 nt, Mycobacterium avium subsp. paratuberculosis
ggccggcggugu

SEQ ID NO: 3014911 - RNA, 15 nt, Mycobacterium avium subsp. paratuberculosis
ggccggcggugucgu

SEQ ID NO: 3014912 - RNA, 19 nt, Mycobacterium avium subsp. paratuberculosis
ggccggcggugucguaguu

SEQ ID NO: 3014913 - RNA, 20 nt, Mycobacterium avium subsp. paratuberculosis
ggccggcgucacucuggcgu

SEQ ID NO: 3014914 - RNA, 15 nt, Mycobacterium avium subsp. paratuberculosis
ggccggcgucgucga

SEQ ID NO: 3014915 - RNA, 17 nt, Mycobacterium avium subsp. paratuberculosis
ggccggcgucgucgagc

SEQ ID NO: 3014916 - RNA, 15 nt, Mycobacterium avium subsp. paratuberculosis
ggccggcgugcuggg

SEQ ID NO: 3014917 - RNA, 18 nt, Mycobacterium avium subsp. paratuberculosis
ggccggcgugcugggcca

SEQ ID NO: 3014918 - RNA, 20 nt, Mycobacterium avium subsp. paratuberculosis
ggccggcgugcugggccacg

SEQ ID NO: 3014919 - RNA, 17 nt, Mycobacterium avium subsp. paratuberculosis
ggccggcgugggaacca

SEQ ID NO: 3014920 - RNA, 15 nt, Mycobacterium avium subsp. paratuberculosis
ggccggcuaccgcgc

SEQ ID NO: 3014921 - RNA, 19 nt, Mycobacterium avium subsp. paratuberculosis
ggccggcugcagccgggcg

SEQ ID NO: 3014922 - RNA, 21 nt, Mycobacterium avium subsp. paratuberculosis
ggccggcugcagccgggcggc

SEQ ID NO: 3014923 - RNA, 22 nt, Mycobacterium avium subsp. paratuberculosis
ggccggcugcagccgggcggcg

SEQ ID NO: 3014924 - RNA, 18 nt, Mycobacterium avium subsp. paratuberculosis
ggccggcuucggccaagg

SEQ ID NO: 3014925 - RNA, 14 nt, Mycobacterium avium subsp. paratuberculosis
ggccggcuucucgg

SEQ ID NO: 3014926 - RNA, 16 nt, Mycobacterium avium subsp. paratuberculosis
ggccggcuucucggcg

SEQ ID NO: 3014927 - RNA, 19 nt, Mycobacterium avium subsp. paratuberculosis
ggccggcuucucggcgugc

SEQ ID NO: 3014928 - RNA, 20 nt, Mycobacterium avium subsp. paratuberculosis
ggccgggaaacccucgacgc

SEQ ID NO: 3014929 - RNA, 20 nt, Mycobacterium avium subsp. paratuberculosis
ggccgggaaguuggccuccc

SEQ ID NO: 3014930 - RNA, 21 nt, Mycobacterium avium subsp. paratuberculosis
ggccgggaaugucgcgcagca

SEQ ID NO: 3014931 - RNA, 13 nt, Mycobacterium avium subsp. paratuberculosis
ggccgggacgcgg

SEQ ID NO: 3014932 - RNA, 20 nt, Mycobacterium avium subsp. paratuberculosis
ggccgggagauacggucgca

SEQ ID NO: 3014933 - RNA, 21 nt, Mycobacterium avium subsp. paratuberculosis
ggccgggauagagcaccgcgc

SEQ ID NO: 3014934 - RNA, 22 nt, Mycobacterium avium subsp. paratuberculosis
ggccgggauagagcaccgcgcu

SEQ ID NO: 3014935 - RNA, 20 nt, Mycobacterium avium subsp. paratuberculosis
ggccgggaucuggccgguga

SEQ ID NO: 3014936 - RNA, 18 nt, Mycobacterium avium subsp. paratuberculosis
ggccgggaugccgccggu

SEQ ID NO: 3014937 - RNA, 17 nt, Mycobacterium avium subsp. paratuberculosis
ggccgggauuucccggg

SEQ ID NO: 3014938 - RNA, 15 nt, Mycobacterium avium subsp. paratuberculosis
ggccgggcaccgcgc

SEQ ID NO: 3014939 - RNA, 14 nt, Mycobacterium avium subsp. paratuberculosis
ggccgggcacgucg

SEQ ID NO: 3014940 - RNA, 16 nt, Mycobacterium avium subsp. paratuberculosis
ggccgggcacgucgac

SEQ ID NO: 3014941 - RNA, 19 nt, Mycobacterium avium subsp. paratuberculosis
ggccgggcagugcgcggcg

SEQ ID NO: 3014942 - RNA, 17 nt, Mycobacterium avium subsp. paratuberculosis
ggccgggcccucggacg

SEQ ID NO: 3014943 - RNA, 11 nt, Mycobacterium avium subsp. paratuberculosis
ggccgggccgg

SEQ ID NO: 3014944 - RNA, 17 nt, Mycobacterium avium subsp. paratuberculosis
ggccgggccggcgguga

SEQ ID NO: 3014945 - RNA, 14 nt, Mycobacterium avium subsp. paratuberculosis
ggccgggcgcuggc

SEQ ID NO: 3014946 - RNA, 16 nt, Mycobacterium avium subsp. paratuberculosis
ggccgggcgcuggccg

SEQ ID NO: 3014947 - RNA, 17 nt, Mycobacterium avium subsp. paratuberculosis
ggccgggcgcuggccgu

SEQ ID NO: 3014948 - RNA, 20 nt, Mycobacterium avium subsp. paratuberculosis
ggccgguugccuuuccgcgc

SEQ ID NO: 3014949 - RNA, 21 nt, Mycobacterium avium subsp. paratuberculosis
ggccgguugccuuuccgcgcg

SEQ ID NO: 3014950 - RNA, 22 nt, Mycobacterium avium subsp. paratuberculosis
ggccgguugccuuuccgcgcgg

SEQ ID NO: 3014951 - RNA, 20 nt, Mycobacterium avium subsp. paratuberculosis
ggccgguuggugcgccguca

SEQ ID NO: 3014952 - RNA, 17 nt, Mycobacterium avium subsp. paratuberculosis
ggccgguuguugcgguc

SEQ ID NO: 3014953 - RNA, 14 nt, Mycobacterium avium subsp. paratuberculosis
ggccguaaccgccg

SEQ ID NO: 3014954 - RNA, 16 nt, Mycobacterium avium subsp. paratuberculosis
ggccguagccggaccg

SEQ ID NO: 3014955 - RNA, 14 nt, Mycobacterium avium subsp. paratuberculosis
ggccguagcgagcg

SEQ ID NO: 3014956 - RNA, 21 nt, Mycobacterium avium subsp. paratuberculosis
ggccguagcgagcgcuggccu

SEQ ID NO: 3014957 - RNA, 23 nt, Mycobacterium avium subsp. paratuberculosis
ggccguagcgagcgcuggccuug

SEQ ID NO: 3014958 - RNA, 20 nt, Mycobacterium avium subsp. paratuberculosis
ggccguagcggacgacggcc

SEQ ID NO: 3014959 - RNA, 23 nt, Mycobacterium avium subsp. paratuberculosis
ggccguagcggacgacggccagc

SEQ ID NO: 3014960 - RNA, 13 nt, Mycobacterium avium subsp. paratuberculosis
ggccguagcggcu

SEQ ID NO: 3014961 - RNA, 15 nt, Mycobacterium avium subsp. paratuberculosis
ggccguagcggcucg

SEQ ID NO: 3014962 - RNA, 16 nt, Mycobacterium avium subsp. paratuberculosis
ggccguagcggcucgc

SEQ ID NO: 3014963 - RNA, 19 nt, Mycobacterium avium subsp. paratuberculosis
ggccguagcggcucgccac

SEQ ID NO: 3014964 - RNA, 18 nt, Mycobacterium avium subsp. paratuberculosis
ggccguagcguugccggc

SEQ ID NO: 3014965 - RNA, 19 nt, Mycobacterium avium subsp. paratuberculosis
ggccguagcguugccggcc

SEQ ID NO: 3014966 - RNA, 20 nt, Mycobacterium avium subsp. paratuberculosis
ggccguagcguugccggccg

SEQ ID NO: 3014967 - RNA, 15 nt, Mycobacterium avium subsp. paratuberculosis
ggccguaggucgggu

SEQ ID NO: 3014968 - RNA, 17 nt, Mycobacterium avium subsp. paratuberculosis
ggccguaggucgggucg

SEQ ID NO: 3014969 - RNA, 12 nt, Mycobacterium avium subsp. paratuberculosis
ggccguauacgc

SEQ ID NO: 3014970 - RNA, 15 nt, Mycobacterium avium subsp. paratuberculosis
ggccguaucggcccc

SEQ ID NO: 3014971 - RNA, 20 nt, Mycobacterium avium subsp. paratuberculosis
ggccguaucggccccggccg

SEQ ID NO: 3014972 - RNA, 20 nt, Mycobacterium avium subsp. paratuberculosis
ggccgucacaggccgccugc

SEQ ID NO: 3014973 - RNA, 17 nt, Mycobacterium avium subsp. paratuberculosis
ggccgucacgcuggcgu

SEQ ID NO: 3014974 - RNA, 19 nt, Mycobacterium avium subsp. paratuberculosis
ggccgucacgcuggcguga

SEQ ID NO: 3014975 - RNA, 22 nt, Mycobacterium avium subsp. paratuberculosis
ggccgucaggagugcucggcgu

SEQ ID NO: 3014976 - RNA, 23 nt, Mycobacterium avium subsp. paratuberculosis
ggccgucaggagugcucggcguu

SEQ ID NO: 3014977 - RNA, 15 nt, Mycobacterium avium subsp. paratuberculosis
ggccgucaucgccga

SEQ ID NO: 3014978 - RNA, 21 nt, Mycobacterium avium subsp. paratuberculosis
ggccgucaucgccgacgguga

SEQ ID NO: 3014979 - RNA, 23 nt, Mycobacterium avium subsp. paratuberculosis
ggccgucaucgccgacggugagc

SEQ ID NO: 3014980 - RNA, 22 nt, Mycobacterium avium subsp. paratuberculosis
ggccgucaucuccgacucgaug

SEQ ID NO: 3014981 - RNA, 18 nt, Mycobacterium avium subsp. paratuberculosis
ggccguccaccagaucgc

SEQ ID NO: 3014982 - RNA, 19 nt, Mycobacterium avium subsp. paratuberculosis
ggccguccaccagaucgcc

SEQ ID NO: 3014983 - RNA, 13 nt, Mycobacterium avium subsp. paratuberculosis
ggccguccacggc

SEQ ID NO: 3014984 - RNA, 13 nt, Mycobacterium avium subsp. paratuberculosis
ggccguccagcag

SEQ ID NO: 3014985 - RNA, 15 nt, Mycobacterium avium subsp. paratuberculosis
ggccguccagcagca

SEQ ID NO: 3014986 - RNA, 22 nt, Mycobacterium avium subsp. paratuberculosis
ggccguccagcgucuggcagcc

SEQ ID NO: 3014987 - RNA, 13 nt, Mycobacterium avium subsp. paratuberculosis
ggccguccgccgg

SEQ ID NO: 3014988 - RNA, 15 nt, Mycobacterium avium subsp. paratuberculosis
ggccguccgccggcu

SEQ ID NO: 3014989 - RNA, 20 nt, Mycobacterium avium subsp. paratuberculosis
ggccguccggauagccgucg

SEQ ID NO: 3014990 - RNA, 22 nt, Mycobacterium avium subsp. paratuberculosis
ggccguccgggauaguucgccg

SEQ ID NO: 3014991 - RNA, 23 nt, Mycobacterium avium subsp. paratuberculosis
ggccguccgggauaguucgccgc

SEQ ID NO: 3014992 - RNA, 14 nt, Mycobacterium avium subsp. paratuberculosis
ggccguccgggugc

SEQ ID NO: 3014993 - RNA, 20 nt, Mycobacterium avium subsp. paratuberculosis
ggccgucgaacugcagccgg

SEQ ID NO: 3014994 - RNA, 23 nt, Mycobacterium avium subsp. paratuberculosis
ggccgucgaacugcagccggcca

SEQ ID NO: 3014995 - RNA, 13 nt, Mycobacterium avium subsp. paratuberculosis
ggccgucgaggcg

SEQ ID NO: 3014996 - RNA, 17 nt, Mycobacterium avium subsp. paratuberculosis
ggccgucgaggcgcugc

SEQ ID NO: 3014997 - RNA, 18 nt, Mycobacterium avium subsp. paratuberculosis
ggccgucgaggcgcugca

SEQ ID NO: 3014998 - RNA, 21 nt, Mycobacterium avium subsp. paratuberculosis
ggccgucgaggcgcugcagca

SEQ ID NO: 3014999 - RNA, 12 nt, Mycobacterium avium subsp. paratuberculosis
ggccgucgcccg

SEQ ID NO: 3015000 - RNA, 13 nt, Mycobacterium avium subsp. paratuberculosis
ggccgucgccgaa

SEQ ID NO: 3015001 - RNA, 23 nt, Mycobacterium avium subsp. paratuberculosis
ggccgucgccggucuccaugucg

SEQ ID NO: 3015002 - RNA, 12 nt, Mycobacterium avium subsp. paratuberculosis
ggccgucgcgca

SEQ ID NO: 3015003 - RNA, 14 nt, Mycobacterium avium subsp. paratuberculosis
ggccgucgcgcacc

SEQ ID NO: 3015004 - RNA, 15 nt, Mycobacterium avium subsp. paratuberculosis
ggccgucgcggcgcg

SEQ ID NO: 3015005 - RNA, 21 nt, Mycobacterium avium subsp. paratuberculosis
ggccgucgcggcgcgggucgc

SEQ ID NO: 3015006 - RNA, 14 nt, Mycobacterium avium subsp. paratuberculosis
ggccgucgcguucg

SEQ ID NO: 3015007 - RNA, 14 nt, Mycobacterium avium subsp. paratuberculosis
ggccgucggccugc

SEQ ID NO: 3015008 - RNA, 18 nt, Mycobacterium avium subsp. paratuberculosis
ggccgucggccugcgcug

SEQ ID NO: 3015009 - RNA, 23 nt, Mycobacterium avium subsp. paratuberculosis
ggccgucggccugcgcugcggcc

SEQ ID NO: 3015010 - RNA, 20 nt, Mycobacterium avium subsp. paratuberculosis
ggccgucggcgccgccgagc

SEQ ID NO: 3015011 - RNA, 24 nt, Mycobacterium avium subsp. paratuberculosis
ggccgucggcgccgccgagccgcg

SEQ ID NO: 3015012 - RNA, 16 nt, Mycobacterium avium subsp. paratuberculosis
ggccgucggcgcggcc

SEQ ID NO: 3015013 - RNA, 18 nt, Mycobacterium avium subsp. paratuberculosis
ggccgucggcgcggccgg

SEQ ID NO: 3015014 - RNA, 19 nt, Mycobacterium avium subsp. paratuberculosis
ggccgucggcgcggccgga

SEQ ID NO: 3015015 - RNA, 21 nt, Mycobacterium avium subsp. paratuberculosis
ggccgucggcgcggccggauc

SEQ ID NO: 3015016 - RNA, 23 nt, Mycobacterium avium subsp. paratuberculosis
ggccagcgucuccggcgggcugg

SEQ ID NO: 3015017 - RNA, 18 nt, Mycobacterium avium subsp. paratuberculosis
ggccagcgugaacaccgc

SEQ ID NO: 3015018 - RNA, 20 nt, Mycobacterium avium subsp. paratuberculosis
ggccagcgugaacaccgcgu

SEQ ID NO: 3015019 - RNA, 15 nt, Mycobacterium avium subsp. paratuberculosis
ggccagcguggcgcg

SEQ ID NO: 3015020 - RNA, 17 nt, Mycobacterium avium subsp. paratuberculosis
ggccagcguggcgcgcc

SEQ ID NO: 3015021 - RNA, 17 nt, Mycobacterium avium subsp. paratuberculosis
ggccagcguuuccagcg

SEQ ID NO: 3015022 - RNA, 18 nt, Mycobacterium avium subsp. paratuberculosis
ggccagcguuuccagcgc

SEQ ID NO: 3015023 - RNA, 19 nt, Mycobacterium avium subsp. paratuberculosis
ggccagcguuuccagcgcc

SEQ ID NO: 3015024 - RNA, 23 nt, Mycobacterium avium subsp. paratuberculosis
ggccagcguuuccagcgccggca

SEQ ID NO: 3015025 - RNA, 13 nt, Mycobacterium avium subsp. paratuberculosis
ggccagcucaccg

SEQ ID NO: 3015026 - RNA, 12 nt, Mycobacterium avium subsp. paratuberculosis
ggccagcucccg

SEQ ID NO: 3015027 - RNA, 14 nt, Mycobacterium avium subsp. paratuberculosis
ggccagcucccggg

SEQ ID NO: 3015028 - RNA, 15 nt, Mycobacterium avium subsp. paratuberculosis
ggccagcuccgccac

SEQ ID NO: 3015029 - RNA, 16 nt, Mycobacterium avium subsp. paratuberculosis
ggccagcuccgccacc

SEQ ID NO: 3015030 - RNA, 20 nt, Mycobacterium avium subsp. paratuberculosis
ggccagcuccgccacccugc

SEQ ID NO: 3015031 - RNA, 21 nt, Mycobacterium avium subsp. paratuberculosis
ggccagcuccgggucgaccgc

SEQ ID NO: 3015032 - RNA, 23 nt, Mycobacterium avium subsp. paratuberculosis
ggccagcuccgggucgaccgccu

SEQ ID NO: 3015033 - RNA, 18 nt, Mycobacterium avium subsp. paratuberculosis
ggccagcuccucggggau

SEQ ID NO: 3015034 - RNA, 17 nt, Mycobacterium avium subsp. paratuberculosis
ggccagcucgaacaccg

SEQ ID NO: 3015035 - RNA, 19 nt, Mycobacterium avium subsp. paratuberculosis
ggccagcucgaccgcggcg

SEQ ID NO: 3015036 - RNA, 19 nt, Mycobacterium avium subsp. paratuberculosis
ggccagcucgagcaucacg

SEQ ID NO: 3015037 - RNA, 19 nt, Mycobacterium avium subsp. paratuberculosis
ggccgacauggacgcggcc

SEQ ID NO: 3015038 - RNA, 22 nt, Mycobacterium avium subsp. paratuberculosis
ggccgacauggacgcggccuca

SEQ ID NO: 3015039 - RNA, 14 nt, Mycobacterium avium subsp. paratuberculosis
ggccgaccccgaug

SEQ ID NO: 3015040 - RNA, 15 nt, Mycobacterium avium subsp. paratuberculosis
ggccgacccggccga

SEQ ID NO: 3015041 - RNA, 15 nt, Mycobacterium avium subsp. paratuberculosis
ggccgaccgacaguu

SEQ ID NO: 3015042 - RNA, 13 nt, Mycobacterium avium subsp. paratuberculosis
ggccgaccgccgc

SEQ ID NO: 3015043 - RNA, 14 nt, Mycobacterium avium subsp. paratuberculosis
ggccgaccgccgcc

SEQ ID NO: 3015044 - RNA, 16 nt, Mycobacterium avium subsp. paratuberculosis
ggccgaccggucucga

SEQ ID NO: 3015045 - RNA, 16 nt, Mycobacterium avium subsp. paratuberculosis
ggccgaccuggcggcc

SEQ ID NO: 3015046 - RNA, 16 nt, Mycobacterium avium subsp. paratuberculosis
ggccgacgcccagcac

SEQ ID NO: 3015047 - RNA, 17 nt, Mycobacterium avium subsp. paratuberculosis
ggccgacgccggccacc

SEQ ID NO: 3015048 - RNA, 18 nt, Mycobacterium avium subsp. paratuberculosis
ggccgacgccggccacca

SEQ ID NO: 3015049 - RNA, 21 nt, Mycobacterium avium subsp. paratuberculosis
ggccgacgccggccaccaaca

SEQ ID NO: 3015050 - RNA, 16 nt, Mycobacterium avium subsp. paratuberculosis
ggccgacgcggccucg

SEQ ID NO: 3015051 - RNA, 16 nt, Mycobacterium avium subsp. paratuberculosis
ggccgacgcuggccga

SEQ ID NO: 3015052 - RNA, 23 nt, Mycobacterium avium subsp. paratuberculosis
ggccgacgggauaguccggcaug

SEQ ID NO: 3015053 - RNA, 20 nt, Mycobacterium avium subsp. paratuberculosis
ggccgacucgaugcgcguga

SEQ ID NO: 3015054 - RNA, 17 nt, Mycobacterium avium subsp. paratuberculosis
ggccgacugauccacca

SEQ ID NO: 3015055 - RNA, 19 nt, Mycobacterium avium subsp. paratuberculosis
ggccgacugauccaccauc

SEQ ID NO: 3015056 - RNA, 23 nt, Mycobacterium avium subsp. paratuberculosis
ggccgacugauccaccaucuucc

SEQ ID NO: 3015057 - RNA, 21 nt, Mycobacterium avium subsp. paratuberculosis
ggccgacuuggucagcccgcg

SEQ ID NO: 3015058 - RNA, 13 nt, Mycobacterium avium subsp. paratuberculosis
ggccgagcagccg

SEQ ID NO: 3015059 - RNA, 14 nt, Mycobacterium avium subsp. paratuberculosis
ggccgagcagccgg

SEQ ID NO: 3015060 - RNA, 15 nt, Mycobacterium avium subsp. paratuberculosis
ggccgagcagccggg

SEQ ID NO: 3015061 - RNA, 20 nt, Mycobacterium avium subsp. paratuberculosis
ggccgagccgagccgacccg

SEQ ID NO: 3015062 - RNA, 16 nt, Mycobacterium avium subsp. paratuberculosis
ggccgagccgaggccg

SEQ ID NO: 3015063 - RNA, 19 nt, Mycobacterium avium subsp. paratuberculosis
ggccgagccgaugcccagc

SEQ ID NO: 3015064 - RNA, 21 nt, Mycobacterium avium subsp. paratuberculosis
ggccgagccgaugcccagcag

SEQ ID NO: 3015065 - RNA, 12 nt, Mycobacterium avium subsp. paratuberculosis
ggccgagccgcc

SEQ ID NO: 3015066 - RNA, 13 nt, Mycobacterium avium subsp. paratuberculosis
ggccgagccgccg

SEQ ID NO: 3015067 - RNA, 17 nt, Mycobacterium avium subsp. paratuberculosis
ggccgagccgccggauc

SEQ ID NO: 3015068 - RNA, 22 nt, Mycobacterium avium subsp. paratuberculosis
ggccgagccggcguacccgccc

SEQ ID NO: 3015069 - RNA, 16 nt, Mycobacterium avium subsp. paratuberculosis
ggccgagccgggcggc

SEQ ID NO: 3015070 - RNA, 20 nt, Mycobacterium avium subsp. paratuberculosis
ggccgagccgggcggccagc

SEQ ID NO: 3015071 - RNA, 21 nt, Mycobacterium avium subsp. paratuberculosis
ggccgagccgggcggccagcg

SEQ ID NO: 3015072 - RNA, 12 nt, Mycobacterium avium subsp. paratuberculosis
ggccgagcgcac

SEQ ID NO: 3015073 - RNA, 13 nt, Mycobacterium avium subsp. paratuberculosis
ggccgagcgcacc

SEQ ID NO: 3015074 - RNA, 16 nt, Mycobacterium avium subsp. paratuberculosis
ggccgagcgcaccgcg

SEQ ID NO: 3015075 - RNA, 17 nt, Mycobacterium avium subsp. paratuberculosis
ggccgagcgcaccgcgg

SEQ ID NO: 3015076 - RNA, 19 nt, Mycobacterium avium subsp. paratuberculosis
ggccgagcgcaccgcggag

SEQ ID NO: 3015077 - RNA, 20 nt, Mycobacterium avium subsp. paratuberculosis
ggccgagcgcaccgcggagc

SEQ ID NO: 3015078 - RNA, 13 nt, Mycobacterium avium subsp. paratuberculosis
ggccgagcgcagc

SEQ ID NO: 3015079 - RNA, 14 nt, Mycobacterium avium subsp. paratuberculosis
ggccgagcgcagcg

SEQ ID NO: 3015080 - RNA, 14 nt, Mycobacterium avium subsp. paratuberculosis
ggccgagcgcgccg

SEQ ID NO: 3015081 - RNA, 18 nt, Mycobacterium avium subsp. paratuberculosis
ggccgagcgcgccgagca

SEQ ID NO: 3015082 - RNA, 21 nt, Mycobacterium avium subsp. paratuberculosis
ggccgagcgcgccgagcagcu

SEQ ID NO: 3015083 - RNA, 22 nt, Mycobacterium avium subsp. paratuberculosis
ggccgagcgcgccgagcagcug

SEQ ID NO: 3015084 - RNA, 24 nt, Mycobacterium avium subsp. paratuberculosis
ggccgagcgcgccgagcagcuggg

SEQ ID NO: 3015085 - RNA, 18 nt, Mycobacterium avium subsp. paratuberculosis
ggccgagcgcgccgccgc

SEQ ID NO: 3015086 - RNA, 13 nt, Mycobacterium avium subsp. paratuberculosis
ggccgagcgcgcu

SEQ ID NO: 3015087 - RNA, 14 nt, Mycobacterium avium subsp. paratuberculosis
ggccgagcgcgcug

SEQ ID NO: 3015088 - RNA, 15 nt, Mycobacterium avium subsp. paratuberculosis
ggccgagcgcgcugg

SEQ ID NO: 3015089 - RNA, 17 nt, Mycobacterium avium subsp. paratuberculosis
ggccgagcguucggcgc

SEQ ID NO: 3015090 - RNA, 14 nt, Mycobacterium avium subsp. paratuberculosis
ggccgaggccucca

SEQ ID NO: 3015091 - RNA, 15 nt, Mycobacterium avium subsp. paratuberculosis
ggccgaggcgaguga

SEQ ID NO: 3015092 - RNA, 18 nt, Mycobacterium avium subsp. paratuberculosis
ggccgaggcgagugagga

SEQ ID NO: 3015093 - RNA, 15 nt, Mycobacterium avium subsp. paratuberculosis
ggccgaggcugucgg

SEQ ID NO: 3015094 - RNA, 23 nt, Mycobacterium avium subsp. paratuberculosis
ggccgaggcugucggaggccucc

SEQ ID NO: 3015095 - RNA, 14 nt, Mycobacterium avium subsp. paratuberculosis
ggccgaggucacca

SEQ ID NO: 3015096 - RNA, 15 nt, Mycobacterium avium subsp. paratuberculosis
ggccgaggucaccac

SEQ ID NO: 3015097 - RNA, 21 nt, Mycobacterium avium subsp. paratuberculosis
ggccgaggucaccaccgagcc

SEQ ID NO: 3015098 - RNA, 23 nt, Mycobacterium avium subsp. paratuberculosis
ggccgaggucaccaccgagccgg

SEQ ID NO: 3015099 - RNA, 15 nt, Mycobacterium avium subsp. paratuberculosis
ggccgagguccgcgg

SEQ ID NO: 3015100 - RNA, 16 nt, Mycobacterium avium subsp. paratuberculosis
ggccgaggucggucgc

SEQ ID NO: 3015101 - RNA, 16 nt, Mycobacterium avium subsp. paratuberculosis
ggccgaguauccgcgc

SEQ ID NO: 3015102 - RNA, 22 nt, Mycobacterium avium subsp. paratuberculosis
ggccgagucgacgugcucggcg

SEQ ID NO: 3015103 - RNA, 18 nt, Mycobacterium avium subsp. paratuberculosis
ggccgaucaccucgaugg

SEQ ID NO: 3015104 - RNA, 20 nt, Mycobacterium avium subsp. paratuberculosis
ggccgaucaccucgauggcc

SEQ ID NO: 3015105 - RNA, 17 nt, Mycobacterium avium subsp. paratuberculosis
ggccgaucagcggcggg

SEQ ID NO: 3015106 - RNA, 22 nt, Mycobacterium avium subsp. paratuberculosis
ggccgaucagcggcgggcccag

SEQ ID NO: 3015107 - RNA, 18 nt, Mycobacterium avium subsp. paratuberculosis
ggccgaucagcugcucgg

SEQ ID NO: 3015108 - RNA, 21 nt, Mycobacterium avium subsp. paratuberculosis
ggccgaucagcugcucggcca

SEQ ID NO: 3015109 - RNA, 16 nt, Mycobacterium avium subsp. paratuberculosis
ggccgaucagugccgc

SEQ ID NO: 3015110 - RNA, 18 nt, Mycobacterium avium subsp. paratuberculosis
ggccgaucauggucggcg

SEQ ID NO: 3015111 - RNA, 19 nt, Mycobacterium avium subsp. paratuberculosis
ggccgaucauggucggcga

SEQ ID NO: 3015112 - RNA, 16 nt, Mycobacterium avium subsp. paratuberculosis
ggccgaucccggccac

SEQ ID NO: 3015113 - RNA, 17 nt, Mycobacterium avium subsp. paratuberculosis
ggccgaucccggccacg

SEQ ID NO: 3015114 - RNA, 21 nt, Mycobacterium avium subsp. paratuberculosis
ggccgaucccggccacgucga

SEQ ID NO: 3015115 - RNA, 13 nt, Mycobacterium avium subsp. paratuberculosis
ggccgaugaccgc

SEQ ID NO: 3015116 - RNA, 17 nt, Mycobacterium avium subsp. paratuberculosis
ggccgaugaccgcggcg

SEQ ID NO: 3015117 - RNA, 18 nt, Mycobacterium avium subsp. paratuberculosis
ggccgaugaccgcggcgg

SEQ ID NO: 3015118 - RNA, 23 nt, Mycobacterium avium subsp. paratuberculosis
ggccgaugaccucgcacagcuug

SEQ ID NO: 3015119 - RNA, 22 nt, Mycobacterium avium subsp. paratuberculosis
ggccgaugagccucagcgcgca

SEQ ID NO: 3015120 - RNA, 16 nt, Mycobacterium avium subsp. paratuberculosis
ggccgaugaugaugcc

SEQ ID NO: 3015121 - RNA, 21 nt, Mycobacterium avium subsp. paratuberculosis
ggccgaugaugaugccgccca

SEQ ID NO: 3015122 - RNA, 13 nt, Mycobacterium avium subsp. paratuberculosis
ggccgccagcgcc

SEQ ID NO: 3015123 - RNA, 14 nt, Mycobacterium avium subsp. paratuberculosis
ggccgccagcgccc

SEQ ID NO: 3015124 - RNA, 17 nt, Mycobacterium avium subsp. paratuberculosis
ggccgccagcgcccgcg

SEQ ID NO: 3015125 - RNA, 18 nt, Mycobacterium avium subsp. paratuberculosis
ggccgccagcgucccguc

SEQ ID NO: 3015126 - RNA, 22 nt, Mycobacterium avium subsp. paratuberculosis
ggccgccagcgucccguccugg

SEQ ID NO: 3015127 - RNA, 12 nt, Mycobacterium avium subsp. paratuberculosis
ggccgccagcuc

SEQ ID NO: 3015128 - RNA, 19 nt, Mycobacterium avium subsp. paratuberculosis
ggccgccaggaugucgucc

SEQ ID NO: 3015129 - RNA, 20 nt, Mycobacterium avium subsp. paratuberculosis
ggccgccaggaugucguccu

SEQ ID NO: 3015130 - RNA, 14 nt, Mycobacterium avium subsp. paratuberculosis
ggccgccagggcca

SEQ ID NO: 3015131 - RNA, 22 nt, Mycobacterium avium subsp. paratuberculosis
ggccgccaguuguuggccgggc

SEQ ID NO: 3015132 - RNA, 15 nt, Mycobacterium avium subsp. paratuberculosis
ggccgccaucaccgc

SEQ ID NO: 3015133 - RNA, 18 nt, Mycobacterium avium subsp. paratuberculosis
ggccgccaucaccgcgcu

SEQ ID NO: 3015134 - RNA, 20 nt, Mycobacterium avium subsp. paratuberculosis
ggccgccaucauccgcuggg

SEQ ID NO: 3015135 - RNA, 21 nt, Mycobacterium avium subsp. paratuberculosis
ggccgccaucgaucgggcguc

SEQ ID NO: 3015136 - RNA, 22 nt, Mycobacterium avium subsp. paratuberculosis
ggccgccaucgaucgggcgucg

SEQ ID NO: 3015137 - RNA, 22 nt, Mycobacterium avium subsp. paratuberculosis
ggccgccauguacagaccccac

SEQ ID NO: 3015138 - RNA, 14 nt, Mycobacterium avium subsp. paratuberculosis
ggccgcccagcccg

SEQ ID NO: 3015139 - RNA, 19 nt, Mycobacterium avium subsp. paratuberculosis
ggccgcccagcccgcgccg

SEQ ID NO: 3015140 - RNA, 23 nt, Mycobacterium avium subsp. paratuberculosis
ggccgcccagcccgcgccgagca

SEQ ID NO: 3015141 - RNA, 17 nt, Mycobacterium avium subsp. paratuberculosis
ggccgcccagucgccgc

SEQ ID NO: 3015142 - RNA, 21 nt, Mycobacterium avium subsp. paratuberculosis
ggccgcccagucgccgccgcg

SEQ ID NO: 3015143 - RNA, 23 nt, Mycobacterium avium subsp. paratuberculosis
ggccgcccagucgccgccgcgca

SEQ ID NO: 3015144 - RNA, 13 nt, Mycobacterium avium subsp. paratuberculosis
ggccgccccgaac

SEQ ID NO: 3015145 - RNA, 15 nt, Mycobacterium avium subsp. paratuberculosis
ggccgccccggccgc

SEQ ID NO: 3015146 - RNA, 16 nt, Mycobacterium avium subsp. paratuberculosis
ggccgccccggccgcg

SEQ ID NO: 3015147 - RNA, 19 nt, Mycobacterium avium subsp. paratuberculosis
ggccgccccggccgcgcac

SEQ ID NO: 3015148 - RNA, 20 nt, Mycobacterium avium subsp. paratuberculosis
ggccgccccggccgcgcacc

SEQ ID NO: 3015149 - RNA, 18 nt, Mycobacterium avium subsp. paratuberculosis
ggccgcccgcaccagcag

SEQ ID NO: 3015150 - RNA, 12 nt, Mycobacterium avium subsp. paratuberculosis
ggccgcccgcgc

SEQ ID NO: 3015151 - RNA, 14 nt, Mycobacterium avium subsp. paratuberculosis
ggccgcccgcgcgu

SEQ ID NO: 3015152 - RNA, 22 nt, Mycobacterium avium subsp. paratuberculosis
ggccgcccgcgcguggucccac

SEQ ID NO: 3015153 - RNA, 17 nt, Mycobacterium avium subsp. paratuberculosis
ggccgcccgcuccugca

SEQ ID NO: 3015154 - RNA, 18 nt, Mycobacterium avium subsp. paratuberculosis
ggccgcccgcuccugcag

SEQ ID NO: 3015155 - RNA, 23 nt, Mycobacterium avium subsp. paratuberculosis
ggccgcccgcuccugcaggccga

SEQ ID NO: 3015156 - RNA, 17 nt, Mycobacterium avium subsp. paratuberculosis
ggccgcccgcuggggcg

SEQ ID NO: 3015157 - RNA, 22 nt, Mycobacterium avium subsp. paratuberculosis
ggccgcccgcuggggcgcaccg

SEQ ID NO: 3015158 - RNA, 20 nt, Mycobacterium avium subsp. paratuberculosis
ggccgcccggcccaagaccc

SEQ ID NO: 3015159 - RNA, 15 nt, Mycobacterium avium subsp. paratuberculosis
ggccgcccggcgagc

SEQ ID NO: 3015160 - RNA, 16 nt, Mycobacterium avium subsp. paratuberculosis
ggccgcccggcgagca

SEQ ID NO: 3015161 - RNA, 22 nt, Mycobacterium avium subsp. paratuberculosis
ggccgcccggcgagcagcccgg

SEQ ID NO: 3015162 - RNA, 15 nt, Mycobacterium avium subsp. paratuberculosis
ggccgcccggcgcgc

SEQ ID NO: 3015163 - RNA, 15 nt, Mycobacterium avium subsp. paratuberculosis
ggccgcccgggaaaa

SEQ ID NO: 3015164 - RNA, 13 nt, Mycobacterium avium subsp. paratuberculosis
ggccgcccggucc

SEQ ID NO: 3015165 - RNA, 23 nt, Mycobacterium avium subsp. paratuberculosis
ggccgcccgguccgggucgcuga

SEQ ID NO: 3015166 - RNA, 15 nt, Mycobacterium avium subsp. paratuberculosis
ggccgcccguccggg

SEQ ID NO: 3015167 - RNA, 17 nt, Mycobacterium avium subsp. paratuberculosis
ggccgcccgucggggcc

SEQ ID NO: 3015168 - RNA, 12 nt, Mycobacterium avium subsp. paratuberculosis
ggccgccgaagc

SEQ ID NO: 3015169 - RNA, 13 nt, Mycobacterium avium subsp. paratuberculosis
ggccgccgacgac

SEQ ID NO: 3015170 - RNA, 14 nt, Mycobacterium avium subsp. paratuberculosis
ggccgccgacgucg

SEQ ID NO: 3015171 - RNA, 17 nt, Mycobacterium avium subsp. paratuberculosis
ggccgccgacgucgugg

SEQ ID NO: 3015172 - RNA, 20 nt, Mycobacterium avium subsp. paratuberculosis
ggccgccgacgucgugggcg

SEQ ID NO: 3015173 - RNA, 22 nt, Mycobacterium avium subsp. paratuberculosis
ggccgccgacugugcgaugucg

SEQ ID NO: 3015174 - RNA, 20 nt, Mycobacterium avium subsp. paratuberculosis
ggccgccgaggacacguugg

SEQ ID NO: 3015175 - RNA, 19 nt, Mycobacterium avium subsp. paratuberculosis
ggccgccgaggcgaugccg

SEQ ID NO: 3015176 - RNA, 14 nt, Mycobacterium avium subsp. paratuberculosis
ggccgccgaucaac

SEQ ID NO: 3015177 - RNA, 15 nt, Mycobacterium avium subsp. paratuberculosis
ggccgccgaucaaca

SEQ ID NO: 3015178 - RNA, 19 nt, Mycobacterium avium subsp. paratuberculosis
ggccgccgaugcgcccgcu

SEQ ID NO: 3015179 - RNA, 21 nt, Mycobacterium avium subsp. paratuberculosis
ggccgccgaugcgcccgcugc

SEQ ID NO: 3015180 - RNA, 22 nt, Mycobacterium avium subsp. paratuberculosis
ggccgccgauucaaccccgcgc

SEQ ID NO: 3015181 - RNA, 21 nt, Mycobacterium avium subsp. paratuberculosis
ggccgccgauuccggccggcc

SEQ ID NO: 3015182 - RNA, 14 nt, Mycobacterium avium subsp. paratuberculosis
ggccgccgccaccg

SEQ ID NO: 3015183 - RNA, 19 nt, Mycobacterium avium subsp. paratuberculosis
ggccgccgccaccgucgcc

SEQ ID NO: 3015184 - RNA, 13 nt, Mycobacterium avium subsp. paratuberculosis
ggccgccgcccgc

SEQ ID NO: 3015185 - RNA, 14 nt, Mycobacterium avium subsp. paratuberculosis
ggccgccgcccgcg

SEQ ID NO: 3015186 - RNA, 15 nt, Mycobacterium avium subsp. paratuberculosis
ggccgccgcccgcgc

SEQ ID NO: 3015187 - RNA, 21 nt, Mycobacterium avium subsp. paratuberculosis
ggccgccgcccgcgcggcggc

SEQ ID NO: 3015188 - RNA, 13 nt, Mycobacterium avium subsp. paratuberculosis
ggccgccgccgcg

SEQ ID NO: 3015189 - RNA, 15 nt, Mycobacterium avium subsp. paratuberculosis
ggccgccgccgcggc

SEQ ID NO: 3015190 - RNA, 16 nt, Mycobacterium avium subsp. paratuberculosis
ggccgccgccgcggcc

SEQ ID NO: 3015191 - RNA, 18 nt, Mycobacterium avium subsp. paratuberculosis
ggccgccgccgcggccgc

SEQ ID NO: 3015192 - RNA, 22 nt, Mycobacterium avium subsp. paratuberculosis
ggccgccgccgcggccgcggcg

SEQ ID NO: 3015193 - RNA, 21 nt, Mycobacterium avium subsp. paratuberculosis
ggccgccgccugagcccgccu

SEQ ID NO: 3015194 - RNA, 12 nt, Mycobacterium avium subsp. paratuberculosis
ggccgccgcgac

SEQ ID NO: 3015195 - RNA, 14 nt, Mycobacterium avium subsp. paratuberculosis
ggccgccgcgaccg

SEQ ID NO: 3015196 - RNA, 16 nt, Mycobacterium avium subsp. paratuberculosis
ggccgccgcgaccguc

SEQ ID NO: 3015197 - RNA, 13 nt, Mycobacterium avium subsp. paratuberculosis
ggccgccgcgacg

SEQ ID NO: 3015198 - RNA, 15 nt, Mycobacterium avium subsp. paratuberculosis
ggccgccgcgacggc

SEQ ID NO: 3015199 - RNA, 13 nt, Mycobacterium avium subsp. paratuberculosis
ggccgccgcgcgg

SEQ ID NO: 3015200 - RNA, 15 nt, Mycobacterium avium subsp. paratuberculosis
ggccgccgcgcgggu

SEQ ID NO: 3015201 - RNA, 13 nt, Mycobacterium avium subsp. paratuberculosis
ggccgccgcggcc

SEQ ID NO: 3015202 - RNA, 15 nt, Mycobacterium avium subsp. paratuberculosis
ggccgccgcggccac

SEQ ID NO: 3015203 - RNA, 16 nt, Mycobacterium avium subsp. paratuberculosis
ggccgccgcggcggca

SEQ ID NO: 3015204 - RNA, 13 nt, Mycobacterium avium subsp. paratuberculosis
ggccgccggaucg

SEQ ID NO: 3015205 - RNA, 15 nt, Mycobacterium avium subsp. paratuberculosis
ggccgccggaucgug

SEQ ID NO: 3015206 - RNA, 22 nt, Mycobacterium avium subsp. paratuberculosis
ggccgccggauuacucgccggc

SEQ ID NO: 3015207 - RNA, 12 nt, Mycobacterium avium subsp. paratuberculosis
ggccgcgcagcg

SEQ ID NO: 3015208 - RNA, 15 nt, Mycobacterium avium subsp. paratuberculosis
ggccgcgcagcgugu

SEQ ID NO: 3015209 - RNA, 15 nt, Mycobacterium avium subsp. paratuberculosis
ggccgcgcagcucgg

SEQ ID NO: 3015210 - RNA, 14 nt, Mycobacterium avium subsp. paratuberculosis
ggccgcgccacagc

SEQ ID NO: 3015211 - RNA, 17 nt, Mycobacterium avium subsp. paratuberculosis
ggccgcgcccaucgcgg

SEQ ID NO: 3015212 - RNA, 21 nt, Mycobacterium avium subsp. paratuberculosis
ggccgcgcccaucgcggccgc

SEQ ID NO: 3015213 - RNA, 23 nt, Mycobacterium avium subsp. paratuberculosis
ggccgcgcccaucgcggccgccc

SEQ ID NO: 3015214 - RNA, 13 nt, Mycobacterium avium subsp. paratuberculosis
ggccgcgccgccg

SEQ ID NO: 3015215 - RNA, 14 nt, Mycobacterium avium subsp. paratuberculosis
ggccgcgccgccga

SEQ ID NO: 3015216 - RNA, 19 nt, Mycobacterium avium subsp. paratuberculosis
ggccgcgccgccgaccacg

SEQ ID NO: 3015217 - RNA, 22 nt, Mycobacterium avium subsp. paratuberculosis
ggccgcgccgccgcccuggccc

SEQ ID NO: 3015218 - RNA, 15 nt, Mycobacterium avium subsp. paratuberculosis
ggccgcgccggaugg

SEQ ID NO: 3015219 - RNA, 21 nt, Mycobacterium avium subsp. paratuberculosis
ggccgcgccggaugguccgca

SEQ ID NO: 3015220 - RNA, 13 nt, Mycobacterium avium subsp. paratuberculosis
ggccgcgccggcc

SEQ ID NO: 3015221 - RNA, 15 nt, Mycobacterium avium subsp. paratuberculosis
ggccgcgccgggcga

SEQ ID NO: 3015222 - RNA, 17 nt, Mycobacterium avium subsp. paratuberculosis
ggccgcgccgugcgcca

SEQ ID NO: 3015223 - RNA, 19 nt, Mycobacterium avium subsp. paratuberculosis
ggccgcgccgugcgccagc

SEQ ID NO: 3015224 - RNA, 20 nt, Mycobacterium avium subsp. paratuberculosis
ggccgcgccgugcgccagcg

SEQ ID NO: 3015225 - RNA, 12 nt, Mycobacterium avium subsp. paratuberculosis
ggccgcgcgcag

SEQ ID NO: 3015226 - RNA, 14 nt, Mycobacterium avium subsp. paratuberculosis
ggccgcgcgcaggc

SEQ ID NO: 3015227 - RNA, 18 nt, Mycobacterium avium subsp. paratuberculosis
ggccgcgcgcaggcgcug

SEQ ID NO: 3015228 - RNA, 19 nt, Mycobacterium avium subsp. paratuberculosis
ggccgcgcgcaggcgcuga

SEQ ID NO: 3015229 - RNA, 21 nt, Mycobacterium avium subsp. paratuberculosis
ggccgcgcgcaggcgcugagc

SEQ ID NO: 3015230 - RNA, 17 nt, Mycobacterium avium subsp. paratuberculosis
ggccgcgcgcaucucga

SEQ ID NO: 3015231 - RNA, 19 nt, Mycobacterium avium subsp. paratuberculosis
ggccgcgcgcccgucgucg

SEQ ID NO: 3015232 - RNA, 21 nt, Mycobacterium avium subsp. paratuberculosis
ggccgcgcgcccgucgucggu

SEQ ID NO: 3015233 - RNA, 13 nt, Mycobacterium avium subsp. paratuberculosis
ggccgcgcgcggc

SEQ ID NO: 3015234 - RNA, 16 nt, Mycobacterium avium subsp. paratuberculosis
ggccgcgcgcggcgcg

SEQ ID NO: 3015235 - RNA, 14 nt, Mycobacterium avium subsp. paratuberculosis
ggccgcgcgggcga

SEQ ID NO: 3015236 - RNA, 19 nt, Mycobacterium avium subsp. paratuberculosis
ggccgcgcgggcgaccugc

SEQ ID NO: 3015237 - RNA, 20 nt, Mycobacterium avium subsp. paratuberculosis
ggccgcgcgggcgaccugcg

SEQ ID NO: 3015238 - RNA, 13 nt, Mycobacterium avium subsp. paratuberculosis
ggccgcgcggugc

SEQ ID NO: 3015239 - RNA, 16 nt, Mycobacterium avium subsp. paratuberculosis
ggccgcgcggugcucg

SEQ ID NO: 3015240 - RNA, 18 nt, Mycobacterium avium subsp. paratuberculosis
ggccgcgcgugcccgcgg

SEQ ID NO: 3015241 - RNA, 12 nt, Mycobacterium avium subsp. paratuberculosis
ggccgcgcuggc

SEQ ID NO: 3015242 - RNA, 14 nt, Mycobacterium avium subsp. paratuberculosis
ggccgcgcuggcca

SEQ ID NO: 3015243 - RNA, 16 nt, Mycobacterium avium subsp. paratuberculosis
ggccgcgcuggccagc

SEQ ID NO: 3015244 - RNA, 17 nt, Mycobacterium avium subsp. paratuberculosis
ggccgcgcuggccagcg

SEQ ID NO: 3015245 - RNA, 18 nt, Mycobacterium avium subsp. paratuberculosis
ggccgcgcuggccagcgu

SEQ ID NO: 3015246 - RNA, 14 nt, Mycobacterium avium subsp. paratuberculosis
ggccgcgcugguca

SEQ ID NO: 3015247 - RNA, 22 nt, Mycobacterium avium subsp. paratuberculosis
ggccgcggaauucgcgggugcg

SEQ ID NO: 3015248 - RNA, 14 nt, Mycobacterium avium subsp. paratuberculosis
ggccgcggacccga

SEQ ID NO: 3015249 - RNA, 21 nt, Mycobacterium avium subsp. paratuberculosis
ggccgcggauggugacggccg

SEQ ID NO: 3015250 - RNA, 14 nt, Mycobacterium avium subsp. paratuberculosis
ggccgcggccaagu

SEQ ID NO: 3015251 - RNA, 16 nt, Mycobacterium avium subsp. paratuberculosis
ggccgcggccagcgag

SEQ ID NO: 3015252 - RNA, 17 nt, Mycobacterium avium subsp. paratuberculosis
ggccgcggccagcgagg

SEQ ID NO: 3015253 - RNA, 22 nt, Mycobacterium avium subsp. paratuberculosis
ggccgcggccagcuccgggucg

SEQ ID NO: 3015254 - RNA, 13 nt, Mycobacterium avium subsp. paratuberculosis
ggccgcggcccgg

SEQ ID NO: 3015255 - RNA, 19 nt, Mycobacterium avium subsp. paratuberculosis
ggccgcggcccggccacca

SEQ ID NO: 3015256 - RNA, 12 nt, Mycobacterium avium subsp. paratuberculosis
ggccgcggccgc

SEQ ID NO: 3015257 - RNA, 15 nt, Mycobacterium avium subsp. paratuberculosis
ggccgcggccgccgc

SEQ ID NO: 3015258 - RNA, 15 nt, Mycobacterium avium subsp. paratuberculosis
ggccgcggccggcac

SEQ ID NO: 3015259 - RNA, 14 nt, Mycobacterium avium subsp. paratuberculosis
ggccgcggccggcg

SEQ ID NO: 3015260 - RNA, 15 nt, Mycobacterium avium subsp. paratuberculosis
ggccgcggccggcgg

SEQ ID NO: 3015261 - RNA, 14 nt, Mycobacterium avium subsp. paratuberculosis
ggccgcggccgucg

SEQ ID NO: 3015262 - RNA, 12 nt, Mycobacterium avium subsp. paratuberculosis
ggccgcggccuu

SEQ ID NO: 3015263 - RNA, 16 nt, Mycobacterium avium subsp. paratuberculosis
ggccgcggcgaucggc

SEQ ID NO: 3015264 - RNA, 19 nt, Mycobacterium avium subsp. paratuberculosis
ggccgcggcgaucggcggu

SEQ ID NO: 3015265 - RNA, 20 nt, Mycobacterium avium subsp. paratuberculosis
ggccgcggcgaucggcgguc

SEQ ID NO: 3015266 - RNA, 17 nt, Mycobacterium avium subsp. paratuberculosis
ggccgcggcgccguuga

SEQ ID NO: 3015267 - RNA, 12 nt, Mycobacterium avium subsp. paratuberculosis
ggccgcggcgcg

SEQ ID NO: 3015268 - RNA, 14 nt, Mycobacterium avium subsp. paratuberculosis
ggccgcggcgcgca

SEQ ID NO: 3015269 - RNA, 16 nt, Mycobacterium avium subsp. paratuberculosis
ggccgcggcgcggccc

SEQ ID NO: 3015270 - RNA, 18 nt, Mycobacterium avium subsp. paratuberculosis
ggccgcggcgcggcccgg

SEQ ID NO: 3015271 - RNA, 19 nt, Mycobacterium avium subsp. paratuberculosis
ggccgcggcgcggcccggc

SEQ ID NO: 3015272 - RNA, 15 nt, Mycobacterium avium subsp. paratuberculosis
ggccgcggcggcccg

SEQ ID NO: 3015273 - RNA, 17 nt, Mycobacterium avium subsp. paratuberculosis
ggccgcggcggcccggc

SEQ ID NO: 3015274 - RNA, 19 nt, Mycobacterium avium subsp. paratuberculosis
ggccgcggcgggcgcgucg

SEQ ID NO: 3015275 - RNA, 13 nt, Mycobacterium avium subsp. paratuberculosis
ggccgcggcgucg

SEQ ID NO: 3015276 - RNA, 16 nt, Mycobacterium avium subsp. paratuberculosis
ggccgcggcgucggga

SEQ ID NO: 3015277 - RNA, 12 nt, Mycobacterium avium subsp. paratuberculosis
ggccgcggcgug

SEQ ID NO: 3015278 - RNA, 14 nt, Mycobacterium avium subsp. paratuberculosis
ggccgcggcgugca

SEQ ID NO: 3015279 - RNA, 12 nt, Mycobacterium avium subsp. paratuberculosis
ggccgcggcucg

SEQ ID NO: 3015280 - RNA, 16 nt, Mycobacterium avium subsp. paratuberculosis
ggccgcgggcccaccg

SEQ ID NO: 3015281 - RNA, 22 nt, Mycobacterium avium subsp. paratuberculosis
ggccgcgggcccaccgccacca

SEQ ID NO: 3015282 - RNA, 23 nt, Mycobacterium avium subsp. paratuberculosis
ggccgcgggcccaccgccaccag

SEQ ID NO: 3015283 - RNA, 14 nt, Mycobacterium avium subsp. paratuberculosis
ggccgcgggcgggc

SEQ ID NO: 3015284 - RNA, 17 nt, Mycobacterium avium subsp. paratuberculosis
ggccgcgggcgggccga

SEQ ID NO: 3015285 - RNA, 20 nt, Mycobacterium avium subsp. paratuberculosis
ggccgcgggcgggccgaacc

SEQ ID NO: 3015286 - RNA, 12 nt, Mycobacterium avium subsp. paratuberculosis
ggccgcggggcc

SEQ ID NO: 3015287 - RNA, 17 nt, Mycobacterium avium subsp. paratuberculosis
ggccgcggggccggcgc

SEQ ID NO: 3015288 - RNA, 18 nt, Mycobacterium avium subsp. paratuberculosis
ggccgcgggugcggccca

SEQ ID NO: 3015289 - RNA, 13 nt, Mycobacterium avium subsp. paratuberculosis
ggccgcggucgcc

SEQ ID NO: 3015290 - RNA, 15 nt, Mycobacterium avium subsp. paratuberculosis
ggccgcggucgcccc

SEQ ID NO: 3015291 - RNA, 22 nt, Mycobacterium avium subsp. paratuberculosis
ggccgcggucgccccggccgcg

SEQ ID NO: 3015292 - RNA, 20 nt, Mycobacterium avium subsp. paratuberculosis
ggccgcggucucgaccgacu

SEQ ID NO: 3015293 - RNA, 20 nt, Mycobacterium avium subsp. paratuberculosis
ggccacgcuagcgugacgcu

SEQ ID NO: 3015294 - RNA, 12 nt, Mycobacterium avium subsp. paratuberculosis
ggccacgcucgc

SEQ ID NO: 3015295 - RNA, 17 nt, Mycobacterium avium subsp. paratuberculosis
ggccacgcucggcggcg

SEQ ID NO: 3015296 - RNA, 21 nt, Mycobacterium avium subsp. paratuberculosis
ggccacgcucggcggcgcgca

SEQ ID NO: 3015297 - RNA, 22 nt, Mycobacterium avium subsp. paratuberculosis
ggccacgcucgggccggcgccg

SEQ ID NO: 3015298 - RNA, 16 nt, Mycobacterium avium subsp. paratuberculosis
ggccacgcucucgccg

SEQ ID NO: 3015299 - RNA, 18 nt, Mycobacterium avium subsp. paratuberculosis
ggccacgcucucgccggu

SEQ ID NO: 3015300 - RNA, 23 nt, Mycobacterium avium subsp. paratuberculosis
ggccacgcucucgccggucagca

SEQ ID NO: 3015301 - RNA, 19 nt, Mycobacterium avium subsp. paratuberculosis
ggccacgcuggcguccagg

SEQ ID NO: 3015302 - RNA, 20 nt, Mycobacterium avium subsp. paratuberculosis
ggccacgcuggcguccaggu

SEQ ID NO: 3015303 - RNA, 11 nt, Mycobacterium avium subsp. paratuberculosis
ggccacggcgu

SEQ ID NO: 3015304 - RNA, 13 nt, Mycobacterium avium subsp. paratuberculosis
ggccacggcguug

SEQ ID NO: 3015305 - RNA, 14 nt, Mycobacterium avium subsp. paratuberculosis
ggccacggcguuga

SEQ ID NO: 3015306 - RNA, 21 nt, Mycobacterium avium subsp. paratuberculosis
ggccacggcguugaccaacgc

SEQ ID NO: 3015307 - RNA, 13 nt, Mycobacterium avium subsp. paratuberculosis
ggccacggggucg

SEQ ID NO: 3015308 - RNA, 19 nt, Mycobacterium avium subsp. paratuberculosis
ggccacgucgaagcccggg

SEQ ID NO: 3015309 - RNA, 20 nt, Mycobacterium avium subsp. paratuberculosis
ggccacgucgaagcccgggu

SEQ ID NO: 3015310 - RNA, 13 nt, Mycobacterium avium subsp. paratuberculosis
ggccacguggucg

SEQ ID NO: 3015311 - RNA, 19 nt, Mycobacterium avium subsp. paratuberculosis
ggccacguggucgcugacc

SEQ ID NO: 3015312 - RNA, 14 nt, Mycobacterium avium subsp. paratuberculosis
ggccacucgccgcg

SEQ ID NO: 3015313 - RNA, 18 nt, Mycobacterium avium subsp. paratuberculosis
ggccacucgccgcgaacg

SEQ ID NO: 3015314 - RNA, 16 nt, Mycobacterium avium subsp. paratuberculosis
ggccacucgcgucccc

SEQ ID NO: 3015315 - RNA, 16 nt, Mycobacterium avium subsp. paratuberculosis
ggccacugccccggcg

SEQ ID NO: 3015316 - RNA, 18 nt, Mycobacterium avium subsp. paratuberculosis
ggccagacugcgcaccgc

SEQ ID NO: 3015317 - RNA, 20 nt, Mycobacterium avium subsp. paratuberculosis
ggccagacugcgcaccgcca

SEQ ID NO: 3015318 - RNA, 22 nt, Mycobacterium avium subsp. paratuberculosis
ggccagacugcgcaccgccagc

SEQ ID NO: 3015319 - RNA, 23 nt, Mycobacterium avium subsp. paratuberculosis
ggccagacugcgcaccgccagca

SEQ ID NO: 3015320 - RNA, 16 nt, Mycobacterium avium subsp. paratuberculosis
ggccagauacuccucg

SEQ ID NO: 3015321 - RNA, 17 nt, Mycobacterium avium subsp. paratuberculosis
ggccagauacuccucgg

SEQ ID NO: 3015322 - RNA, 22 nt, Mycobacterium avium subsp. paratuberculosis
ggccagaucgacccccaccgcg

SEQ ID NO: 3015323 - RNA, 14 nt, Mycobacterium avium subsp. paratuberculosis
ggccagaucgacgc

SEQ ID NO: 3015324 - RNA, 15 nt, Mycobacterium avium subsp. paratuberculosis
ggccagaucgacgcc

SEQ ID NO: 3015325 - RNA, 16 nt, Mycobacterium avium subsp. paratuberculosis
ggccagaucgacgccg

SEQ ID NO: 3015326 - RNA, 18 nt, Mycobacterium avium subsp. paratuberculosis
ggccagaucgacgccgcg

SEQ ID NO: 3015327 - RNA, 23 nt, Mycobacterium avium subsp. paratuberculosis
ggccagaucgacgccgcgguggc

SEQ ID NO: 3015328 - RNA, 13 nt, Mycobacterium avium subsp. paratuberculosis
ggccagaucggcc

SEQ ID NO: 3015329 - RNA, 15 nt, Mycobacterium avium subsp. paratuberculosis
ggccagaucggccag

SEQ ID NO: 3015330 - RNA, 16 nt, Mycobacterium avium subsp. paratuberculosis
ggccagaucggccagg

SEQ ID NO: 3015331 - RNA, 16 nt, Mycobacterium avium subsp. paratuberculosis
ggccagaugcccgccc

SEQ ID NO: 3015332 - RNA, 19 nt, Mycobacterium avium subsp. paratuberculosis
ggccagaugcccgccccgc

SEQ ID NO: 3015333 - RNA, 17 nt, Mycobacterium avium subsp. paratuberculosis
ggccagcaacaccagcu

SEQ ID NO: 3015334 - RNA, 18 nt, Mycobacterium avium subsp. paratuberculosis
ggccagcaacaccagcug

SEQ ID NO: 3015335 - RNA, 19 nt, Mycobacterium avium subsp. paratuberculosis
ggccagcaacaccagcugg

SEQ ID NO: 3015336 - RNA, 17 nt, Mycobacterium avium subsp. paratuberculosis
ggccagcaacagcagcg

SEQ ID NO: 3015337 - RNA, 18 nt, Mycobacterium avium subsp. paratuberculosis
ggccagcaacagcagcgg

SEQ ID NO: 3015338 - RNA, 19 nt, Mycobacterium avium subsp. paratuberculosis
ggccagcaacagcagcggc

SEQ ID NO: 3015339 - RNA, 20 nt, Mycobacterium avium subsp. paratuberculosis
ggccagcaacagcagcggca

SEQ ID NO: 3015340 - RNA, 19 nt, Mycobacterium avium subsp. paratuberculosis
ggccagcaaccgccguggc

SEQ ID NO: 3015341 - RNA, 18 nt, Mycobacterium avium subsp. paratuberculosis
ggccagcaaccggaaugg

SEQ ID NO: 3015342 - RNA, 17 nt, Mycobacterium avium subsp. paratuberculosis
ggccagcacacccucga

SEQ ID NO: 3015343 - RNA, 14 nt, Mycobacterium avium subsp. paratuberculosis
ggccagcaccaccg

SEQ ID NO: 3015344 - RNA, 19 nt, Mycobacterium avium subsp. paratuberculosis
ggccagcaccaccgcgagc

SEQ ID NO: 3015345 - RNA, 20 nt, Mycobacterium avium subsp. paratuberculosis
ggccagcaccaccgcgagcg

SEQ ID NO: 3015346 - RNA, 13 nt, Mycobacterium avium subsp. paratuberculosis
ggccagcaccacg

SEQ ID NO: 3015347 - RNA, 19 nt, Mycobacterium avium subsp. paratuberculosis
ggccagcaccacguccgcg

SEQ ID NO: 3015348 - RNA, 13 nt, Mycobacterium avium subsp. paratuberculosis
ggccagcaccagc

SEQ ID NO: 3015349 - RNA, 14 nt, Mycobacterium avium subsp. paratuberculosis
ggccagcaccagca

SEQ ID NO: 3015350 - RNA, 15 nt, Mycobacterium avium subsp. paratuberculosis
ggccagcaccagcag

SEQ ID NO: 3015351 - RNA, 21 nt, Mycobacterium avium subsp. paratuberculosis
ggccagcaccagcagccgguc

SEQ ID NO: 3015352 - RNA, 22 nt, Mycobacterium avium subsp. paratuberculosis
ggccagcaccagcagccggucg

SEQ ID NO: 3015353 - RNA, 16 nt, Mycobacterium avium subsp. paratuberculosis
ggccagcaccagcccg

SEQ ID NO: 3015354 - RNA, 17 nt, Mycobacterium avium subsp. paratuberculosis
ggccagcaccagcccga

SEQ ID NO: 3015355 - RNA, 15 nt, Mycobacterium avium subsp. paratuberculosis
ggccagcaccagcgc

SEQ ID NO: 3015356 - RNA, 17 nt, Mycobacterium avium subsp. paratuberculosis
ggccagcaccagcgugu

SEQ ID NO: 3015357 - RNA, 23 nt, Mycobacterium avium subsp. paratuberculosis
ggccagcaccaggaaggcgaccg

SEQ ID NO: 3015358 - RNA, 13 nt, Mycobacterium avium subsp. paratuberculosis
ggccagcacccag

SEQ ID NO: 3015359 - RNA, 17 nt, Mycobacterium avium subsp. paratuberculosis
ggccagcacccgcucgc

SEQ ID NO: 3015360 - RNA, 18 nt, Mycobacterium avium subsp. paratuberculosis
ggccagcacccgcucgcg

SEQ ID NO: 3015361 - RNA, 22 nt, Mycobacterium avium subsp. paratuberculosis
ggccagcacccgcucgcgggcc

SEQ ID NO: 3015362 - RNA, 11 nt, Mycobacterium avium subsp. paratuberculosis
ggccagcaccg

SEQ ID NO: 3015363 - RNA, 16 nt, Mycobacterium avium subsp. paratuberculosis
ggccagcaccgccagc

SEQ ID NO: 3015364 - RNA, 17 nt, Mycobacterium avium subsp. paratuberculosis
ggccagcaccgccagcg

SEQ ID NO: 3015365 - RNA, 18 nt, Mycobacterium avium subsp. paratuberculosis
ggccagcaccgccagcgc

SEQ ID NO: 3015366 - RNA, 15 nt, Mycobacterium avium subsp. paratuberculosis
ggccagcaccgcggc

SEQ ID NO: 3015367 - RNA, 16 nt, Mycobacterium avium subsp. paratuberculosis
ggccagcaccgcggcg

SEQ ID NO: 3015368 - RNA, 17 nt, Mycobacterium avium subsp. paratuberculosis
ggccagcaccgcggcga

SEQ ID NO: 3015369 - RNA, 18 nt, Mycobacterium avium subsp. paratuberculosis
ggccagcaccgcggcgau

SEQ ID NO: 3015370 - RNA, 20 nt, Mycobacterium avium subsp. paratuberculosis
ggccagcaccgcggcgaucg

SEQ ID NO: 3015371 - RNA, 23 nt, Mycobacterium avium subsp. paratuberculosis
ggccagcaccgcggcgaucgccg

SEQ ID NO: 3015372 - RNA, 14 nt, Mycobacterium avium subsp. paratuberculosis
ggccagcaccgcgu

SEQ ID NO: 3015373 - RNA, 16 nt, Mycobacterium avium subsp. paratuberculosis
ggccagcaccgcgucg

SEQ ID NO: 3015374 - RNA, 20 nt, Mycobacterium avium subsp. paratuberculosis
ggccagcaccgcgucgaugu

SEQ ID NO: 3015375 - RNA, 22 nt, Mycobacterium avium subsp. paratuberculosis
ggccagcaccgcgucgaugucg

SEQ ID NO: 3015376 - RNA, 14 nt, Mycobacterium avium subsp. paratuberculosis
ggccagcaccguca

SEQ ID NO: 3015377 - RNA, 16 nt, Mycobacterium avium subsp. paratuberculosis
ggccagcaccgucagc

SEQ ID NO: 3015378 - RNA, 17 nt, Mycobacterium avium subsp. paratuberculosis
ggccagcaccgucagcc

SEQ ID NO: 3015379 - RNA, 19 nt, Mycobacterium avium subsp. paratuberculosis
ggccagcaccgucagccag

SEQ ID NO: 3015380 - RNA, 16 nt, Mycobacterium avium subsp. paratuberculosis
ggccagcaccuggcgc

SEQ ID NO: 3015381 - RNA, 20 nt, Mycobacterium avium subsp. paratuberculosis
ggccagcaccuggcgcaccg

SEQ ID NO: 3015382 - RNA, 23 nt, Mycobacterium avium subsp. paratuberculosis
ggccagcaccuucagcgggcgca

SEQ ID NO: 3015383 - RNA, 17 nt, Mycobacterium avium subsp. paratuberculosis
ggccagcacgaccccgc

SEQ ID NO: 3015384 - RNA, 22 nt, Mycobacterium avium subsp. paratuberculosis
ggccagcacgaccccgcccacg

SEQ ID NO: 3015385 - RNA, 11 nt, Mycobacterium avium subsp. paratuberculosis
ggccagcacgc

SEQ ID NO: 3015386 - RNA, 13 nt, Mycobacterium avium subsp. paratuberculosis
ggccagcacgccg

SEQ ID NO: 3015387 - RNA, 23 nt, Mycobacterium avium subsp. paratuberculosis
ggccagcacgccggucagcacca

SEQ ID NO: 3015388 - RNA, 13 nt, Mycobacterium avium subsp. paratuberculosis
ggccagcacgcug

SEQ ID NO: 3015389 - RNA, 14 nt, Mycobacterium avium subsp. paratuberculosis
ggccagcacggcca

SEQ ID NO: 3015390 - RNA, 15 nt, Mycobacterium avium subsp. paratuberculosis
ggccagcacggcggc

SEQ ID NO: 3015391 - RNA, 16 nt, Mycobacterium avium subsp. paratuberculosis
ggccagcacggcggcg

SEQ ID NO: 3015392 - RNA, 20 nt, Mycobacterium avium subsp. paratuberculosis
ggccagcacggucagcggcc

SEQ ID NO: 3015393 - RNA, 15 nt, Mycobacterium avium subsp. paratuberculosis
ggccagcagcaccag

SEQ ID NO: 3015394 - RNA, 17 nt, Mycobacterium avium subsp. paratuberculosis
ggccagcagcaccgcgu

SEQ ID NO: 3015395 - RNA, 14 nt, Mycobacterium avium subsp. paratuberculosis
ggccagcagcagca

SEQ ID NO: 3015396 - RNA, 15 nt, Mycobacterium avium subsp. paratuberculosis
ggccagcagcagccc

SEQ ID NO: 3015397 - RNA, 15 nt, Mycobacterium avium subsp. paratuberculosis
ggccagcagcaggua

SEQ ID NO: 3015398 - RNA, 18 nt, Mycobacterium avium subsp. paratuberculosis
ggccagcagcagguagcg

SEQ ID NO: 3015399 - RNA, 11 nt, Mycobacterium avium subsp. paratuberculosis
ggccagcagcc

SEQ ID NO: 3015400 - RNA, 14 nt, Mycobacterium avium subsp. paratuberculosis
ggccagcagccagc

SEQ ID NO: 3015401 - RNA, 16 nt, Mycobacterium avium subsp. paratuberculosis
ggccagcagccagcug

SEQ ID NO: 3015402 - RNA, 19 nt, Mycobacterium avium subsp. paratuberculosis
ggccagcagccagcuggug

SEQ ID NO: 3015403 - RNA, 13 nt, Mycobacterium avium subsp. paratuberculosis
ggccagcagcccg

SEQ ID NO: 3015404 - RNA, 12 nt, Mycobacterium avium subsp. paratuberculosis
ggccagcagccg

SEQ ID NO: 3015405 - RNA, 16 nt, Mycobacterium avium subsp. paratuberculosis
ggccagcagccgcgac

SEQ ID NO: 3015406 - RNA, 20 nt, Mycobacterium avium subsp. paratuberculosis
ggccagcagccgcgcgagca

SEQ ID NO: 3015407 - RNA, 14 nt, Mycobacterium avium subsp. paratuberculosis
ggccagcagccggg

SEQ ID NO: 3015408 - RNA, 14 nt, Mycobacterium avium subsp. paratuberculosis
ggccagcagcgcgg

SEQ ID NO: 3015409 - RNA, 20 nt, Mycobacterium avium subsp. paratuberculosis
ggccagcagcgcgucgcggg

SEQ ID NO: 3015410 - RNA, 22 nt, Mycobacterium avium subsp. paratuberculosis
ggccagcagcgcgucgcgggcc

SEQ ID NO: 3015411 - RNA, 17 nt, Mycobacterium avium subsp. paratuberculosis
ggccagcagcggcuugg

SEQ ID NO: 3015412 - RNA, 15 nt, Mycobacterium avium subsp. paratuberculosis
ggccagcagcguggg

SEQ ID NO: 3015413 - RNA, 20 nt, Mycobacterium avium subsp. paratuberculosis
ggccagcagcgugggauccg

SEQ ID NO: 3015414 - RNA, 16 nt, Mycobacterium avium subsp. paratuberculosis
ggccagcagcuugacg

SEQ ID NO: 3015415 - RNA, 19 nt, Mycobacterium avium subsp. paratuberculosis
ggccagcagcuugacgucg

SEQ ID NO: 3015416 - RNA, 23 nt, Mycobacterium avium subsp. paratuberculosis
ggccagcaggaucuggugcgcgc

SEQ ID NO: 3015417 - RNA, 18 nt, Mycobacterium avium subsp. paratuberculosis
ggccagcagggcgccgac

SEQ ID NO: 3015418 - RNA, 14 nt, Mycobacterium avium subsp. paratuberculosis
ggccagcaggucga

SEQ ID NO: 3015419 - RNA, 18 nt, Mycobacterium avium subsp. paratuberculosis
ggccagcaggucgaaggc

SEQ ID NO: 3015420 - RNA, 22 nt, Mycobacterium avium subsp. paratuberculosis
ggccagcaggucgaaggcggcc

SEQ ID NO: 3015421 - RNA, 17 nt, Mycobacterium avium subsp. paratuberculosis
ggccagcaggucgucga

SEQ ID NO: 3015422 - RNA, 20 nt, Mycobacterium avium subsp. paratuberculosis
ggccagcaggucgucgacgu

SEQ ID NO: 3015423 - RNA, 21 nt, Mycobacterium avium subsp. paratuberculosis
ggccagcaggucgucgacguc

SEQ ID NO: 3015424 - RNA, 15 nt, Mycobacterium avium subsp. paratuberculosis
ggccagcagugccac

SEQ ID NO: 3015425 - RNA, 15 nt, Mycobacterium avium subsp. paratuberculosis
ggccagcaguucguc

SEQ ID NO: 3015426 - RNA, 16 nt, Mycobacterium avium subsp. paratuberculosis
ggccagcaucucggcg

SEQ ID NO: 3015427 - RNA, 18 nt, Mycobacterium avium subsp. paratuberculosis
ggccagcaucucggcgaa

SEQ ID NO: 3015428 - RNA, 20 nt, Mycobacterium avium subsp. paratuberculosis
ggccagcaucucggcgaagg

SEQ ID NO: 3015429 - RNA, 18 nt, Mycobacterium avium subsp. paratuberculosis
ggccagccacuccagggu

SEQ ID NO: 3015430 - RNA, 18 nt, Mycobacterium avium subsp. paratuberculosis
ggccagccagccgcccag

SEQ ID NO: 3015431 - RNA, 20 nt, Mycobacterium avium subsp. paratuberculosis
ggccagccagccgcccagca

SEQ ID NO: 3015432 - RNA, 22 nt, Mycobacterium avium subsp. paratuberculosis
ggccagccagccgcccagcauc

SEQ ID NO: 3015433 - RNA, 19 nt, Mycobacterium avium subsp. paratuberculosis
ggccagccaggccgucggc

SEQ ID NO: 3015434 - RNA, 20 nt, Mycobacterium avium subsp. paratuberculosis
ggccagccaggccgucggcg

SEQ ID NO: 3015435 - RNA, 12 nt, Mycobacterium avium subsp. paratuberculosis
ggccagccaggu

SEQ ID NO: 3015436 - RNA, 14 nt, Mycobacterium avium subsp. paratuberculosis
ggccagccaggucu

SEQ ID NO: 3015437 - RNA, 20 nt, Mycobacterium avium subsp. paratuberculosis
ggccagccaguugggggcca

SEQ ID NO: 3015438 - RNA, 22 nt, Mycobacterium avium subsp. paratuberculosis
ggccagccccaccaccgccacc

SEQ ID NO: 3015439 - RNA, 20 nt, Mycobacterium avium subsp. paratuberculosis
ggccagccccgggaaccagc

SEQ ID NO: 3015440 - RNA, 18 nt, Mycobacterium avium subsp. paratuberculosis
ggccagcccgcggcagcc

SEQ ID NO: 3015441 - RNA, 15 nt, Mycobacterium avium subsp. paratuberculosis
ggccagcccggcgug

SEQ ID NO: 3015442 - RNA, 17 nt, Mycobacterium avium subsp. paratuberculosis
ggccagcccggcgugca

SEQ ID NO: 3015443 - RNA, 18 nt, Mycobacterium avium subsp. paratuberculosis
ggccagccgcgcgacgcc

SEQ ID NO: 3015444 - RNA, 19 nt, Mycobacterium avium subsp. paratuberculosis
ggccagccgcgcgacgccg

SEQ ID NO: 3015445 - RNA, 15 nt, Mycobacterium avium subsp. paratuberculosis
ggccagccgcgcggc

SEQ ID NO: 3015446 - RNA, 17 nt, Mycobacterium avium subsp. paratuberculosis
ggccagccgcgcggcgu

SEQ ID NO: 3015447 - RNA, 19 nt, Mycobacterium avium subsp. paratuberculosis
ggccagccgcgcggcgucg

SEQ ID NO: 3015448 - RNA, 22 nt, Mycobacterium avium subsp. paratuberculosis
ggccagccgcgcggcgucggcc

SEQ ID NO: 3015449 - RNA, 15 nt, Mycobacterium avium subsp. paratuberculosis
ggccagccgcucccg

SEQ ID NO: 3015450 - RNA, 17 nt, Mycobacterium avium subsp. paratuberculosis
ggccagccgcucccggc

SEQ ID NO: 3015451 - RNA, 20 nt, Mycobacterium avium subsp. paratuberculosis
ggccagccgcucccggcgca

SEQ ID NO: 3015452 - RNA, 21 nt, Mycobacterium avium subsp. paratuberculosis
ggccagccggcucuuggcgac

SEQ ID NO: 3015453 - RNA, 19 nt, Mycobacterium avium subsp. paratuberculosis
ggccagccgggcgaccguc

SEQ ID NO: 3015454 - RNA, 17 nt, Mycobacterium avium subsp. paratuberculosis
ggccagccgggcggcca

SEQ ID NO: 3015455 - RNA, 22 nt, Mycobacterium avium subsp. paratuberculosis
ggccagccgggguagggcggcg

SEQ ID NO: 3015456 - RNA, 21 nt, Mycobacterium avium subsp. paratuberculosis
ggccagccgguugcgguggcc

SEQ ID NO: 3015457 - RNA, 22 nt, Mycobacterium avium subsp. paratuberculosis
ggccagcgaguccagccagccg

SEQ ID NO: 3015458 - RNA, 13 nt, Mycobacterium avium subsp. paratuberculosis
ggccagcgcagcg

SEQ ID NO: 3015459 - RNA, 23 nt, Mycobacterium avium subsp. paratuberculosis
ggccagcgcagcgaccuggucca

SEQ ID NO: 3015460 - RNA, 22 nt, Mycobacterium avium subsp. paratuberculosis
ggccagcgcagugcggacgcca

SEQ ID NO: 3015461 - RNA, 22 nt, Mycobacterium avium subsp. paratuberculosis
ggccagcgcaucggucaccagc

SEQ ID NO: 3015462 - RNA, 16 nt, Mycobacterium avium subsp. paratuberculosis
ggccagcgccagcgcc

SEQ ID NO: 3015463 - RNA, 21 nt, Mycobacterium avium subsp. paratuberculosis
ggccagcgccagcgccagcgu

SEQ ID NO: 3015464 - RNA, 13 nt, Mycobacterium avium subsp. paratuberculosis
ggccagcgccaug

SEQ ID NO: 3015465 - RNA, 19 nt, Mycobacterium avium subsp. paratuberculosis
ggccagcgccaugccgccg

SEQ ID NO: 3015466 - RNA, 14 nt, Mycobacterium avium subsp. paratuberculosis
ggccagcgcccgcg

SEQ ID NO: 3015467 - RNA, 15 nt, Mycobacterium avium subsp. paratuberculosis
ggccagcgcccgcgc

SEQ ID NO: 3015468 - RNA, 11 nt, Mycobacterium avium subsp. paratuberculosis
ggccagcgccg

SEQ ID NO: 3015469 - RNA, 14 nt, Mycobacterium avium subsp. paratuberculosis
ggccagcgccgaga

SEQ ID NO: 3015470 - RNA, 14 nt, Mycobacterium avium subsp. paratuberculosis
ggccagcgccgagc

SEQ ID NO: 3015471 - RNA, 16 nt, Mycobacterium avium subsp. paratuberculosis
ggccagcgccgagccg

SEQ ID NO: 3015472 - RNA, 20 nt, Mycobacterium avium subsp. paratuberculosis
ggccagcgccgagccgaggc

SEQ ID NO: 3015473 - RNA, 16 nt, Mycobacterium avium subsp. paratuberculosis
ggccagcgccgccagc

SEQ ID NO: 3015474 - RNA, 17 nt, Mycobacterium avium subsp. paratuberculosis
ggccagcgccgccagcc

SEQ ID NO: 3015475 - RNA, 18 nt, Mycobacterium avium subsp. paratuberculosis
ggccagcgccgccagccg

SEQ ID NO: 3015476 - RNA, 17 nt, Mycobacterium avium subsp. paratuberculosis
ggccagcgccgcccggg

SEQ ID NO: 3015477 - RNA, 22 nt, Mycobacterium avium subsp. paratuberculosis
ggccagcgccgcccgggcggcc

SEQ ID NO: 3015478 - RNA, 23 nt, Mycobacterium avium subsp. paratuberculosis
ggccagcgccgcccgggcggccc

SEQ ID NO: 3015479 - RNA, 13 nt, Mycobacterium avium subsp. paratuberculosis
ggccagcgccgcg

SEQ ID NO: 3015480 - RNA, 14 nt, Mycobacterium avium subsp. paratuberculosis
ggccagcgccgcgc

SEQ ID NO: 3015481 - RNA, 16 nt, Mycobacterium avium subsp. paratuberculosis
ggccagcgccgcgcgc

SEQ ID NO: 3015482 - RNA, 18 nt, Mycobacterium avium subsp. paratuberculosis
ggccagcgccgcgcgcgc

SEQ ID NO: 3015483 - RNA, 22 nt, Mycobacterium avium subsp. paratuberculosis
ggccagcgccgcgcgcgcggcc

SEQ ID NO: 3015484 - RNA, 21 nt, Mycobacterium avium subsp. paratuberculosis
ggccagcgccgucaucaccgc

SEQ ID NO: 3015485 - RNA, 23 nt, Mycobacterium avium subsp. paratuberculosis
ggccagcgccgucaucaccgccg

SEQ ID NO: 3015486 - RNA, 13 nt, Mycobacterium avium subsp. paratuberculosis
ggccagcgccucc

SEQ ID NO: 3015487 - RNA, 18 nt, Mycobacterium avium subsp. paratuberculosis
ggccagcgccuccagccg

SEQ ID NO: 3015488 - RNA, 15 nt, Mycobacterium avium subsp. paratuberculosis
ggccagcgccucggc

SEQ ID NO: 3015489 - RNA, 16 nt, Mycobacterium avium subsp. paratuberculosis
ggccagcgccucggcg

SEQ ID NO: 3015490 - RNA, 19 nt, Mycobacterium avium subsp. paratuberculosis
ggccagcgccucggcguca

SEQ ID NO: 3015491 - RNA, 19 nt, Mycobacterium avium subsp. paratuberculosis
ggccagcgccuucggcgcc

SEQ ID NO: 3015492 - RNA, 20 nt, Mycobacterium avium subsp. paratuberculosis
ggccagcgccuucggcgcca

SEQ ID NO: 3015493 - RNA, 22 nt, Mycobacterium avium subsp. paratuberculosis
ggccagcgccuucggcgccagc

SEQ ID NO: 3015494 - RNA, 23 nt, Mycobacterium avium subsp. paratuberculosis
ggccagcgccuucggcgccagcc

SEQ ID NO: 3015495 - RNA, 19 nt, Mycobacterium avium subsp. paratuberculosis
ggccagcgcgaaagcagca

SEQ ID NO: 3015496 - RNA, 13 nt, Mycobacterium avium subsp. paratuberculosis
ggccagcgcgacg

SEQ ID NO: 3015497 - RNA, 14 nt, Mycobacterium avium subsp. paratuberculosis
ggccagcgcgacgg

SEQ ID NO: 3015498 - RNA, 15 nt, Mycobacterium avium subsp. paratuberculosis
ggccagcgcgacggc

SEQ ID NO: 3015499 - RNA, 17 nt, Mycobacterium avium subsp. paratuberculosis
ggccagcgcgacggccu

SEQ ID NO: 3015500 - RNA, 19 nt, Mycobacterium avium subsp. paratuberculosis
ggccagcgcgacggccucg

SEQ ID NO: 3015501 - RNA, 13 nt, Mycobacterium avium subsp. paratuberculosis
ggccagcgcgccg

SEQ ID NO: 3015502 - RNA, 20 nt, Mycobacterium avium subsp. paratuberculosis
ggccagcgcgccgcacagcc

SEQ ID NO: 3015503 - RNA, 17 nt, Mycobacterium avium subsp. paratuberculosis
ggccagcgcgccgccga

SEQ ID NO: 3015504 - RNA, 14 nt, Mycobacterium avium subsp. paratuberculosis
ggccagcgcgcggc

SEQ ID NO: 3015505 - RNA, 15 nt, Mycobacterium avium subsp. paratuberculosis
ggccagcgcgcggcc

SEQ ID NO: 3015506 - RNA, 20 nt, Mycobacterium avium subsp. paratuberculosis
ggccagcgcgcggcccagcg

SEQ ID NO: 3015507 - RNA, 19 nt, Mycobacterium avium subsp. paratuberculosis
ggccagcgcgcgggcgcgc

SEQ ID NO: 3015508 - RNA, 20 nt, Mycobacterium avium subsp. paratuberculosis
ggccagcgcgcgggcgcgcg

SEQ ID NO: 3015509 - RNA, 12 nt, Mycobacterium avium subsp. paratuberculosis
ggccagcgcggc

SEQ ID NO: 3015510 - RNA, 13 nt, Mycobacterium avium subsp. paratuberculosis
ggccagcgcggcc

SEQ ID NO: 3015511 - RNA, 18 nt, Mycobacterium avium subsp. paratuberculosis
ggccagcgcggccgggcg

SEQ ID NO: 3015512 - RNA, 20 nt, Mycobacterium avium subsp. paratuberculosis
ggccagcgcggccgggcgcc

SEQ ID NO: 3015513 - RNA, 20 nt, Mycobacterium avium subsp. paratuberculosis
ggccagcgcggcggccagcu

SEQ ID NO: 3015514 - RNA, 15 nt, Mycobacterium avium subsp. paratuberculosis
ggccagcgcggcggu

SEQ ID NO: 3015515 - RNA, 22 nt, Mycobacterium avium subsp. paratuberculosis
ggccagcgcggcggucgcgcgc

SEQ ID NO: 3015516 - RNA, 14 nt, Mycobacterium avium subsp. paratuberculosis
ggccagcgcggcgu

SEQ ID NO: 3015517 - RNA, 15 nt, Mycobacterium avium subsp. paratuberculosis
ggccagcgcggcguc

SEQ ID NO: 3015518 - RNA, 16 nt, Mycobacterium avium subsp. paratuberculosis
ggccagcgcggcguca

SEQ ID NO: 3015519 - RNA, 13 nt, Mycobacterium avium subsp. paratuberculosis
ggccagcgcggug

SEQ ID NO: 3015520 - RNA, 14 nt, Mycobacterium avium subsp. paratuberculosis
ggccagcgcgguga

SEQ ID NO: 3015521 - RNA, 23 nt, Mycobacterium avium subsp. paratuberculosis
ggccagcgcggugaagucggugc

SEQ ID NO: 3015522 - RNA, 21 nt, Mycobacterium avium subsp. paratuberculosis
ggccagcgcgguggccagcag

SEQ ID NO: 3015523 - RNA, 19 nt, Mycobacterium avium subsp. paratuberculosis
ggccagcgcggugugcggc

SEQ ID NO: 3015524 - RNA, 21 nt, Mycobacterium avium subsp. paratuberculosis
ggccagcgcggugugcggcgg

SEQ ID NO: 3015525 - RNA, 22 nt, Mycobacterium avium subsp. paratuberculosis
ggccagcgcggugugcggcggc

SEQ ID NO: 3015526 - RNA, 11 nt, Mycobacterium avium subsp. paratuberculosis
ggccagcgcgu

SEQ ID NO: 3015527 - RNA, 13 nt, Mycobacterium avium subsp. paratuberculosis
ggccagcgcgucg

SEQ ID NO: 3015528 - RNA, 16 nt, Mycobacterium avium subsp. paratuberculosis
ggccagcgcgucggcc

SEQ ID NO: 3015529 - RNA, 20 nt, Mycobacterium avium subsp. paratuberculosis
ggccagcgcgucggccagca

SEQ ID NO: 3015530 - RNA, 21 nt, Mycobacterium avium subsp. paratuberculosis
ggccagcgcgucggccagcac

SEQ ID NO: 3015531 - RNA, 23 nt, Mycobacterium avium subsp. paratuberculosis
ggccagcgcgucggccagcacca

SEQ ID NO: 3015532 - RNA, 16 nt, Mycobacterium avium subsp. paratuberculosis
ggccagcgcgugaucg

SEQ ID NO: 3015533 - RNA, 17 nt, Mycobacterium avium subsp. paratuberculosis
ggccagcggcagcgaca

SEQ ID NO: 3015534 - RNA, 16 nt, Mycobacterium avium subsp. paratuberculosis
ggccagcggcagcggc

SEQ ID NO: 3015535 - RNA, 15 nt, Mycobacterium avium subsp. paratuberculosis
ggccagcggccagcc

SEQ ID NO: 3015536 - RNA, 17 nt, Mycobacterium avium subsp. paratuberculosis
ggccagcggccagcccg

SEQ ID NO: 3015537 - RNA, 15 nt, Mycobacterium avium subsp. paratuberculosis
ggccagcggcgccgg

SEQ ID NO: 3015538 - RNA, 13 nt, Mycobacterium avium subsp. paratuberculosis
ggccagcgggccg

SEQ ID NO: 3015539 - RNA, 14 nt, Mycobacterium avium subsp. paratuberculosis
ggccagcgggcggc

SEQ ID NO: 3015540 - RNA, 13 nt, Mycobacterium avium subsp. paratuberculosis
ggccagcgggucg

SEQ ID NO: 3015541 - RNA, 13 nt, Mycobacterium avium subsp. paratuberculosis
ggccagcggguga

SEQ ID NO: 3015542 - RNA, 13 nt, Mycobacterium avium subsp. paratuberculosis
ggccagcgguugc

SEQ ID NO: 3015543 - RNA, 18 nt, Mycobacterium avium subsp. paratuberculosis
ggccagcgucgcgccgcc

SEQ ID NO: 3015544 - RNA, 19 nt, Mycobacterium avium subsp. paratuberculosis
ggccagcgucgcgccgcca

SEQ ID NO: 3015545 - RNA, 19 nt, Mycobacterium avium subsp. paratuberculosis
ggccagcgucuccggcggg

SEQ ID NO: 3015546 - RNA, 20 nt, Mycobacterium avium subsp. paratuberculosis
ggccagcgucuccggcgggc

SEQ ID NO: 3015547 - RNA, 22 nt, Mycobacterium avium subsp. paratuberculosis
ggccagcgucuccggcgggcug

SEQ ID NO: 3015548 - RNA, 20 nt, Mycobacterium avium subsp. paratuberculosis
ggccaacuccggcggcagcc

SEQ ID NO: 3015549 - RNA, 16 nt, Mycobacterium avium subsp. paratuberculosis
ggccaacucgaccugc

SEQ ID NO: 3015550 - RNA, 21 nt, Mycobacterium avium subsp. paratuberculosis
ggccaacucgaccugcccggg

SEQ ID NO: 3015551 - RNA, 18 nt, Mycobacterium avium subsp. paratuberculosis
ggccaacugcaucgccag

SEQ ID NO: 3015552 - RNA, 19 nt, Mycobacterium avium subsp. paratuberculosis
ggccaacugcaucgccagc

SEQ ID NO: 3015553 - RNA, 21 nt, Mycobacterium avium subsp. paratuberculosis
ggccaacugcaucgccagcac

SEQ ID NO: 3015554 - RNA, 14 nt, Mycobacterium avium subsp. paratuberculosis
ggccaagacacgcu

SEQ ID NO: 3015555 - RNA, 15 nt, Mycobacterium avium subsp. paratuberculosis
ggccaaggccagcaa

SEQ ID NO: 3015556 - RNA, 22 nt, Mycobacterium avium subsp. paratuberculosis
ggccaaucccaccaugagcaga

SEQ ID NO: 3015557 - RNA, 18 nt, Mycobacterium avium subsp. paratuberculosis
ggccaauuacgcugcggc

SEQ ID NO: 3015558 - RNA, 20 nt, Mycobacterium avium subsp. paratuberculosis
ggccaauuacgcugcggcgc

SEQ ID NO: 3015559 - RNA, 21 nt, Mycobacterium avium subsp. paratuberculosis
ggccaauuacgcugcggcgcc

SEQ ID NO: 3015560 - RNA, 22 nt, Mycobacterium avium subsp. paratuberculosis
ggccaauuacgcugcggcgccg

SEQ ID NO: 3015561 - RNA, 22 nt, Mycobacterium avium subsp. paratuberculosis
ggccacacccgucgacucggcg

SEQ ID NO: 3015562 - RNA, 17 nt, Mycobacterium avium subsp. paratuberculosis
ggccacaccgaucagca

SEQ ID NO: 3015563 - RNA, 15 nt, Mycobacterium avium subsp. paratuberculosis
ggccacaccggggcc

SEQ ID NO: 3015564 - RNA, 18 nt, Mycobacterium avium subsp. paratuberculosis
ggccacacuggccaugcu

SEQ ID NO: 3015565 - RNA, 15 nt, Mycobacterium avium subsp. paratuberculosis
ggccacagcggcgac

SEQ ID NO: 3015566 - RNA, 16 nt, Mycobacterium avium subsp. paratuberculosis
ggccacaugggccacg

SEQ ID NO: 3015567 - RNA, 19 nt, Mycobacterium avium subsp. paratuberculosis
ggccacaugggccacggcg

SEQ ID NO: 3015568 - RNA, 22 nt, Mycobacterium avium subsp. paratuberculosis
ggccaccaacaggucggcgugc

SEQ ID NO: 3015569 - RNA, 17 nt, Mycobacterium avium subsp. paratuberculosis
ggccaccaacggcagca

SEQ ID NO: 3015570 - RNA, 19 nt, Mycobacterium avium subsp. paratuberculosis
ggccaccacaguggccgcc

SEQ ID NO: 3015571 - RNA, 15 nt, Mycobacterium avium subsp. paratuberculosis
ggccaccacauuggc

SEQ ID NO: 3015572 - RNA, 20 nt, Mycobacterium avium subsp. paratuberculosis
ggccaccacauuggcgaccg

SEQ ID NO: 3015573 - RNA, 22 nt, Mycobacterium avium subsp. paratuberculosis
ggccaccacauuggcgaccgcg

SEQ ID NO: 3015574 - RNA, 21 nt, Mycobacterium avium subsp. paratuberculosis
ggccaccaccacggagcgccc

SEQ ID NO: 3015575 - RNA, 24 nt, Mycobacterium avium subsp. paratuberculosis
ggccaccaccacggagcgcccggc

SEQ ID NO: 3015576 - RNA, 23 nt, Mycobacterium avium subsp. paratuberculosis
ggccaccaccacggccaugcaga

SEQ ID NO: 3015577 - RNA, 19 nt, Mycobacterium avium subsp. paratuberculosis
ggccaccaccacggccgcc

SEQ ID NO: 3015578 - RNA, 21 nt, Mycobacterium avium subsp. paratuberculosis
ggccaccaccacggccgccga

SEQ ID NO: 3015579 - RNA, 11 nt, Mycobacterium avium subsp. paratuberculosis
ggccaccaccg

SEQ ID NO: 3015580 - RNA, 19 nt, Mycobacterium avium subsp. paratuberculosis
ggccaccaccgagguggcc

SEQ ID NO: 3015581 - RNA, 21 nt, Mycobacterium avium subsp. paratuberculosis
ggccaccaccgagguggccca

SEQ ID NO: 3015582 - RNA, 21 nt, Mycobacterium avium subsp. paratuberculosis
ggccaccaccgcaucaauuac

SEQ ID NO: 3015583 - RNA, 17 nt, Mycobacterium avium subsp. paratuberculosis
ggccaccaccucgcggg

SEQ ID NO: 3015584 - RNA, 20 nt, Mycobacterium avium subsp. paratuberculosis
ggccaccacgacgccgggcg

SEQ ID NO: 3015585 - RNA, 14 nt, Mycobacterium avium subsp. paratuberculosis
ggccaccacgccag

SEQ ID NO: 3015586 - RNA, 18 nt, Mycobacterium avium subsp. paratuberculosis
ggccaccacggcaccgcc

SEQ ID NO: 3015587 - RNA, 21 nt, Mycobacterium avium subsp. paratuberculosis
ggccaccacggcaccgccgcg

SEQ ID NO: 3015588 - RNA, 22 nt, Mycobacterium avium subsp. paratuberculosis
ggccaccacggcaccgccgcgc

SEQ ID NO: 3015589 - RNA, 22 nt, Mycobacterium avium subsp. paratuberculosis
ggccaccacguacuccugcgcg
